United States Patent 8,969,254 (OLIGONUCLEOTIDE ARRAY FOR TISSUE TYPING) - sequence listing, part 14

SEQ ID NO: 312927 - DNA, 28 bp, Artificial Sequence
  Description of Artificial Sequence: Synthetic oligonucleotide
gcaacactccacactggagagacagctc

SEQ ID NO: 312928 - DNA, 30 bp, Artificial Sequence
  Description of Artificial Sequence: Synthetic oligonucleotide
caacactccacactggagagacagctcttg

SEQ ID NO: 312929 - DNA, 31 bp, Artificial Sequence
  Description of Artificial Sequence: Synthetic oligonucleotide
aacactccacactggagagacagctcttgtg

SEQ ID NO: 312930 - DNA, 30 bp, Artificial Sequence
  Description of Artificial Sequence: Synthetic oligonucleotide
acactccacactggagagacagctcttgtg

SEQ ID NO: 312931 - DNA, 29 bp, Artificial Sequence
  Description of Artificial Sequence: Synthetic oligonucleotide
cactccacactggagagacagctcttgtg

SEQ ID NO: 312932 - DNA, 30 bp, Artificial Sequence
  Description of Artificial Sequence: Synthetic oligonucleotide
actccacactggagagacagctcttgtgtg

SEQ ID NO: 312933 - DNA, 29 bp, Artificial Sequence
  Description of Artificial Sequence: Synthetic oligonucleotide
ctccacactggagagacagctcttgtgtg

SEQ ID NO: 312934 - DNA, 30 bp, Artificial Sequence
  Description of Artificial Sequence: Synthetic oligonucleotide
tccacactggagagacagctcttgtgtgag

SEQ ID NO: 312935 - DNA, 29 bp, Artificial Sequence
  Description of Artificial Sequence: Synthetic oligonucleotide
ccacactggagagacagctcttgtgtgag

SEQ ID NO: 312936 - DNA, 29 bp, Artificial Sequence
  Description of Artificial Sequence: Synthetic oligonucleotide
cacactggagagacagctcttgtgtgagc

SEQ ID NO: 312937 - DNA, 30 bp, Artificial Sequence
  Description of Artificial Sequence: Synthetic oligonucleotide
acactggagagacagctcttgtgtgagcag

SEQ ID NO: 312938 - DNA, 29 bp, Artificial Sequence
  Description of Artificial Sequence: Synthetic oligonucleotide
cactggagagacagctcttgtgtgagcag

SEQ ID NO: 312939 - DNA, 29 bp, Artificial Sequence
  Description of Artificial Sequence: Synthetic oligonucleotide
actggagagacagctcttgtgtgagcagc

SEQ ID NO: 312940 - DNA, 28 bp, Artificial Sequence
  Description of Artificial Sequence: Synthetic oligonucleotide
ctggagagacagctcttgtgtgagcagc

SEQ ID NO: 312941 - DNA, 28 bp, Artificial Sequence
  Description of Artificial Sequence: Synthetic oligonucleotide
tggagagacagctcttgtgtgagcagcg

SEQ ID NO: 312942 - DNA, 27 bp, Artificial Sequence
  Description of Artificial Sequence: Synthetic oligonucleotide
ggagagacagctcttgtgtgagcagcg

SEQ ID NO: 312943 - DNA, 28 bp, Artificial Sequence
  Description of Artificial Sequence: Synthetic oligonucleotide
gagagacagctcttgtgtgagcagcgag

SEQ ID NO: 312944 - DNA, 30 bp, Artificial Sequence
  Description of Artificial Sequence: Synthetic oligonucleotide
agagacagctcttgtgtgagcagcgagatg

SEQ ID NO: 312945 - DNA, 29 bp, Artificial Sequence
  Description of Artificial Sequence: Synthetic oligonucleotide
gagacagctcttgtgtgagcagcgagatg

SEQ ID NO: 312946 - DNA, 29 bp, Artificial Sequence
  Description of Artificial Sequence: Synthetic oligonucleotide
agacagctcttgtgtgagcagcgagatgg

SEQ ID NO: 312947 - DNA, 28 bp, Artificial Sequence
  Description of Artificial Sequence: Synthetic oligonucleotide
gacagctcttgtgtgagcagcgagatgg

SEQ ID NO: 312948 - DNA, 28 bp, Artificial Sequence
  Description of Artificial Sequence: Synthetic oligonucleotide
acagctcttgtgtgagcagcgagatggg

SEQ ID NO: 312949 - DNA, 27 bp, Artificial Sequence
  Description of Artificial Sequence: Synthetic oligonucleotide
cagctcttgtgtgagcagcgagatggg

SEQ ID NO: 312950 - DNA, 27 bp, Artificial Sequence
  Description of Artificial Sequence: Synthetic oligonucleotide
agctcttgtgtgagcagcgagatgggg

SEQ ID NO: 312951 - DNA, 26 bp, Artificial Sequence
  Description of Artificial Sequence: Synthetic oligonucleotide
gctcttgtgtgagcagcgagatgggg

SEQ ID NO: 312952 - DNA, 26 bp, Artificial Sequence
  Description of Artificial Sequence: Synthetic oligonucleotide
ctcttgtgtgagcagcgagatggggc

SEQ ID NO: 312953 - DNA, 27 bp, Artificial Sequence
  Description of Artificial Sequence: Synthetic oligonucleotide
tcttgtgtgagcagcgagatggggcca

SEQ ID NO: 312954 - DNA, 26 bp, Artificial Sequence
  Description of Artificial Sequence: Synthetic oligonucleotide
cttgtgtgagcagcgagatggggcca

SEQ ID NO: 312955 - DNA, 27 bp, Artificial Sequence
  Description of Artificial Sequence: Synthetic oligonucleotide
ttgtgtgagcagcgagatggggccaca

SEQ ID NO: 312956 - DNA, 26 bp, Artificial Sequence
  Description of Artificial Sequence: Synthetic oligonucleotide
tgtgtgagcagcgagatggggccaca

SEQ ID NO: 312957 - DNA, 25 bp, Artificial Sequence
  Description of Artificial Sequence: Synthetic oligonucleotide
gtgtgagcagcgagatggggccaca

SEQ ID NO: 312958 - DNA, 27 bp, Artificial Sequence
  Description of Artificial Sequence: Synthetic oligonucleotide
tgtgagcagcgagatggggccacagaa

SEQ ID NO: 312959 - DNA, 26 bp, Artificial Sequence
  Description of Artificial Sequence: Synthetic oligonucleotide
gtgagcagcgagatggggccacagaa

SEQ ID NO: 312960 - DNA, 26 bp, Artificial Sequence
  Description of Artificial Sequence: Synthetic oligonucleotide
tgagcagcgagatggggccacagaag

SEQ ID NO: 312961 - DNA, 25 bp, Artificial Sequence
  Description of Artificial Sequence: Synthetic oligonucleotide
gagcagcgagatggggccacagaag

SEQ ID NO: 312962 - DNA, 25 bp, Artificial Sequence
  Description of Artificial Sequence: Synthetic oligonucleotide
agcagcgagatggggccacagaagg

SEQ ID NO: 312963 - DNA, 24 bp, Artificial Sequence
  Description of Artificial Sequence: Synthetic oligonucleotide
gcagcgagatggggccacagaagg

SEQ ID NO: 312964 - DNA, 24 bp, Artificial Sequence
  Description of Artificial Sequence: Synthetic oligonucleotide
cagcgagatggggccacagaaggc

SEQ ID NO: 312965 - DNA, 25 bp, Artificial Sequence
  Description of Artificial Sequence: Synthetic oligonucleotide
agcgagatggggccacagaaggcca

SEQ ID NO: 312966 - DNA, 24 bp, Artificial Sequence
  Description of Artificial Sequence: Synthetic oligonucleotide
gcgagatggggccacagaaggcca

SEQ ID NO: 312967 - DNA, 25 bp, Artificial Sequence
  Description of Artificial Sequence: Synthetic oligonucleotide
cgagatggggccacagaaggccact

SEQ ID NO: 312968 - DNA, 26 bp, Artificial Sequence
  Description of Artificial Sequence: Synthetic oligonucleotide
gagatggggccacagaaggccactca

SEQ ID NO: 312969 - DNA, 26 bp, Artificial Sequence
  Description of Artificial Sequence: Synthetic oligonucleotide
agatggggccacagaaggccactcac

SEQ ID NO: 312970 - DNA, 25 bp, Artificial Sequence
  Description of Artificial Sequence: Synthetic oligonucleotide
gatggggccacagaaggccactcac

SEQ ID NO: 312971 - DNA, 27 bp, Artificial Sequence
  Description of Artificial Sequence: Synthetic oligonucleotide
atggggccacagaaggccactcaccaa

SEQ ID NO: 312972 - DNA, 26 bp, Artificial Sequence
  Description of Artificial Sequence: Synthetic oligonucleotide
tggggccacagaaggccactcaccaa

SEQ ID NO: 312973 - DNA, 25 bp, Artificial Sequence
  Description of Artificial Sequence: Synthetic oligonucleotide
ggggccacagaaggccactcaccaa

SEQ ID NO: 312974 - DNA, 26 bp, Artificial Sequence
  Description of Artificial Sequence: Synthetic oligonucleotide
gggccacagaaggccactcaccaact

SEQ ID NO: 312975 - DNA, 26 bp, Artificial Sequence
  Description of Artificial Sequence: Synthetic oligonucleotide
ggccacagaaggccactcaccaactg

SEQ ID NO: 312976 - DNA, 27 bp, Artificial Sequence
  Description of Artificial Sequence: Synthetic oligonucleotide
gccacagaaggccactcaccaactgga

SEQ ID NO: 312977 - DNA, 30 bp, Artificial Sequence
  Description of Artificial Sequence: Synthetic oligonucleotide
ccacagaaggccactcaccaactggaattc

SEQ ID NO: 312978 - DNA, 31 bp, Artificial Sequence
  Description of Artificial Sequence: Synthetic oligonucleotide
cacagaaggccactcaccaactggaattcag

SEQ ID NO: 312979 - DNA, 31 bp, Artificial Sequence
  Description of Artificial Sequence: Synthetic oligonucleotide
acagaaggccactcaccaactggaattcagg

SEQ ID NO: 312980 - DNA, 30 bp, Artificial Sequence
  Description of Artificial Sequence: Synthetic oligonucleotide
cagaaggccactcaccaactggaattcagg

SEQ ID NO: 312981 - DNA, 34 bp, Artificial Sequence
  Description of Artificial Sequence: Synthetic oligonucleotide
agaaggccactcaccaactggaattcaggaaaag

SEQ ID NO: 312982 - DNA, 33 bp, Artificial Sequence
  Description of Artificial Sequence: Synthetic oligonucleotide
gaaggccactcaccaactggaattcaggaaaag

SEQ ID NO: 312983 - DNA, 36 bp, Artificial Sequence
  Description of Artificial Sequence: Synthetic oligonucleotide
aaggccactcaccaactggaattcaggaaaagatac

SEQ ID NO: 312984 - DNA, 35 bp, Artificial Sequence
  Description of Artificial Sequence: Synthetic oligonucleotide
aggccactcaccaactggaattcaggaaaagatac

SEQ ID NO: 312985 - DNA, 34 bp, Artificial Sequence
  Description of Artificial Sequence: Synthetic oligonucleotide
ggccactcaccaactggaattcaggaaaagatac

SEQ ID NO: 312986 - DNA, 34 bp, Artificial Sequence
  Description of Artificial Sequence: Synthetic oligonucleotide
gccactcaccaactggaattcaggaaaagatacc

SEQ ID NO: 312987 - DNA, 34 bp, Artificial Sequence
  Description of Artificial Sequence: Synthetic oligonucleotide
ccactcaccaactggaattcaggaaaagataccc

SEQ ID NO: 312988 - DNA, 34 bp, Artificial Sequence
  Description of Artificial Sequence: Synthetic oligonucleotide
cactcaccaactggaattcaggaaaagatacccc

SEQ ID NO: 312989 - DNA, 34 bp, Artificial Sequence
  Description of Artificial Sequence: Synthetic oligonucleotide
actcaccaactggaattcaggaaaagataccccc

SEQ ID NO: 312990 - DNA, 33 bp, Artificial Sequence
  Description of Artificial Sequence: Synthetic oligonucleotide
ctcaccaactggaattcaggaaaagataccccc

SEQ ID NO: 312991 - DNA, 33 bp, Artificial Sequence
  Description of Artificial Sequence: Synthetic oligonucleotide
tcaccaactggaattcaggaaaagatacccccg

SEQ ID NO: 312992 - DNA, 32 bp, Artificial Sequence
  Description of Artificial Sequence: Synthetic oligonucleotide
caccaactggaattcaggaaaagatacccccg

SEQ ID NO: 312993 - DNA, 32 bp, Artificial Sequence
  Description of Artificial Sequence: Synthetic oligonucleotide
accaactggaattcaggaaaagatacccccgg

SEQ ID NO: 312994 - DNA, 31 bp, Artificial Sequence
  Description of Artificial Sequence: Synthetic oligonucleotide
ccaactggaattcaggaaaagatacccccgg

SEQ ID NO: 312995 - DNA, 34 bp, Artificial Sequence
  Description of Artificial Sequence: Synthetic oligonucleotide
caactggaattcaggaaaagatacccccggatac

SEQ ID NO: 312996 - DNA, 35 bp, Artificial Sequence
  Description of Artificial Sequence: Synthetic oligonucleotide
aactggaattcaggaaaagatacccccggatacag

SEQ ID NO: 312997 - DNA, 34 bp, Artificial Sequence
  Description of Artificial Sequence: Synthetic oligonucleotide
actggaattcaggaaaagatacccccggatacag

SEQ ID NO: 312998 - DNA, 33 bp, Artificial Sequence
  Description of Artificial Sequence: Synthetic oligonucleotide
ctggaattcaggaaaagatacccccggatacag

SEQ ID NO: 312999 - DNA, 34 bp, Artificial Sequence
  Description of Artificial Sequence: Synthetic oligonucleotide
tggaattcaggaaaagatacccccggatacagag

SEQ ID NO: 313000 - DNA, 33 bp, Artificial Sequence
  Description of Artificial Sequence: Synthetic oligonucleotide
ggaattcaggaaaagatacccccggatacagag

SEQ ID NO: 313001 - DNA, 33 bp, Artificial Sequence
  Description of Artificial Sequence: Synthetic oligonucleotide
gaattcaggaaaagatacccccggatacagagg

SEQ ID NO: 313002 - DNA, 33 bp, Artificial Sequence
  Description of Artificial Sequence: Synthetic oligonucleotide
aattcaggaaaagatacccccggatacagaggc

SEQ ID NO: 313003 - DNA, 32 bp, Artificial Sequence
  Description of Artificial Sequence: Synthetic oligonucleotide
attcaggaaaagatacccccggatacagaggc

SEQ ID NO: 313004 - DNA, 31 bp, Artificial Sequence
  Description of Artificial Sequence: Synthetic oligonucleotide
ttcaggaaaagatacccccggatacagaggc

SEQ ID NO: 313005 - DNA, 30 bp, Artificial Sequence
  Description of Artificial Sequence: Synthetic oligonucleotide
tcaggaaaagatacccccggatacagaggc

SEQ ID NO: 313006 - DNA, 29 bp, Artificial Sequence
  Description of Artificial Sequence: Synthetic oligonucleotide
caggaaaagatacccccggatacagaggc

SEQ ID NO: 313007 - DNA, 29 bp, Artificial Sequence
  Description of Artificial Sequence: Synthetic oligonucleotide
aggaaaagatacccccggatacagaggcc

SEQ ID NO: 313008 - DNA, 28 bp, Artificial Sequence
  Description of Artificial Sequence: Synthetic oligonucleotide
ggaaaagatacccccggatacagaggcc

SEQ ID NO: 313009 - DNA, 29 bp, Artificial Sequence
  Description of Artificial Sequence: Synthetic oligonucleotide
gaaaagatacccccggatacagaggccag

SEQ ID NO: 313010 - DNA, 29 bp, Artificial Sequence
  Description of Artificial Sequence: Synthetic oligonucleotide
aaaagatacccccggatacagaggccagg

SEQ ID NO: 313011 - DNA, 28 bp, Artificial Sequence
  Description of Artificial Sequence: Synthetic oligonucleotide
aaagatacccccggatacagaggccagg

SEQ ID NO: 313012 - DNA, 27 bp, Artificial Sequence
  Description of Artificial Sequence: Synthetic oligonucleotide
aagatacccccggatacagaggccagg

SEQ ID NO: 313013 - DNA, 27 bp, Artificial Sequence
  Description of Artificial Sequence: Synthetic oligonucleotide
agatacccccggatacagaggccaggt

SEQ ID NO: 313014 - DNA, 27 bp, Artificial Sequence
  Description of Artificial Sequence: Synthetic oligonucleotide
gatacccccggatacagaggccaggtt

SEQ ID NO: 313015 - DNA, 27 bp, Artificial Sequence
  Description of Artificial Sequence: Synthetic oligonucleotide
atacccccggatacagaggccaggttg

SEQ ID NO: 313016 - DNA, 26 bp, Artificial Sequence
  Description of Artificial Sequence: Synthetic oligonucleotide
tacccccggatacagaggccaggttg

SEQ ID NO: 313017 - DNA, 25 bp, Artificial Sequence
  Description of Artificial Sequence: Synthetic oligonucleotide
acccccggatacagaggccaggttg

SEQ ID NO: 313018 - DNA, 24 bp, Artificial Sequence
  Description of Artificial Sequence: Synthetic oligonucleotide
cccccggatacagaggccaggttg

SEQ ID NO: 313019 - DNA, 25 bp, Artificial Sequence
  Description of Artificial Sequence: Synthetic oligonucleotide
ccccggatacagaggccaggttggt

SEQ ID NO: 313020 - DNA, 25 bp, Artificial Sequence
  Description of Artificial Sequence: Synthetic oligonucleotide
cccggatacagaggccaggttggtg

SEQ ID NO: 313021 - DNA, 27 bp, Artificial Sequence
  Description of Artificial Sequence: Synthetic oligonucleotide
ccggatacagaggccaggttggtgctt

SEQ ID NO: 313022 - DNA, 27 bp, Artificial Sequence
  Description of Artificial Sequence: Synthetic oligonucleotide
cggatacagaggccaggttggtgcttg

SEQ ID NO: 313023 - DNA, 28 bp, Artificial Sequence
  Description of Artificial Sequence: Synthetic oligonucleotide
ggatacagaggccaggttggtgcttgtg

SEQ ID NO: 313024 - DNA, 28 bp, Artificial Sequence
  Description of Artificial Sequence: Synthetic oligonucleotide
gatacagaggccaggttggtgcttgtgg

SEQ ID NO: 313025 - DNA, 28 bp, Artificial Sequence
  Description of Artificial Sequence: Synthetic oligonucleotide
atacagaggccaggttggtgcttgtggg

SEQ ID NO: 313026 - DNA, 27 bp, Artificial Sequence
  Description of Artificial Sequence: Synthetic oligonucleotide
tacagaggccaggttggtgcttgtggg

SEQ ID NO: 313027 - DNA, 26 bp, Artificial Sequence
  Description of Artificial Sequence: Synthetic oligonucleotide
acagaggccaggttggtgcttgtggg

SEQ ID NO: 313028 - DNA, 25 bp, Artificial Sequence
  Description of Artificial Sequence: Synthetic oligonucleotide
cagaggccaggttggtgcttgtggg

SEQ ID NO: 313029 - DNA, 25 bp, Artificial Sequence
  Description of Artificial Sequence: Synthetic oligonucleotide
agaggccaggttggtgcttgtgggc

SEQ ID NO: 313030 - DNA, 24 bp, Artificial Sequence
  Description of Artificial Sequence: Synthetic oligonucleotide
gaggccaggttggtgcttgtgggc

SEQ ID NO: 313031 - DNA, 24 bp, Artificial Sequence
  Description of Artificial Sequence: Synthetic oligonucleotide
aggccaggttggtgcttgtgggcc

SEQ ID NO: 313032 - DNA, 23 bp, Artificial Sequence
  Description of Artificial Sequence: Synthetic oligonucleotide
ggccaggttggtgcttgtgggcc

SEQ ID NO: 313033 - DNA, 23 bp, Artificial Sequence
  Description of Artificial Sequence: Synthetic oligonucleotide
gccaggttggtgcttgtgggccg

SEQ ID NO: 313034 - DNA, 23 bp, Artificial Sequence
  Description of Artificial Sequence: Synthetic oligonucleotide
ccaggttggtgcttgtgggccgc

SEQ ID NO: 313035 - DNA, 23 bp, Artificial Sequence
  Description of Artificial Sequence: Synthetic oligonucleotide
caggttggtgcttgtgggccgcc

SEQ ID NO: 313036 - DNA, 23 bp, Artificial Sequence
  Description of Artificial Sequence: Synthetic oligonucleotide
aggttggtgcttgtgggccgccc

SEQ ID NO: 313037 - DNA, 22 bp, Artificial Sequence
  Description of Artificial Sequence: Synthetic oligonucleotide
ggttggtgcttgtgggccgccc

SEQ ID NO: 313038 - DNA, 22 bp, Artificial Sequence
  Description of Artificial Sequence: Synthetic oligonucleotide
gttggtgcttgtgggccgcccc

SEQ ID NO: 313039 - DNA, 23 bp, Artificial Sequence
  Description of Artificial Sequence: Synthetic oligonucleotide
ttggtgcttgtgggccgccccga

SEQ ID NO: 313040 - DNA, 22 bp, Artificial Sequence
  Description of Artificial Sequence: Synthetic oligonucleotide
tggtgcttgtgggccgccccga

SEQ ID NO: 313041 - DNA, 21 bp, Artificial Sequence
  Description of Artificial Sequence: Synthetic oligonucleotide
ggtgcttgtgggccgccccga

SEQ ID NO: 313042 - DNA, 23 bp, Artificial Sequence
  Description of Artificial Sequence: Synthetic oligonucleotide
gtgcttgtgggccgccccgactt

SEQ ID NO: 313043 - DNA, 23 bp, Artificial Sequence
  Description of Artificial Sequence: Synthetic oligonucleotide
tgcttgtgggccgccccgacttc

SEQ ID NO: 313044 - DNA, 22 bp, Artificial Sequence
  Description of Artificial Sequence: Synthetic oligonucleotide
gcttgtgggccgccccgacttc

SEQ ID NO: 313045 - DNA, 23 bp, Artificial Sequence
  Description of Artificial Sequence: Synthetic oligonucleotide
cttgtgggccgccccgacttcca

SEQ ID NO: 313046 - DNA, 23 bp, Artificial Sequence
  Description of Artificial Sequence: Synthetic oligonucleotide
ttgtgggccgccccgacttccag

SEQ ID NO: 313047 - DNA, 22 bp, Artificial Sequence
  Description of Artificial Sequence: Synthetic oligonucleotide
tgtgggccgccccgacttccag

SEQ ID NO: 313048 - DNA, 21 bp, Artificial Sequence
  Description of Artificial Sequence: Synthetic oligonucleotide
gtgggccgccccgacttccag

SEQ ID NO: 313049 - DNA, 22 bp, Artificial Sequence
  Description of Artificial Sequence: Synthetic oligonucleotide
tgggccgccccgacttccagga

SEQ ID NO: 313050 - DNA, 21 bp, Artificial Sequence
  Description of Artificial Sequence: Synthetic oligonucleotide
gggccgccccgacttccagga

SEQ ID NO: 313051 - DNA, 21 bp, Artificial Sequence
  Description of Artificial Sequence: Synthetic oligonucleotide
ggccgccccgacttccaggag

SEQ ID NO: 313052 - DNA, 22 bp, Artificial Sequence
  Description of Artificial Sequence: Synthetic oligonucleotide
gccgccccgacttccaggagca

SEQ ID NO: 313053 - DNA, 22 bp, Artificial Sequence
  Description of Artificial Sequence: Synthetic oligonucleotide
ccgccccgacttccaggagcag

SEQ ID NO: 313054 - DNA, 22 bp, Artificial Sequence
  Description of Artificial Sequence: Synthetic oligonucleotide
cgccccgacttccaggagcagc

SEQ ID NO: 313055 - DNA, 22 bp, Artificial Sequence
  Description of Artificial Sequence: Synthetic oligonucleotide
gccccgacttccaggagcagcc

SEQ ID NO: 313056 - DNA, 22 bp, Artificial Sequence
  Description of Artificial Sequence: Synthetic oligonucleotide
ccccgacttccaggagcagccc

SEQ ID NO: 313057 - DNA, 23 bp, Artificial Sequence
  Description of Artificial Sequence: Synthetic oligonucleotide
cccgacttccaggagcagcccgt

SEQ ID NO: 313058 - DNA, 23 bp, Artificial Sequence
  Description of Artificial Sequence: Synthetic oligonucleotide
ccgacttccaggagcagcccgtg

SEQ ID NO: 313059 - DNA, 24 bp, Artificial Sequence
  Description of Artificial Sequence: Synthetic oligonucleotide
cgacttccaggagcagcccgtgct

SEQ ID NO: 313060 - DNA, 24 bp, Artificial Sequence
  Description of Artificial Sequence: Synthetic oligonucleotide
gacttccaggagcagcccgtgctg

SEQ ID NO: 313061 - DNA, 24 bp, Artificial Sequence
  Description of Artificial Sequence: Synthetic oligonucleotide
acttccaggagcagcccgtgctgg

SEQ ID NO: 313062 - DNA, 23 bp, Artificial Sequence
  Description of Artificial Sequence: Synthetic oligonucleotide
cttccaggagcagcccgtgctgg

SEQ ID NO: 313063 - DNA, 23 bp, Artificial Sequence
  Description of Artificial Sequence: Synthetic oligonucleotide
ttccaggagcagcccgtgctggg

SEQ ID NO: 313064 - DNA, 22 bp, Artificial Sequence
  Description of Artificial Sequence: Synthetic oligonucleotide
tccaggagcagcccgtgctggg

SEQ ID NO: 313065 - DNA, 21 bp, Artificial Sequence
  Description of Artificial Sequence: Synthetic oligonucleotide
ccaggagcagcccgtgctggg

SEQ ID NO: 313066 - DNA, 23 bp, Artificial Sequence
  Description of Artificial Sequence: Synthetic oligonucleotide
caggagcagcccgtgctgggcat

SEQ ID NO: 313067 - DNA, 23 bp, Artificial Sequence
  Description of Artificial Sequence: Synthetic oligonucleotide
aggagcagcccgtgctgggcatc

SEQ ID NO: 313068 - DNA, 22 bp, Artificial Sequence
  Description of Artificial Sequence: Synthetic oligonucleotide
ggagcagcccgtgctgggcatc

SEQ ID NO: 313069 - DNA, 23 bp, Artificial Sequence
  Description of Artificial Sequence: Synthetic oligonucleotide
gagcagcccgtgctgggcatcgt

SEQ ID NO: 313070 - DNA, 24 bp, Artificial Sequence
  Description of Artificial Sequence: Synthetic oligonucleotide
agcagcccgtgctgggcatcgtga

SEQ ID NO: 313071 - DNA, 23 bp, Artificial Sequence
  Description of Artificial Sequence: Synthetic oligonucleotide
gcagcccgtgctgggcatcgtga

SEQ ID NO: 313072 - DNA, 23 bp, Artificial Sequence
  Description of Artificial Sequence: Synthetic oligonucleotide
cagcccgtgctgggcatcgtgag

SEQ ID NO: 313073 - DNA, 23 bp, Artificial Sequence
  Description of Artificial Sequence: Synthetic oligonucleotide
agcccgtgctgggcatcgtgagg

SEQ ID NO: 313074 - DNA, 22 bp, Artificial Sequence
  Description of Artificial Sequence: Synthetic oligonucleotide
gcccgtgctgggcatcgtgagg

SEQ ID NO: 313075 - DNA, 23 bp, Artificial Sequence
  Description of Artificial Sequence: Synthetic oligonucleotide
cccgtgctgggcatcgtgaggca

SEQ ID NO: 313076 - DNA, 23 bp, Artificial Sequence
  Description of Artificial Sequence: Synthetic oligonucleotide
ccgtgctgggcatcgtgaggcag

SEQ ID NO: 313077 - DNA, 24 bp, Artificial Sequence
  Description of Artificial Sequence: Synthetic oligonucleotide
cgtgctgggcatcgtgaggcagca

SEQ ID NO: 313078 - DNA, 24 bp, Artificial Sequence
  Description of Artificial Sequence: Synthetic oligonucleotide
gtgctgggcatcgtgaggcagcag

SEQ ID NO: 313079 - DNA, 25 bp, Artificial Sequence
  Description of Artificial Sequence: Synthetic oligonucleotide
tgctgggcatcgtgaggcagcagga

SEQ ID NO: 313080 - DNA, 24 bp, Artificial Sequence
  Description of Artificial Sequence: Synthetic oligonucleotide
gctgggcatcgtgaggcagcagga

SEQ ID NO: 313081 - DNA, 24 bp, Artificial Sequence
  Description of Artificial Sequence: Synthetic oligonucleotide
ctgggcatcgtgaggcagcaggag

SEQ ID NO: 313082 - DNA, 24 bp, Artificial Sequence
  Description of Artificial Sequence: Synthetic oligonucleotide
tgggcatcgtgaggcagcaggagg

SEQ ID NO: 313083 - DNA, 23 bp, Artificial Sequence
  Description of Artificial Sequence: Synthetic oligonucleotide
gggcatcgtgaggcagcaggagg

SEQ ID NO: 313084 - DNA, 24 bp, Artificial Sequence
  Description of Artificial Sequence: Synthetic oligonucleotide
ggcatcgtgaggcagcaggaggct

SEQ ID NO: 313085 - DNA, 24 bp, Artificial Sequence
  Description of Artificial Sequence: Synthetic oligonucleotide
gcatcgtgaggcagcaggaggctg

SEQ ID NO: 313086 - DNA, 24 bp, Artificial Sequence
  Description of Artificial Sequence: Synthetic oligonucleotide
catcgtgaggcagcaggaggctgc

SEQ ID NO: 313087 - DNA, 24 bp, Artificial Sequence
  Description of Artificial Sequence: Synthetic oligonucleotide
atcgtgaggcagcaggaggctgcg

SEQ ID NO: 313088 - DNA, 23 bp, Artificial Sequence
  Description of Artificial Sequence: Synthetic oligonucleotide
tcgtgaggcagcaggaggctgcg

SEQ ID NO: 313089 - DNA, 22 bp, Artificial Sequence
  Description of Artificial Sequence: Synthetic oligonucleotide
cgtgaggcagcaggaggctgcg

SEQ ID NO: 313090 - DNA, 23 bp, Artificial Sequence
  Description of Artificial Sequence: Synthetic oligonucleotide
gtgaggcagcaggaggctgcgga

SEQ ID NO: 313091 - DNA, 23 bp, Artificial Sequence
  Description of Artificial Sequence: Synthetic oligonucleotide
tgaggcagcaggaggctgcggag

SEQ ID NO: 313092 - DNA, 22 bp, Artificial Sequence
  Description of Artificial Sequence: Synthetic oligonucleotide
gaggcagcaggaggctgcggag

SEQ ID NO: 313093 - DNA, 23 bp, Artificial Sequence
  Description of Artificial Sequence: Synthetic oligonucleotide
aggcagcaggaggctgcggagct

SEQ ID NO: 313094 - DNA, 22 bp, Artificial Sequence
  Description of Artificial Sequence: Synthetic oligonucleotide
ggcagcaggaggctgcggagct

SEQ ID NO: 313095 - DNA, 22 bp, Artificial Sequence
  Description of Artificial Sequence: Synthetic oligonucleotide
gcagcaggaggctgcggagctg

SEQ ID NO: 313096 - DNA, 23 bp, Artificial Sequence
  Description of Artificial Sequence: Synthetic oligonucleotide
cagcaggaggctgcggagctgca

SEQ ID NO: 313097 - DNA, 23 bp, Artificial Sequence
  Description of Artificial Sequence: Synthetic oligonucleotide
agcaggaggctgcggagctgcag

SEQ ID NO: 313098 - DNA, 22 bp, Artificial Sequence
  Description of Artificial Sequence: Synthetic oligonucleotide
gcaggaggctgcggagctgcag

SEQ ID NO: 313099 - DNA, 22 bp, Artificial Sequence
  Description of Artificial Sequence: Synthetic oligonucleotide
caggaggctgcggagctgcagg

SEQ ID NO: 313100 - DNA, 22 bp, Artificial Sequence
  Description of Artificial Sequence: Synthetic oligonucleotide
aggaggctgcggagctgcaggc

SEQ ID NO: 313101 - DNA, 21 bp, Artificial Sequence
  Description of Artificial Sequence: Synthetic oligonucleotide
ggaggctgcggagctgcaggc

SEQ ID NO: 313102 - DNA, 21 bp, Artificial Sequence
  Description of Artificial Sequence: Synthetic oligonucleotide
gaggctgcggagctgcaggcg

SEQ ID NO: 313103 - DNA, 22 bp, Artificial Sequence
  Description of Artificial Sequence: Synthetic oligonucleotide
aggctgcggagctgcaggcggt

SEQ ID NO: 313104 - DNA, 21 bp, Artificial Sequence
  Description of Artificial Sequence: Synthetic oligonucleotide
ggctgcggagctgcaggcggt

SEQ ID NO: 313105 - DNA, 21 bp, Artificial Sequence
  Description of Artificial Sequence: Synthetic oligonucleotide
gctgcggagctgcaggcggtg

SEQ ID NO: 313106 - DNA, 22 bp, Artificial Sequence
  Description of Artificial Sequence: Synthetic oligonucleotide
ctgcggagctgcaggcggtggt

SEQ ID NO: 313107 - DNA, 22 bp, Artificial Sequence
  Description of Artificial Sequence: Synthetic oligonucleotide
tgcggagctgcaggcggtggtg

SEQ ID NO: 313108 - DNA, 21 bp, Artificial Sequence
  Description of Artificial Sequence: Synthetic oligonucleotide
gcggagctgcaggcggtggtg

SEQ ID NO: 313109 - DNA, 22 bp, Artificial Sequence
  Description of Artificial Sequence: Synthetic oligonucleotide
cggagctgcaggcggtggtgct

SEQ ID NO: 313110 - DNA, 22 bp, Artificial Sequence
  Description of Artificial Sequence: Synthetic oligonucleotide
ggagctgcaggcggtggtgctg

SEQ ID NO: 313111 - DNA, 22 bp, Artificial Sequence
  Description of Artificial Sequence: Synthetic oligonucleotide
gagctgcaggcggtggtgctgc

SEQ ID NO: 313112 - DNA, 22 bp, Artificial Sequence
  Description of Artificial Sequence: Synthetic oligonucleotide
agctgcaggcggtggtgctgcc

SEQ ID NO: 313113 - DNA, 21 bp, Artificial Sequence
  Description of Artificial Sequence: Synthetic oligonucleotide
gctgcaggcggtggtgctgcc

SEQ ID NO: 313114 - DNA, 21 bp, Artificial Sequence
  Description of Artificial Sequence: Synthetic oligonucleotide
ctgcaggcggtggtgctgccg

SEQ ID NO: 313115 - DNA, 22 bp, Artificial Sequence
  Description of Artificial Sequence: Synthetic oligonucleotide
tgcaggcggtggtgctgccggt

SEQ ID NO: 313116 - DNA, 21 bp, Artificial Sequence
  Description of Artificial Sequence: Synthetic oligonucleotide
gcaggcggtggtgctgccggt

SEQ ID NO: 313117 - DNA, 21 bp, Artificial Sequence
  Description of Artificial Sequence: Synthetic oligonucleotide
caggcggtggtgctgccggtc

SEQ ID NO: 313118 - DNA, 21 bp, Artificial Sequence
  Description of Artificial Sequence: Synthetic oligonucleotide
aggcggtggtgctgccggtcc

SEQ ID NO: 313119 - DNA, 20 bp, Artificial Sequence
  Description of Artificial Sequence: Synthetic oligonucleotide
ggcggtggtgctgccggtcc

SEQ ID NO: 313120 - DNA, 24 bp, Artificial Sequence
  Description of Artificial Sequence: Synthetic oligonucleotide
gcggtggtgctgccggtccctata

SEQ ID NO: 313121 - DNA, 24 bp, Artificial Sequence
  Description of Artificial Sequence: Synthetic oligonucleotide
cggtggtgctgccggtccctatac

SEQ ID NO: 313122 - DNA, 24 bp, Artificial Sequence
  Description of Artificial Sequence: Synthetic oligonucleotide
ggtggtgctgccggtccctatacg

SEQ ID NO: 313123 - DNA, 26 bp, Artificial Sequence
  Description of Artificial Sequence: Synthetic oligonucleotide
gtggtgctgccggtccctatacgcat

SEQ ID NO: 313124 - DNA, 26 bp, Artificial Sequence
  Description of Artificial Sequence: Synthetic oligonucleotide
tggtgctgccggtccctatacgcatc

SEQ ID NO: 313125 - DNA, 25 bp, Artificial Sequence
  Description of Artificial Sequence: Synthetic oligonucleotide
ggtgctgccggtccctatacgcatc

SEQ ID NO: 313126 - DNA, 26 bp, Artificial Sequence
  Description of Artificial Sequence: Synthetic oligonucleotide
gtgctgccggtccctatacgcatcct

SEQ ID NO: 313127 - DNA, 27 bp, Artificial Sequence
  Description of Artificial Sequence: Synthetic oligonucleotide
tgctgccggtccctatacgcatcctct

SEQ ID NO: 313128 - DNA, 27 bp, Artificial Sequence
  Description of Artificial Sequence: Synthetic oligonucleotide
gctgccggtccctatacgcatcctctt

SEQ ID NO: 313129 - DNA, 28 bp, Artificial Sequence
  Description of Artificial Sequence: Synthetic oligonucleotide
ctgccggtccctatacgcatcctctttg

SEQ ID NO: 313130 - DNA, 29 bp, Artificial Sequence
  Description of Artificial Sequence: Synthetic oligonucleotide
tgccggtccctatacgcatcctctttgag

SEQ ID NO: 313131 - DNA, 28 bp, Artificial Sequence
  Description of Artificial Sequence: Synthetic oligonucleotide
gccggtccctatacgcatcctctttgag

SEQ ID NO: 313132 - DNA, 30 bp, Artificial Sequence
  Description of Artificial Sequence: Synthetic oligonucleotide
ccggtccctatacgcatcctctttgagttg

SEQ ID NO: 313133 - DNA, 30 bp, Artificial Sequence
  Description of Artificial Sequence: Synthetic oligonucleotide
cggtccctatacgcatcctctttgagttgc

SEQ ID NO: 313134 - DNA, 31 bp, Artificial Sequence
  Description of Artificial Sequence: Synthetic oligonucleotide
ggtccctatacgcatcctctttgagttgctg

SEQ ID NO: 313135 - DNA, 31 bp, Artificial Sequence
  Description of Artificial Sequence: Synthetic oligonucleotide
gtccctatacgcatcctctttgagttgctgg

SEQ ID NO: 313136 - DNA, 31 bp, Artificial Sequence
  Description of Artificial Sequence: Synthetic oligonucleotide
tccctatacgcatcctctttgagttgctggg

SEQ ID NO: 313137 - DNA, 30 bp, Artificial Sequence
  Description of Artificial Sequence: Synthetic oligonucleotide
ccctatacgcatcctctttgagttgctggg

SEQ ID NO: 313138 - DNA, 31 bp, Artificial Sequence
  Description of Artificial Sequence: Synthetic oligonucleotide
cctatacgcatcctctttgagttgctgggtc

SEQ ID NO: 313139 - DNA, 31 bp, Artificial Sequence
  Description of Artificial Sequence: Synthetic oligonucleotide
ctatacgcatcctctttgagttgctgggtcc

SEQ ID NO: 313140 - DNA, 32 bp, Artificial Sequence
  Description of Artificial Sequence: Synthetic oligonucleotide
tatacgcatcctctttgagttgctgggtcctg

SEQ ID NO: 313141 - DNA, 31 bp, Artificial Sequence
  Description of Artificial Sequence: Synthetic oligonucleotide
atacgcatcctctttgagttgctgggtcctg

SEQ ID NO: 313142 - DNA, 30 bp, Artificial Sequence
  Description of Artificial Sequence: Synthetic oligonucleotide
tacgcatcctctttgagttgctgggtcctg

SEQ ID NO: 313143 - DNA, 29 bp, Artificial Sequence
  Description of Artificial Sequence: Synthetic oligonucleotide
acgcatcctctttgagttgctgggtcctg

SEQ ID NO: 313144 - DNA, 28 bp, Artificial Sequence
  Description of Artificial Sequence: Synthetic oligonucleotide
cgcatcctctttgagttgctgggtcctg

SEQ ID NO: 313145 - DNA, 29 bp, Artificial Sequence
  Description of Artificial Sequence: Synthetic oligonucleotide
gcatcctctttgagttgctgggtcctgag

SEQ ID NO: 313146 - DNA, 29 bp, Artificial Sequence
  Description of Artificial Sequence: Synthetic oligonucleotide
catcctctttgagttgctgggtcctgagg

SEQ ID NO: 313147 - DNA, 29 bp, Artificial Sequence
  Description of Artificial Sequence: Synthetic oligonucleotide
atcctctttgagttgctgggtcctgaggc

SEQ ID NO: 313148 - DNA, 28 bp, Artificial Sequence
  Description of Artificial Sequence: Synthetic oligonucleotide
tcctctttgagttgctgggtcctgaggc

SEQ ID NO: 313149 - DNA, 27 bp, Artificial Sequence
  Description of Artificial Sequence: Synthetic oligonucleotide
cctctttgagttgctgggtcctgaggc

SEQ ID NO: 313150 - DNA, 27 bp, Artificial Sequence
  Description of Artificial Sequence: Synthetic oligonucleotide
ctctttgagttgctgggtcctgaggcc

SEQ ID NO: 313151 - DNA, 27 bp, Artificial Sequence
  Description of Artificial Sequence: Synthetic oligonucleotide
tctttgagttgctgggtcctgaggccg

SEQ ID NO: 313152 - DNA, 26 bp, Artificial Sequence
  Description of Artificial Sequence: Synthetic oligonucleotide
ctttgagttgctgggtcctgaggccg

SEQ ID NO: 313153 - DNA, 26 bp, Artificial Sequence
  Description of Artificial Sequence: Synthetic oligonucleotide
tttgagttgctgggtcctgaggccgc

SEQ ID NO: 313154 - DNA, 25 bp, Artificial Sequence
  Description of Artificial Sequence: Synthetic oligonucleotide
ttgagttgctgggtcctgaggccgc

SEQ ID NO: 313155 - DNA, 24 bp, Artificial Sequence
  Description of Artificial Sequence: Synthetic oligonucleotide
tgagttgctgggtcctgaggccgc

SEQ ID NO: 313156 - DNA, 23 bp, Artificial Sequence
  Description of Artificial Sequence: Synthetic oligonucleotide
gagttgctgggtcctgaggccgc

SEQ ID NO: 313157 - DNA, 23 bp, Artificial Sequence
  Description of Artificial Sequence: Synthetic oligonucleotide
agttgctgggtcctgaggccgcc

SEQ ID NO: 313158 - DNA, 22 bp, Artificial Sequence
  Description of Artificial Sequence: Synthetic oligonucleotide
gttgctgggtcctgaggccgcc

SEQ ID NO: 313159 - DNA, 23 bp, Artificial Sequence
  Description of Artificial Sequence: Synthetic oligonucleotide
ttgctgggtcctgaggccgccca

SEQ ID NO: 313160 - DNA, 22 bp, Artificial Sequence
  Description of Artificial Sequence: Synthetic oligonucleotide
tgctgggtcctgaggccgccca

SEQ ID NO: 313161 - DNA, 21 bp, Artificial Sequence
  Description of Artificial Sequence: Synthetic oligonucleotide
gctgggtcctgaggccgccca

SEQ ID NO: 313162 - DNA, 23 bp, Artificial Sequence
  Description of Artificial Sequence: Synthetic oligonucleotide
ctgggtcctgaggccgcccacat

SEQ ID NO: 313163 - DNA, 23 bp, Artificial Sequence
  Description of Artificial Sequence: Synthetic oligonucleotide
tgggtcctgaggccgcccacatc

SEQ ID NO: 313164 - DNA, 22 bp, Artificial Sequence
  Description of Artificial Sequence: Synthetic oligonucleotide
gggtcctgaggccgcccacatc

SEQ ID NO: 313165 - DNA, 26 bp, Artificial Sequence
  Description of Artificial Sequence: Synthetic oligonucleotide
ggtcctgaggccgcccacatcgttta

SEQ ID NO: 313166 - DNA, 27 bp, Artificial Sequence
  Description of Artificial Sequence: Synthetic oligonucleotide
gtcctgaggccgcccacatcgtttaca

SEQ ID NO: 313167 - DNA, 27 bp, Artificial Sequence
  Description of Artificial Sequence: Synthetic oligonucleotide
tcctgaggccgcccacatcgtttacac

SEQ ID NO: 313168 - DNA, 26 bp, Artificial Sequence
  Description of Artificial Sequence: Synthetic oligonucleotide
cctgaggccgcccacatcgtttacac

SEQ ID NO: 313169 - DNA, 26 bp, Artificial Sequence
  Description of Artificial Sequence: Synthetic oligonucleotide
ctgaggccgcccacatcgtttacacc

SEQ ID NO: 313170 - DNA, 27 bp, Artificial Sequence
  Description of Artificial Sequence: Synthetic oligonucleotide
tgaggccgcccacatcgtttacaccca

SEQ ID NO: 313171 - DNA, 26 bp, Artificial Sequence
  Description of Artificial Sequence: Synthetic oligonucleotide
gaggccgcccacatcgtttacaccca

SEQ ID NO: 313172 - DNA, 26 bp, Artificial Sequence
  Description of Artificial Sequence: Synthetic oligonucleotide
aggccgcccacatcgtttacacccac

SEQ ID NO: 313173 - DNA, 25 bp, Artificial Sequence
  Description of Artificial Sequence: Synthetic oligonucleotide
ggccgcccacatcgtttacacccac

SEQ ID NO: 313174 - DNA, 27 bp, Artificial Sequence
  Description of Artificial Sequence: Synthetic oligonucleotide
gccgcccacatcgtttacacccacctt

SEQ ID NO: 313175 - DNA, 27 bp, Artificial Sequence
  Description of Artificial Sequence: Synthetic oligonucleotide
ccgcccacatcgtttacacccaccttg

SEQ ID NO: 313176 - DNA, 27 bp, Artificial Sequence
  Description of Artificial Sequence: Synthetic oligonucleotide
cgcccacatcgtttacacccaccttgg

SEQ ID NO: 313177 - DNA, 27 bp, Artificial Sequence
  Description of Artificial Sequence: Synthetic oligonucleotide
gcccacatcgtttacacccaccttggc

SEQ ID NO: 313178 - DNA, 27 bp, Artificial Sequence
  Description of Artificial Sequence: Synthetic oligonucleotide
cccacatcgtttacacccaccttggcc

SEQ ID NO: 313179 - DNA, 27 bp, Artificial Sequence
  Description of Artificial Sequence: Synthetic oligonucleotide
ccacatcgtttacacccaccttggccg

SEQ ID NO: 313180 - DNA, 27 bp, Artificial Sequence
  Description of Artificial Sequence: Synthetic oligonucleotide
cacatcgtttacacccaccttggccgg

SEQ ID NO: 313181 - DNA, 27 bp, Artificial Sequence
  Description of Artificial Sequence: Synthetic oligonucleotide
acatcgtttacacccaccttggccggc

SEQ ID NO: 313182 - DNA, 26 bp, Artificial Sequence
  Description of Artificial Sequence: Synthetic oligonucleotide
catcgtttacacccaccttggccggc

SEQ ID NO: 313183 - DNA, 27 bp, Artificial Sequence
  Description of Artificial Sequence: Synthetic oligonucleotide
atcgtttacacccaccttggccggcct

SEQ ID NO: 313184 - DNA, 26 bp, Artificial Sequence
  Description of Artificial Sequence: Synthetic oligonucleotide
tcgtttacacccaccttggccggcct

SEQ ID NO: 313185 - DNA, 25 bp, Artificial Sequence
  Description of Artificial Sequence: Synthetic oligonucleotide
cgtttacacccaccttggccggcct

SEQ ID NO: 313186 - DNA, 25 bp, Artificial Sequence
  Description of Artificial Sequence: Synthetic oligonucleotide
gtttacacccaccttggccggcctg

SEQ ID NO: 313187 - DNA, 26 bp, Artificial Sequence
  Description of Artificial Sequence: Synthetic oligonucleotide
tttacacccaccttggccggcctgct

SEQ ID NO: 313188 - DNA, 25 bp, Artificial Sequence
  Description of Artificial Sequence: Synthetic oligonucleotide
ttacacccaccttggccggcctgct

SEQ ID NO: 313189 - DNA, 24 bp, Artificial Sequence
  Description of Artificial Sequence: Synthetic oligonucleotide
tacacccaccttggccggcctgct

SEQ ID NO: 313190 - DNA, 23 bp, Artificial Sequence
  Description of Artificial Sequence: Synthetic oligonucleotide
acacccaccttggccggcctgct

SEQ ID NO: 313191 - DNA, 22 bp, Artificial Sequence
  Description of Artificial Sequence: Synthetic oligonucleotide
cacccaccttggccggcctgct

SEQ ID NO: 313192 - DNA, 22 bp, Artificial Sequence
  Description of Artificial Sequence: Synthetic oligonucleotide
acccaccttggccggcctgctg

SEQ ID NO: 313193 - DNA, 21 bp, Artificial Sequence
  Description of Artificial Sequence: Synthetic oligonucleotide
cccaccttggccggcctgctg

SEQ ID NO: 313194 - DNA, 21 bp, Artificial Sequence
  Description of Artificial Sequence: Synthetic oligonucleotide
ccaccttggccggcctgctgc

SEQ ID NO: 313195 - DNA, 22 bp, Artificial Sequence
  Description of Artificial Sequence: Synthetic oligonucleotide
caccttggccggcctgctgcca

SEQ ID NO: 313196 - DNA, 22 bp, Artificial Sequence
  Description of Artificial Sequence: Synthetic oligonucleotide
accttggccggcctgctgccag

SEQ ID NO: 313197 - DNA, 21 bp, Artificial Sequence
  Description of Artificial Sequence: Synthetic oligonucleotide
ccttggccggcctgctgccag

SEQ ID NO: 313198 - DNA, 21 bp, Artificial Sequence
  Description of Artificial Sequence: Synthetic oligonucleotide
cttggccggcctgctgccagc

SEQ ID NO: 313199 - DNA, 22 bp, Artificial Sequence
  Description of Artificial Sequence: Synthetic oligonucleotide
ttggccggcctgctgccagcct

SEQ ID NO: 313200 - DNA, 21 bp, Artificial Sequence
  Description of Artificial Sequence: Synthetic oligonucleotide
tggccggcctgctgccagcct

SEQ ID NO: 313201 - DNA, 20 bp, Artificial Sequence
  Description of Artificial Sequence: Synthetic oligonucleotide
ggccggcctgctgccagcct

SEQ ID NO: 313202 - DNA, 22 bp, Artificial Sequence
  Description of Artificial Sequence: Synthetic oligonucleotide
gccggcctgctgccagcctcat

SEQ ID NO: 313203 - DNA, 23 bp, Artificial Sequence
  Description of Artificial Sequence: Synthetic oligonucleotide
ccggcctgctgccagcctcatgt

SEQ ID NO: 313204 - DNA, 24 bp, Artificial Sequence
  Description of Artificial Sequence: Synthetic oligonucleotide
cggcctgctgccagcctcatgtct

SEQ ID NO: 313205 - DNA, 25 bp, Artificial Sequence
  Description of Artificial Sequence: Synthetic oligonucleotide
ggcctgctgccagcctcatgtctga

SEQ ID NO: 313206 - DNA, 26 bp, Artificial Sequence
  Description of Artificial Sequence: Synthetic oligonucleotide
gcctgctgccagcctcatgtctgaga

SEQ ID NO: 313207 - DNA, 26 bp, Artificial Sequence
  Description of Artificial Sequence: Synthetic oligonucleotide
cctgctgccagcctcatgtctgagag

SEQ ID NO: 313208 - DNA, 26 bp, Artificial Sequence
  Description of Artificial Sequence: Synthetic oligonucleotide
ctgctgccagcctcatgtctgagagg

SEQ ID NO: 313209 - DNA, 27 bp, Artificial Sequence
  Description of Artificial Sequence: Synthetic oligonucleotide
tgctgccagcctcatgtctgagagggt

SEQ ID NO: 313210 - DNA, 26 bp, Artificial Sequence
  Description of Artificial Sequence: Synthetic oligonucleotide
gctgccagcctcatgtctgagagggt

SEQ ID NO: 313211 - DNA, 27 bp, Artificial Sequence
  Description of Artificial Sequence: Synthetic oligonucleotide
ctgccagcctcatgtctgagagggtga

SEQ ID NO: 313212 - DNA, 28 bp, Artificial Sequence
  Description of Artificial Sequence: Synthetic oligonucleotide
tgccagcctcatgtctgagagggtgatc

SEQ ID NO: 313213 - DNA, 27 bp, Artificial Sequence
  Description of Artificial Sequence: Synthetic oligonucleotide
gccagcctcatgtctgagagggtgatc

SEQ ID NO: 313214 - DNA, 27 bp, Artificial Sequence
  Description of Artificial Sequence: Synthetic oligonucleotide
ccagcctcatgtctgagagggtgatcc

SEQ ID NO: 313215 - DNA, 27 bp, Artificial Sequence
  Description of Artificial Sequence: Synthetic oligonucleotide
cagcctcatgtctgagagggtgatccg

SEQ ID NO: 313216 - DNA, 27 bp, Artificial Sequence
  Description of Artificial Sequence: Synthetic oligonucleotide
agcctcatgtctgagagggtgatccgc

SEQ ID NO: 313217 - DNA, 27 bp, Artificial Sequence
  Description of Artificial Sequence: Synthetic oligonucleotide
gcctcatgtctgagagggtgatccgca

SEQ ID NO: 313218 - DNA, 29 bp, Artificial Sequence
  Description of Artificial Sequence: Synthetic oligonucleotide
cctcatgtctgagagggtgatccgcatag

SEQ ID NO: 313219 - DNA, 31 bp, Artificial Sequence
  Description of Artificial Sequence: Synthetic oligonucleotide
ctcatgtctgagagggtgatccgcatagttg

SEQ ID NO: 313220 - DNA, 31 bp, Artificial Sequence
  Description of Artificial Sequence: Synthetic oligonucleotide
tcatgtctgagagggtgatccgcatagttgc

SEQ ID NO: 313221 - DNA, 30 bp, Artificial Sequence
  Description of Artificial Sequence: Synthetic oligonucleotide
catgtctgagagggtgatccgcatagttgc

SEQ ID NO: 313222 - DNA, 30 bp, Artificial Sequence
  Description of Artificial Sequence: Synthetic oligonucleotide
atgtctgagagggtgatccgcatagttgcc

SEQ ID NO: 313223 - DNA, 29 bp, Artificial Sequence
  Description of Artificial Sequence: Synthetic oligonucleotide
tgtctgagagggtgatccgcatagttgcc

SEQ ID NO: 313224 - DNA, 28 bp, Artificial Sequence
  Description of Artificial Sequence: Synthetic oligonucleotide
gtctgagagggtgatccgcatagttgcc

SEQ ID NO: 313225 - DNA, 30 bp, Artificial Sequence
  Description of Artificial Sequence: Synthetic oligonucleotide
tctgagagggtgatccgcatagttgcctac

SEQ ID NO: 313226 - DNA, 29 bp, Artificial Sequence
  Description of Artificial Sequence: Synthetic oligonucleotide
ctgagagggtgatccgcatagttgcctac

SEQ ID NO: 313227 - DNA, 31 bp, Artificial Sequence
  Description of Artificial Sequence: Synthetic oligonucleotide
tgagagggtgatccgcatagttgcctacatc

SEQ ID NO: 313228 - DNA, 30 bp, Artificial Sequence
  Description of Artificial Sequence: Synthetic oligonucleotide
gagagggtgatccgcatagttgcctacatc

SEQ ID NO: 313229 - DNA, 30 bp, Artificial Sequence
  Description of Artificial Sequence: Synthetic oligonucleotide
agagggtgatccgcatagttgcctacatcg

SEQ ID NO: 313230 - DNA, 29 bp, Artificial Sequence
  Description of Artificial Sequence: Synthetic oligonucleotide
gagggtgatccgcatagttgcctacatcg

SEQ ID NO: 313231 - DNA, 29 bp, Artificial Sequence
  Description of Artificial Sequence: Synthetic oligonucleotide
agggtgatccgcatagttgcctacatcgc

SEQ ID NO: 313232 - DNA, 28 bp, Artificial Sequence
  Description of Artificial Sequence: Synthetic oligonucleotide
gggtgatccgcatagttgcctacatcgc

SEQ ID NO: 313233 - DNA, 29 bp, Artificial Sequence
  Description of Artificial Sequence: Synthetic oligonucleotide
ggtgatccgcatagttgcctacatcgctc

SEQ ID NO: 313234 - DNA, 30 bp, Artificial Sequence
  Description of Artificial Sequence: Synthetic oligonucleotide
gtgatccgcatagttgcctacatcgctcag

SEQ ID NO: 313235 - DNA, 31 bp, Artificial Sequence
  Description of Artificial Sequence: Synthetic oligonucleotide
tgatccgcatagttgcctacatcgctcagag

SEQ ID NO: 313236 - DNA, 30 bp, Artificial Sequence
  Description of Artificial Sequence: Synthetic oligonucleotide
gatccgcatagttgcctacatcgctcagag

SEQ ID NO: 313237 - DNA, 30 bp, Artificial Sequence
  Description of Artificial Sequence: Synthetic oligonucleotide
atccgcatagttgcctacatcgctcagagc

SEQ ID NO: 313238 - DNA, 29 bp, Artificial Sequence
  Description of Artificial Sequence: Synthetic oligonucleotide
tccgcatagttgcctacatcgctcagagc

SEQ ID NO: 313239 - DNA, 28 bp, Artificial Sequence
  Description of Artificial Sequence: Synthetic oligonucleotide
ccgcatagttgcctacatcgctcagagc

SEQ ID NO: 313240 - DNA, 28 bp, Artificial Sequence
  Description of Artificial Sequence: Synthetic oligonucleotide
cgcatagttgcctacatcgctcagagcg

SEQ ID NO: 313241 - DNA, 28 bp, Artificial Sequence
  Description of Artificial Sequence: Synthetic oligonucleotide
gcatagttgcctacatcgctcagagcgg

SEQ ID NO: 313242 - DNA, 29 bp, Artificial Sequence
  Description of Artificial Sequence: Synthetic oligonucleotide
catagttgcctacatcgctcagagcggag

SEQ ID NO: 313243 - DNA, 29 bp, Artificial Sequence
  Description of Artificial Sequence: Synthetic oligonucleotide
atagttgcctacatcgctcagagcggagg

SEQ ID NO: 313244 - DNA, 28 bp, Artificial Sequence
  Description of Artificial Sequence: Synthetic oligonucleotide
tagttgcctacatcgctcagagcggagg

SEQ ID NO: 313245 - DNA, 27 bp, Artificial Sequence
  Description of Artificial Sequence: Synthetic oligonucleotide
agttgcctacatcgctcagagcggagg

SEQ ID NO: 313246 - DNA, 26 bp, Artificial Sequence
  Description of Artificial Sequence: Synthetic oligonucleotide
gttgcctacatcgctcagagcggagg

SEQ ID NO: 313247 - DNA, 26 bp, Artificial Sequence
  Description of Artificial Sequence: Synthetic oligonucleotide
ttgcctacatcgctcagagcggaggg

SEQ ID NO: 313248 - DNA, 25 bp, Artificial Sequence
  Description of Artificial Sequence: Synthetic oligonucleotide
tgcctacatcgctcagagcggaggg

SEQ ID NO: 313249 - DNA, 24 bp, Artificial Sequence
  Description of Artificial Sequence: Synthetic oligonucleotide
gcctacatcgctcagagcggaggg

SEQ ID NO: 313250 - DNA, 25 bp, Artificial Sequence
  Description of Artificial Sequence: Synthetic oligonucleotide
cctacatcgctcagagcggagggga

SEQ ID NO: 313251 - DNA, 25 bp, Artificial Sequence
  Description of Artificial Sequence: Synthetic oligonucleotide
ctacatcgctcagagcggaggggag

SEQ ID NO: 313252 - DNA, 26 bp, Artificial Sequence
  Description of Artificial Sequence: Synthetic oligonucleotide
tacatcgctcagagcggaggggagca

SEQ ID NO: 313253 - DNA, 25 bp, Artificial Sequence
  Description of Artificial Sequence: Synthetic oligonucleotide
acatcgctcagagcggaggggagca

SEQ ID NO: 313254 - DNA, 24 bp, Artificial Sequence
  Description of Artificial Sequence: Synthetic oligonucleotide
catcgctcagagcggaggggagca

SEQ ID NO: 313255 - DNA, 24 bp, Artificial Sequence
  Description of Artificial Sequence: Synthetic oligonucleotide
atcgctcagagcggaggggagcag

SEQ ID NO: 313256 - DNA, 23 bp, Artificial Sequence
  Description of Artificial Sequence: Synthetic oligonucleotide
tcgctcagagcggaggggagcag

SEQ ID NO: 313257 - DNA, 22 bp, Artificial Sequence
  Description of Artificial Sequence: Synthetic oligonucleotide
cgctcagagcggaggggagcag

SEQ ID NO: 313258 - DNA, 23 bp, Artificial Sequence
  Description of Artificial Sequence: Synthetic oligonucleotide
gctcagagcggaggggagcagct

SEQ ID NO: 313259 - DNA, 23 bp, Artificial Sequence
  Description of Artificial Sequence: Synthetic oligonucleotide
ctcagagcggaggggagcagctg

SEQ ID NO: 313260 - DNA, 24 bp, Artificial Sequence
  Description of Artificial Sequence: Synthetic oligonucleotide
tcagagcggaggggagcagctgca

SEQ ID NO: 313261 - DNA, 23 bp, Artificial Sequence
  Description of Artificial Sequence: Synthetic oligonucleotide
cagagcggaggggagcagctgca

SEQ ID NO: 313262 - DNA, 24 bp, Artificial Sequence
  Description of Artificial Sequence: Synthetic oligonucleotide
agagcggaggggagcagctgcact

SEQ ID NO: 313263 - DNA, 23 bp, Artificial Sequence
  Description of Artificial Sequence: Synthetic oligonucleotide
gagcggaggggagcagctgcact

SEQ ID NO: 313264 - DNA, 23 bp, Artificial Sequence
  Description of Artificial Sequence: Synthetic oligonucleotide
agcggaggggagcagctgcactc

SEQ ID NO: 313265 - DNA, 22 bp, Artificial Sequence
  Description of Artificial Sequence: Synthetic oligonucleotide
gcggaggggagcagctgcactc

SEQ ID NO: 313266 - DNA, 22 bp, Artificial Sequence
  Description of Artificial Sequence: Synthetic oligonucleotide
cggaggggagcagctgcactcg

SEQ ID NO: 313267 - DNA, 24 bp, Artificial Sequence
  Description of Artificial Sequence: Synthetic oligonucleotide
ggaggggagcagctgcactcgcta

SEQ ID NO: 313268 - DNA, 25 bp, Artificial Sequence
  Description of Artificial Sequence: Synthetic oligonucleotide
gaggggagcagctgcactcgctaga

SEQ ID NO: 313269 - DNA, 25 bp, Artificial Sequence
  Description of Artificial Sequence: Synthetic oligonucleotide
aggggagcagctgcactcgctagag

SEQ ID NO: 313270 - DNA, 24 bp, Artificial Sequence
  Description of Artificial Sequence: Synthetic oligonucleotide
ggggagcagctgcactcgctagag

SEQ ID NO: 313271 - DNA, 24 bp, Artificial Sequence
  Description of Artificial Sequence: Synthetic oligonucleotide
gggagcagctgcactcgctagagg

SEQ ID NO: 313272 - DNA, 24 bp, Artificial Sequence
  Description of Artificial Sequence: Synthetic oligonucleotide
ggagcagctgcactcgctagaggg

SEQ ID NO: 313273 - DNA, 26 bp, Artificial Sequence
  Description of Artificial Sequence: Synthetic oligonucleotide
gagcagctgcactcgctagagggcat

SEQ ID NO: 313274 - DNA, 26 bp, Artificial Sequence
  Description of Artificial Sequence: Synthetic oligonucleotide
agcagctgcactcgctagagggcatc

SEQ ID NO: 313275 - DNA, 25 bp, Artificial Sequence
  Description of Artificial Sequence: Synthetic oligonucleotide
gcagctgcactcgctagagggcatc

SEQ ID NO: 313276 - DNA, 26 bp, Artificial Sequence
  Description of Artificial Sequence: Synthetic oligonucleotide
cagctgcactcgctagagggcatcct

SEQ ID NO: 313277 - DNA, 26 bp, Artificial Sequence
  Description of Artificial Sequence: Synthetic oligonucleotide
agctgcactcgctagagggcatcctg

SEQ ID NO: 313278 - DNA, 25 bp, Artificial Sequence
  Description of Artificial Sequence: Synthetic oligonucleotide
gctgcactcgctagagggcatcctg

SEQ ID NO: 313279 - DNA, 26 bp, Artificial Sequence
  Description of Artificial Sequence: Synthetic oligonucleotide
ctgcactcgctagagggcatcctgga

SEQ ID NO: 313280 - DNA, 27 bp, Artificial Sequence
  Description of Artificial Sequence: Synthetic oligonucleotide
tgcactcgctagagggcatcctggact

SEQ ID NO: 313281 - DNA, 26 bp, Artificial Sequence
  Description of Artificial Sequence: Synthetic oligonucleotide
gcactcgctagagggcatcctggact

SEQ ID NO: 313282 - DNA, 26 bp, Artificial Sequence
  Description of Artificial Sequence: Synthetic oligonucleotide
cactcgctagagggcatcctggactc

SEQ ID NO: 313283 - DNA, 27 bp, Artificial Sequence
  Description of Artificial Sequence: Synthetic oligonucleotide
actcgctagagggcatcctggactcca

SEQ ID NO: 313284 - DNA, 26 bp, Artificial Sequence
  Description of Artificial Sequence: Synthetic oligonucleotide
ctcgctagagggcatcctggactcca

SEQ ID NO: 313285 - DNA, 26 bp, Artificial Sequence
  Description of Artificial Sequence: Synthetic oligonucleotide
tcgctagagggcatcctggactccag

SEQ ID NO: 313286 - DNA, 25 bp, Artificial Sequence
  Description of Artificial Sequence: Synthetic oligonucleotide
cgctagagggcatcctggactccag

SEQ ID NO: 313287 - DNA, 25 bp, Artificial Sequence
  Description of Artificial Sequence: Synthetic oligonucleotide
gctagagggcatcctggactccagc

SEQ ID NO: 313288 - DNA, 27 bp, Artificial Sequence
  Description of Artificial Sequence: Synthetic oligonucleotide
ctagagggcatcctggactccagccta

SEQ ID NO: 313289 - DNA, 27 bp, Artificial Sequence
  Description of Artificial Sequence: Synthetic oligonucleotide
tagagggcatcctggactccagcctag

SEQ ID NO: 313290 - DNA, 27 bp, Artificial Sequence
  Description of Artificial Sequence: Synthetic oligonucleotide
agagggcatcctggactccagcctagt

SEQ ID NO: 313291 - DNA, 26 bp, Artificial Sequence
  Description of Artificial Sequence: Synthetic oligonucleotide
gagggcatcctggactccagcctagt

SEQ ID NO: 313292 - DNA, 26 bp, Artificial Sequence
  Description of Artificial Sequence: Synthetic oligonucleotide
agggcatcctggactccagcctagtc

SEQ ID NO: 313293 - DNA, 25 bp, Artificial Sequence
  Description of Artificial Sequence: Synthetic oligonucleotide
gggcatcctggactccagcctagtc

SEQ ID NO: 313294 - DNA, 26 bp, Artificial Sequence
  Description of Artificial Sequence: Synthetic oligonucleotide
ggcatcctggactccagcctagtcct

SEQ ID NO: 313295 - DNA, 26 bp, Artificial Sequence
  Description of Artificial Sequence: Synthetic oligonucleotide
gcatcctggactccagcctagtcctg

SEQ ID NO: 313296 - DNA, 26 bp, Artificial Sequence
  Description of Artificial Sequence: Synthetic oligonucleotide
catcctggactccagcctagtcctgc

SEQ ID NO: 313297 - DNA, 27 bp, Artificial Sequence
  Description of Artificial Sequence: Synthetic oligonucleotide
atcctggactccagcctagtcctgcct

SEQ ID NO: 313298 - DNA, 26 bp, Artificial Sequence
  Description of Artificial Sequence: Synthetic oligonucleotide
tcctggactccagcctagtcctgcct

SEQ ID NO: 313299 - DNA, 25 bp, Artificial Sequence
  Description of Artificial Sequence: Synthetic oligonucleotide
cctggactccagcctagtcctgcct

SEQ ID NO: 313300 - DNA, 25 bp, Artificial Sequence
  Description of Artificial Sequence: Synthetic oligonucleotide
ctggactccagcctagtcctgcctc

SEQ ID NO: 313301 - DNA, 25 bp, Artificial Sequence
  Description of Artificial Sequence: Synthetic oligonucleotide
tggactccagcctagtcctgcctcc

SEQ ID NO: 313302 - DNA, 24 bp, Artificial Sequence
  Description of Artificial Sequence: Synthetic oligonucleotide
ggactccagcctagtcctgcctcc

SEQ ID NO: 313303 - DNA, 25 bp, Artificial Sequence
  Description of Artificial Sequence: Synthetic oligonucleotide
gactccagcctagtcctgcctccct

SEQ ID NO: 313304 - DNA, 25 bp, Artificial Sequence
  Description of Artificial Sequence: Synthetic oligonucleotide
actccagcctagtcctgcctccctc

SEQ ID NO: 313305 - DNA, 24 bp, Artificial Sequence
  Description of Artificial Sequence: Synthetic oligonucleotide
ctccagcctagtcctgcctccctc

SEQ ID NO: 313306 - DNA, 24 bp, Artificial Sequence
  Description of Artificial Sequence: Synthetic oligonucleotide
tccagcctagtcctgcctccctcc

SEQ ID NO: 313307 - DNA, 23 bp, Artificial Sequence
  Description of Artificial Sequence: Synthetic oligonucleotide
ccagcctagtcctgcctccctcc

SEQ ID NO: 313308 - DNA, 25 bp, Artificial Sequence
  Description of Artificial Sequence: Synthetic oligonucleotide
cagcctagtcctgcctccctccgat

SEQ ID NO: 313309 - DNA, 25 bp, Artificial Sequence
  Description of Artificial Sequence: Synthetic oligonucleotide
agcctagtcctgcctccctccgatg

SEQ ID NO: 313310 - DNA, 24 bp, Artificial Sequence
  Description of Artificial Sequence: Synthetic oligonucleotide
gcctagtcctgcctccctccgatg

SEQ ID NO: 313311 - DNA, 24 bp, Artificial Sequence
  Description of Artificial Sequence: Synthetic oligonucleotide
cctagtcctgcctccctccgatgc

SEQ ID NO: 313312 - DNA, 24 bp, Artificial Sequence
  Description of Artificial Sequence: Synthetic oligonucleotide
ctagtcctgcctccctccgatgcc

SEQ ID NO: 313313 - DNA, 24 bp, Artificial Sequence
  Description of Artificial Sequence: Synthetic oligonucleotide
tagtcctgcctccctccgatgccc

SEQ ID NO: 313314 - DNA, 23 bp, Artificial Sequence
  Description of Artificial Sequence: Synthetic oligonucleotide
agtcctgcctccctccgatgccc

SEQ ID NO: 313315 - DNA, 22 bp, Artificial Sequence
  Description of Artificial Sequence: Synthetic oligonucleotide
gtcctgcctccctccgatgccc

SEQ ID NO: 313316 - DNA, 22 bp, Artificial Sequence
  Description of Artificial Sequence: Synthetic oligonucleotide
tcctgcctccctccgatgcccg

SEQ ID NO: 313317 - DNA, 21 bp, Artificial Sequence
  Description of Artificial Sequence: Synthetic oligonucleotide
cctgcctccctccgatgcccg

SEQ ID NO: 313318 - DNA, 22 bp, Artificial Sequence
  Description of Artificial Sequence: Synthetic oligonucleotide
ctgcctccctccgatgcccgct

SEQ ID NO: 313319 - DNA, 22 bp, Artificial Sequence
  Description of Artificial Sequence: Synthetic oligonucleotide
tgcctccctccgatgcccgctc

SEQ ID NO: 313320 - DNA, 21 bp, Artificial Sequence
  Description of Artificial Sequence: Synthetic oligonucleotide
gcctccctccgatgcccgctc

SEQ ID NO: 313321 - DNA, 21 bp, Artificial Sequence
  Description of Artificial Sequence: Synthetic oligonucleotide
cctccctccgatgcccgctcc

SEQ ID NO: 313322 - DNA, 22 bp, Artificial Sequence
  Description of Artificial Sequence: Synthetic oligonucleotide
ctccctccgatgcccgctccga

SEQ ID NO: 313323 - DNA, 22 bp, Artificial Sequence
  Description of Artificial Sequence: Synthetic oligonucleotide
tccctccgatgcccgctccgag

SEQ ID NO: 313324 - DNA, 21 bp, Artificial Sequence
  Description of Artificial Sequence: Synthetic oligonucleotide
ccctccgatgcccgctccgag

SEQ ID NO: 313325 - DNA, 22 bp, Artificial Sequence
  Description of Artificial Sequence: Synthetic oligonucleotide
cctccgatgcccgctccgagca

SEQ ID NO: 313326 - DNA, 22 bp, Artificial Sequence
  Description of Artificial Sequence: Synthetic oligonucleotide
ctccgatgcccgctccgagcac

SEQ ID NO: 313327 - DNA, 22 bp, Artificial Sequence
  Description of Artificial Sequence: Synthetic oligonucleotide
tccgatgcccgctccgagcacg

SEQ ID NO: 313328 - DNA, 21 bp, Artificial Sequence
  Description of Artificial Sequence: Synthetic oligonucleotide
ccgatgcccgctccgagcacg

SEQ ID NO: 313329 - DNA, 22 bp, Artificial Sequence
  Description of Artificial Sequence: Synthetic oligonucleotide
cgatgcccgctccgagcacgca

SEQ ID NO: 313330 - DNA, 23 bp, Artificial Sequence
  Description of Artificial Sequence: Synthetic oligonucleotide
gatgcccgctccgagcacgcact

SEQ ID NO: 313331 - DNA, 23 bp, Artificial Sequence
  Description of Artificial Sequence: Synthetic oligonucleotide
atgcccgctccgagcacgcactg

SEQ ID NO: 313332 - DNA, 22 bp, Artificial Sequence
  Description of Artificial Sequence: Synthetic oligonucleotide
tgcccgctccgagcacgcactg

SEQ ID NO: 313333 - DNA, 21 bp, Artificial Sequence
  Description of Artificial Sequence: Synthetic oligonucleotide
gcccgctccgagcacgcactg

SEQ ID NO: 313334 - DNA, 22 bp, Artificial Sequence
  Description of Artificial Sequence: Synthetic oligonucleotide
cccgctccgagcacgcactgct

SEQ ID NO: 313335 - DNA, 23 bp, Artificial Sequence
  Description of Artificial Sequence: Synthetic oligonucleotide
ccgctccgagcacgcactgctct

SEQ ID NO: 313336 - DNA, 24 bp, Artificial Sequence
  Description of Artificial Sequence: Synthetic oligonucleotide
cgctccgagcacgcactgctctgt

SEQ ID NO: 313337 - DNA, 25 bp, Artificial Sequence
  Description of Artificial Sequence: Synthetic oligonucleotide
gctccgagcacgcactgctctgtct

SEQ ID NO: 313338 - DNA, 25 bp, Artificial Sequence
  Description of Artificial Sequence: Synthetic oligonucleotide
ctccgagcacgcactgctctgtctg

SEQ ID NO: 313339 - DNA, 26 bp, Artificial Sequence
  Description of Artificial Sequence: Synthetic oligonucleotide
tccgagcacgcactgctctgtctggt

SEQ ID NO: 313340 - DNA, 25 bp, Artificial Sequence
  Description of Artificial Sequence: Synthetic oligonucleotide
ccgagcacgcactgctctgtctggt

SEQ ID NO: 313341 - DNA, 25 bp, Artificial Sequence
  Description of Artificial Sequence: Synthetic oligonucleotide
cgagcacgcactgctctgtctggtg

SEQ ID NO: 313342 - DNA, 25 bp, Artificial Sequence
  Description of Artificial Sequence: Synthetic oligonucleotide
gagcacgcactgctctgtctggtgc

SEQ ID NO: 313343 - DNA, 26 bp, Artificial Sequence
  Description of Artificial Sequence: Synthetic oligonucleotide
agcacgcactgctctgtctggtgcgt

SEQ ID NO: 313344 - DNA, 25 bp, Artificial Sequence
  Description of Artificial Sequence: Synthetic oligonucleotide
gcacgcactgctctgtctggtgcgt

SEQ ID NO: 313345 - DNA, 26 bp, Artificial Sequence
  Description of Artificial Sequence: Synthetic oligonucleotide
cacgcactgctctgtctggtgcgtgt

SEQ ID NO: 313346 - DNA, 26 bp, Artificial Sequence
  Description of Artificial Sequence: Synthetic oligonucleotide
acgcactgctctgtctggtgcgtgtg

SEQ ID NO: 313347 - DNA, 25 bp, Artificial Sequence
  Description of Artificial Sequence: Synthetic oligonucleotide
cgcactgctctgtctggtgcgtgtg

SEQ ID NO: 313348 - DNA, 26 bp, Artificial Sequence
  Description of Artificial Sequence: Synthetic oligonucleotide
gcactgctctgtctggtgcgtgtgca

SEQ ID NO: 313349 - DNA, 27 bp, Artificial Sequence
  Description of Artificial Sequence: Synthetic oligonucleotide
cactgctctgtctggtgcgtgtgcaga

SEQ ID NO: 313350 - DNA, 27 bp, Artificial Sequence
  Description of Artificial Sequence: Synthetic oligonucleotide
actgctctgtctggtgcgtgtgcagag

SEQ ID NO: 313351 - DNA, 26 bp, Artificial Sequence
  Description of Artificial Sequence: Synthetic oligonucleotide
ctgctctgtctggtgcgtgtgcagag

SEQ ID NO: 313352 - DNA, 26 bp, Artificial Sequence
  Description of Artificial Sequence: Synthetic oligonucleotide
tgctctgtctggtgcgtgtgcagagc

SEQ ID NO: 313353 - DNA, 25 bp, Artificial Sequence
  Description of Artificial Sequence: Synthetic oligonucleotide
gctctgtctggtgcgtgtgcagagc

SEQ ID NO: 313354 - DNA, 26 bp, Artificial Sequence
  Description of Artificial Sequence: Synthetic oligonucleotide
ctctgtctggtgcgtgtgcagagcga

SEQ ID NO: 313355 - DNA, 26 bp, Artificial Sequence
  Description of Artificial Sequence: Synthetic oligonucleotide
tctgtctggtgcgtgtgcagagcgag

SEQ ID NO: 313356 - DNA, 25 bp, Artificial Sequence
  Description of Artificial Sequence: Synthetic oligonucleotide
ctgtctggtgcgtgtgcagagcgag

SEQ ID NO: 313357 - DNA, 27 bp, Artificial Sequence
  Description of Artificial Sequence: Synthetic oligonucleotide
tgtctggtgcgtgtgcagagcgagcta

SEQ ID NO: 313358 - DNA, 26 bp, Artificial Sequence
  Description of Artificial Sequence: Synthetic oligonucleotide
gtctggtgcgtgtgcagagcgagcta

SEQ ID NO: 313359 - DNA, 27 bp, Artificial Sequence
  Description of Artificial Sequence: Synthetic oligonucleotide
tctggtgcgtgtgcagagcgagctact

SEQ ID NO: 313360 - DNA, 27 bp, Artificial Sequence
  Description of Artificial Sequence: Synthetic oligonucleotide
ctggtgcgtgtgcagagcgagctactt

SEQ ID NO: 313361 - DNA, 27 bp, Artificial Sequence
  Description of Artificial Sequence: Synthetic oligonucleotide
tggtgcgtgtgcagagcgagctacttg

SEQ ID NO: 313362 - DNA, 26 bp, Artificial Sequence
  Description of Artificial Sequence: Synthetic oligonucleotide
ggtgcgtgtgcagagcgagctacttg

SEQ ID NO: 313363 - DNA, 27 bp, Artificial Sequence
  Description of Artificial Sequence: Synthetic oligonucleotide
gtgcgtgtgcagagcgagctacttgga

SEQ ID NO: 313364 - DNA, 28 bp, Artificial Sequence
  Description of Artificial Sequence: Synthetic oligonucleotide
tgcgtgtgcagagcgagctacttggaag

SEQ ID NO: 313365 - DNA, 27 bp, Artificial Sequence
  Description of Artificial Sequence: Synthetic oligonucleotide
gcgtgtgcagagcgagctacttggaag

SEQ ID NO: 313366 - DNA, 27 bp, Artificial Sequence
  Description of Artificial Sequence: Synthetic oligonucleotide
cgtgtgcagagcgagctacttggaagg

SEQ ID NO: 313367 - DNA, 27 bp, Artificial Sequence
  Description of Artificial Sequence: Synthetic oligonucleotide
gtgtgcagagcgagctacttggaaggc

SEQ ID NO: 313368 - DNA, 27 bp, Artificial Sequence
  Description of Artificial Sequence: Synthetic oligonucleotide
tgtgcagagcgagctacttggaaggcg

SEQ ID NO: 313369 - DNA, 26 bp, Artificial Sequence
  Description of Artificial Sequence: Synthetic oligonucleotide
gtgcagagcgagctacttggaaggcg

SEQ ID NO: 313370 - DNA, 27 bp, Artificial Sequence
  Description of Artificial Sequence: Synthetic oligonucleotide
tgcagagcgagctacttggaaggcgct

SEQ ID NO: 313371 - DNA, 27 bp, Artificial Sequence
  Description of Artificial Sequence: Synthetic oligonucleotide
gcagagcgagctacttggaaggcgctt

SEQ ID NO: 313372 - DNA, 28 bp, Artificial Sequence
  Description of Artificial Sequence: Synthetic oligonucleotide
cagagcgagctacttggaaggcgctttc

SEQ ID NO: 313373 - DNA, 29 bp, Artificial Sequence
  Description of Artificial Sequence: Synthetic oligonucleotide
agagcgagctacttggaaggcgctttcag

SEQ ID NO: 313374 - DNA, 28 bp, Artificial Sequence
  Description of Artificial Sequence: Synthetic oligonucleotide
gagcgagctacttggaaggcgctttcag

SEQ ID NO: 313375 - DNA, 29 bp, Artificial Sequence
  Description of Artificial Sequence: Synthetic oligonucleotide
agcgagctacttggaaggcgctttcagtc

SEQ ID NO: 313376 - DNA, 28 bp, Artificial Sequence
  Description of Artificial Sequence: Synthetic oligonucleotide
gcgagctacttggaaggcgctttcagtc

SEQ ID NO: 313377 - DNA, 28 bp, Artificial Sequence
  Description of Artificial Sequence: Synthetic oligonucleotide
cgagctacttggaaggcgctttcagtcc

SEQ ID NO: 313378 - DNA, 29 bp, Artificial Sequence
  Description of Artificial Sequence: Synthetic oligonucleotide
gagctacttggaaggcgctttcagtccag

SEQ ID NO: 313379 - DNA, 29 bp, Artificial Sequence
  Description of Artificial Sequence: Synthetic oligonucleotide
agctacttggaaggcgctttcagtccagg

SEQ ID NO: 313380 - DNA, 28 bp, Artificial Sequence
  Description of Artificial Sequence: Synthetic oligonucleotide
gctacttggaaggcgctttcagtccagg

SEQ ID NO: 313381 - DNA, 28 bp, Artificial Sequence
  Description of Artificial Sequence: Synthetic oligonucleotide
ctacttggaaggcgctttcagtccaggc

SEQ ID NO: 313382 - DNA, 28 bp, Artificial Sequence
  Description of Artificial Sequence: Synthetic oligonucleotide
tacttggaaggcgctttcagtccaggcc

SEQ ID NO: 313383 - DNA, 27 bp, Artificial Sequence
  Description of Artificial Sequence: Synthetic oligonucleotide
acttggaaggcgctttcagtccaggcc

SEQ ID NO: 313384 - DNA, 27 bp, Artificial Sequence
  Description of Artificial Sequence: Synthetic oligonucleotide
cttggaaggcgctttcagtccaggcct

SEQ ID NO: 313385 - DNA, 27 bp, Artificial Sequence
  Description of Artificial Sequence: Synthetic oligonucleotide
ttggaaggcgctttcagtccaggcctg

SEQ ID NO: 313386 - DNA, 26 bp, Artificial Sequence
  Description of Artificial Sequence: Synthetic oligonucleotide
tggaaggcgctttcagtccaggcctg

SEQ ID NO: 313387 - DNA, 25 bp, Artificial Sequence
  Description of Artificial Sequence: Synthetic oligonucleotide
ggaaggcgctttcagtccaggcctg

SEQ ID NO: 313388 - DNA, 25 bp, Artificial Sequence
  Description of Artificial Sequence: Synthetic oligonucleotide
gaaggcgctttcagtccaggcctgc

SEQ ID NO: 313389 - DNA, 27 bp, Artificial Sequence
  Description of Artificial Sequence: Synthetic oligonucleotide
aaggcgctttcagtccaggcctgccaa

SEQ ID NO: 313390 - DNA, 26 bp, Artificial Sequence
  Description of Artificial Sequence: Synthetic oligonucleotide
aggcgctttcagtccaggcctgccaa

SEQ ID NO: 313391 - DNA, 25 bp, Artificial Sequence
  Description of Artificial Sequence: Synthetic oligonucleotide
ggcgctttcagtccaggcctgccaa

SEQ ID NO: 313392 - DNA, 25 bp, Artificial Sequence
  Description of Artificial Sequence: Synthetic oligonucleotide
gcgctttcagtccaggcctgccaag

SEQ ID NO: 313393 - DNA, 25 bp, Artificial Sequence
  Description of Artificial Sequence: Synthetic oligonucleotide
cgctttcagtccaggcctgccaagg

SEQ ID NO: 313394 - DNA, 26 bp, Artificial Sequence
  Description of Artificial Sequence: Synthetic oligonucleotide
gctttcagtccaggcctgccaaggca

SEQ ID NO: 313395 - DNA, 27 bp, Artificial Sequence
  Description of Artificial Sequence: Synthetic oligonucleotide
ctttcagtccaggcctgccaaggcaga

SEQ ID NO: 313396 - DNA, 27 bp, Artificial Sequence
  Description of Artificial Sequence: Synthetic oligonucleotide
tttcagtccaggcctgccaaggcagac

SEQ ID NO: 313397 - DNA, 27 bp, Artificial Sequence
  Description of Artificial Sequence: Synthetic oligonucleotide
ttcagtccaggcctgccaaggcagact

SEQ ID NO: 313398 - DNA, 26 bp, Artificial Sequence
  Description of Artificial Sequence: Synthetic oligonucleotide
tcagtccaggcctgccaaggcagact

SEQ ID NO: 313399 - DNA, 25 bp, Artificial Sequence
  Description of Artificial Sequence: Synthetic oligonucleotide
cagtccaggcctgccaaggcagact

SEQ ID NO: 313400 - DNA, 25 bp, Artificial Sequence
  Description of Artificial Sequence: Synthetic oligonucleotide
agtccaggcctgccaaggcagactc

SEQ ID NO: 313401 - DNA, 24 bp, Artificial Sequence
  Description of Artificial Sequence: Synthetic oligonucleotide
gtccaggcctgccaaggcagactc

SEQ ID NO: 313402 - DNA, 25 bp, Artificial Sequence
  Description of Artificial Sequence: Synthetic oligonucleotide
tccaggcctgccaaggcagactcca

SEQ ID NO: 313403 - DNA, 24 bp, Artificial Sequence
  Description of Artificial Sequence: Synthetic oligonucleotide
ccaggcctgccaaggcagactcca

SEQ ID NO: 313404 - DNA, 24 bp, Artificial Sequence
  Description of Artificial Sequence: Synthetic oligonucleotide
caggcctgccaaggcagactccac

SEQ ID NO: 313405 - DNA, 26 bp, Artificial Sequence
  Description of Artificial Sequence: Synthetic oligonucleotide
aggcctgccaaggcagactccacctt

SEQ ID NO: 313406 - DNA, 25 bp, Artificial Sequence
  Description of Artificial Sequence: Synthetic oligonucleotide
ggcctgccaaggcagactccacctt

SEQ ID NO: 313407 - DNA, 27 bp, Artificial Sequence
  Description of Artificial Sequence: Synthetic oligonucleotide
gcctgccaaggcagactccaccttcta

SEQ ID NO: 313408 - DNA, 27 bp, Artificial Sequence
  Description of Artificial Sequence: Synthetic oligonucleotide
cctgccaaggcagactccaccttctac

SEQ ID NO: 313409 - DNA, 29 bp, Artificial Sequence
  Description of Artificial Sequence: Synthetic oligonucleotide
ctgccaaggcagactccaccttctacaac

SEQ ID NO: 313410 - DNA, 29 bp, Artificial Sequence
  Description of Artificial Sequence: Synthetic oligonucleotide
tgccaaggcagactccaccttctacaacg

SEQ ID NO: 313411 - DNA, 28 bp, Artificial Sequence
  Description of Artificial Sequence: Synthetic oligonucleotide
gccaaggcagactccaccttctacaacg

SEQ ID NO: 313412 - DNA, 28 bp, Artificial Sequence
  Description of Artificial Sequence: Synthetic oligonucleotide
ccaaggcagactccaccttctacaacgg

SEQ ID NO: 313413 - DNA, 28 bp, Artificial Sequence
  Description of Artificial Sequence: Synthetic oligonucleotide
caaggcagactccaccttctacaacggc

SEQ ID NO: 313414 - DNA, 28 bp, Artificial Sequence
  Description of Artificial Sequence: Synthetic oligonucleotide
aaggcagactccaccttctacaacggcc

SEQ ID NO: 313415 - DNA, 27 bp, Artificial Sequence
  Description of Artificial Sequence: Synthetic oligonucleotide
aggcagactccaccttctacaacggcc

SEQ ID NO: 313416 - DNA, 27 bp, Artificial Sequence
  Description of Artificial Sequence: Synthetic oligonucleotide
ggcagactccaccttctacaacggcct

SEQ ID NO: 313417 - DNA, 28 bp, Artificial Sequence
  Description of Artificial Sequence: Synthetic oligonucleotide
gcagactccaccttctacaacggcctag

SEQ ID NO: 313418 - DNA, 29 bp, Artificial Sequence
  Description of Artificial Sequence: Synthetic oligonucleotide
cagactccaccttctacaacggcctagac

SEQ ID NO: 313419 - DNA, 35 bp, Artificial Sequence
  Description of Artificial Sequence: Synthetic oligonucleotide
agactccaccttctacaacggcctagacataaatg

SEQ ID NO: 313420 - DNA, 34 bp, Artificial Sequence
  Description of Artificial Sequence: Synthetic oligonucleotide
gactccaccttctacaacggcctagacataaatg

SEQ ID NO: 313421 - DNA, 34 bp, Artificial Sequence
  Description of Artificial Sequence: Synthetic oligonucleotide
actccaccttctacaacggcctagacataaatgg

SEQ ID NO: 313422 - DNA, 33 bp, Artificial Sequence
  Description of Artificial Sequence: Synthetic oligonucleotide
ctccaccttctacaacggcctagacataaatgg

SEQ ID NO: 313423 - DNA, 33 bp, Artificial Sequence
  Description of Artificial Sequence: Synthetic oligonucleotide
tccaccttctacaacggcctagacataaatggg

SEQ ID NO: 313424 - DNA, 32 bp, Artificial Sequence
  Description of Artificial Sequence: Synthetic oligonucleotide
ccaccttctacaacggcctagacataaatggg

SEQ ID NO: 313425 - DNA, 32 bp, Artificial Sequence
  Description of Artificial Sequence: Synthetic oligonucleotide
caccttctacaacggcctagacataaatgggg

SEQ ID NO: 313426 - DNA, 32 bp, Artificial Sequence
  Description of Artificial Sequence: Synthetic oligonucleotide
accttctacaacggcctagacataaatggggc

SEQ ID NO: 313427 - DNA, 31 bp, Artificial Sequence
  Description of Artificial Sequence: Synthetic oligonucleotide
ccttctacaacggcctagacataaatggggc

SEQ ID NO: 313428 - DNA, 31 bp, Artificial Sequence
  Description of Artificial Sequence: Synthetic oligonucleotide
cttctacaacggcctagacataaatggggcc

SEQ ID NO: 313429 - DNA, 31 bp, Artificial Sequence
  Description of Artificial Sequence: Synthetic oligonucleotide
ttctacaacggcctagacataaatggggccc

SEQ ID NO: 313430 - DNA, 30 bp, Artificial Sequence
  Description of Artificial Sequence: Synthetic oligonucleotide
tctacaacggcctagacataaatggggccc

SEQ ID NO: 313431 - DNA, 29 bp, Artificial Sequence
  Description of Artificial Sequence: Synthetic oligonucleotide
ctacaacggcctagacataaatggggccc

SEQ ID NO: 313432 - DNA, 29 bp, Artificial Sequence
  Description of Artificial Sequence: Synthetic oligonucleotide
tacaacggcctagacataaatggggcccc

SEQ ID NO: 313433 - DNA, 28 bp, Artificial Sequence
  Description of Artificial Sequence: Synthetic oligonucleotide
acaacggcctagacataaatggggcccc

SEQ ID NO: 313434 - DNA, 27 bp, Artificial Sequence
  Description of Artificial Sequence: Synthetic oligonucleotide
caacggcctagacataaatggggcccc

SEQ ID NO: 313435 - DNA, 28 bp, Artificial Sequence
  Description of Artificial Sequence: Synthetic oligonucleotide
aacggcctagacataaatggggccccag

SEQ ID NO: 313436 - DNA, 27 bp, Artificial Sequence
  Description of Artificial Sequence: Synthetic oligonucleotide
acggcctagacataaatggggccccag

SEQ ID NO: 313437 - DNA, 27 bp, Artificial Sequence
  Description of Artificial Sequence: Synthetic oligonucleotide
cggcctagacataaatggggccccaga

SEQ ID NO: 313438 - DNA, 28 bp, Artificial Sequence
  Description of Artificial Sequence: Synthetic oligonucleotide
ggcctagacataaatggggccccagatg

SEQ ID NO: 313439 - DNA, 29 bp, Artificial Sequence
  Description of Artificial Sequence: Synthetic oligonucleotide
gcctagacataaatggggccccagatgag

SEQ ID NO: 313440 - DNA, 29 bp, Artificial Sequence
  Description of Artificial Sequence: Synthetic oligonucleotide
cctagacataaatggggccccagatgagc

SEQ ID NO: 313441 - DNA, 29 bp, Artificial Sequence
  Description of Artificial Sequence: Synthetic oligonucleotide
ctagacataaatggggccccagatgagcc

SEQ ID NO: 313442 - DNA, 30 bp, Artificial Sequence
  Description of Artificial Sequence: Synthetic oligonucleotide
tagacataaatggggccccagatgagcctc

SEQ ID NO: 313443 - DNA, 29 bp, Artificial Sequence
  Description of Artificial Sequence: Synthetic oligonucleotide
agacataaatggggccccagatgagcctc

SEQ ID NO: 313444 - DNA, 28 bp, Artificial Sequence
  Description of Artificial Sequence: Synthetic oligonucleotide
gacataaatggggccccagatgagcctc

SEQ ID NO: 313445 - DNA, 29 bp, Artificial Sequence
  Description of Artificial Sequence: Synthetic oligonucleotide
acataaatggggccccagatgagcctctg

SEQ ID NO: 313446 - DNA, 28 bp, Artificial Sequence
  Description of Artificial Sequence: Synthetic oligonucleotide
cataaatggggccccagatgagcctctg

SEQ ID NO: 313447 - DNA, 28 bp, Artificial Sequence
  Description of Artificial Sequence: Synthetic oligonucleotide
ataaatggggccccagatgagcctctgc

SEQ ID NO: 313448 - DNA, 27 bp, Artificial Sequence
  Description of Artificial Sequence: Synthetic oligonucleotide
taaatggggccccagatgagcctctgc

SEQ ID NO: 313449 - DNA, 27 bp, Artificial Sequence
  Description of Artificial Sequence: Synthetic oligonucleotide
aaatggggccccagatgagcctctgca

SEQ ID NO: 313450 - DNA, 26 bp, Artificial Sequence
  Description of Artificial Sequence: Synthetic oligonucleotide
aatggggccccagatgagcctctgca

SEQ ID NO: 313451 - DNA, 25 bp, Artificial Sequence
  Description of Artificial Sequence: Synthetic oligonucleotide
atggggccccagatgagcctctgca

SEQ ID NO: 313452 - DNA, 24 bp, Artificial Sequence
  Description of Artificial Sequence: Synthetic oligonucleotide
tggggccccagatgagcctctgca

SEQ ID NO: 313453 - DNA, 23 bp, Artificial Sequence
  Description of Artificial Sequence: Synthetic oligonucleotide
ggggccccagatgagcctctgca

SEQ ID NO: 313454 - DNA, 23 bp, Artificial Sequence
  Description of Artificial Sequence: Synthetic oligonucleotide
gggccccagatgagcctctgcag

SEQ ID NO: 313455 - DNA, 24 bp, Artificial Sequence
  Description of Artificial Sequence: Synthetic oligonucleotide
ggccccagatgagcctctgcagga

SEQ ID NO: 313456 - DNA, 25 bp, Artificial Sequence
  Description of Artificial Sequence: Synthetic oligonucleotide
gccccagatgagcctctgcaggaga

SEQ ID NO: 313457 - DNA, 26 bp, Artificial Sequence
  Description of Artificial Sequence: Synthetic oligonucleotide
ccccagatgagcctctgcaggagaca

SEQ ID NO: 313458 - DNA, 26 bp, Artificial Sequence
  Description of Artificial Sequence: Synthetic oligonucleotide
cccagatgagcctctgcaggagacag

SEQ ID NO: 313459 - DNA, 26 bp, Artificial Sequence
  Description of Artificial Sequence: Synthetic oligonucleotide
ccagatgagcctctgcaggagacagg

SEQ ID NO: 313460 - DNA, 26 bp, Artificial Sequence
  Description of Artificial Sequence: Synthetic oligonucleotide
cagatgagcctctgcaggagacaggc

SEQ ID NO: 313461 - DNA, 27 bp, Artificial Sequence
  Description of Artificial Sequence: Synthetic oligonucleotide
agatgagcctctgcaggagacaggcct

SEQ ID NO: 313462 - DNA, 26 bp, Artificial Sequence
  Description of Artificial Sequence: Synthetic oligonucleotide
gatgagcctctgcaggagacaggcct

SEQ ID NO: 313463 - DNA, 26 bp, Artificial Sequence
  Description of Artificial Sequence: Synthetic oligonucleotide
atgagcctctgcaggagacaggcctg

SEQ ID NO: 313464 - DNA, 25 bp, Artificial Sequence
  Description of Artificial Sequence: Synthetic oligonucleotide
tgagcctctgcaggagacaggcctg

SEQ ID NO: 313465 - DNA, 24 bp, Artificial Sequence
  Description of Artificial Sequence: Synthetic oligonucleotide
gagcctctgcaggagacaggcctg

SEQ ID NO: 313466 - DNA, 25 bp, Artificial Sequence
  Description of Artificial Sequence: Synthetic oligonucleotide
agcctctgcaggagacaggcctgct

SEQ ID NO: 313467 - DNA, 24 bp, Artificial Sequence
  Description of Artificial Sequence: Synthetic oligonucleotide
gcctctgcaggagacaggcctgct

SEQ ID NO: 313468 - DNA, 26 bp, Artificial Sequence
  Description of Artificial Sequence: Synthetic oligonucleotide
cctctgcaggagacaggcctgctctt

SEQ ID NO: 313469 - DNA, 26 bp, Artificial Sequence
  Description of Artificial Sequence: Synthetic oligonucleotide
ctctgcaggagacaggcctgctcttc

SEQ ID NO: 313470 - DNA, 26 bp, Artificial Sequence
  Description of Artificial Sequence: Synthetic oligonucleotide
tctgcaggagacaggcctgctcttcg

SEQ ID NO: 313471 - DNA, 25 bp, Artificial Sequence
  Description of Artificial Sequence: Synthetic oligonucleotide
ctgcaggagacaggcctgctcttcg

SEQ ID NO: 313472 - DNA, 25 bp, Artificial Sequence
  Description of Artificial Sequence: Synthetic oligonucleotide
tgcaggagacaggcctgctcttcgg

SEQ ID NO: 313473 - DNA, 24 bp, Artificial Sequence
  Description of Artificial Sequence: Synthetic oligonucleotide
gcaggagacaggcctgctcttcgg

SEQ ID NO: 313474 - DNA, 24 bp, Artificial Sequence
  Description of Artificial Sequence: Synthetic oligonucleotide
caggagacaggcctgctcttcggc

SEQ ID NO: 313475 - DNA, 24 bp, Artificial Sequence
  Description of Artificial Sequence: Synthetic oligonucleotide
aggagacaggcctgctcttcggcg

SEQ ID NO: 313476 - DNA, 23 bp, Artificial Sequence
  Description of Artificial Sequence: Synthetic oligonucleotide
ggagacaggcctgctcttcggcg

SEQ ID NO: 313477 - DNA, 23 bp, Artificial Sequence
  Description of Artificial Sequence: Synthetic oligonucleotide
gagacaggcctgctcttcggcgg

SEQ ID NO: 313478 - DNA, 23 bp, Artificial Sequence
  Description of Artificial Sequence: Synthetic oligonucleotide
agacaggcctgctcttcggcggc

SEQ ID NO: 313479 - DNA, 22 bp, Artificial Sequence
  Description of Artificial Sequence: Synthetic oligonucleotide
gacaggcctgctcttcggcggc

SEQ ID NO: 313480 - DNA, 23 bp, Artificial Sequence
  Description of Artificial Sequence: Synthetic oligonucleotide
acaggcctgctcttcggcggcct

SEQ ID NO: 313481 - DNA, 22 bp, Artificial Sequence
  Description of Artificial Sequence: Synthetic oligonucleotide
caggcctgctcttcggcggcct

SEQ ID NO: 313482 - DNA, 22 bp, Artificial Sequence
  Description of Artificial Sequence: Synthetic oligonucleotide
aggcctgctcttcggcggcctg

SEQ ID NO: 313483 - DNA, 21 bp, Artificial Sequence
  Description of Artificial Sequence: Synthetic oligonucleotide
ggcctgctcttcggcggcctg

SEQ ID NO: 313484 - DNA, 22 bp, Artificial Sequence
  Description of Artificial Sequence: Synthetic oligonucleotide
gcctgctcttcggcggcctggt

SEQ ID NO: 313485 - DNA, 22 bp, Artificial Sequence
  Description of Artificial Sequence: Synthetic oligonucleotide
cctgctcttcggcggcctggtg

SEQ ID NO: 313486 - DNA, 22 bp, Artificial Sequence
  Description of Artificial Sequence: Synthetic oligonucleotide
ctgctcttcggcggcctggtgg

SEQ ID NO: 313487 - DNA, 23 bp, Artificial Sequence
  Description of Artificial Sequence: Synthetic oligonucleotide
tgctcttcggcggcctggtgggt

SEQ ID NO: 313488 - DNA, 22 bp, Artificial Sequence
  Description of Artificial Sequence: Synthetic oligonucleotide
gctcttcggcggcctggtgggt

SEQ ID NO: 313489 - DNA, 26 bp, Artificial Sequence
  Description of Artificial Sequence: Synthetic oligonucleotide
ctcttcggcggcctggtgggtgatat

SEQ ID NO: 313490 - DNA, 26 bp, Artificial Sequence
  Description of Artificial Sequence: Synthetic oligonucleotide
tcttcggcggcctggtgggtgatatc

SEQ ID NO: 313491 - DNA, 25 bp, Artificial Sequence
  Description of Artificial Sequence: Synthetic oligonucleotide
cttcggcggcctggtgggtgatatc

SEQ ID NO: 313492 - DNA, 25 bp, Artificial Sequence
  Description of Artificial Sequence: Synthetic oligonucleotide
ttcggcggcctggtgggtgatatcc

SEQ ID NO: 313493 - DNA, 24 bp, Artificial Sequence
  Description of Artificial Sequence: Synthetic oligonucleotide
tcggcggcctggtgggtgatatcc

SEQ ID NO: 313494 - DNA, 23 bp, Artificial Sequence
  Description of Artificial Sequence: Synthetic oligonucleotide
cggcggcctggtgggtgatatcc

SEQ ID NO: 313495 - DNA, 23 bp, Artificial Sequence
  Description of Artificial Sequence: Synthetic oligonucleotide
ggcggcctggtgggtgatatccc

SEQ ID NO: 313496 - DNA, 23 bp, Artificial Sequence
  Description of Artificial Sequence: Synthetic oligonucleotide
gcggcctggtgggtgatatcccg

SEQ ID NO: 313497 - DNA, 23 bp, Artificial Sequence
  Description of Artificial Sequence: Synthetic oligonucleotide
cggcctggtgggtgatatcccgc

SEQ ID NO: 313498 - DNA, 23 bp, Artificial Sequence
  Description of Artificial Sequence: Synthetic oligonucleotide
ggcctggtgggtgatatcccgcg

SEQ ID NO: 313499 - DNA, 23 bp, Artificial Sequence
  Description of Artificial Sequence: Synthetic oligonucleotide
gcctggtgggtgatatcccgcgc

SEQ ID NO: 313500 - DNA, 23 bp, Artificial Sequence
  Description of Artificial Sequence: Synthetic oligonucleotide
cctggtgggtgatatcccgcgcc

SEQ ID NO: 313501 - DNA, 23 bp, Artificial Sequence
  Description of Artificial Sequence: Synthetic oligonucleotide
ctggtgggtgatatcccgcgccg

SEQ ID NO: 313502 - DNA, 25 bp, Artificial Sequence
  Description of Artificial Sequence: Synthetic oligonucleotide
tggtgggtgatatcccgcgccgcta

SEQ ID NO: 313503 - DNA, 24 bp, Artificial Sequence
  Description of Artificial Sequence: Synthetic oligonucleotide
ggtgggtgatatcccgcgccgcta

SEQ ID NO: 313504 - DNA, 24 bp, Artificial Sequence
  Description of Artificial Sequence: Synthetic oligonucleotide
gtgggtgatatcccgcgccgctag

SEQ ID NO: 313505 - DNA, 24 bp, Artificial Sequence
  Description of Artificial Sequence: Synthetic oligonucleotide
tgggtgatatcccgcgccgctagc

SEQ ID NO: 313506 - DNA, 23 bp, Artificial Sequence
  Description of Artificial Sequence: Synthetic oligonucleotide
gggtgatatcccgcgccgctagc

SEQ ID NO: 313507 - DNA, 23 bp, Artificial Sequence
  Description of Artificial Sequence: Synthetic oligonucleotide
ggtgatatcccgcgccgctagcc

SEQ ID NO: 313508 - DNA, 27 bp, Artificial Sequence
  Description of Artificial Sequence: Synthetic oligonucleotide
gtgatatcccgcgccgctagccctatt

SEQ ID NO: 313509 - DNA, 28 bp, Artificial Sequence
  Description of Artificial Sequence: Synthetic oligonucleotide
tgatatcccgcgccgctagccctattac

SEQ ID NO: 313510 - DNA, 27 bp, Artificial Sequence
  Description of Artificial Sequence: Synthetic oligonucleotide
gatatcccgcgccgctagccctattac

SEQ ID NO: 313511 - DNA, 27 bp, Artificial Sequence
  Description of Artificial Sequence: Synthetic oligonucleotide
atatcccgcgccgctagccctattacg

SEQ ID NO: 313512 - DNA, 27 bp, Artificial Sequence
  Description of Artificial Sequence: Synthetic oligonucleotide
tatcccgcgccgctagccctattacgt

SEQ ID NO: 313513 - DNA, 26 bp, Artificial Sequence
  Description of Artificial Sequence: Synthetic oligonucleotide
atcccgcgccgctagccctattacgt

SEQ ID NO: 313514 - DNA, 25 bp, Artificial Sequence
  Description of Artificial Sequence: Synthetic oligonucleotide
tcccgcgccgctagccctattacgt

SEQ ID NO: 313515 - DNA, 24 bp, Artificial Sequence
  Description of Artificial Sequence: Synthetic oligonucleotide
cccgcgccgctagccctattacgt

SEQ ID NO: 313516 - DNA, 25 bp, Artificial Sequence
  Description of Artificial Sequence: Synthetic oligonucleotide
ccgcgccgctagccctattacgtga

SEQ ID NO: 313517 - DNA, 26 bp, Artificial Sequence
  Description of Artificial Sequence: Synthetic oligonucleotide
cgcgccgctagccctattacgtgagt

SEQ ID NO: 313518 - DNA, 27 bp, Artificial Sequence
  Description of Artificial Sequence: Synthetic oligonucleotide
gcgccgctagccctattacgtgagtga

SEQ ID NO: 313519 - DNA, 27 bp, Artificial Sequence
  Description of Artificial Sequence: Synthetic oligonucleotide
cgccgctagccctattacgtgagtgac

SEQ ID NO: 313520 - DNA, 29 bp, Artificial Sequence
  Description of Artificial Sequence: Synthetic oligonucleotide
gccgctagccctattacgtgagtgacaac

SEQ ID NO: 313521 - DNA, 30 bp, Artificial Sequence
  Description of Artificial Sequence: Synthetic oligonucleotide
ccgctagccctattacgtgagtgacaacac

SEQ ID NO: 313522 - DNA, 31 bp, Artificial Sequence
  Description of Artificial Sequence: Synthetic oligonucleotide
cgctagccctattacgtgagtgacaacacag

SEQ ID NO: 313523 - DNA, 33 bp, Artificial Sequence
  Description of Artificial Sequence: Synthetic oligonucleotide
gctagccctattacgtgagtgacaacacagatg

SEQ ID NO: 313524 - DNA, 33 bp, Artificial Sequence
  Description of Artificial Sequence: Synthetic oligonucleotide
ctagccctattacgtgagtgacaacacagatgc

SEQ ID NO: 313525 - DNA, 36 bp, Artificial Sequence
  Description of Artificial Sequence: Synthetic oligonucleotide
tagccctattacgtgagtgacaacacagatgctttc

SEQ ID NO: 313526 - DNA, 35 bp, Artificial Sequence
  Description of Artificial Sequence: Synthetic oligonucleotide
agccctattacgtgagtgacaacacagatgctttc

SEQ ID NO: 313527 - DNA, 34 bp, Artificial Sequence
  Description of Artificial Sequence: Synthetic oligonucleotide
gccctattacgtgagtgacaacacagatgctttc

SEQ ID NO: 313528 - DNA, 35 bp, Artificial Sequence
  Description of Artificial Sequence: Synthetic oligonucleotide
ccctattacgtgagtgacaacacagatgctttcag

SEQ ID NO: 313529 - DNA, 35 bp, Artificial Sequence
  Description of Artificial Sequence: Synthetic oligonucleotide
cctattacgtgagtgacaacacagatgctttcagc

SEQ ID NO: 313530 - DNA, 35 bp, Artificial Sequence
  Description of Artificial Sequence: Synthetic oligonucleotide
ctattacgtgagtgacaacacagatgctttcagcc

SEQ ID NO: 313531 - DNA, 35 bp, Artificial Sequence
  Description of Artificial Sequence: Synthetic oligonucleotide
tattacgtgagtgacaacacagatgctttcagccc

SEQ ID NO: 313532 - DNA, 34 bp, Artificial Sequence
  Description of Artificial Sequence: Synthetic oligonucleotide
attacgtgagtgacaacacagatgctttcagccc

SEQ ID NO: 313533 - DNA, 33 bp, Artificial Sequence
  Description of Artificial Sequence: Synthetic oligonucleotide
ttacgtgagtgacaacacagatgctttcagccc

SEQ ID NO: 313534 - DNA, 32 bp, Artificial Sequence
  Description of Artificial Sequence: Synthetic oligonucleotide
tacgtgagtgacaacacagatgctttcagccc

SEQ ID NO: 313535 - DNA, 31 bp, Artificial Sequence
  Description of Artificial Sequence: Synthetic oligonucleotide
acgtgagtgacaacacagatgctttcagccc

SEQ ID NO: 313536 - DNA, 30 bp, Artificial Sequence
  Description of Artificial Sequence: Synthetic oligonucleotide
cgtgagtgacaacacagatgctttcagccc

SEQ ID NO: 313537 - DNA, 30 bp, Artificial Sequence
  Description of Artificial Sequence: Synthetic oligonucleotide
gtgagtgacaacacagatgctttcagcccc

SEQ ID NO: 313538 - DNA, 30 bp, Artificial Sequence
  Description of Artificial Sequence: Synthetic oligonucleotide
tgagtgacaacacagatgctttcagccccg

SEQ ID NO: 313539 - DNA, 29 bp, Artificial Sequence
  Description of Artificial Sequence: Synthetic oligonucleotide
gagtgacaacacagatgctttcagccccg

SEQ ID NO: 313540 - DNA, 30 bp, Artificial Sequence
  Description of Artificial Sequence: Synthetic oligonucleotide
agtgacaacacagatgctttcagccccgag

SEQ ID NO: 313541 - DNA, 29 bp, Artificial Sequence
  Description of Artificial Sequence: Synthetic oligonucleotide
gtgacaacacagatgctttcagccccgag

SEQ ID NO: 313542 - DNA, 29 bp, Artificial Sequence
  Description of Artificial Sequence: Synthetic oligonucleotide
tgacaacacagatgctttcagccccgagg

SEQ ID NO: 313543 - DNA, 28 bp, Artificial Sequence
  Description of Artificial Sequence: Synthetic oligonucleotide
gacaacacagatgctttcagccccgagg

SEQ ID NO: 313544 - DNA, 29 bp, Artificial Sequence
  Description of Artificial Sequence: Synthetic oligonucleotide
acaacacagatgctttcagccccgaggtc

SEQ ID NO: 313545 - DNA, 28 bp, Artificial Sequence
  Description of Artificial Sequence: Synthetic oligonucleotide
caacacagatgctttcagccccgaggtc

SEQ ID NO: 313546 - DNA, 28 bp, Artificial Sequence
  Description of Artificial Sequence: Synthetic oligonucleotide
aacacagatgctttcagccccgaggtcc

SEQ ID NO: 313547 - DNA, 27 bp, Artificial Sequence
  Description of Artificial Sequence: Synthetic oligonucleotide
acacagatgctttcagccccgaggtcc

SEQ ID NO: 313548 - DNA, 27 bp, Artificial Sequence
  Description of Artificial Sequence: Synthetic oligonucleotide
cacagatgctttcagccccgaggtcct

SEQ ID NO: 313549 - DNA, 27 bp, Artificial Sequence
  Description of Artificial Sequence: Synthetic oligonucleotide
acagatgctttcagccccgaggtcctg

SEQ ID NO: 313550 - DNA, 26 bp, Artificial Sequence
  Description of Artificial Sequence: Synthetic oligonucleotide
cagatgctttcagccccgaggtcctg

SEQ ID NO: 313551 - DNA, 26 bp, Artificial Sequence
  Description of Artificial Sequence: Synthetic oligonucleotide
agatgctttcagccccgaggtcctgg

SEQ ID NO: 313552 - DNA, 25 bp, Artificial Sequence
  Description of Artificial Sequence: Synthetic oligonucleotide
gatgctttcagccccgaggtcctgg

SEQ ID NO: 313553 - DNA, 26 bp, Artificial Sequence
  Description of Artificial Sequence: Synthetic oligonucleotide
atgctttcagccccgaggtcctgggt

SEQ ID NO: 313554 - DNA, 25 bp, Artificial Sequence
  Description of Artificial Sequence: Synthetic oligonucleotide
tgctttcagccccgaggtcctgggt

SEQ ID NO: 313555 - DNA, 24 bp, Artificial Sequence
  Description of Artificial Sequence: Synthetic oligonucleotide
gctttcagccccgaggtcctgggt

SEQ ID NO: 313556 - DNA, 24 bp, Artificial Sequence
  Description of Artificial Sequence: Synthetic oligonucleotide
ctttcagccccgaggtcctgggtg

SEQ ID NO: 313557 - DNA, 24 bp, Artificial Sequence
  Description of Artificial Sequence: Synthetic oligonucleotide
tttcagccccgaggtcctgggtgc

SEQ ID NO: 313558 - DNA, 23 bp, Artificial Sequence
  Description of Artificial Sequence: Synthetic oligonucleotide
ttcagccccgaggtcctgggtgc

SEQ ID NO: 313559 - DNA, 22 bp, Artificial Sequence
  Description of Artificial Sequence: Synthetic oligonucleotide
tcagccccgaggtcctgggtgc

SEQ ID NO: 313560 - DNA, 21 bp, Artificial Sequence
  Description of Artificial Sequence: Synthetic oligonucleotide
cagccccgaggtcctgggtgc

SEQ ID NO: 313561 - DNA, 21 bp, Artificial Sequence
  Description of Artificial Sequence: Synthetic oligonucleotide
agccccgaggtcctgggtgcc

SEQ ID NO: 313562 - DNA, 20 bp, Artificial Sequence
  Description of Artificial Sequence: Synthetic oligonucleotide
gccccgaggtcctgggtgcc

SEQ ID NO: 313563 - DNA, 21 bp, Artificial Sequence
  Description of Artificial Sequence: Synthetic oligonucleotide
ccccgaggtcctgggtgccgt

SEQ ID NO: 313564 - DNA, 23 bp, Artificial Sequence
  Description of Artificial Sequence: Synthetic oligonucleotide
cccgaggtcctgggtgccgtcat

SEQ ID NO: 313565 - DNA, 25 bp, Artificial Sequence
  Description of Artificial Sequence: Synthetic oligonucleotide
ccgaggtcctgggtgccgtcatgtt

SEQ ID NO: 313566 - DNA, 27 bp, Artificial Sequence
  Description of Artificial Sequence: Synthetic oligonucleotide
cgaggtcctgggtgccgtcatgttcat

SEQ ID NO: 313567 - DNA, 27 bp, Artificial Sequence
  Description of Artificial Sequence: Synthetic oligonucleotide
gaggtcctgggtgccgtcatgttcatc

SEQ ID NO: 313568 - DNA, 29 bp, Artificial Sequence
  Description of Artificial Sequence: Synthetic oligonucleotide
aggtcctgggtgccgtcatgttcatctac

SEQ ID NO: 313569 - DNA, 28 bp, Artificial Sequence
  Description of Artificial Sequence: Synthetic oligonucleotide
ggtcctgggtgccgtcatgttcatctac

SEQ ID NO: 313570 - DNA, 31 bp, Artificial Sequence
  Description of Artificial Sequence: Synthetic oligonucleotide
gtcctgggtgccgtcatgttcatctacattg

SEQ ID NO: 313571 - DNA, 31 bp, Artificial Sequence
  Description of Artificial Sequence: Synthetic oligonucleotide
tcctgggtgccgtcatgttcatctacattgc

SEQ ID NO: 313572 - DNA, 30 bp, Artificial Sequence
  Description of Artificial Sequence: Synthetic oligonucleotide
cctgggtgccgtcatgttcatctacattgc

SEQ ID NO: 313573 - DNA, 31 bp, Artificial Sequence
  Description of Artificial Sequence: Synthetic oligonucleotide
ctgggtgccgtcatgttcatctacattgctg

SEQ ID NO: 313574 - DNA, 31 bp, Artificial Sequence
  Description of Artificial Sequence: Synthetic oligonucleotide
tgggtgccgtcatgttcatctacattgctgc

SEQ ID NO: 313575 - DNA, 30 bp, Artificial Sequence
  Description of Artificial Sequence: Synthetic oligonucleotide
gggtgccgtcatgttcatctacattgctgc

SEQ ID NO: 313576 - DNA, 31 bp, Artificial Sequence
  Description of Artificial Sequence: Synthetic oligonucleotide
ggtgccgtcatgttcatctacattgctgcac

SEQ ID NO: 313577 - DNA, 32 bp, Artificial Sequence
  Description of Artificial Sequence: Synthetic oligonucleotide
gtgccgtcatgttcatctacattgctgcacag

SEQ ID NO: 313578 - DNA, 33 bp, Artificial Sequence
  Description of Artificial Sequence: Synthetic oligonucleotide
tgccgtcatgttcatctacattgctgcacagtc

SEQ ID NO: 313579 - DNA, 32 bp, Artificial Sequence
  Description of Artificial Sequence: Synthetic oligonucleotide
gccgtcatgttcatctacattgctgcacagtc

SEQ ID NO: 313580 - DNA, 33 bp, Artificial Sequence
  Description of Artificial Sequence: Synthetic oligonucleotide
ccgtcatgttcatctacattgctgcacagtcac

SEQ ID NO: 313581 - DNA, 33 bp, Artificial Sequence
  Description of Artificial Sequence: Synthetic oligonucleotide
cgtcatgttcatctacattgctgcacagtcacc

SEQ ID NO: 313582 - DNA, 33 bp, Artificial Sequence
  Description of Artificial Sequence: Synthetic oligonucleotide
gtcatgttcatctacattgctgcacagtcaccc

SEQ ID NO: 313583 - DNA, 33 bp, Artificial Sequence
  Description of Artificial Sequence: Synthetic oligonucleotide
tcatgttcatctacattgctgcacagtcacccg

SEQ ID NO: 313584 - DNA, 32 bp, Artificial Sequence
  Description of Artificial Sequence: Synthetic oligonucleotide
catgttcatctacattgctgcacagtcacccg

SEQ ID NO: 313585 - DNA, 32 bp, Artificial Sequence
  Description of Artificial Sequence: Synthetic oligonucleotide
atgttcatctacattgctgcacagtcacccgc

SEQ ID NO: 313586 - DNA, 31 bp, Artificial Sequence
  Description of Artificial Sequence: Synthetic oligonucleotide
tgttcatctacattgctgcacagtcacccgc

SEQ ID NO: 313587 - DNA, 30 bp, Artificial Sequence
  Description of Artificial Sequence: Synthetic oligonucleotide
gttcatctacattgctgcacagtcacccgc

SEQ ID NO: 313588 - DNA, 30 bp, Artificial Sequence
  Description of Artificial Sequence: Synthetic oligonucleotide
ttcatctacattgctgcacagtcacccgcg

SEQ ID NO: 313589 - DNA, 29 bp, Artificial Sequence
  Description of Artificial Sequence: Synthetic oligonucleotide
tcatctacattgctgcacagtcacccgcg

SEQ ID NO: 313590 - DNA, 28 bp, Artificial Sequence
  Description of Artificial Sequence: Synthetic oligonucleotide
catctacattgctgcacagtcacccgcg

SEQ ID NO: 313591 - DNA, 30 bp, Artificial Sequence
  Description of Artificial Sequence: Synthetic oligonucleotide
atctacattgctgcacagtcacccgcgatc

SEQ ID NO: 313592 - DNA, 29 bp, Artificial Sequence
  Description of Artificial Sequence: Synthetic oligonucleotide
tctacattgctgcacagtcacccgcgatc

SEQ ID NO: 313593 - DNA, 28 bp, Artificial Sequence
  Description of Artificial Sequence: Synthetic oligonucleotide
ctacattgctgcacagtcacccgcgatc

SEQ ID NO: 313594 - DNA, 29 bp, Artificial Sequence
  Description of Artificial Sequence: Synthetic oligonucleotide
tacattgctgcacagtcacccgcgatcac

SEQ ID NO: 313595 - DNA, 28 bp, Artificial Sequence
  Description of Artificial Sequence: Synthetic oligonucleotide
acattgctgcacagtcacccgcgatcac

SEQ ID NO: 313596 - DNA, 27 bp, Artificial Sequence
  Description of Artificial Sequence: Synthetic oligonucleotide
cattgctgcacagtcacccgcgatcac

SEQ ID NO: 313597 - DNA, 27 bp, Artificial Sequence
  Description of Artificial Sequence: Synthetic oligonucleotide
attgctgcacagtcacccgcgatcacc

SEQ ID NO: 313598 - DNA, 27 bp, Artificial Sequence
  Description of Artificial Sequence: Synthetic oligonucleotide
ttgctgcacagtcacccgcgatcacct

SEQ ID NO: 313599 - DNA, 27 bp, Artificial Sequence
  Description of Artificial Sequence: Synthetic oligonucleotide
tgctgcacagtcacccgcgatcacctt

SEQ ID NO: 313600 - DNA, 26 bp, Artificial Sequence
  Description of Artificial Sequence: Synthetic oligonucleotide
gctgcacagtcacccgcgatcacctt

SEQ ID NO: 313601 - DNA, 26 bp, Artificial Sequence
  Description of Artificial Sequence: Synthetic oligonucleotide
ctgcacagtcacccgcgatcaccttc

SEQ ID NO: 313602 - DNA, 26 bp, Artificial Sequence
  Description of Artificial Sequence: Synthetic oligonucleotide
tgcacagtcacccgcgatcaccttcc

SEQ ID NO: 313603 - DNA, 25 bp, Artificial Sequence
  Description of Artificial Sequence: Synthetic oligonucleotide
gcacagtcacccgcgatcaccttcc

SEQ ID NO: 313604 - DNA, 25 bp, Artificial Sequence
  Description of Artificial Sequence: Synthetic oligonucleotide
cacagtcacccgcgatcaccttccg

SEQ ID NO: 313605 - DNA, 25 bp, Artificial Sequence
  Description of Artificial Sequence: Synthetic oligonucleotide
acagtcacccgcgatcaccttccgc

SEQ ID NO: 313606 - DNA, 24 bp, Artificial Sequence
  Description of Artificial Sequence: Synthetic oligonucleotide
cagtcacccgcgatcaccttccgc

SEQ ID NO: 313607 - DNA, 24 bp, Artificial Sequence
  Description of Artificial Sequence: Synthetic oligonucleotide
agtcacccgcgatcaccttccgcg

SEQ ID NO: 313608 - DNA, 23 bp, Artificial Sequence
  Description of Artificial Sequence: Synthetic oligonucleotide
gtcacccgcgatcaccttccgcg

SEQ ID NO: 313609 - DNA, 23 bp, Artificial Sequence
  Description of Artificial Sequence: Synthetic oligonucleotide
tcacccgcgatcaccttccgcgg

SEQ ID NO: 313610 - DNA, 22 bp, Artificial Sequence
  Description of Artificial Sequence: Synthetic oligonucleotide
cacccgcgatcaccttccgcgg

SEQ ID NO: 313611 - DNA, 22 bp, Artificial Sequence
  Description of Artificial Sequence: Synthetic oligonucleotide
acccgcgatcaccttccgcggc

SEQ ID NO: 313612 - DNA, 21 bp, Artificial Sequence
  Description of Artificial Sequence: Synthetic oligonucleotide
cccgcgatcaccttccgcggc

SEQ ID NO: 313613 - DNA, 22 bp, Artificial Sequence
  Description of Artificial Sequence: Synthetic oligonucleotide
ccgcgatcaccttccgcggcct

SEQ ID NO: 313614 - DNA, 22 bp, Artificial Sequence
  Description of Artificial Sequence: Synthetic oligonucleotide
cgcgatcaccttccgcggcctc

SEQ ID NO: 313615 - DNA, 23 bp, Artificial Sequence
  Description of Artificial Sequence: Synthetic oligonucleotide
gcgatcaccttccgcggcctcca

SEQ ID NO: 313616 - DNA, 23 bp, Artificial Sequence
  Description of Artificial Sequence: Synthetic oligonucleotide
cgatcaccttccgcggcctccag

SEQ ID NO: 313617 - DNA, 23 bp, Artificial Sequence
  Description of Artificial Sequence: Synthetic oligonucleotide
gatcaccttccgcggcctccagg

SEQ ID NO: 313618 - DNA, 24 bp, Artificial Sequence
  Description of Artificial Sequence: Synthetic oligonucleotide
atcaccttccgcggcctccaggga

SEQ ID NO: 313619 - DNA, 23 bp, Artificial Sequence
  Description of Artificial Sequence: Synthetic oligonucleotide
tcaccttccgcggcctccaggga

SEQ ID NO: 313620 - DNA, 22 bp, Artificial Sequence
  Description of Artificial Sequence: Synthetic oligonucleotide
caccttccgcggcctccaggga

SEQ ID NO: 313621 - DNA, 26 bp, Artificial Sequence
  Description of Artificial Sequence: Synthetic oligonucleotide
accttccgcggcctccagggagaaaa

SEQ ID NO: 313622 - DNA, 25 bp, Artificial Sequence
  Description of Artificial Sequence: Synthetic oligonucleotide
ccttccgcggcctccagggagaaaa

SEQ ID NO: 313623 - DNA, 26 bp, Artificial Sequence
  Description of Artificial Sequence: Synthetic oligonucleotide
cttccgcggcctccagggagaaaaca

SEQ ID NO: 313624 - DNA, 26 bp, Artificial Sequence
  Description of Artificial Sequence: Synthetic oligonucleotide
ttccgcggcctccagggagaaaacac

SEQ ID NO: 313625 - DNA, 25 bp, Artificial Sequence
  Description of Artificial Sequence: Synthetic oligonucleotide
tccgcggcctccagggagaaaacac

SEQ ID NO: 313626 - DNA, 24 bp, Artificial Sequence
  Description of Artificial Sequence: Synthetic oligonucleotide
ccgcggcctccagggagaaaacac

SEQ ID NO: 313627 - DNA, 24 bp, Artificial Sequence
  Description of Artificial Sequence: Synthetic oligonucleotide
cgcggcctccagggagaaaacacc

SEQ ID NO: 313628 - DNA, 24 bp, Artificial Sequence
  Description of Artificial Sequence: Synthetic oligonucleotide
gcggcctccagggagaaaacaccc

SEQ ID NO: 313629 - DNA, 24 bp, Artificial Sequence
  Description of Artificial Sequence: Synthetic oligonucleotide
cggcctccagggagaaaacacccg

SEQ ID NO: 313630 - DNA, 26 bp, Artificial Sequence
  Description of Artificial Sequence: Synthetic oligonucleotide
ggcctccagggagaaaacacccggaa

SEQ ID NO: 313631 - DNA, 26 bp, Artificial Sequence
  Description of Artificial Sequence: Synthetic oligonucleotide
gcctccagggagaaaacacccggaac

SEQ ID NO: 313632 - DNA, 27 bp, Artificial Sequence
  Description of Artificial Sequence: Synthetic oligonucleotide
cctccagggagaaaacacccggaacga

SEQ ID NO: 313633 - DNA, 27 bp, Artificial Sequence
  Description of Artificial Sequence: Synthetic oligonucleotide
ctccagggagaaaacacccggaacgag

SEQ ID NO: 313634 - DNA, 29 bp, Artificial Sequence
  Description of Artificial Sequence: Synthetic oligonucleotide
tccagggagaaaacacccggaacgagatg

SEQ ID NO: 313635 - DNA, 28 bp, Artificial Sequence
  Description of Artificial Sequence: Synthetic oligonucleotide
ccagggagaaaacacccggaacgagatg

SEQ ID NO: 313636 - DNA, 28 bp, Artificial Sequence
  Description of Artificial Sequence: Synthetic oligonucleotide
cagggagaaaacacccggaacgagatgg

SEQ ID NO: 313637 - DNA, 28 bp, Artificial Sequence
  Description of Artificial Sequence: Synthetic oligonucleotide
agggagaaaacacccggaacgagatggg

SEQ ID NO: 313638 - DNA, 27 bp, Artificial Sequence
  Description of Artificial Sequence: Synthetic oligonucleotide
gggagaaaacacccggaacgagatggg

SEQ ID NO: 313639 - DNA, 28 bp, Artificial Sequence
  Description of Artificial Sequence: Synthetic oligonucleotide
ggagaaaacacccggaacgagatgggag

SEQ ID NO: 313640 - DNA, 29 bp, Artificial Sequence
  Description of Artificial Sequence: Synthetic oligonucleotide
gagaaaacacccggaacgagatgggagag

SEQ ID NO: 313641 - DNA, 30 bp, Artificial Sequence
  Description of Artificial Sequence: Synthetic oligonucleotide
agaaaacacccggaacgagatgggagagtc

SEQ ID NO: 313642 - DNA, 29 bp, Artificial Sequence
  Description of Artificial Sequence: Synthetic oligonucleotide
gaaaacacccggaacgagatgggagagtc

SEQ ID NO: 313643 - DNA, 29 bp, Artificial Sequence
  Description of Artificial Sequence: Synthetic oligonucleotide
aaaacacccggaacgagatgggagagtcg

SEQ ID NO: 313644 - DNA, 28 bp, Artificial Sequence
  Description of Artificial Sequence: Synthetic oligonucleotide
aaacacccggaacgagatgggagagtcg

SEQ ID NO: 313645 - DNA, 27 bp, Artificial Sequence
  Description of Artificial Sequence: Synthetic oligonucleotide
aacacccggaacgagatgggagagtcg

SEQ ID NO: 313646 - DNA, 26 bp, Artificial Sequence
  Description of Artificial Sequence: Synthetic oligonucleotide
acacccggaacgagatgggagagtcg

SEQ ID NO: 313647 - DNA, 25 bp, Artificial Sequence
  Description of Artificial Sequence: Synthetic oligonucleotide
cacccggaacgagatgggagagtcg

SEQ ID NO: 313648 - DNA, 26 bp, Artificial Sequence
  Description of Artificial Sequence: Synthetic oligonucleotide
acccggaacgagatgggagagtcgga

SEQ ID NO: 313649 - DNA, 25 bp, Artificial Sequence
  Description of Artificial Sequence: Synthetic oligonucleotide
cccggaacgagatgggagagtcgga

SEQ ID NO: 313650 - DNA, 25 bp, Artificial Sequence
  Description of Artificial Sequence: Synthetic oligonucleotide
ccggaacgagatgggagagtcggag

SEQ ID NO: 313651 - DNA, 26 bp, Artificial Sequence
  Description of Artificial Sequence: Synthetic oligonucleotide
cggaacgagatgggagagtcggagct

SEQ ID NO: 313652 - DNA, 26 bp, Artificial Sequence
  Description of Artificial Sequence: Synthetic oligonucleotide
ggaacgagatgggagagtcggagctc

SEQ ID NO: 313653 - DNA, 27 bp, Artificial Sequence
  Description of Artificial Sequence: Synthetic oligonucleotide
gaacgagatgggagagtcggagctcct

SEQ ID NO: 313654 - DNA, 27 bp, Artificial Sequence
  Description of Artificial Sequence: Synthetic oligonucleotide
aacgagatgggagagtcggagctcctg

SEQ ID NO: 313655 - DNA, 27 bp, Artificial Sequence
  Description of Artificial Sequence: Synthetic oligonucleotide
acgagatgggagagtcggagctcctga

SEQ ID NO: 313656 - DNA, 27 bp, Artificial Sequence
  Description of Artificial Sequence: Synthetic oligonucleotide
cgagatgggagagtcggagctcctgat

SEQ ID NO: 313657 - DNA, 27 bp, Artificial Sequence
  Description of Artificial Sequence: Synthetic oligonucleotide
gagatgggagagtcggagctcctgatc

SEQ ID NO: 313658 - DNA, 28 bp, Artificial Sequence
  Description of Artificial Sequence: Synthetic oligonucleotide
agatgggagagtcggagctcctgatctc

SEQ ID NO: 313659 - DNA, 27 bp, Artificial Sequence
  Description of Artificial Sequence: Synthetic oligonucleotide
gatgggagagtcggagctcctgatctc

SEQ ID NO: 313660 - DNA, 27 bp, Artificial Sequence
  Description of Artificial Sequence: Synthetic oligonucleotide
atgggagagtcggagctcctgatctcc

SEQ ID NO: 313661 - DNA, 27 bp, Artificial Sequence
  Description of Artificial Sequence: Synthetic oligonucleotide
tgggagagtcggagctcctgatctcct

SEQ ID NO: 313662 - DNA, 26 bp, Artificial Sequence
  Description of Artificial Sequence: Synthetic oligonucleotide
gggagagtcggagctcctgatctcct

SEQ ID NO: 313663 - DNA, 27 bp, Artificial Sequence
  Description of Artificial Sequence: Synthetic oligonucleotide
ggagagtcggagctcctgatctcctct

SEQ ID NO: 313664 - DNA, 27 bp, Artificial Sequence
  Description of Artificial Sequence: Synthetic oligonucleotide
gagagtcggagctcctgatctcctctg

SEQ ID NO: 313665 - DNA, 27 bp, Artificial Sequence
  Description of Artificial Sequence: Synthetic oligonucleotide
agagtcggagctcctgatctcctctgc

SEQ ID NO: 313666 - DNA, 27 bp, Artificial Sequence
  Description of Artificial Sequence: Synthetic oligonucleotide
gagtcggagctcctgatctcctctgca

SEQ ID NO: 313667 - DNA, 27 bp, Artificial Sequence
  Description of Artificial Sequence: Synthetic oligonucleotide
agtcggagctcctgatctcctctgcag

SEQ ID NO: 313668 - DNA, 27 bp, Artificial Sequence
  Description of Artificial Sequence: Synthetic oligonucleotide
gtcggagctcctgatctcctctgcagt

SEQ ID NO: 313669 - DNA, 27 bp, Artificial Sequence
  Description of Artificial Sequence: Synthetic oligonucleotide
tcggagctcctgatctcctctgcagtg

SEQ ID NO: 313670 - DNA, 26 bp, Artificial Sequence
  Description of Artificial Sequence: Synthetic oligonucleotide
cggagctcctgatctcctctgcagtg

SEQ ID NO: 313671 - DNA, 27 bp, Artificial Sequence
  Description of Artificial Sequence: Synthetic oligonucleotide
ggagctcctgatctcctctgcagtgct

SEQ ID NO: 313672 - DNA, 27 bp, Artificial Sequence
  Description of Artificial Sequence: Synthetic oligonucleotide
gagctcctgatctcctctgcagtgctg

SEQ ID NO: 313673 - DNA, 27 bp, Artificial Sequence
  Description of Artificial Sequence: Synthetic oligonucleotide
agctcctgatctcctctgcagtgctgg

SEQ ID NO: 313674 - DNA, 26 bp, Artificial Sequence
  Description of Artificial Sequence: Synthetic oligonucleotide
gctcctgatctcctctgcagtgctgg

SEQ ID NO: 313675 - DNA, 26 bp, Artificial Sequence
  Description of Artificial Sequence: Synthetic oligonucleotide
ctcctgatctcctctgcagtgctggg

SEQ ID NO: 313676 - DNA, 27 bp, Artificial Sequence
  Description of Artificial Sequence: Synthetic oligonucleotide
tcctgatctcctctgcagtgctgggca

SEQ ID NO: 313677 - DNA, 27 bp, Artificial Sequence
  Description of Artificial Sequence: Synthetic oligonucleotide
cctgatctcctctgcagtgctgggcat

SEQ ID NO: 313678 - DNA, 28 bp, Artificial Sequence
  Description of Artificial Sequence: Synthetic oligonucleotide
ctgatctcctctgcagtgctgggcattc

SEQ ID NO: 313679 - DNA, 29 bp, Artificial Sequence
  Description of Artificial Sequence: Synthetic oligonucleotide
tgatctcctctgcagtgctgggcattctg

SEQ ID NO: 313680 - DNA, 28 bp, Artificial Sequence
  Description of Artificial Sequence: Synthetic oligonucleotide
gatctcctctgcagtgctgggcattctg

SEQ ID NO: 313681 - DNA, 30 bp, Artificial Sequence
  Description of Artificial Sequence: Synthetic oligonucleotide
atctcctctgcagtgctgggcattctgttc

SEQ ID NO: 313682 - DNA, 29 bp, Artificial Sequence
  Description of Artificial Sequence: Synthetic oligonucleotide
tctcctctgcagtgctgggcattctgttc

SEQ ID NO: 313683 - DNA, 28 bp, Artificial Sequence
  Description of Artificial Sequence: Synthetic oligonucleotide
ctcctctgcagtgctgggcattctgttc

SEQ ID NO: 313684 - DNA, 28 bp, Artificial Sequence
  Description of Artificial Sequence: Synthetic oligonucleotide
tcctctgcagtgctgggcattctgttcg

SEQ ID NO: 313685 - DNA, 27 bp, Artificial Sequence
  Description of Artificial Sequence: Synthetic oligonucleotide
cctctgcagtgctgggcattctgttcg

SEQ ID NO: 313686 - DNA, 27 bp, Artificial Sequence
  Description of Artificial Sequence: Synthetic oligonucleotide
ctctgcagtgctgggcattctgttcgc

SEQ ID NO: 313687 - DNA, 27 bp, Artificial Sequence
  Description of Artificial Sequence: Synthetic oligonucleotide
tctgcagtgctgggcattctgttcgcc

SEQ ID NO: 313688 - DNA, 26 bp, Artificial Sequence
  Description of Artificial Sequence: Synthetic oligonucleotide
ctgcagtgctgggcattctgttcgcc

SEQ ID NO: 313689 - DNA, 27 bp, Artificial Sequence
  Description of Artificial Sequence: Synthetic oligonucleotide
tgcagtgctgggcattctgttcgccct

SEQ ID NO: 313690 - DNA, 26 bp, Artificial Sequence
  Description of Artificial Sequence: Synthetic oligonucleotide
gcagtgctgggcattctgttcgccct

SEQ ID NO: 313691 - DNA, 26 bp, Artificial Sequence
  Description of Artificial Sequence: Synthetic oligonucleotide
cagtgctgggcattctgttcgccctg

SEQ ID NO: 313692 - DNA, 27 bp, Artificial Sequence
  Description of Artificial Sequence: Synthetic oligonucleotide
agtgctgggcattctgttcgccctggt

SEQ ID NO: 313693 - DNA, 26 bp, Artificial Sequence
  Description of Artificial Sequence: Synthetic oligonucleotide
gtgctgggcattctgttcgccctggt

SEQ ID NO: 313694 - DNA, 26 bp, Artificial Sequence
  Description of Artificial Sequence: Synthetic oligonucleotide
tgctgggcattctgttcgccctggtg

SEQ ID NO: 313695 - DNA, 25 bp, Artificial Sequence
  Description of Artificial Sequence: Synthetic oligonucleotide
gctgggcattctgttcgccctggtg

SEQ ID NO: 313696 - DNA, 25 bp, Artificial Sequence
  Description of Artificial Sequence: Synthetic oligonucleotide
ctgggcattctgttcgccctggtgg

SEQ ID NO: 313697 - DNA, 25 bp, Artificial Sequence
  Description of Artificial Sequence: Synthetic oligonucleotide
tgggcattctgttcgccctggtggg

SEQ ID NO: 313698 - DNA, 24 bp, Artificial Sequence
  Description of Artificial Sequence: Synthetic oligonucleotide
gggcattctgttcgccctggtggg

SEQ ID NO: 313699 - DNA, 24 bp, Artificial Sequence
  Description of Artificial Sequence: Synthetic oligonucleotide
ggcattctgttcgccctggtgggg

SEQ ID NO: 313700 - DNA, 24 bp, Artificial Sequence
  Description of Artificial Sequence: Synthetic oligonucleotide
gcattctgttcgccctggtggggg

SEQ ID NO: 313701 - DNA, 25 bp, Artificial Sequence
  Description of Artificial Sequence: Synthetic oligonucleotide
cattctgttcgccctggtgggggct

SEQ ID NO: 313702 - DNA, 26 bp, Artificial Sequence
  Description of Artificial Sequence: Synthetic oligonucleotide
attctgttcgccctggtgggggctct

SEQ ID NO: 313703 - DNA, 25 bp, Artificial Sequence
  Description of Artificial Sequence: Synthetic oligonucleotide
ttctgttcgccctggtgggggctct

SEQ ID NO: 313704 - DNA, 24 bp, Artificial Sequence
  Description of Artificial Sequence: Synthetic oligonucleotide
tctgttcgccctggtgggggctct

SEQ ID NO: 313705 - DNA, 23 bp, Artificial Sequence
  Description of Artificial Sequence: Synthetic oligonucleotide
ctgttcgccctggtgggggctct

SEQ ID NO: 313706 - DNA, 23 bp, Artificial Sequence
  Description of Artificial Sequence: Synthetic oligonucleotide
tgttcgccctggtgggggctctg

SEQ ID NO: 313707 - DNA, 22 bp, Artificial Sequence
  Description of Artificial Sequence: Synthetic oligonucleotide
gttcgccctggtgggggctctg

SEQ ID NO: 313708 - DNA, 22 bp, Artificial Sequence
  Description of Artificial Sequence: Synthetic oligonucleotide
ttcgccctggtgggggctctgc

SEQ ID NO: 313709 - DNA, 21 bp, Artificial Sequence
  Description of Artificial Sequence: Synthetic oligonucleotide
tcgccctggtgggggctctgc

SEQ ID NO: 313710 - DNA, 20 bp, Artificial Sequence
  Description of Artificial Sequence: Synthetic oligonucleotide
cgccctggtgggggctctgc

SEQ ID NO: 313711 - DNA, 20 bp, Artificial Sequence
  Description of Artificial Sequence: Synthetic oligonucleotide
gccctggtgggggctctgcc

SEQ ID NO: 313712 - DNA, 20 bp, Artificial Sequence
  Description of Artificial Sequence: Synthetic oligonucleotide
ccctggtgggggctctgccc

SEQ ID NO: 313713 - DNA, 21 bp, Artificial Sequence
  Description of Artificial Sequence: Synthetic oligonucleotide
cctggtgggggctctgcccct

SEQ ID NO: 313714 - DNA, 21 bp, Artificial Sequence
  Description of Artificial Sequence: Synthetic oligonucleotide
ctggtgggggctctgcccctg

SEQ ID NO: 313715 - DNA, 23 bp, Artificial Sequence
  Description of Artificial Sequence: Synthetic oligonucleotide
tggtgggggctctgcccctgcta

SEQ ID NO: 313716 - DNA, 22 bp, Artificial Sequence
  Description of Artificial Sequence: Synthetic oligonucleotide
ggtgggggctctgcccctgcta

SEQ ID NO: 313717 - DNA, 23 bp, Artificial Sequence
  Description of Artificial Sequence: Synthetic oligonucleotide
gtgggggctctgcccctgctagt

SEQ ID NO: 313718 - DNA, 23 bp, Artificial Sequence
  Description of Artificial Sequence: Synthetic oligonucleotide
tgggggctctgcccctgctagtg

SEQ ID NO: 313719 - DNA, 22 bp, Artificial Sequence
  Description of Artificial Sequence: Synthetic oligonucleotide
gggggctctgcccctgctagtg

SEQ ID NO: 313720 - DNA, 23 bp, Artificial Sequence
  Description of Artificial Sequence: Synthetic oligonucleotide
ggggctctgcccctgctagtggt

SEQ ID NO: 313721 - DNA, 23 bp, Artificial Sequence
  Description of Artificial Sequence: Synthetic oligonucleotide
gggctctgcccctgctagtggtc

SEQ ID NO: 313722 - DNA, 23 bp, Artificial Sequence
  Description of Artificial Sequence: Synthetic oligonucleotide
ggctctgcccctgctagtggtcg

SEQ ID NO: 313723 - DNA, 23 bp, Artificial Sequence
  Description of Artificial Sequence: Synthetic oligonucleotide
gctctgcccctgctagtggtcgg

SEQ ID NO: 313724 - DNA, 25 bp, Artificial Sequence
  Description of Artificial Sequence: Synthetic oligonucleotide
ctctgcccctgctagtggtcggcat

SEQ ID NO: 313725 - DNA, 26 bp, Artificial Sequence
  Description of Artificial Sequence: Synthetic oligonucleotide
tctgcccctgctagtggtcggcatct

SEQ ID NO: 313726 - DNA, 25 bp, Artificial Sequence
  Description of Artificial Sequence: Synthetic oligonucleotide
ctgcccctgctagtggtcggcatct

SEQ ID NO: 313727 - DNA, 26 bp, Artificial Sequence
  Description of Artificial Sequence: Synthetic oligonucleotide
tgcccctgctagtggtcggcatctca

SEQ ID NO: 313728 - DNA, 25 bp, Artificial Sequence
  Description of Artificial Sequence: Synthetic oligonucleotide
gcccctgctagtggtcggcatctca

SEQ ID NO: 313729 - DNA, 25 bp, Artificial Sequence
  Description of Artificial Sequence: Synthetic oligonucleotide
cccctgctagtggtcggcatctcag

SEQ ID NO: 313730 - DNA, 26 bp, Artificial Sequence
  Description of Artificial Sequence: Synthetic oligonucleotide
ccctgctagtggtcggcatctcagga

SEQ ID NO: 313731 - DNA, 26 bp, Artificial Sequence
  Description of Artificial Sequence: Synthetic oligonucleotide
cctgctagtggtcggcatctcaggac

SEQ ID NO: 313732 - DNA, 26 bp, Artificial Sequence
  Description of Artificial Sequence: Synthetic oligonucleotide
ctgctagtggtcggcatctcaggacg

SEQ ID NO: 313733 - DNA, 26 bp, Artificial Sequence
  Description of Artificial Sequence: Synthetic oligonucleotide
tgctagtggtcggcatctcaggacgc

SEQ ID NO: 313734 - DNA, 25 bp, Artificial Sequence
  Description of Artificial Sequence: Synthetic oligonucleotide
gctagtggtcggcatctcaggacgc

SEQ ID NO: 313735 - DNA, 26 bp, Artificial Sequence
  Description of Artificial Sequence: Synthetic oligonucleotide
ctagtggtcggcatctcaggacgcct

SEQ ID NO: 313736 - DNA, 26 bp, Artificial Sequence
  Description of Artificial Sequence: Synthetic oligonucleotide
tagtggtcggcatctcaggacgcctg

SEQ ID NO: 313737 - DNA, 25 bp, Artificial Sequence
  Description of Artificial Sequence: Synthetic oligonucleotide
agtggtcggcatctcaggacgcctg

SEQ ID NO: 313738 - DNA, 24 bp, Artificial Sequence
  Description of Artificial Sequence: Synthetic oligonucleotide
gtggtcggcatctcaggacgcctg

SEQ ID NO: 313739 - DNA, 25 bp, Artificial Sequence
  Description of Artificial Sequence: Synthetic oligonucleotide
tggtcggcatctcaggacgcctgct

SEQ ID NO: 313740 - DNA, 24 bp, Artificial Sequence
  Description of Artificial Sequence: Synthetic oligonucleotide
ggtcggcatctcaggacgcctgct

SEQ ID NO: 313741 - DNA, 24 bp, Artificial Sequence
  Description of Artificial Sequence: Synthetic oligonucleotide
gtcggcatctcaggacgcctgctg

SEQ ID NO: 313742 - DNA, 25 bp, Artificial Sequence
  Description of Artificial Sequence: Synthetic oligonucleotide
tcggcatctcaggacgcctgctggt

SEQ ID NO: 313743 - DNA, 24 bp, Artificial Sequence
  Description of Artificial Sequence: Synthetic oligonucleotide
cggcatctcaggacgcctgctggt

SEQ ID NO: 313744 - DNA, 27 bp, Artificial Sequence
  Description of Artificial Sequence: Synthetic oligonucleotide
ggcatctcaggacgcctgctggtcttt

SEQ ID NO: 313745 - DNA, 27 bp, Artificial Sequence
  Description of Artificial Sequence: Synthetic oligonucleotide
gcatctcaggacgcctgctggtctttg

SEQ ID NO: 313746 - DNA, 28 bp, Artificial Sequence
  Description of Artificial Sequence: Synthetic oligonucleotide
catctcaggacgcctgctggtctttgag

SEQ ID NO: 313747 - DNA, 28 bp, Artificial Sequence
  Description of Artificial Sequence: Synthetic oligonucleotide
atctcaggacgcctgctggtctttgagg

SEQ ID NO: 313748 - DNA, 27 bp, Artificial Sequence
  Description of Artificial Sequence: Synthetic oligonucleotide
tctcaggacgcctgctggtctttgagg

SEQ ID NO: 313749 - DNA, 27 bp, Artificial Sequence
  Description of Artificial Sequence: Synthetic oligonucleotide
ctcaggacgcctgctggtctttgagga

SEQ ID NO: 313750 - DNA, 28 bp, Artificial Sequence
  Description of Artificial Sequence: Synthetic oligonucleotide
tcaggacgcctgctggtctttgaggaac

SEQ ID NO: 313751 - DNA, 27 bp, Artificial Sequence
  Description of Artificial Sequence: Synthetic oligonucleotide
caggacgcctgctggtctttgaggaac

SEQ ID NO: 313752 - DNA, 27 bp, Artificial Sequence
  Description of Artificial Sequence: Synthetic oligonucleotide
aggacgcctgctggtctttgaggaacc

SEQ ID NO: 313753 - DNA, 26 bp, Artificial Sequence
  Description of Artificial Sequence: Synthetic oligonucleotide
ggacgcctgctggtctttgaggaacc

SEQ ID NO: 313754 - DNA, 27 bp, Artificial Sequence
  Description of Artificial Sequence: Synthetic oligonucleotide
gacgcctgctggtctttgaggaaccct

SEQ ID NO: 313755 - DNA, 28 bp, Artificial Sequence
  Description of Artificial Sequence: Synthetic oligonucleotide
acgcctgctggtctttgaggaacccttc

SEQ ID NO: 313756 - DNA, 27 bp, Artificial Sequence
  Description of Artificial Sequence: Synthetic oligonucleotide
cgcctgctggtctttgaggaacccttc

SEQ ID NO: 313757 - DNA, 29 bp, Artificial Sequence
  Description of Artificial Sequence: Synthetic oligonucleotide
gcctgctggtctttgaggaacccttcttc

SEQ ID NO: 313758 - DNA, 30 bp, Artificial Sequence
  Description of Artificial Sequence: Synthetic oligonucleotide
cctgctggtctttgaggaacccttcttctg

SEQ ID NO: 313759 - DNA, 30 bp, Artificial Sequence
  Description of Artificial Sequence: Synthetic oligonucleotide
ctgctggtctttgaggaacccttcttctgg

SEQ ID NO: 313760 - DNA, 32 bp, Artificial Sequence
  Description of Artificial Sequence: Synthetic oligonucleotide
tgctggtctttgaggaacccttcttctggttc

SEQ ID NO: 313761 - DNA, 31 bp, Artificial Sequence
  Description of Artificial Sequence: Synthetic oligonucleotide
gctggtctttgaggaacccttcttctggttc

SEQ ID NO: 313762 - DNA, 32 bp, Artificial Sequence
  Description of Artificial Sequence: Synthetic oligonucleotide
ctggtctttgaggaacccttcttctggttctg

SEQ ID NO: 313763 - DNA, 32 bp, Artificial Sequence
  Description of Artificial Sequence: Synthetic oligonucleotide
tggtctttgaggaacccttcttctggttctgc

SEQ ID NO: 313764 - DNA, 31 bp, Artificial Sequence
  Description of Artificial Sequence: Synthetic oligonucleotide
ggtctttgaggaacccttcttctggttctgc

SEQ ID NO: 313765 - DNA, 31 bp, Artificial Sequence
  Description of Artificial Sequence: Synthetic oligonucleotide
gtctttgaggaacccttcttctggttctgcg

SEQ ID NO: 313766 - DNA, 32 bp, Artificial Sequence
  Description of Artificial Sequence: Synthetic oligonucleotide
tctttgaggaacccttcttctggttctgcgac

SEQ ID NO: 313767 - DNA, 31 bp, Artificial Sequence
  Description of Artificial Sequence: Synthetic oligonucleotide
ctttgaggaacccttcttctggttctgcgac

SEQ ID NO: 313768 - DNA, 32 bp, Artificial Sequence
  Description of Artificial Sequence: Synthetic oligonucleotide
tttgaggaacccttcttctggttctgcgacac

SEQ ID NO: 313769 - DNA, 31 bp, Artificial Sequence
  Description of Artificial Sequence: Synthetic oligonucleotide
ttgaggaacccttcttctggttctgcgacac

SEQ ID NO: 313770 - DNA, 30 bp, Artificial Sequence
  Description of Artificial Sequence: Synthetic oligonucleotide
tgaggaacccttcttctggttctgcgacac

SEQ ID NO: 313771 - DNA, 29 bp, Artificial Sequence
  Description of Artificial Sequence: Synthetic oligonucleotide
gaggaacccttcttctggttctgcgacac

SEQ ID NO: 313772 - DNA, 29 bp, Artificial Sequence
  Description of Artificial Sequence: Synthetic oligonucleotide
aggaacccttcttctggttctgcgacacc

SEQ ID NO: 313773 - DNA, 28 bp, Artificial Sequence
  Description of Artificial Sequence: Synthetic oligonucleotide
ggaacccttcttctggttctgcgacacc

SEQ ID NO: 313774 - DNA, 30 bp, Artificial Sequence
  Description of Artificial Sequence: Synthetic oligonucleotide
gaacccttcttctggttctgcgacaccaac

SEQ ID NO: 313775 - DNA, 30 bp, Artificial Sequence
  Description of Artificial Sequence: Synthetic oligonucleotide
aacccttcttctggttctgcgacaccaacg

SEQ ID NO: 313776 - DNA, 29 bp, Artificial Sequence
  Description of Artificial Sequence: Synthetic oligonucleotide
acccttcttctggttctgcgacaccaacg

SEQ ID NO: 313777 - DNA, 28 bp, Artificial Sequence
  Description of Artificial Sequence: Synthetic oligonucleotide
cccttcttctggttctgcgacaccaacg

SEQ ID NO: 313778 - DNA, 28 bp, Artificial Sequence
  Description of Artificial Sequence: Synthetic oligonucleotide
ccttcttctggttctgcgacaccaacgg

SEQ ID NO: 313779 - DNA, 29 bp, Artificial Sequence
  Description of Artificial Sequence: Synthetic oligonucleotide
cttcttctggttctgcgacaccaacggtg

SEQ ID NO: 313780 - DNA, 31 bp, Artificial Sequence
  Description of Artificial Sequence: Synthetic oligonucleotide
ttcttctggttctgcgacaccaacggtgtag

SEQ ID NO: 313781 - DNA, 30 bp, Artificial Sequence
  Description of Artificial Sequence: Synthetic oligonucleotide
tcttctggttctgcgacaccaacggtgtag

SEQ ID NO: 313782 - DNA, 29 bp, Artificial Sequence
  Description of Artificial Sequence: Synthetic oligonucleotide
cttctggttctgcgacaccaacggtgtag

SEQ ID NO: 313783 - DNA, 30 bp, Artificial Sequence
  Description of Artificial Sequence: Synthetic oligonucleotide
ttctggttctgcgacaccaacggtgtagag

SEQ ID NO: 313784 - DNA, 29 bp, Artificial Sequence
  Description of Artificial Sequence: Synthetic oligonucleotide
tctggttctgcgacaccaacggtgtagag

SEQ ID NO: 313785 - DNA, 28 bp, Artificial Sequence
  Description of Artificial Sequence: Synthetic oligonucleotide
ctggttctgcgacaccaacggtgtagag

SEQ ID NO: 313786 - DNA, 30 bp, Artificial Sequence
  Description of Artificial Sequence: Synthetic oligonucleotide
tggttctgcgacaccaacggtgtagagtac

SEQ ID NO: 313787 - DNA, 29 bp, Artificial Sequence
  Description of Artificial Sequence: Synthetic oligonucleotide
ggttctgcgacaccaacggtgtagagtac

SEQ ID NO: 313788 - DNA, 31 bp, Artificial Sequence
  Description of Artificial Sequence: Synthetic oligonucleotide
gttctgcgacaccaacggtgtagagtacaac

SEQ ID NO: 313789 - DNA, 31 bp, Artificial Sequence
  Description of Artificial Sequence: Synthetic oligonucleotide
ttctgcgacaccaacggtgtagagtacaacg

SEQ ID NO: 313790 - DNA, 30 bp, Artificial Sequence
  Description of Artificial Sequence: Synthetic oligonucleotide
tctgcgacaccaacggtgtagagtacaacg

SEQ ID NO: 313791 - DNA, 29 bp, Artificial Sequence
  Description of Artificial Sequence: Synthetic oligonucleotide
ctgcgacaccaacggtgtagagtacaacg

SEQ ID NO: 313792 - DNA, 30 bp, Artificial Sequence
  Description of Artificial Sequence: Synthetic oligonucleotide
tgcgacaccaacggtgtagagtacaacgtg

SEQ ID NO: 313793 - DNA, 29 bp, Artificial Sequence
  Description of Artificial Sequence: Synthetic oligonucleotide
gcgacaccaacggtgtagagtacaacgtg

SEQ ID NO: 313794 - DNA, 29 bp, Artificial Sequence
  Description of Artificial Sequence: Synthetic oligonucleotide
cgacaccaacggtgtagagtacaacgtgg

SEQ ID NO: 313795 - DNA, 29 bp, Artificial Sequence
  Description of Artificial Sequence: Synthetic oligonucleotide
gacaccaacggtgtagagtacaacgtggg

SEQ ID NO: 313796 - DNA, 29 bp, Artificial Sequence
  Description of Artificial Sequence: Synthetic oligonucleotide
acaccaacggtgtagagtacaacgtgggc

SEQ ID NO: 313797 - DNA, 28 bp, Artificial Sequence
  Description of Artificial Sequence: Synthetic oligonucleotide
caccaacggtgtagagtacaacgtgggc

SEQ ID NO: 313798 - DNA, 28 bp, Artificial Sequence
  Description of Artificial Sequence: Synthetic oligonucleotide
accaacggtgtagagtacaacgtgggcc

SEQ ID NO: 313799 - DNA, 27 bp, Artificial Sequence
  Description of Artificial Sequence: Synthetic oligonucleotide
ccaacggtgtagagtacaacgtgggcc

SEQ ID NO: 313800 - DNA, 27 bp, Artificial Sequence
  Description of Artificial Sequence: Synthetic oligonucleotide
caacggtgtagagtacaacgtgggccg

SEQ ID NO: 313801 - DNA, 27 bp, Artificial Sequence
  Description of Artificial Sequence: Synthetic oligonucleotide
aacggtgtagagtacaacgtgggccgg

SEQ ID NO: 313802 - DNA, 26 bp, Artificial Sequence
  Description of Artificial Sequence: Synthetic oligonucleotide
acggtgtagagtacaacgtgggccgg

SEQ ID NO: 313803 - DNA, 25 bp, Artificial Sequence
  Description of Artificial Sequence: Synthetic oligonucleotide
cggtgtagagtacaacgtgggccgg

SEQ ID NO: 313804 - DNA, 26 bp, Artificial Sequence
  Description of Artificial Sequence: Synthetic oligonucleotide
ggtgtagagtacaacgtgggccgggt

SEQ ID NO: 313805 - DNA, 27 bp, Artificial Sequence
  Description of Artificial Sequence: Synthetic oligonucleotide
gtgtagagtacaacgtgggccgggtgt

SEQ ID NO: 313806 - DNA, 27 bp, Artificial Sequence
  Description of Artificial Sequence: Synthetic oligonucleotide
tgtagagtacaacgtgggccgggtgtg

SEQ ID NO: 313807 - DNA, 26 bp, Artificial Sequence
  Description of Artificial Sequence: Synthetic oligonucleotide
gtagagtacaacgtgggccgggtgtg

SEQ ID NO: 313808 - DNA, 27 bp, Artificial Sequence
  Description of Artificial Sequence: Synthetic oligonucleotide
tagagtacaacgtgggccgggtgtgga

SEQ ID NO: 313809 - DNA, 27 bp, Artificial Sequence
  Description of Artificial Sequence: Synthetic oligonucleotide
agagtacaacgtgggccgggtgtggat

SEQ ID NO: 313810 - DNA, 26 bp, Artificial Sequence
  Description of Artificial Sequence: Synthetic oligonucleotide
gagtacaacgtgggccgggtgtggat

SEQ ID NO: 313811 - DNA, 26 bp, Artificial Sequence
  Description of Artificial Sequence: Synthetic oligonucleotide
agtacaacgtgggccgggtgtggatc

SEQ ID NO: 313812 - DNA, 25 bp, Artificial Sequence
  Description of Artificial Sequence: Synthetic oligonucleotide
gtacaacgtgggccgggtgtggatc

SEQ ID NO: 313813 - DNA, 25 bp, Artificial Sequence
  Description of Artificial Sequence: Synthetic oligonucleotide
tacaacgtgggccgggtgtggatcc

SEQ ID NO: 313814 - DNA, 24 bp, Artificial Sequence
  Description of Artificial Sequence: Synthetic oligonucleotide
acaacgtgggccgggtgtggatcc

SEQ ID NO: 313815 - DNA, 23 bp, Artificial Sequence
  Description of Artificial Sequence: Synthetic oligonucleotide
caacgtgggccgggtgtggatcc

SEQ ID NO: 313816 - DNA, 23 bp, Artificial Sequence
  Description of Artificial Sequence: Synthetic oligonucleotide
aacgtgggccgggtgtggatccg

SEQ ID NO: 313817 - DNA, 22 bp, Artificial Sequence
  Description of Artificial Sequence: Synthetic oligonucleotide
acgtgggccgggtgtggatccg

SEQ ID NO: 313818 - DNA, 21 bp, Artificial Sequence
  Description of Artificial Sequence: Synthetic oligonucleotide
cgtgggccgggtgtggatccg

SEQ ID NO: 313819 - DNA, 23 bp, Artificial Sequence
  Description of Artificial Sequence: Synthetic oligonucleotide
gtgggccgggtgtggatccgctt

SEQ ID NO: 313820 - DNA, 24 bp, Artificial Sequence
  Description of Artificial Sequence: Synthetic oligonucleotide
tgggccgggtgtggatccgcttct

SEQ ID NO: 313821 - DNA, 23 bp, Artificial Sequence
  Description of Artificial Sequence: Synthetic oligonucleotide
gggccgggtgtggatccgcttct

SEQ ID NO: 313822 - DNA, 23 bp, Artificial Sequence
  Description of Artificial Sequence: Synthetic oligonucleotide
ggccgggtgtggatccgcttctg

SEQ ID NO: 313823 - DNA, 23 bp, Artificial Sequence
  Description of Artificial Sequence: Synthetic oligonucleotide
gccgggtgtggatccgcttctgg

SEQ ID NO: 313824 - DNA, 24 bp, Artificial Sequence
  Description of Artificial Sequence: Synthetic oligonucleotide
ccgggtgtggatccgcttctggca

SEQ ID NO: 313825 - DNA, 26 bp, Artificial Sequence
  Description of Artificial Sequence: Synthetic oligonucleotide
cgggtgtggatccgcttctggcacat

SEQ ID NO: 313826 - DNA, 26 bp, Artificial Sequence
  Description of Artificial Sequence: Synthetic oligonucleotide
gggtgtggatccgcttctggcacatc

SEQ ID NO: 313827 - DNA, 27 bp, Artificial Sequence
  Description of Artificial Sequence: Synthetic oligonucleotide
ggtgtggatccgcttctggcacatcct

SEQ ID NO: 313828 - DNA, 27 bp, Artificial Sequence
  Description of Artificial Sequence: Synthetic oligonucleotide
gtgtggatccgcttctggcacatcctg

SEQ ID NO: 313829 - DNA, 27 bp, Artificial Sequence
  Description of Artificial Sequence: Synthetic oligonucleotide
tgtggatccgcttctggcacatcctgc

SEQ ID NO: 313830 - DNA, 27 bp, Artificial Sequence
  Description of Artificial Sequence: Synthetic oligonucleotide
gtggatccgcttctggcacatcctgct

SEQ ID NO: 313831 - DNA, 27 bp, Artificial Sequence
  Description of Artificial Sequence: Synthetic oligonucleotide
tggatccgcttctggcacatcctgctc

SEQ ID NO: 313832 - DNA, 26 bp, Artificial Sequence
  Description of Artificial Sequence: Synthetic oligonucleotide
ggatccgcttctggcacatcctgctc

SEQ ID NO: 313833 - DNA, 27 bp, Artificial Sequence
  Description of Artificial Sequence: Synthetic oligonucleotide
gatccgcttctggcacatcctgctcgt

SEQ ID NO: 313834 - DNA, 27 bp, Artificial Sequence
  Description of Artificial Sequence: Synthetic oligonucleotide
atccgcttctggcacatcctgctcgtg

SEQ ID NO: 313835 - DNA, 26 bp, Artificial Sequence
  Description of Artificial Sequence: Synthetic oligonucleotide
tccgcttctggcacatcctgctcgtg

SEQ ID NO: 313836 - DNA, 25 bp, Artificial Sequence
  Description of Artificial Sequence: Synthetic oligonucleotide
ccgcttctggcacatcctgctcgtg

SEQ ID NO: 313837 - DNA, 26 bp, Artificial Sequence
  Description of Artificial Sequence: Synthetic oligonucleotide
cgcttctggcacatcctgctcgtggt

SEQ ID NO: 313838 - DNA, 27 bp, Artificial Sequence
  Description of Artificial Sequence: Synthetic oligonucleotide
gcttctggcacatcctgctcgtggtgt

SEQ ID NO: 313839 - DNA, 28 bp, Artificial Sequence
  Description of Artificial Sequence: Synthetic oligonucleotide
cttctggcacatcctgctcgtggtgttg

SEQ ID NO: 313840 - DNA, 28 bp, Artificial Sequence
  Description of Artificial Sequence: Synthetic oligonucleotide
ttctggcacatcctgctcgtggtgttgc

SEQ ID NO: 313841 - DNA, 27 bp, Artificial Sequence
  Description of Artificial Sequence: Synthetic oligonucleotide
tctggcacatcctgctcgtggtgttgc

SEQ ID NO: 313842 - DNA, 27 bp, Artificial Sequence
  Description of Artificial Sequence: Synthetic oligonucleotide
ctggcacatcctgctcgtggtgttgct

SEQ ID NO: 313843 - DNA, 27 bp, Artificial Sequence
  Description of Artificial Sequence: Synthetic oligonucleotide
tggcacatcctgctcgtggtgttgctg

SEQ ID NO: 313844 - DNA, 26 bp, Artificial Sequence
  Description of Artificial Sequence: Synthetic oligonucleotide
ggcacatcctgctcgtggtgttgctg

SEQ ID NO: 313845 - DNA, 27 bp, Artificial Sequence
  Description of Artificial Sequence: Synthetic oligonucleotide
gcacatcctgctcgtggtgttgctggt

SEQ ID NO: 313846 - DNA, 27 bp, Artificial Sequence
  Description of Artificial Sequence: Synthetic oligonucleotide
cacatcctgctcgtggtgttgctggtg

SEQ ID NO: 313847 - DNA, 27 bp, Artificial Sequence
  Description of Artificial Sequence: Synthetic oligonucleotide
acatcctgctcgtggtgttgctggtgg

SEQ ID NO: 313848 - DNA, 26 bp, Artificial Sequence
  Description of Artificial Sequence: Synthetic oligonucleotide
catcctgctcgtggtgttgctggtgg

SEQ ID NO: 313849 - DNA, 26 bp, Artificial Sequence
  Description of Artificial Sequence: Synthetic oligonucleotide
atcctgctcgtggtgttgctggtggc

SEQ ID NO: 313850 - DNA, 25 bp, Artificial Sequence
  Description of Artificial Sequence: Synthetic oligonucleotide
tcctgctcgtggtgttgctggtggc

SEQ ID NO: 313851 - DNA, 24 bp, Artificial Sequence
  Description of Artificial Sequence: Synthetic oligonucleotide
cctgctcgtggtgttgctggtggc

SEQ ID NO: 313852 - DNA, 26 bp, Artificial Sequence
  Description of Artificial Sequence: Synthetic oligonucleotide
ctgctcgtggtgttgctggtggccta

SEQ ID NO: 313853 - DNA, 26 bp, Artificial Sequence
  Description of Artificial Sequence: Synthetic oligonucleotide
tgctcgtggtgttgctggtggcctac

SEQ ID NO: 313854 - DNA, 25 bp, Artificial Sequence
  Description of Artificial Sequence: Synthetic oligonucleotide
gctcgtggtgttgctggtggcctac

SEQ ID NO: 313855 - DNA, 26 bp, Artificial Sequence
  Description of Artificial Sequence: Synthetic oligonucleotide
ctcgtggtgttgctggtggcctacga

SEQ ID NO: 313856 - DNA, 26 bp, Artificial Sequence
  Description of Artificial Sequence: Synthetic oligonucleotide
tcgtggtgttgctggtggcctacgag

SEQ ID NO: 313857 - DNA, 25 bp, Artificial Sequence
  Description of Artificial Sequence: Synthetic oligonucleotide
cgtggtgttgctggtggcctacgag

SEQ ID NO: 313858 - DNA, 25 bp, Artificial Sequence
  Description of Artificial Sequence: Synthetic oligonucleotide
gtggtgttgctggtggcctacgagg

SEQ ID NO: 313859 - DNA, 27 bp, Artificial Sequence
  Description of Artificial Sequence: Synthetic oligonucleotide
tggtgttgctggtggcctacgagggta

SEQ ID NO: 313860 - DNA, 26 bp, Artificial Sequence
  Description of Artificial Sequence: Synthetic oligonucleotide
ggtgttgctggtggcctacgagggta

SEQ ID NO: 313861 - DNA, 26 bp, Artificial Sequence
  Description of Artificial Sequence: Synthetic oligonucleotide
gtgttgctggtggcctacgagggtag

SEQ ID NO: 313862 - DNA, 27 bp, Artificial Sequence
  Description of Artificial Sequence: Synthetic oligonucleotide
tgttgctggtggcctacgagggtaggt

SEQ ID NO: 313863 - DNA, 27 bp, Artificial Sequence
  Description of Artificial Sequence: Synthetic oligonucleotide
gttgctggtggcctacgagggtaggtt

SEQ ID NO: 313864 - DNA, 27 bp, Artificial Sequence
  Description of Artificial Sequence: Synthetic oligonucleotide
ttgctggtggcctacgagggtaggttc

SEQ ID NO: 313865 - DNA, 26 bp, Artificial Sequence
  Description of Artificial Sequence: Synthetic oligonucleotide
tgctggtggcctacgagggtaggttc

SEQ ID NO: 313866 - DNA, 25 bp, Artificial Sequence
  Description of Artificial Sequence: Synthetic oligonucleotide
gctggtggcctacgagggtaggttc

SEQ ID NO: 313867 - DNA, 26 bp, Artificial Sequence
  Description of Artificial Sequence: Synthetic oligonucleotide
ctggtggcctacgagggtaggttcct

SEQ ID NO: 313868 - DNA, 26 bp, Artificial Sequence
  Description of Artificial Sequence: Synthetic oligonucleotide
tggtggcctacgagggtaggttcctg

SEQ ID NO: 313869 - DNA, 25 bp, Artificial Sequence
  Description of Artificial Sequence: Synthetic oligonucleotide
ggtggcctacgagggtaggttcctg

SEQ ID NO: 313870 - DNA, 26 bp, Artificial Sequence
  Description of Artificial Sequence: Synthetic oligonucleotide
gtggcctacgagggtaggttcctggt

SEQ ID NO: 313871 - DNA, 26 bp, Artificial Sequence
  Description of Artificial Sequence: Synthetic oligonucleotide
tggcctacgagggtaggttcctggtc

SEQ ID NO: 313872 - DNA, 25 bp, Artificial Sequence
  Description of Artificial Sequence: Synthetic oligonucleotide
ggcctacgagggtaggttcctggtc

SEQ ID NO: 313873 - DNA, 25 bp, Artificial Sequence
  Description of Artificial Sequence: Synthetic oligonucleotide
gcctacgagggtaggttcctggtcg

SEQ ID NO: 313874 - DNA, 25 bp, Artificial Sequence
  Description of Artificial Sequence: Synthetic oligonucleotide
cctacgagggtaggttcctggtcgg

SEQ ID NO: 313875 - DNA, 27 bp, Artificial Sequence
  Description of Artificial Sequence: Synthetic oligonucleotide
ctacgagggtaggttcctggtcggctt

SEQ ID NO: 313876 - DNA, 27 bp, Artificial Sequence
  Description of Artificial Sequence: Synthetic oligonucleotide
tacgagggtaggttcctggtcggcttc

SEQ ID NO: 313877 - DNA, 27 bp, Artificial Sequence
  Description of Artificial Sequence: Synthetic oligonucleotide
acgagggtaggttcctggtcggcttca

SEQ ID NO: 313878 - DNA, 27 bp, Artificial Sequence
  Description of Artificial Sequence: Synthetic oligonucleotide
cgagggtaggttcctggtcggcttcat

SEQ ID NO: 313879 - DNA, 27 bp, Artificial Sequence
  Description of Artificial Sequence: Synthetic oligonucleotide
gagggtaggttcctggtcggcttcatc

SEQ ID NO: 313880 - DNA, 28 bp, Artificial Sequence
  Description of Artificial Sequence: Synthetic oligonucleotide
agggtaggttcctggtcggcttcatctg

SEQ ID NO: 313881 - DNA, 27 bp, Artificial Sequence
  Description of Artificial Sequence: Synthetic oligonucleotide
gggtaggttcctggtcggcttcatctg

SEQ ID NO: 313882 - DNA, 27 bp, Artificial Sequence
  Description of Artificial Sequence: Synthetic oligonucleotide
ggtaggttcctggtcggcttcatctgc

SEQ ID NO: 313883 - DNA, 27 bp, Artificial Sequence
  Description of Artificial Sequence: Synthetic oligonucleotide
gtaggttcctggtcggcttcatctgcc

SEQ ID NO: 313884 - DNA, 27 bp, Artificial Sequence
  Description of Artificial Sequence: Synthetic oligonucleotide
taggttcctggtcggcttcatctgccg

SEQ ID NO: 313885 - DNA, 26 bp, Artificial Sequence
  Description of Artificial Sequence: Synthetic oligonucleotide
aggttcctggtcggcttcatctgccg

SEQ ID NO: 313886 - DNA, 25 bp, Artificial Sequence
  Description of Artificial Sequence: Synthetic oligonucleotide
ggttcctggtcggcttcatctgccg

SEQ ID NO: 313887 - DNA, 27 bp, Artificial Sequence
  Description of Artificial Sequence: Synthetic oligonucleotide
gttcctggtcggcttcatctgccgcta

SEQ ID NO: 313888 - DNA, 29 bp, Artificial Sequence
  Description of Artificial Sequence: Synthetic oligonucleotide
ttcctggtcggcttcatctgccgctatac

SEQ ID NO: 313889 - DNA, 28 bp, Artificial Sequence
  Description of Artificial Sequence: Synthetic oligonucleotide
tcctggtcggcttcatctgccgctatac

SEQ ID NO: 313890 - DNA, 27 bp, Artificial Sequence
  Description of Artificial Sequence: Synthetic oligonucleotide
cctggtcggcttcatctgccgctatac

SEQ ID NO: 313891 - DNA, 27 bp, Artificial Sequence
  Description of Artificial Sequence: Synthetic oligonucleotide
ctggtcggcttcatctgccgctatacg

SEQ ID NO: 313892 - DNA, 27 bp, Artificial Sequence
  Description of Artificial Sequence: Synthetic oligonucleotide
tggtcggcttcatctgccgctatacgc

SEQ ID NO: 313893 - DNA, 27 bp, Artificial Sequence
  Description of Artificial Sequence: Synthetic oligonucleotide
ggtcggcttcatctgccgctatacgca

SEQ ID NO: 313894 - DNA, 27 bp, Artificial Sequence
  Description of Artificial Sequence: Synthetic oligonucleotide
gtcggcttcatctgccgctatacgcag

SEQ ID NO: 313895 - DNA, 27 bp, Artificial Sequence
  Description of Artificial Sequence: Synthetic oligonucleotide
tcggcttcatctgccgctatacgcagg

SEQ ID NO: 313896 - DNA, 27 bp, Artificial Sequence
  Description of Artificial Sequence: Synthetic oligonucleotide
cggcttcatctgccgctatacgcagga

SEQ ID NO: 313897 - DNA, 27 bp, Artificial Sequence
  Description of Artificial Sequence: Synthetic oligonucleotide
ggcttcatctgccgctatacgcaggag

SEQ ID NO: 313898 - DNA, 29 bp, Artificial Sequence
  Description of Artificial Sequence: Synthetic oligonucleotide
gcttcatctgccgctatacgcaggagatc

SEQ ID NO: 313899 - DNA, 31 bp, Artificial Sequence
  Description of Artificial Sequence: Synthetic oligonucleotide
cttcatctgccgctatacgcaggagatcatc

SEQ ID NO: 313900 - DNA, 32 bp, Artificial Sequence
  Description of Artificial Sequence: Synthetic oligonucleotide
ttcatctgccgctatacgcaggagatcatctc

SEQ ID NO: 313901 - DNA, 31 bp, Artificial Sequence
  Description of Artificial Sequence: Synthetic oligonucleotide
tcatctgccgctatacgcaggagatcatctc

SEQ ID NO: 313902 - DNA, 30 bp, Artificial Sequence
  Description of Artificial Sequence: Synthetic oligonucleotide
catctgccgctatacgcaggagatcatctc

SEQ ID NO: 313903 - DNA, 30 bp, Artificial Sequence
  Description of Artificial Sequence: Synthetic oligonucleotide
atctgccgctatacgcaggagatcatctcc

SEQ ID NO: 313904 - DNA, 29 bp, Artificial Sequence
  Description of Artificial Sequence: Synthetic oligonucleotide
tctgccgctatacgcaggagatcatctcc

SEQ ID NO: 313905 - DNA, 28 bp, Artificial Sequence
  Description of Artificial Sequence: Synthetic oligonucleotide
ctgccgctatacgcaggagatcatctcc

SEQ ID NO: 313906 - DNA, 30 bp, Artificial Sequence
  Description of Artificial Sequence: Synthetic oligonucleotide
tgccgctatacgcaggagatcatctccttc

SEQ ID NO: 313907 - DNA, 29 bp, Artificial Sequence
  Description of Artificial Sequence: Synthetic oligonucleotide
gccgctatacgcaggagatcatctccttc

SEQ ID NO: 313908 - DNA, 29 bp, Artificial Sequence
  Description of Artificial Sequence: Synthetic oligonucleotide
ccgctatacgcaggagatcatctccttcc

SEQ ID NO: 313909 - DNA, 30 bp, Artificial Sequence
  Description of Artificial Sequence: Synthetic oligonucleotide
cgctatacgcaggagatcatctccttccac

SEQ ID NO: 313910 - DNA, 34 bp, Artificial Sequence
  Description of Artificial Sequence: Synthetic oligonucleotide
gctatacgcaggagatcatctccttccacatttc

SEQ ID NO: 313911 - DNA, 34 bp, Artificial Sequence
  Description of Artificial Sequence: Synthetic oligonucleotide
ctatacgcaggagatcatctccttccacatttcc

SEQ ID NO: 313912 - DNA, 34 bp, Artificial Sequence
  Description of Artificial Sequence: Synthetic oligonucleotide
tatacgcaggagatcatctccttccacatttccc

SEQ ID NO: 313913 - DNA, 33 bp, Artificial Sequence
  Description of Artificial Sequence: Synthetic oligonucleotide
atacgcaggagatcatctccttccacatttccc

SEQ ID NO: 313914 - DNA, 32 bp, Artificial Sequence
  Description of Artificial Sequence: Synthetic oligonucleotide
tacgcaggagatcatctccttccacatttccc

SEQ ID NO: 313915 - DNA, 31 bp, Artificial Sequence
  Description of Artificial Sequence: Synthetic oligonucleotide
acgcaggagatcatctccttccacatttccc

SEQ ID NO: 313916 - DNA, 30 bp, Artificial Sequence
  Description of Artificial Sequence: Synthetic oligonucleotide
cgcaggagatcatctccttccacatttccc

SEQ ID NO: 313917 - DNA, 31 bp, Artificial Sequence
  Description of Artificial Sequence: Synthetic oligonucleotide
gcaggagatcatctccttccacatttccctg

SEQ ID NO: 313918 - DNA, 33 bp, Artificial Sequence
  Description of Artificial Sequence: Synthetic oligonucleotide
caggagatcatctccttccacatttccctgatc

SEQ ID NO: 313919 - DNA, 35 bp, Artificial Sequence
  Description of Artificial Sequence: Synthetic oligonucleotide
aggagatcatctccttccacatttccctgatcttc

SEQ ID NO: 313920 - DNA, 34 bp, Artificial Sequence
  Description of Artificial Sequence: Synthetic oligonucleotide
ggagatcatctccttccacatttccctgatcttc

SEQ ID NO: 313921 - DNA, 36 bp, Artificial Sequence
  Description of Artificial Sequence: Synthetic oligonucleotide
gagatcatctccttccacatttccctgatcttcatc

SEQ ID NO: 313922 - DNA, 39 bp, Artificial Sequence
  Description of Artificial Sequence: Synthetic oligonucleotide
agatcatctccttccacatttccctgatcttcatcaatg

SEQ ID NO: 313923 - DNA, 38 bp, Artificial Sequence
  Description of Artificial Sequence: Synthetic oligonucleotide
gatcatctccttccacatttccctgatcttcatcaatg

SEQ ID NO: 313924 - DNA, 39 bp, Artificial Sequence
  Description of Artificial Sequence: Synthetic oligonucleotide
atcatctccttccacatttccctgatcttcatcaatgag

SEQ ID NO: 313925 - DNA, 38 bp, Artificial Sequence
  Description of Artificial Sequence: Synthetic oligonucleotide
tcatctccttccacatttccctgatcttcatcaatgag

SEQ ID NO: 313926 - DNA, 37 bp, Artificial Sequence
  Description of Artificial Sequence: Synthetic oligonucleotide
catctccttccacatttccctgatcttcatcaatgag

SEQ ID NO: 313927 - DNA, 38 bp, Artificial Sequence
  Description of Artificial Sequence: Synthetic oligonucleotide
atctccttccacatttccctgatcttcatcaatgagac

SEQ ID NO: 313928 - DNA, 37 bp, Artificial Sequence
  Description of Artificial Sequence: Synthetic oligonucleotide
tctccttccacatttccctgatcttcatcaatgagac

SEQ ID NO: 313929 - DNA, 36 bp, Artificial Sequence
  Description of Artificial Sequence: Synthetic oligonucleotide
ctccttccacatttccctgatcttcatcaatgagac

SEQ ID NO: 313930 - DNA, 39 bp, Artificial Sequence
  Description of Artificial Sequence: Synthetic oligonucleotide
tccttccacatttccctgatcttcatcaatgagacttac

SEQ ID NO: 313931 - DNA, 38 bp, Artificial Sequence
  Description of Artificial Sequence: Synthetic oligonucleotide
ccttccacatttccctgatcttcatcaatgagacttac

SEQ ID NO: 313932 - DNA, 39 bp, Artificial Sequence
  Description of Artificial Sequence: Synthetic oligonucleotide
cttccacatttccctgatcttcatcaatgagacttactc

SEQ ID NO: 313933 - DNA, 39 bp, Artificial Sequence
  Description of Artificial Sequence: Synthetic oligonucleotide
ttccacatttccctgatcttcatcaatgagacttactcc

SEQ ID NO: 313934 - DNA, 38 bp, Artificial Sequence
  Description of Artificial Sequence: Synthetic oligonucleotide
tccacatttccctgatcttcatcaatgagacttactcc

SEQ ID NO: 313935 - DNA, 37 bp, Artificial Sequence
  Description of Artificial Sequence: Synthetic oligonucleotide
ccacatttccctgatcttcatcaatgagacttactcc

SEQ ID NO: 313936 - DNA, 39 bp, Artificial Sequence
  Description of Artificial Sequence: Synthetic oligonucleotide
cacatttccctgatcttcatcaatgagacttactccaag

SEQ ID NO: 313937 - DNA, 39 bp, Artificial Sequence
  Description of Artificial Sequence: Synthetic oligonucleotide
acatttccctgatcttcatcaatgagacttactccaagc

SEQ ID NO: 313938 - DNA, 38 bp, Artificial Sequence
  Description of Artificial Sequence: Synthetic oligonucleotide
catttccctgatcttcatcaatgagacttactccaagc

SEQ ID NO: 313939 - DNA, 39 bp, Artificial Sequence
  Description of Artificial Sequence: Synthetic oligonucleotide
atttccctgatcttcatcaatgagacttactccaagctc

SEQ ID NO: 313940 - DNA, 38 bp, Artificial Sequence
  Description of Artificial Sequence: Synthetic oligonucleotide
tttccctgatcttcatcaatgagacttactccaagctc

SEQ ID NO: 313941 - DNA, 37 bp, Artificial Sequence
  Description of Artificial Sequence: Synthetic oligonucleotide
ttccctgatcttcatcaatgagacttactccaagctc

SEQ ID NO: 313942 - DNA, 36 bp, Artificial Sequence
  Description of Artificial Sequence: Synthetic oligonucleotide
tccctgatcttcatcaatgagacttactccaagctc

SEQ ID NO: 313943 - DNA, 35 bp, Artificial Sequence
  Description of Artificial Sequence: Synthetic oligonucleotide
ccctgatcttcatcaatgagacttactccaagctc

SEQ ID NO: 313944 - DNA, 37 bp, Artificial Sequence
  Description of Artificial Sequence: Synthetic oligonucleotide
cctgatcttcatcaatgagacttactccaagctcatc

SEQ ID NO: 313945 - DNA, 39 bp, Artificial Sequence
  Description of Artificial Sequence: Synthetic oligonucleotide
ctgatcttcatcaatgagacttactccaagctcatcaag

SEQ ID NO: 313946 - DNA, 41 bp, Artificial Sequence
  Description of Artificial Sequence: Synthetic oligonucleotide
tgatcttcatcaatgagacttactccaagctcatcaagatc

SEQ ID NO: 313947 - DNA, 40 bp, Artificial Sequence
  Description of Artificial Sequence: Synthetic oligonucleotide
gatcttcatcaatgagacttactccaagctcatcaagatc

SEQ ID NO: 313948 - DNA, 42 bp, Artificial Sequence
  Description of Artificial Sequence: Synthetic oligonucleotide
atcttcatcaatgagacttactccaagctcatcaagatcatc

SEQ ID NO: 313949 - DNA, 41 bp, Artificial Sequence
  Description of Artificial Sequence: Synthetic oligonucleotide
tcttcatcaatgagacttactccaagctcatcaagatcatc

SEQ ID NO: 313950 - DNA, 40 bp, Artificial Sequence
  Description of Artificial Sequence: Synthetic oligonucleotide
cttcatcaatgagacttactccaagctcatcaagatcatc

SEQ ID NO: 313951 - DNA, 40 bp, Artificial Sequence
  Description of Artificial Sequence: Synthetic oligonucleotide
ttcatcaatgagacttactccaagctcatcaagatcatcc

SEQ ID NO: 313952 - DNA, 39 bp, Artificial Sequence
  Description of Artificial Sequence: Synthetic oligonucleotide
tcatcaatgagacttactccaagctcatcaagatcatcc

SEQ ID NO: 313953 - DNA, 38 bp, Artificial Sequence
  Description of Artificial Sequence: Synthetic oligonucleotide
catcaatgagacttactccaagctcatcaagatcatcc

SEQ ID NO: 313954 - DNA, 39 bp, Artificial Sequence
  Description of Artificial Sequence: Synthetic oligonucleotide
atcaatgagacttactccaagctcatcaagatcatccag

SEQ ID NO: 313955 - DNA, 38 bp, Artificial Sequence
  Description of Artificial Sequence: Synthetic oligonucleotide
tcaatgagacttactccaagctcatcaagatcatccag

SEQ ID NO: 313956 - DNA, 37 bp, Artificial Sequence
  Description of Artificial Sequence: Synthetic oligonucleotide
caatgagacttactccaagctcatcaagatcatccag

SEQ ID NO: 313957 - DNA, 37 bp, Artificial Sequence
  Description of Artificial Sequence: Synthetic oligonucleotide
aatgagacttactccaagctcatcaagatcatccagg

SEQ ID NO: 313958 - DNA, 36 bp, Artificial Sequence
  Description of Artificial Sequence: Synthetic oligonucleotide
atgagacttactccaagctcatcaagatcatccagg

SEQ ID NO: 313959 - DNA, 35 bp, Artificial Sequence
  Description of Artificial Sequence: Synthetic oligonucleotide
tgagacttactccaagctcatcaagatcatccagg

SEQ ID NO: 313960 - DNA, 34 bp, Artificial Sequence
  Description of Artificial Sequence: Synthetic oligonucleotide
gagacttactccaagctcatcaagatcatccagg

SEQ ID NO: 313961 - DNA, 35 bp, Artificial Sequence
  Description of Artificial Sequence: Synthetic oligonucleotide
agacttactccaagctcatcaagatcatccaggac

SEQ ID NO: 313962 - DNA, 34 bp, Artificial Sequence
  Description of Artificial Sequence: Synthetic oligonucleotide
gacttactccaagctcatcaagatcatccaggac

SEQ ID NO: 313963 - DNA, 34 bp, Artificial Sequence
  Description of Artificial Sequence: Synthetic oligonucleotide
acttactccaagctcatcaagatcatccaggacc

SEQ ID NO: 313964 - DNA, 33 bp, Artificial Sequence
  Description of Artificial Sequence: Synthetic oligonucleotide
cttactccaagctcatcaagatcatccaggacc

SEQ ID NO: 313965 - DNA, 34 bp, Artificial Sequence
  Description of Artificial Sequence: Synthetic oligonucleotide
ttactccaagctcatcaagatcatccaggacctc

SEQ ID NO: 313966 - DNA, 33 bp, Artificial Sequence
  Description of Artificial Sequence: Synthetic oligonucleotide
tactccaagctcatcaagatcatccaggacctc

SEQ ID NO: 313967 - DNA, 32 bp, Artificial Sequence
  Description of Artificial Sequence: Synthetic oligonucleotide
actccaagctcatcaagatcatccaggacctc

SEQ ID NO: 313968 - DNA, 31 bp, Artificial Sequence
  Description of Artificial Sequence: Synthetic oligonucleotide
ctccaagctcatcaagatcatccaggacctc

SEQ ID NO: 313969 - DNA, 31 bp, Artificial Sequence
  Description of Artificial Sequence: Synthetic oligonucleotide
tccaagctcatcaagatcatccaggacctcc

SEQ ID NO: 313970 - DNA, 30 bp, Artificial Sequence
  Description of Artificial Sequence: Synthetic oligonucleotide
ccaagctcatcaagatcatccaggacctcc

SEQ ID NO: 313971 - DNA, 30 bp, Artificial Sequence
  Description of Artificial Sequence: Synthetic oligonucleotide
caagctcatcaagatcatccaggacctccc

SEQ ID NO: 313972 - DNA, 31 bp, Artificial Sequence
  Description of Artificial Sequence: Synthetic oligonucleotide
aagctcatcaagatcatccaggacctcccac

SEQ ID NO: 313973 - DNA, 30 bp, Artificial Sequence
  Description of Artificial Sequence: Synthetic oligonucleotide
agctcatcaagatcatccaggacctcccac

SEQ ID NO: 313974 - DNA, 29 bp, Artificial Sequence
  Description of Artificial Sequence: Synthetic oligonucleotide
gctcatcaagatcatccaggacctcccac

SEQ ID NO: 313975 - DNA, 31 bp, Artificial Sequence
  Description of Artificial Sequence: Synthetic oligonucleotide
ctcatcaagatcatccaggacctcccactac

SEQ ID NO: 313976 - DNA, 32 bp, Artificial Sequence
  Description of Artificial Sequence: Synthetic oligonucleotide
tcatcaagatcatccaggacctcccactacac

SEQ ID NO: 313977 - DNA, 31 bp, Artificial Sequence
  Description of Artificial Sequence: Synthetic oligonucleotide
catcaagatcatccaggacctcccactacac

SEQ ID NO: 313978 - DNA, 33 bp, Artificial Sequence
  Description of Artificial Sequence: Synthetic oligonucleotide
atcaagatcatccaggacctcccactacacaag

SEQ ID NO: 313979 - DNA, 32 bp, Artificial Sequence
  Description of Artificial Sequence: Synthetic oligonucleotide
tcaagatcatccaggacctcccactacacaag

SEQ ID NO: 313980 - DNA, 31 bp, Artificial Sequence
  Description of Artificial Sequence: Synthetic oligonucleotide
caagatcatccaggacctcccactacacaag

SEQ ID NO: 313981 - DNA, 32 bp, Artificial Sequence
  Description of Artificial Sequence: Synthetic oligonucleotide
aagatcatccaggacctcccactacacaagac

SEQ ID NO: 313982 - DNA, 31 bp, Artificial Sequence
  Description of Artificial Sequence: Synthetic oligonucleotide
agatcatccaggacctcccactacacaagac

SEQ ID NO: 313983 - DNA, 30 bp, Artificial Sequence
  Description of Artificial Sequence: Synthetic oligonucleotide
gatcatccaggacctcccactacacaagac

SEQ ID NO: 313984 - DNA, 36 bp, Artificial Sequence
  Description of Artificial Sequence: Synthetic oligonucleotide
atcatccaggacctcccactacacaagacttattac

SEQ ID NO: 313985 - DNA, 35 bp, Artificial Sequence
  Description of Artificial Sequence: Synthetic oligonucleotide
tcatccaggacctcccactacacaagacttattac

SEQ ID NO: 313986 - DNA, 34 bp, Artificial Sequence
  Description of Artificial Sequence: Synthetic oligonucleotide
catccaggacctcccactacacaagacttattac

SEQ ID NO: 313987 - DNA, 36 bp, Artificial Sequence
  Description of Artificial Sequence: Synthetic oligonucleotide
atccaggacctcccactacacaagacttattactac

SEQ ID NO: 313988 - DNA, 35 bp, Artificial Sequence
  Description of Artificial Sequence: Synthetic oligonucleotide
tccaggacctcccactacacaagacttattactac

SEQ ID NO: 313989 - DNA, 34 bp, Artificial Sequence
  Description of Artificial Sequence: Synthetic oligonucleotide
ccaggacctcccactacacaagacttattactac

SEQ ID NO: 313990 - DNA, 36 bp, Artificial Sequence
  Description of Artificial Sequence: Synthetic oligonucleotide
caggacctcccactacacaagacttattactacaac

SEQ ID NO: 313991 - DNA, 36 bp, Artificial Sequence
  Description of Artificial Sequence: Synthetic oligonucleotide
aggacctcccactacacaagacttattactacaacg

SEQ ID NO: 313992 - DNA, 35 bp, Artificial Sequence
  Description of Artificial Sequence: Synthetic oligonucleotide
ggacctcccactacacaagacttattactacaacg

SEQ ID NO: 313993 - DNA, 36 bp, Artificial Sequence
  Description of Artificial Sequence: Synthetic oligonucleotide
gacctcccactacacaagacttattactacaacgag

SEQ ID NO: 313994 - DNA, 38 bp, Artificial Sequence
  Description of Artificial Sequence: Synthetic oligonucleotide
acctcccactacacaagacttattactacaacgagttg

SEQ ID NO: 313995 - DNA, 37 bp, Artificial Sequence
  Description of Artificial Sequence: Synthetic oligonucleotide
cctcccactacacaagacttattactacaacgagttg

SEQ ID NO: 313996 - DNA, 39 bp, Artificial Sequence
  Description of Artificial Sequence: Synthetic oligonucleotide
ctcccactacacaagacttattactacaacgagttgatg

SEQ ID NO: 313997 - DNA, 39 bp, Artificial Sequence
  Description of Artificial Sequence: Synthetic oligonucleotide
tcccactacacaagacttattactacaacgagttgatgg

SEQ ID NO: 313998 - DNA, 38 bp, Artificial Sequence
  Description of Artificial Sequence: Synthetic oligonucleotide
cccactacacaagacttattactacaacgagttgatgg

SEQ ID NO: 313999 - DNA, 39 bp, Artificial Sequence
  Description of Artificial Sequence: Synthetic oligonucleotide
ccactacacaagacttattactacaacgagttgatggtc

SEQ ID NO: 314000 - DNA, 39 bp, Artificial Sequence
  Description of Artificial Sequence: Synthetic oligonucleotide
cactacacaagacttattactacaacgagttgatggtcc

SEQ ID NO: 314001 - DNA, 39 bp, Artificial Sequence
  Description of Artificial Sequence: Synthetic oligonucleotide
actacacaagacttattactacaacgagttgatggtccc

SEQ ID NO: 314002 - DNA, 38 bp, Artificial Sequence
  Description of Artificial Sequence: Synthetic oligonucleotide
ctacacaagacttattactacaacgagttgatggtccc

SEQ ID NO: 314003 - DNA, 38 bp, Artificial Sequence
  Description of Artificial Sequence: Synthetic oligonucleotide
tacacaagacttattactacaacgagttgatggtcccc

SEQ ID NO: 314004 - DNA, 37 bp, Artificial Sequence
  Description of Artificial Sequence: Synthetic oligonucleotide
acacaagacttattactacaacgagttgatggtcccc

SEQ ID NO: 314005 - DNA, 36 bp, Artificial Sequence
  Description of Artificial Sequence: Synthetic oligonucleotide
cacaagacttattactacaacgagttgatggtcccc

SEQ ID NO: 314006 - DNA, 39 bp, Artificial Sequence
  Description of Artificial Sequence: Synthetic oligonucleotide
acaagacttattactacaacgagttgatggtccccaaac

SEQ ID NO: 314007 - DNA, 38 bp, Artificial Sequence
  Description of Artificial Sequence: Synthetic oligonucleotide
caagacttattactacaacgagttgatggtccccaaac

SEQ ID NO: 314008 - DNA, 38 bp, Artificial Sequence
  Description of Artificial Sequence: Synthetic oligonucleotide
aagacttattactacaacgagttgatggtccccaaacc

SEQ ID NO: 314009 - DNA, 37 bp, Artificial Sequence
  Description of Artificial Sequence: Synthetic oligonucleotide
agacttattactacaacgagttgatggtccccaaacc

SEQ ID NO: 314010 - DNA, 36 bp, Artificial Sequence
  Description of Artificial Sequence: Synthetic oligonucleotide
gacttattactacaacgagttgatggtccccaaacc

SEQ ID NO: 314011 - DNA, 37 bp, Artificial Sequence
  Description of Artificial Sequence: Synthetic oligonucleotide
acttattactacaacgagttgatggtccccaaacctg

SEQ ID NO: 314012 - DNA, 36 bp, Artificial Sequence
  Description of Artificial Sequence: Synthetic oligonucleotide
cttattactacaacgagttgatggtccccaaacctg

SEQ ID NO: 314013 - DNA, 37 bp, Artificial Sequence
  Description of Artificial Sequence: Synthetic oligonucleotide
ttattactacaacgagttgatggtccccaaacctgag

SEQ ID NO: 314014 - DNA, 36 bp, Artificial Sequence
  Description of Artificial Sequence: Synthetic oligonucleotide
tattactacaacgagttgatggtccccaaacctgag

SEQ ID NO: 314015 - DNA, 35 bp, Artificial Sequence
  Description of Artificial Sequence: Synthetic oligonucleotide
attactacaacgagttgatggtccccaaacctgag

SEQ ID NO: 314016 - DNA, 34 bp, Artificial Sequence
  Description of Artificial Sequence: Synthetic oligonucleotide
ttactacaacgagttgatggtccccaaacctgag

SEQ ID NO: 314017 - DNA, 33 bp, Artificial Sequence
  Description of Artificial Sequence: Synthetic oligonucleotide
tactacaacgagttgatggtccccaaacctgag

SEQ ID NO: 314018 - DNA, 32 bp, Artificial Sequence
  Description of Artificial Sequence: Synthetic oligonucleotide
actacaacgagttgatggtccccaaacctgag

SEQ ID NO: 314019 - DNA, 31 bp, Artificial Sequence
  Description of Artificial Sequence: Synthetic oligonucleotide
ctacaacgagttgatggtccccaaacctgag

SEQ ID NO: 314020 - DNA, 31 bp, Artificial Sequence
  Description of Artificial Sequence: Synthetic oligonucleotide
tacaacgagttgatggtccccaaacctgagg

SEQ ID NO: 314021 - DNA, 30 bp, Artificial Sequence
  Description of Artificial Sequence: Synthetic oligonucleotide
acaacgagttgatggtccccaaacctgagg

SEQ ID NO: 314022 - DNA, 29 bp, Artificial Sequence
  Description of Artificial Sequence: Synthetic oligonucleotide
caacgagttgatggtccccaaacctgagg

SEQ ID NO: 314023 - DNA, 29 bp, Artificial Sequence
  Description of Artificial Sequence: Synthetic oligonucleotide
aacgagttgatggtccccaaacctgaggg

SEQ ID NO: 314024 - DNA, 28 bp, Artificial Sequence
  Description of Artificial Sequence: Synthetic oligonucleotide
acgagttgatggtccccaaacctgaggg

SEQ ID NO: 314025 - DNA, 27 bp, Artificial Sequence
  Description of Artificial Sequence: Synthetic oligonucleotide
cgagttgatggtccccaaacctgaggg

SEQ ID NO: 314026 - DNA, 27 bp, Artificial Sequence
  Description of Artificial Sequence: Synthetic oligonucleotide
gagttgatggtccccaaacctgagggc

SEQ ID NO: 314027 - DNA, 27 bp, Artificial Sequence
  Description of Artificial Sequence: Synthetic oligonucleotide
agttgatggtccccaaacctgagggcc

SEQ ID NO: 314028 - DNA, 26 bp, Artificial Sequence
  Description of Artificial Sequence: Synthetic oligonucleotide
gttgatggtccccaaacctgagggcc

SEQ ID NO: 314029 - DNA, 26 bp, Artificial Sequence
  Description of Artificial Sequence: Synthetic oligonucleotide
ttgatggtccccaaacctgagggccc

SEQ ID NO: 314030 - DNA, 25 bp, Artificial Sequence
  Description of Artificial Sequence: Synthetic oligonucleotide
tgatggtccccaaacctgagggccc

SEQ ID NO: 314031 - DNA, 24 bp, Artificial Sequence
  Description of Artificial Sequence: Synthetic oligonucleotide
gatggtccccaaacctgagggccc

SEQ ID NO: 314032 - DNA, 24 bp, Artificial Sequence
  Description of Artificial Sequence: Synthetic oligonucleotide
atggtccccaaacctgagggcccc

SEQ ID NO: 314033 - DNA, 23 bp, Artificial Sequence
  Description of Artificial Sequence: Synthetic oligonucleotide
tggtccccaaacctgagggcccc

SEQ ID NO: 314034 - DNA, 22 bp, Artificial Sequence
  Description of Artificial Sequence: Synthetic oligonucleotide
ggtccccaaacctgagggcccc

SEQ ID NO: 314035 - DNA, 23 bp, Artificial Sequence
  Description of Artificial Sequence: Synthetic oligonucleotide
gtccccaaacctgagggccccca

SEQ ID NO: 314036 - DNA, 23 bp, Artificial Sequence
  Description of Artificial Sequence: Synthetic oligonucleotide
tccccaaacctgagggcccccag

SEQ ID NO: 314037 - DNA, 22 bp, Artificial Sequence
  Description of Artificial Sequence: Synthetic oligonucleotide
ccccaaacctgagggcccccag

SEQ ID NO: 314038 - DNA, 22 bp, Artificial Sequence
  Description of Artificial Sequence: Synthetic oligonucleotide
cccaaacctgagggcccccagc

SEQ ID NO: 314039 - DNA, 22 bp, Artificial Sequence
  Description of Artificial Sequence: Synthetic oligonucleotide
ccaaacctgagggcccccagcc

SEQ ID NO: 314040 - DNA, 24 bp, Artificial Sequence
  Description of Artificial Sequence: Synthetic oligonucleotide
caaacctgagggcccccagcccaa

SEQ ID NO: 314041 - DNA, 25 bp, Artificial Sequence
  Description of Artificial Sequence: Synthetic oligonucleotide
aaacctgagggcccccagcccaaca

SEQ ID NO: 314042 - DNA, 24 bp, Artificial Sequence
  Description of Artificial Sequence: Synthetic oligonucleotide
aacctgagggcccccagcccaaca

SEQ ID NO: 314043 - DNA, 23 bp, Artificial Sequence
  Description of Artificial Sequence: Synthetic oligonucleotide
acctgagggcccccagcccaaca

SEQ ID NO: 314044 - DNA, 22 bp, Artificial Sequence
  Description of Artificial Sequence: Synthetic oligonucleotide
cctgagggcccccagcccaaca

SEQ ID NO: 314045 - DNA, 23 bp, Artificial Sequence
  Description of Artificial Sequence: Synthetic oligonucleotide
ctgagggcccccagcccaacact

SEQ ID NO: 314046 - DNA, 23 bp, Artificial Sequence
  Description of Artificial Sequence: Synthetic oligonucleotide
tgagggcccccagcccaacactg

SEQ ID NO: 314047 - DNA, 22 bp, Artificial Sequence
  Description of Artificial Sequence: Synthetic oligonucleotide
gagggcccccagcccaacactg

SEQ ID NO: 314048 - DNA, 22 bp, Artificial Sequence
  Description of Artificial Sequence: Synthetic oligonucleotide
agggcccccagcccaacactgc

SEQ ID NO: 314049 - DNA, 21 bp, Artificial Sequence
  Description of Artificial Sequence: Synthetic oligonucleotide
gggcccccagcccaacactgc

SEQ ID NO: 314050 - DNA, 21 bp, Artificial Sequence
  Description of Artificial Sequence: Synthetic oligonucleotide
ggcccccagcccaacactgcc

SEQ ID NO: 314051 - DNA, 22 bp, Artificial Sequence
  Description of Artificial Sequence: Synthetic oligonucleotide
gcccccagcccaacactgccct

SEQ ID NO: 314052 - DNA, 22 bp, Artificial Sequence
  Description of Artificial Sequence: Synthetic oligonucleotide
cccccagcccaacactgccctc

SEQ ID NO: 314053 - DNA, 23 bp, Artificial Sequence
  Description of Artificial Sequence: Synthetic oligonucleotide
ccccagcccaacactgccctcct

SEQ ID NO: 314054 - DNA, 24 bp, Artificial Sequence
  Description of Artificial Sequence: Synthetic oligonucleotide
cccagcccaacactgccctcctca

SEQ ID NO: 314055 - DNA, 24 bp, Artificial Sequence
  Description of Artificial Sequence: Synthetic oligonucleotide
ccagcccaacactgccctcctcac

SEQ ID NO: 314056 - DNA, 24 bp, Artificial Sequence
  Description of Artificial Sequence: Synthetic oligonucleotide
cagcccaacactgccctcctcacc

SEQ ID NO: 314057 - DNA, 26 bp, Artificial Sequence
  Description of Artificial Sequence: Synthetic oligonucleotide
agcccaacactgccctcctcaccctt

SEQ ID NO: 314058 - DNA, 25 bp, Artificial Sequence
  Description of Artificial Sequence: Synthetic oligonucleotide
gcccaacactgccctcctcaccctt

SEQ ID NO: 314059 - DNA, 26 bp, Artificial Sequence
  Description of Artificial Sequence: Synthetic oligonucleotide
cccaacactgccctcctcacccttgt

SEQ ID NO: 314060 - DNA, 26 bp, Artificial Sequence
  Description of Artificial Sequence: Synthetic oligonucleotide
ccaacactgccctcctcacccttgtg

SEQ ID NO: 314061 - DNA, 27 bp, Artificial Sequence
  Description of Artificial Sequence: Synthetic oligonucleotide
caacactgccctcctcacccttgtgca

SEQ ID NO: 314062 - DNA, 27 bp, Artificial Sequence
  Description of Artificial Sequence: Synthetic oligonucleotide
aacactgccctcctcacccttgtgcac

SEQ ID NO: 314063 - DNA, 27 bp, Artificial Sequence
  Description of Artificial Sequence: Synthetic oligonucleotide
acactgccctcctcacccttgtgcaca

SEQ ID NO: 314064 - DNA, 27 bp, Artificial Sequence
  Description of Artificial Sequence: Synthetic oligonucleotide
cactgccctcctcacccttgtgcacat

SEQ ID NO: 314065 - DNA, 27 bp, Artificial Sequence
  Description of Artificial Sequence: Synthetic oligonucleotide
actgccctcctcacccttgtgcacatg

SEQ ID NO: 314066 - DNA, 26 bp, Artificial Sequence
  Description of Artificial Sequence: Synthetic oligonucleotide
ctgccctcctcacccttgtgcacatg

SEQ ID NO: 314067 - DNA, 26 bp, Artificial Sequence
  Description of Artificial Sequence: Synthetic oligonucleotide
tgccctcctcacccttgtgcacatgg

SEQ ID NO: 314068 - DNA, 25 bp, Artificial Sequence
  Description of Artificial Sequence: Synthetic oligonucleotide
gccctcctcacccttgtgcacatgg

SEQ ID NO: 314069 - DNA, 25 bp, Artificial Sequence
  Description of Artificial Sequence: Synthetic oligonucleotide
ccctcctcacccttgtgcacatggc

SEQ ID NO: 314070 - DNA, 25 bp, Artificial Sequence
  Description of Artificial Sequence: Synthetic oligonucleotide
cctcctcacccttgtgcacatggcc

SEQ ID NO: 314071 - DNA, 25 bp, Artificial Sequence
  Description of Artificial Sequence: Synthetic oligonucleotide
ctcctcacccttgtgcacatggccg

SEQ ID NO: 314072 - DNA, 27 bp, Artificial Sequence
  Description of Artificial Sequence: Synthetic oligonucleotide
tcctcacccttgtgcacatggccggaa

SEQ ID NO: 314073 - DNA, 26 bp, Artificial Sequence
  Description of Artificial Sequence: Synthetic oligonucleotide
cctcacccttgtgcacatggccggaa

SEQ ID NO: 314074 - DNA, 26 bp, Artificial Sequence
  Description of Artificial Sequence: Synthetic oligonucleotide
ctcacccttgtgcacatggccggaac

SEQ ID NO: 314075 - DNA, 27 bp, Artificial Sequence
  Description of Artificial Sequence: Synthetic oligonucleotide
tcacccttgtgcacatggccggaacct

SEQ ID NO: 314076 - DNA, 27 bp, Artificial Sequence
  Description of Artificial Sequence: Synthetic oligonucleotide
cacccttgtgcacatggccggaacctt

SEQ ID NO: 314077 - DNA, 27 bp, Artificial Sequence
  Description of Artificial Sequence: Synthetic oligonucleotide
acccttgtgcacatggccggaaccttc

SEQ ID NO: 314078 - DNA, 27 bp, Artificial Sequence
  Description of Artificial Sequence: Synthetic oligonucleotide
cccttgtgcacatggccggaaccttct

SEQ ID NO: 314079 - DNA, 28 bp, Artificial Sequence
  Description of Artificial Sequence: Synthetic oligonucleotide
ccttgtgcacatggccggaaccttcttc

SEQ ID NO: 314080 - DNA, 31 bp, Artificial Sequence
  Description of Artificial Sequence: Synthetic oligonucleotide
cttgtgcacatggccggaaccttcttcattg

SEQ ID NO: 314081 - DNA, 31 bp, Artificial Sequence
  Description of Artificial Sequence: Synthetic oligonucleotide
ttgtgcacatggccggaaccttcttcattgc

SEQ ID NO: 314082 - DNA, 30 bp, Artificial Sequence
  Description of Artificial Sequence: Synthetic oligonucleotide
tgtgcacatggccggaaccttcttcattgc

SEQ ID NO: 314083 - DNA, 29 bp, Artificial Sequence
  Description of Artificial Sequence: Synthetic oligonucleotide
gtgcacatggccggaaccttcttcattgc

SEQ ID NO: 314084 - DNA, 29 bp, Artificial Sequence
  Description of Artificial Sequence: Synthetic oligonucleotide
tgcacatggccggaaccttcttcattgcc

SEQ ID NO: 314085 - DNA, 28 bp, Artificial Sequence
  Description of Artificial Sequence: Synthetic oligonucleotide
gcacatggccggaaccttcttcattgcc

SEQ ID NO: 314086 - DNA, 30 bp, Artificial Sequence
  Description of Artificial Sequence: Synthetic oligonucleotide
cacatggccggaaccttcttcattgccatg

SEQ ID NO: 314087 - DNA, 32 bp, Artificial Sequence
  Description of Artificial Sequence: Synthetic oligonucleotide
acatggccggaaccttcttcattgccatgaag

SEQ ID NO: 314088 - DNA, 31 bp, Artificial Sequence
  Description of Artificial Sequence: Synthetic oligonucleotide
catggccggaaccttcttcattgccatgaag

SEQ ID NO: 314089 - DNA, 31 bp, Artificial Sequence
  Description of Artificial Sequence: Synthetic oligonucleotide
atggccggaaccttcttcattgccatgaagc

SEQ ID NO: 314090 - DNA, 30 bp, Artificial Sequence
  Description of Artificial Sequence: Synthetic oligonucleotide
tggccggaaccttcttcattgccatgaagc

SEQ ID NO: 314091 - DNA, 29 bp, Artificial Sequence
  Description of Artificial Sequence: Synthetic oligonucleotide
ggccggaaccttcttcattgccatgaagc

SEQ ID NO: 314092 - DNA, 30 bp, Artificial Sequence
  Description of Artificial Sequence: Synthetic oligonucleotide
gccggaaccttcttcattgccatgaagctg

SEQ ID NO: 314093 - DNA, 30 bp, Artificial Sequence
  Description of Artificial Sequence: Synthetic oligonucleotide
ccggaaccttcttcattgccatgaagctgc

SEQ ID NO: 314094 - DNA, 30 bp, Artificial Sequence
  Description of Artificial Sequence: Synthetic oligonucleotide
cggaaccttcttcattgccatgaagctgcg

SEQ ID NO: 314095 - DNA, 30 bp, Artificial Sequence
  Description of Artificial Sequence: Synthetic oligonucleotide
ggaaccttcttcattgccatgaagctgcgc

SEQ ID NO: 314096 - DNA, 32 bp, Artificial Sequence
  Description of Artificial Sequence: Synthetic oligonucleotide
gaaccttcttcattgccatgaagctgcgcaac

SEQ ID NO: 314097 - DNA, 34 bp, Artificial Sequence
  Description of Artificial Sequence: Synthetic oligonucleotide
aaccttcttcattgccatgaagctgcgcaacttc

SEQ ID NO: 314098 - DNA, 33 bp, Artificial Sequence
  Description of Artificial Sequence: Synthetic oligonucleotide
accttcttcattgccatgaagctgcgcaacttc

SEQ ID NO: 314099 - DNA, 32 bp, Artificial Sequence
  Description of Artificial Sequence: Synthetic oligonucleotide
ccttcttcattgccatgaagctgcgcaacttc

SEQ ID NO: 314100 - DNA, 34 bp, Artificial Sequence
  Description of Artificial Sequence: Synthetic oligonucleotide
cttcttcattgccatgaagctgcgcaacttcaag

SEQ ID NO: 314101 - DNA, 36 bp, Artificial Sequence
  Description of Artificial Sequence: Synthetic oligonucleotide
ttcttcattgccatgaagctgcgcaacttcaagaac

SEQ ID NO: 314102 - DNA, 35 bp, Artificial Sequence
  Description of Artificial Sequence: Synthetic oligonucleotide
tcttcattgccatgaagctgcgcaacttcaagaac

SEQ ID NO: 314103 - DNA, 34 bp, Artificial Sequence
  Description of Artificial Sequence: Synthetic oligonucleotide
cttcattgccatgaagctgcgcaacttcaagaac

SEQ ID NO: 314104 - DNA, 35 bp, Artificial Sequence
  Description of Artificial Sequence: Synthetic oligonucleotide
ttcattgccatgaagctgcgcaacttcaagaactg

SEQ ID NO: 314105 - DNA, 34 bp, Artificial Sequence
  Description of Artificial Sequence: Synthetic oligonucleotide
tcattgccatgaagctgcgcaacttcaagaactg

SEQ ID NO: 314106 - DNA, 33 bp, Artificial Sequence
  Description of Artificial Sequence: Synthetic oligonucleotide
cattgccatgaagctgcgcaacttcaagaactg

SEQ ID NO: 314107 - DNA, 33 bp, Artificial Sequence
  Description of Artificial Sequence: Synthetic oligonucleotide
attgccatgaagctgcgcaacttcaagaactgc

SEQ ID NO: 314108 - DNA, 32 bp, Artificial Sequence
  Description of Artificial Sequence: Synthetic oligonucleotide
ttgccatgaagctgcgcaacttcaagaactgc

SEQ ID NO: 314109 - DNA, 31 bp, Artificial Sequence
  Description of Artificial Sequence: Synthetic oligonucleotide
tgccatgaagctgcgcaacttcaagaactgc

SEQ ID NO: 314110 - DNA, 30 bp, Artificial Sequence
  Description of Artificial Sequence: Synthetic oligonucleotide
gccatgaagctgcgcaacttcaagaactgc

SEQ ID NO: 314111 - DNA, 31 bp, Artificial Sequence
  Description of Artificial Sequence: Synthetic oligonucleotide
ccatgaagctgcgcaacttcaagaactgctc

SEQ ID NO: 314112 - DNA, 31 bp, Artificial Sequence
  Description of Artificial Sequence: Synthetic oligonucleotide
catgaagctgcgcaacttcaagaactgctcc

SEQ ID NO: 314113 - DNA, 36 bp, Artificial Sequence
  Description of Artificial Sequence: Synthetic oligonucleotide
atgaagctgcgcaacttcaagaactgctcctattac

SEQ ID NO: 314114 - DNA, 35 bp, Artificial Sequence
  Description of Artificial Sequence: Synthetic oligonucleotide
tgaagctgcgcaacttcaagaactgctcctattac

SEQ ID NO: 314115 - DNA, 34 bp, Artificial Sequence
  Description of Artificial Sequence: Synthetic oligonucleotide
gaagctgcgcaacttcaagaactgctcctattac

SEQ ID NO: 314116 - DNA, 34 bp, Artificial Sequence
  Description of Artificial Sequence: Synthetic oligonucleotide
aagctgcgcaacttcaagaactgctcctattacc

SEQ ID NO: 314117 - DNA, 33 bp, Artificial Sequence
  Description of Artificial Sequence: Synthetic oligonucleotide
agctgcgcaacttcaagaactgctcctattacc

SEQ ID NO: 314118 - DNA, 32 bp, Artificial Sequence
  Description of Artificial Sequence: Synthetic oligonucleotide
gctgcgcaacttcaagaactgctcctattacc

SEQ ID NO: 314119 - DNA, 32 bp, Artificial Sequence
  Description of Artificial Sequence: Synthetic oligonucleotide
ctgcgcaacttcaagaactgctcctattaccc

SEQ ID NO: 314120 - DNA, 33 bp, Artificial Sequence
  Description of Artificial Sequence: Synthetic oligonucleotide
tgcgcaacttcaagaactgctcctattaccctg

SEQ ID NO: 314121 - DNA, 32 bp, Artificial Sequence
  Description of Artificial Sequence: Synthetic oligonucleotide
gcgcaacttcaagaactgctcctattaccctg

SEQ ID NO: 314122 - DNA, 32 bp, Artificial Sequence
  Description of Artificial Sequence: Synthetic oligonucleotide
cgcaacttcaagaactgctcctattaccctgg

SEQ ID NO: 314123 - DNA, 32 bp, Artificial Sequence
  Description of Artificial Sequence: Synthetic oligonucleotide
gcaacttcaagaactgctcctattaccctggc

SEQ ID NO: 314124 - DNA, 34 bp, Artificial Sequence
  Description of Artificial Sequence: Synthetic oligonucleotide
caacttcaagaactgctcctattaccctggcaac

SEQ ID NO: 314125 - DNA, 34 bp, Artificial Sequence
  Description of Artificial Sequence: Synthetic oligonucleotide
aacttcaagaactgctcctattaccctggcaacc

SEQ ID NO: 314126 - DNA, 33 bp, Artificial Sequence
  Description of Artificial Sequence: Synthetic oligonucleotide
acttcaagaactgctcctattaccctggcaacc

SEQ ID NO: 314127 - DNA, 32 bp, Artificial Sequence
  Description of Artificial Sequence: Synthetic oligonucleotide
cttcaagaactgctcctattaccctggcaacc

SEQ ID NO: 314128 - DNA, 33 bp, Artificial Sequence
  Description of Artificial Sequence: Synthetic oligonucleotide
ttcaagaactgctcctattaccctggcaacctg

SEQ ID NO: 314129 - DNA, 32 bp, Artificial Sequence
  Description of Artificial Sequence: Synthetic oligonucleotide
tcaagaactgctcctattaccctggcaacctg

SEQ ID NO: 314130 - DNA, 31 bp, Artificial Sequence
  Description of Artificial Sequence: Synthetic oligonucleotide
caagaactgctcctattaccctggcaacctg

SEQ ID NO: 314131 - DNA, 31 bp, Artificial Sequence
  Description of Artificial Sequence: Synthetic oligonucleotide
aagaactgctcctattaccctggcaacctgc

SEQ ID NO: 314132 - DNA, 30 bp, Artificial Sequence
  Description of Artificial Sequence: Synthetic oligonucleotide
agaactgctcctattaccctggcaacctgc

SEQ ID NO: 314133 - DNA, 29 bp, Artificial Sequence
  Description of Artificial Sequence: Synthetic oligonucleotide
gaactgctcctattaccctggcaacctgc

SEQ ID NO: 314134 - DNA, 29 bp, Artificial Sequence
  Description of Artificial Sequence: Synthetic oligonucleotide
aactgctcctattaccctggcaacctgcg

SEQ ID NO: 314135 - DNA, 28 bp, Artificial Sequence
  Description of Artificial Sequence: Synthetic oligonucleotide
actgctcctattaccctggcaacctgcg

SEQ ID NO: 314136 - DNA, 27 bp, Artificial Sequence
  Description of Artificial Sequence: Synthetic oligonucleotide
ctgctcctattaccctggcaacctgcg

SEQ ID NO: 314137 - DNA, 28 bp, Artificial Sequence
  Description of Artificial Sequence: Synthetic oligonucleotide
tgctcctattaccctggcaacctgcgtc

SEQ ID NO: 314138 - DNA, 27 bp, Artificial Sequence
  Description of Artificial Sequence: Synthetic oligonucleotide
gctcctattaccctggcaacctgcgtc

SEQ ID NO: 314139 - DNA, 27 bp, Artificial Sequence
  Description of Artificial Sequence: Synthetic oligonucleotide
ctcctattaccctggcaacctgcgtcg

SEQ ID NO: 314140 - DNA, 27 bp, Artificial Sequence
  Description of Artificial Sequence: Synthetic oligonucleotide
tcctattaccctggcaacctgcgtcgg

SEQ ID NO: 314141 - DNA, 26 bp, Artificial Sequence
  Description of Artificial Sequence: Synthetic oligonucleotide
cctattaccctggcaacctgcgtcgg

SEQ ID NO: 314142 - DNA, 27 bp, Artificial Sequence
  Description of Artificial Sequence: Synthetic oligonucleotide
ctattaccctggcaacctgcgtcggct

SEQ ID NO: 314143 - DNA, 27 bp, Artificial Sequence
  Description of Artificial Sequence: Synthetic oligonucleotide
tattaccctggcaacctgcgtcggctc

SEQ ID NO: 314144 - DNA, 27 bp, Artificial Sequence
  Description of Artificial Sequence: Synthetic oligonucleotide
attaccctggcaacctgcgtcggctca

SEQ ID NO: 314145 - DNA, 27 bp, Artificial Sequence
  Description of Artificial Sequence: Synthetic oligonucleotide
ttaccctggcaacctgcgtcggctcat

SEQ ID NO: 314146 - DNA, 26 bp, Artificial Sequence
  Description of Artificial Sequence: Synthetic oligonucleotide
taccctggcaacctgcgtcggctcat

SEQ ID NO: 314147 - DNA, 25 bp, Artificial Sequence
  Description of Artificial Sequence: Synthetic oligonucleotide
accctggcaacctgcgtcggctcat

SEQ ID NO: 314148 - DNA, 24 bp, Artificial Sequence
  Description of Artificial Sequence: Synthetic oligonucleotide
ccctggcaacctgcgtcggctcat

SEQ ID NO: 314149 - DNA, 24 bp, Artificial Sequence
  Description of Artificial Sequence: Synthetic oligonucleotide
cctggcaacctgcgtcggctcatc

SEQ ID NO: 314150 - DNA, 24 bp, Artificial Sequence
  Description of Artificial Sequence: Synthetic oligonucleotide
ctggcaacctgcgtcggctcatcg

SEQ ID NO: 314151 - DNA, 24 bp, Artificial Sequence
  Description of Artificial Sequence: Synthetic oligonucleotide
tggcaacctgcgtcggctcatcgg

SEQ ID NO: 314152 - DNA, 23 bp, Artificial Sequence
  Description of Artificial Sequence: Synthetic oligonucleotide
ggcaacctgcgtcggctcatcgg

SEQ ID NO: 314153 - DNA, 23 bp, Artificial Sequence
  Description of Artificial Sequence: Synthetic oligonucleotide
gcaacctgcgtcggctcatcggg

SEQ ID NO: 314154 - DNA, 24 bp, Artificial Sequence
  Description of Artificial Sequence: Synthetic oligonucleotide
caacctgcgtcggctcatcggggt

SEQ ID NO: 314155 - DNA, 26 bp, Artificial Sequence
  Description of Artificial Sequence: Synthetic oligonucleotide
aacctgcgtcggctcatcggggtctt

SEQ ID NO: 314156 - DNA, 25 bp, Artificial Sequence
  Description of Artificial Sequence: Synthetic oligonucleotide
acctgcgtcggctcatcggggtctt

SEQ ID NO: 314157 - DNA, 24 bp, Artificial Sequence
  Description of Artificial Sequence: Synthetic oligonucleotide
cctgcgtcggctcatcggggtctt

SEQ ID NO: 314158 - DNA, 24 bp, Artificial Sequence
  Description of Artificial Sequence: Synthetic oligonucleotide
ctgcgtcggctcatcggggtcttc

SEQ ID NO: 314159 - DNA, 24 bp, Artificial Sequence
  Description of Artificial Sequence: Synthetic oligonucleotide
tgcgtcggctcatcggggtcttcg

SEQ ID NO: 314160 - DNA, 23 bp, Artificial Sequence
  Description of Artificial Sequence: Synthetic oligonucleotide
gcgtcggctcatcggggtcttcg

SEQ ID NO: 314161 - DNA, 23 bp, Artificial Sequence
  Description of Artificial Sequence: Synthetic oligonucleotide
cgtcggctcatcggggtcttcgg

SEQ ID NO: 314162 - DNA, 23 bp, Artificial Sequence
  Description of Artificial Sequence: Synthetic oligonucleotide
gtcggctcatcggggtcttcggg

SEQ ID NO: 314163 - DNA, 24 bp, Artificial Sequence
  Description of Artificial Sequence: Synthetic oligonucleotide
tcggctcatcggggtcttcggggt

SEQ ID NO: 314164 - DNA, 23 bp, Artificial Sequence
  Description of Artificial Sequence: Synthetic oligonucleotide
cggctcatcggggtcttcggggt

SEQ ID NO: 314165 - DNA, 23 bp, Artificial Sequence
  Description of Artificial Sequence: Synthetic oligonucleotide
ggctcatcggggtcttcggggtg

SEQ ID NO: 314166 - DNA, 23 bp, Artificial Sequence
  Description of Artificial Sequence: Synthetic oligonucleotide
gctcatcggggtcttcggggtgc

SEQ ID NO: 314167 - DNA, 23 bp, Artificial Sequence
  Description of Artificial Sequence: Synthetic oligonucleotide
ctcatcggggtcttcggggtgcc

SEQ ID NO: 314168 - DNA, 25 bp, Artificial Sequence
  Description of Artificial Sequence: Synthetic oligonucleotide
tcatcggggtcttcggggtgcccat

SEQ ID NO: 314169 - DNA, 24 bp, Artificial Sequence
  Description of Artificial Sequence: Synthetic oligonucleotide
catcggggtcttcggggtgcccat

SEQ ID NO: 314170 - DNA, 25 bp, Artificial Sequence
  Description of Artificial Sequence: Synthetic oligonucleotide
atcggggtcttcggggtgcccatct

SEQ ID NO: 314171 - DNA, 24 bp, Artificial Sequence
  Description of Artificial Sequence: Synthetic oligonucleotide
tcggggtcttcggggtgcccatct

SEQ ID NO: 314172 - DNA, 23 bp, Artificial Sequence
  Description of Artificial Sequence: Synthetic oligonucleotide
cggggtcttcggggtgcccatct

SEQ ID NO: 314173 - DNA, 23 bp, Artificial Sequence
  Description of Artificial Sequence: Synthetic oligonucleotide
ggggtcttcggggtgcccatctc

SEQ ID NO: 314174 - DNA, 25 bp, Artificial Sequence
  Description of Artificial Sequence: Synthetic oligonucleotide
gggtcttcggggtgcccatctcctt

SEQ ID NO: 314175 - DNA, 25 bp, Artificial Sequence
  Description of Artificial Sequence: Synthetic oligonucleotide
ggtcttcggggtgcccatctccttc

SEQ ID NO: 314176 - DNA, 26 bp, Artificial Sequence
  Description of Artificial Sequence: Synthetic oligonucleotide
gtcttcggggtgcccatctccttcct

SEQ ID NO: 314177 - DNA, 27 bp, Artificial Sequence
  Description of Artificial Sequence: Synthetic oligonucleotide
tcttcggggtgcccatctccttcctga

SEQ ID NO: 314178 - DNA, 27 bp, Artificial Sequence
  Description of Artificial Sequence: Synthetic oligonucleotide
cttcggggtgcccatctccttcctgat

SEQ ID NO: 314179 - DNA, 27 bp, Artificial Sequence
  Description of Artificial Sequence: Synthetic oligonucleotide
ttcggggtgcccatctccttcctgatc

SEQ ID NO: 314180 - DNA, 27 bp, Artificial Sequence
  Description of Artificial Sequence: Synthetic oligonucleotide
tcggggtgcccatctccttcctgatca

SEQ ID NO: 314181 - DNA, 27 bp, Artificial Sequence
  Description of Artificial Sequence: Synthetic oligonucleotide
cggggtgcccatctccttcctgatcaa

SEQ ID NO: 314182 - DNA, 27 bp, Artificial Sequence
  Description of Artificial Sequence: Synthetic oligonucleotide
ggggtgcccatctccttcctgatcaag

SEQ ID NO: 314183 - DNA, 27 bp, Artificial Sequence
  Description of Artificial Sequence: Synthetic oligonucleotide
gggtgcccatctccttcctgatcaagg

SEQ ID NO: 314184 - DNA, 28 bp, Artificial Sequence
  Description of Artificial Sequence: Synthetic oligonucleotide
ggtgcccatctccttcctgatcaaggtc

SEQ ID NO: 314185 - DNA, 28 bp, Artificial Sequence
  Description of Artificial Sequence: Synthetic oligonucleotide
gtgcccatctccttcctgatcaaggtcc

SEQ ID NO: 314186 - DNA, 29 bp, Artificial Sequence
  Description of Artificial Sequence: Synthetic oligonucleotide
tgcccatctccttcctgatcaaggtcctg

SEQ ID NO: 314187 - DNA, 28 bp, Artificial Sequence
  Description of Artificial Sequence: Synthetic oligonucleotide
gcccatctccttcctgatcaaggtcctg

SEQ ID NO: 314188 - DNA, 28 bp, Artificial Sequence
  Description of Artificial Sequence: Synthetic oligonucleotide
cccatctccttcctgatcaaggtcctgg

SEQ ID NO: 314189 - DNA, 29 bp, Artificial Sequence
  Description of Artificial Sequence: Synthetic oligonucleotide
ccatctccttcctgatcaaggtcctggtc

SEQ ID NO: 314190 - DNA, 29 bp, Artificial Sequence
  Description of Artificial Sequence: Synthetic oligonucleotide
catctccttcctgatcaaggtcctggtcg

SEQ ID NO: 314191 - DNA, 33 bp, Artificial Sequence
  Description of Artificial Sequence: Synthetic oligonucleotide
atctccttcctgatcaaggtcctggtcgatttc

SEQ ID NO: 314192 - DNA, 32 bp, Artificial Sequence
  Description of Artificial Sequence: Synthetic oligonucleotide
tctccttcctgatcaaggtcctggtcgatttc

SEQ ID NO: 314193 - DNA, 31 bp, Artificial Sequence
  Description of Artificial Sequence: Synthetic oligonucleotide
ctccttcctgatcaaggtcctggtcgatttc

SEQ ID NO: 314194 - DNA, 33 bp, Artificial Sequence
  Description of Artificial Sequence: Synthetic oligonucleotide
tccttcctgatcaaggtcctggtcgatttcttc

SEQ ID NO: 314195 - DNA, 32 bp, Artificial Sequence
  Description of Artificial Sequence: Synthetic oligonucleotide
ccttcctgatcaaggtcctggtcgatttcttc

SEQ ID NO: 314196 - DNA, 35 bp, Artificial Sequence
  Description of Artificial Sequence: Synthetic oligonucleotide
cttcctgatcaaggtcctggtcgatttcttctttc

SEQ ID NO: 314197 - DNA, 36 bp, Artificial Sequence
  Description of Artificial Sequence: Synthetic oligonucleotide
ttcctgatcaaggtcctggtcgatttcttctttcag

SEQ ID NO: 314198 - DNA, 35 bp, Artificial Sequence
  Description of Artificial Sequence: Synthetic oligonucleotide
tcctgatcaaggtcctggtcgatttcttctttcag

SEQ ID NO: 314199 - DNA, 34 bp, Artificial Sequence
  Description of Artificial Sequence: Synthetic oligonucleotide
cctgatcaaggtcctggtcgatttcttctttcag

SEQ ID NO: 314200 - DNA, 34 bp, Artificial Sequence
  Description of Artificial Sequence: Synthetic oligonucleotide
ctgatcaaggtcctggtcgatttcttctttcagg

SEQ ID NO: 314201 - DNA, 37 bp, Artificial Sequence
  Description of Artificial Sequence: Synthetic oligonucleotide
tgatcaaggtcctggtcgatttcttctttcaggatag

SEQ ID NO: 314202 - DNA, 36 bp, Artificial Sequence
  Description of Artificial Sequence: Synthetic oligonucleotide
gatcaaggtcctggtcgatttcttctttcaggatag

SEQ ID NO: 314203 - DNA, 36 bp, Artificial Sequence
  Description of Artificial Sequence: Synthetic oligonucleotide
atcaaggtcctggtcgatttcttctttcaggatagc

SEQ ID NO: 314204 - DNA, 35 bp, Artificial Sequence
  Description of Artificial Sequence: Synthetic oligonucleotide
tcaaggtcctggtcgatttcttctttcaggatagc

SEQ ID NO: 314205 - DNA, 34 bp, Artificial Sequence
  Description of Artificial Sequence: Synthetic oligonucleotide
caaggtcctggtcgatttcttctttcaggatagc

SEQ ID NO: 314206 - DNA, 36 bp, Artificial Sequence
  Description of Artificial Sequence: Synthetic oligonucleotide
aaggtcctggtcgatttcttctttcaggatagctac

SEQ ID NO: 314207 - DNA, 35 bp, Artificial Sequence
  Description of Artificial Sequence: Synthetic oligonucleotide
aggtcctggtcgatttcttctttcaggatagctac

SEQ ID NO: 314208 - DNA, 34 bp, Artificial Sequence
  Description of Artificial Sequence: Synthetic oligonucleotide
ggtcctggtcgatttcttctttcaggatagctac

SEQ ID NO: 314209 - DNA, 35 bp, Artificial Sequence
  Description of Artificial Sequence: Synthetic oligonucleotide
gtcctggtcgatttcttctttcaggatagctacac

SEQ ID NO: 314210 - DNA, 35 bp, Artificial Sequence
  Description of Artificial Sequence: Synthetic oligonucleotide
tcctggtcgatttcttctttcaggatagctacacc

SEQ ID NO: 314211 - DNA, 34 bp, Artificial Sequence
  Description of Artificial Sequence: Synthetic oligonucleotide
cctggtcgatttcttctttcaggatagctacacc

SEQ ID NO: 314212 - DNA, 34 bp, Artificial Sequence
  Description of Artificial Sequence: Synthetic oligonucleotide
ctggtcgatttcttctttcaggatagctacaccc

SEQ ID NO: 314213 - DNA, 35 bp, Artificial Sequence
  Description of Artificial Sequence: Synthetic oligonucleotide
tggtcgatttcttctttcaggatagctacacccac

SEQ ID NO: 314214 - DNA, 34 bp, Artificial Sequence
  Description of Artificial Sequence: Synthetic oligonucleotide
ggtcgatttcttctttcaggatagctacacccac

SEQ ID NO: 314215 - DNA, 37 bp, Artificial Sequence
  Description of Artificial Sequence: Synthetic oligonucleotide
gtcgatttcttctttcaggatagctacacccacaaac

SEQ ID NO: 314216 - DNA, 38 bp, Artificial Sequence
  Description of Artificial Sequence: Synthetic oligonucleotide
tcgatttcttctttcaggatagctacacccacaaactc

SEQ ID NO: 314217 - DNA, 37 bp, Artificial Sequence
  Description of Artificial Sequence: Synthetic oligonucleotide
cgatttcttctttcaggatagctacacccacaaactc

SEQ ID NO: 314218 - DNA, 38 bp, Artificial Sequence
  Description of Artificial Sequence: Synthetic oligonucleotide
gatttcttctttcaggatagctacacccacaaactctc

SEQ ID NO: 314219 - DNA, 38 bp, Artificial Sequence
  Description of Artificial Sequence: Synthetic oligonucleotide
atttcttctttcaggatagctacacccacaaactctcg

SEQ ID NO: 314220 - DNA, 37 bp, Artificial Sequence
  Description of Artificial Sequence: Synthetic oligonucleotide
tttcttctttcaggatagctacacccacaaactctcg

SEQ ID NO: 314221 - DNA, 36 bp, Artificial Sequence
  Description of Artificial Sequence: Synthetic oligonucleotide
ttcttctttcaggatagctacacccacaaactctcg

SEQ ID NO: 314222 - DNA, 35 bp, Artificial Sequence
  Description of Artificial Sequence: Synthetic oligonucleotide
tcttctttcaggatagctacacccacaaactctcg

SEQ ID NO: 314223 - DNA, 34 bp, Artificial Sequence
  Description of Artificial Sequence: Synthetic oligonucleotide
cttctttcaggatagctacacccacaaactctcg

SEQ ID NO: 314224 - DNA, 34 bp, Artificial Sequence
  Description of Artificial Sequence: Synthetic oligonucleotide
ttctttcaggatagctacacccacaaactctcgc

SEQ ID NO: 314225 - DNA, 33 bp, Artificial Sequence
  Description of Artificial Sequence: Synthetic oligonucleotide
tctttcaggatagctacacccacaaactctcgc

SEQ ID NO: 314226 - DNA, 32 bp, Artificial Sequence
  Description of Artificial Sequence: Synthetic oligonucleotide
ctttcaggatagctacacccacaaactctcgc

SEQ ID NO: 314227 - DNA, 33 bp, Artificial Sequence
  Description of Artificial Sequence: Synthetic oligonucleotide
tttcaggatagctacacccacaaactctcgctg

SEQ ID NO: 314228 - DNA, 32 bp, Artificial Sequence
  Description of Artificial Sequence: Synthetic oligonucleotide
ttcaggatagctacacccacaaactctcgctg

SEQ ID NO: 314229 - DNA, 31 bp, Artificial Sequence
  Description of Artificial Sequence: Synthetic oligonucleotide
tcaggatagctacacccacaaactctcgctg

SEQ ID NO: 314230 - DNA, 30 bp, Artificial Sequence
  Description of Artificial Sequence: Synthetic oligonucleotide
caggatagctacacccacaaactctcgctg

SEQ ID NO: 314231 - DNA, 30 bp, Artificial Sequence
  Description of Artificial Sequence: Synthetic oligonucleotide
aggatagctacacccacaaactctcgctgc

SEQ ID NO: 314232 - DNA, 29 bp, Artificial Sequence
  Description of Artificial Sequence: Synthetic oligonucleotide
ggatagctacacccacaaactctcgctgc

SEQ ID NO: 314233 - DNA, 29 bp, Artificial Sequence
  Description of Artificial Sequence: Synthetic oligonucleotide
gatagctacacccacaaactctcgctgcc

SEQ ID NO: 314234 - DNA, 30 bp, Artificial Sequence
  Description of Artificial Sequence: Synthetic oligonucleotide
atagctacacccacaaactctcgctgcctg

SEQ ID NO: 314235 - DNA, 29 bp, Artificial Sequence
  Description of Artificial Sequence: Synthetic oligonucleotide
tagctacacccacaaactctcgctgcctg

SEQ ID NO: 314236 - DNA, 28 bp, Artificial Sequence
  Description of Artificial Sequence: Synthetic oligonucleotide
agctacacccacaaactctcgctgcctg

SEQ ID NO: 314237 - DNA, 27 bp, Artificial Sequence
  Description of Artificial Sequence: Synthetic oligonucleotide
gctacacccacaaactctcgctgcctg

SEQ ID NO: 314238 - DNA, 29 bp, Artificial Sequence
  Description of Artificial Sequence: Synthetic oligonucleotide
ctacacccacaaactctcgctgcctgatg

SEQ ID NO: 314239 - DNA, 29 bp, Artificial Sequence
  Description of Artificial Sequence: Synthetic oligonucleotide
tacacccacaaactctcgctgcctgatgc

SEQ ID NO: 314240 - DNA, 28 bp, Artificial Sequence
  Description of Artificial Sequence: Synthetic oligonucleotide
acacccacaaactctcgctgcctgatgc

SEQ ID NO: 314241 - DNA, 27 bp, Artificial Sequence
  Description of Artificial Sequence: Synthetic oligonucleotide
cacccacaaactctcgctgcctgatgc

SEQ ID NO: 314242 - DNA, 27 bp, Artificial Sequence
  Description of Artificial Sequence: Synthetic oligonucleotide
acccacaaactctcgctgcctgatgcc

SEQ ID NO: 314243 - DNA, 27 bp, Artificial Sequence
  Description of Artificial Sequence: Synthetic oligonucleotide
cccacaaactctcgctgcctgatgcct

SEQ ID NO: 314244 - DNA, 28 bp, Artificial Sequence
  Description of Artificial Sequence: Synthetic oligonucleotide
ccacaaactctcgctgcctgatgccttc

SEQ ID NO: 314245 - DNA, 30 bp, Artificial Sequence
  Description of Artificial Sequence: Synthetic oligonucleotide
cacaaactctcgctgcctgatgccttcaag

SEQ ID NO: 314246 - DNA, 30 bp, Artificial Sequence
  Description of Artificial Sequence: Synthetic oligonucleotide
acaaactctcgctgcctgatgccttcaagg

SEQ ID NO: 314247 - DNA, 29 bp, Artificial Sequence
  Description of Artificial Sequence: Synthetic oligonucleotide
caaactctcgctgcctgatgccttcaagg

SEQ ID NO: 314248 - DNA, 30 bp, Artificial Sequence
  Description of Artificial Sequence: Synthetic oligonucleotide
aaactctcgctgcctgatgccttcaaggtc

SEQ ID NO: 314249 - DNA, 29 bp, Artificial Sequence
  Description of Artificial Sequence: Synthetic oligonucleotide
aactctcgctgcctgatgccttcaaggtc

SEQ ID NO: 314250 - DNA, 28 bp, Artificial Sequence
  Description of Artificial Sequence: Synthetic oligonucleotide
actctcgctgcctgatgccttcaaggtc

SEQ ID NO: 314251 - DNA, 27 bp, Artificial Sequence
  Description of Artificial Sequence: Synthetic oligonucleotide
ctctcgctgcctgatgccttcaaggtc

SEQ ID NO: 314252 - DNA, 28 bp, Artificial Sequence
  Description of Artificial Sequence: Synthetic oligonucleotide
tctcgctgcctgatgccttcaaggtctc

SEQ ID NO: 314253 - DNA, 27 bp, Artificial Sequence
  Description of Artificial Sequence: Synthetic oligonucleotide
ctcgctgcctgatgccttcaaggtctc

SEQ ID NO: 314254 - DNA, 27 bp, Artificial Sequence
  Description of Artificial Sequence: Synthetic oligonucleotide
tcgctgcctgatgccttcaaggtctcc

SEQ ID NO: 314255 - DNA, 27 bp, Artificial Sequence
  Description of Artificial Sequence: Synthetic oligonucleotide
cgctgcctgatgccttcaaggtctcca

SEQ ID NO: 314256 - DNA, 28 bp, Artificial Sequence
  Description of Artificial Sequence: Synthetic oligonucleotide
gctgcctgatgccttcaaggtctccaac

SEQ ID NO: 314257 - DNA, 29 bp, Artificial Sequence
  Description of Artificial Sequence: Synthetic oligonucleotide
ctgcctgatgccttcaaggtctccaactc

SEQ ID NO: 314258 - DNA, 29 bp, Artificial Sequence
  Description of Artificial Sequence: Synthetic oligonucleotide
tgcctgatgccttcaaggtctccaactcc

SEQ ID NO: 314259 - DNA, 28 bp, Artificial Sequence
  Description of Artificial Sequence: Synthetic oligonucleotide
gcctgatgccttcaaggtctccaactcc

SEQ ID NO: 314260 - DNA, 29 bp, Artificial Sequence
  Description of Artificial Sequence: Synthetic oligonucleotide
cctgatgccttcaaggtctccaactccac

SEQ ID NO: 314261 - DNA, 30 bp, Artificial Sequence
  Description of Artificial Sequence: Synthetic oligonucleotide
ctgatgccttcaaggtctccaactccacag

SEQ ID NO: 314262 - DNA, 30 bp, Artificial Sequence
  Description of Artificial Sequence: Synthetic oligonucleotide
tgatgccttcaaggtctccaactccacagc

SEQ ID NO: 314263 - DNA, 29 bp, Artificial Sequence
  Description of Artificial Sequence: Synthetic oligonucleotide
gatgccttcaaggtctccaactccacagc

SEQ ID NO: 314264 - DNA, 29 bp, Artificial Sequence
  Description of Artificial Sequence: Synthetic oligonucleotide
atgccttcaaggtctccaactccacagcc

SEQ ID NO: 314265 - DNA, 28 bp, Artificial Sequence
  Description of Artificial Sequence: Synthetic oligonucleotide
tgccttcaaggtctccaactccacagcc

SEQ ID NO: 314266 - DNA, 27 bp, Artificial Sequence
  Description of Artificial Sequence: Synthetic oligonucleotide
gccttcaaggtctccaactccacagcc

SEQ ID NO: 314267 - DNA, 27 bp, Artificial Sequence
  Description of Artificial Sequence: Synthetic oligonucleotide
ccttcaaggtctccaactccacagccc

SEQ ID NO: 314268 - DNA, 27 bp, Artificial Sequence
  Description of Artificial Sequence: Synthetic oligonucleotide
cttcaaggtctccaactccacagcccg

SEQ ID NO: 314269 - DNA, 27 bp, Artificial Sequence
  Description of Artificial Sequence: Synthetic oligonucleotide
ttcaaggtctccaactccacagcccgg

SEQ ID NO: 314270 - DNA, 26 bp, Artificial Sequence
  Description of Artificial Sequence: Synthetic oligonucleotide
tcaaggtctccaactccacagcccgg

SEQ ID NO: 314271 - DNA, 25 bp, Artificial Sequence
  Description of Artificial Sequence: Synthetic oligonucleotide
caaggtctccaactccacagcccgg

SEQ ID NO: 314272 - DNA, 25 bp, Artificial Sequence
  Description of Artificial Sequence: Synthetic oligonucleotide
aaggtctccaactccacagcccggg

SEQ ID NO: 314273 - DNA, 24 bp, Artificial Sequence
  Description of Artificial Sequence: Synthetic oligonucleotide
aggtctccaactccacagcccggg

SEQ ID NO: 314274 - DNA, 23 bp, Artificial Sequence
  Description of Artificial Sequence: Synthetic oligonucleotide
ggtctccaactccacagcccggg

SEQ ID NO: 314275 - DNA, 23 bp, Artificial Sequence
  Description of Artificial Sequence: Synthetic oligonucleotide
gtctccaactccacagcccgggc

SEQ ID NO: 314276 - DNA, 24 bp, Artificial Sequence
  Description of Artificial Sequence: Synthetic oligonucleotide
tctccaactccacagcccgggcct

SEQ ID NO: 314277 - DNA, 23 bp, Artificial Sequence
  Description of Artificial Sequence: Synthetic oligonucleotide
ctccaactccacagcccgggcct

SEQ ID NO: 314278 - DNA, 23 bp, Artificial Sequence
  Description of Artificial Sequence: Synthetic oligonucleotide
tccaactccacagcccgggcctg

SEQ ID NO: 314279 - DNA, 22 bp, Artificial Sequence
  Description of Artificial Sequence: Synthetic oligonucleotide
ccaactccacagcccgggcctg

SEQ ID NO: 314280 - DNA, 22 bp, Artificial Sequence
  Description of Artificial Sequence: Synthetic oligonucleotide
caactccacagcccgggcctgg

SEQ ID NO: 314281 - DNA, 23 bp, Artificial Sequence
  Description of Artificial Sequence: Synthetic oligonucleotide
aactccacagcccgggcctgggt

SEQ ID NO: 314282 - DNA, 22 bp, Artificial Sequence
  Description of Artificial Sequence: Synthetic oligonucleotide
actccacagcccgggcctgggt

SEQ ID NO: 314283 - DNA, 21 bp, Artificial Sequence
  Description of Artificial Sequence: Synthetic oligonucleotide
ctccacagcccgggcctgggt

SEQ ID NO: 314284 - DNA, 23 bp, Artificial Sequence
  Description of Artificial Sequence: Synthetic oligonucleotide
tccacagcccgggcctgggtcat

SEQ ID NO: 314285 - DNA, 22 bp, Artificial Sequence
  Description of Artificial Sequence: Synthetic oligonucleotide
ccacagcccgggcctgggtcat

SEQ ID NO: 314286 - DNA, 22 bp, Artificial Sequence
  Description of Artificial Sequence: Synthetic oligonucleotide
cacagcccgggcctgggtcatg

SEQ ID NO: 314287 - DNA, 23 bp, Artificial Sequence
  Description of Artificial Sequence: Synthetic oligonucleotide
acagcccgggcctgggtcatgca

SEQ ID NO: 314288 - DNA, 22 bp, Artificial Sequence
  Description of Artificial Sequence: Synthetic oligonucleotide
cagcccgggcctgggtcatgca

SEQ ID NO: 314289 - DNA, 22 bp, Artificial Sequence
  Description of Artificial Sequence: Synthetic oligonucleotide
agcccgggcctgggtcatgcac

SEQ ID NO: 314290 - DNA, 21 bp, Artificial Sequence
  Description of Artificial Sequence: Synthetic oligonucleotide
gcccgggcctgggtcatgcac

SEQ ID NO: 314291 - DNA, 21 bp, Artificial Sequence
  Description of Artificial Sequence: Synthetic oligonucleotide
cccgggcctgggtcatgcacc

SEQ ID NO: 314292 - DNA, 22 bp, Artificial Sequence
  Description of Artificial Sequence: Synthetic oligonucleotide
ccgggcctgggtcatgcaccca

SEQ ID NO: 314293 - DNA, 23 bp, Artificial Sequence
  Description of Artificial Sequence: Synthetic oligonucleotide
cgggcctgggtcatgcacccact

SEQ ID NO: 314294 - DNA, 23 bp, Artificial Sequence
  Description of Artificial Sequence: Synthetic oligonucleotide
gggcctgggtcatgcacccactg

SEQ ID NO: 314295 - DNA, 23 bp, Artificial Sequence
  Description of Artificial Sequence: Synthetic oligonucleotide
ggcctgggtcatgcacccactgc

SEQ ID NO: 314296 - DNA, 23 bp, Artificial Sequence
  Description of Artificial Sequence: Synthetic oligonucleotide
gcctgggtcatgcacccactgcg

SEQ ID NO: 314297 - DNA, 25 bp, Artificial Sequence
  Description of Artificial Sequence: Synthetic oligonucleotide
cctgggtcatgcacccactgcgctt

SEQ ID NO: 314298 - DNA, 25 bp, Artificial Sequence
  Description of Artificial Sequence: Synthetic oligonucleotide
ctgggtcatgcacccactgcgcttg

SEQ ID NO: 314299 - DNA, 25 bp, Artificial Sequence
  Description of Artificial Sequence: Synthetic oligonucleotide
tgggtcatgcacccactgcgcttgc

SEQ ID NO: 314300 - DNA, 24 bp, Artificial Sequence
  Description of Artificial Sequence: Synthetic oligonucleotide
gggtcatgcacccactgcgcttgc

SEQ ID NO: 314301 - DNA, 26 bp, Artificial Sequence
  Description of Artificial Sequence: Synthetic oligonucleotide
ggtcatgcacccactgcgcttgcgtt

SEQ ID NO: 314302 - DNA, 26 bp, Artificial Sequence
  Description of Artificial Sequence: Synthetic oligonucleotide
gtcatgcacccactgcgcttgcgttg

SEQ ID NO: 314303 - DNA, 26 bp, Artificial Sequence
  Description of Artificial Sequence: Synthetic oligonucleotide
tcatgcacccactgcgcttgcgttgc

SEQ ID NO: 314304 - DNA, 25 bp, Artificial Sequence
  Description of Artificial Sequence: Synthetic oligonucleotide
catgcacccactgcgcttgcgttgc

SEQ ID NO: 314305 - DNA, 26 bp, Artificial Sequence
  Description of Artificial Sequence: Synthetic oligonucleotide
atgcacccactgcgcttgcgttgcga

SEQ ID NO: 314306 - DNA, 25 bp, Artificial Sequence
  Description of Artificial Sequence: Synthetic oligonucleotide
tgcacccactgcgcttgcgttgcga

SEQ ID NO: 314307 - DNA, 24 bp, Artificial Sequence
  Description of Artificial Sequence: Synthetic oligonucleotide
gcacccactgcgcttgcgttgcga

SEQ ID NO: 314308 - DNA, 27 bp, Artificial Sequence
  Description of Artificial Sequence: Synthetic oligonucleotide
cacccactgcgcttgcgttgcgagttt

SEQ ID NO: 314309 - DNA, 27 bp, Artificial Sequence
  Description of Artificial Sequence: Synthetic oligonucleotide
acccactgcgcttgcgttgcgagtttc

SEQ ID NO: 314310 - DNA, 26 bp, Artificial Sequence
  Description of Artificial Sequence: Synthetic oligonucleotide
cccactgcgcttgcgttgcgagtttc

SEQ ID NO: 314311 - DNA, 26 bp, Artificial Sequence
  Description of Artificial Sequence: Synthetic oligonucleotide
ccactgcgcttgcgttgcgagtttcc

SEQ ID NO: 314312 - DNA, 27 bp, Artificial Sequence
  Description of Artificial Sequence: Synthetic oligonucleotide
cactgcgcttgcgttgcgagtttccga

SEQ ID NO: 314313 - DNA, 28 bp, Artificial Sequence
  Description of Artificial Sequence: Synthetic oligonucleotide
actgcgcttgcgttgcgagtttccgatc

SEQ ID NO: 314314 - DNA, 27 bp, Artificial Sequence
  Description of Artificial Sequence: Synthetic oligonucleotide
ctgcgcttgcgttgcgagtttccgatc

SEQ ID NO: 314315 - DNA, 28 bp, Artificial Sequence
  Description of Artificial Sequence: Synthetic oligonucleotide
tgcgcttgcgttgcgagtttccgatctg

SEQ ID NO: 314316 - DNA, 27 bp, Artificial Sequence
  Description of Artificial Sequence: Synthetic oligonucleotide
gcgcttgcgttgcgagtttccgatctg

SEQ ID NO: 314317 - DNA, 27 bp, Artificial Sequence
  Description of Artificial Sequence: Synthetic oligonucleotide
cgcttgcgttgcgagtttccgatctgg

SEQ ID NO: 314318 - DNA, 29 bp, Artificial Sequence
  Description of Artificial Sequence: Synthetic oligonucleotide
gcttgcgttgcgagtttccgatctggatg

SEQ ID NO: 314319 - DNA, 31 bp, Artificial Sequence
  Description of Artificial Sequence: Synthetic oligonucleotide
cttgcgttgcgagtttccgatctggatgttg

SEQ ID NO: 314320 - DNA, 34 bp, Artificial Sequence
  Description of Artificial Sequence: Synthetic oligonucleotide
ttgcgttgcgagtttccgatctggatgttgtttg

SEQ ID NO: 314321 - DNA, 33 bp, Artificial Sequence
  Description of Artificial Sequence: Synthetic oligonucleotide
tgcgttgcgagtttccgatctggatgttgtttg

SEQ ID NO: 314322 - DNA, 32 bp, Artificial Sequence
  Description of Artificial Sequence: Synthetic oligonucleotide
gcgttgcgagtttccgatctggatgttgtttg

SEQ ID NO: 314323 - DNA, 32 bp, Artificial Sequence
  Description of Artificial Sequence: Synthetic oligonucleotide
cgttgcgagtttccgatctggatgttgtttgc

SEQ ID NO: 314324 - DNA, 32 bp, Artificial Sequence
  Description of Artificial Sequence: Synthetic oligonucleotide
gttgcgagtttccgatctggatgttgtttgcc

SEQ ID NO: 314325 - DNA, 33 bp, Artificial Sequence
  Description of Artificial Sequence: Synthetic oligonucleotide
ttgcgagtttccgatctggatgttgtttgcctg

SEQ ID NO: 314326 - DNA, 32 bp, Artificial Sequence
  Description of Artificial Sequence: Synthetic oligonucleotide
tgcgagtttccgatctggatgttgtttgcctg

SEQ ID NO: 314327 - DNA, 31 bp, Artificial Sequence
  Description of Artificial Sequence: Synthetic oligonucleotide
gcgagtttccgatctggatgttgtttgcctg

SEQ ID NO: 314328 - DNA, 31 bp, Artificial Sequence
  Description of Artificial Sequence: Synthetic oligonucleotide
cgagtttccgatctggatgttgtttgcctgc

SEQ ID NO: 314329 - DNA, 31 bp, Artificial Sequence
  Description of Artificial Sequence: Synthetic oligonucleotide
gagtttccgatctggatgttgtttgcctgcg

SEQ ID NO: 314330 - DNA, 31 bp, Artificial Sequence
  Description of Artificial Sequence: Synthetic oligonucleotide
agtttccgatctggatgttgtttgcctgcgc

SEQ ID NO: 314331 - DNA, 30 bp, Artificial Sequence
  Description of Artificial Sequence: Synthetic oligonucleotide
gtttccgatctggatgttgtttgcctgcgc

SEQ ID NO: 314332 - DNA, 30 bp, Artificial Sequence
  Description of Artificial Sequence: Synthetic oligonucleotide
tttccgatctggatgttgtttgcctgcgcc

SEQ ID NO: 314333 - DNA, 29 bp, Artificial Sequence
  Description of Artificial Sequence: Synthetic oligonucleotide
ttccgatctggatgttgtttgcctgcgcc

SEQ ID NO: 314334 - DNA, 28 bp, Artificial Sequence
  Description of Artificial Sequence: Synthetic oligonucleotide
tccgatctggatgttgtttgcctgcgcc

SEQ ID NO: 314335 - DNA, 27 bp, Artificial Sequence
  Description of Artificial Sequence: Synthetic oligonucleotide
ccgatctggatgttgtttgcctgcgcc

SEQ ID NO: 314336 - DNA, 27 bp, Artificial Sequence
  Description of Artificial Sequence: Synthetic oligonucleotide
cgatctggatgttgtttgcctgcgccc

SEQ ID NO: 314337 - DNA, 28 bp, Artificial Sequence
  Description of Artificial Sequence: Synthetic oligonucleotide
gatctggatgttgtttgcctgcgccctg

SEQ ID NO: 314338 - DNA, 28 bp, Artificial Sequence
  Description of Artificial Sequence: Synthetic oligonucleotide
atctggatgttgtttgcctgcgccctgc

SEQ ID NO: 314339 - DNA, 27 bp, Artificial Sequence
  Description of Artificial Sequence: Synthetic oligonucleotide
tctggatgttgtttgcctgcgccctgc

SEQ ID NO: 314340 - DNA, 26 bp, Artificial Sequence
  Description of Artificial Sequence: Synthetic oligonucleotide
ctggatgttgtttgcctgcgccctgc

SEQ ID NO: 314341 - DNA, 27 bp, Artificial Sequence
  Description of Artificial Sequence: Synthetic oligonucleotide
tggatgttgtttgcctgcgccctgcca

SEQ ID NO: 314342 - DNA, 26 bp, Artificial Sequence
  Description of Artificial Sequence: Synthetic oligonucleotide
ggatgttgtttgcctgcgccctgcca

SEQ ID NO: 314343 - DNA, 26 bp, Artificial Sequence
  Description of Artificial Sequence: Synthetic oligonucleotide
gatgttgtttgcctgcgccctgccag

SEQ ID NO: 314344 - DNA, 27 bp, Artificial Sequence
  Description of Artificial Sequence: Synthetic oligonucleotide
atgttgtttgcctgcgccctgccagct

SEQ ID NO: 314345 - DNA, 26 bp, Artificial Sequence
  Description of Artificial Sequence: Synthetic oligonucleotide
tgttgtttgcctgcgccctgccagct

SEQ ID NO: 314346 - DNA, 25 bp, Artificial Sequence
  Description of Artificial Sequence: Synthetic oligonucleotide
gttgtttgcctgcgccctgccagct

SEQ ID NO: 314347 - DNA, 26 bp, Artificial Sequence
  Description of Artificial Sequence: Synthetic oligonucleotide
ttgtttgcctgcgccctgccagctct

SEQ ID NO: 314348 - DNA, 25 bp, Artificial Sequence
  Description of Artificial Sequence: Synthetic oligonucleotide
tgtttgcctgcgccctgccagctct

SEQ ID NO: 314349 - DNA, 24 bp, Artificial Sequence
  Description of Artificial Sequence: Synthetic oligonucleotide
gtttgcctgcgccctgccagctct

SEQ ID NO: 314350 - DNA, 24 bp, Artificial Sequence
  Description of Artificial Sequence: Synthetic oligonucleotide
tttgcctgcgccctgccagctctg

SEQ ID NO: 314351 - DNA, 23 bp, Artificial Sequence
  Description of Artificial Sequence: Synthetic oligonucleotide
ttgcctgcgccctgccagctctg

SEQ ID NO: 314352 - DNA, 22 bp, Artificial Sequence
  Description of Artificial Sequence: Synthetic oligonucleotide
tgcctgcgccctgccagctctg

SEQ ID NO: 314353 - DNA, 21 bp, Artificial Sequence
  Description of Artificial Sequence: Synthetic oligonucleotide
gcctgcgccctgccagctctg

SEQ ID NO: 314354 - DNA, 22 bp, Artificial Sequence
  Description of Artificial Sequence: Synthetic oligonucleotide
cctgcgccctgccagctctgct

SEQ ID NO: 314355 - DNA, 22 bp, Artificial Sequence
  Description of Artificial Sequence: Synthetic oligonucleotide
ctgcgccctgccagctctgctg

SEQ ID NO: 314356 - DNA, 23 bp, Artificial Sequence
  Description of Artificial Sequence: Synthetic oligonucleotide
tgcgccctgccagctctgctgct

SEQ ID NO: 314357 - DNA, 22 bp, Artificial Sequence
  Description of Artificial Sequence: Synthetic oligonucleotide
gcgccctgccagctctgctgct

SEQ ID NO: 314358 - DNA, 24 bp, Artificial Sequence
  Description of Artificial Sequence: Synthetic oligonucleotide
cgccctgccagctctgctgctctt

SEQ ID NO: 314359 - DNA, 26 bp, Artificial Sequence
  Description of Artificial Sequence: Synthetic oligonucleotide
gccctgccagctctgctgctcttcat

SEQ ID NO: 314360 - DNA, 26 bp, Artificial Sequence
  Description of Artificial Sequence: Synthetic oligonucleotide
ccctgccagctctgctgctcttcatc

SEQ ID NO: 314361 - DNA, 27 bp, Artificial Sequence
  Description of Artificial Sequence: Synthetic oligonucleotide
cctgccagctctgctgctcttcatcca

SEQ ID NO: 314362 - DNA, 27 bp, Artificial Sequence
  Description of Artificial Sequence: Synthetic oligonucleotide
ctgccagctctgctgctcttcatccac

SEQ ID NO: 314363 - DNA, 32 bp, Artificial Sequence
  Description of Artificial Sequence: Synthetic oligonucleotide
tgccagctctgctgctcttcatccacatattc

SEQ ID NO: 314364 - DNA, 31 bp, Artificial Sequence
  Description of Artificial Sequence: Synthetic oligonucleotide
gccagctctgctgctcttcatccacatattc

SEQ ID NO: 314365 - DNA, 31 bp, Artificial Sequence
  Description of Artificial Sequence: Synthetic oligonucleotide
ccagctctgctgctcttcatccacatattcc

SEQ ID NO: 314366 - DNA, 32 bp, Artificial Sequence
  Description of Artificial Sequence: Synthetic oligonucleotide
cagctctgctgctcttcatccacatattcctc

SEQ ID NO: 314367 - DNA, 32 bp, Artificial Sequence
  Description of Artificial Sequence: Synthetic oligonucleotide
agctctgctgctcttcatccacatattcctcg

SEQ ID NO: 314368 - DNA, 31 bp, Artificial Sequence
  Description of Artificial Sequence: Synthetic oligonucleotide
gctctgctgctcttcatccacatattcctcg

SEQ ID NO: 314369 - DNA, 32 bp, Artificial Sequence
  Description of Artificial Sequence: Synthetic oligonucleotide
ctctgctgctcttcatccacatattcctcgag

SEQ ID NO: 314370 - DNA, 33 bp, Artificial Sequence
  Description of Artificial Sequence: Synthetic oligonucleotide
tctgctgctcttcatccacatattcctcgagtc

SEQ ID NO: 314371 - DNA, 32 bp, Artificial Sequence
  Description of Artificial Sequence: Synthetic oligonucleotide
ctgctgctcttcatccacatattcctcgagtc

SEQ ID NO: 314372 - DNA, 33 bp, Artificial Sequence
  Description of Artificial Sequence: Synthetic oligonucleotide
tgctgctcttcatccacatattcctcgagtctc

SEQ ID NO: 314373 - DNA, 32 bp, Artificial Sequence
  Description of Artificial Sequence: Synthetic oligonucleotide
gctgctcttcatccacatattcctcgagtctc

SEQ ID NO: 314374 - DNA, 33 bp, Artificial Sequence
  Description of Artificial Sequence: Synthetic oligonucleotide
ctgctcttcatccacatattcctcgagtctcag

SEQ ID NO: 314375 - DNA, 35 bp, Artificial Sequence
  Description of Artificial Sequence: Synthetic oligonucleotide
tgctcttcatccacatattcctcgagtctcagttc

SEQ ID NO: 314376 - DNA, 34 bp, Artificial Sequence
  Description of Artificial Sequence: Synthetic oligonucleotide
gctcttcatccacatattcctcgagtctcagttc

SEQ ID NO: 314377 - DNA, 35 bp, Artificial Sequence
  Description of Artificial Sequence: Synthetic oligonucleotide
ctcttcatccacatattcctcgagtctcagttcac

SEQ ID NO: 314378 - DNA, 35 bp, Artificial Sequence
  Description of Artificial Sequence: Synthetic oligonucleotide
tcttcatccacatattcctcgagtctcagttcacc

SEQ ID NO: 314379 - DNA, 34 bp, Artificial Sequence
  Description of Artificial Sequence: Synthetic oligonucleotide
cttcatccacatattcctcgagtctcagttcacc

SEQ ID NO: 314380 - DNA, 35 bp, Artificial Sequence
  Description of Artificial Sequence: Synthetic oligonucleotide
ttcatccacatattcctcgagtctcagttcaccac

SEQ ID NO: 314381 - DNA, 34 bp, Artificial Sequence
  Description of Artificial Sequence: Synthetic oligonucleotide
tcatccacatattcctcgagtctcagttcaccac

SEQ ID NO: 314382 - DNA, 33 bp, Artificial Sequence
  Description of Artificial Sequence: Synthetic oligonucleotide
catccacatattcctcgagtctcagttcaccac

SEQ ID NO: 314383 - DNA, 33 bp, Artificial Sequence
  Description of Artificial Sequence: Synthetic oligonucleotide
atccacatattcctcgagtctcagttcaccacg

SEQ ID NO: 314384 - DNA, 32 bp, Artificial Sequence
  Description of Artificial Sequence: Synthetic oligonucleotide
tccacatattcctcgagtctcagttcaccacg

SEQ ID NO: 314385 - DNA, 31 bp, Artificial Sequence
  Description of Artificial Sequence: Synthetic oligonucleotide
ccacatattcctcgagtctcagttcaccacg

SEQ ID NO: 314386 - DNA, 31 bp, Artificial Sequence
  Description of Artificial Sequence: Synthetic oligonucleotide
cacatattcctcgagtctcagttcaccacgc

SEQ ID NO: 314387 - DNA, 32 bp, Artificial Sequence
  Description of Artificial Sequence: Synthetic oligonucleotide
acatattcctcgagtctcagttcaccacgcag

SEQ ID NO: 314388 - DNA, 31 bp, Artificial Sequence
  Description of Artificial Sequence: Synthetic oligonucleotide
catattcctcgagtctcagttcaccacgcag

SEQ ID NO: 314389 - DNA, 34 bp, Artificial Sequence
  Description of Artificial Sequence: Synthetic oligonucleotide
atattcctcgagtctcagttcaccacgcagattg

SEQ ID NO: 314390 - DNA, 33 bp, Artificial Sequence
  Description of Artificial Sequence: Synthetic oligonucleotide
tattcctcgagtctcagttcaccacgcagattg

SEQ ID NO: 314391 - DNA, 32 bp, Artificial Sequence
  Description of Artificial Sequence: Synthetic oligonucleotide
attcctcgagtctcagttcaccacgcagattg

SEQ ID NO: 314392 - DNA, 31 bp, Artificial Sequence
  Description of Artificial Sequence: Synthetic oligonucleotide
ttcctcgagtctcagttcaccacgcagattg

SEQ ID NO: 314393 - DNA, 30 bp, Artificial Sequence
  Description of Artificial Sequence: Synthetic oligonucleotide
tcctcgagtctcagttcaccacgcagattg

SEQ ID NO: 314394 - DNA, 29 bp, Artificial Sequence
  Description of Artificial Sequence: Synthetic oligonucleotide
cctcgagtctcagttcaccacgcagattg

SEQ ID NO: 314395 - DNA, 30 bp, Artificial Sequence
  Description of Artificial Sequence: Synthetic oligonucleotide
ctcgagtctcagttcaccacgcagattgtc

SEQ ID NO: 314396 - DNA, 31 bp, Artificial Sequence
  Description of Artificial Sequence: Synthetic oligonucleotide
tcgagtctcagttcaccacgcagattgtcag

SEQ ID NO: 314397 - DNA, 30 bp, Artificial Sequence
  Description of Artificial Sequence: Synthetic oligonucleotide
cgagtctcagttcaccacgcagattgtcag

SEQ ID NO: 314398 - DNA, 30 bp, Artificial Sequence
  Description of Artificial Sequence: Synthetic oligonucleotide
gagtctcagttcaccacgcagattgtcagg

SEQ ID NO: 314399 - DNA, 33 bp, Artificial Sequence
  Description of Artificial Sequence: Synthetic oligonucleotide
agtctcagttcaccacgcagattgtcaggaaac

SEQ ID NO: 314400 - DNA, 32 bp, Artificial Sequence
  Description of Artificial Sequence: Synthetic oligonucleotide
gtctcagttcaccacgcagattgtcaggaaac

SEQ ID NO: 314401 - DNA, 32 bp, Artificial Sequence
  Description of Artificial Sequence: Synthetic oligonucleotide
tctcagttcaccacgcagattgtcaggaaacc

SEQ ID NO: 314402 - DNA, 31 bp, Artificial Sequence
  Description of Artificial Sequence: Synthetic oligonucleotide
ctcagttcaccacgcagattgtcaggaaacc

SEQ ID NO: 314403 - DNA, 32 bp, Artificial Sequence
  Description of Artificial Sequence: Synthetic oligonucleotide
tcagttcaccacgcagattgtcaggaaacctg

SEQ ID NO: 314404 - DNA, 31 bp, Artificial Sequence
  Description of Artificial Sequence: Synthetic oligonucleotide
cagttcaccacgcagattgtcaggaaacctg

SEQ ID NO: 314405 - DNA, 32 bp, Artificial Sequence
  Description of Artificial Sequence: Synthetic oligonucleotide
agttcaccacgcagattgtcaggaaacctgag

SEQ ID NO: 314406 - DNA, 31 bp, Artificial Sequence
  Description of Artificial Sequence: Synthetic oligonucleotide
gttcaccacgcagattgtcaggaaacctgag

SEQ ID NO: 314407 - DNA, 31 bp, Artificial Sequence
  Description of Artificial Sequence: Synthetic oligonucleotide
ttcaccacgcagattgtcaggaaacctgagg

SEQ ID NO: 314408 - DNA, 30 bp, Artificial Sequence
  Description of Artificial Sequence: Synthetic oligonucleotide
tcaccacgcagattgtcaggaaacctgagg

SEQ ID NO: 314409 - DNA, 29 bp, Artificial Sequence
  Description of Artificial Sequence: Synthetic oligonucleotide
caccacgcagattgtcaggaaacctgagg

SEQ ID NO: 314410 - DNA, 29 bp, Artificial Sequence
  Description of Artificial Sequence: Synthetic oligonucleotide
accacgcagattgtcaggaaacctgaggg

SEQ ID NO: 314411 - DNA, 28 bp, Artificial Sequence
  Description of Artificial Sequence: Synthetic oligonucleotide
ccacgcagattgtcaggaaacctgaggg

SEQ ID NO: 314412 - DNA, 28 bp, Artificial Sequence
  Description of Artificial Sequence: Synthetic oligonucleotide
cacgcagattgtcaggaaacctgagggc

SEQ ID NO: 314413 - DNA, 30 bp, Artificial Sequence
  Description of Artificial Sequence: Synthetic oligonucleotide
acgcagattgtcaggaaacctgagggcaag

SEQ ID NO: 314414 - DNA, 29 bp, Artificial Sequence
  Description of Artificial Sequence: Synthetic oligonucleotide
cgcagattgtcaggaaacctgagggcaag

SEQ ID NO: 314415 - DNA, 31 bp, Artificial Sequence
  Description of Artificial Sequence: Synthetic oligonucleotide
gcagattgtcaggaaacctgagggcaagatg

SEQ ID NO: 314416 - DNA, 31 bp, Artificial Sequence
  Description of Artificial Sequence: Synthetic oligonucleotide
cagattgtcaggaaacctgagggcaagatgg

SEQ ID NO: 314417 - DNA, 32 bp, Artificial Sequence
  Description of Artificial Sequence: Synthetic oligonucleotide
agattgtcaggaaacctgagggcaagatggac

SEQ ID NO: 314418 - DNA, 31 bp, Artificial Sequence
  Description of Artificial Sequence: Synthetic oligonucleotide
gattgtcaggaaacctgagggcaagatggac

SEQ ID NO: 314419 - DNA, 33 bp, Artificial Sequence
  Description of Artificial Sequence: Synthetic oligonucleotide
attgtcaggaaacctgagggcaagatggacaag

SEQ ID NO: 314420 - DNA, 32 bp, Artificial Sequence
  Description of Artificial Sequence: Synthetic oligonucleotide
ttgtcaggaaacctgagggcaagatggacaag

SEQ ID NO: 314421 - DNA, 31 bp, Artificial Sequence
  Description of Artificial Sequence: Synthetic oligonucleotide
tgtcaggaaacctgagggcaagatggacaag

SEQ ID NO: 314422 - DNA, 30 bp, Artificial Sequence
  Description of Artificial Sequence: Synthetic oligonucleotide
gtcaggaaacctgagggcaagatggacaag

SEQ ID NO: 314423 - DNA, 30 bp, Artificial Sequence
  Description of Artificial Sequence: Synthetic oligonucleotide
tcaggaaacctgagggcaagatggacaagg

SEQ ID NO: 314424 - DNA, 29 bp, Artificial Sequence
  Description of Artificial Sequence: Synthetic oligonucleotide
caggaaacctgagggcaagatggacaagg

SEQ ID NO: 314425 - DNA, 29 bp, Artificial Sequence
  Description of Artificial Sequence: Synthetic oligonucleotide
aggaaacctgagggcaagatggacaaggg

SEQ ID NO: 314426 - DNA, 28 bp, Artificial Sequence
  Description of Artificial Sequence: Synthetic oligonucleotide
ggaaacctgagggcaagatggacaaggg

SEQ ID NO: 314427 - DNA, 28 bp, Artificial Sequence
  Description of Artificial Sequence: Synthetic oligonucleotide
gaaacctgagggcaagatggacaagggc

SEQ ID NO: 314428 - DNA, 29 bp, Artificial Sequence
  Description of Artificial Sequence: Synthetic oligonucleotide
aaacctgagggcaagatggacaagggctc

SEQ ID NO: 314429 - DNA, 28 bp, Artificial Sequence
  Description of Artificial Sequence: Synthetic oligonucleotide
aacctgagggcaagatggacaagggctc

SEQ ID NO: 314430 - DNA, 27 bp, Artificial Sequence
  Description of Artificial Sequence: Synthetic oligonucleotide
acctgagggcaagatggacaagggctc

SEQ ID NO: 314431 - DNA, 26 bp, Artificial Sequence
  Description of Artificial Sequence: Synthetic oligonucleotide
cctgagggcaagatggacaagggctc

SEQ ID NO: 314432 - DNA, 26 bp, Artificial Sequence
  Description of Artificial Sequence: Synthetic oligonucleotide
ctgagggcaagatggacaagggctcg

SEQ ID NO: 314433 - DNA, 26 bp, Artificial Sequence
  Description of Artificial Sequence: Synthetic oligonucleotide
tgagggcaagatggacaagggctcgg

SEQ ID NO: 314434 - DNA, 25 bp, Artificial Sequence
  Description of Artificial Sequence: Synthetic oligonucleotide
gagggcaagatggacaagggctcgg

SEQ ID NO: 314435 - DNA, 25 bp, Artificial Sequence
  Description of Artificial Sequence: Synthetic oligonucleotide
agggcaagatggacaagggctcggg

SEQ ID NO: 314436 - DNA, 24 bp, Artificial Sequence
  Description of Artificial Sequence: Synthetic oligonucleotide
gggcaagatggacaagggctcggg

SEQ ID NO: 314437 - DNA, 26 bp, Artificial Sequence
  Description of Artificial Sequence: Synthetic oligonucleotide
ggcaagatggacaagggctcgggctt

SEQ ID NO: 314438 - DNA, 26 bp, Artificial Sequence
  Description of Artificial Sequence: Synthetic oligonucleotide
gcaagatggacaagggctcgggcttc

SEQ ID NO: 314439 - DNA, 27 bp, Artificial Sequence
  Description of Artificial Sequence: Synthetic oligonucleotide
caagatggacaagggctcgggcttcca

SEQ ID NO: 314440 - DNA, 27 bp, Artificial Sequence
  Description of Artificial Sequence: Synthetic oligonucleotide
aagatggacaagggctcgggcttccac

SEQ ID NO: 314441 - DNA, 26 bp, Artificial Sequence
  Description of Artificial Sequence: Synthetic oligonucleotide
agatggacaagggctcgggcttccac

SEQ ID NO: 314442 - DNA, 25 bp, Artificial Sequence
  Description of Artificial Sequence: Synthetic oligonucleotide
gatggacaagggctcgggcttccac

SEQ ID NO: 314443 - DNA, 26 bp, Artificial Sequence
  Description of Artificial Sequence: Synthetic oligonucleotide
atggacaagggctcgggcttccacgt

SEQ ID NO: 314444 - DNA, 25 bp, Artificial Sequence
  Description of Artificial Sequence: Synthetic oligonucleotide
tggacaagggctcgggcttccacgt

SEQ ID NO: 314445 - DNA, 24 bp, Artificial Sequence
  Description of Artificial Sequence: Synthetic oligonucleotide
ggacaagggctcgggcttccacgt

SEQ ID NO: 314446 - DNA, 24 bp, Artificial Sequence
  Description of Artificial Sequence: Synthetic oligonucleotide
gacaagggctcgggcttccacgtg

SEQ ID NO: 314447 - DNA, 25 bp, Artificial Sequence
  Description of Artificial Sequence: Synthetic oligonucleotide
acaagggctcgggcttccacgtgga

SEQ ID NO: 314448 - DNA, 24 bp, Artificial Sequence
  Description of Artificial Sequence: Synthetic oligonucleotide
caagggctcgggcttccacgtgga

SEQ ID NO: 314449 - DNA, 24 bp, Artificial Sequence
  Description of Artificial Sequence: Synthetic oligonucleotide
aagggctcgggcttccacgtggac

SEQ ID NO: 314450 - DNA, 23 bp, Artificial Sequence
  Description of Artificial Sequence: Synthetic oligonucleotide
agggctcgggcttccacgtggac

SEQ ID NO: 314451 - DNA, 22 bp, Artificial Sequence
  Description of Artificial Sequence: Synthetic oligonucleotide
gggctcgggcttccacgtggac

SEQ ID NO: 314452 - DNA, 23 bp, Artificial Sequence
  Description of Artificial Sequence: Synthetic oligonucleotide
ggctcgggcttccacgtggacct

SEQ ID NO: 314453 - DNA, 23 bp, Artificial Sequence
  Description of Artificial Sequence: Synthetic oligonucleotide
gctcgggcttccacgtggacctg

SEQ ID NO: 314454 - DNA, 24 bp, Artificial Sequence
  Description of Artificial Sequence: Synthetic oligonucleotide
ctcgggcttccacgtggacctgca

SEQ ID NO: 314455 - DNA, 24 bp, Artificial Sequence
  Description of Artificial Sequence: Synthetic oligonucleotide
tcgggcttccacgtggacctgcag

SEQ ID NO: 314456 - DNA, 23 bp, Artificial Sequence
  Description of Artificial Sequence: Synthetic oligonucleotide
cgggcttccacgtggacctgcag

SEQ ID NO: 314457 - DNA, 24 bp, Artificial Sequence
  Description of Artificial Sequence: Synthetic oligonucleotide
gggcttccacgtggacctgcagct

SEQ ID NO: 314458 - DNA, 24 bp, Artificial Sequence
  Description of Artificial Sequence: Synthetic oligonucleotide
ggcttccacgtggacctgcagctg

SEQ ID NO: 314459 - DNA, 26 bp, Artificial Sequence
  Description of Artificial Sequence: Synthetic oligonucleotide
gcttccacgtggacctgcagctggta

SEQ ID NO: 314460 - DNA, 27 bp, Artificial Sequence
  Description of Artificial Sequence: Synthetic oligonucleotide
cttccacgtggacctgcagctggtagt

SEQ ID NO: 314461 - DNA, 28 bp, Artificial Sequence
  Description of Artificial Sequence: Synthetic oligonucleotide
ttccacgtggacctgcagctggtagttg

SEQ ID NO: 314462 - DNA, 27 bp, Artificial Sequence
  Description of Artificial Sequence: Synthetic oligonucleotide
tccacgtggacctgcagctggtagttg

SEQ ID NO: 314463 - DNA, 26 bp, Artificial Sequence
  Description of Artificial Sequence: Synthetic oligonucleotide
ccacgtggacctgcagctggtagttg

SEQ ID NO: 314464 - DNA, 26 bp, Artificial Sequence
  Description of Artificial Sequence: Synthetic oligonucleotide
cacgtggacctgcagctggtagttgg

SEQ ID NO: 314465 - DNA, 27 bp, Artificial Sequence
  Description of Artificial Sequence: Synthetic oligonucleotide
acgtggacctgcagctggtagttggca

SEQ ID NO: 314466 - DNA, 27 bp, Artificial Sequence
  Description of Artificial Sequence: Synthetic oligonucleotide
cgtggacctgcagctggtagttggcat

SEQ ID NO: 314467 - DNA, 27 bp, Artificial Sequence
  Description of Artificial Sequence: Synthetic oligonucleotide
gtggacctgcagctggtagttggcatg

SEQ ID NO: 314468 - DNA, 27 bp, Artificial Sequence
  Description of Artificial Sequence: Synthetic oligonucleotide
tggacctgcagctggtagttggcatgg

SEQ ID NO: 314469 - DNA, 26 bp, Artificial Sequence
  Description of Artificial Sequence: Synthetic oligonucleotide
ggacctgcagctggtagttggcatgg

SEQ ID NO: 314470 - DNA, 27 bp, Artificial Sequence
  Description of Artificial Sequence: Synthetic oligonucleotide
gacctgcagctggtagttggcatgggt

SEQ ID NO: 314471 - DNA, 27 bp, Artificial Sequence
  Description of Artificial Sequence: Synthetic oligonucleotide
acctgcagctggtagttggcatgggtc

SEQ ID NO: 314472 - DNA, 26 bp, Artificial Sequence
  Description of Artificial Sequence: Synthetic oligonucleotide
cctgcagctggtagttggcatgggtc

SEQ ID NO: 314473 - DNA, 26 bp, Artificial Sequence
  Description of Artificial Sequence: Synthetic oligonucleotide
ctgcagctggtagttggcatgggtcg

SEQ ID NO: 314474 - DNA, 26 bp, Artificial Sequence
  Description of Artificial Sequence: Synthetic oligonucleotide
tgcagctggtagttggcatgggtcgg

SEQ ID NO: 314475 - DNA, 25 bp, Artificial Sequence
  Description of Artificial Sequence: Synthetic oligonucleotide
gcagctggtagttggcatgggtcgg

SEQ ID NO: 314476 - DNA, 26 bp, Artificial Sequence
  Description of Artificial Sequence: Synthetic oligonucleotide
cagctggtagttggcatgggtcgggt

SEQ ID NO: 314477 - DNA, 26 bp, Artificial Sequence
  Description of Artificial Sequence: Synthetic oligonucleotide
agctggtagttggcatgggtcgggtg

SEQ ID NO: 314478 - DNA, 25 bp, Artificial Sequence
  Description of Artificial Sequence: Synthetic oligonucleotide
gctggtagttggcatgggtcgggtg

SEQ ID NO: 314479 - DNA, 25 bp, Artificial Sequence
  Description of Artificial Sequence: Synthetic oligonucleotide
ctggtagttggcatgggtcgggtgg

SEQ ID NO: 314480 - DNA, 25 bp, Artificial Sequence
  Description of Artificial Sequence: Synthetic oligonucleotide
tggtagttggcatgggtcgggtggc

SEQ ID NO: 314481 - DNA, 24 bp, Artificial Sequence
  Description of Artificial Sequence: Synthetic oligonucleotide
ggtagttggcatgggtcgggtggc

SEQ ID NO: 314482 - DNA, 24 bp, Artificial Sequence
  Description of Artificial Sequence: Synthetic oligonucleotide
gtagttggcatgggtcgggtggcc

SEQ ID NO: 314483 - DNA, 24 bp, Artificial Sequence
  Description of Artificial Sequence: Synthetic oligonucleotide
tagttggcatgggtcgggtggccg

SEQ ID NO: 314484 - DNA, 23 bp, Artificial Sequence
  Description of Artificial Sequence: Synthetic oligonucleotide
agttggcatgggtcgggtggccg

SEQ ID NO: 314485 - DNA, 22 bp, Artificial Sequence
  Description of Artificial Sequence: Synthetic oligonucleotide
gttggcatgggtcgggtggccg

SEQ ID NO: 314486 - DNA, 22 bp, Artificial Sequence
  Description of Artificial Sequence: Synthetic oligonucleotide
ttggcatgggtcgggtggccgg

SEQ ID NO: 314487 - DNA, 21 bp, Artificial Sequence
  Description of Artificial Sequence: Synthetic oligonucleotide
tggcatgggtcgggtggccgg

SEQ ID NO: 314488 - DNA, 20 bp, Artificial Sequence
  Description of Artificial Sequence: Synthetic oligonucleotide
ggcatgggtcgggtggccgg

SEQ ID NO: 314489 - DNA, 20 bp, Artificial Sequence
  Description of Artificial Sequence: Synthetic oligonucleotide
gcatgggtcgggtggccggc

SEQ ID NO: 314490 - DNA, 21 bp, Artificial Sequence
  Description of Artificial Sequence: Synthetic oligonucleotide
catgggtcgggtggccggcct

SEQ ID NO: 314491 - DNA, 24 bp, Artificial Sequence
  Description of Artificial Sequence: Synthetic oligonucleotide
atgggtcgggtggccggcctcttt

SEQ ID NO: 314492 - DNA, 23 bp, Artificial Sequence
  Description of Artificial Sequence: Synthetic oligonucleotide
tgggtcgggtggccggcctcttt

SEQ ID NO: 314493 - DNA, 22 bp, Artificial Sequence
  Description of Artificial Sequence: Synthetic oligonucleotide
gggtcgggtggccggcctcttt

SEQ ID NO: 314494 - DNA, 22 bp, Artificial Sequence
  Description of Artificial Sequence: Synthetic oligonucleotide
ggtcgggtggccggcctctttg

SEQ ID NO: 314495 - DNA, 22 bp, Artificial Sequence
  Description of Artificial Sequence: Synthetic oligonucleotide
gtcgggtggccggcctctttgg

SEQ ID NO: 314496 - DNA, 24 bp, Artificial Sequence
  Description of Artificial Sequence: Synthetic oligonucleotide
tcgggtggccggcctctttggcat

SEQ ID NO: 314497 - DNA, 23 bp, Artificial Sequence
  Description of Artificial Sequence: Synthetic oligonucleotide
cgggtggccggcctctttggcat

SEQ ID NO: 314498 - DNA, 23 bp, Artificial Sequence
  Description of Artificial Sequence: Synthetic oligonucleotide
gggtggccggcctctttggcatg

SEQ ID NO: 314499 - DNA, 23 bp, Artificial Sequence
  Description of Artificial Sequence: Synthetic oligonucleotide
ggtggccggcctctttggcatgc

SEQ ID NO: 314500 - DNA, 23 bp, Artificial Sequence
  Description of Artificial Sequence: Synthetic oligonucleotide
gtggccggcctctttggcatgcc

SEQ ID NO: 314501 - DNA, 24 bp, Artificial Sequence
  Description of Artificial Sequence: Synthetic oligonucleotide
tggccggcctctttggcatgccct

SEQ ID NO: 314502 - DNA, 23 bp, Artificial Sequence
  Description of Artificial Sequence: Synthetic oligonucleotide
ggccggcctctttggcatgccct

SEQ ID NO: 314503 - DNA, 23 bp, Artificial Sequence
  Description of Artificial Sequence: Synthetic oligonucleotide
gccggcctctttggcatgccctg

SEQ ID NO: 314504 - DNA, 23 bp, Artificial Sequence
  Description of Artificial Sequence: Synthetic oligonucleotide
ccggcctctttggcatgccctgg

SEQ ID NO: 314505 - DNA, 24 bp, Artificial Sequence
  Description of Artificial Sequence: Synthetic oligonucleotide
cggcctctttggcatgccctgggt

SEQ ID NO: 314506 - DNA, 25 bp, Artificial Sequence
  Description of Artificial Sequence: Synthetic oligonucleotide
ggcctctttggcatgccctgggtca

SEQ ID NO: 314507 - DNA, 26 bp, Artificial Sequence
  Description of Artificial Sequence: Synthetic oligonucleotide
gcctctttggcatgccctgggtcagt

SEQ ID NO: 314508 - DNA, 26 bp, Artificial Sequence
  Description of Artificial Sequence: Synthetic oligonucleotide
cctctttggcatgccctgggtcagtg

SEQ ID NO: 314509 - DNA, 26 bp, Artificial Sequence
  Description of Artificial Sequence: Synthetic oligonucleotide
ctctttggcatgccctgggtcagtgc

SEQ ID NO: 314510 - DNA, 27 bp, Artificial Sequence
  Description of Artificial Sequence: Synthetic oligonucleotide
tctttggcatgccctgggtcagtgcca

SEQ ID NO: 314511 - DNA, 26 bp, Artificial Sequence
  Description of Artificial Sequence: Synthetic oligonucleotide
ctttggcatgccctgggtcagtgcca

SEQ ID NO: 314512 - DNA, 26 bp, Artificial Sequence
  Description of Artificial Sequence: Synthetic oligonucleotide
tttggcatgccctgggtcagtgccag

SEQ ID NO: 314513 - DNA, 25 bp, Artificial Sequence
  Description of Artificial Sequence: Synthetic oligonucleotide
ttggcatgccctgggtcagtgccag

SEQ ID NO: 314514 - DNA, 24 bp, Artificial Sequence
  Description of Artificial Sequence: Synthetic oligonucleotide
tggcatgccctgggtcagtgccag

SEQ ID NO: 314515 - DNA, 23 bp, Artificial Sequence
  Description of Artificial Sequence: Synthetic oligonucleotide
ggcatgccctgggtcagtgccag

SEQ ID NO: 314516 - DNA, 24 bp, Artificial Sequence
  Description of Artificial Sequence: Synthetic oligonucleotide
gcatgccctgggtcagtgccagca

SEQ ID NO: 314517 - DNA, 24 bp, Artificial Sequence
  Description of Artificial Sequence: Synthetic oligonucleotide
catgccctgggtcagtgccagcac

SEQ ID NO: 314518 - DNA, 24 bp, Artificial Sequence
  Description of Artificial Sequence: Synthetic oligonucleotide
atgccctgggtcagtgccagcacc

SEQ ID NO: 314519 - DNA, 23 bp, Artificial Sequence
  Description of Artificial Sequence: Synthetic oligonucleotide
tgccctgggtcagtgccagcacc

SEQ ID NO: 314520 - DNA, 22 bp, Artificial Sequence
  Description of Artificial Sequence: Synthetic oligonucleotide
gccctgggtcagtgccagcacc

SEQ ID NO: 314521 - DNA, 23 bp, Artificial Sequence
  Description of Artificial Sequence: Synthetic oligonucleotide
ccctgggtcagtgccagcaccgt

SEQ ID NO: 314522 - DNA, 23 bp, Artificial Sequence
  Description of Artificial Sequence: Synthetic oligonucleotide
cctgggtcagtgccagcaccgtg

SEQ ID NO: 314523 - DNA, 23 bp, Artificial Sequence
  Description of Artificial Sequence: Synthetic oligonucleotide
ctgggtcagtgccagcaccgtgc

SEQ ID NO: 314524 - DNA, 25 bp, Artificial Sequence
  Description of Artificial Sequence: Synthetic oligonucleotide
tgggtcagtgccagcaccgtgcgat

SEQ ID NO: 314525 - DNA, 24 bp, Artificial Sequence
  Description of Artificial Sequence: Synthetic oligonucleotide
gggtcagtgccagcaccgtgcgat

SEQ ID NO: 314526 - DNA, 24 bp, Artificial Sequence
  Description of Artificial Sequence: Synthetic oligonucleotide
ggtcagtgccagcaccgtgcgatc

SEQ ID NO: 314527 - DNA, 24 bp, Artificial Sequence
  Description of Artificial Sequence: Synthetic oligonucleotide
gtcagtgccagcaccgtgcgatcc

SEQ ID NO: 314528 - DNA, 25 bp, Artificial Sequence
  Description of Artificial Sequence: Synthetic oligonucleotide
tcagtgccagcaccgtgcgatccgt

SEQ ID NO: 314529 - DNA, 24 bp, Artificial Sequence
  Description of Artificial Sequence: Synthetic oligonucleotide
cagtgccagcaccgtgcgatccgt

SEQ ID NO: 314530 - DNA, 25 bp, Artificial Sequence
  Description of Artificial Sequence: Synthetic oligonucleotide
agtgccagcaccgtgcgatccgtca

SEQ ID NO: 314531 - DNA, 24 bp, Artificial Sequence
  Description of Artificial Sequence: Synthetic oligonucleotide
gtgccagcaccgtgcgatccgtca

SEQ ID NO: 314532 - DNA, 24 bp, Artificial Sequence
  Description of Artificial Sequence: Synthetic oligonucleotide
tgccagcaccgtgcgatccgtcac

SEQ ID NO: 314533 - DNA, 23 bp, Artificial Sequence
  Description of Artificial Sequence: Synthetic oligonucleotide
gccagcaccgtgcgatccgtcac

SEQ ID NO: 314534 - DNA, 23 bp, Artificial Sequence
  Description of Artificial Sequence: Synthetic oligonucleotide
ccagcaccgtgcgatccgtcacc

SEQ ID NO: 314535 - DNA, 25 bp, Artificial Sequence
  Description of Artificial Sequence: Synthetic oligonucleotide
cagcaccgtgcgatccgtcaccgat

SEQ ID NO: 314536 - DNA, 25 bp, Artificial Sequence
  Description of Artificial Sequence: Synthetic oligonucleotide
agcaccgtgcgatccgtcaccgatg

SEQ ID NO: 314537 - DNA, 24 bp, Artificial Sequence
  Description of Artificial Sequence: Synthetic oligonucleotide
gcaccgtgcgatccgtcaccgatg

SEQ ID NO: 314538 - DNA, 24 bp, Artificial Sequence
  Description of Artificial Sequence: Synthetic oligonucleotide
caccgtgcgatccgtcaccgatgc

SEQ ID NO: 314539 - DNA, 26 bp, Artificial Sequence
  Description of Artificial Sequence: Synthetic oligonucleotide
accgtgcgatccgtcaccgatgccaa

SEQ ID NO: 314540 - DNA, 25 bp, Artificial Sequence
  Description of Artificial Sequence: Synthetic oligonucleotide
ccgtgcgatccgtcaccgatgccaa

SEQ ID NO: 314541 - DNA, 25 bp, Artificial Sequence
  Description of Artificial Sequence: Synthetic oligonucleotide
cgtgcgatccgtcaccgatgccaac

SEQ ID NO: 314542 - DNA, 25 bp, Artificial Sequence
  Description of Artificial Sequence: Synthetic oligonucleotide
gtgcgatccgtcaccgatgccaacg

SEQ ID NO: 314543 - DNA, 25 bp, Artificial Sequence
  Description of Artificial Sequence: Synthetic oligonucleotide
tgcgatccgtcaccgatgccaacgg

SEQ ID NO: 314544 - DNA, 24 bp, Artificial Sequence
  Description of Artificial Sequence: Synthetic oligonucleotide
gcgatccgtcaccgatgccaacgg

SEQ ID NO: 314545 - DNA, 24 bp, Artificial Sequence
  Description of Artificial Sequence: Synthetic oligonucleotide
cgatccgtcaccgatgccaacggc

SEQ ID NO: 314546 - DNA, 25 bp, Artificial Sequence
  Description of Artificial Sequence: Synthetic oligonucleotide
gatccgtcaccgatgccaacggcct

SEQ ID NO: 314547 - DNA, 26 bp, Artificial Sequence
  Description of Artificial Sequence: Synthetic oligonucleotide
atccgtcaccgatgccaacggcctca

SEQ ID NO: 314548 - DNA, 25 bp, Artificial Sequence
  Description of Artificial Sequence: Synthetic oligonucleotide
tccgtcaccgatgccaacggcctca

SEQ ID NO: 314549 - DNA, 24 bp, Artificial Sequence
  Description of Artificial Sequence: Synthetic oligonucleotide
ccgtcaccgatgccaacggcctca

SEQ ID NO: 314550 - DNA, 25 bp, Artificial Sequence
  Description of Artificial Sequence: Synthetic oligonucleotide
cgtcaccgatgccaacggcctcact

SEQ ID NO: 314551 - DNA, 26 bp, Artificial Sequence
  Description of Artificial Sequence: Synthetic oligonucleotide
gtcaccgatgccaacggcctcactgt

SEQ ID NO: 314552 - DNA, 27 bp, Artificial Sequence
  Description of Artificial Sequence: Synthetic oligonucleotide
tcaccgatgccaacggcctcactgtga

SEQ ID NO: 314553 - DNA, 27 bp, Artificial Sequence
  Description of Artificial Sequence: Synthetic oligonucleotide
caccgatgccaacggcctcactgtgat

SEQ ID NO: 314554 - DNA, 27 bp, Artificial Sequence
  Description of Artificial Sequence: Synthetic oligonucleotide
accgatgccaacggcctcactgtgatg

SEQ ID NO: 314555 - DNA, 26 bp, Artificial Sequence
  Description of Artificial Sequence: Synthetic oligonucleotide
ccgatgccaacggcctcactgtgatg

SEQ ID NO: 314556 - DNA, 26 bp, Artificial Sequence
  Description of Artificial Sequence: Synthetic oligonucleotide
cgatgccaacggcctcactgtgatgg

SEQ ID NO: 314557 - DNA, 26 bp, Artificial Sequence
  Description of Artificial Sequence: Synthetic oligonucleotide
gatgccaacggcctcactgtgatggg

SEQ ID NO: 314558 - DNA, 27 bp, Artificial Sequence
  Description of Artificial Sequence: Synthetic oligonucleotide
atgccaacggcctcactgtgatgggca

SEQ ID NO: 314559 - DNA, 27 bp, Artificial Sequence
  Description of Artificial Sequence: Synthetic oligonucleotide
tgccaacggcctcactgtgatgggcaa

SEQ ID NO: 314560 - DNA, 27 bp, Artificial Sequence
  Description of Artificial Sequence: Synthetic oligonucleotide
gccaacggcctcactgtgatgggcaaa

SEQ ID NO: 314561 - DNA, 27 bp, Artificial Sequence
  Description of Artificial Sequence: Synthetic oligonucleotide
ccaacggcctcactgtgatgggcaaac

SEQ ID NO: 314562 - DNA, 27 bp, Artificial Sequence
  Description of Artificial Sequence: Synthetic oligonucleotide
caacggcctcactgtgatgggcaaacc

SEQ ID NO: 314563 - DNA, 27 bp, Artificial Sequence
  Description of Artificial Sequence: Synthetic oligonucleotide
aacggcctcactgtgatgggcaaaccc

SEQ ID NO: 314564 - DNA, 27 bp, Artificial Sequence
  Description of Artificial Sequence: Synthetic oligonucleotide
acggcctcactgtgatgggcaaaccca

SEQ ID NO: 314565 - DNA, 26 bp, Artificial Sequence
  Description of Artificial Sequence: Synthetic oligonucleotide
cggcctcactgtgatgggcaaaccca

SEQ ID NO: 314566 - DNA, 26 bp, Artificial Sequence
  Description of Artificial Sequence: Synthetic oligonucleotide
ggcctcactgtgatgggcaaacccag

SEQ ID NO: 314567 - DNA, 27 bp, Artificial Sequence
  Description of Artificial Sequence: Synthetic oligonucleotide
gcctcactgtgatgggcaaacccagca

SEQ ID NO: 314568 - DNA, 27 bp, Artificial Sequence
  Description of Artificial Sequence: Synthetic oligonucleotide
cctcactgtgatgggcaaacccagcac

SEQ ID NO: 314569 - DNA, 27 bp, Artificial Sequence
  Description of Artificial Sequence: Synthetic oligonucleotide
ctcactgtgatgggcaaacccagcacc

SEQ ID NO: 314570 - DNA, 27 bp, Artificial Sequence
  Description of Artificial Sequence: Synthetic oligonucleotide
tcactgtgatgggcaaacccagcaccc

SEQ ID NO: 314571 - DNA, 26 bp, Artificial Sequence
  Description of Artificial Sequence: Synthetic oligonucleotide
cactgtgatgggcaaacccagcaccc

SEQ ID NO: 314572 - DNA, 27 bp, Artificial Sequence
  Description of Artificial Sequence: Synthetic oligonucleotide
actgtgatgggcaaacccagcacccga

SEQ ID NO: 314573 - DNA, 26 bp, Artificial Sequence
  Description of Artificial Sequence: Synthetic oligonucleotide
ctgtgatgggcaaacccagcacccga

SEQ ID NO: 314574 - DNA, 26 bp, Artificial Sequence
  Description of Artificial Sequence: Synthetic oligonucleotide
tgtgatgggcaaacccagcacccgag

SEQ ID NO: 314575 - DNA, 25 bp, Artificial Sequence
  Description of Artificial Sequence: Synthetic oligonucleotide
gtgatgggcaaacccagcacccgag

SEQ ID NO: 314576 - DNA, 25 bp, Artificial Sequence
  Description of Artificial Sequence: Synthetic oligonucleotide
tgatgggcaaacccagcacccgagg

SEQ ID NO: 314577 - DNA, 24 bp, Artificial Sequence
  Description of Artificial Sequence: Synthetic oligonucleotide
gatgggcaaacccagcacccgagg

SEQ ID NO: 314578 - DNA, 24 bp, Artificial Sequence
  Description of Artificial Sequence: Synthetic oligonucleotide
atgggcaaacccagcacccgaggg

SEQ ID NO: 314579 - DNA, 23 bp, Artificial Sequence
  Description of Artificial Sequence: Synthetic oligonucleotide
tgggcaaacccagcacccgaggg

SEQ ID NO: 314580 - DNA, 22 bp, Artificial Sequence
  Description of Artificial Sequence: Synthetic oligonucleotide
gggcaaacccagcacccgaggg

SEQ ID NO: 314581 - DNA, 22 bp, Artificial Sequence
  Description of Artificial Sequence: Synthetic oligonucleotide
ggcaaacccagcacccgagggg

SEQ ID NO: 314582 - DNA, 23 bp, Artificial Sequence
  Description of Artificial Sequence: Synthetic oligonucleotide
gcaaacccagcacccgaggggct

SEQ ID NO: 314583 - DNA, 23 bp, Artificial Sequence
  Description of Artificial Sequence: Synthetic oligonucleotide
caaacccagcacccgaggggctg

SEQ ID NO: 314584 - DNA, 24 bp, Artificial Sequence
  Description of Artificial Sequence: Synthetic oligonucleotide
aaacccagcacccgaggggctgct

SEQ ID NO: 314585 - DNA, 23 bp, Artificial Sequence
  Description of Artificial Sequence: Synthetic oligonucleotide
aacccagcacccgaggggctgct

SEQ ID NO: 314586 - DNA, 22 bp, Artificial Sequence
  Description of Artificial Sequence: Synthetic oligonucleotide
acccagcacccgaggggctgct

SEQ ID NO: 314587 - DNA, 21 bp, Artificial Sequence
  Description of Artificial Sequence: Synthetic oligonucleotide
cccagcacccgaggggctgct

SEQ ID NO: 314588 - DNA, 21 bp, Artificial Sequence
  Description of Artificial Sequence: Synthetic oligonucleotide
ccagcacccgaggggctgctg

SEQ ID NO: 314589 - DNA, 21 bp, Artificial Sequence
  Description of Artificial Sequence: Synthetic oligonucleotide
cagcacccgaggggctgctgc

SEQ ID NO: 314590 - DNA, 21 bp, Artificial Sequence
  Description of Artificial Sequence: Synthetic oligonucleotide
agcacccgaggggctgctgcc

SEQ ID NO: 314591 - DNA, 20 bp, Artificial Sequence
  Description of Artificial Sequence: Synthetic oligonucleotide
gcacccgaggggctgctgcc

SEQ ID NO: 314592 - DNA, 21 bp, Artificial Sequence
  Description of Artificial Sequence: Synthetic oligonucleotide
cacccgaggggctgctgccca

SEQ ID NO: 314593 - DNA, 23 bp, Artificial Sequence
  Description of Artificial Sequence: Synthetic oligonucleotide
acccgaggggctgctgcccagat

SEQ ID NO: 314594 - DNA, 22 bp, Artificial Sequence
  Description of Artificial Sequence: Synthetic oligonucleotide
cccgaggggctgctgcccagat

SEQ ID NO: 314595 - DNA, 22 bp, Artificial Sequence
  Description of Artificial Sequence: Synthetic oligonucleotide
ccgaggggctgctgcccagatc

SEQ ID NO: 314596 - DNA, 23 bp, Artificial Sequence
  Description of Artificial Sequence: Synthetic oligonucleotide
cgaggggctgctgcccagatcga

SEQ ID NO: 314597 - DNA, 23 bp, Artificial Sequence
  Description of Artificial Sequence: Synthetic oligonucleotide
gaggggctgctgcccagatcgag

SEQ ID NO: 314598 - DNA, 24 bp, Artificial Sequence
  Description of Artificial Sequence: Synthetic oligonucleotide
aggggctgctgcccagatcgagga

SEQ ID NO: 314599 - DNA, 23 bp, Artificial Sequence
  Description of Artificial Sequence: Synthetic oligonucleotide
ggggctgctgcccagatcgagga

SEQ ID NO: 314600 - DNA, 23 bp, Artificial Sequence
  Description of Artificial Sequence: Synthetic oligonucleotide
gggctgctgcccagatcgaggag

SEQ ID NO: 314601 - DNA, 24 bp, Artificial Sequence
  Description of Artificial Sequence: Synthetic oligonucleotide
ggctgctgcccagatcgaggaggt

SEQ ID NO: 314602 - DNA, 27 bp, Artificial Sequence
  Description of Artificial Sequence: Synthetic oligonucleotide
gctgctgcccagatcgaggaggtcata

SEQ ID NO: 314603 - DNA, 27 bp, Artificial Sequence
  Description of Artificial Sequence: Synthetic oligonucleotide
ctgctgcccagatcgaggaggtcatag

SEQ ID NO: 314604 - DNA, 28 bp, Artificial Sequence
  Description of Artificial Sequence: Synthetic oligonucleotide
tgctgcccagatcgaggaggtcatagag

SEQ ID NO: 314605 - DNA, 27 bp, Artificial Sequence
  Description of Artificial Sequence: Synthetic oligonucleotide
gctgcccagatcgaggaggtcatagag

SEQ ID NO: 314606 - DNA, 27 bp, Artificial Sequence
  Description of Artificial Sequence: Synthetic oligonucleotide
ctgcccagatcgaggaggtcatagagc

SEQ ID NO: 314607 - DNA, 28 bp, Artificial Sequence
  Description of Artificial Sequence: Synthetic oligonucleotide
tgcccagatcgaggaggtcatagagcag

SEQ ID NO: 314608 - DNA, 27 bp, Artificial Sequence
  Description of Artificial Sequence: Synthetic oligonucleotide
gcccagatcgaggaggtcatagagcag

SEQ ID NO: 314609 - DNA, 27 bp, Artificial Sequence
  Description of Artificial Sequence: Synthetic oligonucleotide
cccagatcgaggaggtcatagagcagc

SEQ ID NO: 314610 - DNA, 27 bp, Artificial Sequence
  Description of Artificial Sequence: Synthetic oligonucleotide
ccagatcgaggaggtcatagagcagcg

SEQ ID NO: 314611 - DNA, 27 bp, Artificial Sequence
  Description of Artificial Sequence: Synthetic oligonucleotide
cagatcgaggaggtcatagagcagcgc

SEQ ID NO: 314612 - DNA, 29 bp, Artificial Sequence
  Description of Artificial Sequence: Synthetic oligonucleotide
agatcgaggaggtcatagagcagcgcatc

SEQ ID NO: 314613 - DNA, 28 bp, Artificial Sequence
  Description of Artificial Sequence: Synthetic oligonucleotide
gatcgaggaggtcatagagcagcgcatc

SEQ ID NO: 314614 - DNA, 29 bp, Artificial Sequence
  Description of Artificial Sequence: Synthetic oligonucleotide
atcgaggaggtcatagagcagcgcatcag

SEQ ID NO: 314615 - DNA, 28 bp, Artificial Sequence
  Description of Artificial Sequence: Synthetic oligonucleotide
tcgaggaggtcatagagcagcgcatcag

SEQ ID NO: 314616 - DNA, 27 bp, Artificial Sequence
  Description of Artificial Sequence: Synthetic oligonucleotide
cgaggaggtcatagagcagcgcatcag

SEQ ID NO: 314617 - DNA, 28 bp, Artificial Sequence
  Description of Artificial Sequence: Synthetic oligonucleotide
gaggaggtcatagagcagcgcatcagtg

SEQ ID NO: 314618 - DNA, 28 bp, Artificial Sequence
  Description of Artificial Sequence: Synthetic oligonucleotide
aggaggtcatagagcagcgcatcagtgg

SEQ ID NO: 314619 - DNA, 27 bp, Artificial Sequence
  Description of Artificial Sequence: Synthetic oligonucleotide
ggaggtcatagagcagcgcatcagtgg

SEQ ID NO: 314620 - DNA, 28 bp, Artificial Sequence
  Description of Artificial Sequence: Synthetic oligonucleotide
gaggtcatagagcagcgcatcagtggag

SEQ ID NO: 314621 - DNA, 29 bp, Artificial Sequence
  Description of Artificial Sequence: Synthetic oligonucleotide
aggtcatagagcagcgcatcagtggagtc

SEQ ID NO: 314622 - DNA, 28 bp, Artificial Sequence
  Description of Artificial Sequence: Synthetic oligonucleotide
ggtcatagagcagcgcatcagtggagtc

SEQ ID NO: 314623 - DNA, 28 bp, Artificial Sequence
  Description of Artificial Sequence: Synthetic oligonucleotide
gtcatagagcagcgcatcagtggagtcc

SEQ ID NO: 314624 - DNA, 29 bp, Artificial Sequence
  Description of Artificial Sequence: Synthetic oligonucleotide
tcatagagcagcgcatcagtggagtcctg

SEQ ID NO: 314625 - DNA, 28 bp, Artificial Sequence
  Description of Artificial Sequence: Synthetic oligonucleotide
catagagcagcgcatcagtggagtcctg

SEQ ID NO: 314626 - DNA, 28 bp, Artificial Sequence
  Description of Artificial Sequence: Synthetic oligonucleotide
atagagcagcgcatcagtggagtcctgg

SEQ ID NO: 314627 - DNA, 27 bp, Artificial Sequence
  Description of Artificial Sequence: Synthetic oligonucleotide
tagagcagcgcatcagtggagtcctgg

SEQ ID NO: 314628 - DNA, 27 bp, Artificial Sequence
  Description of Artificial Sequence: Synthetic oligonucleotide
agagcagcgcatcagtggagtcctggt

SEQ ID NO: 314629 - DNA, 26 bp, Artificial Sequence
  Description of Artificial Sequence: Synthetic oligonucleotide
gagcagcgcatcagtggagtcctggt

SEQ ID NO: 314630 - DNA, 26 bp, Artificial Sequence
  Description of Artificial Sequence: Synthetic oligonucleotide
agcagcgcatcagtggagtcctggtc

SEQ ID NO: 314631 - DNA, 25 bp, Artificial Sequence
  Description of Artificial Sequence: Synthetic oligonucleotide
gcagcgcatcagtggagtcctggtc

SEQ ID NO: 314632 - DNA, 25 bp, Artificial Sequence
  Description of Artificial Sequence: Synthetic oligonucleotide
cagcgcatcagtggagtcctggtcg

SEQ ID NO: 314633 - DNA, 26 bp, Artificial Sequence
  Description of Artificial Sequence: Synthetic oligonucleotide
agcgcatcagtggagtcctggtcggt

SEQ ID NO: 314634 - DNA, 25 bp, Artificial Sequence
  Description of Artificial Sequence: Synthetic oligonucleotide
gcgcatcagtggagtcctggtcggt

SEQ ID NO: 314635 - DNA, 26 bp, Artificial Sequence
  Description of Artificial Sequence: Synthetic oligonucleotide
cgcatcagtggagtcctggtcggtgt

SEQ ID NO: 314636 - DNA, 26 bp, Artificial Sequence
  Description of Artificial Sequence: Synthetic oligonucleotide
gcatcagtggagtcctggtcggtgtg

SEQ ID NO: 314637 - DNA, 27 bp, Artificial Sequence
  Description of Artificial Sequence: Synthetic oligonucleotide
catcagtggagtcctggtcggtgtgct

SEQ ID NO: 314638 - DNA, 28 bp, Artificial Sequence
  Description of Artificial Sequence: Synthetic oligonucleotide
atcagtggagtcctggtcggtgtgcttg

SEQ ID NO: 314639 - DNA, 27 bp, Artificial Sequence
  Description of Artificial Sequence: Synthetic oligonucleotide
tcagtggagtcctggtcggtgtgcttg

SEQ ID NO: 314640 - DNA, 27 bp, Artificial Sequence
  Description of Artificial Sequence: Synthetic oligonucleotide
cagtggagtcctggtcggtgtgcttgt

SEQ ID NO: 314641 - DNA, 27 bp, Artificial Sequence
  Description of Artificial Sequence: Synthetic oligonucleotide
agtggagtcctggtcggtgtgcttgtc

SEQ ID NO: 314642 - DNA, 26 bp, Artificial Sequence
  Description of Artificial Sequence: Synthetic oligonucleotide
gtggagtcctggtcggtgtgcttgtc

SEQ ID NO: 314643 - DNA, 26 bp, Artificial Sequence
  Description of Artificial Sequence: Synthetic oligonucleotide
tggagtcctggtcggtgtgcttgtcg

SEQ ID NO: 314644 - DNA, 25 bp, Artificial Sequence
  Description of Artificial Sequence: Synthetic oligonucleotide
ggagtcctggtcggtgtgcttgtcg

SEQ ID NO: 314645 - DNA, 25 bp, Artificial Sequence
  Description of Artificial Sequence: Synthetic oligonucleotide
gagtcctggtcggtgtgcttgtcgg

SEQ ID NO: 314646 - DNA, 25 bp, Artificial Sequence
  Description of Artificial Sequence: Synthetic oligonucleotide
agtcctggtcggtgtgcttgtcggc

SEQ ID NO: 314647 - DNA, 24 bp, Artificial Sequence
  Description of Artificial Sequence: Synthetic oligonucleotide
gtcctggtcggtgtgcttgtcggc

SEQ ID NO: 314648 - DNA, 25 bp, Artificial Sequence
  Description of Artificial Sequence: Synthetic oligonucleotide
tcctggtcggtgtgcttgtcggcct

SEQ ID NO: 314649 - DNA, 24 bp, Artificial Sequence
  Description of Artificial Sequence: Synthetic oligonucleotide
cctggtcggtgtgcttgtcggcct

SEQ ID NO: 314650 - DNA, 25 bp, Artificial Sequence
  Description of Artificial Sequence: Synthetic oligonucleotide
ctggtcggtgtgcttgtcggcctgt

SEQ ID NO: 314651 - DNA, 25 bp, Artificial Sequence
  Description of Artificial Sequence: Synthetic oligonucleotide
tggtcggtgtgcttgtcggcctgtc

SEQ ID NO: 314652 - DNA, 24 bp, Artificial Sequence
  Description of Artificial Sequence: Synthetic oligonucleotide
ggtcggtgtgcttgtcggcctgtc

SEQ ID NO: 314653 - DNA, 26 bp, Artificial Sequence
  Description of Artificial Sequence: Synthetic oligonucleotide
gtcggtgtgcttgtcggcctgtcctt

SEQ ID NO: 314654 - DNA, 26 bp, Artificial Sequence
  Description of Artificial Sequence: Synthetic oligonucleotide
tcggtgtgcttgtcggcctgtccttc

SEQ ID NO: 314655 - DNA, 25 bp, Artificial Sequence
  Description of Artificial Sequence: Synthetic oligonucleotide
cggtgtgcttgtcggcctgtccttc

SEQ ID NO: 314656 - DNA, 26 bp, Artificial Sequence
  Description of Artificial Sequence: Synthetic oligonucleotide
ggtgtgcttgtcggcctgtccttcct

SEQ ID NO: 314657 - DNA, 27 bp, Artificial Sequence
  Description of Artificial Sequence: Synthetic oligonucleotide
gtgtgcttgtcggcctgtccttcctca

SEQ ID NO: 314658 - DNA, 28 bp, Artificial Sequence
  Description of Artificial Sequence: Synthetic oligonucleotide
tgtgcttgtcggcctgtccttcctcatg

SEQ ID NO: 314659 - DNA, 27 bp, Artificial Sequence
  Description of Artificial Sequence: Synthetic oligonucleotide
gtgcttgtcggcctgtccttcctcatg

SEQ ID NO: 314660 - DNA, 27 bp, Artificial Sequence
  Description of Artificial Sequence: Synthetic oligonucleotide
tgcttgtcggcctgtccttcctcatgg

SEQ ID NO: 314661 - DNA, 27 bp, Artificial Sequence
  Description of Artificial Sequence: Synthetic oligonucleotide
gcttgtcggcctgtccttcctcatggt

SEQ ID NO: 314662 - DNA, 27 bp, Artificial Sequence
  Description of Artificial Sequence: Synthetic oligonucleotide
cttgtcggcctgtccttcctcatggtg

SEQ ID NO: 314663 - DNA, 27 bp, Artificial Sequence
  Description of Artificial Sequence: Synthetic oligonucleotide
ttgtcggcctgtccttcctcatggtgc

SEQ ID NO: 314664 - DNA, 26 bp, Artificial Sequence
  Description of Artificial Sequence: Synthetic oligonucleotide
tgtcggcctgtccttcctcatggtgc

SEQ ID NO: 314665 - DNA, 25 bp, Artificial Sequence
  Description of Artificial Sequence: Synthetic oligonucleotide
gtcggcctgtccttcctcatggtgc

SEQ ID NO: 314666 - DNA, 25 bp, Artificial Sequence
  Description of Artificial Sequence: Synthetic oligonucleotide
tcggcctgtccttcctcatggtgcc

SEQ ID NO: 314667 - DNA, 24 bp, Artificial Sequence
  Description of Artificial Sequence: Synthetic oligonucleotide
cggcctgtccttcctcatggtgcc

SEQ ID NO: 314668 - DNA, 26 bp, Artificial Sequence
  Description of Artificial Sequence: Synthetic oligonucleotide
ggcctgtccttcctcatggtgcccat

SEQ ID NO: 314669 - DNA, 26 bp, Artificial Sequence
  Description of Artificial Sequence: Synthetic oligonucleotide
gcctgtccttcctcatggtgcccatc

SEQ ID NO: 314670 - DNA, 27 bp, Artificial Sequence
  Description of Artificial Sequence: Synthetic oligonucleotide
cctgtccttcctcatggtgcccatcct

SEQ ID NO: 314671 - DNA, 27 bp, Artificial Sequence
  Description of Artificial Sequence: Synthetic oligonucleotide
ctgtccttcctcatggtgcccatcctc

SEQ ID NO: 314672 - DNA, 28 bp, Artificial Sequence
  Description of Artificial Sequence: Synthetic oligonucleotide
tgtccttcctcatggtgcccatcctctc

SEQ ID NO: 314673 - DNA, 27 bp, Artificial Sequence
  Description of Artificial Sequence: Synthetic oligonucleotide
gtccttcctcatggtgcccatcctctc

SEQ ID NO: 314674 - DNA, 27 bp, Artificial Sequence
  Description of Artificial Sequence: Synthetic oligonucleotide
tccttcctcatggtgcccatcctctcc

SEQ ID NO: 314675 - DNA, 26 bp, Artificial Sequence
  Description of Artificial Sequence: Synthetic oligonucleotide
ccttcctcatggtgcccatcctctcc

SEQ ID NO: 314676 - DNA, 26 bp, Artificial Sequence
  Description of Artificial Sequence: Synthetic oligonucleotide
cttcctcatggtgcccatcctctccc

SEQ ID NO: 314677 - DNA, 26 bp, Artificial Sequence
  Description of Artificial Sequence: Synthetic oligonucleotide
ttcctcatggtgcccatcctctcccg

SEQ ID NO: 314678 - DNA, 25 bp, Artificial Sequence
  Description of Artificial Sequence: Synthetic oligonucleotide
tcctcatggtgcccatcctctcccg

SEQ ID NO: 314679 - DNA, 24 bp, Artificial Sequence
  Description of Artificial Sequence: Synthetic oligonucleotide
cctcatggtgcccatcctctcccg

SEQ ID NO: 314680 - DNA, 26 bp, Artificial Sequence
  Description of Artificial Sequence: Synthetic oligonucleotide
ctcatggtgcccatcctctcccgcat

SEQ ID NO: 314681 - DNA, 26 bp, Artificial Sequence
  Description of Artificial Sequence: Synthetic oligonucleotide
tcatggtgcccatcctctcccgcatc

SEQ ID NO: 314682 - DNA, 25 bp, Artificial Sequence
  Description of Artificial Sequence: Synthetic oligonucleotide
catggtgcccatcctctcccgcatc

SEQ ID NO: 314683 - DNA, 25 bp, Artificial Sequence
  Description of Artificial Sequence: Synthetic oligonucleotide
atggtgcccatcctctcccgcatcg

SEQ ID NO: 314684 - DNA, 24 bp, Artificial Sequence
  Description of Artificial Sequence: Synthetic oligonucleotide
tggtgcccatcctctcccgcatcg

SEQ ID NO: 314685 - DNA, 23 bp, Artificial Sequence
  Description of Artificial Sequence: Synthetic oligonucleotide
ggtgcccatcctctcccgcatcg

SEQ ID NO: 314686 - DNA, 23 bp, Artificial Sequence
  Description of Artificial Sequence: Synthetic oligonucleotide
gtgcccatcctctcccgcatcgc

SEQ ID NO: 314687 - DNA, 23 bp, Artificial Sequence
  Description of Artificial Sequence: Synthetic oligonucleotide
tgcccatcctctcccgcatcgcc

SEQ ID NO: 314688 - DNA, 22 bp, Artificial Sequence
  Description of Artificial Sequence: Synthetic oligonucleotide
gcccatcctctcccgcatcgcc

SEQ ID NO: 314689 - DNA, 23 bp, Artificial Sequence
  Description of Artificial Sequence: Synthetic oligonucleotide
cccatcctctcccgcatcgccct

SEQ ID NO: 314690 - DNA, 23 bp, Artificial Sequence
  Description of Artificial Sequence: Synthetic oligonucleotide
ccatcctctcccgcatcgccctg

SEQ ID NO: 314691 - DNA, 23 bp, Artificial Sequence
  Description of Artificial Sequence: Synthetic oligonucleotide
catcctctcccgcatcgccctgg

SEQ ID NO: 314692 - DNA, 24 bp, Artificial Sequence
  Description of Artificial Sequence: Synthetic oligonucleotide
atcctctcccgcatcgccctggct

SEQ ID NO: 314693 - DNA, 23 bp, Artificial Sequence
  Description of Artificial Sequence: Synthetic oligonucleotide
tcctctcccgcatcgccctggct

SEQ ID NO: 314694 - DNA, 22 bp, Artificial Sequence
  Description of Artificial Sequence: Synthetic oligonucleotide
cctctcccgcatcgccctggct

SEQ ID NO: 314695 - DNA, 24 bp, Artificial Sequence
  Description of Artificial Sequence: Synthetic oligonucleotide
ctctcccgcatcgccctggctgaa

SEQ ID NO: 314696 - DNA, 25 bp, Artificial Sequence
  Description of Artificial Sequence: Synthetic oligonucleotide
tctcccgcatcgccctggctgaact

SEQ ID NO: 314697 - DNA, 24 bp, Artificial Sequence
  Description of Artificial Sequence: Synthetic oligonucleotide
ctcccgcatcgccctggctgaact

SEQ ID NO: 314698 - DNA, 27 bp, Artificial Sequence
  Description of Artificial Sequence: Synthetic oligonucleotide
tcccgcatcgccctggctgaactgttt

SEQ ID NO: 314699 - DNA, 26 bp, Artificial Sequence
  Description of Artificial Sequence: Synthetic oligonucleotide
cccgcatcgccctggctgaactgttt

SEQ ID NO: 314700 - DNA, 26 bp, Artificial Sequence
  Description of Artificial Sequence: Synthetic oligonucleotide
ccgcatcgccctggctgaactgtttg

SEQ ID NO: 314701 - DNA, 26 bp, Artificial Sequence
  Description of Artificial Sequence: Synthetic oligonucleotide
cgcatcgccctggctgaactgtttgg

SEQ ID NO: 314702 - DNA, 27 bp, Artificial Sequence
  Description of Artificial Sequence: Synthetic oligonucleotide
gcatcgccctggctgaactgtttggga

SEQ ID NO: 314703 - DNA, 28 bp, Artificial Sequence
  Description of Artificial Sequence: Synthetic oligonucleotide
catcgccctggctgaactgtttgggatc

SEQ ID NO: 314704 - DNA, 30 bp, Artificial Sequence
  Description of Artificial Sequence: Synthetic oligonucleotide
atcgccctggctgaactgtttgggatcttc

SEQ ID NO: 314705 - DNA, 29 bp, Artificial Sequence
  Description of Artificial Sequence: Synthetic oligonucleotide
tcgccctggctgaactgtttgggatcttc

SEQ ID NO: 314706 - DNA, 28 bp, Artificial Sequence
  Description of Artificial Sequence: Synthetic oligonucleotide
cgccctggctgaactgtttgggatcttc

SEQ ID NO: 314707 - DNA, 28 bp, Artificial Sequence
  Description of Artificial Sequence: Synthetic oligonucleotide
gccctggctgaactgtttgggatcttcc

SEQ ID NO: 314708 - DNA, 29 bp, Artificial Sequence
  Description of Artificial Sequence: Synthetic oligonucleotide
ccctggctgaactgtttgggatcttcctc

SEQ ID NO: 314709 - DNA, 31 bp, Artificial Sequence
  Description of Artificial Sequence: Synthetic oligonucleotide
cctggctgaactgtttgggatcttcctcaac

SEQ ID NO: 314710 - DNA, 33 bp, Artificial Sequence
  Description of Artificial Sequence: Synthetic oligonucleotide
ctggctgaactgtttgggatcttcctcaacatg

SEQ ID NO: 314711 - DNA, 33 bp, Artificial Sequence
  Description of Artificial Sequence: Synthetic oligonucleotide
tggctgaactgtttgggatcttcctcaacatgg

SEQ ID NO: 314712 - DNA, 32 bp, Artificial Sequence
  Description of Artificial Sequence: Synthetic oligonucleotide
ggctgaactgtttgggatcttcctcaacatgg

SEQ ID NO: 314713 - DNA, 32 bp, Artificial Sequence
  Description of Artificial Sequence: Synthetic oligonucleotide
gctgaactgtttgggatcttcctcaacatggg

SEQ ID NO: 314714 - DNA, 32 bp, Artificial Sequence
  Description of Artificial Sequence: Synthetic oligonucleotide
ctgaactgtttgggatcttcctcaacatgggg

SEQ ID NO: 314715 - DNA, 32 bp, Artificial Sequence
  Description of Artificial Sequence: Synthetic oligonucleotide
tgaactgtttgggatcttcctcaacatggggg

SEQ ID NO: 314716 - DNA, 31 bp, Artificial Sequence
  Description of Artificial Sequence: Synthetic oligonucleotide
gaactgtttgggatcttcctcaacatggggg

SEQ ID NO: 314717 - DNA, 32 bp, Artificial Sequence
  Description of Artificial Sequence: Synthetic oligonucleotide
aactgtttgggatcttcctcaacatgggggac

SEQ ID NO: 314718 - DNA, 31 bp, Artificial Sequence
  Description of Artificial Sequence: Synthetic oligonucleotide
actgtttgggatcttcctcaacatgggggac

SEQ ID NO: 314719 - DNA, 30 bp, Artificial Sequence
  Description of Artificial Sequence: Synthetic oligonucleotide
ctgtttgggatcttcctcaacatgggggac

SEQ ID NO: 314720 - DNA, 31 bp, Artificial Sequence
  Description of Artificial Sequence: Synthetic oligonucleotide
tgtttgggatcttcctcaacatgggggacac

SEQ ID NO: 314721 - DNA, 30 bp, Artificial Sequence
  Description of Artificial Sequence: Synthetic oligonucleotide
gtttgggatcttcctcaacatgggggacac

SEQ ID NO: 314722 - DNA, 30 bp, Artificial Sequence
  Description of Artificial Sequence: Synthetic oligonucleotide
tttgggatcttcctcaacatgggggacacg

SEQ ID NO: 314723 - DNA, 29 bp, Artificial Sequence
  Description of Artificial Sequence: Synthetic oligonucleotide
ttgggatcttcctcaacatgggggacacg

SEQ ID NO: 314724 - DNA, 28 bp, Artificial Sequence
  Description of Artificial Sequence: Synthetic oligonucleotide
tgggatcttcctcaacatgggggacacg

SEQ ID NO: 314725 - DNA, 27 bp, Artificial Sequence
  Description of Artificial Sequence: Synthetic oligonucleotide
gggatcttcctcaacatgggggacacg

SEQ ID NO: 314726 - DNA, 28 bp, Artificial Sequence
  Description of Artificial Sequence: Synthetic oligonucleotide
ggatcttcctcaacatgggggacacgtc

SEQ ID NO: 314727 - DNA, 28 bp, Artificial Sequence
  Description of Artificial Sequence: Synthetic oligonucleotide
gatcttcctcaacatgggggacacgtcg

SEQ ID NO: 314728 - DNA, 28 bp, Artificial Sequence
  Description of Artificial Sequence: Synthetic oligonucleotide
atcttcctcaacatgggggacacgtcgc

SEQ ID NO: 314729 - DNA, 27 bp, Artificial Sequence
  Description of Artificial Sequence: Synthetic oligonucleotide
tcttcctcaacatgggggacacgtcgc

SEQ ID NO: 314730 - DNA, 27 bp, Artificial Sequence
  Description of Artificial Sequence: Synthetic oligonucleotide
cttcctcaacatgggggacacgtcgct

SEQ ID NO: 314731 - DNA, 27 bp, Artificial Sequence
  Description of Artificial Sequence: Synthetic oligonucleotide
ttcctcaacatgggggacacgtcgctg

SEQ ID NO: 314732 - DNA, 27 bp, Artificial Sequence
  Description of Artificial Sequence: Synthetic oligonucleotide
tcctcaacatgggggacacgtcgctga

SEQ ID NO: 314733 - DNA, 26 bp, Artificial Sequence
  Description of Artificial Sequence: Synthetic oligonucleotide
cctcaacatgggggacacgtcgctga

SEQ ID NO: 314734 - DNA, 26 bp, Artificial Sequence
  Description of Artificial Sequence: Synthetic oligonucleotide
ctcaacatgggggacacgtcgctgag

SEQ ID NO: 314735 - DNA, 26 bp, Artificial Sequence
  Description of Artificial Sequence: Synthetic oligonucleotide
tcaacatgggggacacgtcgctgagc

SEQ ID NO: 314736 - DNA, 25 bp, Artificial Sequence
  Description of Artificial Sequence: Synthetic oligonucleotide
caacatgggggacacgtcgctgagc

SEQ ID NO: 314737 - DNA, 25 bp, Artificial Sequence
  Description of Artificial Sequence: Synthetic oligonucleotide
aacatgggggacacgtcgctgagcg

SEQ ID NO: 314738 - DNA, 24 bp, Artificial Sequence
  Description of Artificial Sequence: Synthetic oligonucleotide
acatgggggacacgtcgctgagcg

SEQ ID NO: 314739 - DNA, 23 bp, Artificial Sequence
  Description of Artificial Sequence: Synthetic oligonucleotide
catgggggacacgtcgctgagcg

SEQ ID NO: 314740 - DNA, 23 bp, Artificial Sequence
  Description of Artificial Sequence: Synthetic oligonucleotide
atgggggacacgtcgctgagcgg

SEQ ID NO: 314741 - DNA, 22 bp, Artificial Sequence
  Description of Artificial Sequence: Synthetic oligonucleotide
tgggggacacgtcgctgagcgg

SEQ ID NO: 314742 - DNA, 21 bp, Artificial Sequence
  Description of Artificial Sequence: Synthetic oligonucleotide
gggggacacgtcgctgagcgg

SEQ ID NO: 314743 - DNA, 23 bp, Artificial Sequence
  Description of Artificial Sequence: Synthetic oligonucleotide
ggggacacgtcgctgagcggcat

SEQ ID NO: 314744 - DNA, 23 bp, Artificial Sequence
  Description of Artificial Sequence: Synthetic oligonucleotide
gggacacgtcgctgagcggcatc

SEQ ID NO: 314745 - DNA, 24 bp, Artificial Sequence
  Description of Artificial Sequence: Synthetic oligonucleotide
ggacacgtcgctgagcggcatcga

SEQ ID NO: 314746 - DNA, 24 bp, Artificial Sequence
  Description of Artificial Sequence: Synthetic oligonucleotide
gacacgtcgctgagcggcatcgag

SEQ ID NO: 314747 - DNA, 25 bp, Artificial Sequence
  Description of Artificial Sequence: Synthetic oligonucleotide
acacgtcgctgagcggcatcgagct

SEQ ID NO: 314748 - DNA, 24 bp, Artificial Sequence
  Description of Artificial Sequence: Synthetic oligonucleotide
cacgtcgctgagcggcatcgagct

SEQ ID NO: 314749 - DNA, 27 bp, Artificial Sequence
  Description of Artificial Sequence: Synthetic oligonucleotide
acgtcgctgagcggcatcgagctcttt

SEQ ID NO: 314750 - DNA, 26 bp, Artificial Sequence
  Description of Artificial Sequence: Synthetic oligonucleotide
cgtcgctgagcggcatcgagctcttt

SEQ ID NO: 314751 - DNA, 27 bp, Artificial Sequence
  Description of Artificial Sequence: Synthetic oligonucleotide
gtcgctgagcggcatcgagctctttgt

SEQ ID NO: 314752 - DNA, 27 bp, Artificial Sequence
  Description of Artificial Sequence: Synthetic oligonucleotide
tcgctgagcggcatcgagctctttgtc

SEQ ID NO: 314753 - DNA, 26 bp, Artificial Sequence
  Description of Artificial Sequence: Synthetic oligonucleotide
cgctgagcggcatcgagctctttgtc

SEQ ID NO: 314754 - DNA, 26 bp, Artificial Sequence
  Description of Artificial Sequence: Synthetic oligonucleotide
gctgagcggcatcgagctctttgtcc

SEQ ID NO: 314755 - DNA, 26 bp, Artificial Sequence
  Description of Artificial Sequence: Synthetic oligonucleotide
ctgagcggcatcgagctctttgtccg

SEQ ID NO: 314756 - DNA, 27 bp, Artificial Sequence
  Description of Artificial Sequence: Synthetic oligonucleotide
tgagcggcatcgagctctttgtccgca

SEQ ID NO: 314757 - DNA, 27 bp, Artificial Sequence
  Description of Artificial Sequence: Synthetic oligonucleotide
gagcggcatcgagctctttgtccgcat

SEQ ID NO: 314758 - DNA, 27 bp, Artificial Sequence
  Description of Artificial Sequence: Synthetic oligonucleotide
agcggcatcgagctctttgtccgcatc

SEQ ID NO: 314759 - DNA, 27 bp, Artificial Sequence
  Description of Artificial Sequence: Synthetic oligonucleotide
gcggcatcgagctctttgtccgcatct

SEQ ID NO: 314760 - DNA, 28 bp, Artificial Sequence
  Description of Artificial Sequence: Synthetic oligonucleotide
cggcatcgagctctttgtccgcatcttc

SEQ ID NO: 314761 - DNA, 28 bp, Artificial Sequence
  Description of Artificial Sequence: Synthetic oligonucleotide
ggcatcgagctctttgtccgcatcttcc

SEQ ID NO: 314762 - DNA, 30 bp, Artificial Sequence
  Description of Artificial Sequence: Synthetic oligonucleotide
gcatcgagctctttgtccgcatcttccttc

SEQ ID NO: 314763 - DNA, 31 bp, Artificial Sequence
  Description of Artificial Sequence: Synthetic oligonucleotide
catcgagctctttgtccgcatcttccttctg

SEQ ID NO: 314764 - DNA, 33 bp, Artificial Sequence
  Description of Artificial Sequence: Synthetic oligonucleotide
atcgagctctttgtccgcatcttccttctgttc

SEQ ID NO: 314765 - DNA, 32 bp, Artificial Sequence
  Description of Artificial Sequence: Synthetic oligonucleotide
tcgagctctttgtccgcatcttccttctgttc

SEQ ID NO: 314766 - DNA, 31 bp, Artificial Sequence
  Description of Artificial Sequence: Synthetic oligonucleotide
cgagctctttgtccgcatcttccttctgttc

SEQ ID NO: 314767 - DNA, 33 bp, Artificial Sequence
  Description of Artificial Sequence: Synthetic oligonucleotide
gagctctttgtccgcatcttccttctgttctag

SEQ ID NO: 314768 - DNA, 33 bp, Artificial Sequence
  Description of Artificial Sequence: Synthetic oligonucleotide
agctctttgtccgcatcttccttctgttctagc

SEQ ID NO: 314769 - DNA, 32 bp, Artificial Sequence
  Description of Artificial Sequence: Synthetic oligonucleotide
gctctttgtccgcatcttccttctgttctagc

SEQ ID NO: 314770 - DNA, 32 bp, Artificial Sequence
  Description of Artificial Sequence: Synthetic oligonucleotide
ctctttgtccgcatcttccttctgttctagcc

SEQ ID NO: 314771 - DNA, 33 bp, Artificial Sequence
  Description of Artificial Sequence: Synthetic oligonucleotide
tctttgtccgcatcttccttctgttctagccac

SEQ ID NO: 314772 - DNA, 32 bp, Artificial Sequence
  Description of Artificial Sequence: Synthetic oligonucleotide
ctttgtccgcatcttccttctgttctagccac

SEQ ID NO: 314773 - DNA, 32 bp, Artificial Sequence
  Description of Artificial Sequence: Synthetic oligonucleotide
tttgtccgcatcttccttctgttctagccacc

SEQ ID NO: 314774 - DNA, 31 bp, Artificial Sequence
  Description of Artificial Sequence: Synthetic oligonucleotide
ttgtccgcatcttccttctgttctagccacc

SEQ ID NO: 314775 - DNA, 30 bp, Artificial Sequence
  Description of Artificial Sequence: Synthetic oligonucleotide
tgtccgcatcttccttctgttctagccacc

SEQ ID NO: 314776 - DNA, 29 bp, Artificial Sequence
  Description of Artificial Sequence: Synthetic oligonucleotide
gtccgcatcttccttctgttctagccacc

SEQ ID NO: 314777 - DNA, 29 bp, Artificial Sequence
  Description of Artificial Sequence: Synthetic oligonucleotide
tccgcatcttccttctgttctagccaccc

SEQ ID NO: 314778 - DNA, 28 bp, Artificial Sequence
  Description of Artificial Sequence: Synthetic oligonucleotide
ccgcatcttccttctgttctagccaccc

SEQ ID NO: 314779 - DNA, 30 bp, Artificial Sequence
  Description of Artificial Sequence: Synthetic oligonucleotide
cgcatcttccttctgttctagccacccatg

SEQ ID NO: 314780 - DNA, 33 bp, Artificial Sequence
  Description of Artificial Sequence: Synthetic oligonucleotide
gcatcttccttctgttctagccacccatgtatc

SEQ ID NO: 314781 - DNA, 34 bp, Artificial Sequence
  Description of Artificial Sequence: Synthetic oligonucleotide
catcttccttctgttctagccacccatgtatcac

SEQ ID NO: 314782 - DNA, 34 bp, Artificial Sequence
  Description of Artificial Sequence: Synthetic oligonucleotide
atcttccttctgttctagccacccatgtatcacc

SEQ ID NO: 314783 - DNA, 33 bp, Artificial Sequence
  Description of Artificial Sequence: Synthetic oligonucleotide
tcttccttctgttctagccacccatgtatcacc

SEQ ID NO: 314784 - DNA, 32 bp, Artificial Sequence
  Description of Artificial Sequence: Synthetic oligonucleotide
cttccttctgttctagccacccatgtatcacc

SEQ ID NO: 314785 - DNA, 32 bp, Artificial Sequence
  Description of Artificial Sequence: Synthetic oligonucleotide
ttccttctgttctagccacccatgtatcaccc

SEQ ID NO: 314786 - DNA, 31 bp, Artificial Sequence
  Description of Artificial Sequence: Synthetic oligonucleotide
tccttctgttctagccacccatgtatcaccc

SEQ ID NO: 314787 - DNA, 30 bp, Artificial Sequence
  Description of Artificial Sequence: Synthetic oligonucleotide
ccttctgttctagccacccatgtatcaccc

SEQ ID NO: 314788 - DNA, 31 bp, Artificial Sequence
  Description of Artificial Sequence: Synthetic oligonucleotide
cttctgttctagccacccatgtatcaccctg

SEQ ID NO: 314789 - DNA, 33 bp, Artificial Sequence
  Description of Artificial Sequence: Synthetic oligonucleotide
ttctgttctagccacccatgtatcaccctgatg

SEQ ID NO: 314790 - DNA, 32 bp, Artificial Sequence
  Description of Artificial Sequence: Synthetic oligonucleotide
tctgttctagccacccatgtatcaccctgatg

SEQ ID NO: 314791 - DNA, 31 bp, Artificial Sequence
  Description of Artificial Sequence: Synthetic oligonucleotide
ctgttctagccacccatgtatcaccctgatg

SEQ ID NO: 314792 - DNA, 32 bp, Artificial Sequence
  Description of Artificial Sequence: Synthetic oligonucleotide
tgttctagccacccatgtatcaccctgatgtg

SEQ ID NO: 314793 - DNA, 31 bp, Artificial Sequence
  Description of Artificial Sequence: Synthetic oligonucleotide
gttctagccacccatgtatcaccctgatgtg

SEQ ID NO: 314794 - DNA, 31 bp, Artificial Sequence
  Description of Artificial Sequence: Synthetic oligonucleotide
ttctagccacccatgtatcaccctgatgtgc

SEQ ID NO: 314795 - DNA, 30 bp, Artificial Sequence
  Description of Artificial Sequence: Synthetic oligonucleotide
tctagccacccatgtatcaccctgatgtgc

SEQ ID NO: 314796 - DNA, 29 bp, Artificial Sequence
  Description of Artificial Sequence: Synthetic oligonucleotide
ctagccacccatgtatcaccctgatgtgc

SEQ ID NO: 314797 - DNA, 29 bp, Artificial Sequence
  Description of Artificial Sequence: Synthetic oligonucleotide
tagccacccatgtatcaccctgatgtgcc

SEQ ID NO: 314798 - DNA, 28 bp, Artificial Sequence
  Description of Artificial Sequence: Synthetic oligonucleotide
agccacccatgtatcaccctgatgtgcc

SEQ ID NO: 314799 - DNA, 27 bp, Artificial Sequence
  Description of Artificial Sequence: Synthetic oligonucleotide
gccacccatgtatcaccctgatgtgcc

SEQ ID NO: 314800 - DNA, 27 bp, Artificial Sequence
  Description of Artificial Sequence: Synthetic oligonucleotide
ccacccatgtatcaccctgatgtgccc

SEQ ID NO: 314801 - DNA, 29 bp, Artificial Sequence
  Description of Artificial Sequence: Synthetic oligonucleotide
cacccatgtatcaccctgatgtgcccaac

SEQ ID NO: 314802 - DNA, 29 bp, Artificial Sequence
  Description of Artificial Sequence: Synthetic oligonucleotide
acccatgtatcaccctgatgtgcccaacg

SEQ ID NO: 314803 - DNA, 28 bp, Artificial Sequence
  Description of Artificial Sequence: Synthetic oligonucleotide
cccatgtatcaccctgatgtgcccaacg

SEQ ID NO: 314804 - DNA, 29 bp, Artificial Sequence
  Description of Artificial Sequence: Synthetic oligonucleotide
ccatgtatcaccctgatgtgcccaacgtc

SEQ ID NO: 314805 - DNA, 31 bp, Artificial Sequence
  Description of Artificial Sequence: Synthetic oligonucleotide
catgtatcaccctgatgtgcccaacgtcaag

SEQ ID NO: 314806 - DNA, 31 bp, Artificial Sequence
  Description of Artificial Sequence: Synthetic oligonucleotide
atgtatcaccctgatgtgcccaacgtcaagc

SEQ ID NO: 314807 - DNA, 30 bp, Artificial Sequence
  Description of Artificial Sequence: Synthetic oligonucleotide
tgtatcaccctgatgtgcccaacgtcaagc

SEQ ID NO: 314808 - DNA, 29 bp, Artificial Sequence
  Description of Artificial Sequence: Synthetic oligonucleotide
gtatcaccctgatgtgcccaacgtcaagc

SEQ ID NO: 314809 - DNA, 29 bp, Artificial Sequence
  Description of Artificial Sequence: Synthetic oligonucleotide
tatcaccctgatgtgcccaacgtcaagcc

SEQ ID NO: 314810 - DNA, 28 bp, Artificial Sequence
  Description of Artificial Sequence: Synthetic oligonucleotide
atcaccctgatgtgcccaacgtcaagcc

SEQ ID NO: 314811 - DNA, 27 bp, Artificial Sequence
  Description of Artificial Sequence: Synthetic oligonucleotide
tcaccctgatgtgcccaacgtcaagcc

SEQ ID NO: 314812 - DNA, 26 bp, Artificial Sequence
  Description of Artificial Sequence: Synthetic oligonucleotide
caccctgatgtgcccaacgtcaagcc

SEQ ID NO: 314813 - DNA, 26 bp, Artificial Sequence
  Description of Artificial Sequence: Synthetic oligonucleotide
accctgatgtgcccaacgtcaagccg

SEQ ID NO: 314814 - DNA, 25 bp, Artificial Sequence
  Description of Artificial Sequence: Synthetic oligonucleotide
ccctgatgtgcccaacgtcaagccg

SEQ ID NO: 314815 - DNA, 26 bp, Artificial Sequence
  Description of Artificial Sequence: Synthetic oligonucleotide
cctgatgtgcccaacgtcaagccggt

SEQ ID NO: 314816 - DNA, 27 bp, Artificial Sequence
  Description of Artificial Sequence: Synthetic oligonucleotide
ctgatgtgcccaacgtcaagccggtga

SEQ ID NO: 314817 - DNA, 28 bp, Artificial Sequence
  Description of Artificial Sequence: Synthetic oligonucleotide
tgatgtgcccaacgtcaagccggtgaag

SEQ ID NO: 314818 - DNA, 27 bp, Artificial Sequence
  Description of Artificial Sequence: Synthetic oligonucleotide
gatgtgcccaacgtcaagccggtgaag

SEQ ID NO: 314819 - DNA, 28 bp, Artificial Sequence
  Description of Artificial Sequence: Synthetic oligonucleotide
atgtgcccaacgtcaagccggtgaagac

SEQ ID NO: 314820 - DNA, 27 bp, Artificial Sequence
  Description of Artificial Sequence: Synthetic oligonucleotide
tgtgcccaacgtcaagccggtgaagac

SEQ ID NO: 314821 - DNA, 26 bp, Artificial Sequence
  Description of Artificial Sequence: Synthetic oligonucleotide
gtgcccaacgtcaagccggtgaagac

SEQ ID NO: 314822 - DNA, 27 bp, Artificial Sequence
  Description of Artificial Sequence: Synthetic oligonucleotide
tgcccaacgtcaagccggtgaagacgt

SEQ ID NO: 314823 - DNA, 26 bp, Artificial Sequence
  Description of Artificial Sequence: Synthetic oligonucleotide
gcccaacgtcaagccggtgaagacgt

SEQ ID NO: 314824 - DNA, 26 bp, Artificial Sequence
  Description of Artificial Sequence: Synthetic oligonucleotide
cccaacgtcaagccggtgaagacgtg

SEQ ID NO: 314825 - DNA, 26 bp, Artificial Sequence
  Description of Artificial Sequence: Synthetic oligonucleotide
ccaacgtcaagccggtgaagacgtgg

SEQ ID NO: 314826 - DNA, 26 bp, Artificial Sequence
  Description of Artificial Sequence: Synthetic oligonucleotide
caacgtcaagccggtgaagacgtggc

SEQ ID NO: 314827 - DNA, 26 bp, Artificial Sequence
  Description of Artificial Sequence: Synthetic oligonucleotide
aacgtcaagccggtgaagacgtggcg

SEQ ID NO: 314828 - DNA, 25 bp, Artificial Sequence
  Description of Artificial Sequence: Synthetic oligonucleotide
acgtcaagccggtgaagacgtggcg

SEQ ID NO: 314829 - DNA, 24 bp, Artificial Sequence
  Description of Artificial Sequence: Synthetic oligonucleotide
cgtcaagccggtgaagacgtggcg

SEQ ID NO: 314830 - DNA, 26 bp, Artificial Sequence
  Description of Artificial Sequence: Synthetic oligonucleotide
gtcaagccggtgaagacgtggcgcat

SEQ ID NO: 314831 - DNA, 26 bp, Artificial Sequence
  Description of Artificial Sequence: Synthetic oligonucleotide
tcaagccggtgaagacgtggcgcatg

SEQ ID NO: 314832 - DNA, 25 bp, Artificial Sequence
  Description of Artificial Sequence: Synthetic oligonucleotide
caagccggtgaagacgtggcgcatg

SEQ ID NO: 314833 - DNA, 26 bp, Artificial Sequence
  Description of Artificial Sequence: Synthetic oligonucleotide
aagccggtgaagacgtggcgcatgga

SEQ ID NO: 314834 - DNA, 25 bp, Artificial Sequence
  Description of Artificial Sequence: Synthetic oligonucleotide
agccggtgaagacgtggcgcatgga

SEQ ID NO: 314835 - DNA, 24 bp, Artificial Sequence
  Description of Artificial Sequence: Synthetic oligonucleotide
gccggtgaagacgtggcgcatgga

SEQ ID NO: 314836 - DNA, 27 bp, Artificial Sequence
  Description of Artificial Sequence: Synthetic oligonucleotide
ccggtgaagacgtggcgcatggactta

SEQ ID NO: 314837 - DNA, 29 bp, Artificial Sequence
  Description of Artificial Sequence: Synthetic oligonucleotide
cggtgaagacgtggcgcatggacttattc

SEQ ID NO: 314838 - DNA, 30 bp, Artificial Sequence
  Description of Artificial Sequence: Synthetic oligonucleotide
ggtgaagacgtggcgcatggacttattcag

SEQ ID NO: 314839 - DNA, 30 bp, Artificial Sequence
  Description of Artificial Sequence: Synthetic oligonucleotide
gtgaagacgtggcgcatggacttattcagg

SEQ ID NO: 314840 - DNA, 30 bp, Artificial Sequence
  Description of Artificial Sequence: Synthetic oligonucleotide
tgaagacgtggcgcatggacttattcaggg

SEQ ID NO: 314841 - DNA, 29 bp, Artificial Sequence
  Description of Artificial Sequence: Synthetic oligonucleotide
gaagacgtggcgcatggacttattcaggg

SEQ ID NO: 314842 - DNA, 29 bp, Artificial Sequence
  Description of Artificial Sequence: Synthetic oligonucleotide
aagacgtggcgcatggacttattcagggg

SEQ ID NO: 314843 - DNA, 28 bp, Artificial Sequence
  Description of Artificial Sequence: Synthetic oligonucleotide
agacgtggcgcatggacttattcagggg

SEQ ID NO: 314844 - DNA, 27 bp, Artificial Sequence
  Description of Artificial Sequence: Synthetic oligonucleotide
gacgtggcgcatggacttattcagggg

SEQ ID NO: 314845 - DNA, 27 bp, Artificial Sequence
  Description of Artificial Sequence: Synthetic oligonucleotide
acgtggcgcatggacttattcaggggc

SEQ ID NO: 314846 - DNA, 27 bp, Artificial Sequence
  Description of Artificial Sequence: Synthetic oligonucleotide
cgtggcgcatggacttattcaggggca

SEQ ID NO: 314847 - DNA, 28 bp, Artificial Sequence
  Description of Artificial Sequence: Synthetic oligonucleotide
gtggcgcatggacttattcaggggcatc

SEQ ID NO: 314848 - DNA, 28 bp, Artificial Sequence
  Description of Artificial Sequence: Synthetic oligonucleotide
tggcgcatggacttattcaggggcatcc

SEQ ID NO: 314849 - DNA, 27 bp, Artificial Sequence
  Description of Artificial Sequence: Synthetic oligonucleotide
ggcgcatggacttattcaggggcatcc

SEQ ID NO: 314850 - DNA, 28 bp, Artificial Sequence
  Description of Artificial Sequence: Synthetic oligonucleotide
gcgcatggacttattcaggggcatccac

SEQ ID NO: 314851 - DNA, 30 bp, Artificial Sequence
  Description of Artificial Sequence: Synthetic oligonucleotide
cgcatggacttattcaggggcatccacatc

SEQ ID NO: 314852 - DNA, 32 bp, Artificial Sequence
  Description of Artificial Sequence: Synthetic oligonucleotide
gcatggacttattcaggggcatccacatcatc

SEQ ID NO: 314853 - DNA, 33 bp, Artificial Sequence
  Description of Artificial Sequence: Synthetic oligonucleotide
catggacttattcaggggcatccacatcatctg

SEQ ID NO: 314854 - DNA, 33 bp, Artificial Sequence
  Description of Artificial Sequence: Synthetic oligonucleotide
atggacttattcaggggcatccacatcatctgc

SEQ ID NO: 314855 - DNA, 32 bp, Artificial Sequence
  Description of Artificial Sequence: Synthetic oligonucleotide
tggacttattcaggggcatccacatcatctgc

SEQ ID NO: 314856 - DNA, 31 bp, Artificial Sequence
  Description of Artificial Sequence: Synthetic oligonucleotide
ggacttattcaggggcatccacatcatctgc

SEQ ID NO: 314857 - DNA, 31 bp, Artificial Sequence
  Description of Artificial Sequence: Synthetic oligonucleotide
gacttattcaggggcatccacatcatctgcg

SEQ ID NO: 314858 - DNA, 32 bp, Artificial Sequence
  Description of Artificial Sequence: Synthetic oligonucleotide
acttattcaggggcatccacatcatctgcgtg

SEQ ID NO: 314859 - DNA, 31 bp, Artificial Sequence
  Description of Artificial Sequence: Synthetic oligonucleotide
cttattcaggggcatccacatcatctgcgtg

SEQ ID NO: 314860 - DNA, 31 bp, Artificial Sequence
  Description of Artificial Sequence: Synthetic oligonucleotide
ttattcaggggcatccacatcatctgcgtgg

SEQ ID NO: 314861 - DNA, 30 bp, Artificial Sequence
  Description of Artificial Sequence: Synthetic oligonucleotide
tattcaggggcatccacatcatctgcgtgg

SEQ ID NO: 314862 - DNA, 29 bp, Artificial Sequence
  Description of Artificial Sequence: Synthetic oligonucleotide
attcaggggcatccacatcatctgcgtgg

SEQ ID NO: 314863 - DNA, 28 bp, Artificial Sequence
  Description of Artificial Sequence: Synthetic oligonucleotide
ttcaggggcatccacatcatctgcgtgg

SEQ ID NO: 314864 - DNA, 27 bp, Artificial Sequence
  Description of Artificial Sequence: Synthetic oligonucleotide
tcaggggcatccacatcatctgcgtgg

SEQ ID NO: 314865 - DNA, 26 bp, Artificial Sequence
  Description of Artificial Sequence: Synthetic oligonucleotide
caggggcatccacatcatctgcgtgg

SEQ ID NO: 314866 - DNA, 27 bp, Artificial Sequence
  Description of Artificial Sequence: Synthetic oligonucleotide
aggggcatccacatcatctgcgtggca

SEQ ID NO: 314867 - DNA, 26 bp, Artificial Sequence
  Description of Artificial Sequence: Synthetic oligonucleotide
ggggcatccacatcatctgcgtggca

SEQ ID NO: 314868 - DNA, 27 bp, Artificial Sequence
  Description of Artificial Sequence: Synthetic oligonucleotide
gggcatccacatcatctgcgtggcagt

SEQ ID NO: 314869 - DNA, 27 bp, Artificial Sequence
  Description of Artificial Sequence: Synthetic oligonucleotide
ggcatccacatcatctgcgtggcagtg

SEQ ID NO: 314870 - DNA, 27 bp, Artificial Sequence
  Description of Artificial Sequence: Synthetic oligonucleotide
gcatccacatcatctgcgtggcagtgc

SEQ ID NO: 314871 - DNA, 28 bp, Artificial Sequence
  Description of Artificial Sequence: Synthetic oligonucleotide
catccacatcatctgcgtggcagtgcag

SEQ ID NO: 314872 - DNA, 29 bp, Artificial Sequence
  Description of Artificial Sequence: Synthetic oligonucleotide
atccacatcatctgcgtggcagtgcagtg

SEQ ID NO: 314873 - DNA, 28 bp, Artificial Sequence
  Description of Artificial Sequence: Synthetic oligonucleotide
tccacatcatctgcgtggcagtgcagtg

SEQ ID NO: 314874 - DNA, 27 bp, Artificial Sequence
  Description of Artificial Sequence: Synthetic oligonucleotide
ccacatcatctgcgtggcagtgcagtg

SEQ ID NO: 314875 - DNA, 27 bp, Artificial Sequence
  Description of Artificial Sequence: Synthetic oligonucleotide
cacatcatctgcgtggcagtgcagtgg

SEQ ID NO: 314876 - DNA, 27 bp, Artificial Sequence
  Description of Artificial Sequence: Synthetic oligonucleotide
acatcatctgcgtggcagtgcagtggg

SEQ ID NO: 314877 - DNA, 27 bp, Artificial Sequence
  Description of Artificial Sequence: Synthetic oligonucleotide
catcatctgcgtggcagtgcagtgggt

SEQ ID NO: 314878 - DNA, 27 bp, Artificial Sequence
  Description of Artificial Sequence: Synthetic oligonucleotide
atcatctgcgtggcagtgcagtgggtg

SEQ ID NO: 314879 - DNA, 26 bp, Artificial Sequence
  Description of Artificial Sequence: Synthetic oligonucleotide
tcatctgcgtggcagtgcagtgggtg

SEQ ID NO: 314880 - DNA, 25 bp, Artificial Sequence
  Description of Artificial Sequence: Synthetic oligonucleotide
catctgcgtggcagtgcagtgggtg

SEQ ID NO: 314881 - DNA, 26 bp, Artificial Sequence
  Description of Artificial Sequence: Synthetic oligonucleotide
atctgcgtggcagtgcagtgggtggt

SEQ ID NO: 314882 - DNA, 25 bp, Artificial Sequence
  Description of Artificial Sequence: Synthetic oligonucleotide
tctgcgtggcagtgcagtgggtggt

SEQ ID NO: 314883 - DNA, 24 bp, Artificial Sequence
  Description of Artificial Sequence: Synthetic oligonucleotide
ctgcgtggcagtgcagtgggtggt

SEQ ID NO: 314884 - DNA, 26 bp, Artificial Sequence
  Description of Artificial Sequence: Synthetic oligonucleotide
tgcgtggcagtgcagtgggtggtcaa

SEQ ID NO: 314885 - DNA, 25 bp, Artificial Sequence
  Description of Artificial Sequence: Synthetic oligonucleotide
gcgtggcagtgcagtgggtggtcaa

SEQ ID NO: 314886 - DNA, 26 bp, Artificial Sequence
  Description of Artificial Sequence: Synthetic oligonucleotide
cgtggcagtgcagtgggtggtcaagt

SEQ ID NO: 314887 - DNA, 26 bp, Artificial Sequence
  Description of Artificial Sequence: Synthetic oligonucleotide
gtggcagtgcagtgggtggtcaagtc

SEQ ID NO: 314888 - DNA, 27 bp, Artificial Sequence
  Description of Artificial Sequence: Synthetic oligonucleotide
tggcagtgcagtgggtggtcaagtcca

SEQ ID NO: 314889 - DNA, 26 bp, Artificial Sequence
  Description of Artificial Sequence: Synthetic oligonucleotide
ggcagtgcagtgggtggtcaagtcca

SEQ ID NO: 314890 - DNA, 26 bp, Artificial Sequence
  Description of Artificial Sequence: Synthetic oligonucleotide
gcagtgcagtgggtggtcaagtccac

SEQ ID NO: 314891 - DNA, 26 bp, Artificial Sequence
  Description of Artificial Sequence: Synthetic oligonucleotide
cagtgcagtgggtggtcaagtccacg

SEQ ID NO: 314892 - DNA, 26 bp, Artificial Sequence
  Description of Artificial Sequence: Synthetic oligonucleotide
agtgcagtgggtggtcaagtccacgg

SEQ ID NO: 314893 - DNA, 25 bp, Artificial Sequence
  Description of Artificial Sequence: Synthetic oligonucleotide
gtgcagtgggtggtcaagtccacgg

SEQ ID NO: 314894 - DNA, 25 bp, Artificial Sequence
  Description of Artificial Sequence: Synthetic oligonucleotide
tgcagtgggtggtcaagtccacggc

SEQ ID NO: 314895 - DNA, 24 bp, Artificial Sequence
  Description of Artificial Sequence: Synthetic oligonucleotide
gcagtgggtggtcaagtccacggc

SEQ ID NO: 314896 - DNA, 24 bp, Artificial Sequence
  Description of Artificial Sequence: Synthetic oligonucleotide
cagtgggtggtcaagtccacggcg

SEQ ID NO: 314897 - DNA, 24 bp, Artificial Sequence
  Description of Artificial Sequence: Synthetic oligonucleotide
agtgggtggtcaagtccacggcgg

SEQ ID NO: 314898 - DNA, 23 bp, Artificial Sequence
  Description of Artificial Sequence: Synthetic oligonucleotide
gtgggtggtcaagtccacggcgg

SEQ ID NO: 314899 - DNA, 23 bp, Artificial Sequence
  Description of Artificial Sequence: Synthetic oligonucleotide
tgggtggtcaagtccacggcggc

SEQ ID NO: 314900 - DNA, 22 bp, Artificial Sequence
  Description of Artificial Sequence: Synthetic oligonucleotide
gggtggtcaagtccacggcggc

SEQ ID NO: 314901 - DNA, 23 bp, Artificial Sequence
  Description of Artificial Sequence: Synthetic oligonucleotide
ggtggtcaagtccacggcggcct

SEQ ID NO: 314902 - DNA, 23 bp, Artificial Sequence
  Description of Artificial Sequence: Synthetic oligonucleotide
gtggtcaagtccacggcggcctc

SEQ ID NO: 314903 - DNA, 23 bp, Artificial Sequence
  Description of Artificial Sequence: Synthetic oligonucleotide
tggtcaagtccacggcggcctcc

SEQ ID NO: 314904 - DNA, 22 bp, Artificial Sequence
  Description of Artificial Sequence: Synthetic oligonucleotide
ggtcaagtccacggcggcctcc

SEQ ID NO: 314905 - DNA, 23 bp, Artificial Sequence
  Description of Artificial Sequence: Synthetic oligonucleotide
gtcaagtccacggcggcctccca

SEQ ID NO: 314906 - DNA, 23 bp, Artificial Sequence
  Description of Artificial Sequence: Synthetic oligonucleotide
tcaagtccacggcggcctcccag

SEQ ID NO: 314907 - DNA, 22 bp, Artificial Sequence
  Description of Artificial Sequence: Synthetic oligonucleotide
caagtccacggcggcctcccag

SEQ ID NO: 314908 - DNA, 22 bp, Artificial Sequence
  Description of Artificial Sequence: Synthetic oligonucleotide
aagtccacggcggcctcccagg

SEQ ID NO: 314909 - DNA, 21 bp, Artificial Sequence
  Description of Artificial Sequence: Synthetic oligonucleotide
agtccacggcggcctcccagg

SEQ ID NO: 314910 - DNA, 20 bp, Artificial Sequence
  Description of Artificial Sequence: Synthetic oligonucleotide
gtccacggcggcctcccagg

SEQ ID NO: 314911 - DNA, 20 bp, Artificial Sequence
  Description of Artificial Sequence: Synthetic oligonucleotide
tccacggcggcctcccaggc

SEQ ID NO: 314912 - DNA, 20 bp, Artificial Sequence
  Description of Artificial Sequence: Synthetic oligonucleotide
ccacggcggcctcccaggct

SEQ ID NO: 314913 - DNA, 20 bp, Artificial Sequence
  Description of Artificial Sequence: Synthetic oligonucleotide
cacggcggcctcccaggcct

SEQ ID NO: 314914 - DNA, 20 bp, Artificial Sequence
  Description of Artificial Sequence: Synthetic oligonucleotide
acggcggcctcccaggccct

SEQ ID NO: 314915 - DNA, 20 bp, Artificial Sequence
  Description of Artificial Sequence: Synthetic oligonucleotide
cggcggcctcccaggccctt

SEQ ID NO: 314916 - DNA, 20 bp, Artificial Sequence
  Description of Artificial Sequence: Synthetic oligonucleotide
ggcggcctcccaggccctgt

SEQ ID NO: 314917 - DNA, 20 bp, Artificial Sequence
  Description of Artificial Sequence: Synthetic oligonucleotide
gcggcctcccaggccctgct

SEQ ID NO: 314918 - DNA, 20 bp, Artificial Sequence
  Description of Artificial Sequence: Synthetic oligonucleotide
cggcctcccaggccctgcct

SEQ ID NO: 314919 - DNA, 21 bp, Artificial Sequence
  Description of Artificial Sequence: Synthetic oligonucleotide
ggcctcccaggccctgccgtt

SEQ ID NO: 314920 - DNA, 21 bp, Artificial Sequence
  Description of Artificial Sequence: Synthetic oligonucleotide
gcctcccaggccctgccgttc

SEQ ID NO: 314921 - DNA, 22 bp, Artificial Sequence
  Description of Artificial Sequence: Synthetic oligonucleotide
cctcccaggccctgccgttcgt

SEQ ID NO: 314922 - DNA, 22 bp, Artificial Sequence
  Description of Artificial Sequence: Synthetic oligonucleotide
ctcccaggccctgccgttcgtc

SEQ ID NO: 314923 - DNA, 23 bp, Artificial Sequence
  Description of Artificial Sequence: Synthetic oligonucleotide
tcccaggccctgccgttcgtcct

SEQ ID NO: 314924 - DNA, 22 bp, Artificial Sequence
  Description of Artificial Sequence: Synthetic oligonucleotide
cccaggccctgccgttcgtcct

SEQ ID NO: 314925 - DNA, 24 bp, Artificial Sequence
  Description of Artificial Sequence: Synthetic oligonucleotide
ccaggccctgccgttcgtcctctt

SEQ ID NO: 314926 - DNA, 24 bp, Artificial Sequence
  Description of Artificial Sequence: Synthetic oligonucleotide
caggccctgccgttcgtcctcttc

SEQ ID NO: 314927 - DNA, 25 bp, Artificial Sequence
  Description of Artificial Sequence: Synthetic oligonucleotide
aggccctgccgttcgtcctcttcct

SEQ ID NO: 314928 - DNA, 24 bp, Artificial Sequence
  Description of Artificial Sequence: Synthetic oligonucleotide
ggccctgccgttcgtcctcttcct

SEQ ID NO: 314929 - DNA, 25 bp, Artificial Sequence
  Description of Artificial Sequence: Synthetic oligonucleotide
gccctgccgttcgtcctcttcctca

SEQ ID NO: 314930 - DNA, 26 bp, Artificial Sequence
  Description of Artificial Sequence: Synthetic oligonucleotide
ccctgccgttcgtcctcttcctcact

SEQ ID NO: 314931 - DNA, 27 bp, Artificial Sequence
  Description of Artificial Sequence: Synthetic oligonucleotide
cctgccgttcgtcctcttcctcactga

SEQ ID NO: 314932 - DNA, 27 bp, Artificial Sequence
  Description of Artificial Sequence: Synthetic oligonucleotide
ctgccgttcgtcctcttcctcactgag

SEQ ID NO: 314933 - DNA, 27 bp, Artificial Sequence
  Description of Artificial Sequence: Synthetic oligonucleotide
tgccgttcgtcctcttcctcactgagc

SEQ ID NO: 314934 - DNA, 26 bp, Artificial Sequence
  Description of Artificial Sequence: Synthetic oligonucleotide
gccgttcgtcctcttcctcactgagc

SEQ ID NO: 314935 - DNA, 26 bp, Artificial Sequence
  Description of Artificial Sequence: Synthetic oligonucleotide
ccgttcgtcctcttcctcactgagcc

SEQ ID NO: 314936 - DNA, 26 bp, Artificial Sequence
  Description of Artificial Sequence: Synthetic oligonucleotide
cgttcgtcctcttcctcactgagccg

SEQ ID NO: 314937 - DNA, 27 bp, Artificial Sequence
  Description of Artificial Sequence: Synthetic oligonucleotide
gttcgtcctcttcctcactgagccgct

SEQ ID NO: 314938 - DNA, 27 bp, Artificial Sequence
  Description of Artificial Sequence: Synthetic oligonucleotide
ttcgtcctcttcctcactgagccgctg

SEQ ID NO: 314939 - DNA, 26 bp, Artificial Sequence
  Description of Artificial Sequence: Synthetic oligonucleotide
tcgtcctcttcctcactgagccgctg

SEQ ID NO: 314940 - DNA, 25 bp, Artificial Sequence
  Description of Artificial Sequence: Synthetic oligonucleotide
cgtcctcttcctcactgagccgctg

SEQ ID NO: 314941 - DNA, 25 bp, Artificial Sequence
  Description of Artificial Sequence: Synthetic oligonucleotide
gtcctcttcctcactgagccgctgc

SEQ ID NO: 314942 - DNA, 25 bp, Artificial Sequence
  Description of Artificial Sequence: Synthetic oligonucleotide
tcctcttcctcactgagccgctgcg

SEQ ID NO: 314943 - DNA, 24 bp, Artificial Sequence
  Description of Artificial Sequence: Synthetic oligonucleotide
cctcttcctcactgagccgctgcg

SEQ ID NO: 314944 - DNA, 24 bp, Artificial Sequence
  Description of Artificial Sequence: Synthetic oligonucleotide
ctcttcctcactgagccgctgcgc

SEQ ID NO: 314945 - DNA, 24 bp, Artificial Sequence
  Description of Artificial Sequence: Synthetic oligonucleotide
tcttcctcactgagccgctgcgcc

SEQ ID NO: 314946 - DNA, 23 bp, Artificial Sequence
  Description of Artificial Sequence: Synthetic oligonucleotide
cttcctcactgagccgctgcgcc

SEQ ID NO: 314947 - DNA, 23 bp, Artificial Sequence
  Description of Artificial Sequence: Synthetic oligonucleotide
ttcctcactgagccgctgcgccg

SEQ ID NO: 314948 - DNA, 22 bp, Artificial Sequence
  Description of Artificial Sequence: Synthetic oligonucleotide
tcctcactgagccgctgcgccg

SEQ ID NO: 314949 - DNA, 21 bp, Artificial Sequence
  Description of Artificial Sequence: Synthetic oligonucleotide
cctcactgagccgctgcgccg

SEQ ID NO: 314950 - DNA, 21 bp, Artificial Sequence
  Description of Artificial Sequence: Synthetic oligonucleotide
ctcactgagccgctgcgccgc

SEQ ID NO: 314951 - DNA, 22 bp, Artificial Sequence
  Description of Artificial Sequence: Synthetic oligonucleotide
tcactgagccgctgcgccgcgt

SEQ ID NO: 314952 - DNA, 21 bp, Artificial Sequence
  Description of Artificial Sequence: Synthetic oligonucleotide
cactgagccgctgcgccgcgt

SEQ ID NO: 314953 - DNA, 21 bp, Artificial Sequence
  Description of Artificial Sequence: Synthetic oligonucleotide
actgagccgctgcgccgcgtc

SEQ ID NO: 314954 - DNA, 20 bp, Artificial Sequence
  Description of Artificial Sequence: Synthetic oligonucleotide
ctgagccgctgcgccgcgtc

SEQ ID NO: 314955 - DNA, 21 bp, Artificial Sequence
  Description of Artificial Sequence: Synthetic oligonucleotide
tgagccgctgcgccgcgtcct

SEQ ID NO: 314956 - DNA, 20 bp, Artificial Sequence
  Description of Artificial Sequence: Synthetic oligonucleotide
gagccgctgcgccgcgtcct

SEQ ID NO: 314957 - DNA, 20 bp, Artificial Sequence
  Description of Artificial Sequence: Synthetic oligonucleotide
agccgctgcgccgcgtcctg

SEQ ID NO: 314958 - DNA, 20 bp, Artificial Sequence
  Description of Artificial Sequence: Synthetic oligonucleotide
gccgctgcgccgcgtcctgt

SEQ ID NO: 314959 - DNA, 20 bp, Artificial Sequence
  Description of Artificial Sequence: Synthetic oligonucleotide
ccgctgcgccgcgtcctggt

SEQ ID NO: 314960 - DNA, 20 bp, Artificial Sequence
  Description of Artificial Sequence: Synthetic oligonucleotide
cgctgcgccgcgtcctggtg

SEQ ID NO: 314961 - DNA, 20 bp, Artificial Sequence
  Description of Artificial Sequence: Synthetic oligonucleotide
gctgcgccgcgtcctggtgc

SEQ ID NO: 314962 - DNA, 20 bp, Artificial Sequence
  Description of Artificial Sequence: Synthetic oligonucleotide
ctgcgccgcgtcctggtgcc

SEQ ID NO: 314963 - DNA, 20 bp, Artificial Sequence
  Description of Artificial Sequence: Synthetic oligonucleotide
tgcgccgcgtcctggtgccg

SEQ ID NO: 314964 - DNA, 20 bp, Artificial Sequence
  Description of Artificial Sequence: Synthetic oligonucleotide
gcgccgcgtcctggtgccgt

SEQ ID NO: 314965 - DNA, 20 bp, Artificial Sequence
  Description of Artificial Sequence: Synthetic oligonucleotide
cgccgcgtcctggtgccgct

SEQ ID NO: 314966 - DNA, 22 bp, Artificial Sequence
  Description of Artificial Sequence: Synthetic oligonucleotide
gccgcgtcctggtgccgctcaa

SEQ ID NO: 314967 - DNA, 24 bp, Artificial Sequence
  Description of Artificial Sequence: Synthetic oligonucleotide
ccgcgtcctggtgccgctcaactt

SEQ ID NO: 314968 - DNA, 25 bp, Artificial Sequence
  Description of Artificial Sequence: Synthetic oligonucleotide
cgcgtcctggtgccgctcaacttca

SEQ ID NO: 314969 - DNA, 25 bp, Artificial Sequence
  Description of Artificial Sequence: Synthetic oligonucleotide
gcgtcctggtgccgctcaacttcag

SEQ ID NO: 314970 - DNA, 27 bp, Artificial Sequence
  Description of Artificial Sequence: Synthetic oligonucleotide
cgtcctggtgccgctcaacttcaggaa

SEQ ID NO: 314971 - DNA, 27 bp, Artificial Sequence
  Description of Artificial Sequence: Synthetic oligonucleotide
gtcctggtgccgctcaacttcaggaag

SEQ ID NO: 314972 - DNA, 27 bp, Artificial Sequence
  Description of Artificial Sequence: Synthetic oligonucleotide
tcctggtgccgctcaacttcaggaagg

SEQ ID NO: 314973 - DNA, 27 bp, Artificial Sequence
  Description of Artificial Sequence: Synthetic oligonucleotide
cctggtgccgctcaacttcaggaaggt

SEQ ID NO: 314974 - DNA, 27 bp, Artificial Sequence
  Description of Artificial Sequence: Synthetic oligonucleotide
ctggtgccgctcaacttcaggaaggtg

SEQ ID NO: 314975 - DNA, 27 bp, Artificial Sequence
  Description of Artificial Sequence: Synthetic oligonucleotide
tggtgccgctcaacttcaggaaggtgg

SEQ ID NO: 314976 - DNA, 27 bp, Artificial Sequence
  Description of Artificial Sequence: Synthetic oligonucleotide
ggtgccgctcaacttcaggaaggtgga

SEQ ID NO: 314977 - DNA, 27 bp, Artificial Sequence
  Description of Artificial Sequence: Synthetic oligonucleotide
gtgccgctcaacttcaggaaggtggag

SEQ ID NO: 314978 - DNA, 27 bp, Artificial Sequence
  Description of Artificial Sequence: Synthetic oligonucleotide
tgccgctcaacttcaggaaggtggagc

SEQ ID NO: 314979 - DNA, 27 bp, Artificial Sequence
  Description of Artificial Sequence: Synthetic oligonucleotide
gccgctcaacttcaggaaggtggagct

SEQ ID NO: 314980 - DNA, 28 bp, Artificial Sequence
  Description of Artificial Sequence: Synthetic oligonucleotide
ccgctcaacttcaggaaggtggagcttg

SEQ ID NO: 314981 - DNA, 29 bp, Artificial Sequence
  Description of Artificial Sequence: Synthetic oligonucleotide
cgctcaacttcaggaaggtggagcttgag

SEQ ID NO: 314982 - DNA, 30 bp, Artificial Sequence
  Description of Artificial Sequence: Synthetic oligonucleotide
gctcaacttcaggaaggtggagcttgagtg

SEQ ID NO: 314983 - DNA, 31 bp, Artificial Sequence
  Description of Artificial Sequence: Synthetic oligonucleotide
ctcaacttcaggaaggtggagcttgagtgtc

SEQ ID NO: 314984 - DNA, 32 bp, Artificial Sequence
  Description of Artificial Sequence: Synthetic oligonucleotide
tcaacttcaggaaggtggagcttgagtgtctg

SEQ ID NO: 314985 - DNA, 31 bp, Artificial Sequence
  Description of Artificial Sequence: Synthetic oligonucleotide
caacttcaggaaggtggagcttgagtgtctg

SEQ ID NO: 314986 - DNA, 31 bp, Artificial Sequence
  Description of Artificial Sequence: Synthetic oligonucleotide
aacttcaggaaggtggagcttgagtgtctgg

SEQ ID NO: 314987 - DNA, 30 bp, Artificial Sequence
  Description of Artificial Sequence: Synthetic oligonucleotide
acttcaggaaggtggagcttgagtgtctgg

SEQ ID NO: 314988 - DNA, 29 bp, Artificial Sequence
  Description of Artificial Sequence: Synthetic oligonucleotide
cttcaggaaggtggagcttgagtgtctgg

SEQ ID NO: 314989 - DNA, 31 bp, Artificial Sequence
  Description of Artificial Sequence: Synthetic oligonucleotide
ttcaggaaggtggagcttgagtgtctggttg

SEQ ID NO: 314990 - DNA, 30 bp, Artificial Sequence
  Description of Artificial Sequence: Synthetic oligonucleotide
tcaggaaggtggagcttgagtgtctggttg

SEQ ID NO: 314991 - DNA, 29 bp, Artificial Sequence
  Description of Artificial Sequence: Synthetic oligonucleotide
caggaaggtggagcttgagtgtctggttg

SEQ ID NO: 314992 - DNA, 29 bp, Artificial Sequence
  Description of Artificial Sequence: Synthetic oligonucleotide
aggaaggtggagcttgagtgtctggttgc

SEQ ID NO: 314993 - DNA, 28 bp, Artificial Sequence
  Description of Artificial Sequence: Synthetic oligonucleotide
ggaaggtggagcttgagtgtctggttgc

SEQ ID NO: 314994 - DNA, 29 bp, Artificial Sequence
  Description of Artificial Sequence: Synthetic oligonucleotide
gaaggtggagcttgagtgtctggttgctg

SEQ ID NO: 314995 - DNA, 31 bp, Artificial Sequence
  Description of Artificial Sequence: Synthetic oligonucleotide
aaggtggagcttgagtgtctggttgctgatg

SEQ ID NO: 314996 - DNA, 30 bp, Artificial Sequence
  Description of Artificial Sequence: Synthetic oligonucleotide
aggtggagcttgagtgtctggttgctgatg

SEQ ID NO: 314997 - DNA, 29 bp, Artificial Sequence
  Description of Artificial Sequence: Synthetic oligonucleotide
ggtggagcttgagtgtctggttgctgatg

SEQ ID NO: 314998 - DNA, 31 bp, Artificial Sequence
  Description of Artificial Sequence: Synthetic oligonucleotide
gtggagcttgagtgtctggttgctgatgaag

SEQ ID NO: 314999 - DNA, 31 bp, Artificial Sequence
  Description of Artificial Sequence: Synthetic oligonucleotide
tggagcttgagtgtctggttgctgatgaagc

SEQ ID NO: 315000 - DNA, 30 bp, Artificial Sequence
  Description of Artificial Sequence: Synthetic oligonucleotide
ggagcttgagtgtctggttgctgatgaagc

SEQ ID NO: 315001 - DNA, 30 bp, Artificial Sequence
  Description of Artificial Sequence: Synthetic oligonucleotide
gagcttgagtgtctggttgctgatgaagcc

SEQ ID NO: 315002 - DNA, 32 bp, Artificial Sequence
  Description of Artificial Sequence: Synthetic oligonucleotide
agcttgagtgtctggttgctgatgaagccaag

SEQ ID NO: 315003 - DNA, 31 bp, Artificial Sequence
  Description of Artificial Sequence: Synthetic oligonucleotide
gcttgagtgtctggttgctgatgaagccaag

SEQ ID NO: 315004 - DNA, 31 bp, Artificial Sequence
  Description of Artificial Sequence: Synthetic oligonucleotide
cttgagtgtctggttgctgatgaagccaagg

SEQ ID NO: 315005 - DNA, 31 bp, Artificial Sequence
  Description of Artificial Sequence: Synthetic oligonucleotide
ttgagtgtctggttgctgatgaagccaaggc

SEQ ID NO: 315006 - DNA, 30 bp, Artificial Sequence
  Description of Artificial Sequence: Synthetic oligonucleotide
tgagtgtctggttgctgatgaagccaaggc

SEQ ID NO: 315007 - DNA, 29 bp, Artificial Sequence
  Description of Artificial Sequence: Synthetic oligonucleotide
gagtgtctggttgctgatgaagccaaggc

SEQ ID NO: 315008 - DNA, 31 bp, Artificial Sequence
  Description of Artificial Sequence: Synthetic oligonucleotide
agtgtctggttgctgatgaagccaaggcatc

SEQ ID NO: 315009 - DNA, 30 bp, Artificial Sequence
  Description of Artificial Sequence: Synthetic oligonucleotide
gtgtctggttgctgatgaagccaaggcatc

SEQ ID NO: 315010 - DNA, 30 bp, Artificial Sequence
  Description of Artificial Sequence: Synthetic oligonucleotide
tgtctggttgctgatgaagccaaggcatcc

SEQ ID NO: 315011 - DNA, 29 bp, Artificial Sequence
  Description of Artificial Sequence: Synthetic oligonucleotide
gtctggttgctgatgaagccaaggcatcc

SEQ ID NO: 315012 - DNA, 32 bp, Artificial Sequence
  Description of Artificial Sequence: Synthetic oligonucleotide
tctggttgctgatgaagccaaggcatcctttg

SEQ ID NO: 315013 - DNA, 31 bp, Artificial Sequence
  Description of Artificial Sequence: Synthetic oligonucleotide
ctggttgctgatgaagccaaggcatcctttg

SEQ ID NO: 315014 - DNA, 33 bp, Artificial Sequence
  Description of Artificial Sequence: Synthetic oligonucleotide
tggttgctgatgaagccaaggcatcctttgatg

SEQ ID NO: 315015 - DNA, 32 bp, Artificial Sequence
  Description of Artificial Sequence: Synthetic oligonucleotide
ggttgctgatgaagccaaggcatcctttgatg

SEQ ID NO: 315016 - DNA, 33 bp, Artificial Sequence
  Description of Artificial Sequence: Synthetic oligonucleotide
gttgctgatgaagccaaggcatcctttgatgtg

SEQ ID NO: 315017 - DNA, 33 bp, Artificial Sequence
  Description of Artificial Sequence: Synthetic oligonucleotide
ttgctgatgaagccaaggcatcctttgatgtgg

SEQ ID NO: 315018 - DNA, 32 bp, Artificial Sequence
  Description of Artificial Sequence: Synthetic oligonucleotide
tgctgatgaagccaaggcatcctttgatgtgg

SEQ ID NO: 315019 - DNA, 31 bp, Artificial Sequence
  Description of Artificial Sequence: Synthetic oligonucleotide
gctgatgaagccaaggcatcctttgatgtgg

SEQ ID NO: 315020 - DNA, 32 bp, Artificial Sequence
  Description of Artificial Sequence: Synthetic oligonucleotide
ctgatgaagccaaggcatcctttgatgtggag

SEQ ID NO: 315021 - DNA, 32 bp, Artificial Sequence
  Description of Artificial Sequence: Synthetic oligonucleotide
tgatgaagccaaggcatcctttgatgtggagg

SEQ ID NO: 315022 - DNA, 31 bp, Artificial Sequence
  Description of Artificial Sequence: Synthetic oligonucleotide
gatgaagccaaggcatcctttgatgtggagg

SEQ ID NO: 315023 - DNA, 33 bp, Artificial Sequence
  Description of Artificial Sequence: Synthetic oligonucleotide
atgaagccaaggcatcctttgatgtggaggaag

SEQ ID NO: 315024 - DNA, 32 bp, Artificial Sequence
  Description of Artificial Sequence: Synthetic oligonucleotide
tgaagccaaggcatcctttgatgtggaggaag

SEQ ID NO: 315025 - DNA, 31 bp, Artificial Sequence
  Description of Artificial Sequence: Synthetic oligonucleotide
gaagccaaggcatcctttgatgtggaggaag

SEQ ID NO: 315026 - DNA, 31 bp, Artificial Sequence
  Description of Artificial Sequence: Synthetic oligonucleotide
aagccaaggcatcctttgatgtggaggaagg

SEQ ID NO: 315027 - DNA, 30 bp, Artificial Sequence
  Description of Artificial Sequence: Synthetic oligonucleotide
agccaaggcatcctttgatgtggaggaagg

SEQ ID NO: 315028 - DNA, 29 bp, Artificial Sequence
  Description of Artificial Sequence: Synthetic oligonucleotide
gccaaggcatcctttgatgtggaggaagg

SEQ ID NO: 315029 - DNA, 30 bp, Artificial Sequence
  Description of Artificial Sequence: Synthetic oligonucleotide
ccaaggcatcctttgatgtggaggaaggac

SEQ ID NO: 315030 - DNA, 30 bp, Artificial Sequence
  Description of Artificial Sequence: Synthetic oligonucleotide
caaggcatcctttgatgtggaggaaggacg

SEQ ID NO: 315031 - DNA, 30 bp, Artificial Sequence
  Description of Artificial Sequence: Synthetic oligonucleotide
aaggcatcctttgatgtggaggaaggacgg

SEQ ID NO: 315032 - DNA, 29 bp, Artificial Sequence
  Description of Artificial Sequence: Synthetic oligonucleotide
aggcatcctttgatgtggaggaaggacgg

SEQ ID NO: 315033 - DNA, 28 bp, Artificial Sequence
  Description of Artificial Sequence: Synthetic oligonucleotide
ggcatcctttgatgtggaggaaggacgg

SEQ ID NO: 315034 - DNA, 28 bp, Artificial Sequence
  Description of Artificial Sequence: Synthetic oligonucleotide
gcatcctttgatgtggaggaaggacggg

SEQ ID NO: 315035 - DNA, 30 bp, Artificial Sequence
  Description of Artificial Sequence: Synthetic oligonucleotide
catcctttgatgtggaggaaggacgggatg

SEQ ID NO: 315036 - DNA, 34 bp, Artificial Sequence
  Description of Artificial Sequence: Synthetic oligonucleotide
atcctttgatgtggaggaaggacgggatgaaaac

SEQ ID NO: 315037 - DNA, 33 bp, Artificial Sequence
  Description of Artificial Sequence: Synthetic oligonucleotide
tcctttgatgtggaggaaggacgggatgaaaac

SEQ ID NO: 315038 - DNA, 32 bp, Artificial Sequence
  Description of Artificial Sequence: Synthetic oligonucleotide
cctttgatgtggaggaaggacgggatgaaaac

SEQ ID NO: 315039 - DNA, 32 bp, Artificial Sequence
  Description of Artificial Sequence: Synthetic oligonucleotide
ctttgatgtggaggaaggacgggatgaaaacg

SEQ ID NO: 315040 - DNA, 33 bp, Artificial Sequence
  Description of Artificial Sequence: Synthetic oligonucleotide
tttgatgtggaggaaggacgggatgaaaacgac

SEQ ID NO: 315041 - DNA, 32 bp, Artificial Sequence
  Description of Artificial Sequence: Synthetic oligonucleotide
ttgatgtggaggaaggacgggatgaaaacgac

SEQ ID NO: 315042 - DNA, 31 bp, Artificial Sequence
  Description of Artificial Sequence: Synthetic oligonucleotide
tgatgtggaggaaggacgggatgaaaacgac

SEQ ID NO: 315043 - DNA, 30 bp, Artificial Sequence
  Description of Artificial Sequence: Synthetic oligonucleotide
gatgtggaggaaggacgggatgaaaacgac

SEQ ID NO: 315044 - DNA, 30 bp, Artificial Sequence
  Description of Artificial Sequence: Synthetic oligonucleotide
atgtggaggaaggacgggatgaaaacgacg

SEQ ID NO: 315045 - DNA, 29 bp, Artificial Sequence
  Description of Artificial Sequence: Synthetic oligonucleotide
tgtggaggaaggacgggatgaaaacgacg

SEQ ID NO: 315046 - DNA, 28 bp, Artificial Sequence
  Description of Artificial Sequence: Synthetic oligonucleotide
gtggaggaaggacgggatgaaaacgacg

SEQ ID NO: 315047 - DNA, 30 bp, Artificial Sequence
  Description of Artificial Sequence: Synthetic oligonucleotide
tggaggaaggacgggatgaaaacgacgaag

SEQ ID NO: 315048 - DNA, 29 bp, Artificial Sequence
  Description of Artificial Sequence: Synthetic oligonucleotide
ggaggaaggacgggatgaaaacgacgaag

SEQ ID NO: 315049 - DNA, 30 bp, Artificial Sequence
  Description of Artificial Sequence: Synthetic oligonucleotide
gaggaaggacgggatgaaaacgacgaagag

SEQ ID NO: 315050 - DNA, 30 bp, Artificial Sequence
  Description of Artificial Sequence: Synthetic oligonucleotide
aggaaggacgggatgaaaacgacgaagagg

SEQ ID NO: 315051 - DNA, 29 bp, Artificial Sequence
  Description of Artificial Sequence: Synthetic oligonucleotide
ggaaggacgggatgaaaacgacgaagagg

SEQ ID NO: 315052 - DNA, 29 bp, Artificial Sequence
  Description of Artificial Sequence: Synthetic oligonucleotide
gaaggacgggatgaaaacgacgaagaggc

SEQ ID NO: 315053 - DNA, 29 bp, Artificial Sequence
  Description of Artificial Sequence: Synthetic oligonucleotide
aaggacgggatgaaaacgacgaagaggcc

SEQ ID NO: 315054 - DNA, 28 bp, Artificial Sequence
  Description of Artificial Sequence: Synthetic oligonucleotide
aggacgggatgaaaacgacgaagaggcc

SEQ ID NO: 315055 - DNA, 27 bp, Artificial Sequence
  Description of Artificial Sequence: Synthetic oligonucleotide
ggacgggatgaaaacgacgaagaggcc

SEQ ID NO: 315056 - DNA, 29 bp, Artificial Sequence
  Description of Artificial Sequence: Synthetic oligonucleotide
gacgggatgaaaacgacgaagaggccatg

SEQ ID NO: 315057 - DNA, 29 bp, Artificial Sequence
  Description of Artificial Sequence: Synthetic oligonucleotide
acgggatgaaaacgacgaagaggccatgc

SEQ ID NO: 315058 - DNA, 28 bp, Artificial Sequence
  Description of Artificial Sequence: Synthetic oligonucleotide
cgggatgaaaacgacgaagaggccatgc

SEQ ID NO: 315059 - DNA, 28 bp, Artificial Sequence
  Description of Artificial Sequence: Synthetic oligonucleotide
gggatgaaaacgacgaagaggccatgcc

SEQ ID NO: 315060 - DNA, 29 bp, Artificial Sequence
  Description of Artificial Sequence: Synthetic oligonucleotide
ggatgaaaacgacgaagaggccatgccag

SEQ ID NO: 315061 - DNA, 30 bp, Artificial Sequence
  Description of Artificial Sequence: Synthetic oligonucleotide
gatgaaaacgacgaagaggccatgccagtg

SEQ ID NO: 315062 - DNA, 31 bp, Artificial Sequence
  Description of Artificial Sequence: Synthetic oligonucleotide
atgaaaacgacgaagaggccatgccagtgtg

SEQ ID NO: 315063 - DNA, 30 bp, Artificial Sequence
  Description of Artificial Sequence: Synthetic oligonucleotide
tgaaaacgacgaagaggccatgccagtgtg

SEQ ID NO: 315064 - DNA, 29 bp, Artificial Sequence
  Description of Artificial Sequence: Synthetic oligonucleotide
gaaaacgacgaagaggccatgccagtgtg

SEQ ID NO: 315065 - DNA, 39 bp, Artificial Sequence
  Description of Artificial Sequence: Synthetic oligonucleotide
atgggtccaatgatcaacacatgcaagaacattcttctc

SEQ ID NO: 315066 - DNA, 38 bp, Artificial Sequence
  Description of Artificial Sequence: Synthetic oligonucleotide
tgggtccaatgatcaacacatgcaagaacattcttctc

SEQ ID NO: 315067 - DNA, 37 bp, Artificial Sequence
  Description of Artificial Sequence: Synthetic oligonucleotide
gggtccaatgatcaacacatgcaagaacattcttctc

SEQ ID NO: 315068 - DNA, 37 bp, Artificial Sequence
  Description of Artificial Sequence: Synthetic oligonucleotide
ggtccaatgatcaacacatgcaagaacattcttctcg

SEQ ID NO: 315069 - DNA, 37 bp, Artificial Sequence
  Description of Artificial Sequence: Synthetic oligonucleotide
gtccaatgatcaacacatgcaagaacattcttctcgc

SEQ ID NO: 315070 - DNA, 39 bp, Artificial Sequence
  Description of Artificial Sequence: Synthetic oligonucleotide
tccaatgatcaacacatgcaagaacattcttctcgcaac

SEQ ID NO: 315071 - DNA, 38 bp, Artificial Sequence
  Description of Artificial Sequence: Synthetic oligonucleotide
ccaatgatcaacacatgcaagaacattcttctcgcaac

SEQ ID NO: 315072 - DNA, 40 bp, Artificial Sequence
  Description of Artificial Sequence: Synthetic oligonucleotide
caatgatcaacacatgcaagaacattcttctcgcaactac

SEQ ID NO: 315073 - DNA, 41 bp, Artificial Sequence
  Description of Artificial Sequence: Synthetic oligonucleotide
aatgatcaacacatgcaagaacattcttctcgcaactactg

SEQ ID NO: 315074 - DNA, 40 bp, Artificial Sequence
  Description of Artificial Sequence: Synthetic oligonucleotide
atgatcaacacatgcaagaacattcttctcgcaactactg

SEQ ID NO: 315075 - DNA, 39 bp, Artificial Sequence
  Description of Artificial Sequence: Synthetic oligonucleotide
tgatcaacacatgcaagaacattcttctcgcaactactg

SEQ ID NO: 315076 - DNA, 38 bp, Artificial Sequence
  Description of Artificial Sequence: Synthetic oligonucleotide
gatcaacacatgcaagaacattcttctcgcaactactg

SEQ ID NO: 315077 - DNA, 40 bp, Artificial Sequence
  Description of Artificial Sequence: Synthetic oligonucleotide
atcaacacatgcaagaacattcttctcgcaactactgaac

SEQ ID NO: 315078 - DNA, 39 bp, Artificial Sequence
  Description of Artificial Sequence: Synthetic oligonucleotide
tcaacacatgcaagaacattcttctcgcaactactgaac

SEQ ID NO: 315079 - DNA, 38 bp, Artificial Sequence
  Description of Artificial Sequence: Synthetic oligonucleotide
caacacatgcaagaacattcttctcgcaactactgaac

SEQ ID NO: 315080 - DNA, 38 bp, Artificial Sequence
  Description of Artificial Sequence: Synthetic oligonucleotide
aacacatgcaagaacattcttctcgcaactactgaacc

SEQ ID NO: 315081 - DNA, 37 bp, Artificial Sequence
  Description of Artificial Sequence: Synthetic oligonucleotide
acacatgcaagaacattcttctcgcaactactgaacc

SEQ ID NO: 315082 - DNA, 36 bp, Artificial Sequence
  Description of Artificial Sequence: Synthetic oligonucleotide
cacatgcaagaacattcttctcgcaactactgaacc

SEQ ID NO: 315083 - DNA, 37 bp, Artificial Sequence
  Description of Artificial Sequence: Synthetic oligonucleotide
acatgcaagaacattcttctcgcaactactgaacctc

SEQ ID NO: 315084 - DNA, 36 bp, Artificial Sequence
  Description of Artificial Sequence: Synthetic oligonucleotide
catgcaagaacattcttctcgcaactactgaacctc

SEQ ID NO: 315085 - DNA, 36 bp, Artificial Sequence
  Description of Artificial Sequence: Synthetic oligonucleotide
atgcaagaacattcttctcgcaactactgaacctcc

SEQ ID NO: 315086 - DNA, 35 bp, Artificial Sequence
  Description of Artificial Sequence: Synthetic oligonucleotide
tgcaagaacattcttctcgcaactactgaacctcc

SEQ ID NO: 315087 - DNA, 34 bp, Artificial Sequence
  Description of Artificial Sequence: Synthetic oligonucleotide
gcaagaacattcttctcgcaactactgaacctcc

SEQ ID NO: 315088 - DNA, 35 bp, Artificial Sequence
  Description of Artificial Sequence: Synthetic oligonucleotide
caagaacattcttctcgcaactactgaacctcctg

SEQ ID NO: 315089 - DNA, 35 bp, Artificial Sequence
  Description of Artificial Sequence: Synthetic oligonucleotide
aagaacattcttctcgcaactactgaacctcctgc

SEQ ID NO: 315090 - DNA, 34 bp, Artificial Sequence
  Description of Artificial Sequence: Synthetic oligonucleotide
agaacattcttctcgcaactactgaacctcctgc

SEQ ID NO: 315091 - DNA, 33 bp, Artificial Sequence
  Description of Artificial Sequence: Synthetic oligonucleotide
gaacattcttctcgcaactactgaacctcctgc

SEQ ID NO: 315092 - DNA, 35 bp, Artificial Sequence
  Description of Artificial Sequence: Synthetic oligonucleotide
aacattcttctcgcaactactgaacctcctgctac

SEQ ID NO: 315093 - DNA, 34 bp, Artificial Sequence
  Description of Artificial Sequence: Synthetic oligonucleotide
acattcttctcgcaactactgaacctcctgctac

SEQ ID NO: 315094 - DNA, 33 bp, Artificial Sequence
  Description of Artificial Sequence: Synthetic oligonucleotide
cattcttctcgcaactactgaacctcctgctac

SEQ ID NO: 315095 - DNA, 33 bp, Artificial Sequence
  Description of Artificial Sequence: Synthetic oligonucleotide
attcttctcgcaactactgaacctcctgctacg

SEQ ID NO: 315096 - DNA, 32 bp, Artificial Sequence
  Description of Artificial Sequence: Synthetic oligonucleotide
ttcttctcgcaactactgaacctcctgctacg

SEQ ID NO: 315097 - DNA, 31 bp, Artificial Sequence
  Description of Artificial Sequence: Synthetic oligonucleotide
tcttctcgcaactactgaacctcctgctacg

SEQ ID NO: 315098 - DNA, 30 bp, Artificial Sequence
  Description of Artificial Sequence: Synthetic oligonucleotide
cttctcgcaactactgaacctcctgctacg

SEQ ID NO: 315099 - DNA, 32 bp, Artificial Sequence
  Description of Artificial Sequence: Synthetic oligonucleotide
ttctcgcaactactgaacctcctgctacgatg

SEQ ID NO: 315100 - DNA, 31 bp, Artificial Sequence
  Description of Artificial Sequence: Synthetic oligonucleotide
tctcgcaactactgaacctcctgctacgatg

SEQ ID NO: 315101 - DNA, 30 bp, Artificial Sequence
  Description of Artificial Sequence: Synthetic oligonucleotide
ctcgcaactactgaacctcctgctacgatg

SEQ ID NO: 315102 - DNA, 31 bp, Artificial Sequence
  Description of Artificial Sequence: Synthetic oligonucleotide
tcgcaactactgaacctcctgctacgatgag

SEQ ID NO: 315103 - DNA, 30 bp, Artificial Sequence
  Description of Artificial Sequence: Synthetic oligonucleotide
cgcaactactgaacctcctgctacgatgag

SEQ ID NO: 315104 - DNA, 33 bp, Artificial Sequence
  Description of Artificial Sequence: Synthetic oligonucleotide
gcaactactgaacctcctgctacgatgagattc

SEQ ID NO: 315105 - DNA, 34 bp, Artificial Sequence
  Description of Artificial Sequence: Synthetic oligonucleotide
caactactgaacctcctgctacgatgagattctg

SEQ ID NO: 315106 - DNA, 34 bp, Artificial Sequence
  Description of Artificial Sequence: Synthetic oligonucleotide
aactactgaacctcctgctacgatgagattctgg

SEQ ID NO: 315107 - DNA, 33 bp, Artificial Sequence
  Description of Artificial Sequence: Synthetic oligonucleotide
actactgaacctcctgctacgatgagattctgg

SEQ ID NO: 315108 - DNA, 32 bp, Artificial Sequence
  Description of Artificial Sequence: Synthetic oligonucleotide
ctactgaacctcctgctacgatgagattctgg

SEQ ID NO: 315109 - DNA, 32 bp, Artificial Sequence
  Description of Artificial Sequence: Synthetic oligonucleotide
tactgaacctcctgctacgatgagattctggc

SEQ ID NO: 315110 - DNA, 31 bp, Artificial Sequence
  Description of Artificial Sequence: Synthetic oligonucleotide
actgaacctcctgctacgatgagattctggc

SEQ ID NO: 315111 - DNA, 30 bp, Artificial Sequence
  Description of Artificial Sequence: Synthetic oligonucleotide
ctgaacctcctgctacgatgagattctggc

SEQ ID NO: 315112 - DNA, 31 bp, Artificial Sequence
  Description of Artificial Sequence: Synthetic oligonucleotide
tgaacctcctgctacgatgagattctggctc

SEQ ID NO: 315113 - DNA, 30 bp, Artificial Sequence
  Description of Artificial Sequence: Synthetic oligonucleotide
gaacctcctgctacgatgagattctggctc

SEQ ID NO: 315114 - DNA, 30 bp, Artificial Sequence
  Description of Artificial Sequence: Synthetic oligonucleotide
aacctcctgctacgatgagattctggctcc

SEQ ID NO: 315115 - DNA, 29 bp, Artificial Sequence
  Description of Artificial Sequence: Synthetic oligonucleotide
acctcctgctacgatgagattctggctcc

SEQ ID NO: 315116 - DNA, 28 bp, Artificial Sequence
  Description of Artificial Sequence: Synthetic oligonucleotide
cctcctgctacgatgagattctggctcc

SEQ ID NO: 315117 - DNA, 30 bp, Artificial Sequence
  Description of Artificial Sequence: Synthetic oligonucleotide
ctcctgctacgatgagattctggctccatg

SEQ ID NO: 315118 - DNA, 30 bp, Artificial Sequence
  Description of Artificial Sequence: Synthetic oligonucleotide
tcctgctacgatgagattctggctccatgg

SEQ ID NO: 315119 - DNA, 29 bp, Artificial Sequence
  Description of Artificial Sequence: Synthetic oligonucleotide
cctgctacgatgagattctggctccatgg

SEQ ID NO: 315120 - DNA, 30 bp, Artificial Sequence
  Description of Artificial Sequence: Synthetic oligonucleotide
ctgctacgatgagattctggctccatggag

SEQ ID NO: 315121 - DNA, 30 bp, Artificial Sequence
  Description of Artificial Sequence: Synthetic oligonucleotide
tgctacgatgagattctggctccatggagg

SEQ ID NO: 315122 - DNA, 29 bp, Artificial Sequence
  Description of Artificial Sequence: Synthetic oligonucleotide
gctacgatgagattctggctccatggagg

SEQ ID NO: 315123 - DNA, 29 bp, Artificial Sequence
  Description of Artificial Sequence: Synthetic oligonucleotide
ctacgatgagattctggctccatggaggc

SEQ ID NO: 315124 - DNA, 29 bp, Artificial Sequence
  Description of Artificial Sequence: Synthetic oligonucleotide
tacgatgagattctggctccatggaggcc

SEQ ID NO: 315125 - DNA, 28 bp, Artificial Sequence
  Description of Artificial Sequence: Synthetic oligonucleotide
acgatgagattctggctccatggaggcc

SEQ ID NO: 315126 - DNA, 27 bp, Artificial Sequence
  Description of Artificial Sequence: Synthetic oligonucleotide
cgatgagattctggctccatggaggcc

SEQ ID NO: 315127 - DNA, 28 bp, Artificial Sequence
  Description of Artificial Sequence: Synthetic oligonucleotide
gatgagattctggctccatggaggcctc

SEQ ID NO: 315128 - DNA, 28 bp, Artificial Sequence
  Description of Artificial Sequence: Synthetic oligonucleotide
atgagattctggctccatggaggcctcc

SEQ ID NO: 315129 - DNA, 27 bp, Artificial Sequence
  Description of Artificial Sequence: Synthetic oligonucleotide
tgagattctggctccatggaggcctcc

SEQ ID NO: 315130 - DNA, 27 bp, Artificial Sequence
  Description of Artificial Sequence: Synthetic oligonucleotide
gagattctggctccatggaggcctcct

SEQ ID NO: 315131 - DNA, 27 bp, Artificial Sequence
  Description of Artificial Sequence: Synthetic oligonucleotide
agattctggctccatggaggcctcctg

SEQ ID NO: 315132 - DNA, 26 bp, Artificial Sequence
  Description of Artificial Sequence: Synthetic oligonucleotide
gattctggctccatggaggcctcctg

SEQ ID NO: 315133 - DNA, 26 bp, Artificial Sequence
  Description of Artificial Sequence: Synthetic oligonucleotide
attctggctccatggaggcctcctgc

SEQ ID NO: 315134 - DNA, 25 bp, Artificial Sequence
  Description of Artificial Sequence: Synthetic oligonucleotide
ttctggctccatggaggcctcctgc

SEQ ID NO: 315135 - DNA, 24 bp, Artificial Sequence
  Description of Artificial Sequence: Synthetic oligonucleotide
tctggctccatggaggcctcctgc

SEQ ID NO: 315136 - DNA, 23 bp, Artificial Sequence
  Description of Artificial Sequence: Synthetic oligonucleotide
ctggctccatggaggcctcctgc

SEQ ID NO: 315137 - DNA, 26 bp, Artificial Sequence
  Description of Artificial Sequence: Synthetic oligonucleotide
tggctccatggaggcctcctgccatt

SEQ ID NO: 315138 - DNA, 25 bp, Artificial Sequence
  Description of Artificial Sequence: Synthetic oligonucleotide
ggctccatggaggcctcctgccatt

SEQ ID NO: 315139 - DNA, 25 bp, Artificial Sequence
  Description of Artificial Sequence: Synthetic oligonucleotide
gctccatggaggcctcctgccattc

SEQ ID NO: 315140 - DNA, 26 bp, Artificial Sequence
  Description of Artificial Sequence: Synthetic oligonucleotide
ctccatggaggcctcctgccattcgt

SEQ ID NO: 315141 - DNA, 26 bp, Artificial Sequence
  Description of Artificial Sequence: Synthetic oligonucleotide
tccatggaggcctcctgccattcgtg

SEQ ID NO: 315142 - DNA, 25 bp, Artificial Sequence
  Description of Artificial Sequence: Synthetic oligonucleotide
ccatggaggcctcctgccattcgtg

SEQ ID NO: 315143 - DNA, 26 bp, Artificial Sequence
  Description of Artificial Sequence: Synthetic oligonucleotide
catggaggcctcctgccattcgtgct

SEQ ID NO: 315144 - DNA, 26 bp, Artificial Sequence
  Description of Artificial Sequence: Synthetic oligonucleotide
atggaggcctcctgccattcgtgctg

SEQ ID NO: 315145 - DNA, 25 bp, Artificial Sequence
  Description of Artificial Sequence: Synthetic oligonucleotide
tggaggcctcctgccattcgtgctg

SEQ ID NO: 315146 - DNA, 24 bp, Artificial Sequence
  Description of Artificial Sequence: Synthetic oligonucleotide
ggaggcctcctgccattcgtgctg

SEQ ID NO: 315147 - DNA, 25 bp, Artificial Sequence
  Description of Artificial Sequence: Synthetic oligonucleotide
gaggcctcctgccattcgtgctgct

SEQ ID NO: 315148 - DNA, 25 bp, Artificial Sequence
  Description of Artificial Sequence: Synthetic oligonucleotide
aggcctcctgccattcgtgctgctc

SEQ ID NO: 315149 - DNA, 24 bp, Artificial Sequence
  Description of Artificial Sequence: Synthetic oligonucleotide
ggcctcctgccattcgtgctgctc

SEQ ID NO: 315150 - DNA, 25 bp, Artificial Sequence
  Description of Artificial Sequence: Synthetic oligonucleotide
gcctcctgccattcgtgctgctcca

SEQ ID NO: 315151 - DNA, 26 bp, Artificial Sequence
  Description of Artificial Sequence: Synthetic oligonucleotide
cctcctgccattcgtgctgctccact

SEQ ID NO: 315152 - DNA, 27 bp, Artificial Sequence
  Description of Artificial Sequence: Synthetic oligonucleotide
ctcctgccattcgtgctgctccactct

SEQ ID NO: 315153 - DNA, 27 bp, Artificial Sequence
  Description of Artificial Sequence: Synthetic oligonucleotide
tcctgccattcgtgctgctccactctg

SEQ ID NO: 315154 - DNA, 26 bp, Artificial Sequence
  Description of Artificial Sequence: Synthetic oligonucleotide
cctgccattcgtgctgctccactctg

SEQ ID NO: 315155 - DNA, 26 bp, Artificial Sequence
  Description of Artificial Sequence: Synthetic oligonucleotide
ctgccattcgtgctgctccactctgg

SEQ ID NO: 315156 - DNA, 26 bp, Artificial Sequence
  Description of Artificial Sequence: Synthetic oligonucleotide
tgccattcgtgctgctccactctggc

SEQ ID NO: 315157 - DNA, 25 bp, Artificial Sequence
  Description of Artificial Sequence: Synthetic oligonucleotide
gccattcgtgctgctccactctggc

SEQ ID NO: 315158 - DNA, 26 bp, Artificial Sequence
  Description of Artificial Sequence: Synthetic oligonucleotide
ccattcgtgctgctccactctggcct

SEQ ID NO: 315159 - DNA, 26 bp, Artificial Sequence
  Description of Artificial Sequence: Synthetic oligonucleotide
cattcgtgctgctccactctggcctc

SEQ ID NO: 315160 - DNA, 27 bp, Artificial Sequence
  Description of Artificial Sequence: Synthetic oligonucleotide
attcgtgctgctccactctggcctcca

SEQ ID NO: 315161 - DNA, 26 bp, Artificial Sequence
  Description of Artificial Sequence: Synthetic oligonucleotide
ttcgtgctgctccactctggcctcca

SEQ ID NO: 315162 - DNA, 25 bp, Artificial Sequence
  Description of Artificial Sequence: Synthetic oligonucleotide
tcgtgctgctccactctggcctcca

SEQ ID NO: 315163 - DNA, 24 bp, Artificial Sequence
  Description of Artificial Sequence: Synthetic oligonucleotide
cgtgctgctccactctggcctcca

SEQ ID NO: 315164 - DNA, 25 bp, Artificial Sequence
  Description of Artificial Sequence: Synthetic oligonucleotide
gtgctgctccactctggcctccaga

SEQ ID NO: 315165 - DNA, 26 bp, Artificial Sequence
  Description of Artificial Sequence: Synthetic oligonucleotide
tgctgctccactctggcctccagaga

SEQ ID NO: 315166 - DNA, 25 bp, Artificial Sequence
  Description of Artificial Sequence: Synthetic oligonucleotide
gctgctccactctggcctccagaga

SEQ ID NO: 315167 - DNA, 25 bp, Artificial Sequence
  Description of Artificial Sequence: Synthetic oligonucleotide
ctgctccactctggcctccagagac

SEQ ID NO: 315168 - DNA, 25 bp, Artificial Sequence
  Description of Artificial Sequence: Synthetic oligonucleotide
tgctccactctggcctccagagacc

SEQ ID NO: 315169 - DNA, 24 bp, Artificial Sequence
  Description of Artificial Sequence: Synthetic oligonucleotide
gctccactctggcctccagagacc

SEQ ID NO: 315170 - DNA, 25 bp, Artificial Sequence
  Description of Artificial Sequence: Synthetic oligonucleotide
ctccactctggcctccagagaccct

SEQ ID NO: 315171 - DNA, 26 bp, Artificial Sequence
  Description of Artificial Sequence: Synthetic oligonucleotide
tccactctggcctccagagaccctca

SEQ ID NO: 315172 - DNA, 25 bp, Artificial Sequence
  Description of Artificial Sequence: Synthetic oligonucleotide
ccactctggcctccagagaccctca

SEQ ID NO: 315173 - DNA, 26 bp, Artificial Sequence
  Description of Artificial Sequence: Synthetic oligonucleotide
cactctggcctccagagaccctcaga

SEQ ID NO: 315174 - DNA, 26 bp, Artificial Sequence
  Description of Artificial Sequence: Synthetic oligonucleotide
actctggcctccagagaccctcagag

SEQ ID NO: 315175 - DNA, 25 bp, Artificial Sequence
  Description of Artificial Sequence: Synthetic oligonucleotide
ctctggcctccagagaccctcagag

SEQ ID NO: 315176 - DNA, 25 bp, Artificial Sequence
  Description of Artificial Sequence: Synthetic oligonucleotide
tctggcctccagagaccctcagagg

SEQ ID NO: 315177 - DNA, 24 bp, Artificial Sequence
  Description of Artificial Sequence: Synthetic oligonucleotide
ctggcctccagagaccctcagagg

SEQ ID NO: 315178 - DNA, 26 bp, Artificial Sequence
  Description of Artificial Sequence: Synthetic oligonucleotide
tggcctccagagaccctcagagggtt

SEQ ID NO: 315179 - DNA, 25 bp, Artificial Sequence
  Description of Artificial Sequence: Synthetic oligonucleotide
ggcctccagagaccctcagagggtt

SEQ ID NO: 315180 - DNA, 26 bp, Artificial Sequence
  Description of Artificial Sequence: Synthetic oligonucleotide
gcctccagagaccctcagagggttgt

SEQ ID NO: 315181 - DNA, 27 bp, Artificial Sequence
  Description of Artificial Sequence: Synthetic oligonucleotide
cctccagagaccctcagagggttgtga

SEQ ID NO: 315182 - DNA, 27 bp, Artificial Sequence
  Description of Artificial Sequence: Synthetic oligonucleotide
ctccagagaccctcagagggttgtgag

SEQ ID NO: 315183 - DNA, 27 bp, Artificial Sequence
  Description of Artificial Sequence: Synthetic oligonucleotide
tccagagaccctcagagggttgtgagg

SEQ ID NO: 315184 - DNA, 27 bp, Artificial Sequence
  Description of Artificial Sequence: Synthetic oligonucleotide
ccagagaccctcagagggttgtgaggt

SEQ ID NO: 315185 - DNA, 28 bp, Artificial Sequence
  Description of Artificial Sequence: Synthetic oligonucleotide
cagagaccctcagagggttgtgaggttg

SEQ ID NO: 315186 - DNA, 28 bp, Artificial Sequence
  Description of Artificial Sequence: Synthetic oligonucleotide
agagaccctcagagggttgtgaggttgc

SEQ ID NO: 315187 - DNA, 27 bp, Artificial Sequence
  Description of Artificial Sequence: Synthetic oligonucleotide
gagaccctcagagggttgtgaggttgc

SEQ ID NO: 315188 - DNA, 36 bp, Artificial Sequence
  Description of Artificial Sequence: Synthetic oligonucleotide
agaccctcagagggttgtgaggttgctattaaaatc

SEQ ID NO: 315189 - DNA, 35 bp, Artificial Sequence
  Description of Artificial Sequence: Synthetic oligonucleotide
gaccctcagagggttgtgaggttgctattaaaatc

SEQ ID NO: 315190 - DNA, 35 bp, Artificial Sequence
  Description of Artificial Sequence: Synthetic oligonucleotide
accctcagagggttgtgaggttgctattaaaatcc

SEQ ID NO: 315191 - DNA, 34 bp, Artificial Sequence
  Description of Artificial Sequence: Synthetic oligonucleotide
ccctcagagggttgtgaggttgctattaaaatcc

SEQ ID NO: 315192 - DNA, 35 bp, Artificial Sequence
  Description of Artificial Sequence: Synthetic oligonucleotide
cctcagagggttgtgaggttgctattaaaatccac

SEQ ID NO: 315193 - DNA, 37 bp, Artificial Sequence
  Description of Artificial Sequence: Synthetic oligonucleotide
ctcagagggttgtgaggttgctattaaaatccacttc

SEQ ID NO: 315194 - DNA, 37 bp, Artificial Sequence
  Description of Artificial Sequence: Synthetic oligonucleotide
tcagagggttgtgaggttgctattaaaatccacttcg

SEQ ID NO: 315195 - DNA, 36 bp, Artificial Sequence
  Description of Artificial Sequence: Synthetic oligonucleotide
cagagggttgtgaggttgctattaaaatccacttcg

SEQ ID NO: 315196 - DNA, 37 bp, Artificial Sequence
  Description of Artificial Sequence: Synthetic oligonucleotide
agagggttgtgaggttgctattaaaatccacttcgac

SEQ ID NO: 315197 - DNA, 36 bp, Artificial Sequence
  Description of Artificial Sequence: Synthetic oligonucleotide
gagggttgtgaggttgctattaaaatccacttcgac

SEQ ID NO: 315198 - DNA, 38 bp, Artificial Sequence
  Description of Artificial Sequence: Synthetic oligonucleotide
agggttgtgaggttgctattaaaatccacttcgactac

SEQ ID NO: 315199 - DNA, 37 bp, Artificial Sequence
  Description of Artificial Sequence: Synthetic oligonucleotide
gggttgtgaggttgctattaaaatccacttcgactac

SEQ ID NO: 315200 - DNA, 37 bp, Artificial Sequence
  Description of Artificial Sequence: Synthetic oligonucleotide
ggttgtgaggttgctattaaaatccacttcgactacg

SEQ ID NO: 315201 - DNA, 37 bp, Artificial Sequence
  Description of Artificial Sequence: Synthetic oligonucleotide
gttgtgaggttgctattaaaatccacttcgactacgc

SEQ ID NO: 315202 - DNA, 38 bp, Artificial Sequence
  Description of Artificial Sequence: Synthetic oligonucleotide
ttgtgaggttgctattaaaatccacttcgactacgcac

SEQ ID NO: 315203 - DNA, 37 bp, Artificial Sequence
  Description of Artificial Sequence: Synthetic oligonucleotide
tgtgaggttgctattaaaatccacttcgactacgcac

SEQ ID NO: 315204 - DNA, 36 bp, Artificial Sequence
  Description of Artificial Sequence: Synthetic oligonucleotide
gtgaggttgctattaaaatccacttcgactacgcac

SEQ ID NO: 315205 - DNA, 36 bp, Artificial Sequence
  Description of Artificial Sequence: Synthetic oligonucleotide
tgaggttgctattaaaatccacttcgactacgcacc

SEQ ID NO: 315206 - DNA, 35 bp, Artificial Sequence
  Description of Artificial Sequence: Synthetic oligonucleotide
gaggttgctattaaaatccacttcgactacgcacc

SEQ ID NO: 315207 - DNA, 36 bp, Artificial Sequence
  Description of Artificial Sequence: Synthetic oligonucleotide
aggttgctattaaaatccacttcgactacgcaccag

SEQ ID NO: 315208 - DNA, 35 bp, Artificial Sequence
  Description of Artificial Sequence: Synthetic oligonucleotide
ggttgctattaaaatccacttcgactacgcaccag

SEQ ID NO: 315209 - DNA, 35 bp, Artificial Sequence
  Description of Artificial Sequence: Synthetic oligonucleotide
gttgctattaaaatccacttcgactacgcaccagg

SEQ ID NO: 315210 - DNA, 37 bp, Artificial Sequence
  Description of Artificial Sequence: Synthetic oligonucleotide
ttgctattaaaatccacttcgactacgcaccaggatc

SEQ ID NO: 315211 - DNA, 36 bp, Artificial Sequence
  Description of Artificial Sequence: Synthetic oligonucleotide
tgctattaaaatccacttcgactacgcaccaggatc

SEQ ID NO: 315212 - DNA, 35 bp, Artificial Sequence
  Description of Artificial Sequence: Synthetic oligonucleotide
gctattaaaatccacttcgactacgcaccaggatc

SEQ ID NO: 315213 - DNA, 39 bp, Artificial Sequence
  Description of Artificial Sequence: Synthetic oligonucleotide
ctattaaaatccacttcgactacgcaccaggatcttttg

SEQ ID NO: 315214 - DNA, 41 bp, Artificial Sequence
  Description of Artificial Sequence: Synthetic oligonucleotide
tattaaaatccacttcgactacgcaccaggatcttttgatc

SEQ ID NO: 315215 - DNA, 40 bp, Artificial Sequence
  Description of Artificial Sequence: Synthetic oligonucleotide
attaaaatccacttcgactacgcaccaggatcttttgatc

SEQ ID NO: 315216 - DNA, 39 bp, Artificial Sequence
  Description of Artificial Sequence: Synthetic oligonucleotide
ttaaaatccacttcgactacgcaccaggatcttttgatc

SEQ ID NO: 315217 - DNA, 38 bp, Artificial Sequence
  Description of Artificial Sequence: Synthetic oligonucleotide
taaaatccacttcgactacgcaccaggatcttttgatc

SEQ ID NO: 315218 - DNA, 37 bp, Artificial Sequence
  Description of Artificial Sequence: Synthetic oligonucleotide
aaaatccacttcgactacgcaccaggatcttttgatc

SEQ ID NO: 315219 - DNA, 36 bp, Artificial Sequence
  Description of Artificial Sequence: Synthetic oligonucleotide
aaatccacttcgactacgcaccaggatcttttgatc

SEQ ID NO: 315220 - DNA, 35 bp, Artificial Sequence
  Description of Artificial Sequence: Synthetic oligonucleotide
aatccacttcgactacgcaccaggatcttttgatc

SEQ ID NO: 315221 - DNA, 34 bp, Artificial Sequence
  Description of Artificial Sequence: Synthetic oligonucleotide
atccacttcgactacgcaccaggatcttttgatc

SEQ ID NO: 315222 - DNA, 33 bp, Artificial Sequence
  Description of Artificial Sequence: Synthetic oligonucleotide
tccacttcgactacgcaccaggatcttttgatc

SEQ ID NO: 315223 - DNA, 32 bp, Artificial Sequence
  Description of Artificial Sequence: Synthetic oligonucleotide
ccacttcgactacgcaccaggatcttttgatc

SEQ ID NO: 315224 - DNA, 34 bp, Artificial Sequence
  Description of Artificial Sequence: Synthetic oligonucleotide
cacttcgactacgcaccaggatcttttgatcatc

SEQ ID NO: 315225 - DNA, 35 bp, Artificial Sequence
  Description of Artificial Sequence: Synthetic oligonucleotide
acttcgactacgcaccaggatcttttgatcatcag

SEQ ID NO: 315226 - DNA, 34 bp, Artificial Sequence
  Description of Artificial Sequence: Synthetic oligonucleotide
cttcgactacgcaccaggatcttttgatcatcag

SEQ ID NO: 315227 - DNA, 36 bp, Artificial Sequence
  Description of Artificial Sequence: Synthetic oligonucleotide
ttcgactacgcaccaggatcttttgatcatcagtac

SEQ ID NO: 315228 - DNA, 35 bp, Artificial Sequence
  Description of Artificial Sequence: Synthetic oligonucleotide
tcgactacgcaccaggatcttttgatcatcagtac

SEQ ID NO: 315229 - DNA, 34 bp, Artificial Sequence
  Description of Artificial Sequence: Synthetic oligonucleotide
cgactacgcaccaggatcttttgatcatcagtac

SEQ ID NO: 315230 - DNA, 34 bp, Artificial Sequence
  Description of Artificial Sequence: Synthetic oligonucleotide
gactacgcaccaggatcttttgatcatcagtacc

SEQ ID NO: 315231 - DNA, 36 bp, Artificial Sequence
  Description of Artificial Sequence: Synthetic oligonucleotide
actacgcaccaggatcttttgatcatcagtacctag

SEQ ID NO: 315232 - DNA, 35 bp, Artificial Sequence
  Description of Artificial Sequence: Synthetic oligonucleotide
ctacgcaccaggatcttttgatcatcagtacctag

SEQ ID NO: 315233 - DNA, 35 bp, Artificial Sequence
  Description of Artificial Sequence: Synthetic oligonucleotide
tacgcaccaggatcttttgatcatcagtacctagg

SEQ ID NO: 315234 - DNA, 34 bp, Artificial Sequence
  Description of Artificial Sequence: Synthetic oligonucleotide
acgcaccaggatcttttgatcatcagtacctagg

SEQ ID NO: 315235 - DNA, 33 bp, Artificial Sequence
  Description of Artificial Sequence: Synthetic oligonucleotide
cgcaccaggatcttttgatcatcagtacctagg

SEQ ID NO: 315236 - DNA, 33 bp, Artificial Sequence
  Description of Artificial Sequence: Synthetic oligonucleotide
gcaccaggatcttttgatcatcagtacctaggc

SEQ ID NO: 315237 - DNA, 34 bp, Artificial Sequence
  Description of Artificial Sequence: Synthetic oligonucleotide
caccaggatcttttgatcatcagtacctaggctg

SEQ ID NO: 315238 - DNA, 36 bp, Artificial Sequence
  Description of Artificial Sequence: Synthetic oligonucleotide
accaggatcttttgatcatcagtacctaggctgtag

SEQ ID NO: 315239 - DNA, 35 bp, Artificial Sequence
  Description of Artificial Sequence: Synthetic oligonucleotide
ccaggatcttttgatcatcagtacctaggctgtag

SEQ ID NO: 315240 - DNA, 35 bp, Artificial Sequence
  Description of Artificial Sequence: Synthetic oligonucleotide
caggatcttttgatcatcagtacctaggctgtagg

SEQ ID NO: 315241 - DNA, 38 bp, Artificial Sequence
  Description of Artificial Sequence: Synthetic oligonucleotide
aggatcttttgatcatcagtacctaggctgtaggaaac

SEQ ID NO: 315242 - DNA, 37 bp, Artificial Sequence
  Description of Artificial Sequence: Synthetic oligonucleotide
ggatcttttgatcatcagtacctaggctgtaggaaac

SEQ ID NO: 315243 - DNA, 38 bp, Artificial Sequence
  Description of Artificial Sequence: Synthetic oligonucleotide
gatcttttgatcatcagtacctaggctgtaggaaacag

SEQ ID NO: 315244 - DNA, 38 bp, Artificial Sequence
  Description of Artificial Sequence: Synthetic oligonucleotide
atcttttgatcatcagtacctaggctgtaggaaacagg

SEQ ID NO: 315245 - DNA, 37 bp, Artificial Sequence
  Description of Artificial Sequence: Synthetic oligonucleotide
tcttttgatcatcagtacctaggctgtaggaaacagg

SEQ ID NO: 315246 - DNA, 36 bp, Artificial Sequence
  Description of Artificial Sequence: Synthetic oligonucleotide
cttttgatcatcagtacctaggctgtaggaaacagg

SEQ ID NO: 315247 - DNA, 40 bp, Artificial Sequence
  Description of Artificial Sequence: Synthetic oligonucleotide
ttttgatcatcagtacctaggctgtaggaaacaggttttg

SEQ ID NO: 315248 - DNA, 39 bp, Artificial Sequence
  Description of Artificial Sequence: Synthetic oligonucleotide
tttgatcatcagtacctaggctgtaggaaacaggttttg

SEQ ID NO: 315249 - DNA, 38 bp, Artificial Sequence
  Description of Artificial Sequence: Synthetic oligonucleotide
ttgatcatcagtacctaggctgtaggaaacaggttttg

SEQ ID NO: 315250 - DNA, 37 bp, Artificial Sequence
  Description of Artificial Sequence: Synthetic oligonucleotide
tgatcatcagtacctaggctgtaggaaacaggttttg

SEQ ID NO: 315251 - DNA, 36 bp, Artificial Sequence
  Description of Artificial Sequence: Synthetic oligonucleotide
gatcatcagtacctaggctgtaggaaacaggttttg

SEQ ID NO: 315252 - DNA, 36 bp, Artificial Sequence
  Description of Artificial Sequence: Synthetic oligonucleotide
atcatcagtacctaggctgtaggaaacaggttttgg

SEQ ID NO: 315253 - DNA, 35 bp, Artificial Sequence
  Description of Artificial Sequence: Synthetic oligonucleotide
tcatcagtacctaggctgtaggaaacaggttttgg

SEQ ID NO: 315254 - DNA, 34 bp, Artificial Sequence
  Description of Artificial Sequence: Synthetic oligonucleotide
catcagtacctaggctgtaggaaacaggttttgg

SEQ ID NO: 315255 - DNA, 35 bp, Artificial Sequence
  Description of Artificial Sequence: Synthetic oligonucleotide
atcagtacctaggctgtaggaaacaggttttggag

SEQ ID NO: 315256 - DNA, 34 bp, Artificial Sequence
  Description of Artificial Sequence: Synthetic oligonucleotide
tcagtacctaggctgtaggaaacaggttttggag

SEQ ID NO: 315257 - DNA, 33 bp, Artificial Sequence
  Description of Artificial Sequence: Synthetic oligonucleotide
cagtacctaggctgtaggaaacaggttttggag

SEQ ID NO: 315258 - DNA, 36 bp, Artificial Sequence
  Description of Artificial Sequence: Synthetic oligonucleotide
agtacctaggctgtaggaaacaggttttggagaaac

SEQ ID NO: 315259 - DNA, 35 bp, Artificial Sequence
  Description of Artificial Sequence: Synthetic oligonucleotide
gtacctaggctgtaggaaacaggttttggagaaac

SEQ ID NO: 315260 - DNA, 38 bp, Artificial Sequence
  Description of Artificial Sequence: Synthetic oligonucleotide
tacctaggctgtaggaaacaggttttggagaaacaaac

SEQ ID NO: 315261 - DNA, 37 bp, Artificial Sequence
  Description of Artificial Sequence: Synthetic oligonucleotide
acctaggctgtaggaaacaggttttggagaaacaaac

SEQ ID NO: 315262 - DNA, 36 bp, Artificial Sequence
  Description of Artificial Sequence: Synthetic oligonucleotide
cctaggctgtaggaaacaggttttggagaaacaaac

SEQ ID NO: 315263 - DNA, 37 bp, Artificial Sequence
  Description of Artificial Sequence: Synthetic oligonucleotide
ctaggctgtaggaaacaggttttggagaaacaaactc

SEQ ID NO: 315264 - DNA, 39 bp, Artificial Sequence
  Description of Artificial Sequence: Synthetic oligonucleotide
taggctgtaggaaacaggttttggagaaacaaactcaag

SEQ ID NO: 315265 - DNA, 38 bp, Artificial Sequence
  Description of Artificial Sequence: Synthetic oligonucleotide
aggctgtaggaaacaggttttggagaaacaaactcaag

SEQ ID NO: 315266 - DNA, 37 bp, Artificial Sequence
  Description of Artificial Sequence: Synthetic oligonucleotide
ggctgtaggaaacaggttttggagaaacaaactcaag

SEQ ID NO: 315267 - DNA, 37 bp, Artificial Sequence
  Description of Artificial Sequence: Synthetic oligonucleotide
gctgtaggaaacaggttttggagaaacaaactcaagg

SEQ ID NO: 315268 - DNA, 37 bp, Artificial Sequence
  Description of Artificial Sequence: Synthetic oligonucleotide
ctgtaggaaacaggttttggagaaacaaactcaaggc

SEQ ID NO: 315269 - DNA, 37 bp, Artificial Sequence
  Description of Artificial Sequence: Synthetic oligonucleotide
tgtaggaaacaggttttggagaaacaaactcaaggcg

SEQ ID NO: 315270 - DNA, 36 bp, Artificial Sequence
  Description of Artificial Sequence: Synthetic oligonucleotide
gtaggaaacaggttttggagaaacaaactcaaggcg

SEQ ID NO: 315271 - DNA, 43 bp, Artificial Sequence
  Description of Artificial Sequence: Synthetic oligonucleotide
taggaaacaggttttggagaaacaaactcaaggcgattatttc

SEQ ID NO: 315272 - DNA, 42 bp, Artificial Sequence
  Description of Artificial Sequence: Synthetic oligonucleotide
aggaaacaggttttggagaaacaaactcaaggcgattatttc

SEQ ID NO: 315273 - DNA, 41 bp, Artificial Sequence
  Description of Artificial Sequence: Synthetic oligonucleotide
ggaaacaggttttggagaaacaaactcaaggcgattatttc

SEQ ID NO: 315274 - DNA, 42 bp, Artificial Sequence
  Description of Artificial Sequence: Synthetic oligonucleotide
gaaacaggttttggagaaacaaactcaaggcgattatttctc

SEQ ID NO: 315275 - DNA, 46 bp, Artificial Sequence
  Description of Artificial Sequence: Synthetic oligonucleotide
aaacaggttttggagaaacaaactcaaggcgattatttctcaaaag

SEQ ID NO: 315276 - DNA, 45 bp, Artificial Sequence
  Description of Artificial Sequence: Synthetic oligonucleotide
aacaggttttggagaaacaaactcaaggcgattatttctcaaaag

SEQ ID NO: 315277 - DNA, 44 bp, Artificial Sequence
  Description of Artificial Sequence: Synthetic oligonucleotide
acaggttttggagaaacaaactcaaggcgattatttctcaaaag

SEQ ID NO: 315278 - DNA, 43 bp, Artificial Sequence
  Description of Artificial Sequence: Synthetic oligonucleotide
caggttttggagaaacaaactcaaggcgattatttctcaaaag

SEQ ID NO: 315279 - DNA, 44 bp, Artificial Sequence
  Description of Artificial Sequence: Synthetic oligonucleotide
aggttttggagaaacaaactcaaggcgattatttctcaaaagac

SEQ ID NO: 315280 - DNA, 43 bp, Artificial Sequence
  Description of Artificial Sequence: Synthetic oligonucleotide
ggttttggagaaacaaactcaaggcgattatttctcaaaagac

SEQ ID NO: 315281 - DNA, 46 bp, Artificial Sequence
  Description of Artificial Sequence: Synthetic oligonucleotide
gttttggagaaacaaactcaaggcgattatttctcaaaagacaaag

SEQ ID NO: 315282 - DNA, 48 bp, Artificial Sequence
  Description of Artificial Sequence: Synthetic oligonucleotide
ttttggagaaacaaactcaaggcgattatttctcaaaagacaaagaag

SEQ ID NO: 315283 - DNA, 47 bp, Artificial Sequence
  Description of Artificial Sequence: Synthetic oligonucleotide
tttggagaaacaaactcaaggcgattatttctcaaaagacaaagaag

SEQ ID NO: 315284 - DNA, 46 bp, Artificial Sequence
  Description of Artificial Sequence: Synthetic oligonucleotide
ttggagaaacaaactcaaggcgattatttctcaaaagacaaagaag

SEQ ID NO: 315285 - DNA, 45 bp, Artificial Sequence
  Description of Artificial Sequence: Synthetic oligonucleotide
tggagaaacaaactcaaggcgattatttctcaaaagacaaagaag

SEQ ID NO: 315286 - DNA, 44 bp, Artificial Sequence
  Description of Artificial Sequence: Synthetic oligonucleotide
ggagaaacaaactcaaggcgattatttctcaaaagacaaagaag

SEQ ID NO: 315287 - DNA, 44 bp, Artificial Sequence
  Description of Artificial Sequence: Synthetic oligonucleotide
gagaaacaaactcaaggcgattatttctcaaaagacaaagaagc

SEQ ID NO: 315288 - DNA, 44 bp, Artificial Sequence
  Description of Artificial Sequence: Synthetic oligonucleotide
agaaacaaactcaaggcgattatttctcaaaagacaaagaagcc

SEQ ID NO: 315289 - DNA, 43 bp, Artificial Sequence
  Description of Artificial Sequence: Synthetic oligonucleotide
gaaacaaactcaaggcgattatttctcaaaagacaaagaagcc

SEQ ID NO: 315290 - DNA, 43 bp, Artificial Sequence
  Description of Artificial Sequence: Synthetic oligonucleotide
aaacaaactcaaggcgattatttctcaaaagacaaagaagccc

SEQ ID NO: 315291 - DNA, 42 bp, Artificial Sequence
  Description of Artificial Sequence: Synthetic oligonucleotide
aacaaactcaaggcgattatttctcaaaagacaaagaagccc

SEQ ID NO: 315292 - DNA, 41 bp, Artificial Sequence
  Description of Artificial Sequence: Synthetic oligonucleotide
acaaactcaaggcgattatttctcaaaagacaaagaagccc

SEQ ID NO: 315293 - DNA, 40 bp, Artificial Sequence
  Description of Artificial Sequence: Synthetic oligonucleotide
caaactcaaggcgattatttctcaaaagacaaagaagccc

SEQ ID NO: 315294 - DNA, 41 bp, Artificial Sequence
  Description of Artificial Sequence: Synthetic oligonucleotide
aaactcaaggcgattatttctcaaaagacaaagaagcccac

SEQ ID NO: 315295 - DNA, 40 bp, Artificial Sequence
  Description of Artificial Sequence: Synthetic oligonucleotide
aactcaaggcgattatttctcaaaagacaaagaagcccac

SEQ ID NO: 315296 - DNA, 39 bp, Artificial Sequence
  Description of Artificial Sequence: Synthetic oligonucleotide
actcaaggcgattatttctcaaaagacaaagaagcccac

SEQ ID NO: 315297 - DNA, 38 bp, Artificial Sequence
  Description of Artificial Sequence: Synthetic oligonucleotide
ctcaaggcgattatttctcaaaagacaaagaagcccac

SEQ ID NO: 315298 - DNA, 40 bp, Artificial Sequence
  Description of Artificial Sequence: Synthetic oligonucleotide
tcaaggcgattatttctcaaaagacaaagaagcccacaag

SEQ ID NO: 315299 - DNA, 39 bp, Artificial Sequence
  Description of Artificial Sequence: Synthetic oligonucleotide
caaggcgattatttctcaaaagacaaagaagcccacaag

SEQ ID NO: 315300 - DNA, 49 bp, Artificial Sequence
  Description of Artificial Sequence: Synthetic oligonucleotide
aaggcgattatttctcaaaagacaaagaagcccacaagaattatattag

SEQ ID NO: 315301 - DNA, 48 bp, Artificial Sequence
  Description of Artificial Sequence: Synthetic oligonucleotide
aggcgattatttctcaaaagacaaagaagcccacaagaattatattag

SEQ ID NO: 315302 - DNA, 47 bp, Artificial Sequence
  Description of Artificial Sequence: Synthetic oligonucleotide
ggcgattatttctcaaaagacaaagaagcccacaagaattatattag

SEQ ID NO: 315303 - DNA, 47 bp, Artificial Sequence
  Description of Artificial Sequence: Synthetic oligonucleotide
gcgattatttctcaaaagacaaagaagcccacaagaattatattagg

SEQ ID NO: 315304 - DNA, 49 bp, Artificial Sequence
  Description of Artificial Sequence: Synthetic oligonucleotide
cgattatttctcaaaagacaaagaagcccacaagaattatattaggatg

SEQ ID NO: 315305 - DNA, 50 bp, Artificial Sequence
  Description of Artificial Sequence: Synthetic oligonucleotide
gattatttctcaaaagacaaagaagcccacaagaattatattaggatgtc

SEQ ID NO: 315306 - DNA, 50 bp, Artificial Sequence
  Description of Artificial Sequence: Synthetic oligonucleotide
attatttctcaaaagacaaagaagcccacaagaattatattaggatgtcg

SEQ ID NO: 315307 - DNA, 49 bp, Artificial Sequence
  Description of Artificial Sequence: Synthetic oligonucleotide
ttatttctcaaaagacaaagaagcccacaagaattatattaggatgtcg

SEQ ID NO: 315308 - DNA, 48 bp, Artificial Sequence
  Description of Artificial Sequence: Synthetic oligonucleotide
tatttctcaaaagacaaagaagcccacaagaattatattaggatgtcg

SEQ ID NO: 315309 - DNA, 47 bp, Artificial Sequence
  Description of Artificial Sequence: Synthetic oligonucleotide
atttctcaaaagacaaagaagcccacaagaattatattaggatgtcg

SEQ ID NO: 315310 - DNA, 46 bp, Artificial Sequence
  Description of Artificial Sequence: Synthetic oligonucleotide
tttctcaaaagacaaagaagcccacaagaattatattaggatgtcg

SEQ ID NO: 315311 - DNA, 45 bp, Artificial Sequence
  Description of Artificial Sequence: Synthetic oligonucleotide
ttctcaaaagacaaagaagcccacaagaattatattaggatgtcg

SEQ ID NO: 315312 - DNA, 44 bp, Artificial Sequence
  Description of Artificial Sequence: Synthetic oligonucleotide
tctcaaaagacaaagaagcccacaagaattatattaggatgtcg

SEQ ID NO: 315313 - DNA, 43 bp, Artificial Sequence
  Description of Artificial Sequence: Synthetic oligonucleotide
ctcaaaagacaaagaagcccacaagaattatattaggatgtcg

SEQ ID NO: 315314 - DNA, 43 bp, Artificial Sequence
  Description of Artificial Sequence: Synthetic oligonucleotide
tcaaaagacaaagaagcccacaagaattatattaggatgtcgc

SEQ ID NO: 315315 - DNA, 42 bp, Artificial Sequence
  Description of Artificial Sequence: Synthetic oligonucleotide
caaaagacaaagaagcccacaagaattatattaggatgtcgc

SEQ ID NO: 315316 - DNA, 47 bp, Artificial Sequence
  Description of Artificial Sequence: Synthetic oligonucleotide
aaaagacaaagaagcccacaagaattatattaggatgtcgcaaaaag

SEQ ID NO: 315317 - DNA, 46 bp, Artificial Sequence
  Description of Artificial Sequence: Synthetic oligonucleotide
aaagacaaagaagcccacaagaattatattaggatgtcgcaaaaag

SEQ ID NO: 315318 - DNA, 45 bp, Artificial Sequence
  Description of Artificial Sequence: Synthetic oligonucleotide
aagacaaagaagcccacaagaattatattaggatgtcgcaaaaag

SEQ ID NO: 315319 - DNA, 44 bp, Artificial Sequence
  Description of Artificial Sequence: Synthetic oligonucleotide
agacaaagaagcccacaagaattatattaggatgtcgcaaaaag

SEQ ID NO: 315320 - DNA, 43 bp, Artificial Sequence
  Description of Artificial Sequence: Synthetic oligonucleotide
gacaaagaagcccacaagaattatattaggatgtcgcaaaaag

SEQ ID NO: 315321 - DNA, 43 bp, Artificial Sequence
  Description of Artificial Sequence: Synthetic oligonucleotide
acaaagaagcccacaagaattatattaggatgtcgcaaaaagc

SEQ ID NO: 315322 - DNA, 42 bp, Artificial Sequence
  Description of Artificial Sequence: Synthetic oligonucleotide
caaagaagcccacaagaattatattaggatgtcgcaaaaagc

SEQ ID NO: 315323 - DNA, 42 bp, Artificial Sequence
  Description of Artificial Sequence: Synthetic oligonucleotide
aaagaagcccacaagaattatattaggatgtcgcaaaaagcg

SEQ ID NO: 315324 - DNA, 41 bp, Artificial Sequence
  Description of Artificial Sequence: Synthetic oligonucleotide
aagaagcccacaagaattatattaggatgtcgcaaaaagcg

SEQ ID NO: 315325 - DNA, 40 bp, Artificial Sequence
  Description of Artificial Sequence: Synthetic oligonucleotide
agaagcccacaagaattatattaggatgtcgcaaaaagcg

SEQ ID NO: 315326 - DNA, 39 bp, Artificial Sequence
  Description of Artificial Sequence: Synthetic oligonucleotide
gaagcccacaagaattatattaggatgtcgcaaaaagcg

SEQ ID NO: 315327 - DNA, 39 bp, Artificial Sequence
  Description of Artificial Sequence: Synthetic oligonucleotide
aagcccacaagaattatattaggatgtcgcaaaaagcgc

SEQ ID NO: 315328 - DNA, 38 bp, Artificial Sequence
  Description of Artificial Sequence: Synthetic oligonucleotide
agcccacaagaattatattaggatgtcgcaaaaagcgc

SEQ ID NO: 315329 - DNA, 37 bp, Artificial Sequence
  Description of Artificial Sequence: Synthetic oligonucleotide
gcccacaagaattatattaggatgtcgcaaaaagcgc

SEQ ID NO: 315330 - DNA, 38 bp, Artificial Sequence
  Description of Artificial Sequence: Synthetic oligonucleotide
cccacaagaattatattaggatgtcgcaaaaagcgcac

SEQ ID NO: 315331 - DNA, 41 bp, Artificial Sequence
  Description of Artificial Sequence: Synthetic oligonucleotide
ccacaagaattatattaggatgtcgcaaaaagcgcacttag

SEQ ID NO: 315332 - DNA, 41 bp, Artificial Sequence
  Description of Artificial Sequence: Synthetic oligonucleotide
cacaagaattatattaggatgtcgcaaaaagcgcacttagc

SEQ ID NO: 315333 - DNA, 41 bp, Artificial Sequence
  Description of Artificial Sequence: Synthetic oligonucleotide
acaagaattatattaggatgtcgcaaaaagcgcacttagcc

SEQ ID NO: 315334 - DNA, 40 bp, Artificial Sequence
  Description of Artificial Sequence: Synthetic oligonucleotide
caagaattatattaggatgtcgcaaaaagcgcacttagcc

SEQ ID NO: 315335 - DNA, 41 bp, Artificial Sequence
  Description of Artificial Sequence: Synthetic oligonucleotide
aagaattatattaggatgtcgcaaaaagcgcacttagccag

SEQ ID NO: 315336 - DNA, 40 bp, Artificial Sequence
  Description of Artificial Sequence: Synthetic oligonucleotide
agaattatattaggatgtcgcaaaaagcgcacttagccag

SEQ ID NO: 315337 - DNA, 39 bp, Artificial Sequence
  Description of Artificial Sequence: Synthetic oligonucleotide
gaattatattaggatgtcgcaaaaagcgcacttagccag

SEQ ID NO: 315338 - DNA, 39 bp, Artificial Sequence
  Description of Artificial Sequence: Synthetic oligonucleotide
aattatattaggatgtcgcaaaaagcgcacttagccagg

SEQ ID NO: 315339 - DNA, 38 bp, Artificial Sequence
  Description of Artificial Sequence: Synthetic oligonucleotide
attatattaggatgtcgcaaaaagcgcacttagccagg

SEQ ID NO: 315340 - DNA, 37 bp, Artificial Sequence
  Description of Artificial Sequence: Synthetic oligonucleotide
ttatattaggatgtcgcaaaaagcgcacttagccagg

SEQ ID NO: 315341 - DNA, 36 bp, Artificial Sequence
  Description of Artificial Sequence: Synthetic oligonucleotide
tatattaggatgtcgcaaaaagcgcacttagccagg

SEQ ID NO: 315342 - DNA, 35 bp, Artificial Sequence
  Description of Artificial Sequence: Synthetic oligonucleotide
atattaggatgtcgcaaaaagcgcacttagccagg

SEQ ID NO: 315343 - DNA, 34 bp, Artificial Sequence
  Description of Artificial Sequence: Synthetic oligonucleotide
tattaggatgtcgcaaaaagcgcacttagccagg

SEQ ID NO: 315344 - DNA, 33 bp, Artificial Sequence
  Description of Artificial Sequence: Synthetic oligonucleotide
attaggatgtcgcaaaaagcgcacttagccagg

SEQ ID NO: 315345 - DNA, 32 bp, Artificial Sequence
  Description of Artificial Sequence: Synthetic oligonucleotide
ttaggatgtcgcaaaaagcgcacttagccagg

SEQ ID NO: 315346 - DNA, 31 bp, Artificial Sequence
  Description of Artificial Sequence: Synthetic oligonucleotide
taggatgtcgcaaaaagcgcacttagccagg

SEQ ID NO: 315347 - DNA, 30 bp, Artificial Sequence
  Description of Artificial Sequence: Synthetic oligonucleotide
aggatgtcgcaaaaagcgcacttagccagg

SEQ ID NO: 315348 - DNA, 29 bp, Artificial Sequence
  Description of Artificial Sequence: Synthetic oligonucleotide
ggatgtcgcaaaaagcgcacttagccagg

SEQ ID NO: 315349 - DNA, 29 bp, Artificial Sequence
  Description of Artificial Sequence: Synthetic oligonucleotide
gatgtcgcaaaaagcgcacttagccaggc

SEQ ID NO: 315350 - DNA, 33 bp, Artificial Sequence
  Description of Artificial Sequence: Synthetic oligonucleotide
atgtcgcaaaaagcgcacttagccaggcttaac

SEQ ID NO: 315351 - DNA, 32 bp, Artificial Sequence
  Description of Artificial Sequence: Synthetic oligonucleotide
tgtcgcaaaaagcgcacttagccaggcttaac

SEQ ID NO: 315352 - DNA, 31 bp, Artificial Sequence
  Description of Artificial Sequence: Synthetic oligonucleotide
gtcgcaaaaagcgcacttagccaggcttaac

SEQ ID NO: 315353 - DNA, 31 bp, Artificial Sequence
  Description of Artificial Sequence: Synthetic oligonucleotide
tcgcaaaaagcgcacttagccaggcttaacc

SEQ ID NO: 315354 - DNA, 30 bp, Artificial Sequence
  Description of Artificial Sequence: Synthetic oligonucleotide
cgcaaaaagcgcacttagccaggcttaacc

SEQ ID NO: 315355 - DNA, 32 bp, Artificial Sequence
  Description of Artificial Sequence: Synthetic oligonucleotide
gcaaaaagcgcacttagccaggcttaacctag

SEQ ID NO: 315356 - DNA, 32 bp, Artificial Sequence
  Description of Artificial Sequence: Synthetic oligonucleotide
caaaaagcgcacttagccaggcttaacctagg

SEQ ID NO: 315357 - DNA, 36 bp, Artificial Sequence
  Description of Artificial Sequence: Synthetic oligonucleotide
aaaaagcgcacttagccaggcttaacctaggaaaag

SEQ ID NO: 315358 - DNA, 35 bp, Artificial Sequence
  Description of Artificial Sequence: Synthetic oligonucleotide
aaaagcgcacttagccaggcttaacctaggaaaag

SEQ ID NO: 315359 - DNA, 34 bp, Artificial Sequence
  Description of Artificial Sequence: Synthetic oligonucleotide
aaagcgcacttagccaggcttaacctaggaaaag

SEQ ID NO: 315360 - DNA, 33 bp, Artificial Sequence
  Description of Artificial Sequence: Synthetic oligonucleotide
aagcgcacttagccaggcttaacctaggaaaag

SEQ ID NO: 315361 - DNA, 32 bp, Artificial Sequence
  Description of Artificial Sequence: Synthetic oligonucleotide
agcgcacttagccaggcttaacctaggaaaag

SEQ ID NO: 315362 - DNA, 31 bp, Artificial Sequence
  Description of Artificial Sequence: Synthetic oligonucleotide
gcgcacttagccaggcttaacctaggaaaag

SEQ ID NO: 315363 - DNA, 33 bp, Artificial Sequence
  Description of Artificial Sequence: Synthetic oligonucleotide
cgcacttagccaggcttaacctaggaaaagtac

SEQ ID NO: 315364 - DNA, 35 bp, Artificial Sequence
  Description of Artificial Sequence: Synthetic oligonucleotide
gcacttagccaggcttaacctaggaaaagtactac

SEQ ID NO: 315365 - DNA, 35 bp, Artificial Sequence
  Description of Artificial Sequence: Synthetic oligonucleotide
cacttagccaggcttaacctaggaaaagtactacc

SEQ ID NO: 315366 - DNA, 35 bp, Artificial Sequence
  Description of Artificial Sequence: Synthetic oligonucleotide
acttagccaggcttaacctaggaaaagtactaccc

SEQ ID NO: 315367 - DNA, 34 bp, Artificial Sequence
  Description of Artificial Sequence: Synthetic oligonucleotide
cttagccaggcttaacctaggaaaagtactaccc

SEQ ID NO: 315368 - DNA, 34 bp, Artificial Sequence
  Description of Artificial Sequence: Synthetic oligonucleotide
ttagccaggcttaacctaggaaaagtactacccc

SEQ ID NO: 315369 - DNA, 33 bp, Artificial Sequence
  Description of Artificial Sequence: Synthetic oligonucleotide
tagccaggcttaacctaggaaaagtactacccc

SEQ ID NO: 315370 - DNA, 32 bp, Artificial Sequence
  Description of Artificial Sequence: Synthetic oligonucleotide
agccaggcttaacctaggaaaagtactacccc

SEQ ID NO: 315371 - DNA, 31 bp, Artificial Sequence
  Description of Artificial Sequence: Synthetic oligonucleotide
gccaggcttaacctaggaaaagtactacccc

SEQ ID NO: 315372 - DNA, 32 bp, Artificial Sequence
  Description of Artificial Sequence: Synthetic oligonucleotide
ccaggcttaacctaggaaaagtactaccccag

SEQ ID NO: 315373 - DNA, 34 bp, Artificial Sequence
  Description of Artificial Sequence: Synthetic oligonucleotide
caggcttaacctaggaaaagtactaccccagtac

SEQ ID NO: 315374 - DNA, 36 bp, Artificial Sequence
  Description of Artificial Sequence: Synthetic oligonucleotide
aggcttaacctaggaaaagtactaccccagtacatg

SEQ ID NO: 315375 - DNA, 35 bp, Artificial Sequence
  Description of Artificial Sequence: Synthetic oligonucleotide
ggcttaacctaggaaaagtactaccccagtacatg

SEQ ID NO: 315376 - DNA, 36 bp, Artificial Sequence
  Description of Artificial Sequence: Synthetic oligonucleotide
gcttaacctaggaaaagtactaccccagtacatgac

SEQ ID NO: 315377 - DNA, 38 bp, Artificial Sequence
  Description of Artificial Sequence: Synthetic oligonucleotide
cttaacctaggaaaagtactaccccagtacatgactag

SEQ ID NO: 315378 - DNA, 38 bp, Artificial Sequence
  Description of Artificial Sequence: Synthetic oligonucleotide
ttaacctaggaaaagtactaccccagtacatgactagc

SEQ ID NO: 315379 - DNA, 37 bp, Artificial Sequence
  Description of Artificial Sequence: Synthetic oligonucleotide
taacctaggaaaagtactaccccagtacatgactagc

SEQ ID NO: 315380 - DNA, 36 bp, Artificial Sequence
  Description of Artificial Sequence: Synthetic oligonucleotide
aacctaggaaaagtactaccccagtacatgactagc

SEQ ID NO: 315381 - DNA, 35 bp, Artificial Sequence
  Description of Artificial Sequence: Synthetic oligonucleotide
acctaggaaaagtactaccccagtacatgactagc

SEQ ID NO: 315382 - DNA, 34 bp, Artificial Sequence
  Description of Artificial Sequence: Synthetic oligonucleotide
cctaggaaaagtactaccccagtacatgactagc

SEQ ID NO: 315383 - DNA, 35 bp, Artificial Sequence
  Description of Artificial Sequence: Synthetic oligonucleotide
ctaggaaaagtactaccccagtacatgactagcac

SEQ ID NO: 315384 - DNA, 36 bp, Artificial Sequence
  Description of Artificial Sequence: Synthetic oligonucleotide
taggaaaagtactaccccagtacatgactagcacac

SEQ ID NO: 315385 - DNA, 35 bp, Artificial Sequence
  Description of Artificial Sequence: Synthetic oligonucleotide
aggaaaagtactaccccagtacatgactagcacac

SEQ ID NO: 315386 - DNA, 34 bp, Artificial Sequence
  Description of Artificial Sequence: Synthetic oligonucleotide
ggaaaagtactaccccagtacatgactagcacac

SEQ ID NO: 315387 - DNA, 35 bp, Artificial Sequence
  Description of Artificial Sequence: Synthetic oligonucleotide
gaaaagtactaccccagtacatgactagcacacac

SEQ ID NO: 315388 - DNA, 35 bp, Artificial Sequence
  Description of Artificial Sequence: Synthetic oligonucleotide
aaaagtactaccccagtacatgactagcacacacg

SEQ ID NO: 315389 - DNA, 34 bp, Artificial Sequence
  Description of Artificial Sequence: Synthetic oligonucleotide
aaagtactaccccagtacatgactagcacacacg

SEQ ID NO: 315390 - DNA, 33 bp, Artificial Sequence
  Description of Artificial Sequence: Synthetic oligonucleotide
aagtactaccccagtacatgactagcacacacg

SEQ ID NO: 315391 - DNA, 32 bp, Artificial Sequence
  Description of Artificial Sequence: Synthetic oligonucleotide
agtactaccccagtacatgactagcacacacg

SEQ ID NO: 315392 - DNA, 31 bp, Artificial Sequence
  Description of Artificial Sequence: Synthetic oligonucleotide
gtactaccccagtacatgactagcacacacg

SEQ ID NO: 315393 - DNA, 31 bp, Artificial Sequence
  Description of Artificial Sequence: Synthetic oligonucleotide
tactaccccagtacatgactagcacacacgc

SEQ ID NO: 315394 - DNA, 30 bp, Artificial Sequence
  Description of Artificial Sequence: Synthetic oligonucleotide
actaccccagtacatgactagcacacacgc

SEQ ID NO: 315395 - DNA, 29 bp, Artificial Sequence
  Description of Artificial Sequence: Synthetic oligonucleotide
ctaccccagtacatgactagcacacacgc

SEQ ID NO: 315396 - DNA, 30 bp, Artificial Sequence
  Description of Artificial Sequence: Synthetic oligonucleotide
taccccagtacatgactagcacacacgcag

SEQ ID NO: 315397 - DNA, 29 bp, Artificial Sequence
  Description of Artificial Sequence: Synthetic oligonucleotide
accccagtacatgactagcacacacgcag

SEQ ID NO: 315398 - DNA, 28 bp, Artificial Sequence
  Description of Artificial Sequence: Synthetic oligonucleotide
ccccagtacatgactagcacacacgcag

SEQ ID NO: 315399 - DNA, 29 bp, Artificial Sequence
  Description of Artificial Sequence: Synthetic oligonucleotide
cccagtacatgactagcacacacgcagtg

SEQ ID NO: 315400 - DNA, 29 bp, Artificial Sequence
  Description of Artificial Sequence: Synthetic oligonucleotide
ccagtacatgactagcacacacgcagtgg

SEQ ID NO: 315401 - DNA, 29 bp, Artificial Sequence
  Description of Artificial Sequence: Synthetic oligonucleotide
cagtacatgactagcacacacgcagtggc

SEQ ID NO: 315402 - DNA, 35 bp, Artificial Sequence
  Description of Artificial Sequence: Synthetic oligonucleotide
agtacatgactagcacacacgcagtggctattatg

SEQ ID NO: 315403 - DNA, 34 bp, Artificial Sequence
  Description of Artificial Sequence: Synthetic oligonucleotide
gtacatgactagcacacacgcagtggctattatg

SEQ ID NO: 315404 - DNA, 41 bp, Artificial Sequence
  Description of Artificial Sequence: Synthetic oligonucleotide
tacatgactagcacacacgcagtggctattatgttttatag

SEQ ID NO: 315405 - DNA, 40 bp, Artificial Sequence
  Description of Artificial Sequence: Synthetic oligonucleotide
acatgactagcacacacgcagtggctattatgttttatag

SEQ ID NO: 315406 - DNA, 39 bp, Artificial Sequence
  Description of Artificial Sequence: Synthetic oligonucleotide
catgactagcacacacgcagtggctattatgttttatag

SEQ ID NO: 315407 - DNA, 42 bp, Artificial Sequence
  Description of Artificial Sequence: Synthetic oligonucleotide
atgactagcacacacgcagtggctattatgttttatagattg

SEQ ID NO: 315408 - DNA, 41 bp, Artificial Sequence
  Description of Artificial Sequence: Synthetic oligonucleotide
tgactagcacacacgcagtggctattatgttttatagattg

SEQ ID NO: 315409 - DNA, 40 bp, Artificial Sequence
  Description of Artificial Sequence: Synthetic oligonucleotide
gactagcacacacgcagtggctattatgttttatagattg

SEQ ID NO: 315410 - DNA, 42 bp, Artificial Sequence
  Description of Artificial Sequence: Synthetic oligonucleotide
actagcacacacgcagtggctattatgttttatagattgaac

SEQ ID NO: 315411 - DNA, 41 bp, Artificial Sequence
  Description of Artificial Sequence: Synthetic oligonucleotide
ctagcacacacgcagtggctattatgttttatagattgaac

SEQ ID NO: 315412 - DNA, 42 bp, Artificial Sequence
  Description of Artificial Sequence: Synthetic oligonucleotide
tagcacacacgcagtggctattatgttttatagattgaacag

SEQ ID NO: 315413 - DNA, 41 bp, Artificial Sequence
  Description of Artificial Sequence: Synthetic oligonucleotide
agcacacacgcagtggctattatgttttatagattgaacag

SEQ ID NO: 315414 - DNA, 40 bp, Artificial Sequence
  Description of Artificial Sequence: Synthetic oligonucleotide
gcacacacgcagtggctattatgttttatagattgaacag

SEQ ID NO: 315415 - DNA, 40 bp, Artificial Sequence
  Description of Artificial Sequence: Synthetic oligonucleotide
cacacacgcagtggctattatgttttatagattgaacagg

SEQ ID NO: 315416 - DNA, 43 bp, Artificial Sequence
  Description of Artificial Sequence: Synthetic oligonucleotide
acacacgcagtggctattatgttttatagattgaacaggaatg

SEQ ID NO: 315417 - DNA, 42 bp, Artificial Sequence
  Description of Artificial Sequence: Synthetic oligonucleotide
cacacgcagtggctattatgttttatagattgaacaggaatg

SEQ ID NO: 315418 - DNA, 44 bp, Artificial Sequence
  Description of Artificial Sequence: Synthetic oligonucleotide
acacgcagtggctattatgttttatagattgaacaggaatgttc

SEQ ID NO: 315419 - DNA, 43 bp, Artificial Sequence
  Description of Artificial Sequence: Synthetic oligonucleotide
cacgcagtggctattatgttttatagattgaacaggaatgttc

SEQ ID NO: 315420 - DNA, 46 bp, Artificial Sequence
  Description of Artificial Sequence: Synthetic oligonucleotide
acgcagtggctattatgttttatagattgaacaggaatgttcatac

SEQ ID NO: 315421 - DNA, 45 bp, Artificial Sequence
  Description of Artificial Sequence: Synthetic oligonucleotide
cgcagtggctattatgttttatagattgaacaggaatgttcatac

SEQ ID NO: 315422 - DNA, 46 bp, Artificial Sequence
  Description of Artificial Sequence: Synthetic oligonucleotide
gcagtggctattatgttttatagattgaacaggaatgttcatactg

SEQ ID NO: 315423 - DNA, 47 bp, Artificial Sequence
  Description of Artificial Sequence: Synthetic oligonucleotide
cagtggctattatgttttatagattgaacaggaatgttcatactgac

SEQ ID NO: 315424 - DNA, 51 bp, Artificial Sequence
  Description of Artificial Sequence: Synthetic oligonucleotide
agtggctattatgttttatagattgaacaggaatgttcatactgactttag

SEQ ID NO: 315425 - DNA, 50 bp, Artificial Sequence
  Description of Artificial Sequence: Synthetic oligonucleotide
gtggctattatgttttatagattgaacaggaatgttcatactgactttag

SEQ ID NO: 315426 - DNA, 52 bp, Artificial Sequence
  Description of Artificial Sequence: Synthetic oligonucleotide
tggctattatgttttatagattgaacaggaatgttcatactgactttagtag

SEQ ID NO: 315427 - DNA, 51 bp, Artificial Sequence
  Description of Artificial Sequence: Synthetic oligonucleotide
ggctattatgttttatagattgaacaggaatgttcatactgactttagtag

SEQ ID NO: 315428 - DNA, 52 bp, Artificial Sequence
  Description of Artificial Sequence: Synthetic oligonucleotide
gctattatgttttatagattgaacaggaatgttcatactgactttagtagag

SEQ ID NO: 315429 - DNA, 52 bp, Artificial Sequence
  Description of Artificial Sequence: Synthetic oligonucleotide
ctattatgttttatagattgaacaggaatgttcatactgactttagtagagc

SEQ ID NO: 315430 - DNA, 52 bp, Artificial Sequence
  Description of Artificial Sequence: Synthetic oligonucleotide
tattatgttttatagattgaacaggaatgttcatactgactttagtagagcc

SEQ ID NO: 315431 - DNA, 51 bp, Artificial Sequence
  Description of Artificial Sequence: Synthetic oligonucleotide
attatgttttatagattgaacaggaatgttcatactgactttagtagagcc

SEQ ID NO: 315432 - DNA, 50 bp, Artificial Sequence
  Description of Artificial Sequence: Synthetic oligonucleotide
ttatgttttatagattgaacaggaatgttcatactgactttagtagagcc

SEQ ID NO: 315433 - DNA, 49 bp, Artificial Sequence
  Description of Artificial Sequence: Synthetic oligonucleotide
tatgttttatagattgaacaggaatgttcatactgactttagtagagcc

SEQ ID NO: 315434 - DNA, 48 bp, Artificial Sequence
  Description of Artificial Sequence: Synthetic oligonucleotide
atgttttatagattgaacaggaatgttcatactgactttagtagagcc

SEQ ID NO: 315435 - DNA, 47 bp, Artificial Sequence
  Description of Artificial Sequence: Synthetic oligonucleotide
tgttttatagattgaacaggaatgttcatactgactttagtagagcc

SEQ ID NO: 315436 - DNA, 46 bp, Artificial Sequence
  Description of Artificial Sequence: Synthetic oligonucleotide
gttttatagattgaacaggaatgttcatactgactttagtagagcc

SEQ ID NO: 315437 - DNA, 48 bp, Artificial Sequence
  Description of Artificial Sequence: Synthetic oligonucleotide
ttttatagattgaacaggaatgttcatactgactttagtagagccatc

SEQ ID NO: 315438 - DNA, 47 bp, Artificial Sequence
  Description of Artificial Sequence: Synthetic oligonucleotide
tttatagattgaacaggaatgttcatactgactttagtagagccatc

SEQ ID NO: 315439 - DNA, 46 bp, Artificial Sequence
  Description of Artificial Sequence: Synthetic oligonucleotide
ttatagattgaacaggaatgttcatactgactttagtagagccatc

SEQ ID NO: 315440 - DNA, 45 bp, Artificial Sequence
  Description of Artificial Sequence: Synthetic oligonucleotide
tatagattgaacaggaatgttcatactgactttagtagagccatc

SEQ ID NO: 315441 - DNA, 44 bp, Artificial Sequence
  Description of Artificial Sequence: Synthetic oligonucleotide
atagattgaacaggaatgttcatactgactttagtagagccatc

SEQ ID NO: 315442 - DNA, 43 bp, Artificial Sequence
  Description of Artificial Sequence: Synthetic oligonucleotide
tagattgaacaggaatgttcatactgactttagtagagccatc

SEQ ID NO: 315443 - DNA, 42 bp, Artificial Sequence
  Description of Artificial Sequence: Synthetic oligonucleotide
agattgaacaggaatgttcatactgactttagtagagccatc

SEQ ID NO: 315444 - DNA, 41 bp, Artificial Sequence
  Description of Artificial Sequence: Synthetic oligonucleotide
gattgaacaggaatgttcatactgactttagtagagccatc

SEQ ID NO: 315445 - DNA, 41 bp, Artificial Sequence
  Description of Artificial Sequence: Synthetic oligonucleotide
attgaacaggaatgttcatactgactttagtagagccatcg

SEQ ID NO: 315446 - DNA, 40 bp, Artificial Sequence
  Description of Artificial Sequence: Synthetic oligonucleotide
ttgaacaggaatgttcatactgactttagtagagccatcg

SEQ ID NO: 315447 - DNA, 39 bp, Artificial Sequence
  Description of Artificial Sequence: Synthetic oligonucleotide
tgaacaggaatgttcatactgactttagtagagccatcg

SEQ ID NO: 315448 - DNA, 38 bp, Artificial Sequence
  Description of Artificial Sequence: Synthetic oligonucleotide
gaacaggaatgttcatactgactttagtagagccatcg

SEQ ID NO: 315449 - DNA, 38 bp, Artificial Sequence
  Description of Artificial Sequence: Synthetic oligonucleotide
aacaggaatgttcatactgactttagtagagccatcgc

SEQ ID NO: 315450 - DNA, 37 bp, Artificial Sequence
  Description of Artificial Sequence: Synthetic oligonucleotide
acaggaatgttcatactgactttagtagagccatcgc

SEQ ID NO: 315451 - DNA, 36 bp, Artificial Sequence
  Description of Artificial Sequence: Synthetic oligonucleotide
caggaatgttcatactgactttagtagagccatcgc

SEQ ID NO: 315452 - DNA, 36 bp, Artificial Sequence
  Description of Artificial Sequence: Synthetic oligonucleotide
aggaatgttcatactgactttagtagagccatcgcc

SEQ ID NO: 315453 - DNA, 35 bp, Artificial Sequence
  Description of Artificial Sequence: Synthetic oligonucleotide
ggaatgttcatactgactttagtagagccatcgcc

SEQ ID NO: 315454 - DNA, 36 bp, Artificial Sequence
  Description of Artificial Sequence: Synthetic oligonucleotide
gaatgttcatactgactttagtagagccatcgcctc

SEQ ID NO: 315455 - DNA, 37 bp, Artificial Sequence
  Description of Artificial Sequence: Synthetic oligonucleotide
aatgttcatactgactttagtagagccatcgcctctg

SEQ ID NO: 315456 - DNA, 36 bp, Artificial Sequence
  Description of Artificial Sequence: Synthetic oligonucleotide
atgttcatactgactttagtagagccatcgcctctg

SEQ ID NO: 315457 - DNA, 35 bp, Artificial Sequence
  Description of Artificial Sequence: Synthetic oligonucleotide
tgttcatactgactttagtagagccatcgcctctg

SEQ ID NO: 315458 - DNA, 34 bp, Artificial Sequence
  Description of Artificial Sequence: Synthetic oligonucleotide
gttcatactgactttagtagagccatcgcctctg

SEQ ID NO: 315459 - DNA, 36 bp, Artificial Sequence
  Description of Artificial Sequence: Synthetic oligonucleotide
ttcatactgactttagtagagccatcgcctctgttc

SEQ ID NO: 315460 - DNA, 35 bp, Artificial Sequence
  Description of Artificial Sequence: Synthetic oligonucleotide
tcatactgactttagtagagccatcgcctctgttc

SEQ ID NO: 315461 - DNA, 34 bp, Artificial Sequence
  Description of Artificial Sequence: Synthetic oligonucleotide
catactgactttagtagagccatcgcctctgttc

SEQ ID NO: 315462 - DNA, 34 bp, Artificial Sequence
  Description of Artificial Sequence: Synthetic oligonucleotide
atactgactttagtagagccatcgcctctgttcc

SEQ ID NO: 315463 - DNA, 33 bp, Artificial Sequence
  Description of Artificial Sequence: Synthetic oligonucleotide
tactgactttagtagagccatcgcctctgttcc

SEQ ID NO: 315464 - DNA, 32 bp, Artificial Sequence
  Description of Artificial Sequence: Synthetic oligonucleotide
actgactttagtagagccatcgcctctgttcc

SEQ ID NO: 315465 - DNA, 31 bp, Artificial Sequence
  Description of Artificial Sequence: Synthetic oligonucleotide
ctgactttagtagagccatcgcctctgttcc

SEQ ID NO: 315466 - DNA, 31 bp, Artificial Sequence
  Description of Artificial Sequence: Synthetic oligonucleotide
tgactttagtagagccatcgcctctgttccc

SEQ ID NO: 315467 - DNA, 30 bp, Artificial Sequence
  Description of Artificial Sequence: Synthetic oligonucleotide
gactttagtagagccatcgcctctgttccc

SEQ ID NO: 315468 - DNA, 31 bp, Artificial Sequence
  Description of Artificial Sequence: Synthetic oligonucleotide
actttagtagagccatcgcctctgttcccag

SEQ ID NO: 315469 - DNA, 30 bp, Artificial Sequence
  Description of Artificial Sequence: Synthetic oligonucleotide
ctttagtagagccatcgcctctgttcccag

SEQ ID NO: 315470 - DNA, 30 bp, Artificial Sequence
  Description of Artificial Sequence: Synthetic oligonucleotide
tttagtagagccatcgcctctgttcccagg

SEQ ID NO: 315471 - DNA, 29 bp, Artificial Sequence
  Description of Artificial Sequence: Synthetic oligonucleotide
ttagtagagccatcgcctctgttcccagg

SEQ ID NO: 315472 - DNA, 28 bp, Artificial Sequence
  Description of Artificial Sequence: Synthetic oligonucleotide
tagtagagccatcgcctctgttcccagg

SEQ ID NO: 315473 - DNA, 27 bp, Artificial Sequence
  Description of Artificial Sequence: Synthetic oligonucleotide
agtagagccatcgcctctgttcccagg

SEQ ID NO: 315474 - DNA, 27 bp, Artificial Sequence
  Description of Artificial Sequence: Synthetic oligonucleotide
gtagagccatcgcctctgttcccagga

SEQ ID NO: 315475 - DNA, 27 bp, Artificial Sequence
  Description of Artificial Sequence: Synthetic oligonucleotide
tagagccatcgcctctgttcccaggac

SEQ ID NO: 315476 - DNA, 27 bp, Artificial Sequence
  Description of Artificial Sequence: Synthetic oligonucleotide
agagccatcgcctctgttcccaggact

SEQ ID NO: 315477 - DNA, 26 bp, Artificial Sequence
  Description of Artificial Sequence: Synthetic oligonucleotide
gagccatcgcctctgttcccaggact

SEQ ID NO: 315478 - DNA, 26 bp, Artificial Sequence
  Description of Artificial Sequence: Synthetic oligonucleotide
agccatcgcctctgttcccaggactc

SEQ ID NO: 315479 - DNA, 25 bp, Artificial Sequence
  Description of Artificial Sequence: Synthetic oligonucleotide
gccatcgcctctgttcccaggactc

SEQ ID NO: 315480 - DNA, 26 bp, Artificial Sequence
  Description of Artificial Sequence: Synthetic oligonucleotide
ccatcgcctctgttcccaggactcga

SEQ ID NO: 315481 - DNA, 27 bp, Artificial Sequence
  Description of Artificial Sequence: Synthetic oligonucleotide
catcgcctctgttcccaggactcgaca

SEQ ID NO: 315482 - DNA, 27 bp, Artificial Sequence
  Description of Artificial Sequence: Synthetic oligonucleotide
atcgcctctgttcccaggactcgacag

SEQ ID NO: 315483 - DNA, 26 bp, Artificial Sequence
  Description of Artificial Sequence: Synthetic oligonucleotide
tcgcctctgttcccaggactcgacag

SEQ ID NO: 315484 - DNA, 25 bp, Artificial Sequence
  Description of Artificial Sequence: Synthetic oligonucleotide
cgcctctgttcccaggactcgacag

SEQ ID NO: 315485 - DNA, 26 bp, Artificial Sequence
  Description of Artificial Sequence: Synthetic oligonucleotide
gcctctgttcccaggactcgacagca

SEQ ID NO: 315486 - DNA, 27 bp, Artificial Sequence
  Description of Artificial Sequence: Synthetic oligonucleotide
cctctgttcccaggactcgacagcagt

SEQ ID NO: 315487 - DNA, 29 bp, Artificial Sequence
  Description of Artificial Sequence: Synthetic oligonucleotide
ctctgttcccaggactcgacagcagtaag

SEQ ID NO: 315488 - DNA, 31 bp, Artificial Sequence
  Description of Artificial Sequence: Synthetic oligonucleotide
tctgttcccaggactcgacagcagtaagaac

SEQ ID NO: 315489 - DNA, 30 bp, Artificial Sequence
  Description of Artificial Sequence: Synthetic oligonucleotide
ctgttcccaggactcgacagcagtaagaac

SEQ ID NO: 315490 - DNA, 30 bp, Artificial Sequence
  Description of Artificial Sequence: Synthetic oligonucleotide
tgttcccaggactcgacagcagtaagaacg

SEQ ID NO: 315491 - DNA, 29 bp, Artificial Sequence
  Description of Artificial Sequence: Synthetic oligonucleotide
gttcccaggactcgacagcagtaagaacg

SEQ ID NO: 315492 - DNA, 31 bp, Artificial Sequence
  Description of Artificial Sequence: Synthetic oligonucleotide
ttcccaggactcgacagcagtaagaacgttc

SEQ ID NO: 315493 - DNA, 30 bp, Artificial Sequence
  Description of Artificial Sequence: Synthetic oligonucleotide
tcccaggactcgacagcagtaagaacgttc

SEQ ID NO: 315494 - DNA, 29 bp, Artificial Sequence
  Description of Artificial Sequence: Synthetic oligonucleotide
cccaggactcgacagcagtaagaacgttc

SEQ ID NO: 315495 - DNA, 32 bp, Artificial Sequence
  Description of Artificial Sequence: Synthetic oligonucleotide
ccaggactcgacagcagtaagaacgttcaatc

SEQ ID NO: 315496 - DNA, 32 bp, Artificial Sequence
  Description of Artificial Sequence: Synthetic oligonucleotide
caggactcgacagcagtaagaacgttcaatcc

SEQ ID NO: 315497 - DNA, 33 bp, Artificial Sequence
  Description of Artificial Sequence: Synthetic oligonucleotide
aggactcgacagcagtaagaacgttcaatccac

SEQ ID NO: 315498 - DNA, 32 bp, Artificial Sequence
  Description of Artificial Sequence: Synthetic oligonucleotide
ggactcgacagcagtaagaacgttcaatccac

SEQ ID NO: 315499 - DNA, 34 bp, Artificial Sequence
  Description of Artificial Sequence: Synthetic oligonucleotide
gactcgacagcagtaagaacgttcaatccacttc

SEQ ID NO: 315500 - DNA, 43 bp, Artificial Sequence
  Description of Artificial Sequence: Synthetic oligonucleotide
actcgacagcagtaagaacgttcaatccacttcatatatttac

SEQ ID NO: 315501 - DNA, 42 bp, Artificial Sequence
  Description of Artificial Sequence: Synthetic oligonucleotide
ctcgacagcagtaagaacgttcaatccacttcatatatttac

SEQ ID NO: 315502 - DNA, 43 bp, Artificial Sequence
  Description of Artificial Sequence: Synthetic oligonucleotide
tcgacagcagtaagaacgttcaatccacttcatatatttacag

SEQ ID NO: 315503 - DNA, 42 bp, Artificial Sequence
  Description of Artificial Sequence: Synthetic oligonucleotide
cgacagcagtaagaacgttcaatccacttcatatatttacag

SEQ ID NO: 315504 - DNA, 44 bp, Artificial Sequence
  Description of Artificial Sequence: Synthetic oligonucleotide
gacagcagtaagaacgttcaatccacttcatatatttacagtac

SEQ ID NO: 315505 - DNA, 46 bp, Artificial Sequence
  Description of Artificial Sequence: Synthetic oligonucleotide
acagcagtaagaacgttcaatccacttcatatatttacagtactac

SEQ ID NO: 315506 - DNA, 45 bp, Artificial Sequence
  Description of Artificial Sequence: Synthetic oligonucleotide
cagcagtaagaacgttcaatccacttcatatatttacagtactac

SEQ ID NO: 315507 - DNA, 45 bp, Artificial Sequence
  Description of Artificial Sequence: Synthetic oligonucleotide
agcagtaagaacgttcaatccacttcatatatttacagtactacc

SEQ ID NO: 315508 - DNA, 44 bp, Artificial Sequence
  Description of Artificial Sequence: Synthetic oligonucleotide
gcagtaagaacgttcaatccacttcatatatttacagtactacc

SEQ ID NO: 315509 - DNA, 45 bp, Artificial Sequence
  Description of Artificial Sequence: Synthetic oligonucleotide
cagtaagaacgttcaatccacttcatatatttacagtactacctc

SEQ ID NO: 315510 - DNA, 46 bp, Artificial Sequence
  Description of Artificial Sequence: Synthetic oligonucleotide
agtaagaacgttcaatccacttcatatatttacagtactacctctc

SEQ ID NO: 315511 - DNA, 45 bp, Artificial Sequence
  Description of Artificial Sequence: Synthetic oligonucleotide
gtaagaacgttcaatccacttcatatatttacagtactacctctc

SEQ ID NO: 315512 - DNA, 45 bp, Artificial Sequence
  Description of Artificial Sequence: Synthetic oligonucleotide
taagaacgttcaatccacttcatatatttacagtactacctctcc

SEQ ID NO: 315513 - DNA, 44 bp, Artificial Sequence
  Description of Artificial Sequence: Synthetic oligonucleotide
aagaacgttcaatccacttcatatatttacagtactacctctcc

SEQ ID NO: 315514 - DNA, 43 bp, Artificial Sequence
  Description of Artificial Sequence: Synthetic oligonucleotide
agaacgttcaatccacttcatatatttacagtactacctctcc

SEQ ID NO: 315515 - DNA, 42 bp, Artificial Sequence
  Description of Artificial Sequence: Synthetic oligonucleotide
gaacgttcaatccacttcatatatttacagtactacctctcc

SEQ ID NO: 315516 - DNA, 43 bp, Artificial Sequence
  Description of Artificial Sequence: Synthetic oligonucleotide
aacgttcaatccacttcatatatttacagtactacctctcctc

SEQ ID NO: 315517 - DNA, 42 bp, Artificial Sequence
  Description of Artificial Sequence: Synthetic oligonucleotide
acgttcaatccacttcatatatttacagtactacctctcctc

SEQ ID NO: 315518 - DNA, 41 bp, Artificial Sequence
  Description of Artificial Sequence: Synthetic oligonucleotide
cgttcaatccacttcatatatttacagtactacctctcctc

SEQ ID NO: 315519 - DNA, 42 bp, Artificial Sequence
  Description of Artificial Sequence: Synthetic oligonucleotide
gttcaatccacttcatatatttacagtactacctctcctcag

SEQ ID NO: 315520 - DNA, 42 bp, Artificial Sequence
  Description of Artificial Sequence: Synthetic oligonucleotide
ttcaatccacttcatatatttacagtactacctctcctcagc

SEQ ID NO: 315521 - DNA, 41 bp, Artificial Sequence
  Description of Artificial Sequence: Synthetic oligonucleotide
tcaatccacttcatatatttacagtactacctctcctcagc

SEQ ID NO: 315522 - DNA, 40 bp, Artificial Sequence
  Description of Artificial Sequence: Synthetic oligonucleotide
caatccacttcatatatttacagtactacctctcctcagc

SEQ ID NO: 315523 - DNA, 43 bp, Artificial Sequence
  Description of Artificial Sequence: Synthetic oligonucleotide
aatccacttcatatatttacagtactacctctcctcagcaaac

SEQ ID NO: 315524 - DNA, 42 bp, Artificial Sequence
  Description of Artificial Sequence: Synthetic oligonucleotide
atccacttcatatatttacagtactacctctcctcagcaaac

SEQ ID NO: 315525 - DNA, 41 bp, Artificial Sequence
  Description of Artificial Sequence: Synthetic oligonucleotide
tccacttcatatatttacagtactacctctcctcagcaaac

SEQ ID NO: 315526 - DNA, 40 bp, Artificial Sequence
  Description of Artificial Sequence: Synthetic oligonucleotide
ccacttcatatatttacagtactacctctcctcagcaaac

SEQ ID NO: 315527 - DNA, 40 bp, Artificial Sequence
  Description of Artificial Sequence: Synthetic oligonucleotide
cacttcatatatttacagtactacctctcctcagcaaacc

SEQ ID NO: 315528 - DNA, 41 bp, Artificial Sequence
  Description of Artificial Sequence: Synthetic oligonucleotide
acttcatatatttacagtactacctctcctcagcaaaccag

SEQ ID NO: 315529 - DNA, 40 bp, Artificial Sequence
  Description of Artificial Sequence: Synthetic oligonucleotide
cttcatatatttacagtactacctctcctcagcaaaccag

SEQ ID NO: 315530 - DNA, 40 bp, Artificial Sequence
  Description of Artificial Sequence: Synthetic oligonucleotide
ttcatatatttacagtactacctctcctcagcaaaccagc

SEQ ID NO: 315531 - DNA, 39 bp, Artificial Sequence
  Description of Artificial Sequence: Synthetic oligonucleotide
tcatatatttacagtactacctctcctcagcaaaccagc

SEQ ID NO: 315532 - DNA, 38 bp, Artificial Sequence
  Description of Artificial Sequence: Synthetic oligonucleotide
catatatttacagtactacctctcctcagcaaaccagc

SEQ ID NO: 315533 - DNA, 39 bp, Artificial Sequence
  Description of Artificial Sequence: Synthetic oligonucleotide
atatatttacagtactacctctcctcagcaaaccagctg

SEQ ID NO: 315534 - DNA, 38 bp, Artificial Sequence
  Description of Artificial Sequence: Synthetic oligonucleotide
tatatttacagtactacctctcctcagcaaaccagctg

SEQ ID NO: 315535 - DNA, 37 bp, Artificial Sequence
  Description of Artificial Sequence: Synthetic oligonucleotide
atatttacagtactacctctcctcagcaaaccagctg

SEQ ID NO: 315536 - DNA, 36 bp, Artificial Sequence
  Description of Artificial Sequence: Synthetic oligonucleotide
tatttacagtactacctctcctcagcaaaccagctg

SEQ ID NO: 315537 - DNA, 35 bp, Artificial Sequence
  Description of Artificial Sequence: Synthetic oligonucleotide
atttacagtactacctctcctcagcaaaccagctg

SEQ ID NO: 315538 - DNA, 34 bp, Artificial Sequence
  Description of Artificial Sequence: Synthetic oligonucleotide
tttacagtactacctctcctcagcaaaccagctg

SEQ ID NO: 315539 - DNA, 33 bp, Artificial Sequence
  Description of Artificial Sequence: Synthetic oligonucleotide
ttacagtactacctctcctcagcaaaccagctg

SEQ ID NO: 315540 - DNA, 32 bp, Artificial Sequence
  Description of Artificial Sequence: Synthetic oligonucleotide
tacagtactacctctcctcagcaaaccagctg

SEQ ID NO: 315541 - DNA, 31 bp, Artificial Sequence
  Description of Artificial Sequence: Synthetic oligonucleotide
acagtactacctctcctcagcaaaccagctg

SEQ ID NO: 315542 - DNA, 30 bp, Artificial Sequence
  Description of Artificial Sequence: Synthetic oligonucleotide
cagtactacctctcctcagcaaaccagctg

SEQ ID NO: 315543 - DNA, 30 bp, Artificial Sequence
  Description of Artificial Sequence: Synthetic oligonucleotide
agtactacctctcctcagcaaaccagctgc

SEQ ID NO: 315544 - DNA, 29 bp, Artificial Sequence
  Description of Artificial Sequence: Synthetic oligonucleotide
gtactacctctcctcagcaaaccagctgc

SEQ ID NO: 315545 - DNA, 30 bp, Artificial Sequence
  Description of Artificial Sequence: Synthetic oligonucleotide
tactacctctcctcagcaaaccagctgctc

SEQ ID NO: 315546 - DNA, 29 bp, Artificial Sequence
  Description of Artificial Sequence: Synthetic oligonucleotide
actacctctcctcagcaaaccagctgctc

SEQ ID NO: 315547 - DNA, 28 bp, Artificial Sequence
  Description of Artificial Sequence: Synthetic oligonucleotide
ctacctctcctcagcaaaccagctgctc

SEQ ID NO: 315548 - DNA, 29 bp, Artificial Sequence
  Description of Artificial Sequence: Synthetic oligonucleotide
tacctctcctcagcaaaccagctgctcag

SEQ ID NO: 315549 - DNA, 28 bp, Artificial Sequence
  Description of Artificial Sequence: Synthetic oligonucleotide
acctctcctcagcaaaccagctgctcag

SEQ ID NO: 315550 - DNA, 27 bp, Artificial Sequence
  Description of Artificial Sequence: Synthetic oligonucleotide
cctctcctcagcaaaccagctgctcag

SEQ ID NO: 315551 - DNA, 27 bp, Artificial Sequence
  Description of Artificial Sequence: Synthetic oligonucleotide
ctctcctcagcaaaccagctgctcagg

SEQ ID NO: 315552 - DNA, 30 bp, Artificial Sequence
  Description of Artificial Sequence: Synthetic oligonucleotide
tctcctcagcaaaccagctgctcaggaaag

SEQ ID NO: 315553 - DNA, 29 bp, Artificial Sequence
  Description of Artificial Sequence: Synthetic oligonucleotide
ctcctcagcaaaccagctgctcaggaaag

SEQ ID NO: 315554 - DNA, 30 bp, Artificial Sequence
  Description of Artificial Sequence: Synthetic oligonucleotide
tcctcagcaaaccagctgctcaggaaagac

SEQ ID NO: 315555 - DNA, 29 bp, Artificial Sequence
  Description of Artificial Sequence: Synthetic oligonucleotide
cctcagcaaaccagctgctcaggaaagac

SEQ ID NO: 315556 - DNA, 30 bp, Artificial Sequence
  Description of Artificial Sequence: Synthetic oligonucleotide
ctcagcaaaccagctgctcaggaaagactg

SEQ ID NO: 315557 - DNA, 30 bp, Artificial Sequence
  Description of Artificial Sequence: Synthetic oligonucleotide
tcagcaaaccagctgctcaggaaagactgc

SEQ ID NO: 315558 - DNA, 29 bp, Artificial Sequence
  Description of Artificial Sequence: Synthetic oligonucleotide
cagcaaaccagctgctcaggaaagactgc

SEQ ID NO: 315559 - DNA, 31 bp, Artificial Sequence
  Description of Artificial Sequence: Synthetic oligonucleotide
agcaaaccagctgctcaggaaagactgcatc

SEQ ID NO: 315560 - DNA, 30 bp, Artificial Sequence
  Description of Artificial Sequence: Synthetic oligonucleotide
gcaaaccagctgctcaggaaagactgcatc

SEQ ID NO: 315561 - DNA, 32 bp, Artificial Sequence
  Description of Artificial Sequence: Synthetic oligonucleotide
caaaccagctgctcaggaaagactgcatcatg

SEQ ID NO: 315562 - DNA, 32 bp, Artificial Sequence
  Description of Artificial Sequence: Synthetic oligonucleotide
aaaccagctgctcaggaaagactgcatcatgg

SEQ ID NO: 315563 - DNA, 31 bp, Artificial Sequence
  Description of Artificial Sequence: Synthetic oligonucleotide
aaccagctgctcaggaaagactgcatcatgg

SEQ ID NO: 315564 - DNA, 30 bp, Artificial Sequence
  Description of Artificial Sequence: Synthetic oligonucleotide
accagctgctcaggaaagactgcatcatgg

SEQ ID NO: 315565 - DNA, 29 bp, Artificial Sequence
  Description of Artificial Sequence: Synthetic oligonucleotide
ccagctgctcaggaaagactgcatcatgg

SEQ ID NO: 315566 - DNA, 30 bp, Artificial Sequence
  Description of Artificial Sequence: Synthetic oligonucleotide
cagctgctcaggaaagactgcatcatggtg

SEQ ID NO: 315567 - DNA, 33 bp, Artificial Sequence
  Description of Artificial Sequence: Synthetic oligonucleotide
agctgctcaggaaagactgcatcatggtgaatg

SEQ ID NO: 315568 - DNA, 32 bp, Artificial Sequence
  Description of Artificial Sequence: Synthetic oligonucleotide
gctgctcaggaaagactgcatcatggtgaatg

SEQ ID NO: 315569 - DNA, 32 bp, Artificial Sequence
  Description of Artificial Sequence: Synthetic oligonucleotide
ctgctcaggaaagactgcatcatggtgaatgg

SEQ ID NO: 315570 - DNA, 32 bp, Artificial Sequence
  Description of Artificial Sequence: Synthetic oligonucleotide
tgctcaggaaagactgcatcatggtgaatggc

SEQ ID NO: 315571 - DNA, 31 bp, Artificial Sequence
  Description of Artificial Sequence: Synthetic oligonucleotide
gctcaggaaagactgcatcatggtgaatggc

SEQ ID NO: 315572 - DNA, 32 bp, Artificial Sequence
  Description of Artificial Sequence: Synthetic oligonucleotide
ctcaggaaagactgcatcatggtgaatggcac

SEQ ID NO: 315573 - DNA, 33 bp, Artificial Sequence
  Description of Artificial Sequence: Synthetic oligonucleotide
tcaggaaagactgcatcatggtgaatggcacac

SEQ ID NO: 315574 - DNA, 32 bp, Artificial Sequence
  Description of Artificial Sequence: Synthetic oligonucleotide
caggaaagactgcatcatggtgaatggcacac

SEQ ID NO: 315575 - DNA, 33 bp, Artificial Sequence
  Description of Artificial Sequence: Synthetic oligonucleotide
aggaaagactgcatcatggtgaatggcacactg

SEQ ID NO: 315576 - DNA, 32 bp, Artificial Sequence
  Description of Artificial Sequence: Synthetic oligonucleotide
ggaaagactgcatcatggtgaatggcacactg

SEQ ID NO: 315577 - DNA, 33 bp, Artificial Sequence
  Description of Artificial Sequence: Synthetic oligonucleotide
gaaagactgcatcatggtgaatggcacactgtg

SEQ ID NO: 315578 - DNA, 33 bp, Artificial Sequence
  Description of Artificial Sequence: Synthetic oligonucleotide
aaagactgcatcatggtgaatggcacactgtgc

SEQ ID NO: 315579 - DNA, 32 bp, Artificial Sequence
  Description of Artificial Sequence: Synthetic oligonucleotide
aagactgcatcatggtgaatggcacactgtgc

SEQ ID NO: 315580 - DNA, 31 bp, Artificial Sequence
  Description of Artificial Sequence: Synthetic oligonucleotide
agactgcatcatggtgaatggcacactgtgc

SEQ ID NO: 315581 - DNA, 30 bp, Artificial Sequence
  Description of Artificial Sequence: Synthetic oligonucleotide
gactgcatcatggtgaatggcacactgtgc

SEQ ID NO: 315582 - DNA, 33 bp, Artificial Sequence
  Description of Artificial Sequence: Synthetic oligonucleotide
actgcatcatggtgaatggcacactgtgctatc

SEQ ID NO: 315583 - DNA, 32 bp, Artificial Sequence
  Description of Artificial Sequence: Synthetic oligonucleotide
ctgcatcatggtgaatggcacactgtgctatc

SEQ ID NO: 315584 - DNA, 33 bp, Artificial Sequence
  Description of Artificial Sequence: Synthetic oligonucleotide
tgcatcatggtgaatggcacactgtgctatcag

SEQ ID NO: 315585 - DNA, 32 bp, Artificial Sequence
  Description of Artificial Sequence: Synthetic oligonucleotide
gcatcatggtgaatggcacactgtgctatcag

SEQ ID NO: 315586 - DNA, 32 bp, Artificial Sequence
  Description of Artificial Sequence: Synthetic oligonucleotide
catcatggtgaatggcacactgtgctatcagg

SEQ ID NO: 315587 - DNA, 33 bp, Artificial Sequence
  Description of Artificial Sequence: Synthetic oligonucleotide
atcatggtgaatggcacactgtgctatcaggtg

SEQ ID NO: 315588 - DNA, 32 bp, Artificial Sequence
  Description of Artificial Sequence: Synthetic oligonucleotide
tcatggtgaatggcacactgtgctatcaggtg

SEQ ID NO: 315589 - DNA, 31 bp, Artificial Sequence
  Description of Artificial Sequence: Synthetic oligonucleotide
catggtgaatggcacactgtgctatcaggtg

SEQ ID NO: 315590 - DNA, 31 bp, Artificial Sequence
  Description of Artificial Sequence: Synthetic oligonucleotide
atggtgaatggcacactgtgctatcaggtgc

SEQ ID NO: 315591 - DNA, 30 bp, Artificial Sequence
  Description of Artificial Sequence: Synthetic oligonucleotide
tggtgaatggcacactgtgctatcaggtgc

SEQ ID NO: 315592 - DNA, 29 bp, Artificial Sequence
  Description of Artificial Sequence: Synthetic oligonucleotide
ggtgaatggcacactgtgctatcaggtgc

SEQ ID NO: 315593 - DNA, 35 bp, Artificial Sequence
  Description of Artificial Sequence: Synthetic oligonucleotide
gtgaatggcacactgtgctatcaggtgcattttag

SEQ ID NO: 315594 - DNA, 35 bp, Artificial Sequence
  Description of Artificial Sequence: Synthetic oligonucleotide
tgaatggcacactgtgctatcaggtgcattttagg

SEQ ID NO: 315595 - DNA, 34 bp, Artificial Sequence
  Description of Artificial Sequence: Synthetic oligonucleotide
gaatggcacactgtgctatcaggtgcattttagg

SEQ ID NO: 315596 - DNA, 35 bp, Artificial Sequence
  Description of Artificial Sequence: Synthetic oligonucleotide
aatggcacactgtgctatcaggtgcattttaggac

SEQ ID NO: 315597 - DNA, 34 bp, Artificial Sequence
  Description of Artificial Sequence: Synthetic oligonucleotide
atggcacactgtgctatcaggtgcattttaggac

SEQ ID NO: 315598 - DNA, 33 bp, Artificial Sequence
  Description of Artificial Sequence: Synthetic oligonucleotide
tggcacactgtgctatcaggtgcattttaggac

SEQ ID NO: 315599 - DNA, 32 bp, Artificial Sequence
  Description of Artificial Sequence: Synthetic oligonucleotide
ggcacactgtgctatcaggtgcattttaggac

SEQ ID NO: 315600 - DNA, 32 bp, Artificial Sequence
  Description of Artificial Sequence: Synthetic oligonucleotide
gcacactgtgctatcaggtgcattttaggacg

SEQ ID NO: 315601 - DNA, 34 bp, Artificial Sequence
  Description of Artificial Sequence: Synthetic oligonucleotide
cacactgtgctatcaggtgcattttaggacgaac

SEQ ID NO: 315602 - DNA, 34 bp, Artificial Sequence
  Description of Artificial Sequence: Synthetic oligonucleotide
acactgtgctatcaggtgcattttaggacgaacg

SEQ ID NO: 315603 - DNA, 33 bp, Artificial Sequence
  Description of Artificial Sequence: Synthetic oligonucleotide
cactgtgctatcaggtgcattttaggacgaacg

SEQ ID NO: 315604 - DNA, 35 bp, Artificial Sequence
  Description of Artificial Sequence: Synthetic oligonucleotide
actgtgctatcaggtgcattttaggacgaacgatg

SEQ ID NO: 315605 - DNA, 34 bp, Artificial Sequence
  Description of Artificial Sequence: Synthetic oligonucleotide
ctgtgctatcaggtgcattttaggacgaacgatg

SEQ ID NO: 315606 - DNA, 35 bp, Artificial Sequence
  Description of Artificial Sequence: Synthetic oligonucleotide
tgtgctatcaggtgcattttaggacgaacgatgtc

SEQ ID NO: 315607 - DNA, 34 bp, Artificial Sequence
  Description of Artificial Sequence: Synthetic oligonucleotide
gtgctatcaggtgcattttaggacgaacgatgtc

SEQ ID NO: 315608 - DNA, 34 bp, Artificial Sequence
  Description of Artificial Sequence: Synthetic oligonucleotide
tgctatcaggtgcattttaggacgaacgatgtcc

SEQ ID NO: 315609 - DNA, 33 bp, Artificial Sequence
  Description of Artificial Sequence: Synthetic oligonucleotide
gctatcaggtgcattttaggacgaacgatgtcc

SEQ ID NO: 315610 - DNA, 34 bp, Artificial Sequence
  Description of Artificial Sequence: Synthetic oligonucleotide
ctatcaggtgcattttaggacgaacgatgtccac

SEQ ID NO: 315611 - DNA, 40 bp, Artificial Sequence
  Description of Artificial Sequence: Synthetic oligonucleotide
tatcaggtgcattttaggacgaacgatgtccacattaatg

SEQ ID NO: 315612 - DNA, 39 bp, Artificial Sequence
  Description of Artificial Sequence: Synthetic oligonucleotide
atcaggtgcattttaggacgaacgatgtccacattaatg

SEQ ID NO: 315613 - DNA, 38 bp, Artificial Sequence
  Description of Artificial Sequence: Synthetic oligonucleotide
tcaggtgcattttaggacgaacgatgtccacattaatg

SEQ ID NO: 315614 - DNA, 37 bp, Artificial Sequence
  Description of Artificial Sequence: Synthetic oligonucleotide
caggtgcattttaggacgaacgatgtccacattaatg

SEQ ID NO: 315615 - DNA, 37 bp, Artificial Sequence
  Description of Artificial Sequence: Synthetic oligonucleotide
aggtgcattttaggacgaacgatgtccacattaatgc

SEQ ID NO: 315616 - DNA, 36 bp, Artificial Sequence
  Description of Artificial Sequence: Synthetic oligonucleotide
ggtgcattttaggacgaacgatgtccacattaatgc

SEQ ID NO: 315617 - DNA, 36 bp, Artificial Sequence
  Description of Artificial Sequence: Synthetic oligonucleotide
gtgcattttaggacgaacgatgtccacattaatgcc

SEQ ID NO: 315618 - DNA, 38 bp, Artificial Sequence
  Description of Artificial Sequence: Synthetic oligonucleotide
tgcattttaggacgaacgatgtccacattaatgccttc

SEQ ID NO: 315619 - DNA, 37 bp, Artificial Sequence
  Description of Artificial Sequence: Synthetic oligonucleotide
gcattttaggacgaacgatgtccacattaatgccttc

SEQ ID NO: 315620 - DNA, 38 bp, Artificial Sequence
  Description of Artificial Sequence: Synthetic oligonucleotide
cattttaggacgaacgatgtccacattaatgccttcac

SEQ ID NO: 315621 - DNA, 39 bp, Artificial Sequence
  Description of Artificial Sequence: Synthetic oligonucleotide
attttaggacgaacgatgtccacattaatgccttcacag

SEQ ID NO: 315622 - DNA, 38 bp, Artificial Sequence
  Description of Artificial Sequence: Synthetic oligonucleotide
ttttaggacgaacgatgtccacattaatgccttcacag

SEQ ID NO: 315623 - DNA, 37 bp, Artificial Sequence
  Description of Artificial Sequence: Synthetic oligonucleotide
tttaggacgaacgatgtccacattaatgccttcacag

SEQ ID NO: 315624 - DNA, 36 bp, Artificial Sequence
  Description of Artificial Sequence: Synthetic oligonucleotide
ttaggacgaacgatgtccacattaatgccttcacag

SEQ ID NO: 315625 - DNA, 35 bp, Artificial Sequence
  Description of Artificial Sequence: Synthetic oligonucleotide
taggacgaacgatgtccacattaatgccttcacag

SEQ ID NO: 315626 - DNA, 34 bp, Artificial Sequence
  Description of Artificial Sequence: Synthetic oligonucleotide
aggacgaacgatgtccacattaatgccttcacag

SEQ ID NO: 315627 - DNA, 33 bp, Artificial Sequence
  Description of Artificial Sequence: Synthetic oligonucleotide
ggacgaacgatgtccacattaatgccttcacag

SEQ ID NO: 315628 - DNA, 33 bp, Artificial Sequence
  Description of Artificial Sequence: Synthetic oligonucleotide
gacgaacgatgtccacattaatgccttcacagg

SEQ ID NO: 315629 - DNA, 33 bp, Artificial Sequence
  Description of Artificial Sequence: Synthetic oligonucleotide
acgaacgatgtccacattaatgccttcacaggg

SEQ ID NO: 315630 - DNA, 32 bp, Artificial Sequence
  Description of Artificial Sequence: Synthetic oligonucleotide
cgaacgatgtccacattaatgccttcacaggg

SEQ ID NO: 315631 - DNA, 32 bp, Artificial Sequence
  Description of Artificial Sequence: Synthetic oligonucleotide
gaacgatgtccacattaatgccttcacagggg

SEQ ID NO: 315632 - DNA, 32 bp, Artificial Sequence
  Description of Artificial Sequence: Synthetic oligonucleotide
aacgatgtccacattaatgccttcacaggggc

SEQ ID NO: 315633 - DNA, 31 bp, Artificial Sequence
  Description of Artificial Sequence: Synthetic oligonucleotide
acgatgtccacattaatgccttcacaggggc

SEQ ID NO: 315634 - DNA, 30 bp, Artificial Sequence
  Description of Artificial Sequence: Synthetic oligonucleotide
cgatgtccacattaatgccttcacaggggc

SEQ ID NO: 315635 - DNA, 30 bp, Artificial Sequence
  Description of Artificial Sequence: Synthetic oligonucleotide
gatgtccacattaatgccttcacaggggcg

SEQ ID NO: 315636 - DNA, 31 bp, Artificial Sequence
  Description of Artificial Sequence: Synthetic oligonucleotide
atgtccacattaatgccttcacaggggcgac

SEQ ID NO: 315637 - DNA, 30 bp, Artificial Sequence
  Description of Artificial Sequence: Synthetic oligonucleotide
tgtccacattaatgccttcacaggggcgac

SEQ ID NO: 315638 - DNA, 29 bp, Artificial Sequence
  Description of Artificial Sequence: Synthetic oligonucleotide
gtccacattaatgccttcacaggggcgac

SEQ ID NO: 315639 - DNA, 29 bp, Artificial Sequence
  Description of Artificial Sequence: Synthetic oligonucleotide
tccacattaatgccttcacaggggcgacc

SEQ ID NO: 315640 - DNA, 28 bp, Artificial Sequence
  Description of Artificial Sequence: Synthetic oligonucleotide
ccacattaatgccttcacaggggcgacc

SEQ ID NO: 315641 - DNA, 31 bp, Artificial Sequence
  Description of Artificial Sequence: Synthetic oligonucleotide
cacattaatgccttcacaggggcgaccattc

SEQ ID NO: 315642 - DNA, 31 bp, Artificial Sequence
  Description of Artificial Sequence: Synthetic oligonucleotide
acattaatgccttcacaggggcgaccattcg

SEQ ID NO: 315643 - DNA, 30 bp, Artificial Sequence
  Description of Artificial Sequence: Synthetic oligonucleotide
cattaatgccttcacaggggcgaccattcg

SEQ ID NO: 315644 - DNA, 34 bp, Artificial Sequence
  Description of Artificial Sequence: Synthetic oligonucleotide
attaatgccttcacaggggcgaccattcgaattg

SEQ ID NO: 315645 - DNA, 33 bp, Artificial Sequence
  Description of Artificial Sequence: Synthetic oligonucleotide
ttaatgccttcacaggggcgaccattcgaattg

SEQ ID NO: 315646 - DNA, 32 bp, Artificial Sequence
  Description of Artificial Sequence: Synthetic oligonucleotide
taatgccttcacaggggcgaccattcgaattg

SEQ ID NO: 315647 - DNA, 31 bp, Artificial Sequence
  Description of Artificial Sequence: Synthetic oligonucleotide
aatgccttcacaggggcgaccattcgaattg

SEQ ID NO: 315648 - DNA, 30 bp, Artificial Sequence
  Description of Artificial Sequence: Synthetic oligonucleotide
atgccttcacaggggcgaccattcgaattg

SEQ ID NO: 315649 - DNA, 29 bp, Artificial Sequence
  Description of Artificial Sequence: Synthetic oligonucleotide
tgccttcacaggggcgaccattcgaattg

SEQ ID NO: 315650 - DNA, 28 bp, Artificial Sequence
  Description of Artificial Sequence: Synthetic oligonucleotide
gccttcacaggggcgaccattcgaattg

SEQ ID NO: 315651 - DNA, 28 bp, Artificial Sequence
  Description of Artificial Sequence: Synthetic oligonucleotide
ccttcacaggggcgaccattcgaattgg

SEQ ID NO: 315652 - DNA, 28 bp, Artificial Sequence
  Description of Artificial Sequence: Synthetic oligonucleotide
cttcacaggggcgaccattcgaattggc

SEQ ID NO: 315653 - DNA, 28 bp, Artificial Sequence
  Description of Artificial Sequence: Synthetic oligonucleotide
ttcacaggggcgaccattcgaattggcc

SEQ ID NO: 315654 - DNA, 27 bp, Artificial Sequence
  Description of Artificial Sequence: Synthetic oligonucleotide
tcacaggggcgaccattcgaattggcc

SEQ ID NO: 315655 - DNA, 27 bp, Artificial Sequence
  Description of Artificial Sequence: Synthetic oligonucleotide
cacaggggcgaccattcgaattggcca

SEQ ID NO: 315656 - DNA, 30 bp, Artificial Sequence
  Description of Artificial Sequence: Synthetic oligonucleotide
acaggggcgaccattcgaattggccaatac

SEQ ID NO: 315657 - DNA, 29 bp, Artificial Sequence
  Description of Artificial Sequence: Synthetic oligonucleotide
caggggcgaccattcgaattggccaatac

SEQ ID NO: 315658 - DNA, 29 bp, Artificial Sequence
  Description of Artificial Sequence: Synthetic oligonucleotide
aggggcgaccattcgaattggccaatacc

SEQ ID NO: 315659 - DNA, 28 bp, Artificial Sequence
  Description of Artificial Sequence: Synthetic oligonucleotide
ggggcgaccattcgaattggccaatacc

SEQ ID NO: 315660 - DNA, 29 bp, Artificial Sequence
  Description of Artificial Sequence: Synthetic oligonucleotide
gggcgaccattcgaattggccaatacctc

SEQ ID NO: 315661 - DNA, 30 bp, Artificial Sequence
  Description of Artificial Sequence: Synthetic oligonucleotide
ggcgaccattcgaattggccaatacctctc

SEQ ID NO: 315662 - DNA, 30 bp, Artificial Sequence
  Description of Artificial Sequence: Synthetic oligonucleotide
gcgaccattcgaattggccaatacctctcc

SEQ ID NO: 315663 - DNA, 31 bp, Artificial Sequence
  Description of Artificial Sequence: Synthetic oligonucleotide
cgaccattcgaattggccaatacctctccac

SEQ ID NO: 315664 - DNA, 33 bp, Artificial Sequence
  Description of Artificial Sequence: Synthetic oligonucleotide
gaccattcgaattggccaatacctctccacttc

SEQ ID NO: 315665 - DNA, 33 bp, Artificial Sequence
  Description of Artificial Sequence: Synthetic oligonucleotide
accattcgaattggccaatacctctccacttcc

SEQ ID NO: 315666 - DNA, 32 bp, Artificial Sequence
  Description of Artificial Sequence: Synthetic oligonucleotide
ccattcgaattggccaatacctctccacttcc

SEQ ID NO: 315667 - DNA, 32 bp, Artificial Sequence
  Description of Artificial Sequence: Synthetic oligonucleotide
cattcgaattggccaatacctctccacttccc

SEQ ID NO: 315668 - DNA, 33 bp, Artificial Sequence
  Description of Artificial Sequence: Synthetic oligonucleotide
attcgaattggccaatacctctccacttccctc

SEQ ID NO: 315669 - DNA, 32 bp, Artificial Sequence
  Description of Artificial Sequence: Synthetic oligonucleotide
ttcgaattggccaatacctctccacttccctc

SEQ ID NO: 315670 - DNA, 31 bp, Artificial Sequence
  Description of Artificial Sequence: Synthetic oligonucleotide
tcgaattggccaatacctctccacttccctc

SEQ ID NO: 315671 - DNA, 30 bp, Artificial Sequence
  Description of Artificial Sequence: Synthetic oligonucleotide
cgaattggccaatacctctccacttccctc

SEQ ID NO: 315672 - DNA, 30 bp, Artificial Sequence
  Description of Artificial Sequence: Synthetic oligonucleotide
gaattggccaatacctctccacttccctcc

SEQ ID NO: 315673 - DNA, 31 bp, Artificial Sequence
  Description of Artificial Sequence: Synthetic oligonucleotide
aattggccaatacctctccacttccctcctg

SEQ ID NO: 315674 - DNA, 30 bp, Artificial Sequence
  Description of Artificial Sequence: Synthetic oligonucleotide
attggccaatacctctccacttccctcctg

SEQ ID NO: 315675 - DNA, 29 bp, Artificial Sequence
  Description of Artificial Sequence: Synthetic oligonucleotide
ttggccaatacctctccacttccctcctg

SEQ ID NO: 315676 - DNA, 28 bp, Artificial Sequence
  Description of Artificial Sequence: Synthetic oligonucleotide
tggccaatacctctccacttccctcctg

SEQ ID NO: 315677 - DNA, 27 bp, Artificial Sequence
  Description of Artificial Sequence: Synthetic oligonucleotide
ggccaatacctctccacttccctcctg

SEQ ID NO: 315678 - DNA, 30 bp, Artificial Sequence
  Description of Artificial Sequence: Synthetic oligonucleotide
gccaatacctctccacttccctcctgtaag

SEQ ID NO: 315679 - DNA, 32 bp, Artificial Sequence
  Description of Artificial Sequence: Synthetic oligonucleotide
ccaatacctctccacttccctcctgtaagaag

SEQ ID NO: 315680 - DNA, 33 bp, Artificial Sequence
  Description of Artificial Sequence: Synthetic oligonucleotide
caatacctctccacttccctcctgtaagaagag

SEQ ID NO: 315681 - DNA, 33 bp, Artificial Sequence
  Description of Artificial Sequence: Synthetic oligonucleotide
aatacctctccacttccctcctgtaagaagagg

SEQ ID NO: 315682 - DNA, 32 bp, Artificial Sequence
  Description of Artificial Sequence: Synthetic oligonucleotide
atacctctccacttccctcctgtaagaagagg

SEQ ID NO: 315683 - DNA, 31 bp, Artificial Sequence
  Description of Artificial Sequence: Synthetic oligonucleotide
tacctctccacttccctcctgtaagaagagg

SEQ ID NO: 315684 - DNA, 30 bp, Artificial Sequence
  Description of Artificial Sequence: Synthetic oligonucleotide
acctctccacttccctcctgtaagaagagg

SEQ ID NO: 315685 - DNA, 29 bp, Artificial Sequence
  Description of Artificial Sequence: Synthetic oligonucleotide
cctctccacttccctcctgtaagaagagg

SEQ ID NO: 315686 - DNA, 29 bp, Artificial Sequence
  Description of Artificial Sequence: Synthetic oligonucleotide
ctctccacttccctcctgtaagaagaggg

SEQ ID NO: 315687 - DNA, 30 bp, Artificial Sequence
  Description of Artificial Sequence: Synthetic oligonucleotide
tctccacttccctcctgtaagaagagggac

SEQ ID NO: 315688 - DNA, 29 bp, Artificial Sequence
  Description of Artificial Sequence: Synthetic oligonucleotide
ctccacttccctcctgtaagaagagggac

SEQ ID NO: 315689 - DNA, 30 bp, Artificial Sequence
  Description of Artificial Sequence: Synthetic oligonucleotide
tccacttccctcctgtaagaagagggacag

SEQ ID NO: 315690 - DNA, 29 bp, Artificial Sequence
  Description of Artificial Sequence: Synthetic oligonucleotide
ccacttccctcctgtaagaagagggacag

SEQ ID NO: 315691 - DNA, 29 bp, Artificial Sequence
  Description of Artificial Sequence: Synthetic oligonucleotide
cacttccctcctgtaagaagagggacagg

SEQ ID NO: 315692 - DNA, 30 bp, Artificial Sequence
  Description of Artificial Sequence: Synthetic oligonucleotide
acttccctcctgtaagaagagggacaggag

SEQ ID NO: 315693 - DNA, 29 bp, Artificial Sequence
  Description of Artificial Sequence: Synthetic oligonucleotide
cttccctcctgtaagaagagggacaggag

SEQ ID NO: 315694 - DNA, 32 bp, Artificial Sequence
  Description of Artificial Sequence: Synthetic oligonucleotide
ttccctcctgtaagaagagggacaggagttag

SEQ ID NO: 315695 - DNA, 31 bp, Artificial Sequence
  Description of Artificial Sequence: Synthetic oligonucleotide
tccctcctgtaagaagagggacaggagttag

SEQ ID NO: 315696 - DNA, 30 bp, Artificial Sequence
  Description of Artificial Sequence: Synthetic oligonucleotide
ccctcctgtaagaagagggacaggagttag

SEQ ID NO: 315697 - DNA, 30 bp, Artificial Sequence
  Description of Artificial Sequence: Synthetic oligonucleotide
cctcctgtaagaagagggacaggagttagg

SEQ ID NO: 315698 - DNA, 30 bp, Artificial Sequence
  Description of Artificial Sequence: Synthetic oligonucleotide
ctcctgtaagaagagggacaggagttaggg

SEQ ID NO: 315699 - DNA, 32 bp, Artificial Sequence
  Description of Artificial Sequence: Synthetic oligonucleotide
tcctgtaagaagagggacaggagttagggaac

SEQ ID NO: 315700 - DNA, 31 bp, Artificial Sequence
  Description of Artificial Sequence: Synthetic oligonucleotide
cctgtaagaagagggacaggagttagggaac

SEQ ID NO: 315701 - DNA, 31 bp, Artificial Sequence
  Description of Artificial Sequence: Synthetic oligonucleotide
ctgtaagaagagggacaggagttagggaacc

SEQ ID NO: 315702 - DNA, 32 bp, Artificial Sequence
  Description of Artificial Sequence: Synthetic oligonucleotide
tgtaagaagagggacaggagttagggaaccag

SEQ ID NO: 315703 - DNA, 31 bp, Artificial Sequence
  Description of Artificial Sequence: Synthetic oligonucleotide
gtaagaagagggacaggagttagggaaccag

SEQ ID NO: 315704 - DNA, 32 bp, Artificial Sequence
  Description of Artificial Sequence: Synthetic oligonucleotide
taagaagagggacaggagttagggaaccagtc

SEQ ID NO: 315705 - DNA, 31 bp, Artificial Sequence
  Description of Artificial Sequence: Synthetic oligonucleotide
aagaagagggacaggagttagggaaccagtc

SEQ ID NO: 315706 - DNA, 30 bp, Artificial Sequence
  Description of Artificial Sequence: Synthetic oligonucleotide
agaagagggacaggagttagggaaccagtc

SEQ ID NO: 315707 - DNA, 29 bp, Artificial Sequence
  Description of Artificial Sequence: Synthetic oligonucleotide
gaagagggacaggagttagggaaccagtc

SEQ ID NO: 315708 - DNA, 30 bp, Artificial Sequence
  Description of Artificial Sequence: Synthetic oligonucleotide
aagagggacaggagttagggaaccagtcac

SEQ ID NO: 315709 - DNA, 29 bp, Artificial Sequence
  Description of Artificial Sequence: Synthetic oligonucleotide
agagggacaggagttagggaaccagtcac

SEQ ID NO: 315710 - DNA, 28 bp, Artificial Sequence
  Description of Artificial Sequence: Synthetic oligonucleotide
gagggacaggagttagggaaccagtcac

SEQ ID NO: 315711 - DNA, 34 bp, Artificial Sequence
  Description of Artificial Sequence: Synthetic oligonucleotide
agggacaggagttagggaaccagtcactatttag

SEQ ID NO: 315712 - DNA, 33 bp, Artificial Sequence
  Description of Artificial Sequence: Synthetic oligonucleotide
gggacaggagttagggaaccagtcactatttag

SEQ ID NO: 315713 - DNA, 33 bp, Artificial Sequence
  Description of Artificial Sequence: Synthetic oligonucleotide
ggacaggagttagggaaccagtcactatttagc

SEQ ID NO: 315714 - DNA, 38 bp, Artificial Sequence
  Description of Artificial Sequence: Synthetic oligonucleotide
gacaggagttagggaaccagtcactatttagcatattc

SEQ ID NO: 315715 - DNA, 39 bp, Artificial Sequence
  Description of Artificial Sequence: Synthetic oligonucleotide
acaggagttagggaaccagtcactatttagcatattcac

SEQ ID NO: 315716 - DNA, 38 bp, Artificial Sequence
  Description of Artificial Sequence: Synthetic oligonucleotide
caggagttagggaaccagtcactatttagcatattcac

SEQ ID NO: 315717 - DNA, 38 bp, Artificial Sequence
  Description of Artificial Sequence: Synthetic oligonucleotide
aggagttagggaaccagtcactatttagcatattcacg

SEQ ID NO: 315718 - DNA, 37 bp, Artificial Sequence
  Description of Artificial Sequence: Synthetic oligonucleotide
ggagttagggaaccagtcactatttagcatattcacg

SEQ ID NO: 315719 - DNA, 38 bp, Artificial Sequence
  Description of Artificial Sequence: Synthetic oligonucleotide
gagttagggaaccagtcactatttagcatattcacgtg

SEQ ID NO: 315720 - DNA, 38 bp, Artificial Sequence
  Description of Artificial Sequence: Synthetic oligonucleotide
agttagggaaccagtcactatttagcatattcacgtgc

SEQ ID NO: 315721 - DNA, 37 bp, Artificial Sequence
  Description of Artificial Sequence: Synthetic oligonucleotide
gttagggaaccagtcactatttagcatattcacgtgc

SEQ ID NO: 315722 - DNA, 37 bp, Artificial Sequence
  Description of Artificial Sequence: Synthetic oligonucleotide
ttagggaaccagtcactatttagcatattcacgtgcc

SEQ ID NO: 315723 - DNA, 36 bp, Artificial Sequence
  Description of Artificial Sequence: Synthetic oligonucleotide
tagggaaccagtcactatttagcatattcacgtgcc

SEQ ID NO: 315724 - DNA, 35 bp, Artificial Sequence
  Description of Artificial Sequence: Synthetic oligonucleotide
agggaaccagtcactatttagcatattcacgtgcc

SEQ ID NO: 315725 - DNA, 34 bp, Artificial Sequence
  Description of Artificial Sequence: Synthetic oligonucleotide
gggaaccagtcactatttagcatattcacgtgcc

SEQ ID NO: 315726 - DNA, 35 bp, Artificial Sequence
  Description of Artificial Sequence: Synthetic oligonucleotide
ggaaccagtcactatttagcatattcacgtgcctg

SEQ ID NO: 315727 - DNA, 35 bp, Artificial Sequence
  Description of Artificial Sequence: Synthetic oligonucleotide
gaaccagtcactatttagcatattcacgtgcctgg

SEQ ID NO: 315728 - DNA, 35 bp, Artificial Sequence
  Description of Artificial Sequence: Synthetic oligonucleotide
aaccagtcactatttagcatattcacgtgcctggg

SEQ ID NO: 315729 - DNA, 34 bp, Artificial Sequence
  Description of Artificial Sequence: Synthetic oligonucleotide
accagtcactatttagcatattcacgtgcctggg

SEQ ID NO: 315730 - DNA, 33 bp, Artificial Sequence
  Description of Artificial Sequence: Synthetic oligonucleotide
ccagtcactatttagcatattcacgtgcctggg

SEQ ID NO: 315731 - DNA, 34 bp, Artificial Sequence
  Description of Artificial Sequence: Synthetic oligonucleotide
cagtcactatttagcatattcacgtgcctgggtc

SEQ ID NO: 315732 - DNA, 34 bp, Artificial Sequence
  Description of Artificial Sequence: Synthetic oligonucleotide
agtcactatttagcatattcacgtgcctgggtcc

SEQ ID NO: 315733 - DNA, 33 bp, Artificial Sequence
  Description of Artificial Sequence: Synthetic oligonucleotide
gtcactatttagcatattcacgtgcctgggtcc

SEQ ID NO: 315734 - DNA, 34 bp, Artificial Sequence
  Description of Artificial Sequence: Synthetic oligonucleotide
tcactatttagcatattcacgtgcctgggtccac

SEQ ID NO: 315735 - DNA, 33 bp, Artificial Sequence
  Description of Artificial Sequence: Synthetic oligonucleotide
cactatttagcatattcacgtgcctgggtccac

SEQ ID NO: 315736 - DNA, 33 bp, Artificial Sequence
  Description of Artificial Sequence: Synthetic oligonucleotide
actatttagcatattcacgtgcctgggtccacc

SEQ ID NO: 315737 - DNA, 32 bp, Artificial Sequence
  Description of Artificial Sequence: Synthetic oligonucleotide
ctatttagcatattcacgtgcctgggtccacc

SEQ ID NO: 315738 - DNA, 33 bp, Artificial Sequence
  Description of Artificial Sequence: Synthetic oligonucleotide
tatttagcatattcacgtgcctgggtccacctg

SEQ ID NO: 315739 - DNA, 32 bp, Artificial Sequence
  Description of Artificial Sequence: Synthetic oligonucleotide
atttagcatattcacgtgcctgggtccacctg

SEQ ID NO: 315740 - DNA, 31 bp, Artificial Sequence
  Description of Artificial Sequence: Synthetic oligonucleotide
tttagcatattcacgtgcctgggtccacctg

SEQ ID NO: 315741 - DNA, 30 bp, Artificial Sequence
  Description of Artificial Sequence: Synthetic oligonucleotide
ttagcatattcacgtgcctgggtccacctg

SEQ ID NO: 315742 - DNA, 29 bp, Artificial Sequence
  Description of Artificial Sequence: Synthetic oligonucleotide
tagcatattcacgtgcctgggtccacctg

SEQ ID NO: 315743 - DNA, 28 bp, Artificial Sequence
  Description of Artificial Sequence: Synthetic oligonucleotide
agcatattcacgtgcctgggtccacctg

SEQ ID NO: 315744 - DNA, 27 bp, Artificial Sequence
  Description of Artificial Sequence: Synthetic oligonucleotide
gcatattcacgtgcctgggtccacctg

SEQ ID NO: 315745 - DNA, 29 bp, Artificial Sequence
  Description of Artificial Sequence: Synthetic oligonucleotide
catattcacgtgcctgggtccacctgtac

SEQ ID NO: 315746 - DNA, 30 bp, Artificial Sequence
  Description of Artificial Sequence: Synthetic oligonucleotide
atattcacgtgcctgggtccacctgtactg

SEQ ID NO: 315747 - DNA, 29 bp, Artificial Sequence
  Description of Artificial Sequence: Synthetic oligonucleotide
tattcacgtgcctgggtccacctgtactg

SEQ ID NO: 315748 - DNA, 28 bp, Artificial Sequence
  Description of Artificial Sequence: Synthetic oligonucleotide
attcacgtgcctgggtccacctgtactg

SEQ ID NO: 315749 - DNA, 27 bp, Artificial Sequence
  Description of Artificial Sequence: Synthetic oligonucleotide
ttcacgtgcctgggtccacctgtactg

SEQ ID NO: 315750 - DNA, 27 bp, Artificial Sequence
  Description of Artificial Sequence: Synthetic oligonucleotide
tcacgtgcctgggtccacctgtactgt

SEQ ID NO: 315751 - DNA, 27 bp, Artificial Sequence
  Description of Artificial Sequence: Synthetic oligonucleotide
cacgtgcctgggtccacctgtactgta

SEQ ID NO: 315752 - DNA, 27 bp, Artificial Sequence
  Description of Artificial Sequence: Synthetic oligonucleotide
acgtgcctgggtccacctgtactgtac

SEQ ID NO: 315753 - DNA, 27 bp, Artificial Sequence
  Description of Artificial Sequence: Synthetic oligonucleotide
cgtgcctgggtccacctgtactgtact

SEQ ID NO: 315754 - DNA, 28 bp, Artificial Sequence
  Description of Artificial Sequence: Synthetic oligonucleotide
gtgcctgggtccacctgtactgtacttc

SEQ ID NO: 315755 - DNA, 29 bp, Artificial Sequence
  Description of Artificial Sequence: Synthetic oligonucleotide
tgcctgggtccacctgtactgtacttctc

SEQ ID NO: 315756 - DNA, 28 bp, Artificial Sequence
  Description of Artificial Sequence: Synthetic oligonucleotide
gcctgggtccacctgtactgtacttctc

SEQ ID NO: 315757 - DNA, 28 bp, Artificial Sequence
  Description of Artificial Sequence: Synthetic oligonucleotide
cctgggtccacctgtactgtacttctcg

SEQ ID NO: 315758 - DNA, 28 bp, Artificial Sequence
  Description of Artificial Sequence: Synthetic oligonucleotide
ctgggtccacctgtactgtacttctcgc

SEQ ID NO: 315759 - DNA, 29 bp, Artificial Sequence
  Description of Artificial Sequence: Synthetic oligonucleotide
tgggtccacctgtactgtacttctcgctc

SEQ ID NO: 315760 - DNA, 28 bp, Artificial Sequence
  Description of Artificial Sequence: Synthetic oligonucleotide
gggtccacctgtactgtacttctcgctc

SEQ ID NO: 315761 - DNA, 30 bp, Artificial Sequence
  Description of Artificial Sequence: Synthetic oligonucleotide
ggtccacctgtactgtacttctcgctcaag

SEQ ID NO: 315762 - DNA, 32 bp, Artificial Sequence
  Description of Artificial Sequence: Synthetic oligonucleotide
gtccacctgtactgtacttctcgctcaagaag

SEQ ID NO: 315763 - DNA, 32 bp, Artificial Sequence
  Description of Artificial Sequence: Synthetic oligonucleotide
tccacctgtactgtacttctcgctcaagaagc

SEQ ID NO: 315764 - DNA, 31 bp, Artificial Sequence
  Description of Artificial Sequence: Synthetic oligonucleotide
ccacctgtactgtacttctcgctcaagaagc

SEQ ID NO: 315765 - DNA, 33 bp, Artificial Sequence
  Description of Artificial Sequence: Synthetic oligonucleotide
cacctgtactgtacttctcgctcaagaagcaag

SEQ ID NO: 315766 - DNA, 34 bp, Artificial Sequence
  Description of Artificial Sequence: Synthetic oligonucleotide
acctgtactgtacttctcgctcaagaagcaagtc

SEQ ID NO: 315767 - DNA, 33 bp, Artificial Sequence
  Description of Artificial Sequence: Synthetic oligonucleotide
cctgtactgtacttctcgctcaagaagcaagtc

SEQ ID NO: 315768 - DNA, 35 bp, Artificial Sequence
  Description of Artificial Sequence: Synthetic oligonucleotide
ctgtactgtacttctcgctcaagaagcaagtcttg

SEQ ID NO: 315769 - DNA, 37 bp, Artificial Sequence
  Description of Artificial Sequence: Synthetic oligonucleotide
tgtactgtacttctcgctcaagaagcaagtcttgaac

SEQ ID NO: 315770 - DNA, 36 bp, Artificial Sequence
  Description of Artificial Sequence: Synthetic oligonucleotide
gtactgtacttctcgctcaagaagcaagtcttgaac

SEQ ID NO: 315771 - DNA, 36 bp, Artificial Sequence
  Description of Artificial Sequence: Synthetic oligonucleotide
tactgtacttctcgctcaagaagcaagtcttgaacc

SEQ ID NO: 315772 - DNA, 35 bp, Artificial Sequence
  Description of Artificial Sequence: Synthetic oligonucleotide
actgtacttctcgctcaagaagcaagtcttgaacc

SEQ ID NO: 315773 - DNA, 34 bp, Artificial Sequence
  Description of Artificial Sequence: Synthetic oligonucleotide
ctgtacttctcgctcaagaagcaagtcttgaacc

SEQ ID NO: 315774 - DNA, 34 bp, Artificial Sequence
  Description of Artificial Sequence: Synthetic oligonucleotide
tgtacttctcgctcaagaagcaagtcttgaaccc

SEQ ID NO: 315775 - DNA, 33 bp, Artificial Sequence
  Description of Artificial Sequence: Synthetic oligonucleotide
gtacttctcgctcaagaagcaagtcttgaaccc

SEQ ID NO: 315776 - DNA, 34 bp, Artificial Sequence
  Description of Artificial Sequence: Synthetic oligonucleotide
tacttctcgctcaagaagcaagtcttgaaccctc

SEQ ID NO: 315777 - DNA, 33 bp, Artificial Sequence
  Description of Artificial Sequence: Synthetic oligonucleotide
acttctcgctcaagaagcaagtcttgaaccctc

SEQ ID NO: 315778 - DNA, 32 bp, Artificial Sequence
  Description of Artificial Sequence: Synthetic oligonucleotide
cttctcgctcaagaagcaagtcttgaaccctc

SEQ ID NO: 315779 - DNA, 32 bp, Artificial Sequence
  Description of Artificial Sequence: Synthetic oligonucleotide
ttctcgctcaagaagcaagtcttgaaccctcc

SEQ ID NO: 315780 - DNA, 31 bp, Artificial Sequence
  Description of Artificial Sequence: Synthetic oligonucleotide
tctcgctcaagaagcaagtcttgaaccctcc

SEQ ID NO: 315781 - DNA, 30 bp, Artificial Sequence
  Description of Artificial Sequence: Synthetic oligonucleotide
ctcgctcaagaagcaagtcttgaaccctcc

SEQ ID NO: 315782 - DNA, 30 bp, Artificial Sequence
  Description of Artificial Sequence: Synthetic oligonucleotide
tcgctcaagaagcaagtcttgaaccctccc

SEQ ID NO: 315783 - DNA, 29 bp, Artificial Sequence
  Description of Artificial Sequence: Synthetic oligonucleotide
cgctcaagaagcaagtcttgaaccctccc

SEQ ID NO: 315784 - DNA, 32 bp, Artificial Sequence
  Description of Artificial Sequence: Synthetic oligonucleotide
gctcaagaagcaagtcttgaaccctccctaag

SEQ ID NO: 315785 - DNA, 33 bp, Artificial Sequence
  Description of Artificial Sequence: Synthetic oligonucleotide
ctcaagaagcaagtcttgaaccctccctaagag

SEQ ID NO: 315786 - DNA, 33 bp, Artificial Sequence
  Description of Artificial Sequence: Synthetic oligonucleotide
tcaagaagcaagtcttgaaccctccctaagagc

SEQ ID NO: 315787 - DNA, 32 bp, Artificial Sequence
  Description of Artificial Sequence: Synthetic oligonucleotide
caagaagcaagtcttgaaccctccctaagagc

SEQ ID NO: 315788 - DNA, 33 bp, Artificial Sequence
  Description of Artificial Sequence: Synthetic oligonucleotide
aagaagcaagtcttgaaccctccctaagagctg

SEQ ID NO: 315789 - DNA, 32 bp, Artificial Sequence
  Description of Artificial Sequence: Synthetic oligonucleotide
agaagcaagtcttgaaccctccctaagagctg

SEQ ID NO: 315790 - DNA, 31 bp, Artificial Sequence
  Description of Artificial Sequence: Synthetic oligonucleotide
gaagcaagtcttgaaccctccctaagagctg

SEQ ID NO: 315791 - DNA, 37 bp, Artificial Sequence
  Description of Artificial Sequence: Synthetic oligonucleotide
aagcaagtcttgaaccctccctaagagctgttttaag

SEQ ID NO: 315792 - DNA, 36 bp, Artificial Sequence
  Description of Artificial Sequence: Synthetic oligonucleotide
agcaagtcttgaaccctccctaagagctgttttaag

SEQ ID NO: 315793 - DNA, 35 bp, Artificial Sequence
  Description of Artificial Sequence: Synthetic oligonucleotide
gcaagtcttgaaccctccctaagagctgttttaag

SEQ ID NO: 315794 - DNA, 45 bp, Artificial Sequence
  Description of Artificial Sequence: Synthetic oligonucleotide
caagtcttgaaccctccctaagagctgttttaagttataattatg

SEQ ID NO: 315795 - DNA, 46 bp, Artificial Sequence
  Description of Artificial Sequence: Synthetic oligonucleotide
aagtcttgaaccctccctaagagctgttttaagttataattatgag

SEQ ID NO: 315796 - DNA, 45 bp, Artificial Sequence
  Description of Artificial Sequence: Synthetic oligonucleotide
agtcttgaaccctccctaagagctgttttaagttataattatgag

SEQ ID NO: 315797 - DNA, 44 bp, Artificial Sequence
  Description of Artificial Sequence: Synthetic oligonucleotide
gtcttgaaccctccctaagagctgttttaagttataattatgag

SEQ ID NO: 315798 - DNA, 44 bp, Artificial Sequence
  Description of Artificial Sequence: Synthetic oligonucleotide
tcttgaaccctccctaagagctgttttaagttataattatgagc

SEQ ID NO: 315799 - DNA, 43 bp, Artificial Sequence
  Description of Artificial Sequence: Synthetic oligonucleotide
cttgaaccctccctaagagctgttttaagttataattatgagc

SEQ ID NO: 315800 - DNA, 45 bp, Artificial Sequence
  Description of Artificial Sequence: Synthetic oligonucleotide
ttgaaccctccctaagagctgttttaagttataattatgagctag

SEQ ID NO: 315801 - DNA, 44 bp, Artificial Sequence
  Description of Artificial Sequence: Synthetic oligonucleotide
tgaaccctccctaagagctgttttaagttataattatgagctag

SEQ ID NO: 315802 - DNA, 43 bp, Artificial Sequence
  Description of Artificial Sequence: Synthetic oligonucleotide
gaaccctccctaagagctgttttaagttataattatgagctag

SEQ ID NO: 315803 - DNA, 43 bp, Artificial Sequence
  Description of Artificial Sequence: Synthetic oligonucleotide
aaccctccctaagagctgttttaagttataattatgagctagc

SEQ ID NO: 315804 - DNA, 42 bp, Artificial Sequence
  Description of Artificial Sequence: Synthetic oligonucleotide
accctccctaagagctgttttaagttataattatgagctagc

SEQ ID NO: 315805 - DNA, 41 bp, Artificial Sequence
  Description of Artificial Sequence: Synthetic oligonucleotide
ccctccctaagagctgttttaagttataattatgagctagc

SEQ ID NO: 315806 - DNA, 42 bp, Artificial Sequence
  Description of Artificial Sequence: Synthetic oligonucleotide
cctccctaagagctgttttaagttataattatgagctagcac

SEQ ID NO: 315807 - DNA, 42 bp, Artificial Sequence
  Description of Artificial Sequence: Synthetic oligonucleotide
ctccctaagagctgttttaagttataattatgagctagcacc

SEQ ID NO: 315808 - DNA, 42 bp, Artificial Sequence
  Description of Artificial Sequence: Synthetic oligonucleotide
tccctaagagctgttttaagttataattatgagctagcaccc

SEQ ID NO: 315809 - DNA, 41 bp, Artificial Sequence
  Description of Artificial Sequence: Synthetic oligonucleotide
ccctaagagctgttttaagttataattatgagctagcaccc

SEQ ID NO: 315810 - DNA, 43 bp, Artificial Sequence
  Description of Artificial Sequence: Synthetic oligonucleotide
cctaagagctgttttaagttataattatgagctagcacccaag

SEQ ID NO: 315811 - DNA, 44 bp, Artificial Sequence
  Description of Artificial Sequence: Synthetic oligonucleotide
ctaagagctgttttaagttataattatgagctagcacccaagac

SEQ ID NO: 315812 - DNA, 44 bp, Artificial Sequence
  Description of Artificial Sequence: Synthetic oligonucleotide
taagagctgttttaagttataattatgagctagcacccaagacg

SEQ ID NO: 315813 - DNA, 43 bp, Artificial Sequence
  Description of Artificial Sequence: Synthetic oligonucleotide
aagagctgttttaagttataattatgagctagcacccaagacg

SEQ ID NO: 315814 - DNA, 42 bp, Artificial Sequence
  Description of Artificial Sequence: Synthetic oligonucleotide
agagctgttttaagttataattatgagctagcacccaagacg

SEQ ID NO: 315815 - DNA, 41 bp, Artificial Sequence
  Description of Artificial Sequence: Synthetic oligonucleotide
gagctgttttaagttataattatgagctagcacccaagacg

SEQ ID NO: 315816 - DNA, 42 bp, Artificial Sequence
  Description of Artificial Sequence: Synthetic oligonucleotide
agctgttttaagttataattatgagctagcacccaagacgag

SEQ ID NO: 315817 - DNA, 41 bp, Artificial Sequence
  Description of Artificial Sequence: Synthetic oligonucleotide
gctgttttaagttataattatgagctagcacccaagacgag

SEQ ID NO: 315818 - DNA, 42 bp, Artificial Sequence
  Description of Artificial Sequence: Synthetic oligonucleotide
ctgttttaagttataattatgagctagcacccaagacgagac

SEQ ID NO: 315819 - DNA, 43 bp, Artificial Sequence
  Description of Artificial Sequence: Synthetic oligonucleotide
tgttttaagttataattatgagctagcacccaagacgagactg

SEQ ID NO: 315820 - DNA, 42 bp, Artificial Sequence
  Description of Artificial Sequence: Synthetic oligonucleotide
gttttaagttataattatgagctagcacccaagacgagactg

SEQ ID NO: 315821 - DNA, 42 bp, Artificial Sequence
  Description of Artificial Sequence: Synthetic oligonucleotide
ttttaagttataattatgagctagcacccaagacgagactgg

SEQ ID NO: 315822 - DNA, 41 bp, Artificial Sequence
  Description of Artificial Sequence: Synthetic oligonucleotide
tttaagttataattatgagctagcacccaagacgagactgg

SEQ ID NO: 315823 - DNA, 40 bp, Artificial Sequence
  Description of Artificial Sequence: Synthetic oligonucleotide
ttaagttataattatgagctagcacccaagacgagactgg

SEQ ID NO: 315824 - DNA, 39 bp, Artificial Sequence
  Description of Artificial Sequence: Synthetic oligonucleotide
taagttataattatgagctagcacccaagacgagactgg

SEQ ID NO: 315825 - DNA, 38 bp, Artificial Sequence
  Description of Artificial Sequence: Synthetic oligonucleotide
aagttataattatgagctagcacccaagacgagactgg

SEQ ID NO: 315826 - DNA, 37 bp, Artificial Sequence
  Description of Artificial Sequence: Synthetic oligonucleotide
agttataattatgagctagcacccaagacgagactgg

SEQ ID NO: 315827 - DNA, 36 bp, Artificial Sequence
  Description of Artificial Sequence: Synthetic oligonucleotide
gttataattatgagctagcacccaagacgagactgg

SEQ ID NO: 315828 - DNA, 38 bp, Artificial Sequence
  Description of Artificial Sequence: Synthetic oligonucleotide
ttataattatgagctagcacccaagacgagactggtag

SEQ ID NO: 315829 - DNA, 37 bp, Artificial Sequence
  Description of Artificial Sequence: Synthetic oligonucleotide
tataattatgagctagcacccaagacgagactggtag

SEQ ID NO: 315830 - DNA, 36 bp, Artificial Sequence
  Description of Artificial Sequence: Synthetic oligonucleotide
ataattatgagctagcacccaagacgagactggtag

SEQ ID NO: 315831 - DNA, 35 bp, Artificial Sequence
  Description of Artificial Sequence: Synthetic oligonucleotide
taattatgagctagcacccaagacgagactggtag

SEQ ID NO: 315832 - DNA, 34 bp, Artificial Sequence
  Description of Artificial Sequence: Synthetic oligonucleotide
aattatgagctagcacccaagacgagactggtag

SEQ ID NO: 315833 - DNA, 33 bp, Artificial Sequence
  Description of Artificial Sequence: Synthetic oligonucleotide
attatgagctagcacccaagacgagactggtag

SEQ ID NO: 315834 - DNA, 32 bp, Artificial Sequence
  Description of Artificial Sequence: Synthetic oligonucleotide
ttatgagctagcacccaagacgagactggtag

SEQ ID NO: 315835 - DNA, 31 bp, Artificial Sequence
  Description of Artificial Sequence: Synthetic oligonucleotide
tatgagctagcacccaagacgagactggtag

SEQ ID NO: 315836 - DNA, 30 bp, Artificial Sequence
  Description of Artificial Sequence: Synthetic oligonucleotide
atgagctagcacccaagacgagactggtag

SEQ ID NO: 315837 - DNA, 29 bp, Artificial Sequence
  Description of Artificial Sequence: Synthetic oligonucleotide
tgagctagcacccaagacgagactggtag

SEQ ID NO: 315838 - DNA, 28 bp, Artificial Sequence
  Description of Artificial Sequence: Synthetic oligonucleotide
gagctagcacccaagacgagactggtag

SEQ ID NO: 315839 - DNA, 28 bp, Artificial Sequence
  Description of Artificial Sequence: Synthetic oligonucleotide
agctagcacccaagacgagactggtagc

SEQ ID NO: 315840 - DNA, 27 bp, Artificial Sequence
  Description of Artificial Sequence: Synthetic oligonucleotide
gctagcacccaagacgagactggtagc

SEQ ID NO: 315841 - DNA, 28 bp, Artificial Sequence
  Description of Artificial Sequence: Synthetic oligonucleotide
ctagcacccaagacgagactggtagcag

SEQ ID NO: 315842 - DNA, 30 bp, Artificial Sequence
  Description of Artificial Sequence: Synthetic oligonucleotide
tagcacccaagacgagactggtagcagttg

SEQ ID NO: 315843 - DNA, 29 bp, Artificial Sequence
  Description of Artificial Sequence: Synthetic oligonucleotide
agcacccaagacgagactggtagcagttg

SEQ ID NO: 315844 - DNA, 28 bp, Artificial Sequence
  Description of Artificial Sequence: Synthetic oligonucleotide
gcacccaagacgagactggtagcagttg

SEQ ID NO: 315845 - DNA, 29 bp, Artificial Sequence
  Description of Artificial Sequence: Synthetic oligonucleotide
cacccaagacgagactggtagcagttgag

SEQ ID NO: 315846 - DNA, 29 bp, Artificial Sequence
  Description of Artificial Sequence: Synthetic oligonucleotide
acccaagacgagactggtagcagttgagc

SEQ ID NO: 315847 - DNA, 28 bp, Artificial Sequence
  Description of Artificial Sequence: Synthetic oligonucleotide
cccaagacgagactggtagcagttgagc

SEQ ID NO: 315848 - DNA, 29 bp, Artificial Sequence
  Description of Artificial Sequence: Synthetic oligonucleotide
ccaagacgagactggtagcagttgagctc

SEQ ID NO: 315849 - DNA, 31 bp, Artificial Sequence
  Description of Artificial Sequence: Synthetic oligonucleotide
caagacgagactggtagcagttgagctcaac

SEQ ID NO: 315850 - DNA, 32 bp, Artificial Sequence
  Description of Artificial Sequence: Synthetic oligonucleotide
aagacgagactggtagcagttgagctcaactg

SEQ ID NO: 315851 - DNA, 31 bp, Artificial Sequence
  Description of Artificial Sequence: Synthetic oligonucleotide
agacgagactggtagcagttgagctcaactg

SEQ ID NO: 315852 - DNA, 30 bp, Artificial Sequence
  Description of Artificial Sequence: Synthetic oligonucleotide
gacgagactggtagcagttgagctcaactg

SEQ ID NO: 315853 - DNA, 30 bp, Artificial Sequence
  Description of Artificial Sequence: Synthetic oligonucleotide
acgagactggtagcagttgagctcaactgg

SEQ ID NO: 315854 - DNA, 29 bp, Artificial Sequence
  Description of Artificial Sequence: Synthetic oligonucleotide
cgagactggtagcagttgagctcaactgg

SEQ ID NO: 315855 - DNA, 29 bp, Artificial Sequence
  Description of Artificial Sequence: Synthetic oligonucleotide
gagactggtagcagttgagctcaactggg

SEQ ID NO: 315856 - DNA, 31 bp, Artificial Sequence
  Description of Artificial Sequence: Synthetic oligonucleotide
agactggtagcagttgagctcaactgggtac

SEQ ID NO: 315857 - DNA, 30 bp, Artificial Sequence
  Description of Artificial Sequence: Synthetic oligonucleotide
gactggtagcagttgagctcaactgggtac

SEQ ID NO: 315858 - DNA, 30 bp, Artificial Sequence
  Description of Artificial Sequence: Synthetic oligonucleotide
actggtagcagttgagctcaactgggtacc

SEQ ID NO: 315859 - DNA, 29 bp, Artificial Sequence
  Description of Artificial Sequence: Synthetic oligonucleotide
ctggtagcagttgagctcaactgggtacc

SEQ ID NO: 315860 - DNA, 30 bp, Artificial Sequence
  Description of Artificial Sequence: Synthetic oligonucleotide
tggtagcagttgagctcaactgggtacctg

SEQ ID NO: 315861 - DNA, 29 bp, Artificial Sequence
  Description of Artificial Sequence: Synthetic oligonucleotide
ggtagcagttgagctcaactgggtacctg

SEQ ID NO: 315862 - DNA, 30 bp, Artificial Sequence
  Description of Artificial Sequence: Synthetic oligonucleotide
gtagcagttgagctcaactgggtacctgag

SEQ ID NO: 315863 - DNA, 30 bp, Artificial Sequence
  Description of Artificial Sequence: Synthetic oligonucleotide
tagcagttgagctcaactgggtacctgagc

SEQ ID NO: 315864 - DNA, 29 bp, Artificial Sequence
  Description of Artificial Sequence: Synthetic oligonucleotide
agcagttgagctcaactgggtacctgagc

SEQ ID NO: 315865 - DNA, 28 bp, Artificial Sequence
  Description of Artificial Sequence: Synthetic oligonucleotide
gcagttgagctcaactgggtacctgagc

SEQ ID NO: 315866 - DNA, 29 bp, Artificial Sequence
  Description of Artificial Sequence: Synthetic oligonucleotide
cagttgagctcaactgggtacctgagcag

SEQ ID NO: 315867 - DNA, 35 bp, Artificial Sequence
  Description of Artificial Sequence: Synthetic oligonucleotide
agttgagctcaactgggtacctgagcagatataac

SEQ ID NO: 315868 - DNA, 34 bp, Artificial Sequence
  Description of Artificial Sequence: Synthetic oligonucleotide
gttgagctcaactgggtacctgagcagatataac

SEQ ID NO: 315869 - DNA, 35 bp, Artificial Sequence
  Description of Artificial Sequence: Synthetic oligonucleotide
ttgagctcaactgggtacctgagcagatataactg

SEQ ID NO: 315870 - DNA, 34 bp, Artificial Sequence
  Description of Artificial Sequence: Synthetic oligonucleotide
tgagctcaactgggtacctgagcagatataactg

SEQ ID NO: 315871 - DNA, 33 bp, Artificial Sequence
  Description of Artificial Sequence: Synthetic oligonucleotide
gagctcaactgggtacctgagcagatataactg

SEQ ID NO: 315872 - DNA, 34 bp, Artificial Sequence
  Description of Artificial Sequence: Synthetic oligonucleotide
agctcaactgggtacctgagcagatataactgac

SEQ ID NO: 315873 - DNA, 33 bp, Artificial Sequence
  Description of Artificial Sequence: Synthetic oligonucleotide
gctcaactgggtacctgagcagatataactgac

SEQ ID NO: 315874 - DNA, 34 bp, Artificial Sequence
  Description of Artificial Sequence: Synthetic oligonucleotide
ctcaactgggtacctgagcagatataactgacag

SEQ ID NO: 315875 - DNA, 34 bp, Artificial Sequence
  Description of Artificial Sequence: Synthetic oligonucleotide
tcaactgggtacctgagcagatataactgacagc

SEQ ID NO: 315876 - DNA, 33 bp, Artificial Sequence
  Description of Artificial Sequence: Synthetic oligonucleotide
caactgggtacctgagcagatataactgacagc

SEQ ID NO: 315877 - DNA, 34 bp, Artificial Sequence
  Description of Artificial Sequence: Synthetic oligonucleotide
aactgggtacctgagcagatataactgacagctg

SEQ ID NO: 315878 - DNA, 33 bp, Artificial Sequence
  Description of Artificial Sequence: Synthetic oligonucleotide
actgggtacctgagcagatataactgacagctg

SEQ ID NO: 315879 - DNA, 32 bp, Artificial Sequence
  Description of Artificial Sequence: Synthetic oligonucleotide
ctgggtacctgagcagatataactgacagctg

SEQ ID NO: 315880 - DNA, 32 bp, Artificial Sequence
  Description of Artificial Sequence: Synthetic oligonucleotide
tgggtacctgagcagatataactgacagctgc

SEQ ID NO: 315881 - DNA, 31 bp, Artificial Sequence
  Description of Artificial Sequence: Synthetic oligonucleotide
gggtacctgagcagatataactgacagctgc

SEQ ID NO: 315882 - DNA, 36 bp, Artificial Sequence
  Description of Artificial Sequence: Synthetic oligonucleotide
ggtacctgagcagatataactgacagctgctataag

SEQ ID NO: 315883 - DNA, 36 bp, Artificial Sequence
  Description of Artificial Sequence: Synthetic oligonucleotide
gtacctgagcagatataactgacagctgctataagc

SEQ ID NO: 315884 - DNA, 38 bp, Artificial Sequence
  Description of Artificial Sequence: Synthetic oligonucleotide
tacctgagcagatataactgacagctgctataagcttc

SEQ ID NO: 315885 - DNA, 37 bp, Artificial Sequence
  Description of Artificial Sequence: Synthetic oligonucleotide
acctgagcagatataactgacagctgctataagcttc

SEQ ID NO: 315886 - DNA, 36 bp, Artificial Sequence
  Description of Artificial Sequence: Synthetic oligonucleotide
cctgagcagatataactgacagctgctataagcttc

SEQ ID NO: 315887 - DNA, 36 bp, Artificial Sequence
  Description of Artificial Sequence: Synthetic oligonucleotide
ctgagcagatataactgacagctgctataagcttcc

SEQ ID NO: 315888 - DNA, 37 bp, Artificial Sequence
  Description of Artificial Sequence: Synthetic oligonucleotide
tgagcagatataactgacagctgctataagcttccac

SEQ ID NO: 315889 - DNA, 36 bp, Artificial Sequence
  Description of Artificial Sequence: Synthetic oligonucleotide
gagcagatataactgacagctgctataagcttccac

SEQ ID NO: 315890 - DNA, 36 bp, Artificial Sequence
  Description of Artificial Sequence: Synthetic oligonucleotide
agcagatataactgacagctgctataagcttccacc

SEQ ID NO: 315891 - DNA, 35 bp, Artificial Sequence
  Description of Artificial Sequence: Synthetic oligonucleotide
gcagatataactgacagctgctataagcttccacc

SEQ ID NO: 315892 - DNA, 37 bp, Artificial Sequence
  Description of Artificial Sequence: Synthetic oligonucleotide
cagatataactgacagctgctataagcttccaccaag

SEQ ID NO: 315893 - DNA, 41 bp, Artificial Sequence
  Description of Artificial Sequence: Synthetic oligonucleotide
agatataactgacagctgctataagcttccaccaagaaatg

SEQ ID NO: 315894 - DNA, 40 bp, Artificial Sequence
  Description of Artificial Sequence: Synthetic oligonucleotide
gatataactgacagctgctataagcttccaccaagaaatg

SEQ ID NO: 315895 - DNA, 40 bp, Artificial Sequence
  Description of Artificial Sequence: Synthetic oligonucleotide
atataactgacagctgctataagcttccaccaagaaatgg

SEQ ID NO: 315896 - DNA, 39 bp, Artificial Sequence
  Description of Artificial Sequence: Synthetic oligonucleotide
tataactgacagctgctataagcttccaccaagaaatgg

SEQ ID NO: 315897 - DNA, 38 bp, Artificial Sequence
  Description of Artificial Sequence: Synthetic oligonucleotide
ataactgacagctgctataagcttccaccaagaaatgg

SEQ ID NO: 315898 - DNA, 37 bp, Artificial Sequence
  Description of Artificial Sequence: Synthetic oligonucleotide
taactgacagctgctataagcttccaccaagaaatgg

SEQ ID NO: 315899 - DNA, 36 bp, Artificial Sequence
  Description of Artificial Sequence: Synthetic oligonucleotide
aactgacagctgctataagcttccaccaagaaatgg

SEQ ID NO: 315900 - DNA, 35 bp, Artificial Sequence
  Description of Artificial Sequence: Synthetic oligonucleotide
actgacagctgctataagcttccaccaagaaatgg

SEQ ID NO: 315901 - DNA, 34 bp, Artificial Sequence
  Description of Artificial Sequence: Synthetic oligonucleotide
ctgacagctgctataagcttccaccaagaaatgg

SEQ ID NO: 315902 - DNA, 36 bp, Artificial Sequence
  Description of Artificial Sequence: Synthetic oligonucleotide
tgacagctgctataagcttccaccaagaaatggatc

SEQ ID NO: 315903 - DNA, 35 bp, Artificial Sequence
  Description of Artificial Sequence: Synthetic oligonucleotide
gacagctgctataagcttccaccaagaaatggatc

SEQ ID NO: 315904 - DNA, 35 bp, Artificial Sequence
  Description of Artificial Sequence: Synthetic oligonucleotide
acagctgctataagcttccaccaagaaatggatcc

SEQ ID NO: 315905 - DNA, 34 bp, Artificial Sequence
  Description of Artificial Sequence: Synthetic oligonucleotide
cagctgctataagcttccaccaagaaatggatcc

SEQ ID NO: 315906 - DNA, 34 bp, Artificial Sequence
  Description of Artificial Sequence: Synthetic oligonucleotide
agctgctataagcttccaccaagaaatggatccc

SEQ ID NO: 315907 - DNA, 33 bp, Artificial Sequence
  Description of Artificial Sequence: Synthetic oligonucleotide
gctgctataagcttccaccaagaaatggatccc

SEQ ID NO: 315908 - DNA, 34 bp, Artificial Sequence
  Description of Artificial Sequence: Synthetic oligonucleotide
ctgctataagcttccaccaagaaatggatccctg

SEQ ID NO: 315909 - DNA, 36 bp, Artificial Sequence
  Description of Artificial Sequence: Synthetic oligonucleotide
tgctataagcttccaccaagaaatggatccctgatg

SEQ ID NO: 315910 - DNA, 35 bp, Artificial Sequence
  Description of Artificial Sequence: Synthetic oligonucleotide
gctataagcttccaccaagaaatggatccctgatg

SEQ ID NO: 315911 - DNA, 35 bp, Artificial Sequence
  Description of Artificial Sequence: Synthetic oligonucleotide
ctataagcttccaccaagaaatggatccctgatgc

SEQ ID NO: 315912 - DNA, 39 bp, Artificial Sequence
  Description of Artificial Sequence: Synthetic oligonucleotide
tataagcttccaccaagaaatggatccctgatgctatag

SEQ ID NO: 315913 - DNA, 38 bp, Artificial Sequence
  Description of Artificial Sequence: Synthetic oligonucleotide
ataagcttccaccaagaaatggatccctgatgctatag

SEQ ID NO: 315914 - DNA, 37 bp, Artificial Sequence
  Description of Artificial Sequence: Synthetic oligonucleotide
taagcttccaccaagaaatggatccctgatgctatag

SEQ ID NO: 315915 - DNA, 36 bp, Artificial Sequence
  Description of Artificial Sequence: Synthetic oligonucleotide
aagcttccaccaagaaatggatccctgatgctatag

SEQ ID NO: 315916 - DNA, 35 bp, Artificial Sequence
  Description of Artificial Sequence: Synthetic oligonucleotide
agcttccaccaagaaatggatccctgatgctatag

SEQ ID NO: 315917 - DNA, 34 bp, Artificial Sequence
  Description of Artificial Sequence: Synthetic oligonucleotide
gcttccaccaagaaatggatccctgatgctatag

SEQ ID NO: 315918 - DNA, 34 bp, Artificial Sequence
  Description of Artificial Sequence: Synthetic oligonucleotide
cttccaccaagaaatggatccctgatgctatagc

SEQ ID NO: 315919 - DNA, 38 bp, Artificial Sequence
  Description of Artificial Sequence: Synthetic oligonucleotide
ttccaccaagaaatggatccctgatgctatagctaatg

SEQ ID NO: 315920 - DNA, 37 bp, Artificial Sequence
  Description of Artificial Sequence: Synthetic oligonucleotide
tccaccaagaaatggatccctgatgctatagctaatg

SEQ ID NO: 315921 - DNA, 36 bp, Artificial Sequence
  Description of Artificial Sequence: Synthetic oligonucleotide
ccaccaagaaatggatccctgatgctatagctaatg

SEQ ID NO: 315922 - DNA, 36 bp, Artificial Sequence
  Description of Artificial Sequence: Synthetic oligonucleotide
caccaagaaatggatccctgatgctatagctaatgc

SEQ ID NO: 315923 - DNA, 38 bp, Artificial Sequence
  Description of Artificial Sequence: Synthetic oligonucleotide
accaagaaatggatccctgatgctatagctaatgcatc

SEQ ID NO: 315924 - DNA, 37 bp, Artificial Sequence
  Description of Artificial Sequence: Synthetic oligonucleotide
ccaagaaatggatccctgatgctatagctaatgcatc

SEQ ID NO: 315925 - DNA, 38 bp, Artificial Sequence
  Description of Artificial Sequence: Synthetic oligonucleotide
caagaaatggatccctgatgctatagctaatgcatctc

SEQ ID NO: 315926 - DNA, 39 bp, Artificial Sequence
  Description of Artificial Sequence: Synthetic oligonucleotide
aagaaatggatccctgatgctatagctaatgcatctctg

SEQ ID NO: 315927 - DNA, 38 bp, Artificial Sequence
  Description of Artificial Sequence: Synthetic oligonucleotide
agaaatggatccctgatgctatagctaatgcatctctg

SEQ ID NO: 315928 - DNA, 37 bp, Artificial Sequence
  Description of Artificial Sequence: Synthetic oligonucleotide
gaaatggatccctgatgctatagctaatgcatctctg

SEQ ID NO: 315929 - DNA, 38 bp, Artificial Sequence
  Description of Artificial Sequence: Synthetic oligonucleotide
aaatggatccctgatgctatagctaatgcatctctgtc

SEQ ID NO: 315930 - DNA, 37 bp, Artificial Sequence
  Description of Artificial Sequence: Synthetic oligonucleotide
aatggatccctgatgctatagctaatgcatctctgtc

SEQ ID NO: 315931 - DNA, 36 bp, Artificial Sequence
  Description of Artificial Sequence: Synthetic oligonucleotide
atggatccctgatgctatagctaatgcatctctgtc

SEQ ID NO: 315932 - DNA, 35 bp, Artificial Sequence
  Description of Artificial Sequence: Synthetic oligonucleotide
tggatccctgatgctatagctaatgcatctctgtc

SEQ ID NO: 315933 - DNA, 34 bp, Artificial Sequence
  Description of Artificial Sequence: Synthetic oligonucleotide
ggatccctgatgctatagctaatgcatctctgtc

SEQ ID NO: 315934 - DNA, 34 bp, Artificial Sequence
  Description of Artificial Sequence: Synthetic oligonucleotide
gatccctgatgctatagctaatgcatctctgtcc

SEQ ID NO: 315935 - DNA, 39 bp, Artificial Sequence
  Description of Artificial Sequence: Synthetic oligonucleotide
atccctgatgctatagctaatgcatctctgtcctttttg

SEQ ID NO: 315936 - DNA, 38 bp, Artificial Sequence
  Description of Artificial Sequence: Synthetic oligonucleotide
tccctgatgctatagctaatgcatctctgtcctttttg

SEQ ID NO: 315937 - DNA, 37 bp, Artificial Sequence
  Description of Artificial Sequence: Synthetic oligonucleotide
ccctgatgctatagctaatgcatctctgtcctttttg

SEQ ID NO: 315938 - DNA, 38 bp, Artificial Sequence
  Description of Artificial Sequence: Synthetic oligonucleotide
cctgatgctatagctaatgcatctctgtcctttttgtc

SEQ ID NO: 315939 - DNA, 38 bp, Artificial Sequence
  Description of Artificial Sequence: Synthetic oligonucleotide
ctgatgctatagctaatgcatctctgtcctttttgtcc

SEQ ID NO: 315940 - DNA, 39 bp, Artificial Sequence
  Description of Artificial Sequence: Synthetic oligonucleotide
tgatgctatagctaatgcatctctgtcctttttgtccag

SEQ ID NO: 315941 - DNA, 38 bp, Artificial Sequence
  Description of Artificial Sequence: Synthetic oligonucleotide
gatgctatagctaatgcatctctgtcctttttgtccag

SEQ ID NO: 315942 - DNA, 39 bp, Artificial Sequence
  Description of Artificial Sequence: Synthetic oligonucleotide
atgctatagctaatgcatctctgtcctttttgtccagtg

SEQ ID NO: 315943 - DNA, 38 bp, Artificial Sequence
  Description of Artificial Sequence: Synthetic oligonucleotide
tgctatagctaatgcatctctgtcctttttgtccagtg

SEQ ID NO: 315944 - DNA, 37 bp, Artificial Sequence
  Description of Artificial Sequence: Synthetic oligonucleotide
gctatagctaatgcatctctgtcctttttgtccagtg

SEQ ID NO: 315945 - DNA, 38 bp, Artificial Sequence
  Description of Artificial Sequence: Synthetic oligonucleotide
ctatagctaatgcatctctgtcctttttgtccagtgtc

SEQ ID NO: 315946 - DNA, 40 bp, Artificial Sequence
  Description of Artificial Sequence: Synthetic oligonucleotide
tatagctaatgcatctctgtcctttttgtccagtgtcaac

SEQ ID NO: 315947 - DNA, 39 bp, Artificial Sequence
  Description of Artificial Sequence: Synthetic oligonucleotide
atagctaatgcatctctgtcctttttgtccagtgtcaac

SEQ ID NO: 315948 - DNA, 38 bp, Artificial Sequence
  Description of Artificial Sequence: Synthetic oligonucleotide
tagctaatgcatctctgtcctttttgtccagtgtcaac

SEQ ID NO: 315949 - DNA, 37 bp, Artificial Sequence
  Description of Artificial Sequence: Synthetic oligonucleotide
agctaatgcatctctgtcctttttgtccagtgtcaac

SEQ ID NO: 315950 - DNA, 36 bp, Artificial Sequence
  Description of Artificial Sequence: Synthetic oligonucleotide
gctaatgcatctctgtcctttttgtccagtgtcaac

SEQ ID NO: 315951 - DNA, 38 bp, Artificial Sequence
  Description of Artificial Sequence: Synthetic oligonucleotide
ctaatgcatctctgtcctttttgtccagtgtcaacatc

SEQ ID NO: 315952 - DNA, 42 bp, Artificial Sequence
  Description of Artificial Sequence: Synthetic oligonucleotide
taatgcatctctgtcctttttgtccagtgtcaacatcttttc

SEQ ID NO: 315953 - DNA, 41 bp, Artificial Sequence
  Description of Artificial Sequence: Synthetic oligonucleotide
aatgcatctctgtcctttttgtccagtgtcaacatcttttc

SEQ ID NO: 315954 - DNA, 40 bp, Artificial Sequence
  Description of Artificial Sequence: Synthetic oligonucleotide
atgcatctctgtcctttttgtccagtgtcaacatcttttc

SEQ ID NO: 315955 - DNA, 39 bp, Artificial Sequence
  Description of Artificial Sequence: Synthetic oligonucleotide
tgcatctctgtcctttttgtccagtgtcaacatcttttc

SEQ ID NO: 315956 - DNA, 38 bp, Artificial Sequence
  Description of Artificial Sequence: Synthetic oligonucleotide
gcatctctgtcctttttgtccagtgtcaacatcttttc

SEQ ID NO: 315957 - DNA, 38 bp, Artificial Sequence
  Description of Artificial Sequence: Synthetic oligonucleotide
catctctgtcctttttgtccagtgtcaacatcttttcg

SEQ ID NO: 315958 - DNA, 42 bp, Artificial Sequence
  Description of Artificial Sequence: Synthetic oligonucleotide
atctctgtcctttttgtccagtgtcaacatcttttcgaaaag

SEQ ID NO: 315959 - DNA, 41 bp, Artificial Sequence
  Description of Artificial Sequence: Synthetic oligonucleotide
tctctgtcctttttgtccagtgtcaacatcttttcgaaaag

SEQ ID NO: 315960 - DNA, 40 bp, Artificial Sequence
  Description of Artificial Sequence: Synthetic oligonucleotide
ctctgtcctttttgtccagtgtcaacatcttttcgaaaag

SEQ ID NO: 315961 - DNA, 40 bp, Artificial Sequence
  Description of Artificial Sequence: Synthetic oligonucleotide
tctgtcctttttgtccagtgtcaacatcttttcgaaaagc

SEQ ID NO: 315962 - DNA, 39 bp, Artificial Sequence
  Description of Artificial Sequence: Synthetic oligonucleotide
ctgtcctttttgtccagtgtcaacatcttttcgaaaagc

SEQ ID NO: 315963 - DNA, 40 bp, Artificial Sequence
  Description of Artificial Sequence: Synthetic oligonucleotide
tgtcctttttgtccagtgtcaacatcttttcgaaaagcag

SEQ ID NO: 315964 - DNA, 39 bp, Artificial Sequence
  Description of Artificial Sequence: Synthetic oligonucleotide
gtcctttttgtccagtgtcaacatcttttcgaaaagcag

SEQ ID NO: 315965 - DNA, 40 bp, Artificial Sequence
  Description of Artificial Sequence: Synthetic oligonucleotide
tcctttttgtccagtgtcaacatcttttcgaaaagcagac

SEQ ID NO: 315966 - DNA, 39 bp, Artificial Sequence
  Description of Artificial Sequence: Synthetic oligonucleotide
cctttttgtccagtgtcaacatcttttcgaaaagcagac

SEQ ID NO: 315967 - DNA, 26 bp, Artificial Sequence
  Description of Artificial Sequence: Synthetic oligonucleotide
atggggaacagtctgcacacggcgga

SEQ ID NO: 315968 - DNA, 25 bp, Artificial Sequence
  Description of Artificial Sequence: Synthetic oligonucleotide
tggggaacagtctgcacacggcgga

SEQ ID NO: 315969 - DNA, 24 bp, Artificial Sequence
  Description of Artificial Sequence: Synthetic oligonucleotide
ggggaacagtctgcacacggcgga

SEQ ID NO: 315970 - DNA, 24 bp, Artificial Sequence
  Description of Artificial Sequence: Synthetic oligonucleotide
gggaacagtctgcacacggcggag

SEQ ID NO: 315971 - DNA, 25 bp, Artificial Sequence
  Description of Artificial Sequence: Synthetic oligonucleotide
ggaacagtctgcacacggcggagct

SEQ ID NO: 315972 - DNA, 26 bp, Artificial Sequence
  Description of Artificial Sequence: Synthetic oligonucleotide
gaacagtctgcacacggcggagctgt

SEQ ID NO: 315973 - DNA, 26 bp, Artificial Sequence
  Description of Artificial Sequence: Synthetic oligonucleotide
aacagtctgcacacggcggagctgtc

SEQ ID NO: 315974 - DNA, 25 bp, Artificial Sequence
  Description of Artificial Sequence: Synthetic oligonucleotide
acagtctgcacacggcggagctgtc

SEQ ID NO: 315975 - DNA, 24 bp, Artificial Sequence
  Description of Artificial Sequence: Synthetic oligonucleotide
cagtctgcacacggcggagctgtc

SEQ ID NO: 315976 - DNA, 24 bp, Artificial Sequence
  Description of Artificial Sequence: Synthetic oligonucleotide
agtctgcacacggcggagctgtcc

SEQ ID NO: 315977 - DNA, 23 bp, Artificial Sequence
  Description of Artificial Sequence: Synthetic oligonucleotide
gtctgcacacggcggagctgtcc

SEQ ID NO: 315978 - DNA, 23 bp, Artificial Sequence
  Description of Artificial Sequence: Synthetic oligonucleotide
tctgcacacggcggagctgtccc

SEQ ID NO: 315979 - DNA, 22 bp, Artificial Sequence
  Description of Artificial Sequence: Synthetic oligonucleotide
ctgcacacggcggagctgtccc

SEQ ID NO: 315980 - DNA, 22 bp, Artificial Sequence
  Description of Artificial Sequence: Synthetic oligonucleotide
tgcacacggcggagctgtcccc

SEQ ID NO: 315981 - DNA, 21 bp, Artificial Sequence
  Description of Artificial Sequence: Synthetic oligonucleotide
gcacacggcggagctgtcccc

SEQ ID NO: 315982 - DNA, 22 bp, Artificial Sequence
  Description of Artificial Sequence: Synthetic oligonucleotide
cacacggcggagctgtccccct

SEQ ID NO: 315983 - DNA, 24 bp, Artificial Sequence
  Description of Artificial Sequence: Synthetic oligonucleotide
acacggcggagctgtccccctcat

SEQ ID NO: 315984 - DNA, 23 bp, Artificial Sequence
  Description of Artificial Sequence: Synthetic oligonucleotide
cacggcggagctgtccccctcat

SEQ ID NO: 315985 - DNA, 24 bp, Artificial Sequence
  Description of Artificial Sequence: Synthetic oligonucleotide
acggcggagctgtccccctcatct

SEQ ID NO: 315986 - DNA, 23 bp, Artificial Sequence
  Description of Artificial Sequence: Synthetic oligonucleotide
cggcggagctgtccccctcatct

SEQ ID NO: 315987 - DNA, 24 bp, Artificial Sequence
  Description of Artificial Sequence: Synthetic oligonucleotide
ggcggagctgtccccctcatctga

SEQ ID NO: 315988 - DNA, 26 bp, Artificial Sequence
  Description of Artificial Sequence: Synthetic oligonucleotide
gcggagctgtccccctcatctgagaa

SEQ ID NO: 315989 - DNA, 27 bp, Artificial Sequence
  Description of Artificial Sequence: Synthetic oligonucleotide
cggagctgtccccctcatctgagaact

SEQ ID NO: 315990 - DNA, 27 bp, Artificial Sequence
  Description of Artificial Sequence: Synthetic oligonucleotide
ggagctgtccccctcatctgagaactg

SEQ ID NO: 315991 - DNA, 29 bp, Artificial Sequence
  Description of Artificial Sequence: Synthetic oligonucleotide
gagctgtccccctcatctgagaactgaag

SEQ ID NO: 315992 - DNA, 30 bp, Artificial Sequence
  Description of Artificial Sequence: Synthetic oligonucleotide
agctgtccccctcatctgagaactgaagtc

SEQ ID NO: 315993 - DNA, 29 bp, Artificial Sequence
  Description of Artificial Sequence: Synthetic oligonucleotide
gctgtccccctcatctgagaactgaagtc

SEQ ID NO: 315994 - DNA, 30 bp, Artificial Sequence
  Description of Artificial Sequence: Synthetic oligonucleotide
ctgtccccctcatctgagaactgaagtcag

SEQ ID NO: 315995 - DNA, 30 bp, Artificial Sequence
  Description of Artificial Sequence: Synthetic oligonucleotide
tgtccccctcatctgagaactgaagtcagc

SEQ ID NO: 315996 - DNA, 29 bp, Artificial Sequence
  Description of Artificial Sequence: Synthetic oligonucleotide
gtccccctcatctgagaactgaagtcagc

SEQ ID NO: 315997 - DNA, 30 bp, Artificial Sequence
  Description of Artificial Sequence: Synthetic oligonucleotide
tccccctcatctgagaactgaagtcagctc

SEQ ID NO: 315998 - DNA, 29 bp, Artificial Sequence
  Description of Artificial Sequence: Synthetic oligonucleotide
ccccctcatctgagaactgaagtcagctc

SEQ ID NO: 315999 - DNA, 29 bp, Artificial Sequence
  Description of Artificial Sequence: Synthetic oligonucleotide
cccctcatctgagaactgaagtcagctcg

SEQ ID NO: 316000 - DNA, 30 bp, Artificial Sequence
  Description of Artificial Sequence: Synthetic oligonucleotide
ccctcatctgagaactgaagtcagctcgac

SEQ ID NO: 316001 - DNA, 32 bp, Artificial Sequence
  Description of Artificial Sequence: Synthetic oligonucleotide
cctcatctgagaactgaagtcagctcgacttc

SEQ ID NO: 316002 - DNA, 32 bp, Artificial Sequence
  Description of Artificial Sequence: Synthetic oligonucleotide
ctcatctgagaactgaagtcagctcgacttcg

SEQ ID NO: 316003 - DNA, 34 bp, Artificial Sequence
  Description of Artificial Sequence: Synthetic oligonucleotide
tcatctgagaactgaagtcagctcgacttcgaac

SEQ ID NO: 316004 - DNA, 33 bp, Artificial Sequence
  Description of Artificial Sequence: Synthetic oligonucleotide
catctgagaactgaagtcagctcgacttcgaac

SEQ ID NO: 316005 - DNA, 35 bp, Artificial Sequence
  Description of Artificial Sequence: Synthetic oligonucleotide
atctgagaactgaagtcagctcgacttcgaacatg

SEQ ID NO: 316006 - DNA, 34 bp, Artificial Sequence
  Description of Artificial Sequence: Synthetic oligonucleotide
tctgagaactgaagtcagctcgacttcgaacatg

SEQ ID NO: 316007 - DNA, 33 bp, Artificial Sequence
  Description of Artificial Sequence: Synthetic oligonucleotide
ctgagaactgaagtcagctcgacttcgaacatg

SEQ ID NO: 316008 - DNA, 36 bp, Artificial Sequence
  Description of Artificial Sequence: Synthetic oligonucleotide
tgagaactgaagtcagctcgacttcgaacatgtatg

SEQ ID NO: 316009 - DNA, 35 bp, Artificial Sequence
  Description of Artificial Sequence: Synthetic oligonucleotide
gagaactgaagtcagctcgacttcgaacatgtatg

SEQ ID NO: 316010 - DNA, 35 bp, Artificial Sequence
  Description of Artificial Sequence: Synthetic oligonucleotide
agaactgaagtcagctcgacttcgaacatgtatgg

SEQ ID NO: 316011 - DNA, 34 bp, Artificial Sequence
  Description of Artificial Sequence: Synthetic oligonucleotide
gaactgaagtcagctcgacttcgaacatgtatgg

SEQ ID NO: 316012 - DNA, 38 bp, Artificial Sequence
  Description of Artificial Sequence: Synthetic oligonucleotide
aactgaagtcagctcgacttcgaacatgtatggatttc

SEQ ID NO: 316013 - DNA, 37 bp, Artificial Sequence
  Description of Artificial Sequence: Synthetic oligonucleotide
actgaagtcagctcgacttcgaacatgtatggatttc

SEQ ID NO: 316014 - DNA, 36 bp, Artificial Sequence
  Description of Artificial Sequence: Synthetic oligonucleotide
ctgaagtcagctcgacttcgaacatgtatggatttc

SEQ ID NO: 316015 - DNA, 38 bp, Artificial Sequence
  Description of Artificial Sequence: Synthetic oligonucleotide
tgaagtcagctcgacttcgaacatgtatggatttcttc

SEQ ID NO: 316016 - DNA, 37 bp, Artificial Sequence
  Description of Artificial Sequence: Synthetic oligonucleotide
gaagtcagctcgacttcgaacatgtatggatttcttc

SEQ ID NO: 316017 - DNA, 37 bp, Artificial Sequence
  Description of Artificial Sequence: Synthetic oligonucleotide
aagtcagctcgacttcgaacatgtatggatttcttcc

SEQ ID NO: 316018 - DNA, 36 bp, Artificial Sequence
  Description of Artificial Sequence: Synthetic oligonucleotide
agtcagctcgacttcgaacatgtatggatttcttcc

SEQ ID NO: 316019 - DNA, 35 bp, Artificial Sequence
  Description of Artificial Sequence: Synthetic oligonucleotide
gtcagctcgacttcgaacatgtatggatttcttcc

SEQ ID NO: 316020 - DNA, 38 bp, Artificial Sequence
  Description of Artificial Sequence: Synthetic oligonucleotide
tcagctcgacttcgaacatgtatggatttcttcctaag

SEQ ID NO: 316021 - DNA, 37 bp, Artificial Sequence
  Description of Artificial Sequence: Synthetic oligonucleotide
cagctcgacttcgaacatgtatggatttcttcctaag

SEQ ID NO: 316022 - DNA, 37 bp, Artificial Sequence
  Description of Artificial Sequence: Synthetic oligonucleotide
agctcgacttcgaacatgtatggatttcttcctaagg

SEQ ID NO: 316023 - DNA, 36 bp, Artificial Sequence
  Description of Artificial Sequence: Synthetic oligonucleotide
gctcgacttcgaacatgtatggatttcttcctaagg

SEQ ID NO: 316024 - DNA, 37 bp, Artificial Sequence
  Description of Artificial Sequence: Synthetic oligonucleotide
ctcgacttcgaacatgtatggatttcttcctaaggtg

SEQ ID NO: 316025 - DNA, 38 bp, Artificial Sequence
  Description of Artificial Sequence: Synthetic oligonucleotide
tcgacttcgaacatgtatggatttcttcctaaggtgtg

SEQ ID NO: 316026 - DNA, 37 bp, Artificial Sequence
  Description of Artificial Sequence: Synthetic oligonucleotide
cgacttcgaacatgtatggatttcttcctaaggtgtg

SEQ ID NO: 316027 - DNA, 40 bp, Artificial Sequence
  Description of Artificial Sequence: Synthetic oligonucleotide
gacttcgaacatgtatggatttcttcctaaggtgtgaatc

SEQ ID NO: 316028 - DNA, 43 bp, Artificial Sequence
  Description of Artificial Sequence: Synthetic oligonucleotide
acttcgaacatgtatggatttcttcctaaggtgtgaatcattc

SEQ ID NO: 316029 - DNA, 42 bp, Artificial Sequence
  Description of Artificial Sequence: Synthetic oligonucleotide
cttcgaacatgtatggatttcttcctaaggtgtgaatcattc

SEQ ID NO: 316030 - DNA, 42 bp, Artificial Sequence
  Description of Artificial Sequence: Synthetic oligonucleotide
ttcgaacatgtatggatttcttcctaaggtgtgaatcattcc

SEQ ID NO: 316031 - DNA, 41 bp, Artificial Sequence
  Description of Artificial Sequence: Synthetic oligonucleotide
tcgaacatgtatggatttcttcctaaggtgtgaatcattcc

SEQ ID NO: 316032 - DNA, 40 bp, Artificial Sequence
  Description of Artificial Sequence: Synthetic oligonucleotide
cgaacatgtatggatttcttcctaaggtgtgaatcattcc

SEQ ID NO: 316033 - DNA, 42 bp, Artificial Sequence
  Description of Artificial Sequence: Synthetic oligonucleotide
gaacatgtatggatttcttcctaaggtgtgaatcattccttc

SEQ ID NO: 316034 - DNA, 42 bp, Artificial Sequence
  Description of Artificial Sequence: Synthetic oligonucleotide
aacatgtatggatttcttcctaaggtgtgaatcattccttcc

SEQ ID NO: 316035 - DNA, 41 bp, Artificial Sequence
  Description of Artificial Sequence: Synthetic oligonucleotide
acatgtatggatttcttcctaaggtgtgaatcattccttcc

SEQ ID NO: 316036 - DNA, 40 bp, Artificial Sequence
  Description of Artificial Sequence: Synthetic oligonucleotide
catgtatggatttcttcctaaggtgtgaatcattccttcc

SEQ ID NO: 316037 - DNA, 40 bp, Artificial Sequence
  Description of Artificial Sequence: Synthetic oligonucleotide
atgtatggatttcttcctaaggtgtgaatcattccttccg

SEQ ID NO: 316038 - DNA, 39 bp, Artificial Sequence
  Description of Artificial Sequence: Synthetic oligonucleotide
tgtatggatttcttcctaaggtgtgaatcattccttccg

SEQ ID NO: 316039 - DNA, 38 bp, Artificial Sequence
  Description of Artificial Sequence: Synthetic oligonucleotide
gtatggatttcttcctaaggtgtgaatcattccttccg

SEQ ID NO: 316040 - DNA, 39 bp, Artificial Sequence
  Description of Artificial Sequence: Synthetic oligonucleotide
tatggatttcttcctaaggtgtgaatcattccttccgag

SEQ ID NO: 316041 - DNA, 38 bp, Artificial Sequence
  Description of Artificial Sequence: Synthetic oligonucleotide
atggatttcttcctaaggtgtgaatcattccttccgag

SEQ ID NO: 316042 - DNA, 37 bp, Artificial Sequence
  Description of Artificial Sequence: Synthetic oligonucleotide
tggatttcttcctaaggtgtgaatcattccttccgag

SEQ ID NO: 316043 - DNA, 36 bp, Artificial Sequence
  Description of Artificial Sequence: Synthetic oligonucleotide
ggatttcttcctaaggtgtgaatcattccttccgag

SEQ ID NO: 316044 - DNA, 38 bp, Artificial Sequence
  Description of Artificial Sequence: Synthetic oligonucleotide
gatttcttcctaaggtgtgaatcattccttccgagatg

SEQ ID NO: 316045 - DNA, 38 bp, Artificial Sequence
  Description of Artificial Sequence: Synthetic oligonucleotide
atttcttcctaaggtgtgaatcattccttccgagatgg

SEQ ID NO: 316046 - DNA, 37 bp, Artificial Sequence
  Description of Artificial Sequence: Synthetic oligonucleotide
tttcttcctaaggtgtgaatcattccttccgagatgg

SEQ ID NO: 316047 - DNA, 36 bp, Artificial Sequence
  Description of Artificial Sequence: Synthetic oligonucleotide
ttcttcctaaggtgtgaatcattccttccgagatgg

SEQ ID NO: 316048 - DNA, 35 bp, Artificial Sequence
  Description of Artificial Sequence: Synthetic oligonucleotide
tcttcctaaggtgtgaatcattccttccgagatgg

SEQ ID NO: 316049 - DNA, 34 bp, Artificial Sequence
  Description of Artificial Sequence: Synthetic oligonucleotide
cttcctaaggtgtgaatcattccttccgagatgg

SEQ ID NO: 316050 - DNA, 35 bp, Artificial Sequence
  Description of Artificial Sequence: Synthetic oligonucleotide
ttcctaaggtgtgaatcattccttccgagatggag

SEQ ID NO: 316051 - DNA, 34 bp, Artificial Sequence
  Description of Artificial Sequence: Synthetic oligonucleotide
tcctaaggtgtgaatcattccttccgagatggag

SEQ ID NO: 316052 - DNA, 33 bp, Artificial Sequence
  Description of Artificial Sequence: Synthetic oligonucleotide
cctaaggtgtgaatcattccttccgagatggag

SEQ ID NO: 316053 - DNA, 34 bp, Artificial Sequence
  Description of Artificial Sequence: Synthetic oligonucleotide
ctaaggtgtgaatcattccttccgagatggagag

SEQ ID NO: 316054 - DNA, 37 bp, Artificial Sequence
  Description of Artificial Sequence: Synthetic oligonucleotide
taaggtgtgaatcattccttccgagatggagagtatg

SEQ ID NO: 316055 - DNA, 36 bp, Artificial Sequence
  Description of Artificial Sequence: Synthetic oligonucleotide
aaggtgtgaatcattccttccgagatggagagtatg

SEQ ID NO: 316056 - DNA, 35 bp, Artificial Sequence
  Description of Artificial Sequence: Synthetic oligonucleotide
aggtgtgaatcattccttccgagatggagagtatg

SEQ ID NO: 316057 - DNA, 34 bp, Artificial Sequence
  Description of Artificial Sequence: Synthetic oligonucleotide
ggtgtgaatcattccttccgagatggagagtatg

SEQ ID NO: 316058 - DNA, 34 bp, Artificial Sequence
  Description of Artificial Sequence: Synthetic oligonucleotide
gtgtgaatcattccttccgagatggagagtatgg

SEQ ID NO: 316059 - DNA, 35 bp, Artificial Sequence
  Description of Artificial Sequence: Synthetic oligonucleotide
tgtgaatcattccttccgagatggagagtatggtg

SEQ ID NO: 316060 - DNA, 34 bp, Artificial Sequence
  Description of Artificial Sequence: Synthetic oligonucleotide
gtgaatcattccttccgagatggagagtatggtg

SEQ ID NO: 316061 - DNA, 34 bp, Artificial Sequence
  Description of Artificial Sequence: Synthetic oligonucleotide
tgaatcattccttccgagatggagagtatggtgc

SEQ ID NO: 316062 - DNA, 33 bp, Artificial Sequence
  Description of Artificial Sequence: Synthetic oligonucleotide
gaatcattccttccgagatggagagtatggtgc

SEQ ID NO: 316063 - DNA, 33 bp, Artificial Sequence
  Description of Artificial Sequence: Synthetic oligonucleotide
aatcattccttccgagatggagagtatggtgcc

SEQ ID NO: 316064 - DNA, 32 bp, Artificial Sequence
  Description of Artificial Sequence: Synthetic oligonucleotide
atcattccttccgagatggagagtatggtgcc

SEQ ID NO: 316065 - DNA, 31 bp, Artificial Sequence
  Description of Artificial Sequence: Synthetic oligonucleotide
tcattccttccgagatggagagtatggtgcc

SEQ ID NO: 316066 - DNA, 30 bp, Artificial Sequence
  Description of Artificial Sequence: Synthetic oligonucleotide
cattccttccgagatggagagtatggtgcc

SEQ ID NO: 316067 - DNA, 32 bp, Artificial Sequence
  Description of Artificial Sequence: Synthetic oligonucleotide
attccttccgagatggagagtatggtgcctac

SEQ ID NO: 316068 - DNA, 31 bp, Artificial Sequence
  Description of Artificial Sequence: Synthetic oligonucleotide
ttccttccgagatggagagtatggtgcctac

SEQ ID NO: 316069 - DNA, 30 bp, Artificial Sequence
  Description of Artificial Sequence: Synthetic oligonucleotide
tccttccgagatggagagtatggtgcctac

SEQ ID NO: 316070 - DNA, 29 bp, Artificial Sequence
  Description of Artificial Sequence: Synthetic oligonucleotide
ccttccgagatggagagtatggtgcctac

SEQ ID NO: 316071 - DNA, 29 bp, Artificial Sequence
  Description of Artificial Sequence: Synthetic oligonucleotide
cttccgagatggagagtatggtgcctacc

SEQ ID NO: 316072 - DNA, 30 bp, Artificial Sequence
  Description of Artificial Sequence: Synthetic oligonucleotide
ttccgagatggagagtatggtgcctacctg

SEQ ID NO: 316073 - DNA, 29 bp, Artificial Sequence
  Description of Artificial Sequence: Synthetic oligonucleotide
tccgagatggagagtatggtgcctacctg

SEQ ID NO: 316074 - DNA, 28 bp, Artificial Sequence
  Description of Artificial Sequence: Synthetic oligonucleotide
ccgagatggagagtatggtgcctacctg

SEQ ID NO: 316075 - DNA, 28 bp, Artificial Sequence
  Description of Artificial Sequence: Synthetic oligonucleotide
cgagatggagagtatggtgcctacctgg

SEQ ID NO: 316076 - DNA, 30 bp, Artificial Sequence
  Description of Artificial Sequence: Synthetic oligonucleotide
gagatggagagtatggtgcctacctggaag

SEQ ID NO: 316077 - DNA, 30 bp, Artificial Sequence
  Description of Artificial Sequence: Synthetic oligonucleotide
agatggagagtatggtgcctacctggaagg

SEQ ID NO: 316078 - DNA, 29 bp, Artificial Sequence
  Description of Artificial Sequence: Synthetic oligonucleotide
gatggagagtatggtgcctacctggaagg

SEQ ID NO: 316079 - DNA, 30 bp, Artificial Sequence
  Description of Artificial Sequence: Synthetic oligonucleotide
atggagagtatggtgcctacctggaaggag

SEQ ID NO: 316080 - DNA, 29 bp, Artificial Sequence
  Description of Artificial Sequence: Synthetic oligonucleotide
tggagagtatggtgcctacctggaaggag

SEQ ID NO: 316081 - DNA, 28 bp, Artificial Sequence
  Description of Artificial Sequence: Synthetic oligonucleotide
ggagagtatggtgcctacctggaaggag

SEQ ID NO: 316082 - DNA, 28 bp, Artificial Sequence
  Description of Artificial Sequence: Synthetic oligonucleotide
gagagtatggtgcctacctggaaggagc

SEQ ID NO: 316083 - DNA, 29 bp, Artificial Sequence
  Description of Artificial Sequence: Synthetic oligonucleotide
agagtatggtgcctacctggaaggagctg

SEQ ID NO: 316084 - DNA, 28 bp, Artificial Sequence
  Description of Artificial Sequence: Synthetic oligonucleotide
gagtatggtgcctacctggaaggagctg

SEQ ID NO: 316085 - DNA, 28 bp, Artificial Sequence
  Description of Artificial Sequence: Synthetic oligonucleotide
agtatggtgcctacctggaaggagctgc

SEQ ID NO: 316086 - DNA, 27 bp, Artificial Sequence
  Description of Artificial Sequence: Synthetic oligonucleotide
gtatggtgcctacctggaaggagctgc

SEQ ID NO: 316087 - DNA, 27 bp, Artificial Sequence
  Description of Artificial Sequence: Synthetic oligonucleotide
tatggtgcctacctggaaggagctgcc

SEQ ID NO: 316088 - DNA, 26 bp, Artificial Sequence
  Description of Artificial Sequence: Synthetic oligonucleotide
atggtgcctacctggaaggagctgcc

SEQ ID NO: 316089 - DNA, 25 bp, Artificial Sequence
  Description of Artificial Sequence: Synthetic oligonucleotide
tggtgcctacctggaaggagctgcc

SEQ ID NO: 316090 - DNA, 24 bp, Artificial Sequence
  Description of Artificial Sequence: Synthetic oligonucleotide
ggtgcctacctggaaggagctgcc

SEQ ID NO: 316091 - DNA, 24 bp, Artificial Sequence
  Description of Artificial Sequence: Synthetic oligonucleotide
gtgcctacctggaaggagctgccc

SEQ ID NO: 316092 - DNA, 24 bp, Artificial Sequence
  Description of Artificial Sequence: Synthetic oligonucleotide
tgcctacctggaaggagctgcccc

SEQ ID NO: 316093 - DNA, 23 bp, Artificial Sequence
  Description of Artificial Sequence: Synthetic oligonucleotide
gcctacctggaaggagctgcccc

SEQ ID NO: 316094 - DNA, 24 bp, Artificial Sequence
  Description of Artificial Sequence: Synthetic oligonucleotide
cctacctggaaggagctgccccgt

SEQ ID NO: 316095 - DNA, 24 bp, Artificial Sequence
  Description of Artificial Sequence: Synthetic oligonucleotide
ctacctggaaggagctgccccgtg

SEQ ID NO: 316096 - DNA, 24 bp, Artificial Sequence
  Description of Artificial Sequence: Synthetic oligonucleotide
tacctggaaggagctgccccgtgc

SEQ ID NO: 316097 - DNA, 23 bp, Artificial Sequence
  Description of Artificial Sequence: Synthetic oligonucleotide
acctggaaggagctgccccgtgc

SEQ ID NO: 316098 - DNA, 22 bp, Artificial Sequence
  Description of Artificial Sequence: Synthetic oligonucleotide
cctggaaggagctgccccgtgc

SEQ ID NO: 316099 - DNA, 23 bp, Artificial Sequence
  Description of Artificial Sequence: Synthetic oligonucleotide
ctggaaggagctgccccgtgcca

SEQ ID NO: 316100 - DNA, 24 bp, Artificial Sequence
  Description of Artificial Sequence: Synthetic oligonucleotide
tggaaggagctgccccgtgccact

SEQ ID NO: 316101 - DNA, 23 bp, Artificial Sequence
  Description of Artificial Sequence: Synthetic oligonucleotide
ggaaggagctgccccgtgccact

SEQ ID NO: 316102 - DNA, 23 bp, Artificial Sequence
  Description of Artificial Sequence: Synthetic oligonucleotide
gaaggagctgccccgtgccactc

SEQ ID NO: 316103 - DNA, 24 bp, Artificial Sequence
  Description of Artificial Sequence: Synthetic oligonucleotide
aaggagctgccccgtgccactcca

SEQ ID NO: 316104 - DNA, 23 bp, Artificial Sequence
  Description of Artificial Sequence: Synthetic oligonucleotide
aggagctgccccgtgccactcca

SEQ ID NO: 316105 - DNA, 22 bp, Artificial Sequence
  Description of Artificial Sequence: Synthetic oligonucleotide
ggagctgccccgtgccactcca

SEQ ID NO: 316106 - DNA, 25 bp, Artificial Sequence
  Description of Artificial Sequence: Synthetic oligonucleotide
gagctgccccgtgccactccagtaa

SEQ ID NO: 316107 - DNA, 25 bp, Artificial Sequence
  Description of Artificial Sequence: Synthetic oligonucleotide
agctgccccgtgccactccagtaac

SEQ ID NO: 316108 - DNA, 24 bp, Artificial Sequence
  Description of Artificial Sequence: Synthetic oligonucleotide
gctgccccgtgccactccagtaac

SEQ ID NO: 316109 - DNA, 25 bp, Artificial Sequence
  Description of Artificial Sequence: Synthetic oligonucleotide
ctgccccgtgccactccagtaacct

SEQ ID NO: 316110 - DNA, 25 bp, Artificial Sequence
  Description of Artificial Sequence: Synthetic oligonucleotide
tgccccgtgccactccagtaacctg

SEQ ID NO: 316111 - DNA, 24 bp, Artificial Sequence
  Description of Artificial Sequence: Synthetic oligonucleotide
gccccgtgccactccagtaacctg

SEQ ID NO: 316112 - DNA, 25 bp, Artificial Sequence
  Description of Artificial Sequence: Synthetic oligonucleotide
ccccgtgccactccagtaacctgca

SEQ ID NO: 316113 - DNA, 25 bp, Artificial Sequence
  Description of Artificial Sequence: Synthetic oligonucleotide
cccgtgccactccagtaacctgcag

SEQ ID NO: 316114 - DNA, 27 bp, Artificial Sequence
  Description of Artificial Sequence: Synthetic oligonucleotide
ccgtgccactccagtaacctgcaggat

SEQ ID NO: 316115 - DNA, 27 bp, Artificial Sequence
  Description of Artificial Sequence: Synthetic oligonucleotide
cgtgccactccagtaacctgcaggatg

SEQ ID NO: 316116 - DNA, 28 bp, Artificial Sequence
  Description of Artificial Sequence: Synthetic oligonucleotide
gtgccactccagtaacctgcaggatgac

SEQ ID NO: 316117 - DNA, 29 bp, Artificial Sequence
  Description of Artificial Sequence: Synthetic oligonucleotide
tgccactccagtaacctgcaggatgactc

SEQ ID NO: 316118 - DNA, 28 bp, Artificial Sequence
  Description of Artificial Sequence: Synthetic oligonucleotide
gccactccagtaacctgcaggatgactc

SEQ ID NO: 316119 - DNA, 29 bp, Artificial Sequence
  Description of Artificial Sequence: Synthetic oligonucleotide
ccactccagtaacctgcaggatgactcag

SEQ ID NO: 316120 - DNA, 29 bp, Artificial Sequence
  Description of Artificial Sequence: Synthetic oligonucleotide
cactccagtaacctgcaggatgactcagc

SEQ ID NO: 316121 - DNA, 30 bp, Artificial Sequence
  Description of Artificial Sequence: Synthetic oligonucleotide
actccagtaacctgcaggatgactcagcac

SEQ ID NO: 316122 - DNA, 29 bp, Artificial Sequence
  Description of Artificial Sequence: Synthetic oligonucleotide
ctccagtaacctgcaggatgactcagcac

SEQ ID NO: 316123 - DNA, 30 bp, Artificial Sequence
  Description of Artificial Sequence: Synthetic oligonucleotide
tccagtaacctgcaggatgactcagcactg

SEQ ID NO: 316124 - DNA, 29 bp, Artificial Sequence
  Description of Artificial Sequence: Synthetic oligonucleotide
ccagtaacctgcaggatgactcagcactg

SEQ ID NO: 316125 - DNA, 29 bp, Artificial Sequence
  Description of Artificial Sequence: Synthetic oligonucleotide
cagtaacctgcaggatgactcagcactgc

SEQ ID NO: 316126 - DNA, 29 bp, Artificial Sequence
  Description of Artificial Sequence: Synthetic oligonucleotide
agtaacctgcaggatgactcagcactgcc

SEQ ID NO: 316127 - DNA, 28 bp, Artificial Sequence
  Description of Artificial Sequence: Synthetic oligonucleotide
gtaacctgcaggatgactcagcactgcc

SEQ ID NO: 316128 - DNA, 28 bp, Artificial Sequence
  Description of Artificial Sequence: Synthetic oligonucleotide
taacctgcaggatgactcagcactgccc

SEQ ID NO: 316129 - DNA, 27 bp, Artificial Sequence
  Description of Artificial Sequence: Synthetic oligonucleotide
aacctgcaggatgactcagcactgccc

SEQ ID NO: 316130 - DNA, 27 bp, Artificial Sequence
  Description of Artificial Sequence: Synthetic oligonucleotide
acctgcaggatgactcagcactgccca

SEQ ID NO: 316131 - DNA, 27 bp, Artificial Sequence
  Description of Artificial Sequence: Synthetic oligonucleotide
cctgcaggatgactcagcactgcccat

SEQ ID NO: 316132 - DNA, 27 bp, Artificial Sequence
  Description of Artificial Sequence: Synthetic oligonucleotide
ctgcaggatgactcagcactgcccatc

SEQ ID NO: 316133 - DNA, 29 bp, Artificial Sequence
  Description of Artificial Sequence: Synthetic oligonucleotide
tgcaggatgactcagcactgcccatcttc

SEQ ID NO: 316134 - DNA, 28 bp, Artificial Sequence
  Description of Artificial Sequence: Synthetic oligonucleotide
gcaggatgactcagcactgcccatcttc

SEQ ID NO: 316135 - DNA, 30 bp, Artificial Sequence
  Description of Artificial Sequence: Synthetic oligonucleotide
caggatgactcagcactgcccatcttcatc

SEQ ID NO: 316136 - DNA, 30 bp, Artificial Sequence
  Description of Artificial Sequence: Synthetic oligonucleotide
aggatgactcagcactgcccatcttcatcc

SEQ ID NO: 316137 - DNA, 29 bp, Artificial Sequence
  Description of Artificial Sequence: Synthetic oligonucleotide
ggatgactcagcactgcccatcttcatcc

SEQ ID NO: 316138 - DNA, 30 bp, Artificial Sequence
  Description of Artificial Sequence: Synthetic oligonucleotide
gatgactcagcactgcccatcttcatccac

SEQ ID NO: 316139 - DNA, 31 bp, Artificial Sequence
  Description of Artificial Sequence: Synthetic oligonucleotide
atgactcagcactgcccatcttcatccacac

SEQ ID NO: 316140 - DNA, 30 bp, Artificial Sequence
  Description of Artificial Sequence: Synthetic oligonucleotide
tgactcagcactgcccatcttcatccacac

SEQ ID NO: 316141 - DNA, 29 bp, Artificial Sequence
  Description of Artificial Sequence: Synthetic oligonucleotide
gactcagcactgcccatcttcatccacac

SEQ ID NO: 316142 - DNA, 29 bp, Artificial Sequence
  Description of Artificial Sequence: Synthetic oligonucleotide
actcagcactgcccatcttcatccacacc

SEQ ID NO: 316143 - DNA, 28 bp, Artificial Sequence
  Description of Artificial Sequence: Synthetic oligonucleotide
ctcagcactgcccatcttcatccacacc

SEQ ID NO: 316144 - DNA, 29 bp, Artificial Sequence
  Description of Artificial Sequence: Synthetic oligonucleotide
tcagcactgcccatcttcatccacaccag

SEQ ID NO: 316145 - DNA, 28 bp, Artificial Sequence
  Description of Artificial Sequence: Synthetic oligonucleotide
cagcactgcccatcttcatccacaccag

SEQ ID NO: 316146 - DNA, 29 bp, Artificial Sequence
  Description of Artificial Sequence: Synthetic oligonucleotide
agcactgcccatcttcatccacaccagtg

SEQ ID NO: 316147 - DNA, 28 bp, Artificial Sequence
  Description of Artificial Sequence: Synthetic oligonucleotide
gcactgcccatcttcatccacaccagtg

SEQ ID NO: 316148 - DNA, 29 bp, Artificial Sequence
  Description of Artificial Sequence: Synthetic oligonucleotide
cactgcccatcttcatccacaccagtgtg

SEQ ID NO: 316149 - DNA, 29 bp, Artificial Sequence
  Description of Artificial Sequence: Synthetic oligonucleotide
actgcccatcttcatccacaccagtgtgc

SEQ ID NO: 316150 - DNA, 28 bp, Artificial Sequence
  Description of Artificial Sequence: Synthetic oligonucleotide
ctgcccatcttcatccacaccagtgtgc

SEQ ID NO: 316151 - DNA, 29 bp, Artificial Sequence
  Description of Artificial Sequence: Synthetic oligonucleotide
tgcccatcttcatccacaccagtgtgctg

SEQ ID NO: 316152 - DNA, 28 bp, Artificial Sequence
  Description of Artificial Sequence: Synthetic oligonucleotide
gcccatcttcatccacaccagtgtgctg

SEQ ID NO: 316153 - DNA, 28 bp, Artificial Sequence
  Description of Artificial Sequence: Synthetic oligonucleotide
cccatcttcatccacaccagtgtgctgg

SEQ ID NO: 316154 - DNA, 28 bp, Artificial Sequence
  Description of Artificial Sequence: Synthetic oligonucleotide
ccatcttcatccacaccagtgtgctggg

SEQ ID NO: 316155 - DNA, 31 bp, Artificial Sequence
  Description of Artificial Sequence: Synthetic oligonucleotide
catcttcatccacaccagtgtgctgggtatc

SEQ ID NO: 316156 - DNA, 31 bp, Artificial Sequence
  Description of Artificial Sequence: Synthetic oligonucleotide
atcttcatccacaccagtgtgctgggtatcg

SEQ ID NO: 316157 - DNA, 30 bp, Artificial Sequence
  Description of Artificial Sequence: Synthetic oligonucleotide
tcttcatccacaccagtgtgctgggtatcg

SEQ ID NO: 316158 - DNA, 29 bp, Artificial Sequence
  Description of Artificial Sequence: Synthetic oligonucleotide
cttcatccacaccagtgtgctgggtatcg

SEQ ID NO: 316159 - DNA, 31 bp, Artificial Sequence
  Description of Artificial Sequence: Synthetic oligonucleotide
ttcatccacaccagtgtgctgggtatcgtag

SEQ ID NO: 316160 - DNA, 30 bp, Artificial Sequence
  Description of Artificial Sequence: Synthetic oligonucleotide
tcatccacaccagtgtgctgggtatcgtag

SEQ ID NO: 316161 - DNA, 29 bp, Artificial Sequence
  Description of Artificial Sequence: Synthetic oligonucleotide
catccacaccagtgtgctgggtatcgtag

SEQ ID NO: 316162 - DNA, 29 bp, Artificial Sequence
  Description of Artificial Sequence: Synthetic oligonucleotide
atccacaccagtgtgctgggtatcgtagc

SEQ ID NO: 316163 - DNA, 28 bp, Artificial Sequence
  Description of Artificial Sequence: Synthetic oligonucleotide
tccacaccagtgtgctgggtatcgtagc

SEQ ID NO: 316164 - DNA, 27 bp, Artificial Sequence
  Description of Artificial Sequence: Synthetic oligonucleotide
ccacaccagtgtgctgggtatcgtagc

SEQ ID NO: 316165 - DNA, 29 bp, Artificial Sequence
  Description of Artificial Sequence: Synthetic oligonucleotide
cacaccagtgtgctgggtatcgtagctag

SEQ ID NO: 316166 - DNA, 29 bp, Artificial Sequence
  Description of Artificial Sequence: Synthetic oligonucleotide
acaccagtgtgctgggtatcgtagctagc

SEQ ID NO: 316167 - DNA, 28 bp, Artificial Sequence
  Description of Artificial Sequence: Synthetic oligonucleotide
caccagtgtgctgggtatcgtagctagc

SEQ ID NO: 316168 - DNA, 29 bp, Artificial Sequence
  Description of Artificial Sequence: Synthetic oligonucleotide
accagtgtgctgggtatcgtagctagcac

SEQ ID NO: 316169 - DNA, 28 bp, Artificial Sequence
  Description of Artificial Sequence: Synthetic oligonucleotide
ccagtgtgctgggtatcgtagctagcac

SEQ ID NO: 316170 - DNA, 28 bp, Artificial Sequence
  Description of Artificial Sequence: Synthetic oligonucleotide
cagtgtgctgggtatcgtagctagcacc

SEQ ID NO: 316171 - DNA, 29 bp, Artificial Sequence
  Description of Artificial Sequence: Synthetic oligonucleotide
agtgtgctgggtatcgtagctagcaccac

SEQ ID NO: 316172 - DNA, 28 bp, Artificial Sequence
  Description of Artificial Sequence: Synthetic oligonucleotide
gtgtgctgggtatcgtagctagcaccac

SEQ ID NO: 316173 - DNA, 29 bp, Artificial Sequence
  Description of Artificial Sequence: Synthetic oligonucleotide
tgtgctgggtatcgtagctagcaccactg

SEQ ID NO: 316174 - DNA, 28 bp, Artificial Sequence
  Description of Artificial Sequence: Synthetic oligonucleotide
gtgctgggtatcgtagctagcaccactg

SEQ ID NO: 316175 - DNA, 29 bp, Artificial Sequence
  Description of Artificial Sequence: Synthetic oligonucleotide
tgctgggtatcgtagctagcaccactgtc

SEQ ID NO: 316176 - DNA, 28 bp, Artificial Sequence
  Description of Artificial Sequence: Synthetic oligonucleotide
gctgggtatcgtagctagcaccactgtc

SEQ ID NO: 316177 - DNA, 28 bp, Artificial Sequence
  Description of Artificial Sequence: Synthetic oligonucleotide
ctgggtatcgtagctagcaccactgtcc

SEQ ID NO: 316178 - DNA, 29 bp, Artificial Sequence
  Description of Artificial Sequence: Synthetic oligonucleotide
tgggtatcgtagctagcaccactgtcctg

SEQ ID NO: 316179 - DNA, 28 bp, Artificial Sequence
  Description of Artificial Sequence: Synthetic oligonucleotide
gggtatcgtagctagcaccactgtcctg

SEQ ID NO: 316180 - DNA, 30 bp, Artificial Sequence
  Description of Artificial Sequence: Synthetic oligonucleotide
ggtatcgtagctagcaccactgtcctgttc

SEQ ID NO: 316181 - DNA, 32 bp, Artificial Sequence
  Description of Artificial Sequence: Synthetic oligonucleotide
gtatcgtagctagcaccactgtcctgttcatg

SEQ ID NO: 316182 - DNA, 32 bp, Artificial Sequence
  Description of Artificial Sequence: Synthetic oligonucleotide
tatcgtagctagcaccactgtcctgttcatgc

SEQ ID NO: 316183 - DNA, 31 bp, Artificial Sequence
  Description of Artificial Sequence: Synthetic oligonucleotide
atcgtagctagcaccactgtcctgttcatgc

SEQ ID NO: 316184 - DNA, 30 bp, Artificial Sequence
  Description of Artificial Sequence: Synthetic oligonucleotide
tcgtagctagcaccactgtcctgttcatgc

SEQ ID NO: 316185 - DNA, 29 bp, Artificial Sequence
  Description of Artificial Sequence: Synthetic oligonucleotide
cgtagctagcaccactgtcctgttcatgc

SEQ ID NO: 316186 - DNA, 33 bp, Artificial Sequence
  Description of Artificial Sequence: Synthetic oligonucleotide
gtagctagcaccactgtcctgttcatgcttatc

SEQ ID NO: 316187 - DNA, 34 bp, Artificial Sequence
  Description of Artificial Sequence: Synthetic oligonucleotide
tagctagcaccactgtcctgttcatgcttatcag

SEQ ID NO: 316188 - DNA, 33 bp, Artificial Sequence
  Description of Artificial Sequence: Synthetic oligonucleotide
agctagcaccactgtcctgttcatgcttatcag

SEQ ID NO: 316189 - DNA, 32 bp, Artificial Sequence
  Description of Artificial Sequence: Synthetic oligonucleotide
gctagcaccactgtcctgttcatgcttatcag

SEQ ID NO: 316190 - DNA, 33 bp, Artificial Sequence
  Description of Artificial Sequence: Synthetic oligonucleotide
ctagcaccactgtcctgttcatgcttatcagac

SEQ ID NO: 316191 - DNA, 33 bp, Artificial Sequence
  Description of Artificial Sequence: Synthetic oligonucleotide
tagcaccactgtcctgttcatgcttatcagacc

SEQ ID NO: 316192 - DNA, 32 bp, Artificial Sequence
  Description of Artificial Sequence: Synthetic oligonucleotide
agcaccactgtcctgttcatgcttatcagacc

SEQ ID NO: 316193 - DNA, 31 bp, Artificial Sequence
  Description of Artificial Sequence: Synthetic oligonucleotide
gcaccactgtcctgttcatgcttatcagacc

SEQ ID NO: 316194 - DNA, 32 bp, Artificial Sequence
  Description of Artificial Sequence: Synthetic oligonucleotide
caccactgtcctgttcatgcttatcagacctc

SEQ ID NO: 316195 - DNA, 33 bp, Artificial Sequence
  Description of Artificial Sequence: Synthetic oligonucleotide
accactgtcctgttcatgcttatcagacctcac

SEQ ID NO: 316196 - DNA, 32 bp, Artificial Sequence
  Description of Artificial Sequence: Synthetic oligonucleotide
ccactgtcctgttcatgcttatcagacctcac

SEQ ID NO: 316197 - DNA, 34 bp, Artificial Sequence
  Description of Artificial Sequence: Synthetic oligonucleotide
cactgtcctgttcatgcttatcagacctcacttc

SEQ ID NO: 316198 - DNA, 34 bp, Artificial Sequence
  Description of Artificial Sequence: Synthetic oligonucleotide
actgtcctgttcatgcttatcagacctcacttcc

SEQ ID NO: 316199 - DNA, 33 bp, Artificial Sequence
  Description of Artificial Sequence: Synthetic oligonucleotide
ctgtcctgttcatgcttatcagacctcacttcc

SEQ ID NO: 316200 - DNA, 33 bp, Artificial Sequence
  Description of Artificial Sequence: Synthetic oligonucleotide
tgtcctgttcatgcttatcagacctcacttccg

SEQ ID NO: 316201 - DNA, 32 bp, Artificial Sequence
  Description of Artificial Sequence: Synthetic oligonucleotide
gtcctgttcatgcttatcagacctcacttccg

SEQ ID NO: 316202 - DNA, 32 bp, Artificial Sequence
  Description of Artificial Sequence: Synthetic oligonucleotide
tcctgttcatgcttatcagacctcacttccgc

SEQ ID NO: 316203 - DNA, 31 bp, Artificial Sequence
  Description of Artificial Sequence: Synthetic oligonucleotide
cctgttcatgcttatcagacctcacttccgc

SEQ ID NO: 316204 - DNA, 32 bp, Artificial Sequence
  Description of Artificial Sequence: Synthetic oligonucleotide
ctgttcatgcttatcagacctcacttccgctg

SEQ ID NO: 316205 - DNA, 32 bp, Artificial Sequence
  Description of Artificial Sequence: Synthetic oligonucleotide
tgttcatgcttatcagacctcacttccgctgc

SEQ ID NO: 316206 - DNA, 31 bp, Artificial Sequence
  Description of Artificial Sequence: Synthetic oligonucleotide
gttcatgcttatcagacctcacttccgctgc

SEQ ID NO: 316207 - DNA, 31 bp, Artificial Sequence
  Description of Artificial Sequence: Synthetic oligonucleotide
ttcatgcttatcagacctcacttccgctgcc

SEQ ID NO: 316208 - DNA, 30 bp, Artificial Sequence
  Description of Artificial Sequence: Synthetic oligonucleotide
tcatgcttatcagacctcacttccgctgcc

SEQ ID NO: 316209 - DNA, 29 bp, Artificial Sequence
  Description of Artificial Sequence: Synthetic oligonucleotide
catgcttatcagacctcacttccgctgcc

SEQ ID NO: 316210 - DNA, 30 bp, Artificial Sequence
  Description of Artificial Sequence: Synthetic oligonucleotide
atgcttatcagacctcacttccgctgccag

SEQ ID NO: 316211 - DNA, 29 bp, Artificial Sequence
  Description of Artificial Sequence: Synthetic oligonucleotide
tgcttatcagacctcacttccgctgccag

SEQ ID NO: 316212 - DNA, 28 bp, Artificial Sequence
  Description of Artificial Sequence: Synthetic oligonucleotide
gcttatcagacctcacttccgctgccag

SEQ ID NO: 316213 - DNA, 28 bp, Artificial Sequence
  Description of Artificial Sequence: Synthetic oligonucleotide
cttatcagacctcacttccgctgccagc

SEQ ID NO: 316214 - DNA, 29 bp, Artificial Sequence
  Description of Artificial Sequence: Synthetic oligonucleotide
ttatcagacctcacttccgctgccagctc

SEQ ID NO: 316215 - DNA, 28 bp, Artificial Sequence
  Description of Artificial Sequence: Synthetic oligonucleotide
tatcagacctcacttccgctgccagctc

SEQ ID NO: 316216 - DNA, 27 bp, Artificial Sequence
  Description of Artificial Sequence: Synthetic oligonucleotide
atcagacctcacttccgctgccagctc

SEQ ID NO: 316217 - DNA, 27 bp, Artificial Sequence
  Description of Artificial Sequence: Synthetic oligonucleotide
tcagacctcacttccgctgccagctct

SEQ ID NO: 316218 - DNA, 26 bp, Artificial Sequence
  Description of Artificial Sequence: Synthetic oligonucleotide
cagacctcacttccgctgccagctct

SEQ ID NO: 316219 - DNA, 26 bp, Artificial Sequence
  Description of Artificial Sequence: Synthetic oligonucleotide
agacctcacttccgctgccagctctg

SEQ ID NO: 316220 - DNA, 25 bp, Artificial Sequence
  Description of Artificial Sequence: Synthetic oligonucleotide
gacctcacttccgctgccagctctg

SEQ ID NO: 316221 - DNA, 25 bp, Artificial Sequence
  Description of Artificial Sequence: Synthetic oligonucleotide
acctcacttccgctgccagctctgc

SEQ ID NO: 316222 - DNA, 24 bp, Artificial Sequence
  Description of Artificial Sequence: Synthetic oligonucleotide
cctcacttccgctgccagctctgc

SEQ ID NO: 316223 - DNA, 24 bp, Artificial Sequence
  Description of Artificial Sequence: Synthetic oligonucleotide
ctcacttccgctgccagctctgcg

SEQ ID NO: 316224 - DNA, 25 bp, Artificial Sequence
  Description of Artificial Sequence: Synthetic oligonucleotide
tcacttccgctgccagctctgcgct

SEQ ID NO: 316225 - DNA, 24 bp, Artificial Sequence
  Description of Artificial Sequence: Synthetic oligonucleotide
cacttccgctgccagctctgcgct

SEQ ID NO: 316226 - DNA, 24 bp, Artificial Sequence
  Description of Artificial Sequence: Synthetic oligonucleotide
acttccgctgccagctctgcgctg

SEQ ID NO: 316227 - DNA, 23 bp, Artificial Sequence
  Description of Artificial Sequence: Synthetic oligonucleotide
cttccgctgccagctctgcgctg

SEQ ID NO: 316228 - DNA, 23 bp, Artificial Sequence
  Description of Artificial Sequence: Synthetic oligonucleotide
ttccgctgccagctctgcgctgg

SEQ ID NO: 316229 - DNA, 22 bp, Artificial Sequence
  Description of Artificial Sequence: Synthetic oligonucleotide
tccgctgccagctctgcgctgg

SEQ ID NO: 316230 - DNA, 21 bp, Artificial Sequence
  Description of Artificial Sequence: Synthetic oligonucleotide
ccgctgccagctctgcgctgg

SEQ ID NO: 316231 - DNA, 22 bp, Artificial Sequence
  Description of Artificial Sequence: Synthetic oligonucleotide
cgctgccagctctgcgctggct

SEQ ID NO: 316232 - DNA, 22 bp, Artificial Sequence
  Description of Artificial Sequence: Synthetic oligonucleotide
gctgccagctctgcgctggctg

SEQ ID NO: 316233 - DNA, 22 bp, Artificial Sequence
  Description of Artificial Sequence: Synthetic oligonucleotide
ctgccagctctgcgctggctgg

SEQ ID NO: 316234 - DNA, 22 bp, Artificial Sequence
  Description of Artificial Sequence: Synthetic oligonucleotide
tgccagctctgcgctggctggc

SEQ ID NO: 316235 - DNA, 21 bp, Artificial Sequence
  Description of Artificial Sequence: Synthetic oligonucleotide
gccagctctgcgctggctggc

SEQ ID NO: 316236 - DNA, 22 bp, Artificial Sequence
  Description of Artificial Sequence: Synthetic oligonucleotide
ccagctctgcgctggctggcgt

SEQ ID NO: 316237 - DNA, 23 bp, Artificial Sequence
  Description of Artificial Sequence: Synthetic oligonucleotide
cagctctgcgctggctggcgtgt

SEQ ID NO: 316238 - DNA, 23 bp, Artificial Sequence
  Description of Artificial Sequence: Synthetic oligonucleotide
agctctgcgctggctggcgtgtc

SEQ ID NO: 316239 - DNA, 22 bp, Artificial Sequence
  Description of Artificial Sequence: Synthetic oligonucleotide
gctctgcgctggctggcgtgtc

SEQ ID NO: 316240 - DNA, 23 bp, Artificial Sequence
  Description of Artificial Sequence: Synthetic oligonucleotide
ctctgcgctggctggcgtgtcct

SEQ ID NO: 316241 - DNA, 23 bp, Artificial Sequence
  Description of Artificial Sequence: Synthetic oligonucleotide
tctgcgctggctggcgtgtcctg

SEQ ID NO: 316242 - DNA, 22 bp, Artificial Sequence
  Description of Artificial Sequence: Synthetic oligonucleotide
ctgcgctggctggcgtgtcctg

SEQ ID NO: 316243 - DNA, 22 bp, Artificial Sequence
  Description of Artificial Sequence: Synthetic oligonucleotide
tgcgctggctggcgtgtcctgg

SEQ ID NO: 316244 - DNA, 21 bp, Artificial Sequence
  Description of Artificial Sequence: Synthetic oligonucleotide
gcgctggctggcgtgtcctgg

SEQ ID NO: 316245 - DNA, 22 bp, Artificial Sequence
  Description of Artificial Sequence: Synthetic oligonucleotide
cgctggctggcgtgtcctggct

SEQ ID NO: 316246 - DNA, 23 bp, Artificial Sequence
  Description of Artificial Sequence: Synthetic oligonucleotide
gctggctggcgtgtcctggctca

SEQ ID NO: 316247 - DNA, 23 bp, Artificial Sequence
  Description of Artificial Sequence: Synthetic oligonucleotide
ctggctggcgtgtcctggctcag

SEQ ID NO: 316248 - DNA, 24 bp, Artificial Sequence
  Description of Artificial Sequence: Synthetic oligonucleotide
tggctggcgtgtcctggctcagct

SEQ ID NO: 316249 - DNA, 23 bp, Artificial Sequence
  Description of Artificial Sequence: Synthetic oligonucleotide
ggctggcgtgtcctggctcagct

SEQ ID NO: 316250 - DNA, 23 bp, Artificial Sequence
  Description of Artificial Sequence: Synthetic oligonucleotide
gctggcgtgtcctggctcagctg

SEQ ID NO: 316251 - DNA, 23 bp, Artificial Sequence
  Description of Artificial Sequence: Synthetic oligonucleotide
ctggcgtgtcctggctcagctgg

SEQ ID NO: 316252 - DNA, 24 bp, Artificial Sequence
  Description of Artificial Sequence: Synthetic oligonucleotide
tggcgtgtcctggctcagctggct

SEQ ID NO: 316253 - DNA, 23 bp, Artificial Sequence
  Description of Artificial Sequence: Synthetic oligonucleotide
ggcgtgtcctggctcagctggct

SEQ ID NO: 316254 - DNA, 24 bp, Artificial Sequence
  Description of Artificial Sequence: Synthetic oligonucleotide
gcgtgtcctggctcagctggctct

SEQ ID NO: 316255 - DNA, 24 bp, Artificial Sequence
  Description of Artificial Sequence: Synthetic oligonucleotide
cgtgtcctggctcagctggctctg

SEQ ID NO: 316256 - DNA, 24 bp, Artificial Sequence
  Description of Artificial Sequence: Synthetic oligonucleotide
gtgtcctggctcagctggctctgg

SEQ ID NO: 316257 - DNA, 24 bp, Artificial Sequence
  Description of Artificial Sequence: Synthetic oligonucleotide
tgtcctggctcagctggctctggg

SEQ ID NO: 316258 - DNA, 23 bp, Artificial Sequence
  Description of Artificial Sequence: Synthetic oligonucleotide
gtcctggctcagctggctctggg

SEQ ID NO: 316259 - DNA, 24 bp, Artificial Sequence
  Description of Artificial Sequence: Synthetic oligonucleotide
tcctggctcagctggctctgggca

SEQ ID NO: 316260 - DNA, 23 bp, Artificial Sequence
  Description of Artificial Sequence: Synthetic oligonucleotide
cctggctcagctggctctgggca

SEQ ID NO: 316261 - DNA, 24 bp, Artificial Sequence
  Description of Artificial Sequence: Synthetic oligonucleotide
ctggctcagctggctctgggcagt

SEQ ID NO: 316262 - DNA, 24 bp, Artificial Sequence
  Description of Artificial Sequence: Synthetic oligonucleotide
tggctcagctggctctgggcagtg

SEQ ID NO: 316263 - DNA, 23 bp, Artificial Sequence
  Description of Artificial Sequence: Synthetic oligonucleotide
ggctcagctggctctgggcagtg

SEQ ID NO: 316264 - DNA, 23 bp, Artificial Sequence
  Description of Artificial Sequence: Synthetic oligonucleotide
gctcagctggctctgggcagtgg

SEQ ID NO: 316265 - DNA, 23 bp, Artificial Sequence
  Description of Artificial Sequence: Synthetic oligonucleotide
ctcagctggctctgggcagtggc

SEQ ID NO: 316266 - DNA, 24 bp, Artificial Sequence
  Description of Artificial Sequence: Synthetic oligonucleotide
tcagctggctctgggcagtggcct

SEQ ID NO: 316267 - DNA, 23 bp, Artificial Sequence
  Description of Artificial Sequence: Synthetic oligonucleotide
cagctggctctgggcagtggcct

SEQ ID NO: 316268 - DNA, 25 bp, Artificial Sequence
  Description of Artificial Sequence: Synthetic oligonucleotide
agctggctctgggcagtggcctctt

SEQ ID NO: 316269 - DNA, 24 bp, Artificial Sequence
  Description of Artificial Sequence: Synthetic oligonucleotide
gctggctctgggcagtggcctctt

SEQ ID NO: 316270 - DNA, 25 bp, Artificial Sequence
  Description of Artificial Sequence: Synthetic oligonucleotide
ctggctctgggcagtggcctcttca

SEQ ID NO: 316271 - DNA, 25 bp, Artificial Sequence
  Description of Artificial Sequence: Synthetic oligonucleotide
tggctctgggcagtggcctcttcag

SEQ ID NO: 316272 - DNA, 24 bp, Artificial Sequence
  Description of Artificial Sequence: Synthetic oligonucleotide
ggctctgggcagtggcctcttcag

SEQ ID NO: 316273 - DNA, 27 bp, Artificial Sequence
  Description of Artificial Sequence: Synthetic oligonucleotide
gctctgggcagtggcctcttcaggatt

SEQ ID NO: 316274 - DNA, 27 bp, Artificial Sequence
  Description of Artificial Sequence: Synthetic oligonucleotide
ctctgggcagtggcctcttcaggattg

SEQ ID NO: 316275 - DNA, 28 bp, Artificial Sequence
  Description of Artificial Sequence: Synthetic oligonucleotide
tctgggcagtggcctcttcaggattgtg

SEQ ID NO: 316276 - DNA, 27 bp, Artificial Sequence
  Description of Artificial Sequence: Synthetic oligonucleotide
ctgggcagtggcctcttcaggattgtg

SEQ ID NO: 316277 - DNA, 27 bp, Artificial Sequence
  Description of Artificial Sequence: Synthetic oligonucleotide
tgggcagtggcctcttcaggattgtgg

SEQ ID NO: 316278 - DNA, 27 bp, Artificial Sequence
  Description of Artificial Sequence: Synthetic oligonucleotide
gggcagtggcctcttcaggattgtggt

SEQ ID NO: 316279 - DNA, 27 bp, Artificial Sequence
  Description of Artificial Sequence: Synthetic oligonucleotide
ggcagtggcctcttcaggattgtggtg

SEQ ID NO: 316280 - DNA, 27 bp, Artificial Sequence
  Description of Artificial Sequence: Synthetic oligonucleotide
gcagtggcctcttcaggattgtggtgg

SEQ ID NO: 316281 - DNA, 27 bp, Artificial Sequence
  Description of Artificial Sequence: Synthetic oligonucleotide
cagtggcctcttcaggattgtggtggc

SEQ ID NO: 316282 - DNA, 27 bp, Artificial Sequence
  Description of Artificial Sequence: Synthetic oligonucleotide
agtggcctcttcaggattgtggtggcc

SEQ ID NO: 316283 - DNA, 26 bp, Artificial Sequence
  Description of Artificial Sequence: Synthetic oligonucleotide
gtggcctcttcaggattgtggtggcc

SEQ ID NO: 316284 - DNA, 27 bp, Artificial Sequence
  Description of Artificial Sequence: Synthetic oligonucleotide
tggcctcttcaggattgtggtggccgt

SEQ ID NO: 316285 - DNA, 26 bp, Artificial Sequence
  Description of Artificial Sequence: Synthetic oligonucleotide
ggcctcttcaggattgtggtggccgt

SEQ ID NO: 316286 - DNA, 27 bp, Artificial Sequence
  Description of Artificial Sequence: Synthetic oligonucleotide
gcctcttcaggattgtggtggccgtct

SEQ ID NO: 316287 - DNA, 28 bp, Artificial Sequence
  Description of Artificial Sequence: Synthetic oligonucleotide
cctcttcaggattgtggtggccgtcttg

SEQ ID NO: 316288 - DNA, 28 bp, Artificial Sequence
  Description of Artificial Sequence: Synthetic oligonucleotide
ctcttcaggattgtggtggccgtcttgg

SEQ ID NO: 316289 - DNA, 28 bp, Artificial Sequence
  Description of Artificial Sequence: Synthetic oligonucleotide
tcttcaggattgtggtggccgtcttggg

SEQ ID NO: 316290 - DNA, 27 bp, Artificial Sequence
  Description of Artificial Sequence: Synthetic oligonucleotide
cttcaggattgtggtggccgtcttggg

SEQ ID NO: 316291 - DNA, 27 bp, Artificial Sequence
  Description of Artificial Sequence: Synthetic oligonucleotide
ttcaggattgtggtggccgtcttgggc

SEQ ID NO: 316292 - DNA, 26 bp, Artificial Sequence
  Description of Artificial Sequence: Synthetic oligonucleotide
tcaggattgtggtggccgtcttgggc

SEQ ID NO: 316293 - DNA, 25 bp, Artificial Sequence
  Description of Artificial Sequence: Synthetic oligonucleotide
caggattgtggtggccgtcttgggc

SEQ ID NO: 316294 - DNA, 25 bp, Artificial Sequence
  Description of Artificial Sequence: Synthetic oligonucleotide
aggattgtggtggccgtcttgggcc

SEQ ID NO: 316295 - DNA, 24 bp, Artificial Sequence
  Description of Artificial Sequence: Synthetic oligonucleotide
ggattgtggtggccgtcttgggcc

SEQ ID NO: 316296 - DNA, 25 bp, Artificial Sequence
  Description of Artificial Sequence: Synthetic oligonucleotide
gattgtggtggccgtcttgggccca

SEQ ID NO: 316297 - DNA, 25 bp, Artificial Sequence
  Description of Artificial Sequence: Synthetic oligonucleotide
attgtggtggccgtcttgggcccag

SEQ ID NO: 316298 - DNA, 24 bp, Artificial Sequence
  Description of Artificial Sequence: Synthetic oligonucleotide
ttgtggtggccgtcttgggcccag

SEQ ID NO: 316299 - DNA, 23 bp, Artificial Sequence
  Description of Artificial Sequence: Synthetic oligonucleotide
tgtggtggccgtcttgggcccag

SEQ ID NO: 316300 - DNA, 22 bp, Artificial Sequence
  Description of Artificial Sequence: Synthetic oligonucleotide
gtggtggccgtcttgggcccag

SEQ ID NO: 316301 - DNA, 22 bp, Artificial Sequence
  Description of Artificial Sequence: Synthetic oligonucleotide
tggtggccgtcttgggcccagg

SEQ ID NO: 316302 - DNA, 21 bp, Artificial Sequence
  Description of Artificial Sequence: Synthetic oligonucleotide
ggtggccgtcttgggcccagg

SEQ ID NO: 316303 - DNA, 21 bp, Artificial Sequence
  Description of Artificial Sequence: Synthetic oligonucleotide
gtggccgtcttgggcccaggg

SEQ ID NO: 316304 - DNA, 23 bp, Artificial Sequence
  Description of Artificial Sequence: Synthetic oligonucleotide
tggccgtcttgggcccagggctt

SEQ ID NO: 316305 - DNA, 22 bp, Artificial Sequence
  Description of Artificial Sequence: Synthetic oligonucleotide
ggccgtcttgggcccagggctt

SEQ ID NO: 316306 - DNA, 22 bp, Artificial Sequence
  Description of Artificial Sequence: Synthetic oligonucleotide
gccgtcttgggcccagggcttg

SEQ ID NO: 316307 - DNA, 24 bp, Artificial Sequence
  Description of Artificial Sequence: Synthetic oligonucleotide
ccgtcttgggcccagggcttggta

SEQ ID NO: 316308 - DNA, 24 bp, Artificial Sequence
  Description of Artificial Sequence: Synthetic oligonucleotide
cgtcttgggcccagggcttggtag

SEQ ID NO: 316309 - DNA, 25 bp, Artificial Sequence
  Description of Artificial Sequence: Synthetic oligonucleotide
gtcttgggcccagggcttggtagca

SEQ ID NO: 316310 - DNA, 26 bp, Artificial Sequence
  Description of Artificial Sequence: Synthetic oligonucleotide
tcttgggcccagggcttggtagcact

SEQ ID NO: 316311 - DNA, 25 bp, Artificial Sequence
  Description of Artificial Sequence: Synthetic oligonucleotide
cttgggcccagggcttggtagcact

SEQ ID NO: 316312 - DNA, 25 bp, Artificial Sequence
  Description of Artificial Sequence: Synthetic oligonucleotide
ttgggcccagggcttggtagcactg

SEQ ID NO: 316313 - DNA, 24 bp, Artificial Sequence
  Description of Artificial Sequence: Synthetic oligonucleotide
tgggcccagggcttggtagcactg

SEQ ID NO: 316314 - DNA, 23 bp, Artificial Sequence
  Description of Artificial Sequence: Synthetic oligonucleotide
gggcccagggcttggtagcactg

SEQ ID NO: 316315 - DNA, 23 bp, Artificial Sequence
  Description of Artificial Sequence: Synthetic oligonucleotide
ggcccagggcttggtagcactgg

SEQ ID NO: 316316 - DNA, 24 bp, Artificial Sequence
  Description of Artificial Sequence: Synthetic oligonucleotide
gcccagggcttggtagcactggca

SEQ ID NO: 316317 - DNA, 24 bp, Artificial Sequence
  Description of Artificial Sequence: Synthetic oligonucleotide
cccagggcttggtagcactggcag

SEQ ID NO: 316318 - DNA, 25 bp, Artificial Sequence
  Description of Artificial Sequence: Synthetic oligonucleotide
ccagggcttggtagcactggcagct

SEQ ID NO: 316319 - DNA, 26 bp, Artificial Sequence
  Description of Artificial Sequence: Synthetic oligonucleotide
cagggcttggtagcactggcagctct

SEQ ID NO: 316320 - DNA, 26 bp, Artificial Sequence
  Description of Artificial Sequence: Synthetic oligonucleotide
agggcttggtagcactggcagctctg

SEQ ID NO: 316321 - DNA, 25 bp, Artificial Sequence
  Description of Artificial Sequence: Synthetic oligonucleotide
gggcttggtagcactggcagctctg

SEQ ID NO: 316322 - DNA, 25 bp, Artificial Sequence
  Description of Artificial Sequence: Synthetic oligonucleotide
ggcttggtagcactggcagctctgg

SEQ ID NO: 316323 - DNA, 25 bp, Artificial Sequence
  Description of Artificial Sequence: Synthetic oligonucleotide
gcttggtagcactggcagctctggc

SEQ ID NO: 316324 - DNA, 26 bp, Artificial Sequence
  Description of Artificial Sequence: Synthetic oligonucleotide
cttggtagcactggcagctctggcct

SEQ ID NO: 316325 - DNA, 27 bp, Artificial Sequence
  Description of Artificial Sequence: Synthetic oligonucleotide
ttggtagcactggcagctctggcctgt

SEQ ID NO: 316326 - DNA, 26 bp, Artificial Sequence
  Description of Artificial Sequence: Synthetic oligonucleotide
tggtagcactggcagctctggcctgt

SEQ ID NO: 316327 - DNA, 25 bp, Artificial Sequence
  Description of Artificial Sequence: Synthetic oligonucleotide
ggtagcactggcagctctggcctgt

SEQ ID NO: 316328 - DNA, 27 bp, Artificial Sequence
  Description of Artificial Sequence: Synthetic oligonucleotide
gtagcactggcagctctggcctgtgta

SEQ ID NO: 316329 - DNA, 27 bp, Artificial Sequence
  Description of Artificial Sequence: Synthetic oligonucleotide
tagcactggcagctctggcctgtgtag

SEQ ID NO: 316330 - DNA, 26 bp, Artificial Sequence
  Description of Artificial Sequence: Synthetic oligonucleotide
agcactggcagctctggcctgtgtag

SEQ ID NO: 316331 - DNA, 25 bp, Artificial Sequence
  Description of Artificial Sequence: Synthetic oligonucleotide
gcactggcagctctggcctgtgtag

SEQ ID NO: 316332 - DNA, 25 bp, Artificial Sequence
  Description of Artificial Sequence: Synthetic oligonucleotide
cactggcagctctggcctgtgtagg

SEQ ID NO: 316333 - DNA, 26 bp, Artificial Sequence
  Description of Artificial Sequence: Synthetic oligonucleotide
actggcagctctggcctgtgtaggct

SEQ ID NO: 316334 - DNA, 25 bp, Artificial Sequence
  Description of Artificial Sequence: Synthetic oligonucleotide
ctggcagctctggcctgtgtaggct

SEQ ID NO: 316335 - DNA, 25 bp, Artificial Sequence
  Description of Artificial Sequence: Synthetic oligonucleotide
tggcagctctggcctgtgtaggctg

SEQ ID NO: 316336 - DNA, 24 bp, Artificial Sequence
  Description of Artificial Sequence: Synthetic oligonucleotide
ggcagctctggcctgtgtaggctg

SEQ ID NO: 316337 - DNA, 24 bp, Artificial Sequence
  Description of Artificial Sequence: Synthetic oligonucleotide
gcagctctggcctgtgtaggctgg

SEQ ID NO: 316338 - DNA, 24 bp, Artificial Sequence
  Description of Artificial Sequence: Synthetic oligonucleotide
cagctctggcctgtgtaggctggg

SEQ ID NO: 316339 - DNA, 26 bp, Artificial Sequence
  Description of Artificial Sequence: Synthetic oligonucleotide
agctctggcctgtgtaggctgggcta

SEQ ID NO: 316340 - DNA, 25 bp, Artificial Sequence
  Description of Artificial Sequence: Synthetic oligonucleotide
gctctggcctgtgtaggctgggcta

SEQ ID NO: 316341 - DNA, 26 bp, Artificial Sequence
  Description of Artificial Sequence: Synthetic oligonucleotide
ctctggcctgtgtaggctgggctaca

SEQ ID NO: 316342 - DNA, 27 bp, Artificial Sequence
  Description of Artificial Sequence: Synthetic oligonucleotide
tctggcctgtgtaggctgggctacagt

SEQ ID NO: 316343 - DNA, 26 bp, Artificial Sequence
  Description of Artificial Sequence: Synthetic oligonucleotide
ctggcctgtgtaggctgggctacagt

SEQ ID NO: 316344 - DNA, 27 bp, Artificial Sequence
  Description of Artificial Sequence: Synthetic oligonucleotide
tggcctgtgtaggctgggctacagtgt

SEQ ID NO: 316345 - DNA, 26 bp, Artificial Sequence
  Description of Artificial Sequence: Synthetic oligonucleotide
ggcctgtgtaggctgggctacagtgt

SEQ ID NO: 316346 - DNA, 27 bp, Artificial Sequence
  Description of Artificial Sequence: Synthetic oligonucleotide
gcctgtgtaggctgggctacagtgtct

SEQ ID NO: 316347 - DNA, 27 bp, Artificial Sequence
  Description of Artificial Sequence: Synthetic oligonucleotide
cctgtgtaggctgggctacagtgtctg

SEQ ID NO: 316348 - DNA, 27 bp, Artificial Sequence
  Description of Artificial Sequence: Synthetic oligonucleotide
ctgtgtaggctgggctacagtgtctgg

SEQ ID NO: 316349 - DNA, 30 bp, Artificial Sequence
  Description of Artificial Sequence: Synthetic oligonucleotide
tgtgtaggctgggctacagtgtctggtttg

SEQ ID NO: 316350 - DNA, 29 bp, Artificial Sequence
  Description of Artificial Sequence: Synthetic oligonucleotide
gtgtaggctgggctacagtgtctggtttg

SEQ ID NO: 316351 - DNA, 29 bp, Artificial Sequence
  Description of Artificial Sequence: Synthetic oligonucleotide
tgtaggctgggctacagtgtctggtttgg

SEQ ID NO: 316352 - DNA, 28 bp, Artificial Sequence
  Description of Artificial Sequence: Synthetic oligonucleotide
gtaggctgggctacagtgtctggtttgg

SEQ ID NO: 316353 - DNA, 28 bp, Artificial Sequence
  Description of Artificial Sequence: Synthetic oligonucleotide
taggctgggctacagtgtctggtttggc

SEQ ID NO: 316354 - DNA, 27 bp, Artificial Sequence
  Description of Artificial Sequence: Synthetic oligonucleotide
aggctgggctacagtgtctggtttggc

SEQ ID NO: 316355 - DNA, 27 bp, Artificial Sequence
  Description of Artificial Sequence: Synthetic oligonucleotide
ggctgggctacagtgtctggtttggct

SEQ ID NO: 316356 - DNA, 27 bp, Artificial Sequence
  Description of Artificial Sequence: Synthetic oligonucleotide
gctgggctacagtgtctggtttggctc

SEQ ID NO: 316357 - DNA, 28 bp, Artificial Sequence
  Description of Artificial Sequence: Synthetic oligonucleotide
ctgggctacagtgtctggtttggctcag

SEQ ID NO: 316358 - DNA, 28 bp, Artificial Sequence
  Description of Artificial Sequence: Synthetic oligonucleotide
tgggctacagtgtctggtttggctcagc

SEQ ID NO: 316359 - DNA, 27 bp, Artificial Sequence
  Description of Artificial Sequence: Synthetic oligonucleotide
gggctacagtgtctggtttggctcagc

SEQ ID NO: 316360 - DNA, 27 bp, Artificial Sequence
  Description of Artificial Sequence: Synthetic oligonucleotide
ggctacagtgtctggtttggctcagcg

SEQ ID NO: 316361 - DNA, 30 bp, Artificial Sequence
  Description of Artificial Sequence: Synthetic oligonucleotide
gctacagtgtctggtttggctcagcgtttg

SEQ ID NO: 316362 - DNA, 30 bp, Artificial Sequence
  Description of Artificial Sequence: Synthetic oligonucleotide
ctacagtgtctggtttggctcagcgtttgc

SEQ ID NO: 316363 - DNA, 30 bp, Artificial Sequence
  Description of Artificial Sequence: Synthetic oligonucleotide
tacagtgtctggtttggctcagcgtttgcc

SEQ ID NO: 316364 - DNA, 29 bp, Artificial Sequence
  Description of Artificial Sequence: Synthetic oligonucleotide
acagtgtctggtttggctcagcgtttgcc

SEQ ID NO: 316365 - DNA, 28 bp, Artificial Sequence
  Description of Artificial Sequence: Synthetic oligonucleotide
cagtgtctggtttggctcagcgtttgcc

SEQ ID NO: 316366 - DNA, 28 bp, Artificial Sequence
  Description of Artificial Sequence: Synthetic oligonucleotide
agtgtctggtttggctcagcgtttgccc

SEQ ID NO: 316367 - DNA, 27 bp, Artificial Sequence
  Description of Artificial Sequence: Synthetic oligonucleotide
gtgtctggtttggctcagcgtttgccc

SEQ ID NO: 316368 - DNA, 28 bp, Artificial Sequence
  Description of Artificial Sequence: Synthetic oligonucleotide
tgtctggtttggctcagcgtttgcccag

SEQ ID NO: 316369 - DNA, 27 bp, Artificial Sequence
  Description of Artificial Sequence: Synthetic oligonucleotide
gtctggtttggctcagcgtttgcccag

SEQ ID NO: 316370 - DNA, 27 bp, Artificial Sequence
  Description of Artificial Sequence: Synthetic oligonucleotide
tctggtttggctcagcgtttgcccagc

SEQ ID NO: 316371 - DNA, 26 bp, Artificial Sequence
  Description of Artificial Sequence: Synthetic oligonucleotide
ctggtttggctcagcgtttgcccagc

SEQ ID NO: 316372 - DNA, 27 bp, Artificial Sequence
  Description of Artificial Sequence: Synthetic oligonucleotide
tggtttggctcagcgtttgcccagcct

SEQ ID NO: 316373 - DNA, 27 bp, Artificial Sequence
  Description of Artificial Sequence: Synthetic oligonucleotide
ggtttggctcagcgtttgcccagcctt

SEQ ID NO: 316374 - DNA, 28 bp, Artificial Sequence
  Description of Artificial Sequence: Synthetic oligonucleotide
gtttggctcagcgtttgcccagcctttg

SEQ ID NO: 316375 - DNA, 28 bp, Artificial Sequence
  Description of Artificial Sequence: Synthetic oligonucleotide
tttggctcagcgtttgcccagcctttgc

SEQ ID NO: 316376 - DNA, 27 bp, Artificial Sequence
  Description of Artificial Sequence: Synthetic oligonucleotide
ttggctcagcgtttgcccagcctttgc

SEQ ID NO: 316377 - DNA, 27 bp, Artificial Sequence
  Description of Artificial Sequence: Synthetic oligonucleotide
tggctcagcgtttgcccagcctttgct

SEQ ID NO: 316378 - DNA, 26 bp, Artificial Sequence
  Description of Artificial Sequence: Synthetic oligonucleotide
ggctcagcgtttgcccagcctttgct

SEQ ID NO: 316379 - DNA, 26 bp, Artificial Sequence
  Description of Artificial Sequence: Synthetic oligonucleotide
gctcagcgtttgcccagcctttgctg

SEQ ID NO: 316380 - DNA, 27 bp, Artificial Sequence
  Description of Artificial Sequence: Synthetic oligonucleotide
ctcagcgtttgcccagcctttgctgca

SEQ ID NO: 316381 - DNA, 28 bp, Artificial Sequence
  Description of Artificial Sequence: Synthetic oligonucleotide
tcagcgtttgcccagcctttgctgcaag

SEQ ID NO: 316382 - DNA, 27 bp, Artificial Sequence
  Description of Artificial Sequence: Synthetic oligonucleotide
cagcgtttgcccagcctttgctgcaag

SEQ ID NO: 316383 - DNA, 27 bp, Artificial Sequence
  Description of Artificial Sequence: Synthetic oligonucleotide
agcgtttgcccagcctttgctgcaagg

SEQ ID NO: 316384 - DNA, 26 bp, Artificial Sequence
  Description of Artificial Sequence: Synthetic oligonucleotide
gcgtttgcccagcctttgctgcaagg

SEQ ID NO: 316385 - DNA, 27 bp, Artificial Sequence
  Description of Artificial Sequence: Synthetic oligonucleotide
cgtttgcccagcctttgctgcaagggt

SEQ ID NO: 316386 - DNA, 27 bp, Artificial Sequence
  Description of Artificial Sequence: Synthetic oligonucleotide
gtttgcccagcctttgctgcaagggtg

SEQ ID NO: 316387 - DNA, 27 bp, Artificial Sequence
  Description of Artificial Sequence: Synthetic oligonucleotide
tttgcccagcctttgctgcaagggtgc

SEQ ID NO: 316388 - DNA, 26 bp, Artificial Sequence
  Description of Artificial Sequence: Synthetic oligonucleotide
ttgcccagcctttgctgcaagggtgc

SEQ ID NO: 316389 - DNA, 25 bp, Artificial Sequence
  Description of Artificial Sequence: Synthetic oligonucleotide
tgcccagcctttgctgcaagggtgc

SEQ ID NO: 316390 - DNA, 24 bp, Artificial Sequence
  Description of Artificial Sequence: Synthetic oligonucleotide
gcccagcctttgctgcaagggtgc

SEQ ID NO: 316391 - DNA, 26 bp, Artificial Sequence
  Description of Artificial Sequence: Synthetic oligonucleotide
cccagcctttgctgcaagggtgccaa

SEQ ID NO: 316392 - DNA, 26 bp, Artificial Sequence
  Description of Artificial Sequence: Synthetic oligonucleotide
ccagcctttgctgcaagggtgccaag

SEQ ID NO: 316393 - DNA, 26 bp, Artificial Sequence
  Description of Artificial Sequence: Synthetic oligonucleotide
cagcctttgctgcaagggtgccaagc

SEQ ID NO: 316394 - DNA, 27 bp, Artificial Sequence
  Description of Artificial Sequence: Synthetic oligonucleotide
agcctttgctgcaagggtgccaagcct

SEQ ID NO: 316395 - DNA, 26 bp, Artificial Sequence
  Description of Artificial Sequence: Synthetic oligonucleotide
gcctttgctgcaagggtgccaagcct

SEQ ID NO: 316396 - DNA, 26 bp, Artificial Sequence
  Description of Artificial Sequence: Synthetic oligonucleotide
cctttgctgcaagggtgccaagcctc

SEQ ID NO: 316397 - DNA, 26 bp, Artificial Sequence
  Description of Artificial Sequence: Synthetic oligonucleotide
ctttgctgcaagggtgccaagcctcc

SEQ ID NO: 316398 - DNA, 27 bp, Artificial Sequence
  Description of Artificial Sequence: Synthetic oligonucleotide
tttgctgcaagggtgccaagcctccct

SEQ ID NO: 316399 - DNA, 26 bp, Artificial Sequence
  Description of Artificial Sequence: Synthetic oligonucleotide
ttgctgcaagggtgccaagcctccct

SEQ ID NO: 316400 - DNA, 25 bp, Artificial Sequence
  Description of Artificial Sequence: Synthetic oligonucleotide
tgctgcaagggtgccaagcctccct

SEQ ID NO: 316401 - DNA, 24 bp, Artificial Sequence
  Description of Artificial Sequence: Synthetic oligonucleotide
gctgcaagggtgccaagcctccct

SEQ ID NO: 316402 - DNA, 24 bp, Artificial Sequence
  Description of Artificial Sequence: Synthetic oligonucleotide
ctgcaagggtgccaagcctccctg

SEQ ID NO: 316403 - DNA, 24 bp, Artificial Sequence
  Description of Artificial Sequence: Synthetic oligonucleotide
tgcaagggtgccaagcctccctgc

SEQ ID NO: 316404 - DNA, 23 bp, Artificial Sequence
  Description of Artificial Sequence: Synthetic oligonucleotide
gcaagggtgccaagcctccctgc

SEQ ID NO: 316405 - DNA, 23 bp, Artificial Sequence
  Description of Artificial Sequence: Synthetic oligonucleotide
caagggtgccaagcctccctgcg

SEQ ID NO: 316406 - DNA, 23 bp, Artificial Sequence
  Description of Artificial Sequence: Synthetic oligonucleotide
aagggtgccaagcctccctgcgc

SEQ ID NO: 316407 - DNA, 22 bp, Artificial Sequence
  Description of Artificial Sequence: Synthetic oligonucleotide
agggtgccaagcctccctgcgc

SEQ ID NO: 316408 - DNA, 21 bp, Artificial Sequence
  Description of Artificial Sequence: Synthetic oligonucleotide
gggtgccaagcctccctgcgc

SEQ ID NO: 316409 - DNA, 22 bp, Artificial Sequence
  Description of Artificial Sequence: Synthetic oligonucleotide
ggtgccaagcctccctgcgcca

SEQ ID NO: 316410 - DNA, 23 bp, Artificial Sequence
  Description of Artificial Sequence: Synthetic oligonucleotide
gtgccaagcctccctgcgccaca

SEQ ID NO: 316411 - DNA, 24 bp, Artificial Sequence
  Description of Artificial Sequence: Synthetic oligonucleotide
tgccaagcctccctgcgccacaga

SEQ ID NO: 316412 - DNA, 23 bp, Artificial Sequence
  Description of Artificial Sequence: Synthetic oligonucleotide
gccaagcctccctgcgccacaga

SEQ ID NO: 316413 - DNA, 24 bp, Artificial Sequence
  Description of Artificial Sequence: Synthetic oligonucleotide
ccaagcctccctgcgccacagaca

SEQ ID NO: 316414 - DNA, 24 bp, Artificial Sequence
  Description of Artificial Sequence: Synthetic oligonucleotide
caagcctccctgcgccacagacag

SEQ ID NO: 316415 - DNA, 24 bp, Artificial Sequence
  Description of Artificial Sequence: Synthetic oligonucleotide
aagcctccctgcgccacagacagg

SEQ ID NO: 316416 - DNA, 23 bp, Artificial Sequence
  Description of Artificial Sequence: Synthetic oligonucleotide
agcctccctgcgccacagacagg

SEQ ID NO: 316417 - DNA, 22 bp, Artificial Sequence
  Description of Artificial Sequence: Synthetic oligonucleotide
gcctccctgcgccacagacagg

SEQ ID NO: 316418 - DNA, 23 bp, Artificial Sequence
  Description of Artificial Sequence: Synthetic oligonucleotide
cctccctgcgccacagacagggt

SEQ ID NO: 316419 - DNA, 23 bp, Artificial Sequence
  Description of Artificial Sequence: Synthetic oligonucleotide
ctccctgcgccacagacagggtg

SEQ ID NO: 316420 - DNA, 24 bp, Artificial Sequence
  Description of Artificial Sequence: Synthetic oligonucleotide
tccctgcgccacagacagggtgca

SEQ ID NO: 316421 - DNA, 23 bp, Artificial Sequence
  Description of Artificial Sequence: Synthetic oligonucleotide
ccctgcgccacagacagggtgca

SEQ ID NO: 316422 - DNA, 23 bp, Artificial Sequence
  Description of Artificial Sequence: Synthetic oligonucleotide
cctgcgccacagacagggtgcag

SEQ ID NO: 316423 - DNA, 23 bp, Artificial Sequence
  Description of Artificial Sequence: Synthetic oligonucleotide
ctgcgccacagacagggtgcagg

SEQ ID NO: 316424 - DNA, 23 bp, Artificial Sequence
  Description of Artificial Sequence: Synthetic oligonucleotide
tgcgccacagacagggtgcaggg

SEQ ID NO: 316425 - DNA, 22 bp, Artificial Sequence
  Description of Artificial Sequence: Synthetic oligonucleotide
gcgccacagacagggtgcaggg

SEQ ID NO: 316426 - DNA, 23 bp, Artificial Sequence
  Description of Artificial Sequence: Synthetic oligonucleotide
cgccacagacagggtgcagggca

SEQ ID NO: 316427 - DNA, 23 bp, Artificial Sequence
  Description of Artificial Sequence: Synthetic oligonucleotide
gccacagacagggtgcagggcag

SEQ ID NO: 316428 - DNA, 24 bp, Artificial Sequence
  Description of Artificial Sequence: Synthetic oligonucleotide
ccacagacagggtgcagggcaggt

SEQ ID NO: 316429 - DNA, 24 bp, Artificial Sequence
  Description of Artificial Sequence: Synthetic oligonucleotide
cacagacagggtgcagggcaggtc

SEQ ID NO: 316430 - DNA, 24 bp, Artificial Sequence
  Description of Artificial Sequence: Synthetic oligonucleotide
acagacagggtgcagggcaggtcc

SEQ ID NO: 316431 - DNA, 23 bp, Artificial Sequence
  Description of Artificial Sequence: Synthetic oligonucleotide
cagacagggtgcagggcaggtcc

SEQ ID NO: 316432 - DNA, 24 bp, Artificial Sequence
  Description of Artificial Sequence: Synthetic oligonucleotide
agacagggtgcagggcaggtccca

SEQ ID NO: 316433 - DNA, 23 bp, Artificial Sequence
  Description of Artificial Sequence: Synthetic oligonucleotide
gacagggtgcagggcaggtccca

SEQ ID NO: 316434 - DNA, 23 bp, Artificial Sequence
  Description of Artificial Sequence: Synthetic oligonucleotide
acagggtgcagggcaggtcccac

SEQ ID NO: 316435 - DNA, 22 bp, Artificial Sequence
  Description of Artificial Sequence: Synthetic oligonucleotide
cagggtgcagggcaggtcccac

SEQ ID NO: 316436 - DNA, 22 bp, Artificial Sequence
  Description of Artificial Sequence: Synthetic oligonucleotide
agggtgcagggcaggtcccacg

SEQ ID NO: 316437 - DNA, 21 bp, Artificial Sequence
  Description of Artificial Sequence: Synthetic oligonucleotide
gggtgcagggcaggtcccacg

SEQ ID NO: 316438 - DNA, 21 bp, Artificial Sequence
  Description of Artificial Sequence: Synthetic oligonucleotide
ggtgcagggcaggtcccacgc

SEQ ID NO: 316439 - DNA, 22 bp, Artificial Sequence
  Description of Artificial Sequence: Synthetic oligonucleotide
gtgcagggcaggtcccacgcct

SEQ ID NO: 316440 - DNA, 23 bp, Artificial Sequence
  Description of Artificial Sequence: Synthetic oligonucleotide
tgcagggcaggtcccacgcctca

SEQ ID NO: 316441 - DNA, 22 bp, Artificial Sequence
  Description of Artificial Sequence: Synthetic oligonucleotide
gcagggcaggtcccacgcctca

SEQ ID NO: 316442 - DNA, 22 bp, Artificial Sequence
  Description of Artificial Sequence: Synthetic oligonucleotide
cagggcaggtcccacgcctcac

SEQ ID NO: 316443 - DNA, 22 bp, Artificial Sequence
  Description of Artificial Sequence: Synthetic oligonucleotide
agggcaggtcccacgcctcacc

SEQ ID NO: 316444 - DNA, 21 bp, Artificial Sequence
  Description of Artificial Sequence: Synthetic oligonucleotide
gggcaggtcccacgcctcacc

SEQ ID NO: 316445 - DNA, 22 bp, Artificial Sequence
  Description of Artificial Sequence: Synthetic oligonucleotide
ggcaggtcccacgcctcaccca

SEQ ID NO: 316446 - DNA, 22 bp, Artificial Sequence
  Description of Artificial Sequence: Synthetic oligonucleotide
gcaggtcccacgcctcacccag

SEQ ID NO: 316447 - DNA, 22 bp, Artificial Sequence
  Description of Artificial Sequence: Synthetic oligonucleotide
caggtcccacgcctcacccagg

SEQ ID NO: 316448 - DNA, 22 bp, Artificial Sequence
  Description of Artificial Sequence: Synthetic oligonucleotide
aggtcccacgcctcacccaggg

SEQ ID NO: 316449 - DNA, 21 bp, Artificial Sequence
  Description of Artificial Sequence: Synthetic oligonucleotide
ggtcccacgcctcacccaggg

SEQ ID NO: 316450 - DNA, 21 bp, Artificial Sequence
  Description of Artificial Sequence: Synthetic oligonucleotide
gtcccacgcctcacccagggg

SEQ ID NO: 316451 - DNA, 22 bp, Artificial Sequence
  Description of Artificial Sequence: Synthetic oligonucleotide
tcccacgcctcacccaggggct

SEQ ID NO: 316452 - DNA, 21 bp, Artificial Sequence
  Description of Artificial Sequence: Synthetic oligonucleotide
cccacgcctcacccaggggct

SEQ ID NO: 316453 - DNA, 22 bp, Artificial Sequence
  Description of Artificial Sequence: Synthetic oligonucleotide
ccacgcctcacccaggggctca

SEQ ID NO: 316454 - DNA, 23 bp, Artificial Sequence
  Description of Artificial Sequence: Synthetic oligonucleotide
cacgcctcacccaggggctcaca

SEQ ID NO: 316455 - DNA, 24 bp, Artificial Sequence
  Description of Artificial Sequence: Synthetic oligonucleotide
acgcctcacccaggggctcacagt

SEQ ID NO: 316456 - DNA, 23 bp, Artificial Sequence
  Description of Artificial Sequence: Synthetic oligonucleotide
cgcctcacccaggggctcacagt

SEQ ID NO: 316457 - DNA, 23 bp, Artificial Sequence
  Description of Artificial Sequence: Synthetic oligonucleotide
gcctcacccaggggctcacagtg

SEQ ID NO: 316458 - DNA, 23 bp, Artificial Sequence
  Description of Artificial Sequence: Synthetic oligonucleotide
cctcacccaggggctcacagtgg

SEQ ID NO: 316459 - DNA, 27 bp, Artificial Sequence
  Description of Artificial Sequence: Synthetic oligonucleotide
ctcacccaggggctcacagtgggaatt

SEQ ID NO: 316460 - DNA, 28 bp, Artificial Sequence
  Description of Artificial Sequence: Synthetic oligonucleotide
tcacccaggggctcacagtgggaattag

SEQ ID NO: 316461 - DNA, 27 bp, Artificial Sequence
  Description of Artificial Sequence: Synthetic oligonucleotide
cacccaggggctcacagtgggaattag

SEQ ID NO: 316462 - DNA, 27 bp, Artificial Sequence
  Description of Artificial Sequence: Synthetic oligonucleotide
acccaggggctcacagtgggaattagg

SEQ ID NO: 316463 - DNA, 26 bp, Artificial Sequence
  Description of Artificial Sequence: Synthetic oligonucleotide
cccaggggctcacagtgggaattagg

SEQ ID NO: 316464 - DNA, 26 bp, Artificial Sequence
  Description of Artificial Sequence: Synthetic oligonucleotide
ccaggggctcacagtgggaattaggg

SEQ ID NO: 316465 - DNA, 27 bp, Artificial Sequence
  Description of Artificial Sequence: Synthetic oligonucleotide
caggggctcacagtgggaattagggga

SEQ ID NO: 316466 - DNA, 27 bp, Artificial Sequence
  Description of Artificial Sequence: Synthetic oligonucleotide
aggggctcacagtgggaattaggggag

SEQ ID NO: 316467 - DNA, 27 bp, Artificial Sequence
  Description of Artificial Sequence: Synthetic oligonucleotide
ggggctcacagtgggaattaggggagt

SEQ ID NO: 316468 - DNA, 27 bp, Artificial Sequence
  Description of Artificial Sequence: Synthetic oligonucleotide
gggctcacagtgggaattaggggagtg

SEQ ID NO: 316469 - DNA, 27 bp, Artificial Sequence
  Description of Artificial Sequence: Synthetic oligonucleotide
ggctcacagtgggaattaggggagtgg

SEQ ID NO: 316470 - DNA, 27 bp, Artificial Sequence
  Description of Artificial Sequence: Synthetic oligonucleotide
gctcacagtgggaattaggggagtggg

SEQ ID NO: 316471 - DNA, 28 bp, Artificial Sequence
  Description of Artificial Sequence: Synthetic oligonucleotide
ctcacagtgggaattaggggagtgggtg

SEQ ID NO: 316472 - DNA, 28 bp, Artificial Sequence
  Description of Artificial Sequence: Synthetic oligonucleotide
tcacagtgggaattaggggagtgggtgc

SEQ ID NO: 316473 - DNA, 27 bp, Artificial Sequence
  Description of Artificial Sequence: Synthetic oligonucleotide
cacagtgggaattaggggagtgggtgc

SEQ ID NO: 316474 - DNA, 27 bp, Artificial Sequence
  Description of Artificial Sequence: Synthetic oligonucleotide
acagtgggaattaggggagtgggtgcc

SEQ ID NO: 316475 - DNA, 26 bp, Artificial Sequence
  Description of Artificial Sequence: Synthetic oligonucleotide
cagtgggaattaggggagtgggtgcc

SEQ ID NO: 316476 - DNA, 27 bp, Artificial Sequence
  Description of Artificial Sequence: Synthetic oligonucleotide
agtgggaattaggggagtgggtgccct

SEQ ID NO: 316477 - DNA, 27 bp, Artificial Sequence
  Description of Artificial Sequence: Synthetic oligonucleotide
gtgggaattaggggagtgggtgcccta

SEQ ID NO: 316478 - DNA, 27 bp, Artificial Sequence
  Description of Artificial Sequence: Synthetic oligonucleotide
tgggaattaggggagtgggtgccctac

SEQ ID NO: 316479 - DNA, 27 bp, Artificial Sequence
  Description of Artificial Sequence: Synthetic oligonucleotide
gggaattaggggagtgggtgccctact

SEQ ID NO: 316480 - DNA, 27 bp, Artificial Sequence
  Description of Artificial Sequence: Synthetic oligonucleotide
ggaattaggggagtgggtgccctactc

SEQ ID NO: 316481 - DNA, 28 bp, Artificial Sequence
  Description of Artificial Sequence: Synthetic oligonucleotide
gaattaggggagtgggtgccctactcac

SEQ ID NO: 316482 - DNA, 29 bp, Artificial Sequence
  Description of Artificial Sequence: Synthetic oligonucleotide
aattaggggagtgggtgccctactcacac

SEQ ID NO: 316483 - DNA, 28 bp, Artificial Sequence
  Description of Artificial Sequence: Synthetic oligonucleotide
attaggggagtgggtgccctactcacac

SEQ ID NO: 316484 - DNA, 27 bp, Artificial Sequence
  Description of Artificial Sequence: Synthetic oligonucleotide
ttaggggagtgggtgccctactcacac

SEQ ID NO: 316485 - DNA, 27 bp, Artificial Sequence
  Description of Artificial Sequence: Synthetic oligonucleotide
taggggagtgggtgccctactcacact

SEQ ID NO: 316486 - DNA, 26 bp, Artificial Sequence
  Description of Artificial Sequence: Synthetic oligonucleotide
aggggagtgggtgccctactcacact

SEQ ID NO: 316487 - DNA, 25 bp, Artificial Sequence
  Description of Artificial Sequence: Synthetic oligonucleotide
ggggagtgggtgccctactcacact

SEQ ID NO: 316488 - DNA, 25 bp, Artificial Sequence
  Description of Artificial Sequence: Synthetic oligonucleotide
gggagtgggtgccctactcacactg

SEQ ID NO: 316489 - DNA, 25 bp, Artificial Sequence
  Description of Artificial Sequence: Synthetic oligonucleotide
ggagtgggtgccctactcacactgc

SEQ ID NO: 316490 - DNA, 26 bp, Artificial Sequence
  Description of Artificial Sequence: Synthetic oligonucleotide
gagtgggtgccctactcacactgcct

SEQ ID NO: 316491 - DNA, 27 bp, Artificial Sequence
  Description of Artificial Sequence: Synthetic oligonucleotide
agtgggtgccctactcacactgcctct

SEQ ID NO: 316492 - DNA, 26 bp, Artificial Sequence
  Description of Artificial Sequence: Synthetic oligonucleotide
gtgggtgccctactcacactgcctct

SEQ ID NO: 316493 - DNA, 27 bp, Artificial Sequence
  Description of Artificial Sequence: Synthetic oligonucleotide
tgggtgccctactcacactgcctctca

SEQ ID NO: 316494 - DNA, 26 bp, Artificial Sequence
  Description of Artificial Sequence: Synthetic oligonucleotide
gggtgccctactcacactgcctctca

SEQ ID NO: 316495 - DNA, 26 bp, Artificial Sequence
  Description of Artificial Sequence: Synthetic oligonucleotide
ggtgccctactcacactgcctctcac

SEQ ID NO: 316496 - DNA, 26 bp, Artificial Sequence
  Description of Artificial Sequence: Synthetic oligonucleotide
gtgccctactcacactgcctctcacc

SEQ ID NO: 316497 - DNA, 27 bp, Artificial Sequence
  Description of Artificial Sequence: Synthetic oligonucleotide
tgccctactcacactgcctctcaccct

SEQ ID NO: 316498 - DNA, 26 bp, Artificial Sequence
  Description of Artificial Sequence: Synthetic oligonucleotide
gccctactcacactgcctctcaccct

SEQ ID NO: 316499 - DNA, 26 bp, Artificial Sequence
  Description of Artificial Sequence: Synthetic oligonucleotide
ccctactcacactgcctctcaccctg

SEQ ID NO: 316500 - DNA, 26 bp, Artificial Sequence
  Description of Artificial Sequence: Synthetic oligonucleotide
cctactcacactgcctctcaccctgg

SEQ ID NO: 316501 - DNA, 26 bp, Artificial Sequence
  Description of Artificial Sequence: Synthetic oligonucleotide
ctactcacactgcctctcaccctggg

SEQ ID NO: 316502 - DNA, 27 bp, Artificial Sequence
  Description of Artificial Sequence: Synthetic oligonucleotide
tactcacactgcctctcaccctgggca

SEQ ID NO: 316503 - DNA, 26 bp, Artificial Sequence
  Description of Artificial Sequence: Synthetic oligonucleotide
actcacactgcctctcaccctgggca

SEQ ID NO: 316504 - DNA, 25 bp, Artificial Sequence
  Description of Artificial Sequence: Synthetic oligonucleotide
ctcacactgcctctcaccctgggca

SEQ ID NO: 316505 - DNA, 26 bp, Artificial Sequence
  Description of Artificial Sequence: Synthetic oligonucleotide
tcacactgcctctcaccctgggcagt

SEQ ID NO: 316506 - DNA, 25 bp, Artificial Sequence
  Description of Artificial Sequence: Synthetic oligonucleotide
cacactgcctctcaccctgggcagt

SEQ ID NO: 316507 - DNA, 25 bp, Artificial Sequence
  Description of Artificial Sequence: Synthetic oligonucleotide
acactgcctctcaccctgggcagtg

SEQ ID NO: 316508 - DNA, 24 bp, Artificial Sequence
  Description of Artificial Sequence: Synthetic oligonucleotide
cactgcctctcaccctgggcagtg

SEQ ID NO: 316509 - DNA, 25 bp, Artificial Sequence
  Description of Artificial Sequence: Synthetic oligonucleotide
actgcctctcaccctgggcagtggt

SEQ ID NO: 316510 - DNA, 24 bp, Artificial Sequence
  Description of Artificial Sequence: Synthetic oligonucleotide
ctgcctctcaccctgggcagtggt

SEQ ID NO: 316511 - DNA, 24 bp, Artificial Sequence
  Description of Artificial Sequence: Synthetic oligonucleotide
tgcctctcaccctgggcagtggtg

SEQ ID NO: 316512 - DNA, 23 bp, Artificial Sequence
  Description of Artificial Sequence: Synthetic oligonucleotide
gcctctcaccctgggcagtggtg

SEQ ID NO: 316513 - DNA, 25 bp, Artificial Sequence
  Description of Artificial Sequence: Synthetic oligonucleotide
cctctcaccctgggcagtggtgcat

SEQ ID NO: 316514 - DNA, 26 bp, Artificial Sequence
  Description of Artificial Sequence: Synthetic oligonucleotide
ctctcaccctgggcagtggtgcatct

SEQ ID NO: 316515 - DNA, 26 bp, Artificial Sequence
  Description of Artificial Sequence: Synthetic oligonucleotide
tctcaccctgggcagtggtgcatctg

SEQ ID NO: 316516 - DNA, 25 bp, Artificial Sequence
  Description of Artificial Sequence: Synthetic oligonucleotide
ctcaccctgggcagtggtgcatctg

SEQ ID NO: 316517 - DNA, 26 bp, Artificial Sequence
  Description of Artificial Sequence: Synthetic oligonucleotide
tcaccctgggcagtggtgcatctggt

SEQ ID NO: 316518 - DNA, 25 bp, Artificial Sequence
  Description of Artificial Sequence: Synthetic oligonucleotide
caccctgggcagtggtgcatctggt

SEQ ID NO: 316519 - DNA, 25 bp, Artificial Sequence
  Description of Artificial Sequence: Synthetic oligonucleotide
accctgggcagtggtgcatctggtg

SEQ ID NO: 316520 - DNA, 24 bp, Artificial Sequence
  Description of Artificial Sequence: Synthetic oligonucleotide
ccctgggcagtggtgcatctggtg

SEQ ID NO: 316521 - DNA, 25 bp, Artificial Sequence
  Description of Artificial Sequence: Synthetic oligonucleotide
cctgggcagtggtgcatctggtgga

SEQ ID NO: 316522 - DNA, 26 bp, Artificial Sequence
  Description of Artificial Sequence: Synthetic oligonucleotide
ctgggcagtggtgcatctggtggagt

SEQ ID NO: 316523 - DNA, 27 bp, Artificial Sequence
  Description of Artificial Sequence: Synthetic oligonucleotide
tgggcagtggtgcatctggtggagtct

SEQ ID NO: 316524 - DNA, 26 bp, Artificial Sequence
  Description of Artificial Sequence: Synthetic oligonucleotide
gggcagtggtgcatctggtggagtct

SEQ ID NO: 316525 - DNA, 26 bp, Artificial Sequence
  Description of Artificial Sequence: Synthetic oligonucleotide
ggcagtggtgcatctggtggagtctg

SEQ ID NO: 316526 - DNA, 27 bp, Artificial Sequence
  Description of Artificial Sequence: Synthetic oligonucleotide
gcagtggtgcatctggtggagtctgca

SEQ ID NO: 316527 - DNA, 27 bp, Artificial Sequence
  Description of Artificial Sequence: Synthetic oligonucleotide
cagtggtgcatctggtggagtctgcac

SEQ ID NO: 316528 - DNA, 27 bp, Artificial Sequence
  Description of Artificial Sequence: Synthetic oligonucleotide
agtggtgcatctggtggagtctgcacc

SEQ ID NO: 316529 - DNA, 26 bp, Artificial Sequence
  Description of Artificial Sequence: Synthetic oligonucleotide
gtggtgcatctggtggagtctgcacc

SEQ ID NO: 316530 - DNA, 27 bp, Artificial Sequence
  Description of Artificial Sequence: Synthetic oligonucleotide
tggtgcatctggtggagtctgcaccca

SEQ ID NO: 316531 - DNA, 26 bp, Artificial Sequence
  Description of Artificial Sequence: Synthetic oligonucleotide
ggtgcatctggtggagtctgcaccca

SEQ ID NO: 316532 - DNA, 27 bp, Artificial Sequence
  Description of Artificial Sequence: Synthetic oligonucleotide
gtgcatctggtggagtctgcacccaga

SEQ ID NO: 316533 - DNA, 31 bp, Artificial Sequence
  Description of Artificial Sequence: Synthetic oligonucleotide
tgcatctggtggagtctgcacccagatatac

SEQ ID NO: 316534 - DNA, 30 bp, Artificial Sequence
  Description of Artificial Sequence: Synthetic oligonucleotide
gcatctggtggagtctgcacccagatatac

SEQ ID NO: 316535 - DNA, 31 bp, Artificial Sequence
  Description of Artificial Sequence: Synthetic oligonucleotide
catctggtggagtctgcacccagatatacag

SEQ ID NO: 316536 - DNA, 31 bp, Artificial Sequence
  Description of Artificial Sequence: Synthetic oligonucleotide
atctggtggagtctgcacccagatatacagg

SEQ ID NO: 316537 - DNA, 30 bp, Artificial Sequence
  Description of Artificial Sequence: Synthetic oligonucleotide
tctggtggagtctgcacccagatatacagg

SEQ ID NO: 316538 - DNA, 29 bp, Artificial Sequence
  Description of Artificial Sequence: Synthetic oligonucleotide
ctggtggagtctgcacccagatatacagg

SEQ ID NO: 316539 - DNA, 30 bp, Artificial Sequence
  Description of Artificial Sequence: Synthetic oligonucleotide
tggtggagtctgcacccagatatacaggac

SEQ ID NO: 316540 - DNA, 29 bp, Artificial Sequence
  Description of Artificial Sequence: Synthetic oligonucleotide
ggtggagtctgcacccagatatacaggac

SEQ ID NO: 316541 - DNA, 29 bp, Artificial Sequence
  Description of Artificial Sequence: Synthetic oligonucleotide
gtggagtctgcacccagatatacaggacg

SEQ ID NO: 316542 - DNA, 29 bp, Artificial Sequence
  Description of Artificial Sequence: Synthetic oligonucleotide
tggagtctgcacccagatatacaggacgg

SEQ ID NO: 316543 - DNA, 28 bp, Artificial Sequence
  Description of Artificial Sequence: Synthetic oligonucleotide
ggagtctgcacccagatatacaggacgg

SEQ ID NO: 316544 - DNA, 29 bp, Artificial Sequence
  Description of Artificial Sequence: Synthetic oligonucleotide
gagtctgcacccagatatacaggacggag

SEQ ID NO: 316545 - DNA, 29 bp, Artificial Sequence
  Description of Artificial Sequence: Synthetic oligonucleotide
agtctgcacccagatatacaggacggagc

SEQ ID NO: 316546 - DNA, 28 bp, Artificial Sequence
  Description of Artificial Sequence: Synthetic oligonucleotide
gtctgcacccagatatacaggacggagc

SEQ ID NO: 316547 - DNA, 29 bp, Artificial Sequence
  Description of Artificial Sequence: Synthetic oligonucleotide
tctgcacccagatatacaggacggagctg

SEQ ID NO: 316548 - DNA, 28 bp, Artificial Sequence
  Description of Artificial Sequence: Synthetic oligonucleotide
ctgcacccagatatacaggacggagctg

SEQ ID NO: 316549 - DNA, 30 bp, Artificial Sequence
  Description of Artificial Sequence: Synthetic oligonucleotide
tgcacccagatatacaggacggagctgtag

SEQ ID NO: 316550 - DNA, 29 bp, Artificial Sequence
  Description of Artificial Sequence: Synthetic oligonucleotide
gcacccagatatacaggacggagctgtag

SEQ ID NO: 316551 - DNA, 29 bp, Artificial Sequence
  Description of Artificial Sequence: Synthetic oligonucleotide
cacccagatatacaggacggagctgtagg

SEQ ID NO: 316552 - DNA, 29 bp, Artificial Sequence
  Description of Artificial Sequence: Synthetic oligonucleotide
acccagatatacaggacggagctgtaggc

SEQ ID NO: 316553 - DNA, 28 bp, Artificial Sequence
  Description of Artificial Sequence: Synthetic oligonucleotide
cccagatatacaggacggagctgtaggc

SEQ ID NO: 316554 - DNA, 31 bp, Artificial Sequence
  Description of Artificial Sequence: Synthetic oligonucleotide
ccagatatacaggacggagctgtaggctttg

SEQ ID NO: 316555 - DNA, 31 bp, Artificial Sequence
  Description of Artificial Sequence: Synthetic oligonucleotide
cagatatacaggacggagctgtaggctttgc

SEQ ID NO: 316556 - DNA, 32 bp, Artificial Sequence
  Description of Artificial Sequence: Synthetic oligonucleotide
agatatacaggacggagctgtaggctttgctg

SEQ ID NO: 316557 - DNA, 31 bp, Artificial Sequence
  Description of Artificial Sequence: Synthetic oligonucleotide
gatatacaggacggagctgtaggctttgctg

SEQ ID NO: 316558 - DNA, 31 bp, Artificial Sequence
  Description of Artificial Sequence: Synthetic oligonucleotide
atatacaggacggagctgtaggctttgctgg

SEQ ID NO: 316559 - DNA, 30 bp, Artificial Sequence
  Description of Artificial Sequence: Synthetic oligonucleotide
tatacaggacggagctgtaggctttgctgg

SEQ ID NO: 316560 - DNA, 29 bp, Artificial Sequence
  Description of Artificial Sequence: Synthetic oligonucleotide
atacaggacggagctgtaggctttgctgg

SEQ ID NO: 316561 - DNA, 28 bp, Artificial Sequence
  Description of Artificial Sequence: Synthetic oligonucleotide
tacaggacggagctgtaggctttgctgg

SEQ ID NO: 316562 - DNA, 27 bp, Artificial Sequence
  Description of Artificial Sequence: Synthetic oligonucleotide
acaggacggagctgtaggctttgctgg

SEQ ID NO: 316563 - DNA, 26 bp, Artificial Sequence
  Description of Artificial Sequence: Synthetic oligonucleotide
caggacggagctgtaggctttgctgg

SEQ ID NO: 316564 - DNA, 26 bp, Artificial Sequence
  Description of Artificial Sequence: Synthetic oligonucleotide
aggacggagctgtaggctttgctggc

SEQ ID NO: 316565 - DNA, 25 bp, Artificial Sequence
  Description of Artificial Sequence: Synthetic oligonucleotide
ggacggagctgtaggctttgctggc

SEQ ID NO: 316566 - DNA, 26 bp, Artificial Sequence
  Description of Artificial Sequence: Synthetic oligonucleotide
gacggagctgtaggctttgctggcca

SEQ ID NO: 316567 - DNA, 27 bp, Artificial Sequence
  Description of Artificial Sequence: Synthetic oligonucleotide
acggagctgtaggctttgctggccaca

SEQ ID NO: 316568 - DNA, 26 bp, Artificial Sequence
  Description of Artificial Sequence: Synthetic oligonucleotide
cggagctgtaggctttgctggccaca

SEQ ID NO: 316569 - DNA, 27 bp, Artificial Sequence
  Description of Artificial Sequence: Synthetic oligonucleotide
ggagctgtaggctttgctggccacaca

SEQ ID NO: 316570 - DNA, 27 bp, Artificial Sequence
  Description of Artificial Sequence: Synthetic oligonucleotide
gagctgtaggctttgctggccacacag

SEQ ID NO: 316571 - DNA, 28 bp, Artificial Sequence
  Description of Artificial Sequence: Synthetic oligonucleotide
agctgtaggctttgctggccacacagac

SEQ ID NO: 316572 - DNA, 27 bp, Artificial Sequence
  Description of Artificial Sequence: Synthetic oligonucleotide
gctgtaggctttgctggccacacagac

SEQ ID NO: 316573 - DNA, 28 bp, Artificial Sequence
  Description of Artificial Sequence: Synthetic oligonucleotide
ctgtaggctttgctggccacacagactg

SEQ ID NO: 316574 - DNA, 30 bp, Artificial Sequence
  Description of Artificial Sequence: Synthetic oligonucleotide
tgtaggctttgctggccacacagactgtag

SEQ ID NO: 316575 - DNA, 29 bp, Artificial Sequence
  Description of Artificial Sequence: Synthetic oligonucleotide
gtaggctttgctggccacacagactgtag

SEQ ID NO: 316576 - DNA, 29 bp, Artificial Sequence
  Description of Artificial Sequence: Synthetic oligonucleotide
taggctttgctggccacacagactgtagc

SEQ ID NO: 316577 - DNA, 28 bp, Artificial Sequence
  Description of Artificial Sequence: Synthetic oligonucleotide
aggctttgctggccacacagactgtagc

SEQ ID NO: 316578 - DNA, 27 bp, Artificial Sequence
  Description of Artificial Sequence: Synthetic oligonucleotide
ggctttgctggccacacagactgtagc

SEQ ID NO: 316579 - DNA, 27 bp, Artificial Sequence
  Description of Artificial Sequence: Synthetic oligonucleotide
gctttgctggccacacagactgtagcc

SEQ ID NO: 316580 - DNA, 28 bp, Artificial Sequence
  Description of Artificial Sequence: Synthetic oligonucleotide
ctttgctggccacacagactgtagccag

SEQ ID NO: 316581 - DNA, 29 bp, Artificial Sequence
  Description of Artificial Sequence: Synthetic oligonucleotide
tttgctggccacacagactgtagccagtc

SEQ ID NO: 316582 - DNA, 28 bp, Artificial Sequence
  Description of Artificial Sequence: Synthetic oligonucleotide
ttgctggccacacagactgtagccagtc

SEQ ID NO: 316583 - DNA, 27 bp, Artificial Sequence
  Description of Artificial Sequence: Synthetic oligonucleotide
tgctggccacacagactgtagccagtc

SEQ ID NO: 316584 - DNA, 27 bp, Artificial Sequence
  Description of Artificial Sequence: Synthetic oligonucleotide
gctggccacacagactgtagccagtct

SEQ ID NO: 316585 - DNA, 28 bp, Artificial Sequence
  Description of Artificial Sequence: Synthetic oligonucleotide
ctggccacacagactgtagccagtcttg

SEQ ID NO: 316586 - DNA, 28 bp, Artificial Sequence
  Description of Artificial Sequence: Synthetic oligonucleotide
tggccacacagactgtagccagtcttgc

SEQ ID NO: 316587 - DNA, 27 bp, Artificial Sequence
  Description of Artificial Sequence: Synthetic oligonucleotide
ggccacacagactgtagccagtcttgc

SEQ ID NO: 316588 - DNA, 27 bp, Artificial Sequence
  Description of Artificial Sequence: Synthetic oligonucleotide
gccacacagactgtagccagtcttgcc

SEQ ID NO: 316589 - DNA, 29 bp, Artificial Sequence
  Description of Artificial Sequence: Synthetic oligonucleotide
ccacacagactgtagccagtcttgccaac

SEQ ID NO: 316590 - DNA, 32 bp, Artificial Sequence
  Description of Artificial Sequence: Synthetic oligonucleotide
cacacagactgtagccagtcttgccaactttg

SEQ ID NO: 316591 - DNA, 33 bp, Artificial Sequence
  Description of Artificial Sequence: Synthetic oligonucleotide
acacagactgtagccagtcttgccaactttgtc

SEQ ID NO: 316592 - DNA, 32 bp, Artificial Sequence
  Description of Artificial Sequence: Synthetic oligonucleotide
cacagactgtagccagtcttgccaactttgtc

SEQ ID NO: 316593 - DNA, 34 bp, Artificial Sequence
  Description of Artificial Sequence: Synthetic oligonucleotide
acagactgtagccagtcttgccaactttgtcttc

SEQ ID NO: 316594 - DNA, 33 bp, Artificial Sequence
  Description of Artificial Sequence: Synthetic oligonucleotide
cagactgtagccagtcttgccaactttgtcttc

SEQ ID NO: 316595 - DNA, 35 bp, Artificial Sequence
  Description of Artificial Sequence: Synthetic oligonucleotide
agactgtagccagtcttgccaactttgtcttcttg

SEQ ID NO: 316596 - DNA, 34 bp, Artificial Sequence
  Description of Artificial Sequence: Synthetic oligonucleotide
gactgtagccagtcttgccaactttgtcttcttg

SEQ ID NO: 316597 - DNA, 34 bp, Artificial Sequence
  Description of Artificial Sequence: Synthetic oligonucleotide
actgtagccagtcttgccaactttgtcttcttgc

SEQ ID NO: 316598 - DNA, 33 bp, Artificial Sequence
  Description of Artificial Sequence: Synthetic oligonucleotide
ctgtagccagtcttgccaactttgtcttcttgc

SEQ ID NO: 316599 - DNA, 33 bp, Artificial Sequence
  Description of Artificial Sequence: Synthetic oligonucleotide
tgtagccagtcttgccaactttgtcttcttgcc

SEQ ID NO: 316600 - DNA, 32 bp, Artificial Sequence
  Description of Artificial Sequence: Synthetic oligonucleotide
gtagccagtcttgccaactttgtcttcttgcc

SEQ ID NO: 316601 - DNA, 35 bp, Artificial Sequence
  Description of Artificial Sequence: Synthetic oligonucleotide
tagccagtcttgccaactttgtcttcttgccattg

SEQ ID NO: 316602 - DNA, 34 bp, Artificial Sequence
  Description of Artificial Sequence: Synthetic oligonucleotide
agccagtcttgccaactttgtcttcttgccattg

SEQ ID NO: 316603 - DNA, 33 bp, Artificial Sequence
  Description of Artificial Sequence: Synthetic oligonucleotide
gccagtcttgccaactttgtcttcttgccattg

SEQ ID NO: 316604 - DNA, 33 bp, Artificial Sequence
  Description of Artificial Sequence: Synthetic oligonucleotide
ccagtcttgccaactttgtcttcttgccattgc

SEQ ID NO: 316605 - DNA, 33 bp, Artificial Sequence
  Description of Artificial Sequence: Synthetic oligonucleotide
cagtcttgccaactttgtcttcttgccattgcg

SEQ ID NO: 316606 - DNA, 36 bp, Artificial Sequence
  Description of Artificial Sequence: Synthetic oligonucleotide
agtcttgccaactttgtcttcttgccattgcgtttg

SEQ ID NO: 316607 - DNA, 35 bp, Artificial Sequence
  Description of Artificial Sequence: Synthetic oligonucleotide
gtcttgccaactttgtcttcttgccattgcgtttg

SEQ ID NO: 316608 - DNA, 38 bp, Artificial Sequence
  Description of Artificial Sequence: Synthetic oligonucleotide
tcttgccaactttgtcttcttgccattgcgtttgtttg

SEQ ID NO: 316609 - DNA, 37 bp, Artificial Sequence
  Description of Artificial Sequence: Synthetic oligonucleotide
cttgccaactttgtcttcttgccattgcgtttgtttg

SEQ ID NO: 316610 - DNA, 37 bp, Artificial Sequence
  Description of Artificial Sequence: Synthetic oligonucleotide
ttgccaactttgtcttcttgccattgcgtttgtttgc

SEQ ID NO: 316611 - DNA, 36 bp, Artificial Sequence
  Description of Artificial Sequence: Synthetic oligonucleotide
tgccaactttgtcttcttgccattgcgtttgtttgc

SEQ ID NO: 316612 - DNA, 35 bp, Artificial Sequence
  Description of Artificial Sequence: Synthetic oligonucleotide
gccaactttgtcttcttgccattgcgtttgtttgc

SEQ ID NO: 316613 - DNA, 36 bp, Artificial Sequence
  Description of Artificial Sequence: Synthetic oligonucleotide
ccaactttgtcttcttgccattgcgtttgtttgcag

SEQ ID NO: 316614 - DNA, 36 bp, Artificial Sequence
  Description of Artificial Sequence: Synthetic oligonucleotide
caactttgtcttcttgccattgcgtttgtttgcagc

SEQ ID NO: 316615 - DNA, 36 bp, Artificial Sequence
  Description of Artificial Sequence: Synthetic oligonucleotide
aactttgtcttcttgccattgcgtttgtttgcagcc

SEQ ID NO: 316616 - DNA, 35 bp, Artificial Sequence
  Description of Artificial Sequence: Synthetic oligonucleotide
actttgtcttcttgccattgcgtttgtttgcagcc

SEQ ID NO: 316617 - DNA, 34 bp, Artificial Sequence
  Description of Artificial Sequence: Synthetic oligonucleotide
ctttgtcttcttgccattgcgtttgtttgcagcc

SEQ ID NO: 316618 - DNA, 36 bp, Artificial Sequence
  Description of Artificial Sequence: Synthetic oligonucleotide
tttgtcttcttgccattgcgtttgtttgcagccaag

SEQ ID NO: 316619 - DNA, 35 bp, Artificial Sequence
  Description of Artificial Sequence: Synthetic oligonucleotide
ttgtcttcttgccattgcgtttgtttgcagccaag

SEQ ID NO: 316620 - DNA, 34 bp, Artificial Sequence
  Description of Artificial Sequence: Synthetic oligonucleotide
tgtcttcttgccattgcgtttgtttgcagccaag

SEQ ID NO: 316621 - DNA, 33 bp, Artificial Sequence
  Description of Artificial Sequence: Synthetic oligonucleotide
gtcttcttgccattgcgtttgtttgcagccaag

SEQ ID NO: 316622 - DNA, 33 bp, Artificial Sequence
  Description of Artificial Sequence: Synthetic oligonucleotide
tcttcttgccattgcgtttgtttgcagccaagg

SEQ ID NO: 316623 - DNA, 32 bp, Artificial Sequence
  Description of Artificial Sequence: Synthetic oligonucleotide
cttcttgccattgcgtttgtttgcagccaagg

SEQ ID NO: 316624 - DNA, 32 bp, Artificial Sequence
  Description of Artificial Sequence: Synthetic oligonucleotide
ttcttgccattgcgtttgtttgcagccaaggg

SEQ ID NO: 316625 - DNA, 31 bp, Artificial Sequence
  Description of Artificial Sequence: Synthetic oligonucleotide
tcttgccattgcgtttgtttgcagccaaggg

SEQ ID NO: 316626 - DNA, 30 bp, Artificial Sequence
  Description of Artificial Sequence: Synthetic oligonucleotide
cttgccattgcgtttgtttgcagccaaggg

SEQ ID NO: 316627 - DNA, 30 bp, Artificial Sequence
  Description of Artificial Sequence: Synthetic oligonucleotide
ttgccattgcgtttgtttgcagccaagggc

SEQ ID NO: 316628 - DNA, 29 bp, Artificial Sequence
  Description of Artificial Sequence: Synthetic oligonucleotide
tgccattgcgtttgtttgcagccaagggc

SEQ ID NO: 316629 - DNA, 28 bp, Artificial Sequence
  Description of Artificial Sequence: Synthetic oligonucleotide
gccattgcgtttgtttgcagccaagggc

SEQ ID NO: 316630 - DNA, 28 bp, Artificial Sequence
  Description of Artificial Sequence: Synthetic oligonucleotide
ccattgcgtttgtttgcagccaagggcc

SEQ ID NO: 316631 - DNA, 29 bp, Artificial Sequence
  Description of Artificial Sequence: Synthetic oligonucleotide
cattgcgtttgtttgcagccaagggcctg

SEQ ID NO: 316632 - DNA, 31 bp, Artificial Sequence
  Description of Artificial Sequence: Synthetic oligonucleotide
attgcgtttgtttgcagccaagggcctgaag

SEQ ID NO: 316633 - DNA, 30 bp, Artificial Sequence
  Description of Artificial Sequence: Synthetic oligonucleotide
ttgcgtttgtttgcagccaagggcctgaag

SEQ ID NO: 316634 - DNA, 29 bp, Artificial Sequence
  Description of Artificial Sequence: Synthetic oligonucleotide
tgcgtttgtttgcagccaagggcctgaag

SEQ ID NO: 316635 - DNA, 28 bp, Artificial Sequence
  Description of Artificial Sequence: Synthetic oligonucleotide
gcgtttgtttgcagccaagggcctgaag

SEQ ID NO: 316636 - DNA, 30 bp, Artificial Sequence
  Description of Artificial Sequence: Synthetic oligonucleotide
cgtttgtttgcagccaagggcctgaagaag

SEQ ID NO: 316637 - DNA, 30 bp, Artificial Sequence
  Description of Artificial Sequence: Synthetic oligonucleotide
gtttgtttgcagccaagggcctgaagaagc

SEQ ID NO: 316638 - DNA, 30 bp, Artificial Sequence
  Description of Artificial Sequence: Synthetic oligonucleotide
tttgtttgcagccaagggcctgaagaagcc

SEQ ID NO: 316639 - DNA, 29 bp, Artificial Sequence
  Description of Artificial Sequence: Synthetic oligonucleotide
ttgtttgcagccaagggcctgaagaagcc

SEQ ID NO: 316640 - DNA, 28 bp, Artificial Sequence
  Description of Artificial Sequence: Synthetic oligonucleotide
tgtttgcagccaagggcctgaagaagcc

SEQ ID NO: 316641 - DNA, 27 bp, Artificial Sequence
  Description of Artificial Sequence: Synthetic oligonucleotide
gtttgcagccaagggcctgaagaagcc

SEQ ID NO: 316642 - DNA, 30 bp, Artificial Sequence
  Description of Artificial Sequence: Synthetic oligonucleotide
tttgcagccaagggcctgaagaagccattg

SEQ ID NO: 316643 - DNA, 29 bp, Artificial Sequence
  Description of Artificial Sequence: Synthetic oligonucleotide
ttgcagccaagggcctgaagaagccattg

SEQ ID NO: 316644 - DNA, 28 bp, Artificial Sequence
  Description of Artificial Sequence: Synthetic oligonucleotide
tgcagccaagggcctgaagaagccattg

SEQ ID NO: 316645 - DNA, 27 bp, Artificial Sequence
  Description of Artificial Sequence: Synthetic oligonucleotide
gcagccaagggcctgaagaagccattg

SEQ ID NO: 316646 - DNA, 27 bp, Artificial Sequence
  Description of Artificial Sequence: Synthetic oligonucleotide
cagccaagggcctgaagaagccattgg

SEQ ID NO: 316647 - DNA, 27 bp, Artificial Sequence
  Description of Artificial Sequence: Synthetic oligonucleotide
agccaagggcctgaagaagccattggg

SEQ ID NO: 316648 - DNA, 27 bp, Artificial Sequence
  Description of Artificial Sequence: Synthetic oligonucleotide
gccaagggcctgaagaagccattgggt

SEQ ID NO: 316649 - DNA, 29 bp, Artificial Sequence
  Description of Artificial Sequence: Synthetic oligonucleotide
ccaagggcctgaagaagccattgggtaag

SEQ ID NO: 316650 - DNA, 29 bp, Artificial Sequence
  Description of Artificial Sequence: Synthetic oligonucleotide
caagggcctgaagaagccattgggtaagg

SEQ ID NO: 316651 - DNA, 29 bp, Artificial Sequence
  Description of Artificial Sequence: Synthetic oligonucleotide
aagggcctgaagaagccattgggtaaggg

SEQ ID NO: 316652 - DNA, 28 bp, Artificial Sequence
  Description of Artificial Sequence: Synthetic oligonucleotide
agggcctgaagaagccattgggtaaggg

SEQ ID NO: 316653 - DNA, 27 bp, Artificial Sequence
  Description of Artificial Sequence: Synthetic oligonucleotide
gggcctgaagaagccattgggtaaggg

SEQ ID NO: 316654 - DNA, 27 bp, Artificial Sequence
  Description of Artificial Sequence: Synthetic oligonucleotide
ggcctgaagaagccattgggtaagggg

SEQ ID NO: 316655 - DNA, 27 bp, Artificial Sequence
  Description of Artificial Sequence: Synthetic oligonucleotide
gcctgaagaagccattgggtaaggggc

SEQ ID NO: 316656 - DNA, 27 bp, Artificial Sequence
  Description of Artificial Sequence: Synthetic oligonucleotide
cctgaagaagccattgggtaaggggcc

SEQ ID NO: 316657 - DNA, 28 bp, Artificial Sequence
  Description of Artificial Sequence: Synthetic oligonucleotide
ctgaagaagccattgggtaaggggccag

SEQ ID NO: 316658 - DNA, 28 bp, Artificial Sequence
  Description of Artificial Sequence: Synthetic oligonucleotide
tgaagaagccattgggtaaggggccagg

SEQ ID NO: 316659 - DNA, 27 bp, Artificial Sequence
  Description of Artificial Sequence: Synthetic oligonucleotide
gaagaagccattgggtaaggggccagg

SEQ ID NO: 316660 - DNA, 27 bp, Artificial Sequence
  Description of Artificial Sequence: Synthetic oligonucleotide
aagaagccattgggtaaggggccaggg

SEQ ID NO: 316661 - DNA, 26 bp, Artificial Sequence
  Description of Artificial Sequence: Synthetic oligonucleotide
agaagccattgggtaaggggccaggg

SEQ ID NO: 316662 - DNA, 25 bp, Artificial Sequence
  Description of Artificial Sequence: Synthetic oligonucleotide
gaagccattgggtaaggggccaggg

SEQ ID NO: 316663 - DNA, 25 bp, Artificial Sequence
  Description of Artificial Sequence: Synthetic oligonucleotide
aagccattgggtaaggggccagggc

SEQ ID NO: 316664 - DNA, 24 bp, Artificial Sequence
  Description of Artificial Sequence: Synthetic oligonucleotide
agccattgggtaaggggccagggc

SEQ ID NO: 316665 - DNA, 23 bp, Artificial Sequence
  Description of Artificial Sequence: Synthetic oligonucleotide
gccattgggtaaggggccagggc

SEQ ID NO: 316666 - DNA, 23 bp, Artificial Sequence
  Description of Artificial Sequence: Synthetic oligonucleotide
ccattgggtaaggggccagggcc

SEQ ID NO: 316667 - DNA, 24 bp, Artificial Sequence
  Description of Artificial Sequence: Synthetic oligonucleotide
cattgggtaaggggccagggccct

SEQ ID NO: 316668 - DNA, 24 bp, Artificial Sequence
  Description of Artificial Sequence: Synthetic oligonucleotide
attgggtaaggggccagggccctg

SEQ ID NO: 316669 - DNA, 23 bp, Artificial Sequence
  Description of Artificial Sequence: Synthetic oligonucleotide
ttgggtaaggggccagggccctg

SEQ ID NO: 316670 - DNA, 22 bp, Artificial Sequence
  Description of Artificial Sequence: Synthetic oligonucleotide
tgggtaaggggccagggccctg

SEQ ID NO: 316671 - DNA, 21 bp, Artificial Sequence
  Description of Artificial Sequence: Synthetic oligonucleotide
gggtaaggggccagggccctg

SEQ ID NO: 316672 - DNA, 23 bp, Artificial Sequence
  Description of Artificial Sequence: Synthetic oligonucleotide
ggtaaggggccagggccctggat

SEQ ID NO: 316673 - DNA, 27 bp, Artificial Sequence
  Description of Artificial Sequence: Synthetic oligonucleotide
gtaaggggccagggccctggatgtata

SEQ ID NO: 316674 - DNA, 28 bp, Artificial Sequence
  Description of Artificial Sequence: Synthetic oligonucleotide
taaggggccagggccctggatgtatatc

SEQ ID NO: 316675 - DNA, 27 bp, Artificial Sequence
  Description of Artificial Sequence: Synthetic oligonucleotide
aaggggccagggccctggatgtatatc

SEQ ID NO: 316676 - DNA, 26 bp, Artificial Sequence
  Description of Artificial Sequence: Synthetic oligonucleotide
aggggccagggccctggatgtatatc

SEQ ID NO: 316677 - DNA, 25 bp, Artificial Sequence
  Description of Artificial Sequence: Synthetic oligonucleotide
ggggccagggccctggatgtatatc

SEQ ID NO: 316678 - DNA, 26 bp, Artificial Sequence
  Description of Artificial Sequence: Synthetic oligonucleotide
gggccagggccctggatgtatatcct

SEQ ID NO: 316679 - DNA, 27 bp, Artificial Sequence
  Description of Artificial Sequence: Synthetic oligonucleotide
ggccagggccctggatgtatatcctgt

SEQ ID NO: 316680 - DNA, 27 bp, Artificial Sequence
  Description of Artificial Sequence: Synthetic oligonucleotide
gccagggccctggatgtatatcctgtc

SEQ ID NO: 316681 - DNA, 27 bp, Artificial Sequence
  Description of Artificial Sequence: Synthetic oligonucleotide
ccagggccctggatgtatatcctgtcg

SEQ ID NO: 316682 - DNA, 27 bp, Artificial Sequence
  Description of Artificial Sequence: Synthetic oligonucleotide
cagggccctggatgtatatcctgtcgg

SEQ ID NO: 316683 - DNA, 27 bp, Artificial Sequence
  Description of Artificial Sequence: Synthetic oligonucleotide
agggccctggatgtatatcctgtcggc

SEQ ID NO: 316684 - DNA, 26 bp, Artificial Sequence
  Description of Artificial Sequence: Synthetic oligonucleotide
gggccctggatgtatatcctgtcggc

SEQ ID NO: 316685 - DNA, 27 bp, Artificial Sequence
  Description of Artificial Sequence: Synthetic oligonucleotide
ggccctggatgtatatcctgtcggcct

SEQ ID NO: 316686 - DNA, 27 bp, Artificial Sequence
  Description of Artificial Sequence: Synthetic oligonucleotide
gccctggatgtatatcctgtcggcctg

SEQ ID NO: 316687 - DNA, 27 bp, Artificial Sequence
  Description of Artificial Sequence: Synthetic oligonucleotide
ccctggatgtatatcctgtcggcctgg

SEQ ID NO: 316688 - DNA, 35 bp, Artificial Sequence
  Description of Artificial Sequence: Synthetic oligonucleotide
cctggatgtatatcctgtcggcctggttaattttc

SEQ ID NO: 316689 - DNA, 36 bp, Artificial Sequence
  Description of Artificial Sequence: Synthetic oligonucleotide
ctggatgtatatcctgtcggcctggttaattttctg

SEQ ID NO: 316690 - DNA, 36 bp, Artificial Sequence
  Description of Artificial Sequence: Synthetic oligonucleotide
tggatgtatatcctgtcggcctggttaattttctgg

SEQ ID NO: 316691 - DNA, 35 bp, Artificial Sequence
  Description of Artificial Sequence: Synthetic oligonucleotide
ggatgtatatcctgtcggcctggttaattttctgg

SEQ ID NO: 316692 - DNA, 36 bp, Artificial Sequence
  Description of Artificial Sequence: Synthetic oligonucleotide
gatgtatatcctgtcggcctggttaattttctggag

SEQ ID NO: 316693 - DNA, 36 bp, Artificial Sequence
  Description of Artificial Sequence: Synthetic oligonucleotide
atgtatatcctgtcggcctggttaattttctggagg

SEQ ID NO: 316694 - DNA, 35 bp, Artificial Sequence
  Description of Artificial Sequence: Synthetic oligonucleotide
tgtatatcctgtcggcctggttaattttctggagg

SEQ ID NO: 316695 - DNA, 34 bp, Artificial Sequence
  Description of Artificial Sequence: Synthetic oligonucleotide
gtatatcctgtcggcctggttaattttctggagg

SEQ ID NO: 316696 - DNA, 34 bp, Artificial Sequence
  Description of Artificial Sequence: Synthetic oligonucleotide
tatatcctgtcggcctggttaattttctggaggc

SEQ ID NO: 316697 - DNA, 33 bp, Artificial Sequence
  Description of Artificial Sequence: Synthetic oligonucleotide
atatcctgtcggcctggttaattttctggaggc

SEQ ID NO: 316698 - DNA, 32 bp, Artificial Sequence
  Description of Artificial Sequence: Synthetic oligonucleotide
tatcctgtcggcctggttaattttctggaggc

SEQ ID NO: 316699 - DNA, 31 bp, Artificial Sequence
  Description of Artificial Sequence: Synthetic oligonucleotide
atcctgtcggcctggttaattttctggaggc

SEQ ID NO: 316700 - DNA, 30 bp, Artificial Sequence
  Description of Artificial Sequence: Synthetic oligonucleotide
tcctgtcggcctggttaattttctggaggc

SEQ ID NO: 316701 - DNA, 29 bp, Artificial Sequence
  Description of Artificial Sequence: Synthetic oligonucleotide
cctgtcggcctggttaattttctggaggc

SEQ ID NO: 316702 - DNA, 29 bp, Artificial Sequence
  Description of Artificial Sequence: Synthetic oligonucleotide
ctgtcggcctggttaattttctggaggcc

SEQ ID NO: 316703 - DNA, 30 bp, Artificial Sequence
  Description of Artificial Sequence: Synthetic oligonucleotide
tgtcggcctggttaattttctggaggcctc

SEQ ID NO: 316704 - DNA, 29 bp, Artificial Sequence
  Description of Artificial Sequence: Synthetic oligonucleotide
gtcggcctggttaattttctggaggcctc

SEQ ID NO: 316705 - DNA, 31 bp, Artificial Sequence
  Description of Artificial Sequence: Synthetic oligonucleotide
tcggcctggttaattttctggaggcctcatg

SEQ ID NO: 316706 - DNA, 30 bp, Artificial Sequence
  Description of Artificial Sequence: Synthetic oligonucleotide
cggcctggttaattttctggaggcctcatg

SEQ ID NO: 316707 - DNA, 30 bp, Artificial Sequence
  Description of Artificial Sequence: Synthetic oligonucleotide
ggcctggttaattttctggaggcctcatgc

SEQ ID NO: 316708 - DNA, 30 bp, Artificial Sequence
  Description of Artificial Sequence: Synthetic oligonucleotide
gcctggttaattttctggaggcctcatgcg

SEQ ID NO: 316709 - DNA, 30 bp, Artificial Sequence
  Description of Artificial Sequence: Synthetic oligonucleotide
cctggttaattttctggaggcctcatgcgg

SEQ ID NO: 316710 - DNA, 31 bp, Artificial Sequence
  Description of Artificial Sequence: Synthetic oligonucleotide
ctggttaattttctggaggcctcatgcggtg

SEQ ID NO: 316711 - DNA, 31 bp, Artificial Sequence
  Description of Artificial Sequence: Synthetic oligonucleotide
tggttaattttctggaggcctcatgcggtgg

SEQ ID NO: 316712 - DNA, 30 bp, Artificial Sequence
  Description of Artificial Sequence: Synthetic oligonucleotide
ggttaattttctggaggcctcatgcggtgg

SEQ ID NO: 316713 - DNA, 32 bp, Artificial Sequence
  Description of Artificial Sequence: Synthetic oligonucleotide
gttaattttctggaggcctcatgcggtggttc

SEQ ID NO: 316714 - DNA, 34 bp, Artificial Sequence
  Description of Artificial Sequence: Synthetic oligonucleotide
ttaattttctggaggcctcatgcggtggttcttg

SEQ ID NO: 316715 - DNA, 33 bp, Artificial Sequence
  Description of Artificial Sequence: Synthetic oligonucleotide
taattttctggaggcctcatgcggtggttcttg

SEQ ID NO: 316716 - DNA, 32 bp, Artificial Sequence
  Description of Artificial Sequence: Synthetic oligonucleotide
aattttctggaggcctcatgcggtggttcttg

SEQ ID NO: 316717 - DNA, 31 bp, Artificial Sequence
  Description of Artificial Sequence: Synthetic oligonucleotide
attttctggaggcctcatgcggtggttcttg

SEQ ID NO: 316718 - DNA, 30 bp, Artificial Sequence
  Description of Artificial Sequence: Synthetic oligonucleotide
ttttctggaggcctcatgcggtggttcttg

SEQ ID NO: 316719 - DNA, 29 bp, Artificial Sequence
  Description of Artificial Sequence: Synthetic oligonucleotide
tttctggaggcctcatgcggtggttcttg

SEQ ID NO: 316720 - DNA, 28 bp, Artificial Sequence
  Description of Artificial Sequence: Synthetic oligonucleotide
ttctggaggcctcatgcggtggttcttg

SEQ ID NO: 316721 - DNA, 27 bp, Artificial Sequence
  Description of Artificial Sequence: Synthetic oligonucleotide
tctggaggcctcatgcggtggttcttg

SEQ ID NO: 316722 - DNA, 26 bp, Artificial Sequence
  Description of Artificial Sequence: Synthetic oligonucleotide
ctggaggcctcatgcggtggttcttg

SEQ ID NO: 316723 - DNA, 27 bp, Artificial Sequence
  Description of Artificial Sequence: Synthetic oligonucleotide
tggaggcctcatgcggtggttcttgga

SEQ ID NO: 316724 - DNA, 26 bp, Artificial Sequence
  Description of Artificial Sequence: Synthetic oligonucleotide
ggaggcctcatgcggtggttcttgga

SEQ ID NO: 316725 - DNA, 27 bp, Artificial Sequence
  Description of Artificial Sequence: Synthetic oligonucleotide
gaggcctcatgcggtggttcttggact

SEQ ID NO: 316726 - DNA, 27 bp, Artificial Sequence
  Description of Artificial Sequence: Synthetic oligonucleotide
aggcctcatgcggtggttcttggactg

SEQ ID NO: 316727 - DNA, 26 bp, Artificial Sequence
  Description of Artificial Sequence: Synthetic oligonucleotide
ggcctcatgcggtggttcttggactg

SEQ ID NO: 316728 - DNA, 27 bp, Artificial Sequence
  Description of Artificial Sequence: Synthetic oligonucleotide
gcctcatgcggtggttcttggactgga

SEQ ID NO: 316729 - DNA, 30 bp, Artificial Sequence
  Description of Artificial Sequence: Synthetic oligonucleotide
cctcatgcggtggttcttggactggatatc

SEQ ID NO: 316730 - DNA, 30 bp, Artificial Sequence
  Description of Artificial Sequence: Synthetic oligonucleotide
ctcatgcggtggttcttggactggatatcc

SEQ ID NO: 316731 - DNA, 31 bp, Artificial Sequence
  Description of Artificial Sequence: Synthetic oligonucleotide
tcatgcggtggttcttggactggatatcctg

SEQ ID NO: 316732 - DNA, 30 bp, Artificial Sequence
  Description of Artificial Sequence: Synthetic oligonucleotide
catgcggtggttcttggactggatatcctg

SEQ ID NO: 316733 - DNA, 30 bp, Artificial Sequence
  Description of Artificial Sequence: Synthetic oligonucleotide
atgcggtggttcttggactggatatcctgg

SEQ ID NO: 316734 - DNA, 29 bp, Artificial Sequence
  Description of Artificial Sequence: Synthetic oligonucleotide
tgcggtggttcttggactggatatcctgg

SEQ ID NO: 316735 - DNA, 28 bp, Artificial Sequence
  Description of Artificial Sequence: Synthetic oligonucleotide
gcggtggttcttggactggatatcctgg

SEQ ID NO: 316736 - DNA, 29 bp, Artificial Sequence
  Description of Artificial Sequence: Synthetic oligonucleotide
cggtggttcttggactggatatcctggtg

SEQ ID NO: 316737 - DNA, 30 bp, Artificial Sequence
  Description of Artificial Sequence: Synthetic oligonucleotide
ggtggttcttggactggatatcctggtgac

SEQ ID NO: 316738 - DNA, 30 bp, Artificial Sequence
  Description of Artificial Sequence: Synthetic oligonucleotide
gtggttcttggactggatatcctggtgacg

SEQ ID NO: 316739 - DNA, 31 bp, Artificial Sequence
  Description of Artificial Sequence: Synthetic oligonucleotide
tggttcttggactggatatcctggtgacgtc

SEQ ID NO: 316740 - DNA, 30 bp, Artificial Sequence
  Description of Artificial Sequence: Synthetic oligonucleotide
ggttcttggactggatatcctggtgacgtc

SEQ ID NO: 316741 - DNA, 30 bp, Artificial Sequence
  Description of Artificial Sequence: Synthetic oligonucleotide
gttcttggactggatatcctggtgacgtcc

SEQ ID NO: 316742 - DNA, 32 bp, Artificial Sequence
  Description of Artificial Sequence: Synthetic oligonucleotide
ttcttggactggatatcctggtgacgtccaag

SEQ ID NO: 316743 - DNA, 31 bp, Artificial Sequence
  Description of Artificial Sequence: Synthetic oligonucleotide
tcttggactggatatcctggtgacgtccaag

SEQ ID NO: 316744 - DNA, 30 bp, Artificial Sequence
  Description of Artificial Sequence: Synthetic oligonucleotide
cttggactggatatcctggtgacgtccaag

SEQ ID NO: 316745 - DNA, 30 bp, Artificial Sequence
  Description of Artificial Sequence: Synthetic oligonucleotide
ttggactggatatcctggtgacgtccaagc

SEQ ID NO: 316746 - DNA, 29 bp, Artificial Sequence
  Description of Artificial Sequence: Synthetic oligonucleotide
tggactggatatcctggtgacgtccaagc

SEQ ID NO: 316747 - DNA, 28 bp, Artificial Sequence
  Description of Artificial Sequence: Synthetic oligonucleotide
ggactggatatcctggtgacgtccaagc

SEQ ID NO: 316748 - DNA, 29 bp, Artificial Sequence
  Description of Artificial Sequence: Synthetic oligonucleotide
gactggatatcctggtgacgtccaagctc

SEQ ID NO: 316749 - DNA, 31 bp, Artificial Sequence
  Description of Artificial Sequence: Synthetic oligonucleotide
actggatatcctggtgacgtccaagctcttg

SEQ ID NO: 316750 - DNA, 30 bp, Artificial Sequence
  Description of Artificial Sequence: Synthetic oligonucleotide
ctggatatcctggtgacgtccaagctcttg

SEQ ID NO: 316751 - DNA, 30 bp, Artificial Sequence
  Description of Artificial Sequence: Synthetic oligonucleotide
tggatatcctggtgacgtccaagctcttgc

SEQ ID NO: 316752 - DNA, 29 bp, Artificial Sequence
  Description of Artificial Sequence: Synthetic oligonucleotide
ggatatcctggtgacgtccaagctcttgc

SEQ ID NO: 316753 - DNA, 30 bp, Artificial Sequence
  Description of Artificial Sequence: Synthetic oligonucleotide
gatatcctggtgacgtccaagctcttgctg

SEQ ID NO: 316754 - DNA, 32 bp, Artificial Sequence
  Description of Artificial Sequence: Synthetic oligonucleotide
atatcctggtgacgtccaagctcttgctgttg

SEQ ID NO: 316755 - DNA, 31 bp, Artificial Sequence
  Description of Artificial Sequence: Synthetic oligonucleotide
tatcctggtgacgtccaagctcttgctgttg

SEQ ID NO: 316756 - DNA, 30 bp, Artificial Sequence
  Description of Artificial Sequence: Synthetic oligonucleotide
atcctggtgacgtccaagctcttgctgttg

SEQ ID NO: 316757 - DNA, 29 bp, Artificial Sequence
  Description of Artificial Sequence: Synthetic oligonucleotide
tcctggtgacgtccaagctcttgctgttg

SEQ ID NO: 316758 - DNA, 28 bp, Artificial Sequence
  Description of Artificial Sequence: Synthetic oligonucleotide
cctggtgacgtccaagctcttgctgttg

SEQ ID NO: 316759 - DNA, 29 bp, Artificial Sequence
  Description of Artificial Sequence: Synthetic oligonucleotide
ctggtgacgtccaagctcttgctgttgac

SEQ ID NO: 316760 - DNA, 31 bp, Artificial Sequence
  Description of Artificial Sequence: Synthetic oligonucleotide
tggtgacgtccaagctcttgctgttgacaac

SEQ ID NO: 316761 - DNA, 30 bp, Artificial Sequence
  Description of Artificial Sequence: Synthetic oligonucleotide
ggtgacgtccaagctcttgctgttgacaac

SEQ ID NO: 316762 - DNA, 32 bp, Artificial Sequence
  Description of Artificial Sequence: Synthetic oligonucleotide
gtgacgtccaagctcttgctgttgacaacatg

SEQ ID NO: 316763 - DNA, 33 bp, Artificial Sequence
  Description of Artificial Sequence: Synthetic oligonucleotide
tgacgtccaagctcttgctgttgacaacatgtc

SEQ ID NO: 316764 - DNA, 32 bp, Artificial Sequence
  Description of Artificial Sequence: Synthetic oligonucleotide
gacgtccaagctcttgctgttgacaacatgtc

SEQ ID NO: 316765 - DNA, 33 bp, Artificial Sequence
  Description of Artificial Sequence: Synthetic oligonucleotide
acgtccaagctcttgctgttgacaacatgtcag

SEQ ID NO: 316766 - DNA, 32 bp, Artificial Sequence
  Description of Artificial Sequence: Synthetic oligonucleotide
cgtccaagctcttgctgttgacaacatgtcag

SEQ ID NO: 316767 - DNA, 32 bp, Artificial Sequence
  Description of Artificial Sequence: Synthetic oligonucleotide
gtccaagctcttgctgttgacaacatgtcagg

SEQ ID NO: 316768 - DNA, 32 bp, Artificial Sequence
  Description of Artificial Sequence: Synthetic oligonucleotide
tccaagctcttgctgttgacaacatgtcaggc

SEQ ID NO: 316769 - DNA, 31 bp, Artificial Sequence
  Description of Artificial Sequence: Synthetic oligonucleotide
ccaagctcttgctgttgacaacatgtcaggc

SEQ ID NO: 316770 - DNA, 31 bp, Artificial Sequence
  Description of Artificial Sequence: Synthetic oligonucleotide
caagctcttgctgttgacaacatgtcaggcc

SEQ ID NO: 316771 - DNA, 31 bp, Artificial Sequence
  Description of Artificial Sequence: Synthetic oligonucleotide
aagctcttgctgttgacaacatgtcaggccc

SEQ ID NO: 316772 - DNA, 30 bp, Artificial Sequence
  Description of Artificial Sequence: Synthetic oligonucleotide
agctcttgctgttgacaacatgtcaggccc

SEQ ID NO: 316773 - DNA, 29 bp, Artificial Sequence
  Description of Artificial Sequence: Synthetic oligonucleotide
gctcttgctgttgacaacatgtcaggccc

SEQ ID NO: 316774 - DNA, 30 bp, Artificial Sequence
  Description of Artificial Sequence: Synthetic oligonucleotide
ctcttgctgttgacaacatgtcaggcccag

SEQ ID NO: 316775 - DNA, 30 bp, Artificial Sequence
  Description of Artificial Sequence: Synthetic oligonucleotide
tcttgctgttgacaacatgtcaggcccagc

SEQ ID NO: 316776 - DNA, 29 bp, Artificial Sequence
  Description of Artificial Sequence: Synthetic oligonucleotide
cttgctgttgacaacatgtcaggcccagc

SEQ ID NO: 316777 - DNA, 30 bp, Artificial Sequence
  Description of Artificial Sequence: Synthetic oligonucleotide
ttgctgttgacaacatgtcaggcccagcac

SEQ ID NO: 316778 - DNA, 29 bp, Artificial Sequence
  Description of Artificial Sequence: Synthetic oligonucleotide
tgctgttgacaacatgtcaggcccagcac

SEQ ID NO: 316779 - DNA, 28 bp, Artificial Sequence
  Description of Artificial Sequence: Synthetic oligonucleotide
gctgttgacaacatgtcaggcccagcac

SEQ ID NO: 316780 - DNA, 28 bp, Artificial Sequence
  Description of Artificial Sequence: Synthetic oligonucleotide
ctgttgacaacatgtcaggcccagcacg

SEQ ID NO: 316781 - DNA, 28 bp, Artificial Sequence
  Description of Artificial Sequence: Synthetic oligonucleotide
tgttgacaacatgtcaggcccagcacgc

SEQ ID NO: 316782 - DNA, 27 bp, Artificial Sequence
  Description of Artificial Sequence: Synthetic oligonucleotide
gttgacaacatgtcaggcccagcacgc

SEQ ID NO: 316783 - DNA, 28 bp, Artificial Sequence
  Description of Artificial Sequence: Synthetic oligonucleotide
ttgacaacatgtcaggcccagcacgctc

SEQ ID NO: 316784 - DNA, 27 bp, Artificial Sequence
  Description of Artificial Sequence: Synthetic oligonucleotide
tgacaacatgtcaggcccagcacgctc

SEQ ID NO: 316785 - DNA, 27 bp, Artificial Sequence
  Description of Artificial Sequence: Synthetic oligonucleotide
gacaacatgtcaggcccagcacgctct

SEQ ID NO: 316786 - DNA, 27 bp, Artificial Sequence
  Description of Artificial Sequence: Synthetic oligonucleotide
acaacatgtcaggcccagcacgctctg

SEQ ID NO: 316787 - DNA, 26 bp, Artificial Sequence
  Description of Artificial Sequence: Synthetic oligonucleotide
caacatgtcaggcccagcacgctctg

SEQ ID NO: 316788 - DNA, 27 bp, Artificial Sequence
  Description of Artificial Sequence: Synthetic oligonucleotide
aacatgtcaggcccagcacgctctgga

SEQ ID NO: 316789 - DNA, 26 bp, Artificial Sequence
  Description of Artificial Sequence: Synthetic oligonucleotide
acatgtcaggcccagcacgctctgga

SEQ ID NO: 316790 - DNA, 25 bp, Artificial Sequence
  Description of Artificial Sequence: Synthetic oligonucleotide
catgtcaggcccagcacgctctgga

SEQ ID NO: 316791 - DNA, 25 bp, Artificial Sequence
  Description of Artificial Sequence: Synthetic oligonucleotide
atgtcaggcccagcacgctctggac

SEQ ID NO: 316792 - DNA, 24 bp, Artificial Sequence
  Description of Artificial Sequence: Synthetic oligonucleotide
tgtcaggcccagcacgctctggac

SEQ ID NO: 316793 - DNA, 23 bp, Artificial Sequence
  Description of Artificial Sequence: Synthetic oligonucleotide
gtcaggcccagcacgctctggac

SEQ ID NO: 316794 - DNA, 24 bp, Artificial Sequence
  Description of Artificial Sequence: Synthetic oligonucleotide
tcaggcccagcacgctctggacgt

SEQ ID NO: 316795 - DNA, 23 bp, Artificial Sequence
  Description of Artificial Sequence: Synthetic oligonucleotide
caggcccagcacgctctggacgt

SEQ ID NO: 316796 - DNA, 23 bp, Artificial Sequence
  Description of Artificial Sequence: Synthetic oligonucleotide
aggcccagcacgctctggacgtg

SEQ ID NO: 316797 - DNA, 22 bp, Artificial Sequence
  Description of Artificial Sequence: Synthetic oligonucleotide
ggcccagcacgctctggacgtg

SEQ ID NO: 316798 - DNA, 23 bp, Artificial Sequence
  Description of Artificial Sequence: Synthetic oligonucleotide
gcccagcacgctctggacgtgct

SEQ ID NO: 316799 - DNA, 23 bp, Artificial Sequence
  Description of Artificial Sequence: Synthetic oligonucleotide
cccagcacgctctggacgtgctg

SEQ ID NO: 316800 - DNA, 24 bp, Artificial Sequence
  Description of Artificial Sequence: Synthetic oligonucleotide
ccagcacgctctggacgtgctgct

SEQ ID NO: 316801 - DNA, 26 bp, Artificial Sequence
  Description of Artificial Sequence: Synthetic oligonucleotide
cagcacgctctggacgtgctgctgat

SEQ ID NO: 316802 - DNA, 26 bp, Artificial Sequence
  Description of Artificial Sequence: Synthetic oligonucleotide
agcacgctctggacgtgctgctgatc

SEQ ID NO: 316803 - DNA, 25 bp, Artificial Sequence
  Description of Artificial Sequence: Synthetic oligonucleotide
gcacgctctggacgtgctgctgatc

SEQ ID NO: 316804 - DNA, 26 bp, Artificial Sequence
  Description of Artificial Sequence: Synthetic oligonucleotide
cacgctctggacgtgctgctgatcct

SEQ ID NO: 316805 - DNA, 26 bp, Artificial Sequence
  Description of Artificial Sequence: Synthetic oligonucleotide
acgctctggacgtgctgctgatcctg

SEQ ID NO: 316806 - DNA, 25 bp, Artificial Sequence
  Description of Artificial Sequence: Synthetic oligonucleotide
cgctctggacgtgctgctgatcctg

SEQ ID NO: 316807 - DNA, 25 bp, Artificial Sequence
  Description of Artificial Sequence: Synthetic oligonucleotide
gctctggacgtgctgctgatcctgg

SEQ ID NO: 316808 - DNA, 26 bp, Artificial Sequence
  Description of Artificial Sequence: Synthetic oligonucleotide
ctctggacgtgctgctgatcctggca

SEQ ID NO: 316809 - DNA, 27 bp, Artificial Sequence
  Description of Artificial Sequence: Synthetic oligonucleotide
tctggacgtgctgctgatcctggcaga

SEQ ID NO: 316810 - DNA, 27 bp, Artificial Sequence
  Description of Artificial Sequence: Synthetic oligonucleotide
ctggacgtgctgctgatcctggcagat

SEQ ID NO: 316811 - DNA, 27 bp, Artificial Sequence
  Description of Artificial Sequence: Synthetic oligonucleotide
tggacgtgctgctgatcctggcagatg

SEQ ID NO: 316812 - DNA, 26 bp, Artificial Sequence
  Description of Artificial Sequence: Synthetic oligonucleotide
ggacgtgctgctgatcctggcagatg

SEQ ID NO: 316813 - DNA, 26 bp, Artificial Sequence
  Description of Artificial Sequence: Synthetic oligonucleotide
gacgtgctgctgatcctggcagatgc

SEQ ID NO: 316814 - DNA, 26 bp, Artificial Sequence
  Description of Artificial Sequence: Synthetic oligonucleotide
acgtgctgctgatcctggcagatgcc

SEQ ID NO: 316815 - DNA, 25 bp, Artificial Sequence
  Description of Artificial Sequence: Synthetic oligonucleotide
cgtgctgctgatcctggcagatgcc

SEQ ID NO: 316816 - DNA, 26 bp, Artificial Sequence
  Description of Artificial Sequence: Synthetic oligonucleotide
gtgctgctgatcctggcagatgccct

SEQ ID NO: 316817 - DNA, 26 bp, Artificial Sequence
  Description of Artificial Sequence: Synthetic oligonucleotide
tgctgctgatcctggcagatgccctg

SEQ ID NO: 316818 - DNA, 25 bp, Artificial Sequence
  Description of Artificial Sequence: Synthetic oligonucleotide
gctgctgatcctggcagatgccctg

SEQ ID NO: 316819 - DNA, 25 bp, Artificial Sequence
  Description of Artificial Sequence: Synthetic oligonucleotide
ctgctgatcctggcagatgccctgg

SEQ ID NO: 316820 - DNA, 27 bp, Artificial Sequence
  Description of Artificial Sequence: Synthetic oligonucleotide
tgctgatcctggcagatgccctggcat

SEQ ID NO: 316821 - DNA, 27 bp, Artificial Sequence
  Description of Artificial Sequence: Synthetic oligonucleotide
gctgatcctggcagatgccctggcatt

SEQ ID NO: 316822 - DNA, 30 bp, Artificial Sequence
  Description of Artificial Sequence: Synthetic oligonucleotide
ctgatcctggcagatgccctggcatttttg

SEQ ID NO: 316823 - DNA, 30 bp, Artificial Sequence
  Description of Artificial Sequence: Synthetic oligonucleotide
tgatcctggcagatgccctggcatttttgc

SEQ ID NO: 316824 - DNA, 29 bp, Artificial Sequence
  Description of Artificial Sequence: Synthetic oligonucleotide
gatcctggcagatgccctggcatttttgc

SEQ ID NO: 316825 - DNA, 30 bp, Artificial Sequence
  Description of Artificial Sequence: Synthetic oligonucleotide
atcctggcagatgccctggcatttttgcac

SEQ ID NO: 316826 - DNA, 29 bp, Artificial Sequence
  Description of Artificial Sequence: Synthetic oligonucleotide
tcctggcagatgccctggcatttttgcac

SEQ ID NO: 316827 - DNA, 28 bp, Artificial Sequence
  Description of Artificial Sequence: Synthetic oligonucleotide
cctggcagatgccctggcatttttgcac

SEQ ID NO: 316828 - DNA, 29 bp, Artificial Sequence
  Description of Artificial Sequence: Synthetic oligonucleotide
ctggcagatgccctggcatttttgcactc

SEQ ID NO: 316829 - DNA, 30 bp, Artificial Sequence
  Description of Artificial Sequence: Synthetic oligonucleotide
tggcagatgccctggcatttttgcactctg

SEQ ID NO: 316830 - DNA, 29 bp, Artificial Sequence
  Description of Artificial Sequence: Synthetic oligonucleotide
ggcagatgccctggcatttttgcactctg

SEQ ID NO: 316831 - DNA, 30 bp, Artificial Sequence
  Description of Artificial Sequence: Synthetic oligonucleotide
gcagatgccctggcatttttgcactctgtg

SEQ ID NO: 316832 - DNA, 30 bp, Artificial Sequence
  Description of Artificial Sequence: Synthetic oligonucleotide
cagatgccctggcatttttgcactctgtgg

SEQ ID NO: 316833 - DNA, 30 bp, Artificial Sequence
  Description of Artificial Sequence: Synthetic oligonucleotide
agatgccctggcatttttgcactctgtggc

SEQ ID NO: 316834 - DNA, 29 bp, Artificial Sequence
  Description of Artificial Sequence: Synthetic oligonucleotide
gatgccctggcatttttgcactctgtggc

SEQ ID NO: 316835 - DNA, 31 bp, Artificial Sequence
  Description of Artificial Sequence: Synthetic oligonucleotide
atgccctggcatttttgcactctgtggctac

SEQ ID NO: 316836 - DNA, 30 bp, Artificial Sequence
  Description of Artificial Sequence: Synthetic oligonucleotide
tgccctggcatttttgcactctgtggctac

SEQ ID NO: 316837 - DNA, 29 bp, Artificial Sequence
  Description of Artificial Sequence: Synthetic oligonucleotide
gccctggcatttttgcactctgtggctac

SEQ ID NO: 316838 - DNA, 29 bp, Artificial Sequence
  Description of Artificial Sequence: Synthetic oligonucleotide
ccctggcatttttgcactctgtggctacc

SEQ ID NO: 316839 - DNA, 29 bp, Artificial Sequence
  Description of Artificial Sequence: Synthetic oligonucleotide
cctggcatttttgcactctgtggctaccc

SEQ ID NO: 316840 - DNA, 29 bp, Artificial Sequence
  Description of Artificial Sequence: Synthetic oligonucleotide
ctggcatttttgcactctgtggctacccc

SEQ ID NO: 316841 - DNA, 29 bp, Artificial Sequence
  Description of Artificial Sequence: Synthetic oligonucleotide
tggcatttttgcactctgtggctaccccc

SEQ ID NO: 316842 - DNA, 28 bp, Artificial Sequence
  Description of Artificial Sequence: Synthetic oligonucleotide
ggcatttttgcactctgtggctaccccc

SEQ ID NO: 316843 - DNA, 28 bp, Artificial Sequence
  Description of Artificial Sequence: Synthetic oligonucleotide
gcatttttgcactctgtggctacccccc

SEQ ID NO: 316844 - DNA, 29 bp, Artificial Sequence
  Description of Artificial Sequence: Synthetic oligonucleotide
catttttgcactctgtggctacccccctg

SEQ ID NO: 316845 - DNA, 29 bp, Artificial Sequence
  Description of Artificial Sequence: Synthetic oligonucleotide
atttttgcactctgtggctacccccctgc

SEQ ID NO: 316846 - DNA, 28 bp, Artificial Sequence
  Description of Artificial Sequence: Synthetic oligonucleotide
tttttgcactctgtggctacccccctgc

SEQ ID NO: 316847 - DNA, 27 bp, Artificial Sequence
  Description of Artificial Sequence: Synthetic oligonucleotide
ttttgcactctgtggctacccccctgc

SEQ ID NO: 316848 - DNA, 27 bp, Artificial Sequence
  Description of Artificial Sequence: Synthetic oligonucleotide
tttgcactctgtggctacccccctgct

SEQ ID NO: 316849 - DNA, 26 bp, Artificial Sequence
  Description of Artificial Sequence: Synthetic oligonucleotide
ttgcactctgtggctacccccctgct

SEQ ID NO: 316850 - DNA, 25 bp, Artificial Sequence
  Description of Artificial Sequence: Synthetic oligonucleotide
tgcactctgtggctacccccctgct

SEQ ID NO: 316851 - DNA, 24 bp, Artificial Sequence
  Description of Artificial Sequence: Synthetic oligonucleotide
gcactctgtggctacccccctgct

SEQ ID NO: 316852 - DNA, 24 bp, Artificial Sequence
  Description of Artificial Sequence: Synthetic oligonucleotide
cactctgtggctacccccctgctc

SEQ ID NO: 316853 - DNA, 25 bp, Artificial Sequence
  Description of Artificial Sequence: Synthetic oligonucleotide
actctgtggctacccccctgctcgt

SEQ ID NO: 316854 - DNA, 24 bp, Artificial Sequence
  Description of Artificial Sequence: Synthetic oligonucleotide
ctctgtggctacccccctgctcgt

SEQ ID NO: 316855 - DNA, 24 bp, Artificial Sequence
  Description of Artificial Sequence: Synthetic oligonucleotide
tctgtggctacccccctgctcgtc

SEQ ID NO: 316856 - DNA, 23 bp, Artificial Sequence
  Description of Artificial Sequence: Synthetic oligonucleotide
ctgtggctacccccctgctcgtc

SEQ ID NO: 316857 - DNA, 23 bp, Artificial Sequence
  Description of Artificial Sequence: Synthetic oligonucleotide
tgtggctacccccctgctcgtcg

SEQ ID NO: 316858 - DNA, 22 bp, Artificial Sequence
  Description of Artificial Sequence: Synthetic oligonucleotide
gtggctacccccctgctcgtcg

SEQ ID NO: 316859 - DNA, 22 bp, Artificial Sequence
  Description of Artificial Sequence: Synthetic oligonucleotide
tggctacccccctgctcgtcgc

SEQ ID NO: 316860 - DNA, 21 bp, Artificial Sequence
  Description of Artificial Sequence: Synthetic oligonucleotide
ggctacccccctgctcgtcgc

SEQ ID NO: 316861 - DNA, 21 bp, Artificial Sequence
  Description of Artificial Sequence: Synthetic oligonucleotide
gctacccccctgctcgtcgcc

SEQ ID NO: 316862 - DNA, 25 bp, Artificial Sequence
  Description of Artificial Sequence: Synthetic oligonucleotide
ctacccccctgctcgtcgccctata

SEQ ID NO: 316863 - DNA, 26 bp, Artificial Sequence
  Description of Artificial Sequence: Synthetic oligonucleotide
tacccccctgctcgtcgccctatact

SEQ ID NO: 316864 - DNA, 25 bp, Artificial Sequence
  Description of Artificial Sequence: Synthetic oligonucleotide
acccccctgctcgtcgccctatact

SEQ ID NO: 316865 - DNA, 24 bp, Artificial Sequence
  Description of Artificial Sequence: Synthetic oligonucleotide
cccccctgctcgtcgccctatact

SEQ ID NO: 316866 - DNA, 24 bp, Artificial Sequence
  Description of Artificial Sequence: Synthetic oligonucleotide
ccccctgctcgtcgccctatactg

SEQ ID NO: 316867 - DNA, 24 bp, Artificial Sequence
  Description of Artificial Sequence: Synthetic oligonucleotide
cccctgctcgtcgccctatactgc

SEQ ID NO: 316868 - DNA, 25 bp, Artificial Sequence
  Description of Artificial Sequence: Synthetic oligonucleotide
ccctgctcgtcgccctatactgcca

SEQ ID NO: 316869 - DNA, 25 bp, Artificial Sequence
  Description of Artificial Sequence: Synthetic oligonucleotide
cctgctcgtcgccctatactgccac

SEQ ID NO: 316870 - DNA, 26 bp, Artificial Sequence
  Description of Artificial Sequence: Synthetic oligonucleotide
ctgctcgtcgccctatactgccacca

SEQ ID NO: 316871 - DNA, 26 bp, Artificial Sequence
  Description of Artificial Sequence: Synthetic oligonucleotide
tgctcgtcgccctatactgccaccac

SEQ ID NO: 316872 - DNA, 25 bp, Artificial Sequence
  Description of Artificial Sequence: Synthetic oligonucleotide
gctcgtcgccctatactgccaccac

SEQ ID NO: 316873 - DNA, 25 bp, Artificial Sequence
  Description of Artificial Sequence: Synthetic oligonucleotide
ctcgtcgccctatactgccaccacg

SEQ ID NO: 316874 - DNA, 25 bp, Artificial Sequence
  Description of Artificial Sequence: Synthetic oligonucleotide
tcgtcgccctatactgccaccacgc

SEQ ID NO: 316875 - DNA, 24 bp, Artificial Sequence
  Description of Artificial Sequence: Synthetic oligonucleotide
cgtcgccctatactgccaccacgc

SEQ ID NO: 316876 - DNA, 25 bp, Artificial Sequence
  Description of Artificial Sequence: Synthetic oligonucleotide
gtcgccctatactgccaccacgcca

SEQ ID NO: 316877 - DNA, 25 bp, Artificial Sequence
  Description of Artificial Sequence: Synthetic oligonucleotide
tcgccctatactgccaccacgccac

SEQ ID NO: 316878 - DNA, 24 bp, Artificial Sequence
  Description of Artificial Sequence: Synthetic oligonucleotide
cgccctatactgccaccacgccac

SEQ ID NO: 316879 - DNA, 24 bp, Artificial Sequence
  Description of Artificial Sequence: Synthetic oligonucleotide
gccctatactgccaccacgccacc

SEQ ID NO: 316880 - DNA, 24 bp, Artificial Sequence
  Description of Artificial Sequence: Synthetic oligonucleotide
ccctatactgccaccacgccaccc

SEQ ID NO: 316881 - DNA, 24 bp, Artificial Sequence
  Description of Artificial Sequence: Synthetic oligonucleotide
cctatactgccaccacgccacccg

SEQ ID NO: 316882 - DNA, 25 bp, Artificial Sequence
  Description of Artificial Sequence: Synthetic oligonucleotide
ctatactgccaccacgccacccgct

SEQ ID NO: 316883 - DNA, 25 bp, Artificial Sequence
  Description of Artificial Sequence: Synthetic oligonucleotide
tatactgccaccacgccacccgctc

SEQ ID NO: 316884 - DNA, 24 bp, Artificial Sequence
  Description of Artificial Sequence: Synthetic oligonucleotide
atactgccaccacgccacccgctc

SEQ ID NO: 316885 - DNA, 23 bp, Artificial Sequence
  Description of Artificial Sequence: Synthetic oligonucleotide
tactgccaccacgccacccgctc

SEQ ID NO: 316886 - DNA, 22 bp, Artificial Sequence
  Description of Artificial Sequence: Synthetic oligonucleotide
actgccaccacgccacccgctc

SEQ ID NO: 316887 - DNA, 21 bp, Artificial Sequence
  Description of Artificial Sequence: Synthetic oligonucleotide
ctgccaccacgccacccgctc

SEQ ID NO: 316888 - DNA, 21 bp, Artificial Sequence
  Description of Artificial Sequence: Synthetic oligonucleotide
tgccaccacgccacccgctcc

SEQ ID NO: 316889 - DNA, 20 bp, Artificial Sequence
  Description of Artificial Sequence: Synthetic oligonucleotide
gccaccacgccacccgctcc

SEQ ID NO: 316890 - DNA, 21 bp, Artificial Sequence
  Description of Artificial Sequence: Synthetic oligonucleotide
ccaccacgccacccgctccct

SEQ ID NO: 316891 - DNA, 23 bp, Artificial Sequence
  Description of Artificial Sequence: Synthetic oligonucleotide
caccacgccacccgctccctctt

SEQ ID NO: 316892 - DNA, 23 bp, Artificial Sequence
  Description of Artificial Sequence: Synthetic oligonucleotide
accacgccacccgctccctcttg

SEQ ID NO: 316893 - DNA, 22 bp, Artificial Sequence
  Description of Artificial Sequence: Synthetic oligonucleotide
ccacgccacccgctccctcttg

SEQ ID NO: 316894 - DNA, 22 bp, Artificial Sequence
  Description of Artificial Sequence: Synthetic oligonucleotide
cacgccacccgctccctcttgc

SEQ ID NO: 316895 - DNA, 22 bp, Artificial Sequence
  Description of Artificial Sequence: Synthetic oligonucleotide
acgccacccgctccctcttgcg

SEQ ID NO: 316896 - DNA, 21 bp, Artificial Sequence
  Description of Artificial Sequence: Synthetic oligonucleotide
cgccacccgctccctcttgcg

SEQ ID NO: 316897 - DNA, 22 bp, Artificial Sequence
  Description of Artificial Sequence: Synthetic oligonucleotide
gccacccgctccctcttgcgct

SEQ ID NO: 316898 - DNA, 23 bp, Artificial Sequence
  Description of Artificial Sequence: Synthetic oligonucleotide
ccacccgctccctcttgcgctct

SEQ ID NO: 316899 - DNA, 24 bp, Artificial Sequence
  Description of Artificial Sequence: Synthetic oligonucleotide
cacccgctccctcttgcgctctct

SEQ ID NO: 316900 - DNA, 24 bp, Artificial Sequence
  Description of Artificial Sequence: Synthetic oligonucleotide
acccgctccctcttgcgctctctg

SEQ ID NO: 316901 - DNA, 23 bp, Artificial Sequence
  Description of Artificial Sequence: Synthetic oligonucleotide
cccgctccctcttgcgctctctg

SEQ ID NO: 316902 - DNA, 23 bp, Artificial Sequence
  Description of Artificial Sequence: Synthetic oligonucleotide
ccgctccctcttgcgctctctgc

SEQ ID NO: 316903 - DNA, 23 bp, Artificial Sequence
  Description of Artificial Sequence: Synthetic oligonucleotide
cgctccctcttgcgctctctgcc

SEQ ID NO: 316904 - DNA, 23 bp, Artificial Sequence
  Description of Artificial Sequence: Synthetic oligonucleotide
gctccctcttgcgctctctgccg

SEQ ID NO: 316905 - DNA, 24 bp, Artificial Sequence
  Description of Artificial Sequence: Synthetic oligonucleotide
ctccctcttgcgctctctgccgct

SEQ ID NO: 316906 - DNA, 24 bp, Artificial Sequence
  Description of Artificial Sequence: Synthetic oligonucleotide
tccctcttgcgctctctgccgctc

SEQ ID NO: 316907 - DNA, 23 bp, Artificial Sequence
  Description of Artificial Sequence: Synthetic oligonucleotide
ccctcttgcgctctctgccgctc

SEQ ID NO: 316908 - DNA, 23 bp, Artificial Sequence
  Description of Artificial Sequence: Synthetic oligonucleotide
cctcttgcgctctctgccgctcc

SEQ ID NO: 316909 - DNA, 24 bp, Artificial Sequence
  Description of Artificial Sequence: Synthetic oligonucleotide
ctcttgcgctctctgccgctccct

SEQ ID NO: 316910 - DNA, 26 bp, Artificial Sequence
  Description of Artificial Sequence: Synthetic oligonucleotide
tcttgcgctctctgccgctccctgaa

SEQ ID NO: 316911 - DNA, 25 bp, Artificial Sequence
  Description of Artificial Sequence: Synthetic oligonucleotide
cttgcgctctctgccgctccctgaa

SEQ ID NO: 316912 - DNA, 25 bp, Artificial Sequence
  Description of Artificial Sequence: Synthetic oligonucleotide
ttgcgctctctgccgctccctgaac

SEQ ID NO: 316913 - DNA, 24 bp, Artificial Sequence
  Description of Artificial Sequence: Synthetic oligonucleotide
tgcgctctctgccgctccctgaac

SEQ ID NO: 316914 - DNA, 23 bp, Artificial Sequence
  Description of Artificial Sequence: Synthetic oligonucleotide
gcgctctctgccgctccctgaac

SEQ ID NO: 316915 - DNA, 25 bp, Artificial Sequence
  Description of Artificial Sequence: Synthetic oligonucleotide
cgctctctgccgctccctgaacgat

SEQ ID NO: 316916 - DNA, 25 bp, Artificial Sequence
  Description of Artificial Sequence: Synthetic oligonucleotide
gctctctgccgctccctgaacgatg

SEQ ID NO: 316917 - DNA, 26 bp, Artificial Sequence
  Description of Artificial Sequence: Synthetic oligonucleotide
ctctctgccgctccctgaacgatggt

SEQ ID NO: 316918 - DNA, 27 bp, Artificial Sequence
  Description of Artificial Sequence: Synthetic oligonucleotide
tctctgccgctccctgaacgatggtct

SEQ ID NO: 316919 - DNA, 27 bp, Artificial Sequence
  Description of Artificial Sequence: Synthetic oligonucleotide
ctctgccgctccctgaacgatggtctt

SEQ ID NO: 316920 - DNA, 27 bp, Artificial Sequence
  Description of Artificial Sequence: Synthetic oligonucleotide
tctgccgctccctgaacgatggtcttg

SEQ ID NO: 316921 - DNA, 27 bp, Artificial Sequence
  Description of Artificial Sequence: Synthetic oligonucleotide
ctgccgctccctgaacgatggtcttgt

SEQ ID NO: 316922 - DNA, 27 bp, Artificial Sequence
  Description of Artificial Sequence: Synthetic oligonucleotide
tgccgctccctgaacgatggtcttgtc

SEQ ID NO: 316923 - DNA, 27 bp, Artificial Sequence
  Description of Artificial Sequence: Synthetic oligonucleotide
gccgctccctgaacgatggtcttgtca

SEQ ID NO: 316924 - DNA, 28 bp, Artificial Sequence
  Description of Artificial Sequence: Synthetic oligonucleotide
ccgctccctgaacgatggtcttgtcatc

SEQ ID NO: 316925 - DNA, 29 bp, Artificial Sequence
  Description of Artificial Sequence: Synthetic oligonucleotide
cgctccctgaacgatggtcttgtcatctg

SEQ ID NO: 316926 - DNA, 29 bp, Artificial Sequence
  Description of Artificial Sequence: Synthetic oligonucleotide
gctccctgaacgatggtcttgtcatctgg

SEQ ID NO: 316927 - DNA, 30 bp, Artificial Sequence
  Description of Artificial Sequence: Synthetic oligonucleotide
ctccctgaacgatggtcttgtcatctggag

SEQ ID NO: 316928 - DNA, 31 bp, Artificial Sequence
  Description of Artificial Sequence: Synthetic oligonucleotide
tccctgaacgatggtcttgtcatctggagac

SEQ ID NO: 316929 - DNA, 30 bp, Artificial Sequence
  Description of Artificial Sequence: Synthetic oligonucleotide
ccctgaacgatggtcttgtcatctggagac

SEQ ID NO: 316930 - DNA, 30 bp, Artificial Sequence
  Description of Artificial Sequence: Synthetic oligonucleotide
cctgaacgatggtcttgtcatctggagacc

SEQ ID NO: 316931 - DNA, 30 bp, Artificial Sequence
  Description of Artificial Sequence: Synthetic oligonucleotide
ctgaacgatggtcttgtcatctggagaccc

SEQ ID NO: 316932 - DNA, 32 bp, Artificial Sequence
  Description of Artificial Sequence: Synthetic oligonucleotide
tgaacgatggtcttgtcatctggagacccttg

SEQ ID NO: 316933 - DNA, 31 bp, Artificial Sequence
  Description of Artificial Sequence: Synthetic oligonucleotide
gaacgatggtcttgtcatctggagacccttg

SEQ ID NO: 316934 - DNA, 31 bp, Artificial Sequence
  Description of Artificial Sequence: Synthetic oligonucleotide
aacgatggtcttgtcatctggagacccttgg

SEQ ID NO: 316935 - DNA, 30 bp, Artificial Sequence
  Description of Artificial Sequence: Synthetic oligonucleotide
acgatggtcttgtcatctggagacccttgg

SEQ ID NO: 316936 - DNA, 29 bp, Artificial Sequence
  Description of Artificial Sequence: Synthetic oligonucleotide
cgatggtcttgtcatctggagacccttgg

SEQ ID NO: 316937 - DNA, 31 bp, Artificial Sequence
  Description of Artificial Sequence: Synthetic oligonucleotide
gatggtcttgtcatctggagacccttggatg

SEQ ID NO: 316938 - DNA, 31 bp, Artificial Sequence
  Description of Artificial Sequence: Synthetic oligonucleotide
atggtcttgtcatctggagacccttggatgc

SEQ ID NO: 316939 - DNA, 30 bp, Artificial Sequence
  Description of Artificial Sequence: Synthetic oligonucleotide
tggtcttgtcatctggagacccttggatgc

SEQ ID NO: 316940 - DNA, 29 bp, Artificial Sequence
  Description of Artificial Sequence: Synthetic oligonucleotide
ggtcttgtcatctggagacccttggatgc

SEQ ID NO: 316941 - DNA, 33 bp, Artificial Sequence
  Description of Artificial Sequence: Synthetic oligonucleotide
gtcttgtcatctggagacccttggatgcaaatc

SEQ ID NO: 316942 - DNA, 33 bp, Artificial Sequence
  Description of Artificial Sequence: Synthetic oligonucleotide
tcttgtcatctggagacccttggatgcaaatcc

SEQ ID NO: 316943 - DNA, 32 bp, Artificial Sequence
  Description of Artificial Sequence: Synthetic oligonucleotide
cttgtcatctggagacccttggatgcaaatcc

SEQ ID NO: 316944 - DNA, 34 bp, Artificial Sequence
  Description of Artificial Sequence: Synthetic oligonucleotide
ttgtcatctggagacccttggatgcaaatccttg

SEQ ID NO: 316945 - DNA, 27 bp, Artificial Sequence
  Description of Artificial Sequence: Synthetic oligonucleotide
atgtggtcgtcgagaagccgcaacagc

SEQ ID NO: 316946 - DNA, 27 bp, Artificial Sequence
  Description of Artificial Sequence: Synthetic oligonucleotide
tgtggtcgtcgagaagccgcaacagca

SEQ ID NO: 316947 - DNA, 26 bp, Artificial Sequence
  Description of Artificial Sequence: Synthetic oligonucleotide
gtggtcgtcgagaagccgcaacagca

SEQ ID NO: 316948 - DNA, 26 bp, Artificial Sequence
  Description of Artificial Sequence: Synthetic oligonucleotide
tggtcgtcgagaagccgcaacagcac

SEQ ID NO: 316949 - DNA, 25 bp, Artificial Sequence
  Description of Artificial Sequence: Synthetic oligonucleotide
ggtcgtcgagaagccgcaacagcac

SEQ ID NO: 316950 - DNA, 25 bp, Artificial Sequence
  Description of Artificial Sequence: Synthetic oligonucleotide
gtcgtcgagaagccgcaacagcacc

SEQ ID NO: 316951 - DNA, 25 bp, Artificial Sequence
  Description of Artificial Sequence: Synthetic oligonucleotide
tcgtcgagaagccgcaacagcaccg

SEQ ID NO: 316952 - DNA, 24 bp, Artificial Sequence
  Description of Artificial Sequence: Synthetic oligonucleotide
cgtcgagaagccgcaacagcaccg

SEQ ID NO: 316953 - DNA, 24 bp, Artificial Sequence
  Description of Artificial Sequence: Synthetic oligonucleotide
gtcgagaagccgcaacagcaccgc

SEQ ID NO: 316954 - DNA, 25 bp, Artificial Sequence
  Description of Artificial Sequence: Synthetic oligonucleotide
tcgagaagccgcaacagcaccgcgt

SEQ ID NO: 316955 - DNA, 24 bp, Artificial Sequence
  Description of Artificial Sequence: Synthetic oligonucleotide
cgagaagccgcaacagcaccgcgt

SEQ ID NO: 316956 - DNA, 24 bp, Artificial Sequence
  Description of Artificial Sequence: Synthetic oligonucleotide
gagaagccgcaacagcaccgcgtg

SEQ ID NO: 316957 - DNA, 24 bp, Artificial Sequence
  Description of Artificial Sequence: Synthetic oligonucleotide
agaagccgcaacagcaccgcgtgg

SEQ ID NO: 316958 - DNA, 23 bp, Artificial Sequence
  Description of Artificial Sequence: Synthetic oligonucleotide
gaagccgcaacagcaccgcgtgg

SEQ ID NO: 316959 - DNA, 23 bp, Artificial Sequence
  Description of Artificial Sequence: Synthetic oligonucleotide
aagccgcaacagcaccgcgtggc

SEQ ID NO: 316960 - DNA, 22 bp, Artificial Sequence
  Description of Artificial Sequence: Synthetic oligonucleotide
agccgcaacagcaccgcgtggc

SEQ ID NO: 316961 - DNA, 21 bp, Artificial Sequence
  Description of Artificial Sequence: Synthetic oligonucleotide
gccgcaacagcaccgcgtggc

SEQ ID NO: 316962 - DNA, 22 bp, Artificial Sequence
  Description of Artificial Sequence: Synthetic oligonucleotide
ccgcaacagcaccgcgtggcct

SEQ ID NO: 316963 - DNA, 23 bp, Artificial Sequence
  Description of Artificial Sequence: Synthetic oligonucleotide
cgcaacagcaccgcgtggcctgt

SEQ ID NO: 316964 - DNA, 24 bp, Artificial Sequence
  Description of Artificial Sequence: Synthetic oligonucleotide
gcaacagcaccgcgtggcctgtca

SEQ ID NO: 316965 - DNA, 24 bp, Artificial Sequence
  Description of Artificial Sequence: Synthetic oligonucleotide
caacagcaccgcgtggcctgtcag

SEQ ID NO: 316966 - DNA, 24 bp, Artificial Sequence
  Description of Artificial Sequence: Synthetic oligonucleotide
aacagcaccgcgtggcctgtcagc

SEQ ID NO: 316967 - DNA, 23 bp, Artificial Sequence
  Description of Artificial Sequence: Synthetic oligonucleotide
acagcaccgcgtggcctgtcagc

SEQ ID NO: 316968 - DNA, 22 bp, Artificial Sequence
  Description of Artificial Sequence: Synthetic oligonucleotide
cagcaccgcgtggcctgtcagc

SEQ ID NO: 316969 - DNA, 23 bp, Artificial Sequence
  Description of Artificial Sequence: Synthetic oligonucleotide
agcaccgcgtggcctgtcagcct

SEQ ID NO: 316970 - DNA, 22 bp, Artificial Sequence
  Description of Artificial Sequence: Synthetic oligonucleotide
gcaccgcgtggcctgtcagcct

SEQ ID NO: 316971 - DNA, 22 bp, Artificial Sequence
  Description of Artificial Sequence: Synthetic oligonucleotide
caccgcgtggcctgtcagcctc

SEQ ID NO: 316972 - DNA, 23 bp, Artificial Sequence
  Description of Artificial Sequence: Synthetic oligonucleotide
accgcgtggcctgtcagcctcgt

SEQ ID NO: 316973 - DNA, 22 bp, Artificial Sequence
  Description of Artificial Sequence: Synthetic oligonucleotide
ccgcgtggcctgtcagcctcgt

SEQ ID NO: 316974 - DNA, 22 bp, Artificial Sequence
  Description of Artificial Sequence: Synthetic oligonucleotide
cgcgtggcctgtcagcctcgtg

SEQ ID NO: 316975 - DNA, 22 bp, Artificial Sequence
  Description of Artificial Sequence: Synthetic oligonucleotide
gcgtggcctgtcagcctcgtgc

SEQ ID NO: 316976 - DNA, 23 bp, Artificial Sequence
  Description of Artificial Sequence: Synthetic oligonucleotide
cgtggcctgtcagcctcgtgcct

SEQ ID NO: 316977 - DNA, 25 bp, Artificial Sequence
  Description of Artificial Sequence: Synthetic oligonucleotide
gtggcctgtcagcctcgtgcctgat

SEQ ID NO: 316978 - DNA, 25 bp, Artificial Sequence
  Description of Artificial Sequence: Synthetic oligonucleotide
tggcctgtcagcctcgtgcctgatc

SEQ ID NO: 316979 - DNA, 24 bp, Artificial Sequence
  Description of Artificial Sequence: Synthetic oligonucleotide
ggcctgtcagcctcgtgcctgatc

SEQ ID NO: 316980 - DNA, 24 bp, Artificial Sequence
  Description of Artificial Sequence: Synthetic oligonucleotide
gcctgtcagcctcgtgcctgatcc

SEQ ID NO: 316981 - DNA, 24 bp, Artificial Sequence
  Description of Artificial Sequence: Synthetic oligonucleotide
cctgtcagcctcgtgcctgatccc

SEQ ID NO: 316982 - DNA, 24 bp, Artificial Sequence
  Description of Artificial Sequence: Synthetic oligonucleotide
ctgtcagcctcgtgcctgatcccg

SEQ ID NO: 316983 - DNA, 24 bp, Artificial Sequence
  Description of Artificial Sequence: Synthetic oligonucleotide
tgtcagcctcgtgcctgatcccgg

SEQ ID NO: 316984 - DNA, 23 bp, Artificial Sequence
  Description of Artificial Sequence: Synthetic oligonucleotide
gtcagcctcgtgcctgatcccgg

SEQ ID NO: 316985 - DNA, 25 bp, Artificial Sequence
  Description of Artificial Sequence: Synthetic oligonucleotide
tcagcctcgtgcctgatcccgggat

SEQ ID NO: 316986 - DNA, 24 bp, Artificial Sequence
  Description of Artificial Sequence: Synthetic oligonucleotide
cagcctcgtgcctgatcccgggat

SEQ ID NO: 316987 - DNA, 24 bp, Artificial Sequence
  Description of Artificial Sequence: Synthetic oligonucleotide
agcctcgtgcctgatcccgggatg

SEQ ID NO: 316988 - DNA, 23 bp, Artificial Sequence
  Description of Artificial Sequence: Synthetic oligonucleotide
gcctcgtgcctgatcccgggatg

SEQ ID NO: 316989 - DNA, 23 bp, Artificial Sequence
  Description of Artificial Sequence: Synthetic oligonucleotide
cctcgtgcctgatcccgggatgg

SEQ ID NO: 316990 - DNA, 23 bp, Artificial Sequence
  Description of Artificial Sequence: Synthetic oligonucleotide
ctcgtgcctgatcccgggatggc

SEQ ID NO: 316991 - DNA, 24 bp, Artificial Sequence
  Description of Artificial Sequence: Synthetic oligonucleotide
tcgtgcctgatcccgggatggcca

SEQ ID NO: 316992 - DNA, 23 bp, Artificial Sequence
  Description of Artificial Sequence: Synthetic oligonucleotide
cgtgcctgatcccgggatggcca

SEQ ID NO: 316993 - DNA, 24 bp, Artificial Sequence
  Description of Artificial Sequence: Synthetic oligonucleotide
gtgcctgatcccgggatggccact

SEQ ID NO: 316994 - DNA, 24 bp, Artificial Sequence
  Description of Artificial Sequence: Synthetic oligonucleotide
tgcctgatcccgggatggccactg

SEQ ID NO: 316995 - DNA, 23 bp, Artificial Sequence
  Description of Artificial Sequence: Synthetic oligonucleotide
gcctgatcccgggatggccactg

SEQ ID NO: 316996 - DNA, 23 bp, Artificial Sequence
  Description of Artificial Sequence: Synthetic oligonucleotide
cctgatcccgggatggccactgc

SEQ ID NO: 316997 - DNA, 24 bp, Artificial Sequence
  Description of Artificial Sequence: Synthetic oligonucleotide
ctgatcccgggatggccactgcct

SEQ ID NO: 316998 - DNA, 24 bp, Artificial Sequence
  Description of Artificial Sequence: Synthetic oligonucleotide
tgatcccgggatggccactgcctc

SEQ ID NO: 316999 - DNA, 23 bp, Artificial Sequence
  Description of Artificial Sequence: Synthetic oligonucleotide
gatcccgggatggccactgcctc

SEQ ID NO: 317000 - DNA, 24 bp, Artificial Sequence
  Description of Artificial Sequence: Synthetic oligonucleotide
atcccgggatggccactgcctcca

SEQ ID NO: 317001 - DNA, 23 bp, Artificial Sequence
  Description of Artificial Sequence: Synthetic oligonucleotide
tcccgggatggccactgcctcca

SEQ ID NO: 317002 - DNA, 22 bp, Artificial Sequence
  Description of Artificial Sequence: Synthetic oligonucleotide
cccgggatggccactgcctcca

SEQ ID NO: 317003 - DNA, 22 bp, Artificial Sequence
  Description of Artificial Sequence: Synthetic oligonucleotide
ccgggatggccactgcctccag

SEQ ID NO: 317004 - DNA, 23 bp, Artificial Sequence
  Description of Artificial Sequence: Synthetic oligonucleotide
cgggatggccactgcctccagca

SEQ ID NO: 317005 - DNA, 26 bp, Artificial Sequence
  Description of Artificial Sequence: Synthetic oligonucleotide
gggatggccactgcctccagcacaat

SEQ ID NO: 317006 - DNA, 26 bp, Artificial Sequence
  Description of Artificial Sequence: Synthetic oligonucleotide
ggatggccactgcctccagcacaatg

SEQ ID NO: 317007 - DNA, 27 bp, Artificial Sequence
  Description of Artificial Sequence: Synthetic oligonucleotide
gatggccactgcctccagcacaatgca

SEQ ID NO: 317008 - DNA, 29 bp, Artificial Sequence
  Description of Artificial Sequence: Synthetic oligonucleotide
atggccactgcctccagcacaatgcaaac

SEQ ID NO: 317009 - DNA, 28 bp, Artificial Sequence
  Description of Artificial Sequence: Synthetic oligonucleotide
tggccactgcctccagcacaatgcaaac

SEQ ID NO: 317010 - DNA, 27 bp, Artificial Sequence
  Description of Artificial Sequence: Synthetic oligonucleotide
ggccactgcctccagcacaatgcaaac

SEQ ID NO: 317011 - DNA, 29 bp, Artificial Sequence
  Description of Artificial Sequence: Synthetic oligonucleotide
gccactgcctccagcacaatgcaaactac

SEQ ID NO: 317012 - DNA, 29 bp, Artificial Sequence
  Description of Artificial Sequence: Synthetic oligonucleotide
ccactgcctccagcacaatgcaaactacc

SEQ ID NO: 317013 - DNA, 30 bp, Artificial Sequence
  Description of Artificial Sequence: Synthetic oligonucleotide
cactgcctccagcacaatgcaaactaccac

SEQ ID NO: 317014 - DNA, 30 bp, Artificial Sequence
  Description of Artificial Sequence: Synthetic oligonucleotide
actgcctccagcacaatgcaaactaccacc

SEQ ID NO: 317015 - DNA, 29 bp, Artificial Sequence
  Description of Artificial Sequence: Synthetic oligonucleotide
ctgcctccagcacaatgcaaactaccacc

SEQ ID NO: 317016 - DNA, 32 bp, Artificial Sequence
  Description of Artificial Sequence: Synthetic oligonucleotide
tgcctccagcacaatgcaaactaccacctttg

SEQ ID NO: 317017 - DNA, 31 bp, Artificial Sequence
  Description of Artificial Sequence: Synthetic oligonucleotide
gcctccagcacaatgcaaactaccacctttg

SEQ ID NO: 317018 - DNA, 31 bp, Artificial Sequence
  Description of Artificial Sequence: Synthetic oligonucleotide
cctccagcacaatgcaaactaccacctttgc

SEQ ID NO: 317019 - DNA, 32 bp, Artificial Sequence
  Description of Artificial Sequence: Synthetic oligonucleotide
ctccagcacaatgcaaactaccacctttgcag

SEQ ID NO: 317020 - DNA, 33 bp, Artificial Sequence
  Description of Artificial Sequence: Synthetic oligonucleotide
tccagcacaatgcaaactaccacctttgcagag

SEQ ID NO: 317021 - DNA, 32 bp, Artificial Sequence
  Description of Artificial Sequence: Synthetic oligonucleotide
ccagcacaatgcaaactaccacctttgcagag

SEQ ID NO: 317022 - DNA, 32 bp, Artificial Sequence
  Description of Artificial Sequence: Synthetic oligonucleotide
cagcacaatgcaaactaccacctttgcagagc

SEQ ID NO: 317023 - DNA, 32 bp, Artificial Sequence
  Description of Artificial Sequence: Synthetic oligonucleotide
agcacaatgcaaactaccacctttgcagagcg

SEQ ID NO: 317024 - DNA, 31 bp, Artificial Sequence
  Description of Artificial Sequence: Synthetic oligonucleotide
gcacaatgcaaactaccacctttgcagagcg

SEQ ID NO: 317025 - DNA, 32 bp, Artificial Sequence
  Description of Artificial Sequence: Synthetic oligonucleotide
cacaatgcaaactaccacctttgcagagcgtg

SEQ ID NO: 317026 - DNA, 34 bp, Artificial Sequence
  Description of Artificial Sequence: Synthetic oligonucleotide
acaatgcaaactaccacctttgcagagcgtgatc

SEQ ID NO: 317027 - DNA, 33 bp, Artificial Sequence
  Description of Artificial Sequence: Synthetic oligonucleotide
caatgcaaactaccacctttgcagagcgtgatc

SEQ ID NO: 317028 - DNA, 33 bp, Artificial Sequence
  Description of Artificial Sequence: Synthetic oligonucleotide
aatgcaaactaccacctttgcagagcgtgatcc

SEQ ID NO: 317029 - DNA, 32 bp, Artificial Sequence
  Description of Artificial Sequence: Synthetic oligonucleotide
atgcaaactaccacctttgcagagcgtgatcc

SEQ ID NO: 317030 - DNA, 31 bp, Artificial Sequence
  Description of Artificial Sequence: Synthetic oligonucleotide
tgcaaactaccacctttgcagagcgtgatcc

SEQ ID NO: 317031 - DNA, 30 bp, Artificial Sequence
  Description of Artificial Sequence: Synthetic oligonucleotide
gcaaactaccacctttgcagagcgtgatcc

SEQ ID NO: 317032 - DNA, 31 bp, Artificial Sequence
  Description of Artificial Sequence: Synthetic oligonucleotide
caaactaccacctttgcagagcgtgatccag

SEQ ID NO: 317033 - DNA, 31 bp, Artificial Sequence
  Description of Artificial Sequence: Synthetic oligonucleotide
aaactaccacctttgcagagcgtgatccagg

SEQ ID NO: 317034 - DNA, 30 bp, Artificial Sequence
  Description of Artificial Sequence: Synthetic oligonucleotide
aactaccacctttgcagagcgtgatccagg

SEQ ID NO: 317035 - DNA, 29 bp, Artificial Sequence
  Description of Artificial Sequence: Synthetic oligonucleotide
actaccacctttgcagagcgtgatccagg

SEQ ID NO: 317036 - DNA, 28 bp, Artificial Sequence
  Description of Artificial Sequence: Synthetic oligonucleotide
ctaccacctttgcagagcgtgatccagg

SEQ ID NO: 317037 - DNA, 28 bp, Artificial Sequence
  Description of Artificial Sequence: Synthetic oligonucleotide
taccacctttgcagagcgtgatccaggc

SEQ ID NO: 317038 - DNA, 27 bp, Artificial Sequence
  Description of Artificial Sequence: Synthetic oligonucleotide
accacctttgcagagcgtgatccaggc

SEQ ID NO: 317039 - DNA, 27 bp, Artificial Sequence
  Description of Artificial Sequence: Synthetic oligonucleotide
ccacctttgcagagcgtgatccaggca

SEQ ID NO: 317040 - DNA, 28 bp, Artificial Sequence
  Description of Artificial Sequence: Synthetic oligonucleotide
cacctttgcagagcgtgatccaggcatg

SEQ ID NO: 317041 - DNA, 29 bp, Artificial Sequence
  Description of Artificial Sequence: Synthetic oligonucleotide
acctttgcagagcgtgatccaggcatgtc

SEQ ID NO: 317042 - DNA, 28 bp, Artificial Sequence
  Description of Artificial Sequence: Synthetic oligonucleotide
cctttgcagagcgtgatccaggcatgtc

SEQ ID NO: 317043 - DNA, 29 bp, Artificial Sequence
  Description of Artificial Sequence: Synthetic oligonucleotide
ctttgcagagcgtgatccaggcatgtctg

SEQ ID NO: 317044 - DNA, 29 bp, Artificial Sequence
  Description of Artificial Sequence: Synthetic oligonucleotide
tttgcagagcgtgatccaggcatgtctgg

SEQ ID NO: 317045 - DNA, 28 bp, Artificial Sequence
  Description of Artificial Sequence: Synthetic oligonucleotide
ttgcagagcgtgatccaggcatgtctgg

SEQ ID NO: 317046 - DNA, 27 bp, Artificial Sequence
  Description of Artificial Sequence: Synthetic oligonucleotide
tgcagagcgtgatccaggcatgtctgg

SEQ ID NO: 317047 - DNA, 27 bp, Artificial Sequence
  Description of Artificial Sequence: Synthetic oligonucleotide
gcagagcgtgatccaggcatgtctgga

SEQ ID NO: 317048 - DNA, 28 bp, Artificial Sequence
  Description of Artificial Sequence: Synthetic oligonucleotide
cagagcgtgatccaggcatgtctggaag

SEQ ID NO: 317049 - DNA, 28 bp, Artificial Sequence
  Description of Artificial Sequence: Synthetic oligonucleotide
agagcgtgatccaggcatgtctggaagg

SEQ ID NO: 317050 - DNA, 27 bp, Artificial Sequence
  Description of Artificial Sequence: Synthetic oligonucleotide
gagcgtgatccaggcatgtctggaagg

SEQ ID NO: 317051 - DNA, 27 bp, Artificial Sequence
  Description of Artificial Sequence: Synthetic oligonucleotide
agcgtgatccaggcatgtctggaaggc

SEQ ID NO: 317052 - DNA, 26 bp, Artificial Sequence
  Description of Artificial Sequence: Synthetic oligonucleotide
gcgtgatccaggcatgtctggaaggc

SEQ ID NO: 317053 - DNA, 26 bp, Artificial Sequence
  Description of Artificial Sequence: Synthetic oligonucleotide
cgtgatccaggcatgtctggaaggcc

SEQ ID NO: 317054 - DNA, 26 bp, Artificial Sequence
  Description of Artificial Sequence: Synthetic oligonucleotide
gtgatccaggcatgtctggaaggccg

SEQ ID NO: 317055 - DNA, 27 bp, Artificial Sequence
  Description of Artificial Sequence: Synthetic oligonucleotide
tgatccaggcatgtctggaaggccgga

SEQ ID NO: 317056 - DNA, 27 bp, Artificial Sequence
  Description of Artificial Sequence: Synthetic oligonucleotide
gatccaggcatgtctggaaggccggat

SEQ ID NO: 317057 - DNA, 27 bp, Artificial Sequence
  Description of Artificial Sequence: Synthetic oligonucleotide
atccaggcatgtctggaaggccggatg

SEQ ID NO: 317058 - DNA, 26 bp, Artificial Sequence
  Description of Artificial Sequence: Synthetic oligonucleotide
tccaggcatgtctggaaggccggatg

SEQ ID NO: 317059 - DNA, 25 bp, Artificial Sequence
  Description of Artificial Sequence: Synthetic oligonucleotide
ccaggcatgtctggaaggccggatg

SEQ ID NO: 317060 - DNA, 25 bp, Artificial Sequence
  Description of Artificial Sequence: Synthetic oligonucleotide
caggcatgtctggaaggccggatgc

SEQ ID NO: 317061 - DNA, 26 bp, Artificial Sequence
  Description of Artificial Sequence: Synthetic oligonucleotide
aggcatgtctggaaggccggatgcca

SEQ ID NO: 317062 - DNA, 25 bp, Artificial Sequence
  Description of Artificial Sequence: Synthetic oligonucleotide
ggcatgtctggaaggccggatgcca

SEQ ID NO: 317063 - DNA, 27 bp, Artificial Sequence
  Description of Artificial Sequence: Synthetic oligonucleotide
gcatgtctggaaggccggatgccagaa

SEQ ID NO: 317064 - DNA, 28 bp, Artificial Sequence
  Description of Artificial Sequence: Synthetic oligonucleotide
catgtctggaaggccggatgccagaatg

SEQ ID NO: 317065 - DNA, 28 bp, Artificial Sequence
  Description of Artificial Sequence: Synthetic oligonucleotide
atgtctggaaggccggatgccagaatgg

SEQ ID NO: 317066 - DNA, 27 bp, Artificial Sequence
  Description of Artificial Sequence: Synthetic oligonucleotide
tgtctggaaggccggatgccagaatgg

SEQ ID NO: 317067 - DNA, 27 bp, Artificial Sequence
  Description of Artificial Sequence: Synthetic oligonucleotide
gtctggaaggccggatgccagaatgga

SEQ ID NO: 317068 - DNA, 27 bp, Artificial Sequence
  Description of Artificial Sequence: Synthetic oligonucleotide
tctggaaggccggatgccagaatggac

SEQ ID NO: 317069 - DNA, 27 bp, Artificial Sequence
  Description of Artificial Sequence: Synthetic oligonucleotide
ctggaaggccggatgccagaatggaca

SEQ ID NO: 317070 - DNA, 27 bp, Artificial Sequence
  Description of Artificial Sequence: Synthetic oligonucleotide
tggaaggccggatgccagaatggacac

SEQ ID NO: 317071 - DNA, 26 bp, Artificial Sequence
  Description of Artificial Sequence: Synthetic oligonucleotide
ggaaggccggatgccagaatggacac

SEQ ID NO: 317072 - DNA, 27 bp, Artificial Sequence
  Description of Artificial Sequence: Synthetic oligonucleotide
gaaggccggatgccagaatggacacct

SEQ ID NO: 317073 - DNA, 27 bp, Artificial Sequence
  Description of Artificial Sequence: Synthetic oligonucleotide
aaggccggatgccagaatggacacctc

SEQ ID NO: 317074 - DNA, 26 bp, Artificial Sequence
  Description of Artificial Sequence: Synthetic oligonucleotide
aggccggatgccagaatggacacctc

SEQ ID NO: 317075 - DNA, 25 bp, Artificial Sequence
  Description of Artificial Sequence: Synthetic oligonucleotide
ggccggatgccagaatggacacctc

SEQ ID NO: 317076 - DNA, 26 bp, Artificial Sequence
  Description of Artificial Sequence: Synthetic oligonucleotide
gccggatgccagaatggacacctcca

SEQ ID NO: 317077 - DNA, 26 bp, Artificial Sequence
  Description of Artificial Sequence: Synthetic oligonucleotide
ccggatgccagaatggacacctccac

SEQ ID NO: 317078 - DNA, 26 bp, Artificial Sequence
  Description of Artificial Sequence: Synthetic oligonucleotide
cggatgccagaatggacacctccacc

SEQ ID NO: 317079 - DNA, 26 bp, Artificial Sequence
  Description of Artificial Sequence: Synthetic oligonucleotide
ggatgccagaatggacacctccaccg

SEQ ID NO: 317080 - DNA, 26 bp, Artificial Sequence
  Description of Artificial Sequence: Synthetic oligonucleotide
gatgccagaatggacacctccaccgc

SEQ ID NO: 317081 - DNA, 27 bp, Artificial Sequence
  Description of Artificial Sequence: Synthetic oligonucleotide
atgccagaatggacacctccaccgcca

SEQ ID NO: 317082 - DNA, 26 bp, Artificial Sequence
  Description of Artificial Sequence: Synthetic oligonucleotide
tgccagaatggacacctccaccgcca

SEQ ID NO: 317083 - DNA, 25 bp, Artificial Sequence
  Description of Artificial Sequence: Synthetic oligonucleotide
gccagaatggacacctccaccgcca

SEQ ID NO: 317084 - DNA, 25 bp, Artificial Sequence
  Description of Artificial Sequence: Synthetic oligonucleotide
ccagaatggacacctccaccgccac

SEQ ID NO: 317085 - DNA, 27 bp, Artificial Sequence
  Description of Artificial Sequence: Synthetic oligonucleotide
cagaatggacacctccaccgccaccat

SEQ ID NO: 317086 - DNA, 30 bp, Artificial Sequence
  Description of Artificial Sequence: Synthetic oligonucleotide
agaatggacacctccaccgccaccataaag

SEQ ID NO: 317087 - DNA, 29 bp, Artificial Sequence
  Description of Artificial Sequence: Synthetic oligonucleotide
gaatggacacctccaccgccaccataaag

SEQ ID NO: 317088 - DNA, 29 bp, Artificial Sequence
  Description of Artificial Sequence: Synthetic oligonucleotide
aatggacacctccaccgccaccataaagg

SEQ ID NO: 317089 - DNA, 28 bp, Artificial Sequence
  Description of Artificial Sequence: Synthetic oligonucleotide
atggacacctccaccgccaccataaagg

SEQ ID NO: 317090 - DNA, 27 bp, Artificial Sequence
  Description of Artificial Sequence: Synthetic oligonucleotide
tggacacctccaccgccaccataaagg

SEQ ID NO: 317091 - DNA, 27 bp, Artificial Sequence
  Description of Artificial Sequence: Synthetic oligonucleotide
ggacacctccaccgccaccataaagga

SEQ ID NO: 317092 - DNA, 27 bp, Artificial Sequence
  Description of Artificial Sequence: Synthetic oligonucleotide
gacacctccaccgccaccataaaggac

SEQ ID NO: 317093 - DNA, 30 bp, Artificial Sequence
  Description of Artificial Sequence: Synthetic oligonucleotide
acacctccaccgccaccataaaggacattg

SEQ ID NO: 317094 - DNA, 29 bp, Artificial Sequence
  Description of Artificial Sequence: Synthetic oligonucleotide
cacctccaccgccaccataaaggacattg

SEQ ID NO: 317095 - DNA, 30 bp, Artificial Sequence
  Description of Artificial Sequence: Synthetic oligonucleotide
acctccaccgccaccataaaggacattgtg

SEQ ID NO: 317096 - DNA, 29 bp, Artificial Sequence
  Description of Artificial Sequence: Synthetic oligonucleotide
cctccaccgccaccataaaggacattgtg

SEQ ID NO: 317097 - DNA, 29 bp, Artificial Sequence
  Description of Artificial Sequence: Synthetic oligonucleotide
ctccaccgccaccataaaggacattgtgg

SEQ ID NO: 317098 - DNA, 30 bp, Artificial Sequence
  Description of Artificial Sequence: Synthetic oligonucleotide
tccaccgccaccataaaggacattgtggtc

SEQ ID NO: 317099 - DNA, 29 bp, Artificial Sequence
  Description of Artificial Sequence: Synthetic oligonucleotide
ccaccgccaccataaaggacattgtggtc

SEQ ID NO: 317100 - DNA, 32 bp, Artificial Sequence
  Description of Artificial Sequence: Synthetic oligonucleotide
caccgccaccataaaggacattgtggtcattg

SEQ ID NO: 317101 - DNA, 32 bp, Artificial Sequence
  Description of Artificial Sequence: Synthetic oligonucleotide
accgccaccataaaggacattgtggtcattgc

SEQ ID NO: 317102 - DNA, 31 bp, Artificial Sequence
  Description of Artificial Sequence: Synthetic oligonucleotide
ccgccaccataaaggacattgtggtcattgc

SEQ ID NO: 317103 - DNA, 32 bp, Artificial Sequence
  Description of Artificial Sequence: Synthetic oligonucleotide
cgccaccataaaggacattgtggtcattgcac

SEQ ID NO: 317104 - DNA, 32 bp, Artificial Sequence
  Description of Artificial Sequence: Synthetic oligonucleotide
gccaccataaaggacattgtggtcattgcacg

SEQ ID NO: 317105 - DNA, 33 bp, Artificial Sequence
  Description of Artificial Sequence: Synthetic oligonucleotide
ccaccataaaggacattgtggtcattgcacgtg

SEQ ID NO: 317106 - DNA, 34 bp, Artificial Sequence
  Description of Artificial Sequence: Synthetic oligonucleotide
caccataaaggacattgtggtcattgcacgtgtg

SEQ ID NO: 317107 - DNA, 37 bp, Artificial Sequence
  Description of Artificial Sequence: Synthetic oligonucleotide
accataaaggacattgtggtcattgcacgtgtgattg

SEQ ID NO: 317108 - DNA, 36 bp, Artificial Sequence
  Description of Artificial Sequence: Synthetic oligonucleotide
ccataaaggacattgtggtcattgcacgtgtgattg

SEQ ID NO: 317109 - DNA, 36 bp, Artificial Sequence
  Description of Artificial Sequence: Synthetic oligonucleotide
cataaaggacattgtggtcattgcacgtgtgattgg

SEQ ID NO: 317110 - DNA, 37 bp, Artificial Sequence
  Description of Artificial Sequence: Synthetic oligonucleotide
ataaaggacattgtggtcattgcacgtgtgattggtg

SEQ ID NO: 317111 - DNA, 36 bp, Artificial Sequence
  Description of Artificial Sequence: Synthetic oligonucleotide
taaaggacattgtggtcattgcacgtgtgattggtg

SEQ ID NO: 317112 - DNA, 35 bp, Artificial Sequence
  Description of Artificial Sequence: Synthetic oligonucleotide
aaaggacattgtggtcattgcacgtgtgattggtg

SEQ ID NO: 317113 - DNA, 34 bp, Artificial Sequence
  Description of Artificial Sequence: Synthetic oligonucleotide
aaggacattgtggtcattgcacgtgtgattggtg

SEQ ID NO: 317114 - DNA, 33 bp, Artificial Sequence
  Description of Artificial Sequence: Synthetic oligonucleotide
aggacattgtggtcattgcacgtgtgattggtg

SEQ ID NO: 317115 - DNA, 32 bp, Artificial Sequence
  Description of Artificial Sequence: Synthetic oligonucleotide
ggacattgtggtcattgcacgtgtgattggtg

SEQ ID NO: 317116 - DNA, 32 bp, Artificial Sequence
  Description of Artificial Sequence: Synthetic oligonucleotide
gacattgtggtcattgcacgtgtgattggtgc

SEQ ID NO: 317117 - DNA, 33 bp, Artificial Sequence
  Description of Artificial Sequence: Synthetic oligonucleotide
acattgtggtcattgcacgtgtgattggtgctg

SEQ ID NO: 317118 - DNA, 32 bp, Artificial Sequence
  Description of Artificial Sequence: Synthetic oligonucleotide
cattgtggtcattgcacgtgtgattggtgctg

SEQ ID NO: 317119 - DNA, 33 bp, Artificial Sequence
  Description of Artificial Sequence: Synthetic oligonucleotide
attgtggtcattgcacgtgtgattggtgctgtg

SEQ ID NO: 317120 - DNA, 32 bp, Artificial Sequence
  Description of Artificial Sequence: Synthetic oligonucleotide
ttgtggtcattgcacgtgtgattggtgctgtg

SEQ ID NO: 317121 - DNA, 31 bp, Artificial Sequence
  Description of Artificial Sequence: Synthetic oligonucleotide
tgtggtcattgcacgtgtgattggtgctgtg

SEQ ID NO: 317122 - DNA, 30 bp, Artificial Sequence
  Description of Artificial Sequence: Synthetic oligonucleotide
gtggtcattgcacgtgtgattggtgctgtg

SEQ ID NO: 317123 - DNA, 30 bp, Artificial Sequence
  Description of Artificial Sequence: Synthetic oligonucleotide
tggtcattgcacgtgtgattggtgctgtgg

SEQ ID NO: 317124 - DNA, 29 bp, Artificial Sequence
  Description of Artificial Sequence: Synthetic oligonucleotide
ggtcattgcacgtgtgattggtgctgtgg

SEQ ID NO: 317125 - DNA, 29 bp, Artificial Sequence
  Description of Artificial Sequence: Synthetic oligonucleotide
gtcattgcacgtgtgattggtgctgtggc

SEQ ID NO: 317126 - DNA, 29 bp, Artificial Sequence
  Description of Artificial Sequence: Synthetic oligonucleotide
tcattgcacgtgtgattggtgctgtggcg

SEQ ID NO: 317127 - DNA, 28 bp, Artificial Sequence
  Description of Artificial Sequence: Synthetic oligonucleotide
cattgcacgtgtgattggtgctgtggcg

SEQ ID NO: 317128 - DNA, 30 bp, Artificial Sequence
  Description of Artificial Sequence: Synthetic oligonucleotide
attgcacgtgtgattggtgctgtggcgatc

SEQ ID NO: 317129 - DNA, 29 bp, Artificial Sequence
  Description of Artificial Sequence: Synthetic oligonucleotide
ttgcacgtgtgattggtgctgtggcgatc

SEQ ID NO: 317130 - DNA, 28 bp, Artificial Sequence
  Description of Artificial Sequence: Synthetic oligonucleotide
tgcacgtgtgattggtgctgtggcgatc

SEQ ID NO: 317131 - DNA, 27 bp, Artificial Sequence
  Description of Artificial Sequence: Synthetic oligonucleotide
gcacgtgtgattggtgctgtggcgatc

SEQ ID NO: 317132 - DNA, 27 bp, Artificial Sequence
  Description of Artificial Sequence: Synthetic oligonucleotide
cacgtgtgattggtgctgtggcgatcg

SEQ ID NO: 317133 - DNA, 28 bp, Artificial Sequence
  Description of Artificial Sequence: Synthetic oligonucleotide
acgtgtgattggtgctgtggcgatcgtc

SEQ ID NO: 317134 - DNA, 27 bp, Artificial Sequence
  Description of Artificial Sequence: Synthetic oligonucleotide
cgtgtgattggtgctgtggcgatcgtc

SEQ ID NO: 317135 - DNA, 27 bp, Artificial Sequence
  Description of Artificial Sequence: Synthetic oligonucleotide
gtgtgattggtgctgtggcgatcgtcc

SEQ ID NO: 317136 - DNA, 29 bp, Artificial Sequence
  Description of Artificial Sequence: Synthetic oligonucleotide
tgtgattggtgctgtggcgatcgtcctac

SEQ ID NO: 317137 - DNA, 28 bp, Artificial Sequence
  Description of Artificial Sequence: Synthetic oligonucleotide
gtgattggtgctgtggcgatcgtcctac

SEQ ID NO: 317138 - DNA, 29 bp, Artificial Sequence
  Description of Artificial Sequence: Synthetic oligonucleotide
tgattggtgctgtggcgatcgtcctactc

SEQ ID NO: 317139 - DNA, 28 bp, Artificial Sequence
  Description of Artificial Sequence: Synthetic oligonucleotide
gattggtgctgtggcgatcgtcctactc

SEQ ID NO: 317140 - DNA, 29 bp, Artificial Sequence
  Description of Artificial Sequence: Synthetic oligonucleotide
attggtgctgtggcgatcgtcctactctc

SEQ ID NO: 317141 - DNA, 28 bp, Artificial Sequence
  Description of Artificial Sequence: Synthetic oligonucleotide
ttggtgctgtggcgatcgtcctactctc

SEQ ID NO: 317142 - DNA, 27 bp, Artificial Sequence
  Description of Artificial Sequence: Synthetic oligonucleotide
tggtgctgtggcgatcgtcctactctc

SEQ ID NO: 317143 - DNA, 26 bp, Artificial Sequence
  Description of Artificial Sequence: Synthetic oligonucleotide
ggtgctgtggcgatcgtcctactctc

SEQ ID NO: 317144 - DNA, 26 bp, Artificial Sequence
  Description of Artificial Sequence: Synthetic oligonucleotide
gtgctgtggcgatcgtcctactctcc

SEQ ID NO: 317145 - DNA, 27 bp, Artificial Sequence
  Description of Artificial Sequence: Synthetic oligonucleotide
tgctgtggcgatcgtcctactctccct

SEQ ID NO: 317146 - DNA, 26 bp, Artificial Sequence
  Description of Artificial Sequence: Synthetic oligonucleotide
gctgtggcgatcgtcctactctccct

SEQ ID NO: 317147 - DNA, 26 bp, Artificial Sequence
  Description of Artificial Sequence: Synthetic oligonucleotide
ctgtggcgatcgtcctactctccctc

SEQ ID NO: 317148 - DNA, 27 bp, Artificial Sequence
  Description of Artificial Sequence: Synthetic oligonucleotide
tgtggcgatcgtcctactctccctcca

SEQ ID NO: 317149 - DNA, 26 bp, Artificial Sequence
  Description of Artificial Sequence: Synthetic oligonucleotide
gtggcgatcgtcctactctccctcca

SEQ ID NO: 317150 - DNA, 27 bp, Artificial Sequence
  Description of Artificial Sequence: Synthetic oligonucleotide
tggcgatcgtcctactctccctccact

SEQ ID NO: 317151 - DNA, 27 bp, Artificial Sequence
  Description of Artificial Sequence: Synthetic oligonucleotide
ggcgatcgtcctactctccctccactt

SEQ ID NO: 317152 - DNA, 27 bp, Artificial Sequence
  Description of Artificial Sequence: Synthetic oligonucleotide
gcgatcgtcctactctccctccacttc

SEQ ID NO: 317153 - DNA, 27 bp, Artificial Sequence
  Description of Artificial Sequence: Synthetic oligonucleotide
cgatcgtcctactctccctccacttcg

SEQ ID NO: 317154 - DNA, 28 bp, Artificial Sequence
  Description of Artificial Sequence: Synthetic oligonucleotide
gatcgtcctactctccctccacttcgtc

SEQ ID NO: 317155 - DNA, 30 bp, Artificial Sequence
  Description of Artificial Sequence: Synthetic oligonucleotide
atcgtcctactctccctccacttcgtcatc

SEQ ID NO: 317156 - DNA, 29 bp, Artificial Sequence
  Description of Artificial Sequence: Synthetic oligonucleotide
tcgtcctactctccctccacttcgtcatc

SEQ ID NO: 317157 - DNA, 28 bp, Artificial Sequence
  Description of Artificial Sequence: Synthetic oligonucleotide
cgtcctactctccctccacttcgtcatc

SEQ ID NO: 317158 - DNA, 28 bp, Artificial Sequence
  Description of Artificial Sequence: Synthetic oligonucleotide
gtcctactctccctccacttcgtcatcc

SEQ ID NO: 317159 - DNA, 29 bp, Artificial Sequence
  Description of Artificial Sequence: Synthetic oligonucleotide
tcctactctccctccacttcgtcatcctg

SEQ ID NO: 317160 - DNA, 28 bp, Artificial Sequence
  Description of Artificial Sequence: Synthetic oligonucleotide
cctactctccctccacttcgtcatcctg

SEQ ID NO: 317161 - DNA, 28 bp, Artificial Sequence
  Description of Artificial Sequence: Synthetic oligonucleotide
ctactctccctccacttcgtcatcctgc

SEQ ID NO: 317162 - DNA, 28 bp, Artificial Sequence
  Description of Artificial Sequence: Synthetic oligonucleotide
tactctccctccacttcgtcatcctgcg

SEQ ID NO: 317163 - DNA, 27 bp, Artificial Sequence
  Description of Artificial Sequence: Synthetic oligonucleotide
actctccctccacttcgtcatcctgcg

SEQ ID NO: 317164 - DNA, 26 bp, Artificial Sequence
  Description of Artificial Sequence: Synthetic oligonucleotide
ctctccctccacttcgtcatcctgcg

SEQ ID NO: 317165 - DNA, 27 bp, Artificial Sequence
  Description of Artificial Sequence: Synthetic oligonucleotide
tctccctccacttcgtcatcctgcgct

SEQ ID NO: 317166 - DNA, 27 bp, Artificial Sequence
  Description of Artificial Sequence: Synthetic oligonucleotide
ctccctccacttcgtcatcctgcgcta

SEQ ID NO: 317167 - DNA, 27 bp, Artificial Sequence
  Description of Artificial Sequence: Synthetic oligonucleotide
tccctccacttcgtcatcctgcgctac

SEQ ID NO: 317168 - DNA, 27 bp, Artificial Sequence
  Description of Artificial Sequence: Synthetic oligonucleotide
ccctccacttcgtcatcctgcgctact

SEQ ID NO: 317169 - DNA, 28 bp, Artificial Sequence
  Description of Artificial Sequence: Synthetic oligonucleotide
cctccacttcgtcatcctgcgctacttg

SEQ ID NO: 317170 - DNA, 30 bp, Artificial Sequence
  Description of Artificial Sequence: Synthetic oligonucleotide
ctccacttcgtcatcctgcgctacttgtac

SEQ ID NO: 317171 - DNA, 30 bp, Artificial Sequence
  Description of Artificial Sequence: Synthetic oligonucleotide
tccacttcgtcatcctgcgctacttgtacc

SEQ ID NO: 317172 - DNA, 29 bp, Artificial Sequence
  Description of Artificial Sequence: Synthetic oligonucleotide
ccacttcgtcatcctgcgctacttgtacc

SEQ ID NO: 317173 - DNA, 29 bp, Artificial Sequence
  Description of Artificial Sequence: Synthetic oligonucleotide
cacttcgtcatcctgcgctacttgtaccg

SEQ ID NO: 317174 - DNA, 29 bp, Artificial Sequence
  Description of Artificial Sequence: Synthetic oligonucleotide
acttcgtcatcctgcgctacttgtaccgg

SEQ ID NO: 317175 - DNA, 28 bp, Artificial Sequence
  Description of Artificial Sequence: Synthetic oligonucleotide
cttcgtcatcctgcgctacttgtaccgg

SEQ ID NO: 317176 - DNA, 28 bp, Artificial Sequence
  Description of Artificial Sequence: Synthetic oligonucleotide
ttcgtcatcctgcgctacttgtaccggc

SEQ ID NO: 317177 - DNA, 27 bp, Artificial Sequence
  Description of Artificial Sequence: Synthetic oligonucleotide
tcgtcatcctgcgctacttgtaccggc

SEQ ID NO: 317178 - DNA, 27 bp, Artificial Sequence
  Description of Artificial Sequence: Synthetic oligonucleotide
cgtcatcctgcgctacttgtaccggct

SEQ ID NO: 317179 - DNA, 27 bp, Artificial Sequence
  Description of Artificial Sequence: Synthetic oligonucleotide
gtcatcctgcgctacttgtaccggctc

SEQ ID NO: 317180 - DNA, 29 bp, Artificial Sequence
  Description of Artificial Sequence: Synthetic oligonucleotide
tcatcctgcgctacttgtaccggctcaag

SEQ ID NO: 317181 - DNA, 28 bp, Artificial Sequence
  Description of Artificial Sequence: Synthetic oligonucleotide
catcctgcgctacttgtaccggctcaag

SEQ ID NO: 317182 - DNA, 28 bp, Artificial Sequence
  Description of Artificial Sequence: Synthetic oligonucleotide
atcctgcgctacttgtaccggctcaagg

SEQ ID NO: 317183 - DNA, 27 bp, Artificial Sequence
  Description of Artificial Sequence: Synthetic oligonucleotide
tcctgcgctacttgtaccggctcaagg

SEQ ID NO: 317184 - DNA, 26 bp, Artificial Sequence
  Description of Artificial Sequence: Synthetic oligonucleotide
cctgcgctacttgtaccggctcaagg

SEQ ID NO: 317185 - DNA, 26 bp, Artificial Sequence
  Description of Artificial Sequence: Synthetic oligonucleotide
ctgcgctacttgtaccggctcaaggg

SEQ ID NO: 317186 - DNA, 27 bp, Artificial Sequence
  Description of Artificial Sequence: Synthetic oligonucleotide
tgcgctacttgtaccggctcaagggca

SEQ ID NO: 317187 - DNA, 26 bp, Artificial Sequence
  Description of Artificial Sequence: Synthetic oligonucleotide
gcgctacttgtaccggctcaagggca

SEQ ID NO: 317188 - DNA, 26 bp, Artificial Sequence
  Description of Artificial Sequence: Synthetic oligonucleotide
cgctacttgtaccggctcaagggcac

SEQ ID NO: 317189 - DNA, 27 bp, Artificial Sequence
  Description of Artificial Sequence: Synthetic oligonucleotide
gctacttgtaccggctcaagggcacct

SEQ ID NO: 317190 - DNA, 28 bp, Artificial Sequence
  Description of Artificial Sequence: Synthetic oligonucleotide
ctacttgtaccggctcaagggcacctac

SEQ ID NO: 317191 - DNA, 28 bp, Artificial Sequence
  Description of Artificial Sequence: Synthetic oligonucleotide
tacttgtaccggctcaagggcacctacc

SEQ ID NO: 317192 - DNA, 27 bp, Artificial Sequence
  Description of Artificial Sequence: Synthetic oligonucleotide
acttgtaccggctcaagggcacctacc

SEQ ID NO: 317193 - DNA, 27 bp, Artificial Sequence
  Description of Artificial Sequence: Synthetic oligonucleotide
cttgtaccggctcaagggcacctacca

SEQ ID NO: 317194 - DNA, 27 bp, Artificial Sequence
  Description of Artificial Sequence: Synthetic oligonucleotide
ttgtaccggctcaagggcacctaccac

SEQ ID NO: 317195 - DNA, 27 bp, Artificial Sequence
  Description of Artificial Sequence: Synthetic oligonucleotide
tgtaccggctcaagggcacctaccaca

SEQ ID NO: 317196 - DNA, 26 bp, Artificial Sequence
  Description of Artificial Sequence: Synthetic oligonucleotide
gtaccggctcaagggcacctaccaca

SEQ ID NO: 317197 - DNA, 26 bp, Artificial Sequence
  Description of Artificial Sequence: Synthetic oligonucleotide
taccggctcaagggcacctaccacac

SEQ ID NO: 317198 - DNA, 25 bp, Artificial Sequence
  Description of Artificial Sequence: Synthetic oligonucleotide
accggctcaagggcacctaccacac

SEQ ID NO: 317199 - DNA, 24 bp, Artificial Sequence
  Description of Artificial Sequence: Synthetic oligonucleotide
ccggctcaagggcacctaccacac

SEQ ID NO: 317200 - DNA, 27 bp, Artificial Sequence
  Description of Artificial Sequence: Synthetic oligonucleotide
cggctcaagggcacctaccacacctat

SEQ ID NO: 317201 - DNA, 27 bp, Artificial Sequence
  Description of Artificial Sequence: Synthetic oligonucleotide
ggctcaagggcacctaccacacctatg

SEQ ID NO: 317202 - DNA, 28 bp, Artificial Sequence
  Description of Artificial Sequence: Synthetic oligonucleotide
gctcaagggcacctaccacacctatgag

SEQ ID NO: 317203 - DNA, 28 bp, Artificial Sequence
  Description of Artificial Sequence: Synthetic oligonucleotide
ctcaagggcacctaccacacctatgagg

SEQ ID NO: 317204 - DNA, 28 bp, Artificial Sequence
  Description of Artificial Sequence: Synthetic oligonucleotide
tcaagggcacctaccacacctatgaggc

SEQ ID NO: 317205 - DNA, 27 bp, Artificial Sequence
  Description of Artificial Sequence: Synthetic oligonucleotide
caagggcacctaccacacctatgaggc

SEQ ID NO: 317206 - DNA, 27 bp, Artificial Sequence
  Description of Artificial Sequence: Synthetic oligonucleotide
aagggcacctaccacacctatgaggcc

SEQ ID NO: 317207 - DNA, 27 bp, Artificial Sequence
  Description of Artificial Sequence: Synthetic oligonucleotide
agggcacctaccacacctatgaggcca

SEQ ID NO: 317208 - DNA, 27 bp, Artificial Sequence
  Description of Artificial Sequence: Synthetic oligonucleotide
gggcacctaccacacctatgaggccat

SEQ ID NO: 317209 - DNA, 27 bp, Artificial Sequence
  Description of Artificial Sequence: Synthetic oligonucleotide
ggcacctaccacacctatgaggccatg

SEQ ID NO: 317210 - DNA, 27 bp, Artificial Sequence
  Description of Artificial Sequence: Synthetic oligonucleotide
gcacctaccacacctatgaggccatgg

SEQ ID NO: 317211 - DNA, 27 bp, Artificial Sequence
  Description of Artificial Sequence: Synthetic oligonucleotide
cacctaccacacctatgaggccatggg

SEQ ID NO: 317212 - DNA, 27 bp, Artificial Sequence
  Description of Artificial Sequence: Synthetic oligonucleotide
acctaccacacctatgaggccatgggc

SEQ ID NO: 317213 - DNA, 27 bp, Artificial Sequence
  Description of Artificial Sequence: Synthetic oligonucleotide
cctaccacacctatgaggccatgggca

SEQ ID NO: 317214 - DNA, 27 bp, Artificial Sequence
  Description of Artificial Sequence: Synthetic oligonucleotide
ctaccacacctatgaggccatgggcac

SEQ ID NO: 317215 - DNA, 27 bp, Artificial Sequence
  Description of Artificial Sequence: Synthetic oligonucleotide
taccacacctatgaggccatgggcacg

SEQ ID NO: 317216 - DNA, 26 bp, Artificial Sequence
  Description of Artificial Sequence: Synthetic oligonucleotide
accacacctatgaggccatgggcacg

SEQ ID NO: 317217 - DNA, 25 bp, Artificial Sequence
  Description of Artificial Sequence: Synthetic oligonucleotide
ccacacctatgaggccatgggcacg

SEQ ID NO: 317218 - DNA, 26 bp, Artificial Sequence
  Description of Artificial Sequence: Synthetic oligonucleotide
cacacctatgaggccatgggcacgga

SEQ ID NO: 317219 - DNA, 27 bp, Artificial Sequence
  Description of Artificial Sequence: Synthetic oligonucleotide
acacctatgaggccatgggcacggact

SEQ ID NO: 317220 - DNA, 27 bp, Artificial Sequence
  Description of Artificial Sequence: Synthetic oligonucleotide
cacctatgaggccatgggcacggactt

SEQ ID NO: 317221 - DNA, 28 bp, Artificial Sequence
  Description of Artificial Sequence: Synthetic oligonucleotide
acctatgaggccatgggcacggactttg

SEQ ID NO: 317222 - DNA, 27 bp, Artificial Sequence
  Description of Artificial Sequence: Synthetic oligonucleotide
cctatgaggccatgggcacggactttg

SEQ ID NO: 317223 - DNA, 27 bp, Artificial Sequence
  Description of Artificial Sequence: Synthetic oligonucleotide
ctatgaggccatgggcacggactttgc

SEQ ID NO: 317224 - DNA, 28 bp, Artificial Sequence
  Description of Artificial Sequence: Synthetic oligonucleotide
tatgaggccatgggcacggactttgctg

SEQ ID NO: 317225 - DNA, 27 bp, Artificial Sequence
  Description of Artificial Sequence: Synthetic oligonucleotide
atgaggccatgggcacggactttgctg

SEQ ID NO: 317226 - DNA, 27 bp, Artificial Sequence
  Description of Artificial Sequence: Synthetic oligonucleotide
tgaggccatgggcacggactttgctga

SEQ ID NO: 317227 - DNA, 26 bp, Artificial Sequence
  Description of Artificial Sequence: Synthetic oligonucleotide
gaggccatgggcacggactttgctga

SEQ ID NO: 317228 - DNA, 27 bp, Artificial Sequence
  Description of Artificial Sequence: Synthetic oligonucleotide
aggccatgggcacggactttgctgagt

SEQ ID NO: 317229 - DNA, 26 bp, Artificial Sequence
  Description of Artificial Sequence: Synthetic oligonucleotide
ggccatgggcacggactttgctgagt

SEQ ID NO: 317230 - DNA, 27 bp, Artificial Sequence
  Description of Artificial Sequence: Synthetic oligonucleotide
gccatgggcacggactttgctgagtgt

SEQ ID NO: 317231 - DNA, 27 bp, Artificial Sequence
  Description of Artificial Sequence: Synthetic oligonucleotide
ccatgggcacggactttgctgagtgtg

SEQ ID NO: 317232 - DNA, 27 bp, Artificial Sequence
  Description of Artificial Sequence: Synthetic oligonucleotide
catgggcacggactttgctgagtgtgc

SEQ ID NO: 317233 - DNA, 28 bp, Artificial Sequence
  Description of Artificial Sequence: Synthetic oligonucleotide
atgggcacggactttgctgagtgtgcag

SEQ ID NO: 317234 - DNA, 27 bp, Artificial Sequence
  Description of Artificial Sequence: Synthetic oligonucleotide
tgggcacggactttgctgagtgtgcag

SEQ ID NO: 317235 - DNA, 27 bp, Artificial Sequence
  Description of Artificial Sequence: Synthetic oligonucleotide
gggcacggactttgctgagtgtgcaga

SEQ ID NO: 317236 - DNA, 28 bp, Artificial Sequence
  Description of Artificial Sequence: Synthetic oligonucleotide
ggcacggactttgctgagtgtgcagatg

SEQ ID NO: 317237 - DNA, 28 bp, Artificial Sequence
  Description of Artificial Sequence: Synthetic oligonucleotide
gcacggactttgctgagtgtgcagatgg

SEQ ID NO: 317238 - DNA, 29 bp, Artificial Sequence
  Description of Artificial Sequence: Synthetic oligonucleotide
cacggactttgctgagtgtgcagatggag

SEQ ID NO: 317239 - DNA, 29 bp, Artificial Sequence
  Description of Artificial Sequence: Synthetic oligonucleotide
acggactttgctgagtgtgcagatggagc

SEQ ID NO: 317240 - DNA, 28 bp, Artificial Sequence
  Description of Artificial Sequence: Synthetic oligonucleotide
cggactttgctgagtgtgcagatggagc

SEQ ID NO: 317241 - DNA, 28 bp, Artificial Sequence
  Description of Artificial Sequence: Synthetic oligonucleotide
ggactttgctgagtgtgcagatggagcc

SEQ ID NO: 317242 - DNA, 28 bp, Artificial Sequence
  Description of Artificial Sequence: Synthetic oligonucleotide
gactttgctgagtgtgcagatggagccc

SEQ ID NO: 317243 - DNA, 29 bp, Artificial Sequence
  Description of Artificial Sequence: Synthetic oligonucleotide
actttgctgagtgtgcagatggagccctg

SEQ ID NO: 317244 - DNA, 28 bp, Artificial Sequence
  Description of Artificial Sequence: Synthetic oligonucleotide
ctttgctgagtgtgcagatggagccctg

SEQ ID NO: 317245 - DNA, 28 bp, Artificial Sequence
  Description of Artificial Sequence: Synthetic oligonucleotide
tttgctgagtgtgcagatggagccctgc

SEQ ID NO: 317246 - DNA, 27 bp, Artificial Sequence
  Description of Artificial Sequence: Synthetic oligonucleotide
ttgctgagtgtgcagatggagccctgc

SEQ ID NO: 317247 - DNA, 27 bp, Artificial Sequence
  Description of Artificial Sequence: Synthetic oligonucleotide
tgctgagtgtgcagatggagccctgca

SEQ ID NO: 317248 - DNA, 26 bp, Artificial Sequence
  Description of Artificial Sequence: Synthetic oligonucleotide
gctgagtgtgcagatggagccctgca

SEQ ID NO: 317249 - DNA, 26 bp, Artificial Sequence
  Description of Artificial Sequence: Synthetic oligonucleotide
ctgagtgtgcagatggagccctgcac

SEQ ID NO: 317250 - DNA, 26 bp, Artificial Sequence
  Description of Artificial Sequence: Synthetic oligonucleotide
tgagtgtgcagatggagccctgcacg

SEQ ID NO: 317251 - DNA, 25 bp, Artificial Sequence
  Description of Artificial Sequence: Synthetic oligonucleotide
gagtgtgcagatggagccctgcacg

SEQ ID NO: 317252 - DNA, 26 bp, Artificial Sequence
  Description of Artificial Sequence: Synthetic oligonucleotide
agtgtgcagatggagccctgcacgga

SEQ ID NO: 317253 - DNA, 25 bp, Artificial Sequence
  Description of Artificial Sequence: Synthetic oligonucleotide
gtgtgcagatggagccctgcacgga

SEQ ID NO: 317254 - DNA, 26 bp, Artificial Sequence
  Description of Artificial Sequence: Synthetic oligonucleotide
tgtgcagatggagccctgcacggaga

SEQ ID NO: 317255 - DNA, 25 bp, Artificial Sequence
  Description of Artificial Sequence: Synthetic oligonucleotide
gtgcagatggagccctgcacggaga

SEQ ID NO: 317256 - DNA, 25 bp, Artificial Sequence
  Description of Artificial Sequence: Synthetic oligonucleotide
tgcagatggagccctgcacggagac

SEQ ID NO: 317257 - DNA, 24 bp, Artificial Sequence
  Description of Artificial Sequence: Synthetic oligonucleotide
gcagatggagccctgcacggagac

SEQ ID NO: 317258 - DNA, 24 bp, Artificial Sequence
  Description of Artificial Sequence: Synthetic oligonucleotide
cagatggagccctgcacggagacc

SEQ ID NO: 317259 - DNA, 25 bp, Artificial Sequence
  Description of Artificial Sequence: Synthetic oligonucleotide
agatggagccctgcacggagaccct

SEQ ID NO: 317260 - DNA, 24 bp, Artificial Sequence
  Description of Artificial Sequence: Synthetic oligonucleotide
gatggagccctgcacggagaccct

SEQ ID NO: 317261 - DNA, 24 bp, Artificial Sequence
  Description of Artificial Sequence: Synthetic oligonucleotide
atggagccctgcacggagaccctc

SEQ ID NO: 317262 - DNA, 23 bp, Artificial Sequence
  Description of Artificial Sequence: Synthetic oligonucleotide
tggagccctgcacggagaccctc

SEQ ID NO: 317263 - DNA, 22 bp, Artificial Sequence
  Description of Artificial Sequence: Synthetic oligonucleotide
ggagccctgcacggagaccctc

SEQ ID NO: 317264 - DNA, 22 bp, Artificial Sequence
  Description of Artificial Sequence: Synthetic oligonucleotide
gagccctgcacggagaccctcc

SEQ ID NO: 317265 - DNA, 22 bp, Artificial Sequence
  Description of Artificial Sequence: Synthetic oligonucleotide
agccctgcacggagaccctccc

SEQ ID NO: 317266 - DNA, 21 bp, Artificial Sequence
  Description of Artificial Sequence: Synthetic oligonucleotide
gccctgcacggagaccctccc

SEQ ID NO: 317267 - DNA, 22 bp, Artificial Sequence
  Description of Artificial Sequence: Synthetic oligonucleotide
ccctgcacggagaccctcccct

SEQ ID NO: 317268 - DNA, 22 bp, Artificial Sequence
  Description of Artificial Sequence: Synthetic oligonucleotide
cctgcacggagaccctcccctc

SEQ ID NO: 317269 - DNA, 24 bp, Artificial Sequence
  Description of Artificial Sequence: Synthetic oligonucleotide
ctgcacggagaccctcccctccaa

SEQ ID NO: 317270 - DNA, 26 bp, Artificial Sequence
  Description of Artificial Sequence: Synthetic oligonucleotide
tgcacggagaccctcccctccaagtt

SEQ ID NO: 317271 - DNA, 25 bp, Artificial Sequence
  Description of Artificial Sequence: Synthetic oligonucleotide
gcacggagaccctcccctccaagtt

SEQ ID NO: 317272 - DNA, 25 bp, Artificial Sequence
  Description of Artificial Sequence: Synthetic oligonucleotide
cacggagaccctcccctccaagttg

SEQ ID NO: 317273 - DNA, 26 bp, Artificial Sequence
  Description of Artificial Sequence: Synthetic oligonucleotide
acggagaccctcccctccaagttgct

SEQ ID NO: 317274 - DNA, 25 bp, Artificial Sequence
  Description of Artificial Sequence: Synthetic oligonucleotide
cggagaccctcccctccaagttgct

SEQ ID NO: 317275 - DNA, 25 bp, Artificial Sequence
  Description of Artificial Sequence: Synthetic oligonucleotide
ggagaccctcccctccaagttgctg

SEQ ID NO: 317276 - DNA, 26 bp, Artificial Sequence
  Description of Artificial Sequence: Synthetic oligonucleotide
gagaccctcccctccaagttgctggt

SEQ ID NO: 317277 - DNA, 27 bp, Artificial Sequence
  Description of Artificial Sequence: Synthetic oligonucleotide
agaccctcccctccaagttgctggtga

SEQ ID NO: 317278 - DNA, 27 bp, Artificial Sequence
  Description of Artificial Sequence: Synthetic oligonucleotide
gaccctcccctccaagttgctggtgaa

SEQ ID NO: 317279 - DNA, 28 bp, Artificial Sequence
  Description of Artificial Sequence: Synthetic oligonucleotide
accctcccctccaagttgctggtgaaag

SEQ ID NO: 317280 - DNA, 27 bp, Artificial Sequence
  Description of Artificial Sequence: Synthetic oligonucleotide
ccctcccctccaagttgctggtgaaag

SEQ ID NO: 317281 - DNA, 27 bp, Artificial Sequence
  Description of Artificial Sequence: Synthetic oligonucleotide
cctcccctccaagttgctggtgaaagc

SEQ ID NO: 317282 - DNA, 28 bp, Artificial Sequence
  Description of Artificial Sequence: Synthetic oligonucleotide
ctcccctccaagttgctggtgaaagcag

SEQ ID NO: 317283 - DNA, 28 bp, Artificial Sequence
  Description of Artificial Sequence: Synthetic oligonucleotide
tcccctccaagttgctggtgaaagcagc

SEQ ID NO: 317284 - DNA, 27 bp, Artificial Sequence
  Description of Artificial Sequence: Synthetic oligonucleotide
cccctccaagttgctggtgaaagcagc

SEQ ID NO: 317285 - DNA, 28 bp, Artificial Sequence
  Description of Artificial Sequence: Synthetic oligonucleotide
ccctccaagttgctggtgaaagcagcag

SEQ ID NO: 317286 - DNA, 31 bp, Artificial Sequence
  Description of Artificial Sequence: Synthetic oligonucleotide
cctccaagttgctggtgaaagcagcagatag

SEQ ID NO: 317287 - DNA, 31 bp, Artificial Sequence
  Description of Artificial Sequence: Synthetic oligonucleotide
ctccaagttgctggtgaaagcagcagatagg

SEQ ID NO: 317288 - DNA, 32 bp, Artificial Sequence
  Description of Artificial Sequence: Synthetic oligonucleotide
tccaagttgctggtgaaagcagcagataggag

SEQ ID NO: 317289 - DNA, 31 bp, Artificial Sequence
  Description of Artificial Sequence: Synthetic oligonucleotide
ccaagttgctggtgaaagcagcagataggag

SEQ ID NO: 317290 - DNA, 33 bp, Artificial Sequence
  Description of Artificial Sequence: Synthetic oligonucleotide
caagttgctggtgaaagcagcagataggagtac

SEQ ID NO: 317291 - DNA, 40 bp, Artificial Sequence
  Description of Artificial Sequence: Synthetic oligonucleotide
aagttgctggtgaaagcagcagataggagtactatatttg

SEQ ID NO: 317292 - DNA, 39 bp, Artificial Sequence
  Description of Artificial Sequence: Synthetic oligonucleotide
agttgctggtgaaagcagcagataggagtactatatttg

SEQ ID NO: 317293 - DNA, 38 bp, Artificial Sequence
  Description of Artificial Sequence: Synthetic oligonucleotide
gttgctggtgaaagcagcagataggagtactatatttg

SEQ ID NO: 317294 - DNA, 27 bp, Artificial Sequence
  Description of Artificial Sequence: Synthetic oligonucleotide
atgggtcgagagaaggagcaggtgtcc

SEQ ID NO: 317295 - DNA, 26 bp, Artificial Sequence
  Description of Artificial Sequence: Synthetic oligonucleotide
tgggtcgagagaaggagcaggtgtcc

SEQ ID NO: 317296 - DNA, 25 bp, Artificial Sequence
  Description of Artificial Sequence: Synthetic oligonucleotide
gggtcgagagaaggagcaggtgtcc

SEQ ID NO: 317297 - DNA, 25 bp, Artificial Sequence
  Description of Artificial Sequence: Synthetic oligonucleotide
ggtcgagagaaggagcaggtgtccc

SEQ ID NO: 317298 - DNA, 25 bp, Artificial Sequence
  Description of Artificial Sequence: Synthetic oligonucleotide
gtcgagagaaggagcaggtgtcccg

SEQ ID NO: 317299 - DNA, 26 bp, Artificial Sequence
  Description of Artificial Sequence: Synthetic oligonucleotide
tcgagagaaggagcaggtgtcccggt

SEQ ID NO: 317300 - DNA, 25 bp, Artificial Sequence
  Description of Artificial Sequence: Synthetic oligonucleotide
cgagagaaggagcaggtgtcccggt

SEQ ID NO: 317301 - DNA, 25 bp, Artificial Sequence
  Description of Artificial Sequence: Synthetic oligonucleotide
gagagaaggagcaggtgtcccggtg

SEQ ID NO: 317302 - DNA, 25 bp, Artificial Sequence
  Description of Artificial Sequence: Synthetic oligonucleotide
agagaaggagcaggtgtcccggtgc

SEQ ID NO: 317303 - DNA, 24 bp, Artificial Sequence
  Description of Artificial Sequence: Synthetic oligonucleotide
gagaaggagcaggtgtcccggtgc

SEQ ID NO: 317304 - DNA, 24 bp, Artificial Sequence
  Description of Artificial Sequence: Synthetic oligonucleotide
agaaggagcaggtgtcccggtgcg

SEQ ID NO: 317305 - DNA, 23 bp, Artificial Sequence
  Description of Artificial Sequence: Synthetic oligonucleotide
gaaggagcaggtgtcccggtgcg

SEQ ID NO: 317306 - DNA, 23 bp, Artificial Sequence
  Description of Artificial Sequence: Synthetic oligonucleotide
aaggagcaggtgtcccggtgcgg

SEQ ID NO: 317307 - DNA, 22 bp, Artificial Sequence
  Description of Artificial Sequence: Synthetic oligonucleotide
aggagcaggtgtcccggtgcgg

SEQ ID NO: 317308 - DNA, 21 bp, Artificial Sequence
  Description of Artificial Sequence: Synthetic oligonucleotide
ggagcaggtgtcccggtgcgg

SEQ ID NO: 317309 - DNA, 21 bp, Artificial Sequence
  Description of Artificial Sequence: Synthetic oligonucleotide
gagcaggtgtcccggtgcggg

SEQ ID NO: 317310 - DNA, 22 bp, Artificial Sequence
  Description of Artificial Sequence: Synthetic oligonucleotide
agcaggtgtcccggtgcgggga

SEQ ID NO: 317311 - DNA, 21 bp, Artificial Sequence
  Description of Artificial Sequence: Synthetic oligonucleotide
gcaggtgtcccggtgcgggga

SEQ ID NO: 317312 - DNA, 23 bp, Artificial Sequence
  Description of Artificial Sequence: Synthetic oligonucleotide
caggtgtcccggtgcggggagtt

SEQ ID NO: 317313 - DNA, 23 bp, Artificial Sequence
  Description of Artificial Sequence: Synthetic oligonucleotide
aggtgtcccggtgcggggagttg

SEQ ID NO: 317314 - DNA, 22 bp, Artificial Sequence
  Description of Artificial Sequence: Synthetic oligonucleotide
ggtgtcccggtgcggggagttg

SEQ ID NO: 317315 - DNA, 23 bp, Artificial Sequence
  Description of Artificial Sequence: Synthetic oligonucleotide
gtgtcccggtgcggggagttgct

SEQ ID NO: 317316 - DNA, 23 bp, Artificial Sequence
  Description of Artificial Sequence: Synthetic oligonucleotide
tgtcccggtgcggggagttgctc

SEQ ID NO: 317317 - DNA, 22 bp, Artificial Sequence
  Description of Artificial Sequence: Synthetic oligonucleotide
gtcccggtgcggggagttgctc

SEQ ID NO: 317318 - DNA, 23 bp, Artificial Sequence
  Description of Artificial Sequence: Synthetic oligonucleotide
tcccggtgcggggagttgctcca

SEQ ID NO: 317319 - DNA, 22 bp, Artificial Sequence
  Description of Artificial Sequence: Synthetic oligonucleotide
cccggtgcggggagttgctcca

SEQ ID NO: 317320 - DNA, 24 bp, Artificial Sequence
  Description of Artificial Sequence: Synthetic oligonucleotide
ccggtgcggggagttgctccacaa

SEQ ID NO: 317321 - DNA, 24 bp, Artificial Sequence
  Description of Artificial Sequence: Synthetic oligonucleotide
cggtgcggggagttgctccacaac

SEQ ID NO: 317322 - DNA, 24 bp, Artificial Sequence
  Description of Artificial Sequence: Synthetic oligonucleotide
ggtgcggggagttgctccacaacc

SEQ ID NO: 317323 - DNA, 24 bp, Artificial Sequence
  Description of Artificial Sequence: Synthetic oligonucleotide
gtgcggggagttgctccacaaccg

SEQ ID NO: 317324 - DNA, 26 bp, Artificial Sequence
  Description of Artificial Sequence: Synthetic oligonucleotide
tgcggggagttgctccacaaccgcta

SEQ ID NO: 317325 - DNA, 25 bp, Artificial Sequence
  Description of Artificial Sequence: Synthetic oligonucleotide
gcggggagttgctccacaaccgcta

SEQ ID NO: 317326 - DNA, 25 bp, Artificial Sequence
  Description of Artificial Sequence: Synthetic oligonucleotide
cggggagttgctccacaaccgctac

SEQ ID NO: 317327 - DNA, 25 bp, Artificial Sequence
  Description of Artificial Sequence: Synthetic oligonucleotide
ggggagttgctccacaaccgctacc

SEQ ID NO: 317328 - DNA, 25 bp, Artificial Sequence
  Description of Artificial Sequence: Synthetic oligonucleotide
gggagttgctccacaaccgctaccg

SEQ ID NO: 317329 - DNA, 25 bp, Artificial Sequence
  Description of Artificial Sequence: Synthetic oligonucleotide
ggagttgctccacaaccgctaccgc

SEQ ID NO: 317330 - DNA, 26 bp, Artificial Sequence
  Description of Artificial Sequence: Synthetic oligonucleotide
gagttgctccacaaccgctaccgcct

SEQ ID NO: 317331 - DNA, 26 bp, Artificial Sequence
  Description of Artificial Sequence: Synthetic oligonucleotide
agttgctccacaaccgctaccgcctg

SEQ ID NO: 317332 - DNA, 25 bp, Artificial Sequence
  Description of Artificial Sequence: Synthetic oligonucleotide
gttgctccacaaccgctaccgcctg

SEQ ID NO: 317333 - DNA, 26 bp, Artificial Sequence
  Description of Artificial Sequence: Synthetic oligonucleotide
ttgctccacaaccgctaccgcctgct

SEQ ID NO: 317334 - DNA, 25 bp, Artificial Sequence
  Description of Artificial Sequence: Synthetic oligonucleotide
tgctccacaaccgctaccgcctgct

SEQ ID NO: 317335 - DNA, 24 bp, Artificial Sequence
  Description of Artificial Sequence: Synthetic oligonucleotide
gctccacaaccgctaccgcctgct

SEQ ID NO: 317336 - DNA, 24 bp, Artificial Sequence
  Description of Artificial Sequence: Synthetic oligonucleotide
ctccacaaccgctaccgcctgctc

SEQ ID NO: 317337 - DNA, 24 bp, Artificial Sequence
  Description of Artificial Sequence: Synthetic oligonucleotide
tccacaaccgctaccgcctgctcc

SEQ ID NO: 317338 - DNA, 23 bp, Artificial Sequence
  Description of Artificial Sequence: Synthetic oligonucleotide
ccacaaccgctaccgcctgctcc

SEQ ID NO: 317339 - DNA, 24 bp, Artificial Sequence
  Description of Artificial Sequence: Synthetic oligonucleotide
cacaaccgctaccgcctgctccga

SEQ ID NO: 317340 - DNA, 25 bp, Artificial Sequence
  Description of Artificial Sequence: Synthetic oligonucleotide
acaaccgctaccgcctgctccgaga

SEQ ID NO: 317341 - DNA, 24 bp, Artificial Sequence
  Description of Artificial Sequence: Synthetic oligonucleotide
caaccgctaccgcctgctccgaga

SEQ ID NO: 317342 - DNA, 24 bp, Artificial Sequence
  Description of Artificial Sequence: Synthetic oligonucleotide
aaccgctaccgcctgctccgagag

SEQ ID NO: 317343 - DNA, 23 bp, Artificial Sequence
  Description of Artificial Sequence: Synthetic oligonucleotide
accgctaccgcctgctccgagag

SEQ ID NO: 317344 - DNA, 22 bp, Artificial Sequence
  Description of Artificial Sequence: Synthetic oligonucleotide
ccgctaccgcctgctccgagag

SEQ ID NO: 317345 - DNA, 22 bp, Artificial Sequence
  Description of Artificial Sequence: Synthetic oligonucleotide
cgctaccgcctgctccgagagg

SEQ ID NO: 317346 - DNA, 22 bp, Artificial Sequence
  Description of Artificial Sequence: Synthetic oligonucleotide
gctaccgcctgctccgagaggc

SEQ ID NO: 317347 - DNA, 22 bp, Artificial Sequence
  Description of Artificial Sequence: Synthetic oligonucleotide
ctaccgcctgctccgagaggcg

SEQ ID NO: 317348 - DNA, 23 bp, Artificial Sequence
  Description of Artificial Sequence: Synthetic oligonucleotide
taccgcctgctccgagaggcgct

SEQ ID NO: 317349 - DNA, 22 bp, Artificial Sequence
  Description of Artificial Sequence: Synthetic oligonucleotide
accgcctgctccgagaggcgct

SEQ ID NO: 317350 - DNA, 21 bp, Artificial Sequence
  Description of Artificial Sequence: Synthetic oligonucleotide
ccgcctgctccgagaggcgct

SEQ ID NO: 317351 - DNA, 21 bp, Artificial Sequence
  Description of Artificial Sequence: Synthetic oligonucleotide
cgcctgctccgagaggcgctg

SEQ ID NO: 317352 - DNA, 21 bp, Artificial Sequence
  Description of Artificial Sequence: Synthetic oligonucleotide
gcctgctccgagaggcgctgg

SEQ ID NO: 317353 - DNA, 21 bp, Artificial Sequence
  Description of Artificial Sequence: Synthetic oligonucleotide
cctgctccgagaggcgctggg

SEQ ID NO: 317354 - DNA, 21 bp, Artificial Sequence
  Description of Artificial Sequence: Synthetic oligonucleotide
ctgctccgagaggcgctgggc

SEQ ID NO: 317355 - DNA, 22 bp, Artificial Sequence
  Description of Artificial Sequence: Synthetic oligonucleotide
tgctccgagaggcgctgggcga

SEQ ID NO: 317356 - DNA, 21 bp, Artificial Sequence
  Description of Artificial Sequence: Synthetic oligonucleotide
gctccgagaggcgctgggcga

SEQ ID NO: 317357 - DNA, 22 bp, Artificial Sequence
  Description of Artificial Sequence: Synthetic oligonucleotide
ctccgagaggcgctgggcgagt

SEQ ID NO: 317358 - DNA, 22 bp, Artificial Sequence
  Description of Artificial Sequence: Synthetic oligonucleotide
tccgagaggcgctgggcgagtg

SEQ ID NO: 317359 - DNA, 21 bp, Artificial Sequence
  Description of Artificial Sequence: Synthetic oligonucleotide
ccgagaggcgctgggcgagtg

SEQ ID NO: 317360 - DNA, 21 bp, Artificial Sequence
  Description of Artificial Sequence: Synthetic oligonucleotide
cgagaggcgctgggcgagtgc

SEQ ID NO: 317361 - DNA, 22 bp, Artificial Sequence
  Description of Artificial Sequence: Synthetic oligonucleotide
gagaggcgctgggcgagtgcct

SEQ ID NO: 317362 - DNA, 22 bp, Artificial Sequence
  Description of Artificial Sequence: Synthetic oligonucleotide
agaggcgctgggcgagtgcctc

SEQ ID NO: 317363 - DNA, 21 bp, Artificial Sequence
  Description of Artificial Sequence: Synthetic oligonucleotide
gaggcgctgggcgagtgcctc

SEQ ID NO: 317364 - DNA, 21 bp, Artificial Sequence
  Description of Artificial Sequence: Synthetic oligonucleotide
aggcgctgggcgagtgcctcg

SEQ ID NO: 317365 - DNA, 20 bp, Artificial Sequence
  Description of Artificial Sequence: Synthetic oligonucleotide
ggcgctgggcgagtgcctcg

SEQ ID NO: 317366 - DNA, 20 bp, Artificial Sequence
  Description of Artificial Sequence: Synthetic oligonucleotide
gcgctgggcgagtgcctcgg

SEQ ID NO: 317367 - DNA, 21 bp, Artificial Sequence
  Description of Artificial Sequence: Synthetic oligonucleotide
cgctgggcgagtgcctcggga

SEQ ID NO: 317368 - DNA, 21 bp, Artificial Sequence
  Description of Artificial Sequence: Synthetic oligonucleotide
gctgggcgagtgcctcgggac

SEQ ID NO: 317369 - DNA, 21 bp, Artificial Sequence
  Description of Artificial Sequence: Synthetic oligonucleotide
ctgggcgagtgcctcgggacc

SEQ ID NO: 317370 - DNA, 22 bp, Artificial Sequence
  Description of Artificial Sequence: Synthetic oligonucleotide
tgggcgagtgcctcgggaccct

SEQ ID NO: 317371 - DNA, 21 bp, Artificial Sequence
  Description of Artificial Sequence: Synthetic oligonucleotide
gggcgagtgcctcgggaccct

SEQ ID NO: 317372 - DNA, 23 bp, Artificial Sequence
  Description of Artificial Sequence: Synthetic oligonucleotide
ggcgagtgcctcgggaccctctt

SEQ ID NO: 317373 - DNA, 23 bp, Artificial Sequence
  Description of Artificial Sequence: Synthetic oligonucleotide
gcgagtgcctcgggaccctcttc

SEQ ID NO: 317374 - DNA, 24 bp, Artificial Sequence
  Description of Artificial Sequence: Synthetic oligonucleotide
cgagtgcctcgggaccctcttcct

SEQ ID NO: 317375 - DNA, 24 bp, Artificial Sequence
  Description of Artificial Sequence: Synthetic oligonucleotide
gagtgcctcgggaccctcttcctg

SEQ ID NO: 317376 - DNA, 25 bp, Artificial Sequence
  Description of Artificial Sequence: Synthetic oligonucleotide
agtgcctcgggaccctcttcctggt

SEQ ID NO: 317377 - DNA, 24 bp, Artificial Sequence
  Description of Artificial Sequence: Synthetic oligonucleotide
gtgcctcgggaccctcttcctggt

SEQ ID NO: 317378 - DNA, 26 bp, Artificial Sequence
  Description of Artificial Sequence: Synthetic oligonucleotide
tgcctcgggaccctcttcctggtgaa

SEQ ID NO: 317379 - DNA, 25 bp, Artificial Sequence
  Description of Artificial Sequence: Synthetic oligonucleotide
gcctcgggaccctcttcctggtgaa

SEQ ID NO: 317380 - DNA, 27 bp, Artificial Sequence
  Description of Artificial Sequence: Synthetic oligonucleotide
cctcgggaccctcttcctggtgaagtt

SEQ ID NO: 317381 - DNA, 28 bp, Artificial Sequence
  Description of Artificial Sequence: Synthetic oligonucleotide
ctcgggaccctcttcctggtgaagtttg

SEQ ID NO: 317382 - DNA, 28 bp, Artificial Sequence
  Description of Artificial Sequence: Synthetic oligonucleotide
tcgggaccctcttcctggtgaagtttgg

SEQ ID NO: 317383 - DNA, 27 bp, Artificial Sequence
  Description of Artificial Sequence: Synthetic oligonucleotide
cgggaccctcttcctggtgaagtttgg

SEQ ID NO: 317384 - DNA, 27 bp, Artificial Sequence
  Description of Artificial Sequence: Synthetic oligonucleotide
gggaccctcttcctggtgaagtttggc

SEQ ID NO: 317385 - DNA, 28 bp, Artificial Sequence
  Description of Artificial Sequence: Synthetic oligonucleotide
ggaccctcttcctggtgaagtttggctg

SEQ ID NO: 317386 - DNA, 29 bp, Artificial Sequence
  Description of Artificial Sequence: Synthetic oligonucleotide
gaccctcttcctggtgaagtttggctgag

SEQ ID NO: 317387 - DNA, 29 bp, Artificial Sequence
  Description of Artificial Sequence: Synthetic oligonucleotide
accctcttcctggtgaagtttggctgagg

SEQ ID NO: 317388 - DNA, 28 bp, Artificial Sequence
  Description of Artificial Sequence: Synthetic oligonucleotide
ccctcttcctggtgaagtttggctgagg

SEQ ID NO: 317389 - DNA, 28 bp, Artificial Sequence
  Description of Artificial Sequence: Synthetic oligonucleotide
cctcttcctggtgaagtttggctgaggc

SEQ ID NO: 317390 - DNA, 29 bp, Artificial Sequence
  Description of Artificial Sequence: Synthetic oligonucleotide
ctcttcctggtgaagtttggctgaggctc

SEQ ID NO: 317391 - DNA, 29 bp, Artificial Sequence
  Description of Artificial Sequence: Synthetic oligonucleotide
tcttcctggtgaagtttggctgaggctcc

SEQ ID NO: 317392 - DNA, 28 bp, Artificial Sequence
  Description of Artificial Sequence: Synthetic oligonucleotide
cttcctggtgaagtttggctgaggctcc

SEQ ID NO: 317393 - DNA, 28 bp, Artificial Sequence
  Description of Artificial Sequence: Synthetic oligonucleotide
ttcctggtgaagtttggctgaggctccg

SEQ ID NO: 317394 - DNA, 27 bp, Artificial Sequence
  Description of Artificial Sequence: Synthetic oligonucleotide
tcctggtgaagtttggctgaggctccg

SEQ ID NO: 317395 - DNA, 27 bp, Artificial Sequence
  Description of Artificial Sequence: Synthetic oligonucleotide
cctggtgaagtttggctgaggctccgt

SEQ ID NO: 317396 - DNA, 27 bp, Artificial Sequence
  Description of Artificial Sequence: Synthetic oligonucleotide
ctggtgaagtttggctgaggctccgtg

SEQ ID NO: 317397 - DNA, 27 bp, Artificial Sequence
  Description of Artificial Sequence: Synthetic oligonucleotide
tggtgaagtttggctgaggctccgtgc

SEQ ID NO: 317398 - DNA, 26 bp, Artificial Sequence
  Description of Artificial Sequence: Synthetic oligonucleotide
ggtgaagtttggctgaggctccgtgc

SEQ ID NO: 317399 - DNA, 26 bp, Artificial Sequence
  Description of Artificial Sequence: Synthetic oligonucleotide
gtgaagtttggctgaggctccgtgcc

SEQ ID NO: 317400 - DNA, 26 bp, Artificial Sequence
  Description of Artificial Sequence: Synthetic oligonucleotide
tgaagtttggctgaggctccgtgccc

SEQ ID NO: 317401 - DNA, 25 bp, Artificial Sequence
  Description of Artificial Sequence: Synthetic oligonucleotide
gaagtttggctgaggctccgtgccc

SEQ ID NO: 317402 - DNA, 26 bp, Artificial Sequence
  Description of Artificial Sequence: Synthetic oligonucleotide
aagtttggctgaggctccgtgcccca

SEQ ID NO: 317403 - DNA, 25 bp, Artificial Sequence
  Description of Artificial Sequence: Synthetic oligonucleotide
agtttggctgaggctccgtgcccca

SEQ ID NO: 317404 - DNA, 24 bp, Artificial Sequence
  Description of Artificial Sequence: Synthetic oligonucleotide
gtttggctgaggctccgtgcccca

SEQ ID NO: 317405 - DNA, 24 bp, Artificial Sequence
  Description of Artificial Sequence: Synthetic oligonucleotide
tttggctgaggctccgtgccccag

SEQ ID NO: 317406 - DNA, 23 bp, Artificial Sequence
  Description of Artificial Sequence: Synthetic oligonucleotide
ttggctgaggctccgtgccccag

SEQ ID NO: 317407 - DNA, 22 bp, Artificial Sequence
  Description of Artificial Sequence: Synthetic oligonucleotide
tggctgaggctccgtgccccag

SEQ ID NO: 317408 - DNA, 21 bp, Artificial Sequence
  Description of Artificial Sequence: Synthetic oligonucleotide
ggctgaggctccgtgccccag

SEQ ID NO: 317409 - DNA, 23 bp, Artificial Sequence
  Description of Artificial Sequence: Synthetic oligonucleotide
gctgaggctccgtgccccaggtt

SEQ ID NO: 317410 - DNA, 24 bp, Artificial Sequence
  Description of Artificial Sequence: Synthetic oligonucleotide
ctgaggctccgtgccccaggttga

SEQ ID NO: 317411 - DNA, 24 bp, Artificial Sequence
  Description of Artificial Sequence: Synthetic oligonucleotide
tgaggctccgtgccccaggttgag

SEQ ID NO: 317412 - DNA, 23 bp, Artificial Sequence
  Description of Artificial Sequence: Synthetic oligonucleotide
gaggctccgtgccccaggttgag

SEQ ID NO: 317413 - DNA, 24 bp, Artificial Sequence
  Description of Artificial Sequence: Synthetic oligonucleotide
aggctccgtgccccaggttgagct

SEQ ID NO: 317414 - DNA, 23 bp, Artificial Sequence
  Description of Artificial Sequence: Synthetic oligonucleotide
ggctccgtgccccaggttgagct

SEQ ID NO: 317415 - DNA, 24 bp, Artificial Sequence
  Description of Artificial Sequence: Synthetic oligonucleotide
gctccgtgccccaggttgagctca

SEQ ID NO: 317416 - DNA, 24 bp, Artificial Sequence
  Description of Artificial Sequence: Synthetic oligonucleotide
ctccgtgccccaggttgagctcag

SEQ ID NO: 317417 - DNA, 24 bp, Artificial Sequence
  Description of Artificial Sequence: Synthetic oligonucleotide
tccgtgccccaggttgagctcagc

SEQ ID NO: 317418 - DNA, 23 bp, Artificial Sequence
  Description of Artificial Sequence: Synthetic oligonucleotide
ccgtgccccaggttgagctcagc

SEQ ID NO: 317419 - DNA, 23 bp, Artificial Sequence
  Description of Artificial Sequence: Synthetic oligonucleotide
cgtgccccaggttgagctcagcc

SEQ ID NO: 317420 - DNA, 23 bp, Artificial Sequence
  Description of Artificial Sequence: Synthetic oligonucleotide
gtgccccaggttgagctcagccg

SEQ ID NO: 317421 - DNA, 23 bp, Artificial Sequence
  Description of Artificial Sequence: Synthetic oligonucleotide
tgccccaggttgagctcagccgc

SEQ ID NO: 317422 - DNA, 22 bp, Artificial Sequence
  Description of Artificial Sequence: Synthetic oligonucleotide
gccccaggttgagctcagccgc

SEQ ID NO: 317423 - DNA, 22 bp, Artificial Sequence
  Description of Artificial Sequence: Synthetic oligonucleotide
ccccaggttgagctcagccgcg

SEQ ID NO: 317424 - DNA, 22 bp, Artificial Sequence
  Description of Artificial Sequence: Synthetic oligonucleotide
cccaggttgagctcagccgcgg

SEQ ID NO: 317425 - DNA, 23 bp, Artificial Sequence
  Description of Artificial Sequence: Synthetic oligonucleotide
ccaggttgagctcagccgcggca

SEQ ID NO: 317426 - DNA, 23 bp, Artificial Sequence
  Description of Artificial Sequence: Synthetic oligonucleotide
caggttgagctcagccgcggcac

SEQ ID NO: 317427 - DNA, 23 bp, Artificial Sequence
  Description of Artificial Sequence: Synthetic oligonucleotide
aggttgagctcagccgcggcacc

SEQ ID NO: 317428 - DNA, 22 bp, Artificial Sequence
  Description of Artificial Sequence: Synthetic oligonucleotide
ggttgagctcagccgcggcacc

SEQ ID NO: 317429 - DNA, 23 bp, Artificial Sequence
  Description of Artificial Sequence: Synthetic oligonucleotide
gttgagctcagccgcggcaccca

SEQ ID NO: 317430 - DNA, 23 bp, Artificial Sequence
  Description of Artificial Sequence: Synthetic oligonucleotide
ttgagctcagccgcggcacccac

SEQ ID NO: 317431 - DNA, 22 bp, Artificial Sequence
  Description of Artificial Sequence: Synthetic oligonucleotide
tgagctcagccgcggcacccac

SEQ ID NO: 317432 - DNA, 21 bp, Artificial Sequence
  Description of Artificial Sequence: Synthetic oligonucleotide
gagctcagccgcggcacccac

SEQ ID NO: 317433 - DNA, 21 bp, Artificial Sequence
  Description of Artificial Sequence: Synthetic oligonucleotide
agctcagccgcggcacccacc

SEQ ID NO: 317434 - DNA, 20 bp, Artificial Sequence
  Description of Artificial Sequence: Synthetic oligonucleotide
gctcagccgcggcacccacc

SEQ ID NO: 317435 - DNA, 21 bp, Artificial Sequence
  Description of Artificial Sequence: Synthetic oligonucleotide
ctcagccgcggcacccaccgt

SEQ ID NO: 317436 - DNA, 21 bp, Artificial Sequence
  Description of Artificial Sequence: Synthetic oligonucleotide
tcagccgcggcacccaccgtg

SEQ ID NO: 317437 - DNA, 20 bp, Artificial Sequence
  Description of Artificial Sequence: Synthetic oligonucleotide
cagccgcggcacccaccgtg

SEQ ID NO: 317438 - DNA, 23 bp, Artificial Sequence
  Description of Artificial Sequence: Synthetic oligonucleotide
agccgcggcacccaccgtggttt

SEQ ID NO: 317439 - DNA, 22 bp, Artificial Sequence
  Description of Artificial Sequence: Synthetic oligonucleotide
gccgcggcacccaccgtggttt

SEQ ID NO: 317440 - DNA, 22 bp, Artificial Sequence
  Description of Artificial Sequence: Synthetic oligonucleotide
ccgcggcacccaccgtggtttc

SEQ ID NO: 317441 - DNA, 23 bp, Artificial Sequence
  Description of Artificial Sequence: Synthetic oligonucleotide
cgcggcacccaccgtggtttcca

SEQ ID NO: 317442 - DNA, 24 bp, Artificial Sequence
  Description of Artificial Sequence: Synthetic oligonucleotide
gcggcacccaccgtggtttccaca

SEQ ID NO: 317443 - DNA, 24 bp, Artificial Sequence
  Description of Artificial Sequence: Synthetic oligonucleotide
cggcacccaccgtggtttccacac

SEQ ID NO: 317444 - DNA, 26 bp, Artificial Sequence
  Description of Artificial Sequence: Synthetic oligonucleotide
ggcacccaccgtggtttccacaccat

SEQ ID NO: 317445 - DNA, 27 bp, Artificial Sequence
  Description of Artificial Sequence: Synthetic oligonucleotide
gcacccaccgtggtttccacaccatca

SEQ ID NO: 317446 - DNA, 28 bp, Artificial Sequence
  Description of Artificial Sequence: Synthetic oligonucleotide
cacccaccgtggtttccacaccatcaag

SEQ ID NO: 317447 - DNA, 28 bp, Artificial Sequence
  Description of Artificial Sequence: Synthetic oligonucleotide
acccaccgtggtttccacaccatcaagc

SEQ ID NO: 317448 - DNA, 27 bp, Artificial Sequence
  Description of Artificial Sequence: Synthetic oligonucleotide
cccaccgtggtttccacaccatcaagc

SEQ ID NO: 317449 - DNA, 28 bp, Artificial Sequence
  Description of Artificial Sequence: Synthetic oligonucleotide
ccaccgtggtttccacaccatcaagctg

SEQ ID NO: 317450 - DNA, 28 bp, Artificial Sequence
  Description of Artificial Sequence: Synthetic oligonucleotide
caccgtggtttccacaccatcaagctgg

SEQ ID NO: 317451 - DNA, 28 bp, Artificial Sequence
  Description of Artificial Sequence: Synthetic oligonucleotide
accgtggtttccacaccatcaagctggc

SEQ ID NO: 317452 - DNA, 27 bp, Artificial Sequence
  Description of Artificial Sequence: Synthetic oligonucleotide
ccgtggtttccacaccatcaagctggc

SEQ ID NO: 317453 - DNA, 27 bp, Artificial Sequence
  Description of Artificial Sequence: Synthetic oligonucleotide
cgtggtttccacaccatcaagctggcc

SEQ ID NO: 317454 - DNA, 30 bp, Artificial Sequence
  Description of Artificial Sequence: Synthetic oligonucleotide
gtggtttccacaccatcaagctggcctttc

SEQ ID NO: 317455 - DNA, 30 bp, Artificial Sequence
  Description of Artificial Sequence: Synthetic oligonucleotide
tggtttccacaccatcaagctggcctttcg

SEQ ID NO: 317456 - DNA, 29 bp, Artificial Sequence
  Description of Artificial Sequence: Synthetic oligonucleotide
ggtttccacaccatcaagctggcctttcg

SEQ ID NO: 317457 - DNA, 29 bp, Artificial Sequence
  Description of Artificial Sequence: Synthetic oligonucleotide
gtttccacaccatcaagctggcctttcgc

SEQ ID NO: 317458 - DNA, 32 bp, Artificial Sequence
  Description of Artificial Sequence: Synthetic oligonucleotide
tttccacaccatcaagctggcctttcgctttg

SEQ ID NO: 317459 - DNA, 31 bp, Artificial Sequence
  Description of Artificial Sequence: Synthetic oligonucleotide
ttccacaccatcaagctggcctttcgctttg

SEQ ID NO: 317460 - DNA, 30 bp, Artificial Sequence
  Description of Artificial Sequence: Synthetic oligonucleotide
tccacaccatcaagctggcctttcgctttg

SEQ ID NO: 317461 - DNA, 29 bp, Artificial Sequence
  Description of Artificial Sequence: Synthetic oligonucleotide
ccacaccatcaagctggcctttcgctttg

SEQ ID NO: 317462 - DNA, 29 bp, Artificial Sequence
  Description of Artificial Sequence: Synthetic oligonucleotide
cacaccatcaagctggcctttcgctttgc

SEQ ID NO: 317463 - DNA, 30 bp, Artificial Sequence
  Description of Artificial Sequence: Synthetic oligonucleotide
acaccatcaagctggcctttcgctttgctg

SEQ ID NO: 317464 - DNA, 29 bp, Artificial Sequence
  Description of Artificial Sequence: Synthetic oligonucleotide
caccatcaagctggcctttcgctttgctg

SEQ ID NO: 317465 - DNA, 30 bp, Artificial Sequence
  Description of Artificial Sequence: Synthetic oligonucleotide
accatcaagctggcctttcgctttgctgac

SEQ ID NO: 317466 - DNA, 29 bp, Artificial Sequence
  Description of Artificial Sequence: Synthetic oligonucleotide
ccatcaagctggcctttcgctttgctgac

SEQ ID NO: 317467 - DNA, 30 bp, Artificial Sequence
  Description of Artificial Sequence: Synthetic oligonucleotide
catcaagctggcctttcgctttgctgacac

SEQ ID NO: 317468 - DNA, 31 bp, Artificial Sequence
  Description of Artificial Sequence: Synthetic oligonucleotide
atcaagctggcctttcgctttgctgacactc

SEQ ID NO: 317469 - DNA, 30 bp, Artificial Sequence
  Description of Artificial Sequence: Synthetic oligonucleotide
tcaagctggcctttcgctttgctgacactc

SEQ ID NO: 317470 - DNA, 29 bp, Artificial Sequence
  Description of Artificial Sequence: Synthetic oligonucleotide
caagctggcctttcgctttgctgacactc

SEQ ID NO: 317471 - DNA, 30 bp, Artificial Sequence
  Description of Artificial Sequence: Synthetic oligonucleotide
aagctggcctttcgctttgctgacactctg

SEQ ID NO: 317472 - DNA, 29 bp, Artificial Sequence
  Description of Artificial Sequence: Synthetic oligonucleotide
agctggcctttcgctttgctgacactctg

SEQ ID NO: 317473 - DNA, 28 bp, Artificial Sequence
  Description of Artificial Sequence: Synthetic oligonucleotide
gctggcctttcgctttgctgacactctg

SEQ ID NO: 317474 - DNA, 28 bp, Artificial Sequence
  Description of Artificial Sequence: Synthetic oligonucleotide
ctggcctttcgctttgctgacactctgg

SEQ ID NO: 317475 - DNA, 28 bp, Artificial Sequence
  Description of Artificial Sequence: Synthetic oligonucleotide
tggcctttcgctttgctgacactctggg

SEQ ID NO: 317476 - DNA, 27 bp, Artificial Sequence
  Description of Artificial Sequence: Synthetic oligonucleotide
ggcctttcgctttgctgacactctggg

SEQ ID NO: 317477 - DNA, 27 bp, Artificial Sequence
  Description of Artificial Sequence: Synthetic oligonucleotide
gcctttcgctttgctgacactctgggg

SEQ ID NO: 317478 - DNA, 29 bp, Artificial Sequence
  Description of Artificial Sequence: Synthetic oligonucleotide
cctttcgctttgctgacactctggggatc

SEQ ID NO: 317479 - DNA, 29 bp, Artificial Sequence
  Description of Artificial Sequence: Synthetic oligonucleotide
ctttcgctttgctgacactctggggatcc

SEQ ID NO: 317480 - DNA, 30 bp, Artificial Sequence
  Description of Artificial Sequence: Synthetic oligonucleotide
tttcgctttgctgacactctggggatcctc

SEQ ID NO: 317481 - DNA, 29 bp, Artificial Sequence
  Description of Artificial Sequence: Synthetic oligonucleotide
ttcgctttgctgacactctggggatcctc

SEQ ID NO: 317482 - DNA, 28 bp, Artificial Sequence
  Description of Artificial Sequence: Synthetic oligonucleotide
tcgctttgctgacactctggggatcctc

SEQ ID NO: 317483 - DNA, 27 bp, Artificial Sequence
  Description of Artificial Sequence: Synthetic oligonucleotide
cgctttgctgacactctggggatcctc

SEQ ID NO: 317484 - DNA, 29 bp, Artificial Sequence
  Description of Artificial Sequence: Synthetic oligonucleotide
gctttgctgacactctggggatcctcatc

SEQ ID NO: 317485 - DNA, 29 bp, Artificial Sequence
  Description of Artificial Sequence: Synthetic oligonucleotide
ctttgctgacactctggggatcctcatcc

SEQ ID NO: 317486 - DNA, 29 bp, Artificial Sequence
  Description of Artificial Sequence: Synthetic oligonucleotide
tttgctgacactctggggatcctcatccc

SEQ ID NO: 317487 - DNA, 28 bp, Artificial Sequence
  Description of Artificial Sequence: Synthetic oligonucleotide
ttgctgacactctggggatcctcatccc

SEQ ID NO: 317488 - DNA, 27 bp, Artificial Sequence
  Description of Artificial Sequence: Synthetic oligonucleotide
tgctgacactctggggatcctcatccc

SEQ ID NO: 317489 - DNA, 27 bp, Artificial Sequence
  Description of Artificial Sequence: Synthetic oligonucleotide
gctgacactctggggatcctcatccct

SEQ ID NO: 317490 - DNA, 27 bp, Artificial Sequence
  Description of Artificial Sequence: Synthetic oligonucleotide
ctgacactctggggatcctcatccctg

SEQ ID NO: 317491 - DNA, 27 bp, Artificial Sequence
  Description of Artificial Sequence: Synthetic oligonucleotide
tgacactctggggatcctcatccctgg

SEQ ID NO: 317492 - DNA, 26 bp, Artificial Sequence
  Description of Artificial Sequence: Synthetic oligonucleotide
gacactctggggatcctcatccctgg

SEQ ID NO: 317493 - DNA, 26 bp, Artificial Sequence
  Description of Artificial Sequence: Synthetic oligonucleotide
acactctggggatcctcatccctggc

SEQ ID NO: 317494 - DNA, 25 bp, Artificial Sequence
  Description of Artificial Sequence: Synthetic oligonucleotide
cactctggggatcctcatccctggc

SEQ ID NO: 317495 - DNA, 26 bp, Artificial Sequence
  Description of Artificial Sequence: Synthetic oligonucleotide
actctggggatcctcatccctggcca

SEQ ID NO: 317496 - DNA, 25 bp, Artificial Sequence
  Description of Artificial Sequence: Synthetic oligonucleotide
ctctggggatcctcatccctggcca

SEQ ID NO: 317497 - DNA, 25 bp, Artificial Sequence
  Description of Artificial Sequence: Synthetic oligonucleotide
tctggggatcctcatccctggccag

SEQ ID NO: 317498 - DNA, 24 bp, Artificial Sequence
  Description of Artificial Sequence: Synthetic oligonucleotide
ctggggatcctcatccctggccag

SEQ ID NO: 317499 - DNA, 25 bp, Artificial Sequence
  Description of Artificial Sequence: Synthetic oligonucleotide
tggggatcctcatccctggccagga

SEQ ID NO: 317500 - DNA, 24 bp, Artificial Sequence
  Description of Artificial Sequence: Synthetic oligonucleotide
ggggatcctcatccctggccagga

SEQ ID NO: 317501 - DNA, 25 bp, Artificial Sequence
  Description of Artificial Sequence: Synthetic oligonucleotide
gggatcctcatccctggccaggact

SEQ ID NO: 317502 - DNA, 26 bp, Artificial Sequence
  Description of Artificial Sequence: Synthetic oligonucleotide
ggatcctcatccctggccaggactct

SEQ ID NO: 317503 - DNA, 26 bp, Artificial Sequence
  Description of Artificial Sequence: Synthetic oligonucleotide
gatcctcatccctggccaggactctg

SEQ ID NO: 317504 - DNA, 26 bp, Artificial Sequence
  Description of Artificial Sequence: Synthetic oligonucleotide
atcctcatccctggccaggactctgg

SEQ ID NO: 317505 - DNA, 25 bp, Artificial Sequence
  Description of Artificial Sequence: Synthetic oligonucleotide
tcctcatccctggccaggactctgg

SEQ ID NO: 317506 - DNA, 24 bp, Artificial Sequence
  Description of Artificial Sequence: Synthetic oligonucleotide
cctcatccctggccaggactctgg

SEQ ID NO: 317507 - DNA, 24 bp, Artificial Sequence
  Description of Artificial Sequence: Synthetic oligonucleotide
ctcatccctggccaggactctggg

SEQ ID NO: 317508 - DNA, 24 bp, Artificial Sequence
  Description of Artificial Sequence: Synthetic oligonucleotide
tcatccctggccaggactctgggg

SEQ ID NO: 317509 - DNA, 23 bp, Artificial Sequence
  Description of Artificial Sequence: Synthetic oligonucleotide
catccctggccaggactctgggg

SEQ ID NO: 317510 - DNA, 23 bp, Artificial Sequence
  Description of Artificial Sequence: Synthetic oligonucleotide
atccctggccaggactctggggc

SEQ ID NO: 317511 - DNA, 22 bp, Artificial Sequence
  Description of Artificial Sequence: Synthetic oligonucleotide
tccctggccaggactctggggc

SEQ ID NO: 317512 - DNA, 21 bp, Artificial Sequence
  Description of Artificial Sequence: Synthetic oligonucleotide
ccctggccaggactctggggc

SEQ ID NO: 317513 - DNA, 21 bp, Artificial Sequence
  Description of Artificial Sequence: Synthetic oligonucleotide
cctggccaggactctggggcg

SEQ ID NO: 317514 - DNA, 22 bp, Artificial Sequence
  Description of Artificial Sequence: Synthetic oligonucleotide
ctggccaggactctggggcgca

SEQ ID NO: 317515 - DNA, 22 bp, Artificial Sequence
  Description of Artificial Sequence: Synthetic oligonucleotide
tggccaggactctggggcgcac

SEQ ID NO: 317516 - DNA, 21 bp, Artificial Sequence
  Description of Artificial Sequence: Synthetic oligonucleotide
ggccaggactctggggcgcac

SEQ ID NO: 317517 - DNA, 22 bp, Artificial Sequence
  Description of Artificial Sequence: Synthetic oligonucleotide
gccaggactctggggcgcacct

SEQ ID NO: 317518 - DNA, 24 bp, Artificial Sequence
  Description of Artificial Sequence: Synthetic oligonucleotide
ccaggactctggggcgcacctgaa

SEQ ID NO: 317519 - DNA, 24 bp, Artificial Sequence
  Description of Artificial Sequence: Synthetic oligonucleotide
caggactctggggcgcacctgaac

SEQ ID NO: 317520 - DNA, 24 bp, Artificial Sequence
  Description of Artificial Sequence: Synthetic oligonucleotide
aggactctggggcgcacctgaacg

SEQ ID NO: 317521 - DNA, 23 bp, Artificial Sequence
  Description of Artificial Sequence: Synthetic oligonucleotide
ggactctggggcgcacctgaacg

SEQ ID NO: 317522 - DNA, 24 bp, Artificial Sequence
  Description of Artificial Sequence: Synthetic oligonucleotide
gactctggggcgcacctgaacgct

SEQ ID NO: 317523 - DNA, 24 bp, Artificial Sequence
  Description of Artificial Sequence: Synthetic oligonucleotide
actctggggcgcacctgaacgctg

SEQ ID NO: 317524 - DNA, 23 bp, Artificial Sequence
  Description of Artificial Sequence: Synthetic oligonucleotide
ctctggggcgcacctgaacgctg

SEQ ID NO: 317525 - DNA, 23 bp, Artificial Sequence
  Description of Artificial Sequence: Synthetic oligonucleotide
tctggggcgcacctgaacgctgc

SEQ ID NO: 317526 - DNA, 22 bp, Artificial Sequence
  Description of Artificial Sequence: Synthetic oligonucleotide
ctggggcgcacctgaacgctgc

SEQ ID NO: 317527 - DNA, 22 bp, Artificial Sequence
  Description of Artificial Sequence: Synthetic oligonucleotide
tggggcgcacctgaacgctgcc

SEQ ID NO: 317528 - DNA, 21 bp, Artificial Sequence
  Description of Artificial Sequence: Synthetic oligonucleotide
ggggcgcacctgaacgctgcc

SEQ ID NO: 317529 - DNA, 22 bp, Artificial Sequence
  Description of Artificial Sequence: Synthetic oligonucleotide
gggcgcacctgaacgctgccgt

SEQ ID NO: 317530 - DNA, 23 bp, Artificial Sequence
  Description of Artificial Sequence: Synthetic oligonucleotide
ggcgcacctgaacgctgccgtga

SEQ ID NO: 317531 - DNA, 23 bp, Artificial Sequence
  Description of Artificial Sequence: Synthetic oligonucleotide
gcgcacctgaacgctgccgtgag

SEQ ID NO: 317532 - DNA, 26 bp, Artificial Sequence
  Description of Artificial Sequence: Synthetic oligonucleotide
cgcacctgaacgctgccgtgagcttt

SEQ ID NO: 317533 - DNA, 26 bp, Artificial Sequence
  Description of Artificial Sequence: Synthetic oligonucleotide
gcacctgaacgctgccgtgagctttg

SEQ ID NO: 317534 - DNA, 26 bp, Artificial Sequence
  Description of Artificial Sequence: Synthetic oligonucleotide
cacctgaacgctgccgtgagctttgc

SEQ ID NO: 317535 - DNA, 27 bp, Artificial Sequence
  Description of Artificial Sequence: Synthetic oligonucleotide
acctgaacgctgccgtgagctttgcca

SEQ ID NO: 317536 - DNA, 27 bp, Artificial Sequence
  Description of Artificial Sequence: Synthetic oligonucleotide
cctgaacgctgccgtgagctttgccat

SEQ ID NO: 317537 - DNA, 27 bp, Artificial Sequence
  Description of Artificial Sequence: Synthetic oligonucleotide
ctgaacgctgccgtgagctttgccatc

SEQ ID NO: 317538 - DNA, 28 bp, Artificial Sequence
  Description of Artificial Sequence: Synthetic oligonucleotide
tgaacgctgccgtgagctttgccatctg

SEQ ID NO: 317539 - DNA, 27 bp, Artificial Sequence
  Description of Artificial Sequence: Synthetic oligonucleotide
gaacgctgccgtgagctttgccatctg

SEQ ID NO: 317540 - DNA, 27 bp, Artificial Sequence
  Description of Artificial Sequence: Synthetic oligonucleotide
aacgctgccgtgagctttgccatctgc

SEQ ID NO: 317541 - DNA, 27 bp, Artificial Sequence
  Description of Artificial Sequence: Synthetic oligonucleotide
acgctgccgtgagctttgccatctgct

SEQ ID NO: 317542 - DNA, 27 bp, Artificial Sequence
  Description of Artificial Sequence: Synthetic oligonucleotide
cgctgccgtgagctttgccatctgctt

SEQ ID NO: 317543 - DNA, 27 bp, Artificial Sequence
  Description of Artificial Sequence: Synthetic oligonucleotide
gctgccgtgagctttgccatctgcttc

SEQ ID NO: 317544 - DNA, 27 bp, Artificial Sequence
  Description of Artificial Sequence: Synthetic oligonucleotide
ctgccgtgagctttgccatctgcttcc

SEQ ID NO: 317545 - DNA, 28 bp, Artificial Sequence
  Description of Artificial Sequence: Synthetic oligonucleotide
tgccgtgagctttgccatctgcttcctg

SEQ ID NO: 317546 - DNA, 27 bp, Artificial Sequence
  Description of Artificial Sequence: Synthetic oligonucleotide
gccgtgagctttgccatctgcttcctg

SEQ ID NO: 317547 - DNA, 27 bp, Artificial Sequence
  Description of Artificial Sequence: Synthetic oligonucleotide
ccgtgagctttgccatctgcttcctgc

SEQ ID NO: 317548 - DNA, 27 bp, Artificial Sequence
  Description of Artificial Sequence: Synthetic oligonucleotide
cgtgagctttgccatctgcttcctgcc

SEQ ID NO: 317549 - DNA, 28 bp, Artificial Sequence
  Description of Artificial Sequence: Synthetic oligonucleotide
gtgagctttgccatctgcttcctgcctc

SEQ ID NO: 317550 - DNA, 28 bp, Artificial Sequence
  Description of Artificial Sequence: Synthetic oligonucleotide
tgagctttgccatctgcttcctgcctcg

SEQ ID NO: 317551 - DNA, 27 bp, Artificial Sequence
  Description of Artificial Sequence: Synthetic oligonucleotide
gagctttgccatctgcttcctgcctcg

SEQ ID NO: 317552 - DNA, 28 bp, Artificial Sequence
  Description of Artificial Sequence: Synthetic oligonucleotide
agctttgccatctgcttcctgcctcgtg

SEQ ID NO: 317553 - DNA, 27 bp, Artificial Sequence
  Description of Artificial Sequence: Synthetic oligonucleotide
gctttgccatctgcttcctgcctcgtg

SEQ ID NO: 317554 - DNA, 28 bp, Artificial Sequence
  Description of Artificial Sequence: Synthetic oligonucleotide
ctttgccatctgcttcctgcctcgtgag

SEQ ID NO: 317555 - DNA, 28 bp, Artificial Sequence
  Description of Artificial Sequence: Synthetic oligonucleotide
tttgccatctgcttcctgcctcgtgagc

SEQ ID NO: 317556 - DNA, 27 bp, Artificial Sequence
  Description of Artificial Sequence: Synthetic oligonucleotide
ttgccatctgcttcctgcctcgtgagc

SEQ ID NO: 317557 - DNA, 26 bp, Artificial Sequence
  Description of Artificial Sequence: Synthetic oligonucleotide
tgccatctgcttcctgcctcgtgagc

SEQ ID NO: 317558 - DNA, 25 bp, Artificial Sequence
  Description of Artificial Sequence: Synthetic oligonucleotide
gccatctgcttcctgcctcgtgagc

SEQ ID NO: 317559 - DNA, 25 bp, Artificial Sequence
  Description of Artificial Sequence: Synthetic oligonucleotide
ccatctgcttcctgcctcgtgagcg

SEQ ID NO: 317560 - DNA, 26 bp, Artificial Sequence
  Description of Artificial Sequence: Synthetic oligonucleotide
catctgcttcctgcctcgtgagcgct

SEQ ID NO: 317561 - DNA, 26 bp, Artificial Sequence
  Description of Artificial Sequence: Synthetic oligonucleotide
atctgcttcctgcctcgtgagcgctg

SEQ ID NO: 317562 - DNA, 25 bp, Artificial Sequence
  Description of Artificial Sequence: Synthetic oligonucleotide
tctgcttcctgcctcgtgagcgctg

SEQ ID NO: 317563 - DNA, 24 bp, Artificial Sequence
  Description of Artificial Sequence: Synthetic oligonucleotide
ctgcttcctgcctcgtgagcgctg

SEQ ID NO: 317564 - DNA, 26 bp, Artificial Sequence
  Description of Artificial Sequence: Synthetic oligonucleotide
tgcttcctgcctcgtgagcgctggat

SEQ ID NO: 317565 - DNA, 25 bp, Artificial Sequence
  Description of Artificial Sequence: Synthetic oligonucleotide
gcttcctgcctcgtgagcgctggat

SEQ ID NO: 317566 - DNA, 27 bp, Artificial Sequence
  Description of Artificial Sequence: Synthetic oligonucleotide
cttcctgcctcgtgagcgctggatcaa

SEQ ID NO: 317567 - DNA, 27 bp, Artificial Sequence
  Description of Artificial Sequence: Synthetic oligonucleotide
ttcctgcctcgtgagcgctggatcaac

SEQ ID NO: 317568 - DNA, 26 bp, Artificial Sequence
  Description of Artificial Sequence: Synthetic oligonucleotide
tcctgcctcgtgagcgctggatcaac

SEQ ID NO: 317569 - DNA, 25 bp, Artificial Sequence
  Description of Artificial Sequence: Synthetic oligonucleotide
cctgcctcgtgagcgctggatcaac

SEQ ID NO: 317570 - DNA, 26 bp, Artificial Sequence
  Description of Artificial Sequence: Synthetic oligonucleotide
ctgcctcgtgagcgctggatcaacct

SEQ ID NO: 317571 - DNA, 26 bp, Artificial Sequence
  Description of Artificial Sequence: Synthetic oligonucleotide
tgcctcgtgagcgctggatcaacctg

SEQ ID NO: 317572 - DNA, 25 bp, Artificial Sequence
  Description of Artificial Sequence: Synthetic oligonucleotide
gcctcgtgagcgctggatcaacctg

SEQ ID NO: 317573 - DNA, 25 bp, Artificial Sequence
  Description of Artificial Sequence: Synthetic oligonucleotide
cctcgtgagcgctggatcaacctgc

SEQ ID NO: 317574 - DNA, 25 bp, Artificial Sequence
  Description of Artificial Sequence: Synthetic oligonucleotide
ctcgtgagcgctggatcaacctgcc

SEQ ID NO: 317575 - DNA, 27 bp, Artificial Sequence
  Description of Artificial Sequence: Synthetic oligonucleotide
tcgtgagcgctggatcaacctgcccat

SEQ ID NO: 317576 - DNA, 26 bp, Artificial Sequence
  Description of Artificial Sequence: Synthetic oligonucleotide
cgtgagcgctggatcaacctgcccat

SEQ ID NO: 317577 - DNA, 27 bp, Artificial Sequence
  Description of Artificial Sequence: Synthetic oligonucleotide
gtgagcgctggatcaacctgcccatca

SEQ ID NO: 317578 - DNA, 28 bp, Artificial Sequence
  Description of Artificial Sequence: Synthetic oligonucleotide
tgagcgctggatcaacctgcccatcaac

SEQ ID NO: 317579 - DNA, 27 bp, Artificial Sequence
  Description of Artificial Sequence: Synthetic oligonucleotide
gagcgctggatcaacctgcccatcaac

SEQ ID NO: 317580 - DNA, 28 bp, Artificial Sequence
  Description of Artificial Sequence: Synthetic oligonucleotide
agcgctggatcaacctgcccatcaacac

SEQ ID NO: 317581 - DNA, 27 bp, Artificial Sequence
  Description of Artificial Sequence: Synthetic oligonucleotide
gcgctggatcaacctgcccatcaacac

SEQ ID NO: 317582 - DNA, 27 bp, Artificial Sequence
  Description of Artificial Sequence: Synthetic oligonucleotide
cgctggatcaacctgcccatcaacacc

SEQ ID NO: 317583 - DNA, 27 bp, Artificial Sequence
  Description of Artificial Sequence: Synthetic oligonucleotide
gctggatcaacctgcccatcaacaccc

SEQ ID NO: 317584 - DNA, 28 bp, Artificial Sequence
  Description of Artificial Sequence: Synthetic oligonucleotide
ctggatcaacctgcccatcaacaccctg

SEQ ID NO: 317585 - DNA, 28 bp, Artificial Sequence
  Description of Artificial Sequence: Synthetic oligonucleotide
tggatcaacctgcccatcaacaccctgg

SEQ ID NO: 317586 - DNA, 27 bp, Artificial Sequence
  Description of Artificial Sequence: Synthetic oligonucleotide
ggatcaacctgcccatcaacaccctgg

SEQ ID NO: 317587 - DNA, 27 bp, Artificial Sequence
  Description of Artificial Sequence: Synthetic oligonucleotide
gatcaacctgcccatcaacaccctggg

SEQ ID NO: 317588 - DNA, 28 bp, Artificial Sequence
  Description of Artificial Sequence: Synthetic oligonucleotide
atcaacctgcccatcaacaccctgggac

SEQ ID NO: 317589 - DNA, 27 bp, Artificial Sequence
  Description of Artificial Sequence: Synthetic oligonucleotide
tcaacctgcccatcaacaccctgggac

SEQ ID NO: 317590 - DNA, 27 bp, Artificial Sequence
  Description of Artificial Sequence: Synthetic oligonucleotide
caacctgcccatcaacaccctgggaca

SEQ ID NO: 317591 - DNA, 27 bp, Artificial Sequence
  Description of Artificial Sequence: Synthetic oligonucleotide
aacctgcccatcaacaccctgggacag

SEQ ID NO: 317592 - DNA, 27 bp, Artificial Sequence
  Description of Artificial Sequence: Synthetic oligonucleotide
acctgcccatcaacaccctgggacaga

SEQ ID NO: 317593 - DNA, 26 bp, Artificial Sequence
  Description of Artificial Sequence: Synthetic oligonucleotide
cctgcccatcaacaccctgggacaga

SEQ ID NO: 317594 - DNA, 26 bp, Artificial Sequence
  Description of Artificial Sequence: Synthetic oligonucleotide
ctgcccatcaacaccctgggacagac

SEQ ID NO: 317595 - DNA, 26 bp, Artificial Sequence
  Description of Artificial Sequence: Synthetic oligonucleotide
tgcccatcaacaccctgggacagacg

SEQ ID NO: 317596 - DNA, 25 bp, Artificial Sequence
  Description of Artificial Sequence: Synthetic oligonucleotide
gcccatcaacaccctgggacagacg

SEQ ID NO: 317597 - DNA, 26 bp, Artificial Sequence
  Description of Artificial Sequence: Synthetic oligonucleotide
cccatcaacaccctgggacagacgct

SEQ ID NO: 317598 - DNA, 26 bp, Artificial Sequence
  Description of Artificial Sequence: Synthetic oligonucleotide
ccatcaacaccctgggacagacgctc

SEQ ID NO: 317599 - DNA, 26 bp, Artificial Sequence
  Description of Artificial Sequence: Synthetic oligonucleotide
catcaacaccctgggacagacgctcg

SEQ ID NO: 317600 - DNA, 27 bp, Artificial Sequence
  Description of Artificial Sequence: Synthetic oligonucleotide
atcaacaccctgggacagacgctcgga

SEQ ID NO: 317601 - DNA, 26 bp, Artificial Sequence
  Description of Artificial Sequence: Synthetic oligonucleotide
tcaacaccctgggacagacgctcgga

SEQ ID NO: 317602 - DNA, 25 bp, Artificial Sequence
  Description of Artificial Sequence: Synthetic oligonucleotide
caacaccctgggacagacgctcgga

SEQ ID NO: 317603 - DNA, 25 bp, Artificial Sequence
  Description of Artificial Sequence: Synthetic oligonucleotide
aacaccctgggacagacgctcggag

SEQ ID NO: 317604 - DNA, 24 bp, Artificial Sequence
  Description of Artificial Sequence: Synthetic oligonucleotide
acaccctgggacagacgctcggag

SEQ ID NO: 317605 - DNA, 23 bp, Artificial Sequence
  Description of Artificial Sequence: Synthetic oligonucleotide
caccctgggacagacgctcggag

SEQ ID NO: 317606 - DNA, 23 bp, Artificial Sequence
  Description of Artificial Sequence: Synthetic oligonucleotide
accctgggacagacgctcggagc

SEQ ID NO: 317607 - DNA, 22 bp, Artificial Sequence
  Description of Artificial Sequence: Synthetic oligonucleotide
ccctgggacagacgctcggagc

SEQ ID NO: 317608 - DNA, 24 bp, Artificial Sequence
  Description of Artificial Sequence: Synthetic oligonucleotide
cctgggacagacgctcggagcctt

SEQ ID NO: 317609 - DNA, 26 bp, Artificial Sequence
  Description of Artificial Sequence: Synthetic oligonucleotide
ctgggacagacgctcggagccttcat

SEQ ID NO: 317610 - DNA, 26 bp, Artificial Sequence
  Description of Artificial Sequence: Synthetic oligonucleotide
tgggacagacgctcggagccttcatg

SEQ ID NO: 317611 - DNA, 25 bp, Artificial Sequence
  Description of Artificial Sequence: Synthetic oligonucleotide
gggacagacgctcggagccttcatg

SEQ ID NO: 317612 - DNA, 25 bp, Artificial Sequence
  Description of Artificial Sequence: Synthetic oligonucleotide
ggacagacgctcggagccttcatgg

SEQ ID NO: 317613 - DNA, 26 bp, Artificial Sequence
  Description of Artificial Sequence: Synthetic oligonucleotide
gacagacgctcggagccttcatgggt

SEQ ID NO: 317614 - DNA, 26 bp, Artificial Sequence
  Description of Artificial Sequence: Synthetic oligonucleotide
acagacgctcggagccttcatgggtg

SEQ ID NO: 317615 - DNA, 25 bp, Artificial Sequence
  Description of Artificial Sequence: Synthetic oligonucleotide
cagacgctcggagccttcatgggtg

SEQ ID NO: 317616 - DNA, 26 bp, Artificial Sequence
  Description of Artificial Sequence: Synthetic oligonucleotide
agacgctcggagccttcatgggtgct

SEQ ID NO: 317617 - DNA, 25 bp, Artificial Sequence
  Description of Artificial Sequence: Synthetic oligonucleotide
gacgctcggagccttcatgggtgct

SEQ ID NO: 317618 - DNA, 25 bp, Artificial Sequence
  Description of Artificial Sequence: Synthetic oligonucleotide
acgctcggagccttcatgggtgctg

SEQ ID NO: 317619 - DNA, 24 bp, Artificial Sequence
  Description of Artificial Sequence: Synthetic oligonucleotide
cgctcggagccttcatgggtgctg

SEQ ID NO: 317620 - DNA, 27 bp, Artificial Sequence
  Description of Artificial Sequence: Synthetic oligonucleotide
gctcggagccttcatgggtgctgcaat

SEQ ID NO: 317621 - DNA, 28 bp, Artificial Sequence
  Description of Artificial Sequence: Synthetic oligonucleotide
ctcggagccttcatgggtgctgcaatag

SEQ ID NO: 317622 - DNA, 33 bp, Artificial Sequence
  Description of Artificial Sequence: Synthetic oligonucleotide
tcggagccttcatgggtgctgcaatagttttag

SEQ ID NO: 317623 - DNA, 32 bp, Artificial Sequence
  Description of Artificial Sequence: Synthetic oligonucleotide
cggagccttcatgggtgctgcaatagttttag

SEQ ID NO: 317624 - DNA, 32 bp, Artificial Sequence
  Description of Artificial Sequence: Synthetic oligonucleotide
ggagccttcatgggtgctgcaatagttttagg

SEQ ID NO: 317625 - DNA, 32 bp, Artificial Sequence
  Description of Artificial Sequence: Synthetic oligonucleotide
gagccttcatgggtgctgcaatagttttaggg

SEQ ID NO: 317626 - DNA, 32 bp, Artificial Sequence
  Description of Artificial Sequence: Synthetic oligonucleotide
agccttcatgggtgctgcaatagttttagggc

SEQ ID NO: 317627 - DNA, 31 bp, Artificial Sequence
  Description of Artificial Sequence: Synthetic oligonucleotide
gccttcatgggtgctgcaatagttttagggc

SEQ ID NO: 317628 - DNA, 32 bp, Artificial Sequence
  Description of Artificial Sequence: Synthetic oligonucleotide
ccttcatgggtgctgcaatagttttagggctg

SEQ ID NO: 317629 - DNA, 38 bp, Artificial Sequence
  Description of Artificial Sequence: Synthetic oligonucleotide
cttcatgggtgctgcaatagttttagggctgtataatg

SEQ ID NO: 317630 - DNA, 40 bp, Artificial Sequence
  Description of Artificial Sequence: Synthetic oligonucleotide
ttcatgggtgctgcaatagttttagggctgtataatgatg

SEQ ID NO: 317631 - DNA, 39 bp, Artificial Sequence
  Description of Artificial Sequence: Synthetic oligonucleotide
tcatgggtgctgcaatagttttagggctgtataatgatg

SEQ ID NO: 317632 - DNA, 38 bp, Artificial Sequence
  Description of Artificial Sequence: Synthetic oligonucleotide
catgggtgctgcaatagttttagggctgtataatgatg

SEQ ID NO: 317633 - DNA, 38 bp, Artificial Sequence
  Description of Artificial Sequence: Synthetic oligonucleotide
atgggtgctgcaatagttttagggctgtataatgatgc

SEQ ID NO: 317634 - DNA, 37 bp, Artificial Sequence
  Description of Artificial Sequence: Synthetic oligonucleotide
tgggtgctgcaatagttttagggctgtataatgatgc

SEQ ID NO: 317635 - DNA, 36 bp, Artificial Sequence
  Description of Artificial Sequence: Synthetic oligonucleotide
gggtgctgcaatagttttagggctgtataatgatgc

SEQ ID NO: 317636 - DNA, 39 bp, Artificial Sequence
  Description of Artificial Sequence: Synthetic oligonucleotide
ggtgctgcaatagttttagggctgtataatgatgcaaac

SEQ ID NO: 317637 - DNA, 40 bp, Artificial Sequence
  Description of Artificial Sequence: Synthetic oligonucleotide
gtgctgcaatagttttagggctgtataatgatgcaaactg

SEQ ID NO: 317638 - DNA, 40 bp, Artificial Sequence
  Description of Artificial Sequence: Synthetic oligonucleotide
tgctgcaatagttttagggctgtataatgatgcaaactgg

SEQ ID NO: 317639 - DNA, 39 bp, Artificial Sequence
  Description of Artificial Sequence: Synthetic oligonucleotide
gctgcaatagttttagggctgtataatgatgcaaactgg

SEQ ID NO: 317640 - DNA, 39 bp, Artificial Sequence
  Description of Artificial Sequence: Synthetic oligonucleotide
ctgcaatagttttagggctgtataatgatgcaaactggc

SEQ ID NO: 317641 - DNA, 40 bp, Artificial Sequence
  Description of Artificial Sequence: Synthetic oligonucleotide
tgcaatagttttagggctgtataatgatgcaaactggcac

SEQ ID NO: 317642 - DNA, 39 bp, Artificial Sequence
  Description of Artificial Sequence: Synthetic oligonucleotide
gcaatagttttagggctgtataatgatgcaaactggcac

SEQ ID NO: 317643 - DNA, 41 bp, Artificial Sequence
  Description of Artificial Sequence: Synthetic oligonucleotide
caatagttttagggctgtataatgatgcaaactggcacttg

SEQ ID NO: 317644 - DNA, 41 bp, Artificial Sequence
  Description of Artificial Sequence: Synthetic oligonucleotide
aatagttttagggctgtataatgatgcaaactggcacttgg

SEQ ID NO: 317645 - DNA, 40 bp, Artificial Sequence
  Description of Artificial Sequence: Synthetic oligonucleotide
atagttttagggctgtataatgatgcaaactggcacttgg

SEQ ID NO: 317646 - DNA, 39 bp, Artificial Sequence
  Description of Artificial Sequence: Synthetic oligonucleotide
tagttttagggctgtataatgatgcaaactggcacttgg

SEQ ID NO: 317647 - DNA, 38 bp, Artificial Sequence
  Description of Artificial Sequence: Synthetic oligonucleotide
agttttagggctgtataatgatgcaaactggcacttgg

SEQ ID NO: 317648 - DNA, 37 bp, Artificial Sequence
  Description of Artificial Sequence: Synthetic oligonucleotide
gttttagggctgtataatgatgcaaactggcacttgg

SEQ ID NO: 317649 - DNA, 37 bp, Artificial Sequence
  Description of Artificial Sequence: Synthetic oligonucleotide
ttttagggctgtataatgatgcaaactggcacttggc

SEQ ID NO: 317650 - DNA, 36 bp, Artificial Sequence
  Description of Artificial Sequence: Synthetic oligonucleotide
tttagggctgtataatgatgcaaactggcacttggc

SEQ ID NO: 317651 - DNA, 35 bp, Artificial Sequence
  Description of Artificial Sequence: Synthetic oligonucleotide
ttagggctgtataatgatgcaaactggcacttggc

SEQ ID NO: 317652 - DNA, 34 bp, Artificial Sequence
  Description of Artificial Sequence: Synthetic oligonucleotide
tagggctgtataatgatgcaaactggcacttggc

SEQ ID NO: 317653 - DNA, 33 bp, Artificial Sequence
  Description of Artificial Sequence: Synthetic oligonucleotide
agggctgtataatgatgcaaactggcacttggc

SEQ ID NO: 317654 - DNA, 32 bp, Artificial Sequence
  Description of Artificial Sequence: Synthetic oligonucleotide
gggctgtataatgatgcaaactggcacttggc

SEQ ID NO: 317655 - DNA, 32 bp, Artificial Sequence
  Description of Artificial Sequence: Synthetic oligonucleotide
ggctgtataatgatgcaaactggcacttggcc

SEQ ID NO: 317656 - DNA, 32 bp, Artificial Sequence
  Description of Artificial Sequence: Synthetic oligonucleotide
gctgtataatgatgcaaactggcacttggccg

SEQ ID NO: 317657 - DNA, 33 bp, Artificial Sequence
  Description of Artificial Sequence: Synthetic oligonucleotide
ctgtataatgatgcaaactggcacttggccgac

SEQ ID NO: 317658 - DNA, 35 bp, Artificial Sequence
  Description of Artificial Sequence: Synthetic oligonucleotide
tgtataatgatgcaaactggcacttggccgacaac

SEQ ID NO: 317659 - DNA, 34 bp, Artificial Sequence
  Description of Artificial Sequence: Synthetic oligonucleotide
gtataatgatgcaaactggcacttggccgacaac

SEQ ID NO: 317660 - DNA, 34 bp, Artificial Sequence
  Description of Artificial Sequence: Synthetic oligonucleotide
tataatgatgcaaactggcacttggccgacaacg

SEQ ID NO: 317661 - DNA, 33 bp, Artificial Sequence
  Description of Artificial Sequence: Synthetic oligonucleotide
ataatgatgcaaactggcacttggccgacaacg

SEQ ID NO: 317662 - DNA, 32 bp, Artificial Sequence
  Description of Artificial Sequence: Synthetic oligonucleotide
taatgatgcaaactggcacttggccgacaacg

SEQ ID NO: 317663 - DNA, 31 bp, Artificial Sequence
  Description of Artificial Sequence: Synthetic oligonucleotide
aatgatgcaaactggcacttggccgacaacg

SEQ ID NO: 317664 - DNA, 30 bp, Artificial Sequence
  Description of Artificial Sequence: Synthetic oligonucleotide
atgatgcaaactggcacttggccgacaacg

SEQ ID NO: 317665 - DNA, 29 bp, Artificial Sequence
  Description of Artificial Sequence: Synthetic oligonucleotide
tgatgcaaactggcacttggccgacaacg

SEQ ID NO: 317666 - DNA, 28 bp, Artificial Sequence
  Description of Artificial Sequence: Synthetic oligonucleotide
gatgcaaactggcacttggccgacaacg

SEQ ID NO: 317667 - DNA, 29 bp, Artificial Sequence
  Description of Artificial Sequence: Synthetic oligonucleotide
atgcaaactggcacttggccgacaacgag

SEQ ID NO: 317668 - DNA, 28 bp, Artificial Sequence
  Description of Artificial Sequence: Synthetic oligonucleotide
tgcaaactggcacttggccgacaacgag

SEQ ID NO: 317669 - DNA, 27 bp, Artificial Sequence
  Description of Artificial Sequence: Synthetic oligonucleotide
gcaaactggcacttggccgacaacgag

SEQ ID NO: 317670 - DNA, 27 bp, Artificial Sequence
  Description of Artificial Sequence: Synthetic oligonucleotide
caaactggcacttggccgacaacgagc

SEQ ID NO: 317671 - DNA, 32 bp, Artificial Sequence
  Description of Artificial Sequence: Synthetic oligonucleotide
aaactggcacttggccgacaacgagctttttg

SEQ ID NO: 317672 - DNA, 31 bp, Artificial Sequence
  Description of Artificial Sequence: Synthetic oligonucleotide
aactggcacttggccgacaacgagctttttg

SEQ ID NO: 317673 - DNA, 30 bp, Artificial Sequence
  Description of Artificial Sequence: Synthetic oligonucleotide
actggcacttggccgacaacgagctttttg

SEQ ID NO: 317674 - DNA, 29 bp, Artificial Sequence
  Description of Artificial Sequence: Synthetic oligonucleotide
ctggcacttggccgacaacgagctttttg

SEQ ID NO: 317675 - DNA, 32 bp, Artificial Sequence
  Description of Artificial Sequence: Synthetic oligonucleotide
tggcacttggccgacaacgagctttttgattc

SEQ ID NO: 317676 - DNA, 31 bp, Artificial Sequence
  Description of Artificial Sequence: Synthetic oligonucleotide
ggcacttggccgacaacgagctttttgattc

SEQ ID NO: 317677 - DNA, 31 bp, Artificial Sequence
  Description of Artificial Sequence: Synthetic oligonucleotide
gcacttggccgacaacgagctttttgattcg

SEQ ID NO: 317678 - DNA, 31 bp, Artificial Sequence
  Description of Artificial Sequence: Synthetic oligonucleotide
cacttggccgacaacgagctttttgattcgg

SEQ ID NO: 317679 - DNA, 31 bp, Artificial Sequence
  Description of Artificial Sequence: Synthetic oligonucleotide
acttggccgacaacgagctttttgattcggg

SEQ ID NO: 317680 - DNA, 30 bp, Artificial Sequence
  Description of Artificial Sequence: Synthetic oligonucleotide
cttggccgacaacgagctttttgattcggg

SEQ ID NO: 317681 - DNA, 30 bp, Artificial Sequence
  Description of Artificial Sequence: Synthetic oligonucleotide
ttggccgacaacgagctttttgattcgggc

SEQ ID NO: 317682 - DNA, 29 bp, Artificial Sequence
  Description of Artificial Sequence: Synthetic oligonucleotide
tggccgacaacgagctttttgattcgggc

SEQ ID NO: 317683 - DNA, 28 bp, Artificial Sequence
  Description of Artificial Sequence: Synthetic oligonucleotide
ggccgacaacgagctttttgattcgggc

SEQ ID NO: 317684 - DNA, 28 bp, Artificial Sequence
  Description of Artificial Sequence: Synthetic oligonucleotide
gccgacaacgagctttttgattcgggcc

SEQ ID NO: 317685 - DNA, 28 bp, Artificial Sequence
  Description of Artificial Sequence: Synthetic oligonucleotide
ccgacaacgagctttttgattcgggccc

SEQ ID NO: 317686 - DNA, 28 bp, Artificial Sequence
  Description of Artificial Sequence: Synthetic oligonucleotide
cgacaacgagctttttgattcgggcccg

SEQ ID NO: 317687 - DNA, 31 bp, Artificial Sequence
  Description of Artificial Sequence: Synthetic oligonucleotide
gacaacgagctttttgattcgggcccgaatg

SEQ ID NO: 317688 - DNA, 31 bp, Artificial Sequence
  Description of Artificial Sequence: Synthetic oligonucleotide
acaacgagctttttgattcgggcccgaatgg

SEQ ID NO: 317689 - DNA, 30 bp, Artificial Sequence
  Description of Artificial Sequence: Synthetic oligonucleotide
caacgagctttttgattcgggcccgaatgg

SEQ ID NO: 317690 - DNA, 30 bp, Artificial Sequence
  Description of Artificial Sequence: Synthetic oligonucleotide
aacgagctttttgattcgggcccgaatggc

SEQ ID NO: 317691 - DNA, 29 bp, Artificial Sequence
  Description of Artificial Sequence: Synthetic oligonucleotide
acgagctttttgattcgggcccgaatggc

SEQ ID NO: 317692 - DNA, 28 bp, Artificial Sequence
  Description of Artificial Sequence: Synthetic oligonucleotide
cgagctttttgattcgggcccgaatggc

SEQ ID NO: 317693 - DNA, 29 bp, Artificial Sequence
  Description of Artificial Sequence: Synthetic oligonucleotide
gagctttttgattcgggcccgaatggcac

SEQ ID NO: 317694 - DNA, 30 bp, Artificial Sequence
  Description of Artificial Sequence: Synthetic oligonucleotide
agctttttgattcgggcccgaatggcacac

SEQ ID NO: 317695 - DNA, 29 bp, Artificial Sequence
  Description of Artificial Sequence: Synthetic oligonucleotide
gctttttgattcgggcccgaatggcacac

SEQ ID NO: 317696 - DNA, 29 bp, Artificial Sequence
  Description of Artificial Sequence: Synthetic oligonucleotide
ctttttgattcgggcccgaatggcacacc

SEQ ID NO: 317697 - DNA, 29 bp, Artificial Sequence
  Description of Artificial Sequence: Synthetic oligonucleotide
tttttgattcgggcccgaatggcacaccc

SEQ ID NO: 317698 - DNA, 28 bp, Artificial Sequence
  Description of Artificial Sequence: Synthetic oligonucleotide
ttttgattcgggcccgaatggcacaccc

SEQ ID NO: 317699 - DNA, 27 bp, Artificial Sequence
  Description of Artificial Sequence: Synthetic oligonucleotide
tttgattcgggcccgaatggcacaccc

SEQ ID NO: 317700 - DNA, 26 bp, Artificial Sequence
  Description of Artificial Sequence: Synthetic oligonucleotide
ttgattcgggcccgaatggcacaccc

SEQ ID NO: 317701 - DNA, 25 bp, Artificial Sequence
  Description of Artificial Sequence: Synthetic oligonucleotide
tgattcgggcccgaatggcacaccc

SEQ ID NO: 317702 - DNA, 24 bp, Artificial Sequence
  Description of Artificial Sequence: Synthetic oligonucleotide
gattcgggcccgaatggcacaccc

SEQ ID NO: 317703 - DNA, 24 bp, Artificial Sequence
  Description of Artificial Sequence: Synthetic oligonucleotide
attcgggcccgaatggcacacccg

SEQ ID NO: 317704 - DNA, 23 bp, Artificial Sequence
  Description of Artificial Sequence: Synthetic oligonucleotide
ttcgggcccgaatggcacacccg

SEQ ID NO: 317705 - DNA, 22 bp, Artificial Sequence
  Description of Artificial Sequence: Synthetic oligonucleotide
tcgggcccgaatggcacacccg

SEQ ID NO: 317706 - DNA, 21 bp, Artificial Sequence
  Description of Artificial Sequence: Synthetic oligonucleotide
cgggcccgaatggcacacccg

SEQ ID NO: 317707 - DNA, 21 bp, Artificial Sequence
  Description of Artificial Sequence: Synthetic oligonucleotide
gggcccgaatggcacacccgg

SEQ ID NO: 317708 - DNA, 23 bp, Artificial Sequence
  Description of Artificial Sequence: Synthetic oligonucleotide
ggcccgaatggcacacccggcat

SEQ ID NO: 317709 - DNA, 26 bp, Artificial Sequence
  Description of Artificial Sequence: Synthetic oligonucleotide
gcccgaatggcacacccggcatctat

SEQ ID NO: 317710 - DNA, 26 bp, Artificial Sequence
  Description of Artificial Sequence: Synthetic oligonucleotide
cccgaatggcacacccggcatctatg

SEQ ID NO: 317711 - DNA, 27 bp, Artificial Sequence
  Description of Artificial Sequence: Synthetic oligonucleotide
ccgaatggcacacccggcatctatgct

SEQ ID NO: 317712 - DNA, 28 bp, Artificial Sequence
  Description of Artificial Sequence: Synthetic oligonucleotide
cgaatggcacacccggcatctatgctac

SEQ ID NO: 317713 - DNA, 28 bp, Artificial Sequence
  Description of Artificial Sequence: Synthetic oligonucleotide
gaatggcacacccggcatctatgctacc

SEQ ID NO: 317714 - DNA, 30 bp, Artificial Sequence
  Description of Artificial Sequence: Synthetic oligonucleotide
aatggcacacccggcatctatgctacctag

SEQ ID NO: 317715 - DNA, 29 bp, Artificial Sequence
  Description of Artificial Sequence: Synthetic oligonucleotide
atggcacacccggcatctatgctacctag

SEQ ID NO: 317716 - DNA, 28 bp, Artificial Sequence
  Description of Artificial Sequence: Synthetic oligonucleotide
tggcacacccggcatctatgctacctag

SEQ ID NO: 317717 - DNA, 27 bp, Artificial Sequence
  Description of Artificial Sequence: Synthetic oligonucleotide
ggcacacccggcatctatgctacctag

SEQ ID NO: 317718 - DNA, 27 bp, Artificial Sequence
  Description of Artificial Sequence: Synthetic oligonucleotide
gcacacccggcatctatgctacctagc

SEQ ID NO: 317719 - DNA, 27 bp, Artificial Sequence
  Description of Artificial Sequence: Synthetic oligonucleotide
cacacccggcatctatgctacctagcc

SEQ ID NO: 317720 - DNA, 27 bp, Artificial Sequence
  Description of Artificial Sequence: Synthetic oligonucleotide
acacccggcatctatgctacctagccc

SEQ ID NO: 317721 - DNA, 27 bp, Artificial Sequence
  Description of Artificial Sequence: Synthetic oligonucleotide
cacccggcatctatgctacctagccct

SEQ ID NO: 317722 - DNA, 27 bp, Artificial Sequence
  Description of Artificial Sequence: Synthetic oligonucleotide
acccggcatctatgctacctagccctc

SEQ ID NO: 317723 - DNA, 27 bp, Artificial Sequence
  Description of Artificial Sequence: Synthetic oligonucleotide
cccggcatctatgctacctagccctct

SEQ ID NO: 317724 - DNA, 27 bp, Artificial Sequence
  Description of Artificial Sequence: Synthetic oligonucleotide
ccggcatctatgctacctagccctctg

SEQ ID NO: 317725 - DNA, 27 bp, Artificial Sequence
  Description of Artificial Sequence: Synthetic oligonucleotide
cggcatctatgctacctagccctctgg

SEQ ID NO: 317726 - DNA, 28 bp, Artificial Sequence
  Description of Artificial Sequence: Synthetic oligonucleotide
ggcatctatgctacctagccctctggag

SEQ ID NO: 317727 - DNA, 29 bp, Artificial Sequence
  Description of Artificial Sequence: Synthetic oligonucleotide
gcatctatgctacctagccctctggagac

SEQ ID NO: 317728 - DNA, 31 bp, Artificial Sequence
  Description of Artificial Sequence: Synthetic oligonucleotide
catctatgctacctagccctctggagacttg

SEQ ID NO: 317729 - DNA, 31 bp, Artificial Sequence
  Description of Artificial Sequence: Synthetic oligonucleotide
atctatgctacctagccctctggagacttgg

SEQ ID NO: 317730 - DNA, 30 bp, Artificial Sequence
  Description of Artificial Sequence: Synthetic oligonucleotide
tctatgctacctagccctctggagacttgg

SEQ ID NO: 317731 - DNA, 29 bp, Artificial Sequence
  Description of Artificial Sequence: Synthetic oligonucleotide
ctatgctacctagccctctggagacttgg

SEQ ID NO: 317732 - DNA, 33 bp, Artificial Sequence
  Description of Artificial Sequence: Synthetic oligonucleotide
tatgctacctagccctctggagacttggataag

SEQ ID NO: 317733 - DNA, 32 bp, Artificial Sequence
  Description of Artificial Sequence: Synthetic oligonucleotide
atgctacctagccctctggagacttggataag

SEQ ID NO: 317734 - DNA, 31 bp, Artificial Sequence
  Description of Artificial Sequence: Synthetic oligonucleotide
tgctacctagccctctggagacttggataag

SEQ ID NO: 317735 - DNA, 30 bp, Artificial Sequence
  Description of Artificial Sequence: Synthetic oligonucleotide
gctacctagccctctggagacttggataag

SEQ ID NO: 317736 - DNA, 32 bp, Artificial Sequence
  Description of Artificial Sequence: Synthetic oligonucleotide
ctacctagccctctggagacttggataagatc

SEQ ID NO: 317737 - DNA, 35 bp, Artificial Sequence
  Description of Artificial Sequence: Synthetic oligonucleotide
tacctagccctctggagacttggataagatcaatg

SEQ ID NO: 317738 - DNA, 34 bp, Artificial Sequence
  Description of Artificial Sequence: Synthetic oligonucleotide
acctagccctctggagacttggataagatcaatg

SEQ ID NO: 317739 - DNA, 33 bp, Artificial Sequence
  Description of Artificial Sequence: Synthetic oligonucleotide
cctagccctctggagacttggataagatcaatg

SEQ ID NO: 317740 - DNA, 33 bp, Artificial Sequence
  Description of Artificial Sequence: Synthetic oligonucleotide
ctagccctctggagacttggataagatcaatgg

SEQ ID NO: 317741 - DNA, 33 bp, Artificial Sequence
  Description of Artificial Sequence: Synthetic oligonucleotide
tagccctctggagacttggataagatcaatggg

SEQ ID NO: 317742 - DNA, 32 bp, Artificial Sequence
  Description of Artificial Sequence: Synthetic oligonucleotide
agccctctggagacttggataagatcaatggg

SEQ ID NO: 317743 - DNA, 31 bp, Artificial Sequence
  Description of Artificial Sequence: Synthetic oligonucleotide
gccctctggagacttggataagatcaatggg

SEQ ID NO: 317744 - DNA, 33 bp, Artificial Sequence
  Description of Artificial Sequence: Synthetic oligonucleotide
ccctctggagacttggataagatcaatgggttc

SEQ ID NO: 317745 - DNA, 36 bp, Artificial Sequence
  Description of Artificial Sequence: Synthetic oligonucleotide
cctctggagacttggataagatcaatgggttctttg

SEQ ID NO: 317746 - DNA, 37 bp, Artificial Sequence
  Description of Artificial Sequence: Synthetic oligonucleotide
ctctggagacttggataagatcaatgggttctttgac

SEQ ID NO: 317747 - DNA, 37 bp, Artificial Sequence
  Description of Artificial Sequence: Synthetic oligonucleotide
tctggagacttggataagatcaatgggttctttgacg

SEQ ID NO: 317748 - DNA, 36 bp, Artificial Sequence
  Description of Artificial Sequence: Synthetic oligonucleotide
ctggagacttggataagatcaatgggttctttgacg

SEQ ID NO: 317749 - DNA, 37 bp, Artificial Sequence
  Description of Artificial Sequence: Synthetic oligonucleotide
tggagacttggataagatcaatgggttctttgacgag

SEQ ID NO: 317750 - DNA, 36 bp, Artificial Sequence
  Description of Artificial Sequence: Synthetic oligonucleotide
ggagacttggataagatcaatgggttctttgacgag

SEQ ID NO: 317751 - DNA, 38 bp, Artificial Sequence
  Description of Artificial Sequence: Synthetic oligonucleotide
gagacttggataagatcaatgggttctttgacgagttc

SEQ ID NO: 317752 - DNA, 41 bp, Artificial Sequence
  Description of Artificial Sequence: Synthetic oligonucleotide
agacttggataagatcaatgggttctttgacgagttcatag

SEQ ID NO: 317753 - DNA, 40 bp, Artificial Sequence
  Description of Artificial Sequence: Synthetic oligonucleotide
gacttggataagatcaatgggttctttgacgagttcatag

SEQ ID NO: 317754 - DNA, 40 bp, Artificial Sequence
  Description of Artificial Sequence: Synthetic oligonucleotide
acttggataagatcaatgggttctttgacgagttcatagc

SEQ ID NO: 317755 - DNA, 39 bp, Artificial Sequence
  Description of Artificial Sequence: Synthetic oligonucleotide
cttggataagatcaatgggttctttgacgagttcatagc

SEQ ID NO: 317756 - DNA, 39 bp, Artificial Sequence
  Description of Artificial Sequence: Synthetic oligonucleotide
ttggataagatcaatgggttctttgacgagttcatagcc

SEQ ID NO: 317757 - DNA, 38 bp, Artificial Sequence
  Description of Artificial Sequence: Synthetic oligonucleotide
tggataagatcaatgggttctttgacgagttcatagcc

SEQ ID NO: 317758 - DNA, 37 bp, Artificial Sequence
  Description of Artificial Sequence: Synthetic oligonucleotide
ggataagatcaatgggttctttgacgagttcatagcc

SEQ ID NO: 317759 - DNA, 38 bp, Artificial Sequence
  Description of Artificial Sequence: Synthetic oligonucleotide
gataagatcaatgggttctttgacgagttcatagccac

SEQ ID NO: 317760 - DNA, 39 bp, Artificial Sequence
  Description of Artificial Sequence: Synthetic oligonucleotide
ataagatcaatgggttctttgacgagttcatagccacag

SEQ ID NO: 317761 - DNA, 38 bp, Artificial Sequence
  Description of Artificial Sequence: Synthetic oligonucleotide
taagatcaatgggttctttgacgagttcatagccacag

SEQ ID NO: 317762 - DNA, 37 bp, Artificial Sequence
  Description of Artificial Sequence: Synthetic oligonucleotide
aagatcaatgggttctttgacgagttcatagccacag

SEQ ID NO: 317763 - DNA, 36 bp, Artificial Sequence
  Description of Artificial Sequence: Synthetic oligonucleotide
agatcaatgggttctttgacgagttcatagccacag

SEQ ID NO: 317764 - DNA, 35 bp, Artificial Sequence
  Description of Artificial Sequence: Synthetic oligonucleotide
gatcaatgggttctttgacgagttcatagccacag

SEQ ID NO: 317765 - DNA, 35 bp, Artificial Sequence
  Description of Artificial Sequence: Synthetic oligonucleotide
atcaatgggttctttgacgagttcatagccacagc

SEQ ID NO: 317766 - DNA, 34 bp, Artificial Sequence
  Description of Artificial Sequence: Synthetic oligonucleotide
tcaatgggttctttgacgagttcatagccacagc

SEQ ID NO: 317767 - DNA, 33 bp, Artificial Sequence
  Description of Artificial Sequence: Synthetic oligonucleotide
caatgggttctttgacgagttcatagccacagc

SEQ ID NO: 317768 - DNA, 33 bp, Artificial Sequence
  Description of Artificial Sequence: Synthetic oligonucleotide
aatgggttctttgacgagttcatagccacagcc

SEQ ID NO: 317769 - DNA, 32 bp, Artificial Sequence
  Description of Artificial Sequence: Synthetic oligonucleotide
atgggttctttgacgagttcatagccacagcc

SEQ ID NO: 317770 - DNA, 31 bp, Artificial Sequence
  Description of Artificial Sequence: Synthetic oligonucleotide
tgggttctttgacgagttcatagccacagcc

SEQ ID NO: 317771 - DNA, 30 bp, Artificial Sequence
  Description of Artificial Sequence: Synthetic oligonucleotide
gggttctttgacgagttcatagccacagcc

SEQ ID NO: 317772 - DNA, 31 bp, Artificial Sequence
  Description of Artificial Sequence: Synthetic oligonucleotide
ggttctttgacgagttcatagccacagcctc

SEQ ID NO: 317773 - DNA, 31 bp, Artificial Sequence
  Description of Artificial Sequence: Synthetic oligonucleotide
gttctttgacgagttcatagccacagcctcg

SEQ ID NO: 317774 - DNA, 31 bp, Artificial Sequence
  Description of Artificial Sequence: Synthetic oligonucleotide
ttctttgacgagttcatagccacagcctcgc

SEQ ID NO: 317775 - DNA, 30 bp, Artificial Sequence
  Description of Artificial Sequence: Synthetic oligonucleotide
tctttgacgagttcatagccacagcctcgc

SEQ ID NO: 317776 - DNA, 29 bp, Artificial Sequence
  Description of Artificial Sequence: Synthetic oligonucleotide
ctttgacgagttcatagccacagcctcgc

SEQ ID NO: 317777 - DNA, 33 bp, Artificial Sequence
  Description of Artificial Sequence: Synthetic oligonucleotide
tttgacgagttcatagccacagcctcgcttatc

SEQ ID NO: 317778 - DNA, 32 bp, Artificial Sequence
  Description of Artificial Sequence: Synthetic oligonucleotide
ttgacgagttcatagccacagcctcgcttatc

SEQ ID NO: 317779 - DNA, 31 bp, Artificial Sequence
  Description of Artificial Sequence: Synthetic oligonucleotide
tgacgagttcatagccacagcctcgcttatc

SEQ ID NO: 317780 - DNA, 30 bp, Artificial Sequence
  Description of Artificial Sequence: Synthetic oligonucleotide
gacgagttcatagccacagcctcgcttatc

SEQ ID NO: 317781 - DNA, 30 bp, Artificial Sequence
  Description of Artificial Sequence: Synthetic oligonucleotide
acgagttcatagccacagcctcgcttatcg

SEQ ID NO: 317782 - DNA, 29 bp, Artificial Sequence
  Description of Artificial Sequence: Synthetic oligonucleotide
cgagttcatagccacagcctcgcttatcg

SEQ ID NO: 317783 - DNA, 30 bp, Artificial Sequence
  Description of Artificial Sequence: Synthetic oligonucleotide
gagttcatagccacagcctcgcttatcgtg

SEQ ID NO: 317784 - DNA, 31 bp, Artificial Sequence
  Description of Artificial Sequence: Synthetic oligonucleotide
agttcatagccacagcctcgcttatcgtgag

SEQ ID NO: 317785 - DNA, 30 bp, Artificial Sequence
  Description of Artificial Sequence: Synthetic oligonucleotide
gttcatagccacagcctcgcttatcgtgag

SEQ ID NO: 317786 - DNA, 31 bp, Artificial Sequence
  Description of Artificial Sequence: Synthetic oligonucleotide
ttcatagccacagcctcgcttatcgtgagtg

SEQ ID NO: 317787 - DNA, 30 bp, Artificial Sequence
  Description of Artificial Sequence: Synthetic oligonucleotide
tcatagccacagcctcgcttatcgtgagtg

SEQ ID NO: 317788 - DNA, 29 bp, Artificial Sequence
  Description of Artificial Sequence: Synthetic oligonucleotide
catagccacagcctcgcttatcgtgagtg

SEQ ID NO: 317789 - DNA, 30 bp, Artificial Sequence
  Description of Artificial Sequence: Synthetic oligonucleotide
atagccacagcctcgcttatcgtgagtgtg

SEQ ID NO: 317790 - DNA, 29 bp, Artificial Sequence
  Description of Artificial Sequence: Synthetic oligonucleotide
tagccacagcctcgcttatcgtgagtgtg

SEQ ID NO: 317791 - DNA, 28 bp, Artificial Sequence
  Description of Artificial Sequence: Synthetic oligonucleotide
agccacagcctcgcttatcgtgagtgtg

SEQ ID NO: 317792 - DNA, 27 bp, Artificial Sequence
  Description of Artificial Sequence: Synthetic oligonucleotide
gccacagcctcgcttatcgtgagtgtg

SEQ ID NO: 317793 - DNA, 27 bp, Artificial Sequence
  Description of Artificial Sequence: Synthetic oligonucleotide
ccacagcctcgcttatcgtgagtgtgc

SEQ ID NO: 317794 - DNA, 28 bp, Artificial Sequence
  Description of Artificial Sequence: Synthetic oligonucleotide
cacagcctcgcttatcgtgagtgtgctg

SEQ ID NO: 317795 - DNA, 28 bp, Artificial Sequence
  Description of Artificial Sequence: Synthetic oligonucleotide
acagcctcgcttatcgtgagtgtgctgg

SEQ ID NO: 317796 - DNA, 27 bp, Artificial Sequence
  Description of Artificial Sequence: Synthetic oligonucleotide
cagcctcgcttatcgtgagtgtgctgg

SEQ ID NO: 317797 - DNA, 27 bp, Artificial Sequence
  Description of Artificial Sequence: Synthetic oligonucleotide
agcctcgcttatcgtgagtgtgctggg

SEQ ID NO: 317798 - DNA, 26 bp, Artificial Sequence
  Description of Artificial Sequence: Synthetic oligonucleotide
gcctcgcttatcgtgagtgtgctggg

SEQ ID NO: 317799 - DNA, 27 bp, Artificial Sequence
  Description of Artificial Sequence: Synthetic oligonucleotide
cctcgcttatcgtgagtgtgctgggca

SEQ ID NO: 317800 - DNA, 29 bp, Artificial Sequence
  Description of Artificial Sequence: Synthetic oligonucleotide
ctcgcttatcgtgagtgtgctgggcattg

SEQ ID NO: 317801 - DNA, 31 bp, Artificial Sequence
  Description of Artificial Sequence: Synthetic oligonucleotide
tcgcttatcgtgagtgtgctgggcattgttg

SEQ ID NO: 317802 - DNA, 30 bp, Artificial Sequence
  Description of Artificial Sequence: Synthetic oligonucleotide
cgcttatcgtgagtgtgctgggcattgttg

SEQ ID NO: 317803 - DNA, 31 bp, Artificial Sequence
  Description of Artificial Sequence: Synthetic oligonucleotide
gcttatcgtgagtgtgctgggcattgttgag

SEQ ID NO: 317804 - DNA, 31 bp, Artificial Sequence
  Description of Artificial Sequence: Synthetic oligonucleotide
cttatcgtgagtgtgctgggcattgttgagc

SEQ ID NO: 317805 - DNA, 31 bp, Artificial Sequence
  Description of Artificial Sequence: Synthetic oligonucleotide
ttatcgtgagtgtgctgggcattgttgagcc

SEQ ID NO: 317806 - DNA, 30 bp, Artificial Sequence
  Description of Artificial Sequence: Synthetic oligonucleotide
tatcgtgagtgtgctgggcattgttgagcc

SEQ ID NO: 317807 - DNA, 29 bp, Artificial Sequence
  Description of Artificial Sequence: Synthetic oligonucleotide
atcgtgagtgtgctgggcattgttgagcc

SEQ ID NO: 317808 - DNA, 28 bp, Artificial Sequence
  Description of Artificial Sequence: Synthetic oligonucleotide
tcgtgagtgtgctgggcattgttgagcc

SEQ ID NO: 317809 - DNA, 27 bp, Artificial Sequence
  Description of Artificial Sequence: Synthetic oligonucleotide
cgtgagtgtgctgggcattgttgagcc

SEQ ID NO: 317810 - DNA, 27 bp, Artificial Sequence
  Description of Artificial Sequence: Synthetic oligonucleotide
gtgagtgtgctgggcattgttgagccc

SEQ ID NO: 317811 - DNA, 29 bp, Artificial Sequence
  Description of Artificial Sequence: Synthetic oligonucleotide
tgagtgtgctgggcattgttgagccctac

SEQ ID NO: 317812 - DNA, 28 bp, Artificial Sequence
  Description of Artificial Sequence: Synthetic oligonucleotide
gagtgtgctgggcattgttgagccctac

SEQ ID NO: 317813 - DNA, 30 bp, Artificial Sequence
  Description of Artificial Sequence: Synthetic oligonucleotide
agtgtgctgggcattgttgagccctacaac

SEQ ID NO: 317814 - DNA, 29 bp, Artificial Sequence
  Description of Artificial Sequence: Synthetic oligonucleotide
gtgtgctgggcattgttgagccctacaac

SEQ ID NO: 317815 - DNA, 31 bp, Artificial Sequence
  Description of Artificial Sequence: Synthetic oligonucleotide
tgtgctgggcattgttgagccctacaactac

SEQ ID NO: 317816 - DNA, 30 bp, Artificial Sequence
  Description of Artificial Sequence: Synthetic oligonucleotide
gtgctgggcattgttgagccctacaactac

SEQ ID NO: 317817 - DNA, 30 bp, Artificial Sequence
  Description of Artificial Sequence: Synthetic oligonucleotide
tgctgggcattgttgagccctacaactacc

SEQ ID NO: 317818 - DNA, 29 bp, Artificial Sequence
  Description of Artificial Sequence: Synthetic oligonucleotide
gctgggcattgttgagccctacaactacc

SEQ ID NO: 317819 - DNA, 29 bp, Artificial Sequence
  Description of Artificial Sequence: Synthetic oligonucleotide
ctgggcattgttgagccctacaactaccc

SEQ ID NO: 317820 - DNA, 29 bp, Artificial Sequence
  Description of Artificial Sequence: Synthetic oligonucleotide
tgggcattgttgagccctacaactacccc

SEQ ID NO: 317821 - DNA, 28 bp, Artificial Sequence
  Description of Artificial Sequence: Synthetic oligonucleotide
gggcattgttgagccctacaactacccc

SEQ ID NO: 317822 - DNA, 28 bp, Artificial Sequence
  Description of Artificial Sequence: Synthetic oligonucleotide
ggcattgttgagccctacaactaccccg

SEQ ID NO: 317823 - DNA, 29 bp, Artificial Sequence
  Description of Artificial Sequence: Synthetic oligonucleotide
gcattgttgagccctacaactaccccgtc

SEQ ID NO: 317824 - DNA, 29 bp, Artificial Sequence
  Description of Artificial Sequence: Synthetic oligonucleotide
cattgttgagccctacaactaccccgtcc

SEQ ID NO: 317825 - DNA, 29 bp, Artificial Sequence
  Description of Artificial Sequence: Synthetic oligonucleotide
attgttgagccctacaactaccccgtccg

SEQ ID NO: 317826 - DNA, 28 bp, Artificial Sequence
  Description of Artificial Sequence: Synthetic oligonucleotide
ttgttgagccctacaactaccccgtccg

SEQ ID NO: 317827 - DNA, 27 bp, Artificial Sequence
  Description of Artificial Sequence: Synthetic oligonucleotide
tgttgagccctacaactaccccgtccg

SEQ ID NO: 317828 - DNA, 26 bp, Artificial Sequence
  Description of Artificial Sequence: Synthetic oligonucleotide
gttgagccctacaactaccccgtccg

SEQ ID NO: 317829 - DNA, 26 bp, Artificial Sequence
  Description of Artificial Sequence: Synthetic oligonucleotide
ttgagccctacaactaccccgtccgc

SEQ ID NO: 317830 - DNA, 25 bp, Artificial Sequence
  Description of Artificial Sequence: Synthetic oligonucleotide
tgagccctacaactaccccgtccgc

SEQ ID NO: 317831 - DNA, 24 bp, Artificial Sequence
  Description of Artificial Sequence: Synthetic oligonucleotide
gagccctacaactaccccgtccgc

SEQ ID NO: 317832 - DNA, 24 bp, Artificial Sequence
  Description of Artificial Sequence: Synthetic oligonucleotide
agccctacaactaccccgtccgcc

SEQ ID NO: 317833 - DNA, 23 bp, Artificial Sequence
  Description of Artificial Sequence: Synthetic oligonucleotide
gccctacaactaccccgtccgcc

SEQ ID NO: 317834 - DNA, 24 bp, Artificial Sequence
  Description of Artificial Sequence: Synthetic oligonucleotide
ccctacaactaccccgtccgccga

SEQ ID NO: 317835 - DNA, 24 bp, Artificial Sequence
  Description of Artificial Sequence: Synthetic oligonucleotide
cctacaactaccccgtccgccgag

SEQ ID NO: 317836 - DNA, 24 bp, Artificial Sequence
  Description of Artificial Sequence: Synthetic oligonucleotide
ctacaactaccccgtccgccgagg

SEQ ID NO: 317837 - DNA, 24 bp, Artificial Sequence
  Description of Artificial Sequence: Synthetic oligonucleotide
tacaactaccccgtccgccgaggc

SEQ ID NO: 317838 - DNA, 23 bp, Artificial Sequence
  Description of Artificial Sequence: Synthetic oligonucleotide
acaactaccccgtccgccgaggc

SEQ ID NO: 317839 - DNA, 22 bp, Artificial Sequence
  Description of Artificial Sequence: Synthetic oligonucleotide
caactaccccgtccgccgaggc

SEQ ID NO: 317840 - DNA, 23 bp, Artificial Sequence
  Description of Artificial Sequence: Synthetic oligonucleotide
aactaccccgtccgccgaggcct

SEQ ID NO: 317841 - DNA, 22 bp, Artificial Sequence
  Description of Artificial Sequence: Synthetic oligonucleotide
actaccccgtccgccgaggcct

SEQ ID NO: 317842 - DNA, 21 bp, Artificial Sequence
  Description of Artificial Sequence: Synthetic oligonucleotide
ctaccccgtccgccgaggcct

SEQ ID NO: 317843 - DNA, 21 bp, Artificial Sequence
  Description of Artificial Sequence: Synthetic oligonucleotide
taccccgtccgccgaggcctc

SEQ ID NO: 317844 - DNA, 20 bp, Artificial Sequence
  Description of Artificial Sequence: Synthetic oligonucleotide
accccgtccgccgaggcctc

SEQ ID NO: 317845 - DNA, 20 bp, Artificial Sequence
  Description of Artificial Sequence: Synthetic oligonucleotide
ccccgtccgccgaggcctct

SEQ ID NO: 317846 - DNA, 20 bp, Artificial Sequence
  Description of Artificial Sequence: Synthetic oligonucleotide
cccgtccgccgaggcctcga

SEQ ID NO: 317847 - DNA, 20 bp, Artificial Sequence
  Description of Artificial Sequence: Synthetic oligonucleotide
ccgtccgccgaggcctcgag

SEQ ID NO: 317848 - DNA, 20 bp, Artificial Sequence
  Description of Artificial Sequence: Synthetic oligonucleotide
cgtccgccgaggcctcgagg

SEQ ID NO: 317849 - DNA, 20 bp, Artificial Sequence
  Description of Artificial Sequence: Synthetic oligonucleotide
gtccgccgaggcctcgaggc

SEQ ID NO: 317850 - DNA, 22 bp, Artificial Sequence
  Description of Artificial Sequence: Synthetic oligonucleotide
tccgccgaggcctcgaggcctt

SEQ ID NO: 317851 - DNA, 21 bp, Artificial Sequence
  Description of Artificial Sequence: Synthetic oligonucleotide
ccgccgaggcctcgaggcctt

SEQ ID NO: 317852 - DNA, 22 bp, Artificial Sequence
  Description of Artificial Sequence: Synthetic oligonucleotide
cgccgaggcctcgaggccttct

SEQ ID NO: 317853 - DNA, 22 bp, Artificial Sequence
  Description of Artificial Sequence: Synthetic oligonucleotide
gccgaggcctcgaggccttctc

SEQ ID NO: 317854 - DNA, 22 bp, Artificial Sequence
  Description of Artificial Sequence: Synthetic oligonucleotide
ccgaggcctcgaggccttctcc

SEQ ID NO: 317855 - DNA, 23 bp, Artificial Sequence
  Description of Artificial Sequence: Synthetic oligonucleotide
cgaggcctcgaggccttctccgt

SEQ ID NO: 317856 - DNA, 23 bp, Artificial Sequence
  Description of Artificial Sequence: Synthetic oligonucleotide
gaggcctcgaggccttctccgtg

SEQ ID NO: 317857 - DNA, 23 bp, Artificial Sequence
  Description of Artificial Sequence: Synthetic oligonucleotide
aggcctcgaggccttctccgtgg

SEQ ID NO: 317858 - DNA, 22 bp, Artificial Sequence
  Description of Artificial Sequence: Synthetic oligonucleotide
ggcctcgaggccttctccgtgg

SEQ ID NO: 317859 - DNA, 22 bp, Artificial Sequence
  Description of Artificial Sequence: Synthetic oligonucleotide
gcctcgaggccttctccgtggg

SEQ ID NO: 317860 - DNA, 22 bp, Artificial Sequence
  Description of Artificial Sequence: Synthetic oligonucleotide
cctcgaggccttctccgtgggc

SEQ ID NO: 317861 - DNA, 23 bp, Artificial Sequence
  Description of Artificial Sequence: Synthetic oligonucleotide
ctcgaggccttctccgtgggcca

SEQ ID NO: 317862 - DNA, 23 bp, Artificial Sequence
  Description of Artificial Sequence: Synthetic oligonucleotide
tcgaggccttctccgtgggccag

SEQ ID NO: 317863 - DNA, 22 bp, Artificial Sequence
  Description of Artificial Sequence: Synthetic oligonucleotide
cgaggccttctccgtgggccag

SEQ ID NO: 317864 - DNA, 23 bp, Artificial Sequence
  Description of Artificial Sequence: Synthetic oligonucleotide
gaggccttctccgtgggccaggt

SEQ ID NO: 317865 - DNA, 23 bp, Artificial Sequence
  Description of Artificial Sequence: Synthetic oligonucleotide
aggccttctccgtgggccaggtg

SEQ ID NO: 317866 - DNA, 22 bp, Artificial Sequence
  Description of Artificial Sequence: Synthetic oligonucleotide
ggccttctccgtgggccaggtg

SEQ ID NO: 317867 - DNA, 23 bp, Artificial Sequence
  Description of Artificial Sequence: Synthetic oligonucleotide
gccttctccgtgggccaggtggt

SEQ ID NO: 317868 - DNA, 23 bp, Artificial Sequence
  Description of Artificial Sequence: Synthetic oligonucleotide
ccttctccgtgggccaggtggtc

SEQ ID NO: 317869 - DNA, 24 bp, Artificial Sequence
  Description of Artificial Sequence: Synthetic oligonucleotide
cttctccgtgggccaggtggtcct

SEQ ID NO: 317870 - DNA, 24 bp, Artificial Sequence
  Description of Artificial Sequence: Synthetic oligonucleotide
ttctccgtgggccaggtggtcctc

SEQ ID NO: 317871 - DNA, 23 bp, Artificial Sequence
  Description of Artificial Sequence: Synthetic oligonucleotide
tctccgtgggccaggtggtcctc

SEQ ID NO: 317872 - DNA, 22 bp, Artificial Sequence
  Description of Artificial Sequence: Synthetic oligonucleotide
ctccgtgggccaggtggtcctc

SEQ ID NO: 317873 - DNA, 23 bp, Artificial Sequence
  Description of Artificial Sequence: Synthetic oligonucleotide
tccgtgggccaggtggtcctcgt

SEQ ID NO: 317874 - DNA, 22 bp, Artificial Sequence
  Description of Artificial Sequence: Synthetic oligonucleotide
ccgtgggccaggtggtcctcgt

SEQ ID NO: 317875 - DNA, 25 bp, Artificial Sequence
  Description of Artificial Sequence: Synthetic oligonucleotide
cgtgggccaggtggtcctcgtcatt

SEQ ID NO: 317876 - DNA, 25 bp, Artificial Sequence
  Description of Artificial Sequence: Synthetic oligonucleotide
gtgggccaggtggtcctcgtcattg

SEQ ID NO: 317877 - DNA, 25 bp, Artificial Sequence
  Description of Artificial Sequence: Synthetic oligonucleotide
tgggccaggtggtcctcgtcattgg

SEQ ID NO: 317878 - DNA, 24 bp, Artificial Sequence
  Description of Artificial Sequence: Synthetic oligonucleotide
gggccaggtggtcctcgtcattgg

SEQ ID NO: 317879 - DNA, 25 bp, Artificial Sequence
  Description of Artificial Sequence: Synthetic oligonucleotide
ggccaggtggtcctcgtcattggct

SEQ ID NO: 317880 - DNA, 25 bp, Artificial Sequence
  Description of Artificial Sequence: Synthetic oligonucleotide
gccaggtggtcctcgtcattggctc

SEQ ID NO: 317881 - DNA, 26 bp, Artificial Sequence
  Description of Artificial Sequence: Synthetic oligonucleotide
ccaggtggtcctcgtcattggctcct

SEQ ID NO: 317882 - DNA, 26 bp, Artificial Sequence
  Description of Artificial Sequence: Synthetic oligonucleotide
caggtggtcctcgtcattggctcctc

SEQ ID NO: 317883 - DNA, 27 bp, Artificial Sequence
  Description of Artificial Sequence: Synthetic oligonucleotide
aggtggtcctcgtcattggctcctcca

SEQ ID NO: 317884 - DNA, 27 bp, Artificial Sequence
  Description of Artificial Sequence: Synthetic oligonucleotide
ggtggtcctcgtcattggctcctccat

SEQ ID NO: 317885 - DNA, 27 bp, Artificial Sequence
  Description of Artificial Sequence: Synthetic oligonucleotide
gtggtcctcgtcattggctcctccatg

SEQ ID NO: 317886 - DNA, 27 bp, Artificial Sequence
  Description of Artificial Sequence: Synthetic oligonucleotide
tggtcctcgtcattggctcctccatgg

SEQ ID NO: 317887 - DNA, 26 bp, Artificial Sequence
  Description of Artificial Sequence: Synthetic oligonucleotide
ggtcctcgtcattggctcctccatgg

SEQ ID NO: 317888 - DNA, 26 bp, Artificial Sequence
  Description of Artificial Sequence: Synthetic oligonucleotide
gtcctcgtcattggctcctccatggc

SEQ ID NO: 317889 - DNA, 27 bp, Artificial Sequence
  Description of Artificial Sequence: Synthetic oligonucleotide
tcctcgtcattggctcctccatggcct

SEQ ID NO: 317890 - DNA, 27 bp, Artificial Sequence
  Description of Artificial Sequence: Synthetic oligonucleotide
cctcgtcattggctcctccatggcctt

SEQ ID NO: 317891 - DNA, 27 bp, Artificial Sequence
  Description of Artificial Sequence: Synthetic oligonucleotide
ctcgtcattggctcctccatggccttc

SEQ ID NO: 317892 - DNA, 29 bp, Artificial Sequence
  Description of Artificial Sequence: Synthetic oligonucleotide
tcgtcattggctcctccatggccttcaac

SEQ ID NO: 317893 - DNA, 28 bp, Artificial Sequence
  Description of Artificial Sequence: Synthetic oligonucleotide
cgtcattggctcctccatggccttcaac

SEQ ID NO: 317894 - DNA, 29 bp, Artificial Sequence
  Description of Artificial Sequence: Synthetic oligonucleotide
gtcattggctcctccatggccttcaactc

SEQ ID NO: 317895 - DNA, 29 bp, Artificial Sequence
  Description of Artificial Sequence: Synthetic oligonucleotide
tcattggctcctccatggccttcaactcg

SEQ ID NO: 317896 - DNA, 28 bp, Artificial Sequence
  Description of Artificial Sequence: Synthetic oligonucleotide
cattggctcctccatggccttcaactcg

SEQ ID NO: 317897 - DNA, 28 bp, Artificial Sequence
  Description of Artificial Sequence: Synthetic oligonucleotide
attggctcctccatggccttcaactcgg

SEQ ID NO: 317898 - DNA, 27 bp, Artificial Sequence
  Description of Artificial Sequence: Synthetic oligonucleotide
ttggctcctccatggccttcaactcgg

SEQ ID NO: 317899 - DNA, 26 bp, Artificial Sequence
  Description of Artificial Sequence: Synthetic oligonucleotide
tggctcctccatggccttcaactcgg

SEQ ID NO: 317900 - DNA, 25 bp, Artificial Sequence
  Description of Artificial Sequence: Synthetic oligonucleotide
ggctcctccatggccttcaactcgg

SEQ ID NO: 317901 - DNA, 25 bp, Artificial Sequence
  Description of Artificial Sequence: Synthetic oligonucleotide
gctcctccatggccttcaactcggg

SEQ ID NO: 317902 - DNA, 27 bp, Artificial Sequence
  Description of Artificial Sequence: Synthetic oligonucleotide
ctcctccatggccttcaactcgggcta

SEQ ID NO: 317903 - DNA, 28 bp, Artificial Sequence
  Description of Artificial Sequence: Synthetic oligonucleotide
tcctccatggccttcaactcgggctatg

SEQ ID NO: 317904 - DNA, 27 bp, Artificial Sequence
  Description of Artificial Sequence: Synthetic oligonucleotide
cctccatggccttcaactcgggctatg

SEQ ID NO: 317905 - DNA, 27 bp, Artificial Sequence
  Description of Artificial Sequence: Synthetic oligonucleotide
ctccatggccttcaactcgggctatgc

SEQ ID NO: 317906 - DNA, 27 bp, Artificial Sequence
  Description of Artificial Sequence: Synthetic oligonucleotide
tccatggccttcaactcgggctatgcc

SEQ ID NO: 317907 - DNA, 26 bp, Artificial Sequence
  Description of Artificial Sequence: Synthetic oligonucleotide
ccatggccttcaactcgggctatgcc

SEQ ID NO: 317908 - DNA, 27 bp, Artificial Sequence
  Description of Artificial Sequence: Synthetic oligonucleotide
catggccttcaactcgggctatgccct

SEQ ID NO: 317909 - DNA, 27 bp, Artificial Sequence
  Description of Artificial Sequence: Synthetic oligonucleotide
atggccttcaactcgggctatgccctc

SEQ ID NO: 317910 - DNA, 27 bp, Artificial Sequence
  Description of Artificial Sequence: Synthetic oligonucleotide
tggccttcaactcgggctatgccctca

SEQ ID NO: 317911 - DNA, 27 bp, Artificial Sequence
  Description of Artificial Sequence: Synthetic oligonucleotide
ggccttcaactcgggctatgccctcaa

SEQ ID NO: 317912 - DNA, 27 bp, Artificial Sequence
  Description of Artificial Sequence: Synthetic oligonucleotide
gccttcaactcgggctatgccctcaac

SEQ ID NO: 317913 - DNA, 27 bp, Artificial Sequence
  Description of Artificial Sequence: Synthetic oligonucleotide
ccttcaactcgggctatgccctcaacc

SEQ ID NO: 317914 - DNA, 27 bp, Artificial Sequence
  Description of Artificial Sequence: Synthetic oligonucleotide
cttcaactcgggctatgccctcaaccc

SEQ ID NO: 317915 - DNA, 28 bp, Artificial Sequence
  Description of Artificial Sequence: Synthetic oligonucleotide
ttcaactcgggctatgccctcaaccctg

SEQ ID NO: 317916 - DNA, 27 bp, Artificial Sequence
  Description of Artificial Sequence: Synthetic oligonucleotide
tcaactcgggctatgccctcaaccctg

SEQ ID NO: 317917 - DNA, 26 bp, Artificial Sequence
  Description of Artificial Sequence: Synthetic oligonucleotide
caactcgggctatgccctcaaccctg

SEQ ID NO: 317918 - DNA, 26 bp, Artificial Sequence
  Description of Artificial Sequence: Synthetic oligonucleotide
aactcgggctatgccctcaaccctgg

SEQ ID NO: 317919 - DNA, 25 bp, Artificial Sequence
  Description of Artificial Sequence: Synthetic oligonucleotide
actcgggctatgccctcaaccctgg

SEQ ID NO: 317920 - DNA, 24 bp, Artificial Sequence
  Description of Artificial Sequence: Synthetic oligonucleotide
ctcgggctatgccctcaaccctgg

SEQ ID NO: 317921 - DNA, 24 bp, Artificial Sequence
  Description of Artificial Sequence: Synthetic oligonucleotide
tcgggctatgccctcaaccctggc

SEQ ID NO: 317922 - DNA, 23 bp, Artificial Sequence
  Description of Artificial Sequence: Synthetic oligonucleotide
cgggctatgccctcaaccctggc

SEQ ID NO: 317923 - DNA, 23 bp, Artificial Sequence
  Description of Artificial Sequence: Synthetic oligonucleotide
gggctatgccctcaaccctggcc

SEQ ID NO: 317924 - DNA, 23 bp, Artificial Sequence
  Description of Artificial Sequence: Synthetic oligonucleotide
ggctatgccctcaaccctggccg

SEQ ID NO: 317925 - DNA, 23 bp, Artificial Sequence
  Description of Artificial Sequence: Synthetic oligonucleotide
gctatgccctcaaccctggccgg

SEQ ID NO: 317926 - DNA, 24 bp, Artificial Sequence
  Description of Artificial Sequence: Synthetic oligonucleotide
ctatgccctcaaccctggccggga

SEQ ID NO: 317927 - DNA, 27 bp, Artificial Sequence
  Description of Artificial Sequence: Synthetic oligonucleotide
tatgccctcaaccctggccgggactta

SEQ ID NO: 317928 - DNA, 26 bp, Artificial Sequence
  Description of Artificial Sequence: Synthetic oligonucleotide
atgccctcaaccctggccgggactta

SEQ ID NO: 317929 - DNA, 25 bp, Artificial Sequence
  Description of Artificial Sequence: Synthetic oligonucleotide
tgccctcaaccctggccgggactta

SEQ ID NO: 317930 - DNA, 24 bp, Artificial Sequence
  Description of Artificial Sequence: Synthetic oligonucleotide
gccctcaaccctggccgggactta

SEQ ID NO: 317931 - DNA, 24 bp, Artificial Sequence
  Description of Artificial Sequence: Synthetic oligonucleotide
ccctcaaccctggccgggacttag

SEQ ID NO: 317932 - DNA, 24 bp, Artificial Sequence
  Description of Artificial Sequence: Synthetic oligonucleotide
cctcaaccctggccgggacttagg

SEQ ID NO: 317933 - DNA, 24 bp, Artificial Sequence
  Description of Artificial Sequence: Synthetic oligonucleotide
ctcaaccctggccgggacttaggc

SEQ ID NO: 317934 - DNA, 24 bp, Artificial Sequence
  Description of Artificial Sequence: Synthetic oligonucleotide
tcaaccctggccgggacttaggcc

SEQ ID NO: 317935 - DNA, 23 bp, Artificial Sequence
  Description of Artificial Sequence: Synthetic oligonucleotide
caaccctggccgggacttaggcc

SEQ ID NO: 317936 - DNA, 23 bp, Artificial Sequence
  Description of Artificial Sequence: Synthetic oligonucleotide
aaccctggccgggacttaggccc

SEQ ID NO: 317937 - DNA, 22 bp, Artificial Sequence
  Description of Artificial Sequence: Synthetic oligonucleotide
accctggccgggacttaggccc

SEQ ID NO: 317938 - DNA, 21 bp, Artificial Sequence
  Description of Artificial Sequence: Synthetic oligonucleotide
ccctggccgggacttaggccc

SEQ ID NO: 317939 - DNA, 21 bp, Artificial Sequence
  Description of Artificial Sequence: Synthetic oligonucleotide
cctggccgggacttaggcccc

SEQ ID NO: 317940 - DNA, 21 bp, Artificial Sequence
  Description of Artificial Sequence: Synthetic oligonucleotide
ctggccgggacttaggccccc

SEQ ID NO: 317941 - DNA, 21 bp, Artificial Sequence
  Description of Artificial Sequence: Synthetic oligonucleotide
tggccgggacttaggcccccg

SEQ ID NO: 317942 - DNA, 20 bp, Artificial Sequence
  Description of Artificial Sequence: Synthetic oligonucleotide
ggccgggacttaggcccccg

SEQ ID NO: 317943 - DNA, 20 bp, Artificial Sequence
  Description of Artificial Sequence: Synthetic oligonucleotide
gccgggacttaggcccccgc

SEQ ID NO: 317944 - DNA, 26 bp, Artificial Sequence
  Description of Artificial Sequence: Synthetic oligonucleotide
ccgggacttaggcccccgcgttttta

SEQ ID NO: 317945 - DNA, 27 bp, Artificial Sequence
  Description of Artificial Sequence: Synthetic oligonucleotide
cgggacttaggcccccgcgtttttaca

SEQ ID NO: 317946 - DNA, 27 bp, Artificial Sequence
  Description of Artificial Sequence: Synthetic oligonucleotide
gggacttaggcccccgcgtttttacag

SEQ ID NO: 317947 - DNA, 27 bp, Artificial Sequence
  Description of Artificial Sequence: Synthetic oligonucleotide
ggacttaggcccccgcgtttttacagg

SEQ ID NO: 317948 - DNA, 27 bp, Artificial Sequence
  Description of Artificial Sequence: Synthetic oligonucleotide
gacttaggcccccgcgtttttacaggc

SEQ ID NO: 317949 - DNA, 27 bp, Artificial Sequence
  Description of Artificial Sequence: Synthetic oligonucleotide
acttaggcccccgcgtttttacaggcc

SEQ ID NO: 317950 - DNA, 27 bp, Artificial Sequence
  Description of Artificial Sequence: Synthetic oligonucleotide
cttaggcccccgcgtttttacaggcct

SEQ ID NO: 317951 - DNA, 28 bp, Artificial Sequence
  Description of Artificial Sequence: Synthetic oligonucleotide
ttaggcccccgcgtttttacaggccttg

SEQ ID NO: 317952 - DNA, 27 bp, Artificial Sequence
  Description of Artificial Sequence: Synthetic oligonucleotide
taggcccccgcgtttttacaggccttg

SEQ ID NO: 317953 - DNA, 26 bp, Artificial Sequence
  Description of Artificial Sequence: Synthetic oligonucleotide
aggcccccgcgtttttacaggccttg

SEQ ID NO: 317954 - DNA, 25 bp, Artificial Sequence
  Description of Artificial Sequence: Synthetic oligonucleotide
ggcccccgcgtttttacaggccttg

SEQ ID NO: 317955 - DNA, 25 bp, Artificial Sequence
  Description of Artificial Sequence: Synthetic oligonucleotide
gcccccgcgtttttacaggccttgc

SEQ ID NO: 317956 - DNA, 25 bp, Artificial Sequence
  Description of Artificial Sequence: Synthetic oligonucleotide
cccccgcgtttttacaggccttgcg

SEQ ID NO: 317957 - DNA, 25 bp, Artificial Sequence
  Description of Artificial Sequence: Synthetic oligonucleotide
ccccgcgtttttacaggccttgcgg

SEQ ID NO: 317958 - DNA, 25 bp, Artificial Sequence
  Description of Artificial Sequence: Synthetic oligonucleotide
cccgcgtttttacaggccttgcggg

SEQ ID NO: 317959 - DNA, 26 bp, Artificial Sequence
  Description of Artificial Sequence: Synthetic oligonucleotide
ccgcgtttttacaggccttgcggggt

SEQ ID NO: 317960 - DNA, 26 bp, Artificial Sequence
  Description of Artificial Sequence: Synthetic oligonucleotide
cgcgtttttacaggccttgcggggtg

SEQ ID NO: 317961 - DNA, 26 bp, Artificial Sequence
  Description of Artificial Sequence: Synthetic oligonucleotide
gcgtttttacaggccttgcggggtgg

SEQ ID NO: 317962 - DNA, 26 bp, Artificial Sequence
  Description of Artificial Sequence: Synthetic oligonucleotide
cgtttttacaggccttgcggggtggg

SEQ ID NO: 317963 - DNA, 26 bp, Artificial Sequence
  Description of Artificial Sequence: Synthetic oligonucleotide
gtttttacaggccttgcggggtgggg

SEQ ID NO: 317964 - DNA, 27 bp, Artificial Sequence
  Description of Artificial Sequence: Synthetic oligonucleotide
tttttacaggccttgcggggtggggct

SEQ ID NO: 317965 - DNA, 26 bp, Artificial Sequence
  Description of Artificial Sequence: Synthetic oligonucleotide
ttttacaggccttgcggggtggggct

SEQ ID NO: 317966 - DNA, 25 bp, Artificial Sequence
  Description of Artificial Sequence: Synthetic oligonucleotide
tttacaggccttgcggggtggggct

SEQ ID NO: 317967 - DNA, 24 bp, Artificial Sequence
  Description of Artificial Sequence: Synthetic oligonucleotide
ttacaggccttgcggggtggggct

SEQ ID NO: 317968 - DNA, 23 bp, Artificial Sequence
  Description of Artificial Sequence: Synthetic oligonucleotide
tacaggccttgcggggtggggct

SEQ ID NO: 317969 - DNA, 22 bp, Artificial Sequence
  Description of Artificial Sequence: Synthetic oligonucleotide
acaggccttgcggggtggggct

SEQ ID NO: 317970 - DNA, 21 bp, Artificial Sequence
  Description of Artificial Sequence: Synthetic oligonucleotide
caggccttgcggggtggggct

SEQ ID NO: 317971 - DNA, 22 bp, Artificial Sequence
  Description of Artificial Sequence: Synthetic oligonucleotide
aggccttgcggggtggggctct

SEQ ID NO: 317972 - DNA, 21 bp, Artificial Sequence
  Description of Artificial Sequence: Synthetic oligonucleotide
ggccttgcggggtggggctct

SEQ ID NO: 317973 - DNA, 21 bp, Artificial Sequence
  Description of Artificial Sequence: Synthetic oligonucleotide
gccttgcggggtggggctctc

SEQ ID NO: 317974 - DNA, 22 bp, Artificial Sequence
  Description of Artificial Sequence: Synthetic oligonucleotide
ccttgcggggtggggctctcca

SEQ ID NO: 317975 - DNA, 23 bp, Artificial Sequence
  Description of Artificial Sequence: Synthetic oligonucleotide
cttgcggggtggggctctccagt

SEQ ID NO: 317976 - DNA, 25 bp, Artificial Sequence
  Description of Artificial Sequence: Synthetic oligonucleotide
ttgcggggtggggctctccagtctt

SEQ ID NO: 317977 - DNA, 24 bp, Artificial Sequence
  Description of Artificial Sequence: Synthetic oligonucleotide
tgcggggtggggctctccagtctt

SEQ ID NO: 317978 - DNA, 23 bp, Artificial Sequence
  Description of Artificial Sequence: Synthetic oligonucleotide
gcggggtggggctctccagtctt

SEQ ID NO: 317979 - DNA, 24 bp, Artificial Sequence
  Description of Artificial Sequence: Synthetic oligonucleotide
cggggtggggctctccagtcttca

SEQ ID NO: 317980 - DNA, 24 bp, Artificial Sequence
  Description of Artificial Sequence: Synthetic oligonucleotide
ggggtggggctctccagtcttcag

SEQ ID NO: 317981 - DNA, 25 bp, Artificial Sequence
  Description of Artificial Sequence: Synthetic oligonucleotide
gggtggggctctccagtcttcagga

SEQ ID NO: 317982 - DNA, 25 bp, Artificial Sequence
  Description of Artificial Sequence: Synthetic oligonucleotide
ggtggggctctccagtcttcaggac

SEQ ID NO: 317983 - DNA, 25 bp, Artificial Sequence
  Description of Artificial Sequence: Synthetic oligonucleotide
gtggggctctccagtcttcaggacc

SEQ ID NO: 317984 - DNA, 25 bp, Artificial Sequence
  Description of Artificial Sequence: Synthetic oligonucleotide
tggggctctccagtcttcaggaccg

SEQ ID NO: 317985 - DNA, 24 bp, Artificial Sequence
  Description of Artificial Sequence: Synthetic oligonucleotide
ggggctctccagtcttcaggaccg

SEQ ID NO: 317986 - DNA, 24 bp, Artificial Sequence
  Description of Artificial Sequence: Synthetic oligonucleotide
gggctctccagtcttcaggaccgg

SEQ ID NO: 317987 - DNA, 24 bp, Artificial Sequence
  Description of Artificial Sequence: Synthetic oligonucleotide
ggctctccagtcttcaggaccggc

SEQ ID NO: 317988 - DNA, 25 bp, Artificial Sequence
  Description of Artificial Sequence: Synthetic oligonucleotide
gctctccagtcttcaggaccggcca

SEQ ID NO: 317989 - DNA, 25 bp, Artificial Sequence
  Description of Artificial Sequence: Synthetic oligonucleotide
ctctccagtcttcaggaccggccac

SEQ ID NO: 317990 - DNA, 27 bp, Artificial Sequence
  Description of Artificial Sequence: Synthetic oligonucleotide
tctccagtcttcaggaccggccaccat

SEQ ID NO: 317991 - DNA, 27 bp, Artificial Sequence
  Description of Artificial Sequence: Synthetic oligonucleotide
ctccagtcttcaggaccggccaccatt

SEQ ID NO: 317992 - DNA, 27 bp, Artificial Sequence
  Description of Artificial Sequence: Synthetic oligonucleotide
tccagtcttcaggaccggccaccattg

SEQ ID NO: 317993 - DNA, 26 bp, Artificial Sequence
  Description of Artificial Sequence: Synthetic oligonucleotide
ccagtcttcaggaccggccaccattg

SEQ ID NO: 317994 - DNA, 27 bp, Artificial Sequence
  Description of Artificial Sequence: Synthetic oligonucleotide
cagtcttcaggaccggccaccattggt

SEQ ID NO: 317995 - DNA, 27 bp, Artificial Sequence
  Description of Artificial Sequence: Synthetic oligonucleotide
agtcttcaggaccggccaccattggtg

SEQ ID NO: 317996 - DNA, 26 bp, Artificial Sequence
  Description of Artificial Sequence: Synthetic oligonucleotide
gtcttcaggaccggccaccattggtg

SEQ ID NO: 317997 - DNA, 27 bp, Artificial Sequence
  Description of Artificial Sequence: Synthetic oligonucleotide
tcttcaggaccggccaccattggtgga

SEQ ID NO: 317998 - DNA, 26 bp, Artificial Sequence
  Description of Artificial Sequence: Synthetic oligonucleotide
cttcaggaccggccaccattggtgga

SEQ ID NO: 317999 - DNA, 26 bp, Artificial Sequence
  Description of Artificial Sequence: Synthetic oligonucleotide
ttcaggaccggccaccattggtggag

SEQ ID NO: 318000 - DNA, 25 bp, Artificial Sequence
  Description of Artificial Sequence: Synthetic oligonucleotide
tcaggaccggccaccattggtggag

SEQ ID NO: 318001 - DNA, 24 bp, Artificial Sequence
  Description of Artificial Sequence: Synthetic oligonucleotide
caggaccggccaccattggtggag

SEQ ID NO: 318002 - DNA, 24 bp, Artificial Sequence
  Description of Artificial Sequence: Synthetic oligonucleotide
aggaccggccaccattggtggagg

SEQ ID NO: 318003 - DNA, 23 bp, Artificial Sequence
  Description of Artificial Sequence: Synthetic oligonucleotide
ggaccggccaccattggtggagg

SEQ ID NO: 318004 - DNA, 24 bp, Artificial Sequence
  Description of Artificial Sequence: Synthetic oligonucleotide
gaccggccaccattggtggagggt

SEQ ID NO: 318005 - DNA, 24 bp, Artificial Sequence
  Description of Artificial Sequence: Synthetic oligonucleotide
accggccaccattggtggagggtg

SEQ ID NO: 318006 - DNA, 23 bp, Artificial Sequence
  Description of Artificial Sequence: Synthetic oligonucleotide
ccggccaccattggtggagggtg

SEQ ID NO: 318007 - DNA, 23 bp, Artificial Sequence
  Description of Artificial Sequence: Synthetic oligonucleotide
cggccaccattggtggagggtgc

SEQ ID NO: 318008 - DNA, 23 bp, Artificial Sequence
  Description of Artificial Sequence: Synthetic oligonucleotide
ggccaccattggtggagggtgcc

SEQ ID NO: 318009 - DNA, 25 bp, Artificial Sequence
  Description of Artificial Sequence: Synthetic oligonucleotide
gccaccattggtggagggtgcccaa

SEQ ID NO: 318010 - DNA, 25 bp, Artificial Sequence
  Description of Artificial Sequence: Synthetic oligonucleotide
ccaccattggtggagggtgcccaac

SEQ ID NO: 318011 - DNA, 26 bp, Artificial Sequence
  Description of Artificial Sequence: Synthetic oligonucleotide
caccattggtggagggtgcccaacgt

SEQ ID NO: 318012 - DNA, 27 bp, Artificial Sequence
  Description of Artificial Sequence: Synthetic oligonucleotide
accattggtggagggtgcccaacgtgt

SEQ ID NO: 318013 - DNA, 26 bp, Artificial Sequence
  Description of Artificial Sequence: Synthetic oligonucleotide
ccattggtggagggtgcccaacgtgt

SEQ ID NO: 318014 - DNA, 26 bp, Artificial Sequence
  Description of Artificial Sequence: Synthetic oligonucleotide
cattggtggagggtgcccaacgtgtc

SEQ ID NO: 318015 - DNA, 26 bp, Artificial Sequence
  Description of Artificial Sequence: Synthetic oligonucleotide
attggtggagggtgcccaacgtgtcc

SEQ ID NO: 318016 - DNA, 25 bp, Artificial Sequence
  Description of Artificial Sequence: Synthetic oligonucleotide
ttggtggagggtgcccaacgtgtcc

SEQ ID NO: 318017 - DNA, 24 bp, Artificial Sequence
  Description of Artificial Sequence: Synthetic oligonucleotide
tggtggagggtgcccaacgtgtcc

SEQ ID NO: 318018 - DNA, 23 bp, Artificial Sequence
  Description of Artificial Sequence: Synthetic oligonucleotide
ggtggagggtgcccaacgtgtcc

SEQ ID NO: 318019 - DNA, 23 bp, Artificial Sequence
  Description of Artificial Sequence: Synthetic oligonucleotide
gtggagggtgcccaacgtgtccc

SEQ ID NO: 318020 - DNA, 24 bp, Artificial Sequence
  Description of Artificial Sequence: Synthetic oligonucleotide
tggagggtgcccaacgtgtcccct

SEQ ID NO: 318021 - DNA, 23 bp, Artificial Sequence
  Description of Artificial Sequence: Synthetic oligonucleotide
ggagggtgcccaacgtgtcccct

SEQ ID NO: 318022 - DNA, 24 bp, Artificial Sequence
  Description of Artificial Sequence: Synthetic oligonucleotide
gagggtgcccaacgtgtcccctct

SEQ ID NO: 318023 - DNA, 24 bp, Artificial Sequence
  Description of Artificial Sequence: Synthetic oligonucleotide
agggtgcccaacgtgtcccctctc

SEQ ID NO: 318024 - DNA, 23 bp, Artificial Sequence
  Description of Artificial Sequence: Synthetic oligonucleotide
gggtgcccaacgtgtcccctctc

SEQ ID NO: 318025 - DNA, 24 bp, Artificial Sequence
  Description of Artificial Sequence: Synthetic oligonucleotide
ggtgcccaacgtgtcccctctcct

SEQ ID NO: 318026 - DNA, 24 bp, Artificial Sequence
  Description of Artificial Sequence: Synthetic oligonucleotide
gtgcccaacgtgtcccctctcctg

SEQ ID NO: 318027 - DNA, 24 bp, Artificial Sequence
  Description of Artificial Sequence: Synthetic oligonucleotide
tgcccaacgtgtcccctctcctgg

SEQ ID NO: 318028 - DNA, 23 bp, Artificial Sequence
  Description of Artificial Sequence: Synthetic oligonucleotide
gcccaacgtgtcccctctcctgg

SEQ ID NO: 318029 - DNA, 23 bp, Artificial Sequence
  Description of Artificial Sequence: Synthetic oligonucleotide
cccaacgtgtcccctctcctggg

SEQ ID NO: 318030 - DNA, 24 bp, Artificial Sequence
  Description of Artificial Sequence: Synthetic oligonucleotide
ccaacgtgtcccctctcctgggca

SEQ ID NO: 318031 - DNA, 24 bp, Artificial Sequence
  Description of Artificial Sequence: Synthetic oligonucleotide
caacgtgtcccctctcctgggcac

SEQ ID NO: 318032 - DNA, 27 bp, Artificial Sequence
  Description of Artificial Sequence: Synthetic oligonucleotide
aacgtgtcccctctcctgggcaccatt

SEQ ID NO: 318033 - DNA, 26 bp, Artificial Sequence
  Description of Artificial Sequence: Synthetic oligonucleotide
acgtgtcccctctcctgggcaccatt

SEQ ID NO: 318034 - DNA, 25 bp, Artificial Sequence
  Description of Artificial Sequence: Synthetic oligonucleotide
cgtgtcccctctcctgggcaccatt

SEQ ID NO: 318035 - DNA, 25 bp, Artificial Sequence
  Description of Artificial Sequence: Synthetic oligonucleotide
gtgtcccctctcctgggcaccattg

SEQ ID NO: 318036 - DNA, 25 bp, Artificial Sequence
  Description of Artificial Sequence: Synthetic oligonucleotide
tgtcccctctcctgggcaccattgc

SEQ ID NO: 318037 - DNA, 24 bp, Artificial Sequence
  Description of Artificial Sequence: Synthetic oligonucleotide
gtcccctctcctgggcaccattgc

SEQ ID NO: 318038 - DNA, 24 bp, Artificial Sequence
  Description of Artificial Sequence: Synthetic oligonucleotide
tcccctctcctgggcaccattgcg

SEQ ID NO: 318039 - DNA, 23 bp, Artificial Sequence
  Description of Artificial Sequence: Synthetic oligonucleotide
cccctctcctgggcaccattgcg

SEQ ID NO: 318040 - DNA, 23 bp, Artificial Sequence
  Description of Artificial Sequence: Synthetic oligonucleotide
ccctctcctgggcaccattgcgg

SEQ ID NO: 318041 - DNA, 24 bp, Artificial Sequence
  Description of Artificial Sequence: Synthetic oligonucleotide
cctctcctgggcaccattgcggct

SEQ ID NO: 318042 - DNA, 25 bp, Artificial Sequence
  Description of Artificial Sequence: Synthetic oligonucleotide
ctctcctgggcaccattgcggctgt

SEQ ID NO: 318043 - DNA, 27 bp, Artificial Sequence
  Description of Artificial Sequence: Synthetic oligonucleotide
tctcctgggcaccattgcggctgtctt

SEQ ID NO: 318044 - DNA, 26 bp, Artificial Sequence
  Description of Artificial Sequence: Synthetic oligonucleotide
ctcctgggcaccattgcggctgtctt

SEQ ID NO: 318045 - DNA, 26 bp, Artificial Sequence
  Description of Artificial Sequence: Synthetic oligonucleotide
tcctgggcaccattgcggctgtcttc

SEQ ID NO: 318046 - DNA, 25 bp, Artificial Sequence
  Description of Artificial Sequence: Synthetic oligonucleotide
cctgggcaccattgcggctgtcttc

SEQ ID NO: 318047 - DNA, 26 bp, Artificial Sequence
  Description of Artificial Sequence: Synthetic oligonucleotide
ctgggcaccattgcggctgtcttcgt

SEQ ID NO: 318048 - DNA, 27 bp, Artificial Sequence
  Description of Artificial Sequence: Synthetic oligonucleotide
tgggcaccattgcggctgtcttcgtct

SEQ ID NO: 318049 - DNA, 27 bp, Artificial Sequence
  Description of Artificial Sequence: Synthetic oligonucleotide
gggcaccattgcggctgtcttcgtcta

SEQ ID NO: 318050 - DNA, 27 bp, Artificial Sequence
  Description of Artificial Sequence: Synthetic oligonucleotide
ggcaccattgcggctgtcttcgtctac

SEQ ID NO: 318051 - DNA, 27 bp, Artificial Sequence
  Description of Artificial Sequence: Synthetic oligonucleotide
gcaccattgcggctgtcttcgtctacc

SEQ ID NO: 318052 - DNA, 28 bp, Artificial Sequence
  Description of Artificial Sequence: Synthetic oligonucleotide
caccattgcggctgtcttcgtctaccag

SEQ ID NO: 318053 - DNA, 28 bp, Artificial Sequence
  Description of Artificial Sequence: Synthetic oligonucleotide
accattgcggctgtcttcgtctaccagc

SEQ ID NO: 318054 - DNA, 27 bp, Artificial Sequence
  Description of Artificial Sequence: Synthetic oligonucleotide
ccattgcggctgtcttcgtctaccagc

SEQ ID NO: 318055 - DNA, 28 bp, Artificial Sequence
  Description of Artificial Sequence: Synthetic oligonucleotide
cattgcggctgtcttcgtctaccagctg

SEQ ID NO: 318056 - DNA, 30 bp, Artificial Sequence
  Description of Artificial Sequence: Synthetic oligonucleotide
attgcggctgtcttcgtctaccagctgttg

SEQ ID NO: 318057 - DNA, 29 bp, Artificial Sequence
  Description of Artificial Sequence: Synthetic oligonucleotide
ttgcggctgtcttcgtctaccagctgttg

SEQ ID NO: 318058 - DNA, 28 bp, Artificial Sequence
  Description of Artificial Sequence: Synthetic oligonucleotide
tgcggctgtcttcgtctaccagctgttg

SEQ ID NO: 318059 - DNA, 27 bp, Artificial Sequence
  Description of Artificial Sequence: Synthetic oligonucleotide
gcggctgtcttcgtctaccagctgttg

SEQ ID NO: 318060 - DNA, 29 bp, Artificial Sequence
  Description of Artificial Sequence: Synthetic oligonucleotide
cggctgtcttcgtctaccagctgttgatc

SEQ ID NO: 318061 - DNA, 29 bp, Artificial Sequence
  Description of Artificial Sequence: Synthetic oligonucleotide
ggctgtcttcgtctaccagctgttgatcg

SEQ ID NO: 318062 - DNA, 29 bp, Artificial Sequence
  Description of Artificial Sequence: Synthetic oligonucleotide
gctgtcttcgtctaccagctgttgatcgg

SEQ ID NO: 318063 - DNA, 29 bp, Artificial Sequence
  Description of Artificial Sequence: Synthetic oligonucleotide
ctgtcttcgtctaccagctgttgatcggc

SEQ ID NO: 318064 - DNA, 30 bp, Artificial Sequence
  Description of Artificial Sequence: Synthetic oligonucleotide
tgtcttcgtctaccagctgttgatcggctc

SEQ ID NO: 318065 - DNA, 29 bp, Artificial Sequence
  Description of Artificial Sequence: Synthetic oligonucleotide
gtcttcgtctaccagctgttgatcggctc

SEQ ID NO: 318066 - DNA, 29 bp, Artificial Sequence
  Description of Artificial Sequence: Synthetic oligonucleotide
tcttcgtctaccagctgttgatcggctcc

SEQ ID NO: 318067 - DNA, 28 bp, Artificial Sequence
  Description of Artificial Sequence: Synthetic oligonucleotide
cttcgtctaccagctgttgatcggctcc

SEQ ID NO: 318068 - DNA, 28 bp, Artificial Sequence
  Description of Artificial Sequence: Synthetic oligonucleotide
ttcgtctaccagctgttgatcggctccc

SEQ ID NO: 318069 - DNA, 27 bp, Artificial Sequence
  Description of Artificial Sequence: Synthetic oligonucleotide
tcgtctaccagctgttgatcggctccc

SEQ ID NO: 318070 - DNA, 27 bp, Artificial Sequence
  Description of Artificial Sequence: Synthetic oligonucleotide
cgtctaccagctgttgatcggctccca

SEQ ID NO: 318071 - DNA, 27 bp, Artificial Sequence
  Description of Artificial Sequence: Synthetic oligonucleotide
gtctaccagctgttgatcggctcccac

SEQ ID NO: 318072 - DNA, 27 bp, Artificial Sequence
  Description of Artificial Sequence: Synthetic oligonucleotide
tctaccagctgttgatcggctcccacc

SEQ ID NO: 318073 - DNA, 27 bp, Artificial Sequence
  Description of Artificial Sequence: Synthetic oligonucleotide
ctaccagctgttgatcggctcccacct

SEQ ID NO: 318074 - DNA, 27 bp, Artificial Sequence
  Description of Artificial Sequence: Synthetic oligonucleotide
taccagctgttgatcggctcccacctg

SEQ ID NO: 318075 - DNA, 26 bp, Artificial Sequence
  Description of Artificial Sequence: Synthetic oligonucleotide
accagctgttgatcggctcccacctg

SEQ ID NO: 318076 - DNA, 25 bp, Artificial Sequence
  Description of Artificial Sequence: Synthetic oligonucleotide
ccagctgttgatcggctcccacctg

SEQ ID NO: 318077 - DNA, 26 bp, Artificial Sequence
  Description of Artificial Sequence: Synthetic oligonucleotide
cagctgttgatcggctcccacctgga

SEQ ID NO: 318078 - DNA, 26 bp, Artificial Sequence
  Description of Artificial Sequence: Synthetic oligonucleotide
agctgttgatcggctcccacctggac

SEQ ID NO: 318079 - DNA, 25 bp, Artificial Sequence
  Description of Artificial Sequence: Synthetic oligonucleotide
gctgttgatcggctcccacctggac

SEQ ID NO: 318080 - DNA, 26 bp, Artificial Sequence
  Description of Artificial Sequence: Synthetic oligonucleotide
ctgttgatcggctcccacctggacca

SEQ ID NO: 318081 - DNA, 26 bp, Artificial Sequence
  Description of Artificial Sequence: Synthetic oligonucleotide
tgttgatcggctcccacctggaccag

SEQ ID NO: 318082 - DNA, 25 bp, Artificial Sequence
  Description of Artificial Sequence: Synthetic oligonucleotide
gttgatcggctcccacctggaccag

SEQ ID NO: 318083 - DNA, 25 bp, Artificial Sequence
  Description of Artificial Sequence: Synthetic oligonucleotide
ttgatcggctcccacctggaccagc

SEQ ID NO: 318084 - DNA, 24 bp, Artificial Sequence
  Description of Artificial Sequence: Synthetic oligonucleotide
tgatcggctcccacctggaccagc

SEQ ID NO: 318085 - DNA, 23 bp, Artificial Sequence
  Description of Artificial Sequence: Synthetic oligonucleotide
gatcggctcccacctggaccagc

SEQ ID NO: 318086 - DNA, 23 bp, Artificial Sequence
  Description of Artificial Sequence: Synthetic oligonucleotide
atcggctcccacctggaccagcc

SEQ ID NO: 318087 - DNA, 22 bp, Artificial Sequence
  Description of Artificial Sequence: Synthetic oligonucleotide
tcggctcccacctggaccagcc

SEQ ID NO: 318088 - DNA, 21 bp, Artificial Sequence
  Description of Artificial Sequence: Synthetic oligonucleotide
cggctcccacctggaccagcc

SEQ ID NO: 318089 - DNA, 21 bp, Artificial Sequence
  Description of Artificial Sequence: Synthetic oligonucleotide
ggctcccacctggaccagccc

SEQ ID NO: 318090 - DNA, 21 bp, Artificial Sequence
  Description of Artificial Sequence: Synthetic oligonucleotide
gctcccacctggaccagcccc

SEQ ID NO: 318091 - DNA, 22 bp, Artificial Sequence
  Description of Artificial Sequence: Synthetic oligonucleotide
ctcccacctggaccagccccca

SEQ ID NO: 318092 - DNA, 22 bp, Artificial Sequence
  Description of Artificial Sequence: Synthetic oligonucleotide
tcccacctggaccagcccccag

SEQ ID NO: 318093 - DNA, 21 bp, Artificial Sequence
  Description of Artificial Sequence: Synthetic oligonucleotide
cccacctggaccagcccccag

SEQ ID NO: 318094 - DNA, 21 bp, Artificial Sequence
  Description of Artificial Sequence: Synthetic oligonucleotide
ccacctggaccagcccccagc

SEQ ID NO: 318095 - DNA, 22 bp, Artificial Sequence
  Description of Artificial Sequence: Synthetic oligonucleotide
cacctggaccagcccccagcct

SEQ ID NO: 318096 - DNA, 22 bp, Artificial Sequence
  Description of Artificial Sequence: Synthetic oligonucleotide
acctggaccagcccccagcctc

SEQ ID NO: 318097 - DNA, 21 bp, Artificial Sequence
  Description of Artificial Sequence: Synthetic oligonucleotide
cctggaccagcccccagcctc

SEQ ID NO: 318098 - DNA, 23 bp, Artificial Sequence
  Description of Artificial Sequence: Synthetic oligonucleotide
ctggaccagcccccagcctccaa

SEQ ID NO: 318099 - DNA, 23 bp, Artificial Sequence
  Description of Artificial Sequence: Synthetic oligonucleotide
tggaccagcccccagcctccaac

SEQ ID NO: 318100 - DNA, 22 bp, Artificial Sequence
  Description of Artificial Sequence: Synthetic oligonucleotide
ggaccagcccccagcctccaac

SEQ ID NO: 318101 - DNA, 23 bp, Artificial Sequence
  Description of Artificial Sequence: Synthetic oligonucleotide
gaccagcccccagcctccaacgt

SEQ ID NO: 318102 - DNA, 23 bp, Artificial Sequence
  Description of Artificial Sequence: Synthetic oligonucleotide
accagcccccagcctccaacgtg

SEQ ID NO: 318103 - DNA, 22 bp, Artificial Sequence
  Description of Artificial Sequence: Synthetic oligonucleotide
ccagcccccagcctccaacgtg

SEQ ID NO: 318104 - DNA, 24 bp, Artificial Sequence
  Description of Artificial Sequence: Synthetic oligonucleotide
cagcccccagcctccaacgtggaa

SEQ ID NO: 318105 - DNA, 25 bp, Artificial Sequence
  Description of Artificial Sequence: Synthetic oligonucleotide
agcccccagcctccaacgtggaaga

SEQ ID NO: 318106 - DNA, 24 bp, Artificial Sequence
  Description of Artificial Sequence: Synthetic oligonucleotide
gcccccagcctccaacgtggaaga

SEQ ID NO: 318107 - DNA, 27 bp, Artificial Sequence
  Description of Artificial Sequence: Synthetic oligonucleotide
cccccagcctccaacgtggaagagaaa

SEQ ID NO: 318108 - DNA, 27 bp, Artificial Sequence
  Description of Artificial Sequence: Synthetic oligonucleotide
ccccagcctccaacgtggaagagaaag

SEQ ID NO: 318109 - DNA, 28 bp, Artificial Sequence
  Description of Artificial Sequence: Synthetic oligonucleotide
cccagcctccaacgtggaagagaaagtg

SEQ ID NO: 318110 - DNA, 30 bp, Artificial Sequence
  Description of Artificial Sequence: Synthetic oligonucleotide
ccagcctccaacgtggaagagaaagtgaag

SEQ ID NO: 318111 - DNA, 30 bp, Artificial Sequence
  Description of Artificial Sequence: Synthetic oligonucleotide
cagcctccaacgtggaagagaaagtgaagc

SEQ ID NO: 318112 - DNA, 31 bp, Artificial Sequence
  Description of Artificial Sequence: Synthetic oligonucleotide
agcctccaacgtggaagagaaagtgaagctg

SEQ ID NO: 318113 - DNA, 30 bp, Artificial Sequence
  Description of Artificial Sequence: Synthetic oligonucleotide
gcctccaacgtggaagagaaagtgaagctg

SEQ ID NO: 318114 - DNA, 30 bp, Artificial Sequence
  Description of Artificial Sequence: Synthetic oligonucleotide
cctccaacgtggaagagaaagtgaagctgc

SEQ ID NO: 318115 - DNA, 30 bp, Artificial Sequence
  Description of Artificial Sequence: Synthetic oligonucleotide
ctccaacgtggaagagaaagtgaagctgcc

SEQ ID NO: 318116 - DNA, 30 bp, Artificial Sequence
  Description of Artificial Sequence: Synthetic oligonucleotide
tccaacgtggaagagaaagtgaagctgccc

SEQ ID NO: 318117 - DNA, 29 bp, Artificial Sequence
  Description of Artificial Sequence: Synthetic oligonucleotide
ccaacgtggaagagaaagtgaagctgccc

SEQ ID NO: 318118 - DNA, 29 bp, Artificial Sequence
  Description of Artificial Sequence: Synthetic oligonucleotide
caacgtggaagagaaagtgaagctgcccc

SEQ ID NO: 318119 - DNA, 31 bp, Artificial Sequence
  Description of Artificial Sequence: Synthetic oligonucleotide
aacgtggaagagaaagtgaagctgccccatg

SEQ ID NO: 318120 - DNA, 30 bp, Artificial Sequence
  Description of Artificial Sequence: Synthetic oligonucleotide
acgtggaagagaaagtgaagctgccccatg

SEQ ID NO: 318121 - DNA, 29 bp, Artificial Sequence
  Description of Artificial Sequence: Synthetic oligonucleotide
cgtggaagagaaagtgaagctgccccatg

SEQ ID NO: 318122 - DNA, 30 bp, Artificial Sequence
  Description of Artificial Sequence: Synthetic oligonucleotide
gtggaagagaaagtgaagctgccccatgtg

SEQ ID NO: 318123 - DNA, 32 bp, Artificial Sequence
  Description of Artificial Sequence: Synthetic oligonucleotide
tggaagagaaagtgaagctgccccatgtgatg

SEQ ID NO: 318124 - DNA, 31 bp, Artificial Sequence
  Description of Artificial Sequence: Synthetic oligonucleotide
ggaagagaaagtgaagctgccccatgtgatg

SEQ ID NO: 318125 - DNA, 31 bp, Artificial Sequence
  Description of Artificial Sequence: Synthetic oligonucleotide
gaagagaaagtgaagctgccccatgtgatgc

SEQ ID NO: 318126 - DNA, 32 bp, Artificial Sequence
  Description of Artificial Sequence: Synthetic oligonucleotide
aagagaaagtgaagctgccccatgtgatgcac

SEQ ID NO: 318127 - DNA, 31 bp, Artificial Sequence
  Description of Artificial Sequence: Synthetic oligonucleotide
agagaaagtgaagctgccccatgtgatgcac

SEQ ID NO: 318128 - DNA, 30 bp, Artificial Sequence
  Description of Artificial Sequence: Synthetic oligonucleotide
gagaaagtgaagctgccccatgtgatgcac

SEQ ID NO: 318129 - DNA, 32 bp, Artificial Sequence
  Description of Artificial Sequence: Synthetic oligonucleotide
agaaagtgaagctgccccatgtgatgcacaag

SEQ ID NO: 318130 - DNA, 31 bp, Artificial Sequence
  Description of Artificial Sequence: Synthetic oligonucleotide
gaaagtgaagctgccccatgtgatgcacaag

SEQ ID NO: 318131 - DNA, 31 bp, Artificial Sequence
  Description of Artificial Sequence: Synthetic oligonucleotide
aaagtgaagctgccccatgtgatgcacaagg

SEQ ID NO: 318132 - DNA, 30 bp, Artificial Sequence
  Description of Artificial Sequence: Synthetic oligonucleotide
aagtgaagctgccccatgtgatgcacaagg

SEQ ID NO: 318133 - DNA, 29 bp, Artificial Sequence
  Description of Artificial Sequence: Synthetic oligonucleotide
agtgaagctgccccatgtgatgcacaagg

SEQ ID NO: 318134 - DNA, 28 bp, Artificial Sequence
  Description of Artificial Sequence: Synthetic oligonucleotide
gtgaagctgccccatgtgatgcacaagg

SEQ ID NO: 318135 - DNA, 29 bp, Artificial Sequence
  Description of Artificial Sequence: Synthetic oligonucleotide
tgaagctgccccatgtgatgcacaaggac

SEQ ID NO: 318136 - DNA, 28 bp, Artificial Sequence
  Description of Artificial Sequence: Synthetic oligonucleotide
gaagctgccccatgtgatgcacaaggac

SEQ ID NO: 318137 - DNA, 28 bp, Artificial Sequence
  Description of Artificial Sequence: Synthetic oligonucleotide
aagctgccccatgtgatgcacaaggacc

SEQ ID NO: 318138 - DNA, 27 bp, Artificial Sequence
  Description of Artificial Sequence: Synthetic oligonucleotide
agctgccccatgtgatgcacaaggacc

SEQ ID NO: 318139 - DNA, 27 bp, Artificial Sequence
  Description of Artificial Sequence: Synthetic oligonucleotide
gctgccccatgtgatgcacaaggacca

SEQ ID NO: 318140 - DNA, 27 bp, Artificial Sequence
  Description of Artificial Sequence: Synthetic oligonucleotide
ctgccccatgtgatgcacaaggaccag

SEQ ID NO: 318141 - DNA, 29 bp, Artificial Sequence
  Description of Artificial Sequence: Synthetic oligonucleotide
tgccccatgtgatgcacaaggaccagatc

SEQ ID NO: 318142 - DNA, 28 bp, Artificial Sequence
  Description of Artificial Sequence: Synthetic oligonucleotide
gccccatgtgatgcacaaggaccagatc

SEQ ID NO: 318143 - DNA, 29 bp, Artificial Sequence
  Description of Artificial Sequence: Synthetic oligonucleotide
ccccatgtgatgcacaaggaccagatctg

SEQ ID NO: 318144 - DNA, 56 bp, Artificial Sequence
  Description of Artificial Sequence: Synthetic oligonucleotide
atgtatggataaataatctatgtattacttttgtcagaatttgtgagcaaatcagc

SEQ ID NO: 318145 - DNA, 55 bp, Artificial Sequence
  Description of Artificial Sequence: Synthetic oligonucleotide
tgtatggataaataatctatgtattacttttgtcagaatttgtgagcaaatcagc

SEQ ID NO: 318146 - DNA, 54 bp, Artificial Sequence
  Description of Artificial Sequence: Synthetic oligonucleotide
gtatggataaataatctatgtattacttttgtcagaatttgtgagcaaatcagc

SEQ ID NO: 318147 - DNA, 59 bp, Artificial Sequence
  Description of Artificial Sequence: Synthetic oligonucleotide
tatggataaataatctatgtattacttttgtcagaatttgtgagcaaatcagcatttag

SEQ ID NO: 318148 - DNA, 58 bp, Artificial Sequence
  Description of Artificial Sequence: Synthetic oligonucleotide
atggataaataatctatgtattacttttgtcagaatttgtgagcaaatcagcatttag

SEQ ID NO: 318149 - DNA, 57 bp, Artificial Sequence
  Description of Artificial Sequence: Synthetic oligonucleotide
tggataaataatctatgtattacttttgtcagaatttgtgagcaaatcagcatttag

SEQ ID NO: 318150 - DNA, 56 bp, Artificial Sequence
  Description of Artificial Sequence: Synthetic oligonucleotide
ggataaataatctatgtattacttttgtcagaatttgtgagcaaatcagcatttag

SEQ ID NO: 318151 - DNA, 58 bp, Artificial Sequence
  Description of Artificial Sequence: Synthetic oligonucleotide
gataaataatctatgtattacttttgtcagaatttgtgagcaaatcagcatttagtac

SEQ ID NO: 318152 - DNA, 58 bp, Artificial Sequence
  Description of Artificial Sequence: Synthetic oligonucleotide
ataaataatctatgtattacttttgtcagaatttgtgagcaaatcagcatttagtacc

SEQ ID NO: 318153 - DNA, 57 bp, Artificial Sequence
  Description of Artificial Sequence: Synthetic oligonucleotide
taaataatctatgtattacttttgtcagaatttgtgagcaaatcagcatttagtacc

SEQ ID NO: 318154 - DNA, 56 bp, Artificial Sequence
  Description of Artificial Sequence: Synthetic oligonucleotide
aaataatctatgtattacttttgtcagaatttgtgagcaaatcagcatttagtacc

SEQ ID NO: 318155 - DNA, 55 bp, Artificial Sequence
  Description of Artificial Sequence: Synthetic oligonucleotide
aataatctatgtattacttttgtcagaatttgtgagcaaatcagcatttagtacc

SEQ ID NO: 318156 - DNA, 54 bp, Artificial Sequence
  Description of Artificial Sequence: Synthetic oligonucleotide
ataatctatgtattacttttgtcagaatttgtgagcaaatcagcatttagtacc

SEQ ID NO: 318157 - DNA, 53 bp, Artificial Sequence
  Description of Artificial Sequence: Synthetic oligonucleotide
taatctatgtattacttttgtcagaatttgtgagcaaatcagcatttagtacc

SEQ ID NO: 318158 - DNA, 52 bp, Artificial Sequence
  Description of Artificial Sequence: Synthetic oligonucleotide
aatctatgtattacttttgtcagaatttgtgagcaaatcagcatttagtacc

SEQ ID NO: 318159 - DNA, 51 bp, Artificial Sequence
  Description of Artificial Sequence: Synthetic oligonucleotide
atctatgtattacttttgtcagaatttgtgagcaaatcagcatttagtacc

SEQ ID NO: 318160 - DNA, 50 bp, Artificial Sequence
  Description of Artificial Sequence: Synthetic oligonucleotide
tctatgtattacttttgtcagaatttgtgagcaaatcagcatttagtacc

SEQ ID NO: 318161 - DNA, 49 bp, Artificial Sequence
  Description of Artificial Sequence: Synthetic oligonucleotide
ctatgtattacttttgtcagaatttgtgagcaaatcagcatttagtacc

SEQ ID NO: 318162 - DNA, 50 bp, Artificial Sequence
  Description of Artificial Sequence: Synthetic oligonucleotide
tatgtattacttttgtcagaatttgtgagcaaatcagcatttagtaccac

SEQ ID NO: 318163 - DNA, 49 bp, Artificial Sequence
  Description of Artificial Sequence: Synthetic oligonucleotide
atgtattacttttgtcagaatttgtgagcaaatcagcatttagtaccac

SEQ ID NO: 318164 - DNA, 48 bp, Artificial Sequence
  Description of Artificial Sequence: Synthetic oligonucleotide
tgtattacttttgtcagaatttgtgagcaaatcagcatttagtaccac

SEQ ID NO: 318165 - DNA, 47 bp, Artificial Sequence
  Description of Artificial Sequence: Synthetic oligonucleotide
gtattacttttgtcagaatttgtgagcaaatcagcatttagtaccac

SEQ ID NO: 318166 - DNA, 48 bp, Artificial Sequence
  Description of Artificial Sequence: Synthetic oligonucleotide
tattacttttgtcagaatttgtgagcaaatcagcatttagtaccactc

SEQ ID NO: 318167 - DNA, 47 bp, Artificial Sequence
  Description of Artificial Sequence: Synthetic oligonucleotide
attacttttgtcagaatttgtgagcaaatcagcatttagtaccactc

SEQ ID NO: 318168 - DNA, 46 bp, Artificial Sequence
  Description of Artificial Sequence: Synthetic oligonucleotide
ttacttttgtcagaatttgtgagcaaatcagcatttagtaccactc

SEQ ID NO: 318169 - DNA, 45 bp, Artificial Sequence
  Description of Artificial Sequence: Synthetic oligonucleotide
tacttttgtcagaatttgtgagcaaatcagcatttagtaccactc

SEQ ID NO: 318170 - DNA, 44 bp, Artificial Sequence
  Description of Artificial Sequence: Synthetic oligonucleotide
acttttgtcagaatttgtgagcaaatcagcatttagtaccactc

SEQ ID NO: 318171 - DNA, 43 bp, Artificial Sequence
  Description of Artificial Sequence: Synthetic oligonucleotide
cttttgtcagaatttgtgagcaaatcagcatttagtaccactc

SEQ ID NO: 318172 - DNA, 44 bp, Artificial Sequence
  Description of Artificial Sequence: Synthetic oligonucleotide
ttttgtcagaatttgtgagcaaatcagcatttagtaccactcag

SEQ ID NO: 318173 - DNA, 43 bp, Artificial Sequence
  Description of Artificial Sequence: Synthetic oligonucleotide
tttgtcagaatttgtgagcaaatcagcatttagtaccactcag

SEQ ID NO: 318174 - DNA, 42 bp, Artificial Sequence
  Description of Artificial Sequence: Synthetic oligonucleotide
ttgtcagaatttgtgagcaaatcagcatttagtaccactcag

SEQ ID NO: 318175 - DNA, 41 bp, Artificial Sequence
  Description of Artificial Sequence: Synthetic oligonucleotide
tgtcagaatttgtgagcaaatcagcatttagtaccactcag

SEQ ID NO: 318176 - DNA, 40 bp, Artificial Sequence
  Description of Artificial Sequence: Synthetic oligonucleotide
gtcagaatttgtgagcaaatcagcatttagtaccactcag

SEQ ID NO: 318177 - DNA, 40 bp, Artificial Sequence
  Description of Artificial Sequence: Synthetic oligonucleotide
tcagaatttgtgagcaaatcagcatttagtaccactcagg

SEQ ID NO: 318178 - DNA, 39 bp, Artificial Sequence
  Description of Artificial Sequence: Synthetic oligonucleotide
cagaatttgtgagcaaatcagcatttagtaccactcagg

SEQ ID NO: 318179 - DNA, 40 bp, Artificial Sequence
  Description of Artificial Sequence: Synthetic oligonucleotide
agaatttgtgagcaaatcagcatttagtaccactcaggtg

SEQ ID NO: 318180 - DNA, 39 bp, Artificial Sequence
  Description of Artificial Sequence: Synthetic oligonucleotide
gaatttgtgagcaaatcagcatttagtaccactcaggtg

SEQ ID NO: 318181 - DNA, 39 bp, Artificial Sequence
  Description of Artificial Sequence: Synthetic oligonucleotide
aatttgtgagcaaatcagcatttagtaccactcaggtgg

SEQ ID NO: 318182 - DNA, 38 bp, Artificial Sequence
  Description of Artificial Sequence: Synthetic oligonucleotide
atttgtgagcaaatcagcatttagtaccactcaggtgg

SEQ ID NO: 318183 - DNA, 37 bp, Artificial Sequence
  Description of Artificial Sequence: Synthetic oligonucleotide
tttgtgagcaaatcagcatttagtaccactcaggtgg

SEQ ID NO: 318184 - DNA, 36 bp, Artificial Sequence
  Description of Artificial Sequence: Synthetic oligonucleotide
ttgtgagcaaatcagcatttagtaccactcaggtgg

SEQ ID NO: 318185 - DNA, 35 bp, Artificial Sequence
  Description of Artificial Sequence: Synthetic oligonucleotide
tgtgagcaaatcagcatttagtaccactcaggtgg

SEQ ID NO: 318186 - DNA, 34 bp, Artificial Sequence
  Description of Artificial Sequence: Synthetic oligonucleotide
gtgagcaaatcagcatttagtaccactcaggtgg

SEQ ID NO: 318187 - DNA, 34 bp, Artificial Sequence
  Description of Artificial Sequence: Synthetic oligonucleotide
tgagcaaatcagcatttagtaccactcaggtggc

SEQ ID NO: 318188 - DNA, 33 bp, Artificial Sequence
  Description of Artificial Sequence: Synthetic oligonucleotide
gagcaaatcagcatttagtaccactcaggtggc

SEQ ID NO: 318189 - DNA, 36 bp, Artificial Sequence
  Description of Artificial Sequence: Synthetic oligonucleotide
agcaaatcagcatttagtaccactcaggtggcaaag

SEQ ID NO: 318190 - DNA, 35 bp, Artificial Sequence
  Description of Artificial Sequence: Synthetic oligonucleotide
gcaaatcagcatttagtaccactcaggtggcaaag

SEQ ID NO: 318191 - DNA, 35 bp, Artificial Sequence
  Description of Artificial Sequence: Synthetic oligonucleotide
caaatcagcatttagtaccactcaggtggcaaagc

SEQ ID NO: 318192 - DNA, 36 bp, Artificial Sequence
  Description of Artificial Sequence: Synthetic oligonucleotide
aaatcagcatttagtaccactcaggtggcaaagcac

SEQ ID NO: 318193 - DNA, 35 bp, Artificial Sequence
  Description of Artificial Sequence: Synthetic oligonucleotide
aatcagcatttagtaccactcaggtggcaaagcac

SEQ ID NO: 318194 - DNA, 34 bp, Artificial Sequence
  Description of Artificial Sequence: Synthetic oligonucleotide
atcagcatttagtaccactcaggtggcaaagcac

SEQ ID NO: 318195 - DNA, 33 bp, Artificial Sequence
  Description of Artificial Sequence: Synthetic oligonucleotide
tcagcatttagtaccactcaggtggcaaagcac

SEQ ID NO: 318196 - DNA, 32 bp, Artificial Sequence
  Description of Artificial Sequence: Synthetic oligonucleotide
cagcatttagtaccactcaggtggcaaagcac

SEQ ID NO: 318197 - DNA, 33 bp, Artificial Sequence
  Description of Artificial Sequence: Synthetic oligonucleotide
agcatttagtaccactcaggtggcaaagcacac

SEQ ID NO: 318198 - DNA, 32 bp, Artificial Sequence
  Description of Artificial Sequence: Synthetic oligonucleotide
gcatttagtaccactcaggtggcaaagcacac

SEQ ID NO: 318199 - DNA, 34 bp, Artificial Sequence
  Description of Artificial Sequence: Synthetic oligonucleotide
catttagtaccactcaggtggcaaagcacacttc

SEQ ID NO: 318200 - DNA, 36 bp, Artificial Sequence
  Description of Artificial Sequence: Synthetic oligonucleotide
atttagtaccactcaggtggcaaagcacacttctac

SEQ ID NO: 318201 - DNA, 35 bp, Artificial Sequence
  Description of Artificial Sequence: Synthetic oligonucleotide
tttagtaccactcaggtggcaaagcacacttctac

SEQ ID NO: 318202 - DNA, 34 bp, Artificial Sequence
  Description of Artificial Sequence: Synthetic oligonucleotide
ttagtaccactcaggtggcaaagcacacttctac

SEQ ID NO: 318203 - DNA, 33 bp, Artificial Sequence
  Description of Artificial Sequence: Synthetic oligonucleotide
tagtaccactcaggtggcaaagcacacttctac

SEQ ID NO: 318204 - DNA, 32 bp, Artificial Sequence
  Description of Artificial Sequence: Synthetic oligonucleotide
agtaccactcaggtggcaaagcacacttctac

SEQ ID NO: 318205 - DNA, 31 bp, Artificial Sequence
  Description of Artificial Sequence: Synthetic oligonucleotide
gtaccactcaggtggcaaagcacacttctac

SEQ ID NO: 318206 - DNA, 33 bp, Artificial Sequence
  Description of Artificial Sequence: Synthetic oligonucleotide
taccactcaggtggcaaagcacacttctacttc

SEQ ID NO: 318207 - DNA, 32 bp, Artificial Sequence
  Description of Artificial Sequence: Synthetic oligonucleotide
accactcaggtggcaaagcacacttctacttc

SEQ ID NO: 318208 - DNA, 31 bp, Artificial Sequence
  Description of Artificial Sequence: Synthetic oligonucleotide
ccactcaggtggcaaagcacacttctacttc

SEQ ID NO: 318209 - DNA, 33 bp, Artificial Sequence
  Description of Artificial Sequence: Synthetic oligonucleotide
cactcaggtggcaaagcacacttctacttcttc

SEQ ID NO: 318210 - DNA, 35 bp, Artificial Sequence
  Description of Artificial Sequence: Synthetic oligonucleotide
actcaggtggcaaagcacacttctacttcttctac

SEQ ID NO: 318211 - DNA, 34 bp, Artificial Sequence
  Description of Artificial Sequence: Synthetic oligonucleotide
ctcaggtggcaaagcacacttctacttcttctac

SEQ ID NO: 318212 - DNA, 35 bp, Artificial Sequence
  Description of Artificial Sequence: Synthetic oligonucleotide
tcaggtggcaaagcacacttctacttcttctacag

SEQ ID NO: 318213 - DNA, 34 bp, Artificial Sequence
  Description of Artificial Sequence: Synthetic oligonucleotide
caggtggcaaagcacacttctacttcttctacag

SEQ ID NO: 318214 - DNA, 35 bp, Artificial Sequence
  Description of Artificial Sequence: Synthetic oligonucleotide
aggtggcaaagcacacttctacttcttctacagtc

SEQ ID NO: 318215 - DNA, 34 bp, Artificial Sequence
  Description of Artificial Sequence: Synthetic oligonucleotide
ggtggcaaagcacacttctacttcttctacagtc

SEQ ID NO: 318216 - DNA, 35 bp, Artificial Sequence
  Description of Artificial Sequence: Synthetic oligonucleotide
gtggcaaagcacacttctacttcttctacagtcac

SEQ ID NO: 318217 - DNA, 38 bp, Artificial Sequence
  Description of Artificial Sequence: Synthetic oligonucleotide
tggcaaagcacacttctacttcttctacagtcacaatg

SEQ ID NO: 318218 - DNA, 37 bp, Artificial Sequence
  Description of Artificial Sequence: Synthetic oligonucleotide
ggcaaagcacacttctacttcttctacagtcacaatg

SEQ ID NO: 318219 - DNA, 38 bp, Artificial Sequence
  Description of Artificial Sequence: Synthetic oligonucleotide
gcaaagcacacttctacttcttctacagtcacaatgag

SEQ ID NO: 318220 - DNA, 41 bp, Artificial Sequence
  Description of Artificial Sequence: Synthetic oligonucleotide
caaagcacacttctacttcttctacagtcacaatgagttac

SEQ ID NO: 318221 - DNA, 43 bp, Artificial Sequence
  Description of Artificial Sequence: Synthetic oligonucleotide
aaagcacacttctacttcttctacagtcacaatgagttacatg

SEQ ID NO: 318222 - DNA, 42 bp, Artificial Sequence
  Description of Artificial Sequence: Synthetic oligonucleotide
aagcacacttctacttcttctacagtcacaatgagttacatg

SEQ ID NO: 318223 - DNA, 41 bp, Artificial Sequence
  Description of Artificial Sequence: Synthetic oligonucleotide
agcacacttctacttcttctacagtcacaatgagttacatg

SEQ ID NO: 318224 - DNA, 40 bp, Artificial Sequence
  Description of Artificial Sequence: Synthetic oligonucleotide
gcacacttctacttcttctacagtcacaatgagttacatg

SEQ ID NO: 318225 - DNA, 41 bp, Artificial Sequence
  Description of Artificial Sequence: Synthetic oligonucleotide
cacacttctacttcttctacagtcacaatgagttacatgtc

SEQ ID NO: 318226 - DNA, 43 bp, Artificial Sequence
  Description of Artificial Sequence: Synthetic oligonucleotide
acacttctacttcttctacagtcacaatgagttacatgtcatc

SEQ ID NO: 318227 - DNA, 42 bp, Artificial Sequence
  Description of Artificial Sequence: Synthetic oligonucleotide
cacttctacttcttctacagtcacaatgagttacatgtcatc

SEQ ID NO: 318228 - DNA, 43 bp, Artificial Sequence
  Description of Artificial Sequence: Synthetic oligonucleotide
acttctacttcttctacagtcacaatgagttacatgtcatcac

SEQ ID NO: 318229 - DNA, 42 bp, Artificial Sequence
  Description of Artificial Sequence: Synthetic oligonucleotide
cttctacttcttctacagtcacaatgagttacatgtcatcac

SEQ ID NO: 318230 - DNA, 43 bp, Artificial Sequence
  Description of Artificial Sequence: Synthetic oligonucleotide
ttctacttcttctacagtcacaatgagttacatgtcatcacag

SEQ ID NO: 318231 - DNA, 42 bp, Artificial Sequence
  Description of Artificial Sequence: Synthetic oligonucleotide
tctacttcttctacagtcacaatgagttacatgtcatcacag

SEQ ID NO: 318232 - DNA, 41 bp, Artificial Sequence
  Description of Artificial Sequence: Synthetic oligonucleotide
ctacttcttctacagtcacaatgagttacatgtcatcacag

SEQ ID NO: 318233 - DNA, 42 bp, Artificial Sequence
  Description of Artificial Sequence: Synthetic oligonucleotide
tacttcttctacagtcacaatgagttacatgtcatcacagtc

SEQ ID NO: 318234 - DNA, 41 bp, Artificial Sequence
  Description of Artificial Sequence: Synthetic oligonucleotide
acttcttctacagtcacaatgagttacatgtcatcacagtc

SEQ ID NO: 318235 - DNA, 40 bp, Artificial Sequence
  Description of Artificial Sequence: Synthetic oligonucleotide
cttcttctacagtcacaatgagttacatgtcatcacagtc

SEQ ID NO: 318236 - DNA, 44 bp, Artificial Sequence
  Description of Artificial Sequence: Synthetic oligonucleotide
ttcttctacagtcacaatgagttacatgtcatcacagtcaaatg

SEQ ID NO: 318237 - DNA, 43 bp, Artificial Sequence
  Description of Artificial Sequence: Synthetic oligonucleotide
tcttctacagtcacaatgagttacatgtcatcacagtcaaatg

SEQ ID NO: 318238 - DNA, 42 bp, Artificial Sequence
  Description of Artificial Sequence: Synthetic oligonucleotide
cttctacagtcacaatgagttacatgtcatcacagtcaaatg

SEQ ID NO: 318239 - DNA, 45 bp, Artificial Sequence
  Description of Artificial Sequence: Synthetic oligonucleotide
ttctacagtcacaatgagttacatgtcatcacagtcaaatgatag

SEQ ID NO: 318240 - DNA, 44 bp, Artificial Sequence
  Description of Artificial Sequence: Synthetic oligonucleotide
tctacagtcacaatgagttacatgtcatcacagtcaaatgatag

SEQ ID NO: 318241 - DNA, 43 bp, Artificial Sequence
  Description of Artificial Sequence: Synthetic oligonucleotide
ctacagtcacaatgagttacatgtcatcacagtcaaatgatag

SEQ ID NO: 318242 - DNA, 43 bp, Artificial Sequence
  Description of Artificial Sequence: Synthetic oligonucleotide
tacagtcacaatgagttacatgtcatcacagtcaaatgatagg

SEQ ID NO: 318243 - DNA, 42 bp, Artificial Sequence
  Description of Artificial Sequence: Synthetic oligonucleotide
acagtcacaatgagttacatgtcatcacagtcaaatgatagg

SEQ ID NO: 318244 - DNA, 41 bp, Artificial Sequence
  Description of Artificial Sequence: Synthetic oligonucleotide
cagtcacaatgagttacatgtcatcacagtcaaatgatagg

SEQ ID NO: 318245 - DNA, 41 bp, Artificial Sequence
  Description of Artificial Sequence: Synthetic oligonucleotide
agtcacaatgagttacatgtcatcacagtcaaatgataggc

SEQ ID NO: 318246 - DNA, 40 bp, Artificial Sequence
  Description of Artificial Sequence: Synthetic oligonucleotide
gtcacaatgagttacatgtcatcacagtcaaatgataggc

SEQ ID NO: 318247 - DNA, 41 bp, Artificial Sequence
  Description of Artificial Sequence: Synthetic oligonucleotide
tcacaatgagttacatgtcatcacagtcaaatgataggcac

SEQ ID NO: 318248 - DNA, 40 bp, Artificial Sequence
  Description of Artificial Sequence: Synthetic oligonucleotide
cacaatgagttacatgtcatcacagtcaaatgataggcac

SEQ ID NO: 318249 - DNA, 43 bp, Artificial Sequence
  Description of Artificial Sequence: Synthetic oligonucleotide
acaatgagttacatgtcatcacagtcaaatgataggcacaaac

SEQ ID NO: 318250 - DNA, 42 bp, Artificial Sequence
  Description of Artificial Sequence: Synthetic oligonucleotide
caatgagttacatgtcatcacagtcaaatgataggcacaaac

SEQ ID NO: 318251 - DNA, 42 bp, Artificial Sequence
  Description of Artificial Sequence: Synthetic oligonucleotide
aatgagttacatgtcatcacagtcaaatgataggcacaaacg

SEQ ID NO: 318252 - DNA, 41 bp, Artificial Sequence
  Description of Artificial Sequence: Synthetic oligonucleotide
atgagttacatgtcatcacagtcaaatgataggcacaaacg

SEQ ID NO: 318253 - DNA, 40 bp, Artificial Sequence
  Description of Artificial Sequence: Synthetic oligonucleotide
tgagttacatgtcatcacagtcaaatgataggcacaaacg

SEQ ID NO: 318254 - DNA, 39 bp, Artificial Sequence
  Description of Artificial Sequence: Synthetic oligonucleotide
gagttacatgtcatcacagtcaaatgataggcacaaacg

SEQ ID NO: 318255 - DNA, 39 bp, Artificial Sequence
  Description of Artificial Sequence: Synthetic oligonucleotide
agttacatgtcatcacagtcaaatgataggcacaaacgc

SEQ ID NO: 318256 - DNA, 38 bp, Artificial Sequence
  Description of Artificial Sequence: Synthetic oligonucleotide
gttacatgtcatcacagtcaaatgataggcacaaacgc

SEQ ID NO: 318257 - DNA, 38 bp, Artificial Sequence
  Description of Artificial Sequence: Synthetic oligonucleotide
ttacatgtcatcacagtcaaatgataggcacaaacgcg

SEQ ID NO: 318258 - DNA, 37 bp, Artificial Sequence
  Description of Artificial Sequence: Synthetic oligonucleotide
tacatgtcatcacagtcaaatgataggcacaaacgcg

SEQ ID NO: 318259 - DNA, 36 bp, Artificial Sequence
  Description of Artificial Sequence: Synthetic oligonucleotide
acatgtcatcacagtcaaatgataggcacaaacgcg

SEQ ID NO: 318260 - DNA, 35 bp, Artificial Sequence
  Description of Artificial Sequence: Synthetic oligonucleotide
catgtcatcacagtcaaatgataggcacaaacgcg

SEQ ID NO: 318261 - DNA, 36 bp, Artificial Sequence
  Description of Artificial Sequence: Synthetic oligonucleotide
atgtcatcacagtcaaatgataggcacaaacgcgac

SEQ ID NO: 318262 - DNA, 35 bp, Artificial Sequence
  Description of Artificial Sequence: Synthetic oligonucleotide
tgtcatcacagtcaaatgataggcacaaacgcgac

SEQ ID NO: 318263 - DNA, 34 bp, Artificial Sequence
  Description of Artificial Sequence: Synthetic oligonucleotide
gtcatcacagtcaaatgataggcacaaacgcgac

SEQ ID NO: 318264 - DNA, 35 bp, Artificial Sequence
  Description of Artificial Sequence: Synthetic oligonucleotide
tcatcacagtcaaatgataggcacaaacgcgacac

SEQ ID NO: 318265 - DNA, 34 bp, Artificial Sequence
  Description of Artificial Sequence: Synthetic oligonucleotide
catcacagtcaaatgataggcacaaacgcgacac

SEQ ID NO: 318266 - DNA, 38 bp, Artificial Sequence
  Description of Artificial Sequence: Synthetic oligonucleotide
atcacagtcaaatgataggcacaaacgcgacacatatc

SEQ ID NO: 318267 - DNA, 37 bp, Artificial Sequence
  Description of Artificial Sequence: Synthetic oligonucleotide
tcacagtcaaatgataggcacaaacgcgacacatatc

SEQ ID NO: 318268 - DNA, 36 bp, Artificial Sequence
  Description of Artificial Sequence: Synthetic oligonucleotide
cacagtcaaatgataggcacaaacgcgacacatatc

SEQ ID NO: 318269 - DNA, 36 bp, Artificial Sequence
  Description of Artificial Sequence: Synthetic oligonucleotide
acagtcaaatgataggcacaaacgcgacacatatcc

SEQ ID NO: 318270 - DNA, 35 bp, Artificial Sequence
  Description of Artificial Sequence: Synthetic oligonucleotide
cagtcaaatgataggcacaaacgcgacacatatcc

SEQ ID NO: 318271 - DNA, 36 bp, Artificial Sequence
  Description of Artificial Sequence: Synthetic oligonucleotide
agtcaaatgataggcacaaacgcgacacatatccag

SEQ ID NO: 318272 - DNA, 35 bp, Artificial Sequence
  Description of Artificial Sequence: Synthetic oligonucleotide
gtcaaatgataggcacaaacgcgacacatatccag

SEQ ID NO: 318273 - DNA, 35 bp, Artificial Sequence
  Description of Artificial Sequence: Synthetic oligonucleotide
tcaaatgataggcacaaacgcgacacatatccagc

SEQ ID NO: 318274 - DNA, 34 bp, Artificial Sequence
  Description of Artificial Sequence: Synthetic oligonucleotide
caaatgataggcacaaacgcgacacatatccagc

SEQ ID NO: 318275 - DNA, 34 bp, Artificial Sequence
  Description of Artificial Sequence: Synthetic oligonucleotide
aaatgataggcacaaacgcgacacatatccagcc

SEQ ID NO: 318276 - DNA, 33 bp, Artificial Sequence
  Description of Artificial Sequence: Synthetic oligonucleotide
aatgataggcacaaacgcgacacatatccagcc

SEQ ID NO: 318277 - DNA, 32 bp, Artificial Sequence
  Description of Artificial Sequence: Synthetic oligonucleotide
atgataggcacaaacgcgacacatatccagcc

SEQ ID NO: 318278 - DNA, 31 bp, Artificial Sequence
  Description of Artificial Sequence: Synthetic oligonucleotide
tgataggcacaaacgcgacacatatccagcc

SEQ ID NO: 318279 - DNA, 30 bp, Artificial Sequence
  Description of Artificial Sequence: Synthetic oligonucleotide
gataggcacaaacgcgacacatatccagcc

SEQ ID NO: 318280 - DNA, 31 bp, Artificial Sequence
  Description of Artificial Sequence: Synthetic oligonucleotide
ataggcacaaacgcgacacatatccagccac

SEQ ID NO: 318281 - DNA, 30 bp, Artificial Sequence
  Description of Artificial Sequence: Synthetic oligonucleotide
taggcacaaacgcgacacatatccagccac

SEQ ID NO: 318282 - DNA, 29 bp, Artificial Sequence
  Description of Artificial Sequence: Synthetic oligonucleotide
aggcacaaacgcgacacatatccagccac

SEQ ID NO: 318283 - DNA, 28 bp, Artificial Sequence
  Description of Artificial Sequence: Synthetic oligonucleotide
ggcacaaacgcgacacatatccagccac

SEQ ID NO: 318284 - DNA, 29 bp, Artificial Sequence
  Description of Artificial Sequence: Synthetic oligonucleotide
gcacaaacgcgacacatatccagccactc

SEQ ID NO: 318285 - DNA, 29 bp, Artificial Sequence
  Description of Artificial Sequence: Synthetic oligonucleotide
cacaaacgcgacacatatccagccactcg

SEQ ID NO: 318286 - DNA, 31 bp, Artificial Sequence
  Description of Artificial Sequence: Synthetic oligonucleotide
acaaacgcgacacatatccagccactcgtag

SEQ ID NO: 318287 - DNA, 30 bp, Artificial Sequence
  Description of Artificial Sequence: Synthetic oligonucleotide
caaacgcgacacatatccagccactcgtag

SEQ ID NO: 318288 - DNA, 31 bp, Artificial Sequence
  Description of Artificial Sequence: Synthetic oligonucleotide
aaacgcgacacatatccagccactcgtagag

SEQ ID NO: 318289 - DNA, 30 bp, Artificial Sequence
  Description of Artificial Sequence: Synthetic oligonucleotide
aacgcgacacatatccagccactcgtagag

SEQ ID NO: 318290 - DNA, 29 bp, Artificial Sequence
  Description of Artificial Sequence: Synthetic oligonucleotide
acgcgacacatatccagccactcgtagag

SEQ ID NO: 318291 - DNA, 28 bp, Artificial Sequence
  Description of Artificial Sequence: Synthetic oligonucleotide
cgcgacacatatccagccactcgtagag

SEQ ID NO: 318292 - DNA, 28 bp, Artificial Sequence
  Description of Artificial Sequence: Synthetic oligonucleotide
gcgacacatatccagccactcgtagagc

SEQ ID NO: 318293 - DNA, 29 bp, Artificial Sequence
  Description of Artificial Sequence: Synthetic oligonucleotide
cgacacatatccagccactcgtagagctc

SEQ ID NO: 318294 - DNA, 31 bp, Artificial Sequence
  Description of Artificial Sequence: Synthetic oligonucleotide
gacacatatccagccactcgtagagctcaag

SEQ ID NO: 318295 - DNA, 33 bp, Artificial Sequence
  Description of Artificial Sequence: Synthetic oligonucleotide
acacatatccagccactcgtagagctcaagaag

SEQ ID NO: 318296 - DNA, 32 bp, Artificial Sequence
  Description of Artificial Sequence: Synthetic oligonucleotide
cacatatccagccactcgtagagctcaagaag

SEQ ID NO: 318297 - DNA, 35 bp, Artificial Sequence
  Description of Artificial Sequence: Synthetic oligonucleotide
acatatccagccactcgtagagctcaagaagtttc

SEQ ID NO: 318298 - DNA, 34 bp, Artificial Sequence
  Description of Artificial Sequence: Synthetic oligonucleotide
catatccagccactcgtagagctcaagaagtttc

SEQ ID NO: 318299 - DNA, 35 bp, Artificial Sequence
  Description of Artificial Sequence: Synthetic oligonucleotide
atatccagccactcgtagagctcaagaagtttcac

SEQ ID NO: 318300 - DNA, 34 bp, Artificial Sequence
  Description of Artificial Sequence: Synthetic oligonucleotide
tatccagccactcgtagagctcaagaagtttcac

SEQ ID NO: 318301 - DNA, 33 bp, Artificial Sequence
  Description of Artificial Sequence: Synthetic oligonucleotide
atccagccactcgtagagctcaagaagtttcac

SEQ ID NO: 318302 - DNA, 32 bp, Artificial Sequence
  Description of Artificial Sequence: Synthetic oligonucleotide
tccagccactcgtagagctcaagaagtttcac

SEQ ID NO: 318303 - DNA, 31 bp, Artificial Sequence
  Description of Artificial Sequence: Synthetic oligonucleotide
ccagccactcgtagagctcaagaagtttcac

SEQ ID NO: 318304 - DNA, 37 bp, Artificial Sequence
  Description of Artificial Sequence: Synthetic oligonucleotide
cagccactcgtagagctcaagaagtttcacaaatttc

SEQ ID NO: 318305 - DNA, 38 bp, Artificial Sequence
  Description of Artificial Sequence: Synthetic oligonucleotide
agccactcgtagagctcaagaagtttcacaaatttctg

SEQ ID NO: 318306 - DNA, 37 bp, Artificial Sequence
  Description of Artificial Sequence: Synthetic oligonucleotide
gccactcgtagagctcaagaagtttcacaaatttctg

SEQ ID NO: 318307 - DNA, 40 bp, Artificial Sequence
  Description of Artificial Sequence: Synthetic oligonucleotide
ccactcgtagagctcaagaagtttcacaaatttctgatag

SEQ ID NO: 318308 - DNA, 42 bp, Artificial Sequence
  Description of Artificial Sequence: Synthetic oligonucleotide
cactcgtagagctcaagaagtttcacaaatttctgatagaac

SEQ ID NO: 318309 - DNA, 43 bp, Artificial Sequence
  Description of Artificial Sequence: Synthetic oligonucleotide
actcgtagagctcaagaagtttcacaaatttctgatagaactg

SEQ ID NO: 318310 - DNA, 42 bp, Artificial Sequence
  Description of Artificial Sequence: Synthetic oligonucleotide
ctcgtagagctcaagaagtttcacaaatttctgatagaactg

SEQ ID NO: 318311 - DNA, 46 bp, Artificial Sequence
  Description of Artificial Sequence: Synthetic oligonucleotide
tcgtagagctcaagaagtttcacaaatttctgatagaactgtatac

SEQ ID NO: 318312 - DNA, 45 bp, Artificial Sequence
  Description of Artificial Sequence: Synthetic oligonucleotide
cgtagagctcaagaagtttcacaaatttctgatagaactgtatac

SEQ ID NO: 318313 - DNA, 45 bp, Artificial Sequence
  Description of Artificial Sequence: Synthetic oligonucleotide
gtagagctcaagaagtttcacaaatttctgatagaactgtatacc

SEQ ID NO: 318314 - DNA, 45 bp, Artificial Sequence
  Description of Artificial Sequence: Synthetic oligonucleotide
tagagctcaagaagtttcacaaatttctgatagaactgtataccc

SEQ ID NO: 318315 - DNA, 44 bp, Artificial Sequence
  Description of Artificial Sequence: Synthetic oligonucleotide
agagctcaagaagtttcacaaatttctgatagaactgtataccc

SEQ ID NO: 318316 - DNA, 43 bp, Artificial Sequence
  Description of Artificial Sequence: Synthetic oligonucleotide
gagctcaagaagtttcacaaatttctgatagaactgtataccc

SEQ ID NO: 318317 - DNA, 44 bp, Artificial Sequence
  Description of Artificial Sequence: Synthetic oligonucleotide
agctcaagaagtttcacaaatttctgatagaactgtataccctc

SEQ ID NO: 318318 - DNA, 43 bp, Artificial Sequence
  Description of Artificial Sequence: Synthetic oligonucleotide
gctcaagaagtttcacaaatttctgatagaactgtataccctc

SEQ ID NO: 318319 - DNA, 43 bp, Artificial Sequence
  Description of Artificial Sequence: Synthetic oligonucleotide
ctcaagaagtttcacaaatttctgatagaactgtataccctcc

SEQ ID NO: 318320 - DNA, 44 bp, Artificial Sequence
  Description of Artificial Sequence: Synthetic oligonucleotide
tcaagaagtttcacaaatttctgatagaactgtataccctccac

SEQ ID NO: 318321 - DNA, 43 bp, Artificial Sequence
  Description of Artificial Sequence: Synthetic oligonucleotide
caagaagtttcacaaatttctgatagaactgtataccctccac

SEQ ID NO: 318322 - DNA, 45 bp, Artificial Sequence
  Description of Artificial Sequence: Synthetic oligonucleotide
aagaagtttcacaaatttctgatagaactgtataccctccacaag

SEQ ID NO: 318323 - DNA, 44 bp, Artificial Sequence
  Description of Artificial Sequence: Synthetic oligonucleotide
agaagtttcacaaatttctgatagaactgtataccctccacaag

SEQ ID NO: 318324 - DNA, 43 bp, Artificial Sequence
  Description of Artificial Sequence: Synthetic oligonucleotide
gaagtttcacaaatttctgatagaactgtataccctccacaag

SEQ ID NO: 318325 - DNA, 44 bp, Artificial Sequence
  Description of Artificial Sequence: Synthetic oligonucleotide
aagtttcacaaatttctgatagaactgtataccctccacaagag

SEQ ID NO: 318326 - DNA, 43 bp, Artificial Sequence
  Description of Artificial Sequence: Synthetic oligonucleotide
agtttcacaaatttctgatagaactgtataccctccacaagag

SEQ ID NO: 318327 - DNA, 42 bp, Artificial Sequence
  Description of Artificial Sequence: Synthetic oligonucleotide
gtttcacaaatttctgatagaactgtataccctccacaagag

SEQ ID NO: 318328 - DNA, 42 bp, Artificial Sequence
  Description of Artificial Sequence: Synthetic oligonucleotide
tttcacaaatttctgatagaactgtataccctccacaagagg

SEQ ID NO: 318329 - DNA, 41 bp, Artificial Sequence
  Description of Artificial Sequence: Synthetic oligonucleotide
ttcacaaatttctgatagaactgtataccctccacaagagg

SEQ ID NO: 318330 - DNA, 40 bp, Artificial Sequence
  Description of Artificial Sequence: Synthetic oligonucleotide
tcacaaatttctgatagaactgtataccctccacaagagg

SEQ ID NO: 318331 - DNA, 39 bp, Artificial Sequence
  Description of Artificial Sequence: Synthetic oligonucleotide
cacaaatttctgatagaactgtataccctccacaagagg

SEQ ID NO: 318332 - DNA, 42 bp, Artificial Sequence
  Description of Artificial Sequence: Synthetic oligonucleotide
acaaatttctgatagaactgtataccctccacaagaggaaag

SEQ ID NO: 318333 - DNA, 41 bp, Artificial Sequence
  Description of Artificial Sequence: Synthetic oligonucleotide
caaatttctgatagaactgtataccctccacaagaggaaag

SEQ ID NO: 318334 - DNA, 41 bp, Artificial Sequence
  Description of Artificial Sequence: Synthetic oligonucleotide
aaatttctgatagaactgtataccctccacaagaggaaagc

SEQ ID NO: 318335 - DNA, 40 bp, Artificial Sequence
  Description of Artificial Sequence: Synthetic oligonucleotide
aatttctgatagaactgtataccctccacaagaggaaagc

SEQ ID NO: 318336 - DNA, 39 bp, Artificial Sequence
  Description of Artificial Sequence: Synthetic oligonucleotide
atttctgatagaactgtataccctccacaagaggaaagc

SEQ ID NO: 318337 - DNA, 38 bp, Artificial Sequence
  Description of Artificial Sequence: Synthetic oligonucleotide
tttctgatagaactgtataccctccacaagaggaaagc

SEQ ID NO: 318338 - DNA, 37 bp, Artificial Sequence
  Description of Artificial Sequence: Synthetic oligonucleotide
ttctgatagaactgtataccctccacaagaggaaagc

SEQ ID NO: 318339 - DNA, 36 bp, Artificial Sequence
  Description of Artificial Sequence: Synthetic oligonucleotide
tctgatagaactgtataccctccacaagaggaaagc

SEQ ID NO: 318340 - DNA, 35 bp, Artificial Sequence
  Description of Artificial Sequence: Synthetic oligonucleotide
ctgatagaactgtataccctccacaagaggaaagc

SEQ ID NO: 318341 - DNA, 35 bp, Artificial Sequence
  Description of Artificial Sequence: Synthetic oligonucleotide
tgatagaactgtataccctccacaagaggaaagcg

SEQ ID NO: 318342 - DNA, 34 bp, Artificial Sequence
  Description of Artificial Sequence: Synthetic oligonucleotide
gatagaactgtataccctccacaagaggaaagcg

SEQ ID NO: 318343 - DNA, 34 bp, Artificial Sequence
  Description of Artificial Sequence: Synthetic oligonucleotide
atagaactgtataccctccacaagaggaaagcgg

SEQ ID NO: 318344 - DNA, 33 bp, Artificial Sequence
  Description of Artificial Sequence: Synthetic oligonucleotide
tagaactgtataccctccacaagaggaaagcgg

SEQ ID NO: 318345 - DNA, 32 bp, Artificial Sequence
  Description of Artificial Sequence: Synthetic oligonucleotide
agaactgtataccctccacaagaggaaagcgg

SEQ ID NO: 318346 - DNA, 31 bp, Artificial Sequence
  Description of Artificial Sequence: Synthetic oligonucleotide
gaactgtataccctccacaagaggaaagcgg

SEQ ID NO: 318347 - DNA, 32 bp, Artificial Sequence
  Description of Artificial Sequence: Synthetic oligonucleotide
aactgtataccctccacaagaggaaagcggag

SEQ ID NO: 318348 - DNA, 31 bp, Artificial Sequence
  Description of Artificial Sequence: Synthetic oligonucleotide
actgtataccctccacaagaggaaagcggag

SEQ ID NO: 318349 - DNA, 30 bp, Artificial Sequence
  Description of Artificial Sequence: Synthetic oligonucleotide
ctgtataccctccacaagaggaaagcggag

SEQ ID NO: 318350 - DNA, 33 bp, Artificial Sequence
  Description of Artificial Sequence: Synthetic oligonucleotide
tgtataccctccacaagaggaaagcggagaaag

SEQ ID NO: 318351 - DNA, 32 bp, Artificial Sequence
  Description of Artificial Sequence: Synthetic oligonucleotide
gtataccctccacaagaggaaagcggagaaag

SEQ ID NO: 318352 - DNA, 32 bp, Artificial Sequence
  Description of Artificial Sequence: Synthetic oligonucleotide
tataccctccacaagaggaaagcggagaaagc

SEQ ID NO: 318353 - DNA, 31 bp, Artificial Sequence
  Description of Artificial Sequence: Synthetic oligonucleotide
ataccctccacaagaggaaagcggagaaagc

SEQ ID NO: 318354 - DNA, 30 bp, Artificial Sequence
  Description of Artificial Sequence: Synthetic oligonucleotide
taccctccacaagaggaaagcggagaaagc

SEQ ID NO: 318355 - DNA, 29 bp, Artificial Sequence
  Description of Artificial Sequence: Synthetic oligonucleotide
accctccacaagaggaaagcggagaaagc

SEQ ID NO: 318356 - DNA, 28 bp, Artificial Sequence
  Description of Artificial Sequence: Synthetic oligonucleotide
ccctccacaagaggaaagcggagaaagc

SEQ ID NO: 318357 - DNA, 28 bp, Artificial Sequence
  Description of Artificial Sequence: Synthetic oligonucleotide
cctccacaagaggaaagcggagaaagcg

SEQ ID NO: 318358 - DNA, 30 bp, Artificial Sequence
  Description of Artificial Sequence: Synthetic oligonucleotide
ctccacaagaggaaagcggagaaagcgtac

SEQ ID NO: 318359 - DNA, 32 bp, Artificial Sequence
  Description of Artificial Sequence: Synthetic oligonucleotide
tccacaagaggaaagcggagaaagcgtacaac

SEQ ID NO: 318360 - DNA, 31 bp, Artificial Sequence
  Description of Artificial Sequence: Synthetic oligonucleotide
ccacaagaggaaagcggagaaagcgtacaac

SEQ ID NO: 318361 - DNA, 33 bp, Artificial Sequence
  Description of Artificial Sequence: Synthetic oligonucleotide
cacaagaggaaagcggagaaagcgtacaacttc

SEQ ID NO: 318362 - DNA, 33 bp, Artificial Sequence
  Description of Artificial Sequence: Synthetic oligonucleotide
acaagaggaaagcggagaaagcgtacaacttcc

SEQ ID NO: 318363 - DNA, 32 bp, Artificial Sequence
  Description of Artificial Sequence: Synthetic oligonucleotide
caagaggaaagcggagaaagcgtacaacttcc

SEQ ID NO: 318364 - DNA, 32 bp, Artificial Sequence
  Description of Artificial Sequence: Synthetic oligonucleotide
aagaggaaagcggagaaagcgtacaacttccc

SEQ ID NO: 318365 - DNA, 31 bp, Artificial Sequence
  Description of Artificial Sequence: Synthetic oligonucleotide
agaggaaagcggagaaagcgtacaacttccc

SEQ ID NO: 318366 - DNA, 30 bp, Artificial Sequence
  Description of Artificial Sequence: Synthetic oligonucleotide
gaggaaagcggagaaagcgtacaacttccc

SEQ ID NO: 318367 - DNA, 30 bp, Artificial Sequence
  Description of Artificial Sequence: Synthetic oligonucleotide
aggaaagcggagaaagcgtacaacttcccc

SEQ ID NO: 318368 - DNA, 29 bp, Artificial Sequence
  Description of Artificial Sequence: Synthetic oligonucleotide
ggaaagcggagaaagcgtacaacttcccc

SEQ ID NO: 318369 - DNA, 31 bp, Artificial Sequence
  Description of Artificial Sequence: Synthetic oligonucleotide
gaaagcggagaaagcgtacaacttccccatc

SEQ ID NO: 318370 - DNA, 35 bp, Artificial Sequence
  Description of Artificial Sequence: Synthetic oligonucleotide
aaagcggagaaagcgtacaacttccccatcattac

SEQ ID NO: 318371 - DNA, 34 bp, Artificial Sequence
  Description of Artificial Sequence: Synthetic oligonucleotide
aagcggagaaagcgtacaacttccccatcattac

SEQ ID NO: 318372 - DNA, 33 bp, Artificial Sequence
  Description of Artificial Sequence: Synthetic oligonucleotide
agcggagaaagcgtacaacttccccatcattac

SEQ ID NO: 318373 - DNA, 32 bp, Artificial Sequence
  Description of Artificial Sequence: Synthetic oligonucleotide
gcggagaaagcgtacaacttccccatcattac

SEQ ID NO: 318374 - DNA, 33 bp, Artificial Sequence
  Description of Artificial Sequence: Synthetic oligonucleotide
cggagaaagcgtacaacttccccatcattactc

SEQ ID NO: 318375 - DNA, 34 bp, Artificial Sequence
  Description of Artificial Sequence: Synthetic oligonucleotide
ggagaaagcgtacaacttccccatcattactctg

SEQ ID NO: 318376 - DNA, 36 bp, Artificial Sequence
  Description of Artificial Sequence: Synthetic oligonucleotide
gagaaagcgtacaacttccccatcattactctgaac

SEQ ID NO: 318377 - DNA, 36 bp, Artificial Sequence
  Description of Artificial Sequence: Synthetic oligonucleotide
agaaagcgtacaacttccccatcattactctgaacc

SEQ ID NO: 318378 - DNA, 35 bp, Artificial Sequence
  Description of Artificial Sequence: Synthetic oligonucleotide
gaaagcgtacaacttccccatcattactctgaacc

SEQ ID NO: 318379 - DNA, 36 bp, Artificial Sequence
  Description of Artificial Sequence: Synthetic oligonucleotide
aaagcgtacaacttccccatcattactctgaacctg

SEQ ID NO: 318380 - DNA, 35 bp, Artificial Sequence
  Description of Artificial Sequence: Synthetic oligonucleotide
aagcgtacaacttccccatcattactctgaacctg

SEQ ID NO: 318381 - DNA, 34 bp, Artificial Sequence
  Description of Artificial Sequence: Synthetic oligonucleotide
agcgtacaacttccccatcattactctgaacctg

SEQ ID NO: 318382 - DNA, 33 bp, Artificial Sequence
  Description of Artificial Sequence: Synthetic oligonucleotide
gcgtacaacttccccatcattactctgaacctg

SEQ ID NO: 318383 - DNA, 34 bp, Artificial Sequence
  Description of Artificial Sequence: Synthetic oligonucleotide
cgtacaacttccccatcattactctgaacctgag

SEQ ID NO: 318384 - DNA, 38 bp, Artificial Sequence
  Description of Artificial Sequence: Synthetic oligonucleotide
gtacaacttccccatcattactctgaacctgagataac

SEQ ID NO: 318385 - DNA, 39 bp, Artificial Sequence
  Description of Artificial Sequence: Synthetic oligonucleotide
tacaacttccccatcattactctgaacctgagataacag

SEQ ID NO: 318386 - DNA, 38 bp, Artificial Sequence
  Description of Artificial Sequence: Synthetic oligonucleotide
acaacttccccatcattactctgaacctgagataacag

SEQ ID NO: 318387 - DNA, 37 bp, Artificial Sequence
  Description of Artificial Sequence: Synthetic oligonucleotide
caacttccccatcattactctgaacctgagataacag

SEQ ID NO: 318388 - DNA, 38 bp, Artificial Sequence
  Description of Artificial Sequence: Synthetic oligonucleotide
aacttccccatcattactctgaacctgagataacagtc

SEQ ID NO: 318389 - DNA, 37 bp, Artificial Sequence
  Description of Artificial Sequence: Synthetic oligonucleotide
acttccccatcattactctgaacctgagataacagtc

SEQ ID NO: 318390 - DNA, 36 bp, Artificial Sequence
  Description of Artificial Sequence: Synthetic oligonucleotide
cttccccatcattactctgaacctgagataacagtc

SEQ ID NO: 318391 - DNA, 45 bp, Artificial Sequence
  Description of Artificial Sequence: Synthetic oligonucleotide
ttccccatcattactctgaacctgagataacagtcattatttatg

SEQ ID NO: 318392 - DNA, 44 bp, Artificial Sequence
  Description of Artificial Sequence: Synthetic oligonucleotide
tccccatcattactctgaacctgagataacagtcattatttatg

SEQ ID NO: 318393 - DNA, 43 bp, Artificial Sequence
  Description of Artificial Sequence: Synthetic oligonucleotide
ccccatcattactctgaacctgagataacagtcattatttatg

SEQ ID NO: 318394 - DNA, 43 bp, Artificial Sequence
  Description of Artificial Sequence: Synthetic oligonucleotide
cccatcattactctgaacctgagataacagtcattatttatgg

SEQ ID NO: 318395 - DNA, 43 bp, Artificial Sequence
  Description of Artificial Sequence: Synthetic oligonucleotide
ccatcattactctgaacctgagataacagtcattatttatggg

SEQ ID NO: 318396 - DNA, 43 bp, Artificial Sequence
  Description of Artificial Sequence: Synthetic oligonucleotide
catcattactctgaacctgagataacagtcattatttatgggg

SEQ ID NO: 318397 - DNA, 44 bp, Artificial Sequence
  Description of Artificial Sequence: Synthetic oligonucleotide
atcattactctgaacctgagataacagtcattatttatggggtg

SEQ ID NO: 318398 - DNA, 43 bp, Artificial Sequence
  Description of Artificial Sequence: Synthetic oligonucleotide
tcattactctgaacctgagataacagtcattatttatggggtg

SEQ ID NO: 318399 - DNA, 42 bp, Artificial Sequence
  Description of Artificial Sequence: Synthetic oligonucleotide
cattactctgaacctgagataacagtcattatttatggggtg

SEQ ID NO: 318400 - DNA, 44 bp, Artificial Sequence
  Description of Artificial Sequence: Synthetic oligonucleotide
attactctgaacctgagataacagtcattatttatggggtgatc

SEQ ID NO: 318401 - DNA, 43 bp, Artificial Sequence
  Description of Artificial Sequence: Synthetic oligonucleotide
ttactctgaacctgagataacagtcattatttatggggtgatc

SEQ ID NO: 318402 - DNA, 42 bp, Artificial Sequence
  Description of Artificial Sequence: Synthetic oligonucleotide
tactctgaacctgagataacagtcattatttatggggtgatc

SEQ ID NO: 318403 - DNA, 41 bp, Artificial Sequence
  Description of Artificial Sequence: Synthetic oligonucleotide
actctgaacctgagataacagtcattatttatggggtgatc

SEQ ID NO: 318404 - DNA, 40 bp, Artificial Sequence
  Description of Artificial Sequence: Synthetic oligonucleotide
ctctgaacctgagataacagtcattatttatggggtgatc

SEQ ID NO: 318405 - DNA, 40 bp, Artificial Sequence
  Description of Artificial Sequence: Synthetic oligonucleotide
tctgaacctgagataacagtcattatttatggggtgatcg

SEQ ID NO: 318406 - DNA, 39 bp, Artificial Sequence
  Description of Artificial Sequence: Synthetic oligonucleotide
ctgaacctgagataacagtcattatttatggggtgatcg

SEQ ID NO: 318407 - DNA, 39 bp, Artificial Sequence
  Description of Artificial Sequence: Synthetic oligonucleotide
tgaacctgagataacagtcattatttatggggtgatcgc

SEQ ID NO: 318408 - DNA, 38 bp, Artificial Sequence
  Description of Artificial Sequence: Synthetic oligonucleotide
gaacctgagataacagtcattatttatggggtgatcgc

SEQ ID NO: 318409 - DNA, 39 bp, Artificial Sequence
  Description of Artificial Sequence: Synthetic oligonucleotide
aacctgagataacagtcattatttatggggtgatcgctg

SEQ ID NO: 318410 - DNA, 38 bp, Artificial Sequence
  Description of Artificial Sequence: Synthetic oligonucleotide
acctgagataacagtcattatttatggggtgatcgctg

SEQ ID NO: 318411 - DNA, 37 bp, Artificial Sequence
  Description of Artificial Sequence: Synthetic oligonucleotide
cctgagataacagtcattatttatggggtgatcgctg

SEQ ID NO: 318412 - DNA, 37 bp, Artificial Sequence
  Description of Artificial Sequence: Synthetic oligonucleotide
ctgagataacagtcattatttatggggtgatcgctgg

SEQ ID NO: 318413 - DNA, 38 bp, Artificial Sequence
  Description of Artificial Sequence: Synthetic oligonucleotide
tgagataacagtcattatttatggggtgatcgctggtg

SEQ ID NO: 318414 - DNA, 37 bp, Artificial Sequence
  Description of Artificial Sequence: Synthetic oligonucleotide
gagataacagtcattatttatggggtgatcgctggtg

SEQ ID NO: 318415 - DNA, 42 bp, Artificial Sequence
  Description of Artificial Sequence: Synthetic oligonucleotide
agataacagtcattatttatggggtgatcgctggtgtttttg

SEQ ID NO: 318416 - DNA, 41 bp, Artificial Sequence
  Description of Artificial Sequence: Synthetic oligonucleotide
gataacagtcattatttatggggtgatcgctggtgtttttg

SEQ ID NO: 318417 - DNA, 41 bp, Artificial Sequence
  Description of Artificial Sequence: Synthetic oligonucleotide
ataacagtcattatttatggggtgatcgctggtgtttttgg

SEQ ID NO: 318418 - DNA, 40 bp, Artificial Sequence
  Description of Artificial Sequence: Synthetic oligonucleotide
taacagtcattatttatggggtgatcgctggtgtttttgg

SEQ ID NO: 318419 - DNA, 39 bp, Artificial Sequence
  Description of Artificial Sequence: Synthetic oligonucleotide
aacagtcattatttatggggtgatcgctggtgtttttgg

SEQ ID NO: 318420 - DNA, 38 bp, Artificial Sequence
  Description of Artificial Sequence: Synthetic oligonucleotide
acagtcattatttatggggtgatcgctggtgtttttgg

SEQ ID NO: 318421 - DNA, 37 bp, Artificial Sequence
  Description of Artificial Sequence: Synthetic oligonucleotide
cagtcattatttatggggtgatcgctggtgtttttgg

SEQ ID NO: 318422 - DNA, 39 bp, Artificial Sequence
  Description of Artificial Sequence: Synthetic oligonucleotide
agtcattatttatggggtgatcgctggtgtttttggaac

SEQ ID NO: 318423 - DNA, 38 bp, Artificial Sequence
  Description of Artificial Sequence: Synthetic oligonucleotide
gtcattatttatggggtgatcgctggtgtttttggaac

SEQ ID NO: 318424 - DNA, 38 bp, Artificial Sequence
  Description of Artificial Sequence: Synthetic oligonucleotide
tcattatttatggggtgatcgctggtgtttttggaacg

SEQ ID NO: 318425 - DNA, 37 bp, Artificial Sequence
  Description of Artificial Sequence: Synthetic oligonucleotide
cattatttatggggtgatcgctggtgtttttggaacg

SEQ ID NO: 318426 - DNA, 39 bp, Artificial Sequence
  Description of Artificial Sequence: Synthetic oligonucleotide
attatttatggggtgatcgctggtgtttttggaacgaac

SEQ ID NO: 318427 - DNA, 38 bp, Artificial Sequence
  Description of Artificial Sequence: Synthetic oligonucleotide
ttatttatggggtgatcgctggtgtttttggaacgaac

SEQ ID NO: 318428 - DNA, 37 bp, Artificial Sequence
  Description of Artificial Sequence: Synthetic oligonucleotide
tatttatggggtgatcgctggtgtttttggaacgaac

SEQ ID NO: 318429 - DNA, 36 bp, Artificial Sequence
  Description of Artificial Sequence: Synthetic oligonucleotide
atttatggggtgatcgctggtgtttttggaacgaac

SEQ ID NO: 318430 - DNA, 35 bp, Artificial Sequence
  Description of Artificial Sequence: Synthetic oligonucleotide
tttatggggtgatcgctggtgtttttggaacgaac

SEQ ID NO: 318431 - DNA, 34 bp, Artificial Sequence
  Description of Artificial Sequence: Synthetic oligonucleotide
ttatggggtgatcgctggtgtttttggaacgaac

SEQ ID NO: 318432 - DNA, 33 bp, Artificial Sequence
  Description of Artificial Sequence: Synthetic oligonucleotide
tatggggtgatcgctggtgtttttggaacgaac

SEQ ID NO: 318433 - DNA, 32 bp, Artificial Sequence
  Description of Artificial Sequence: Synthetic oligonucleotide
atggggtgatcgctggtgtttttggaacgaac

SEQ ID NO: 318434 - DNA, 31 bp, Artificial Sequence
  Description of Artificial Sequence: Synthetic oligonucleotide
tggggtgatcgctggtgtttttggaacgaac

SEQ ID NO: 318435 - DNA, 30 bp, Artificial Sequence
  Description of Artificial Sequence: Synthetic oligonucleotide
ggggtgatcgctggtgtttttggaacgaac

SEQ ID NO: 318436 - DNA, 30 bp, Artificial Sequence
  Description of Artificial Sequence: Synthetic oligonucleotide
gggtgatcgctggtgtttttggaacgaacc

SEQ ID NO: 318437 - DNA, 31 bp, Artificial Sequence
  Description of Artificial Sequence: Synthetic oligonucleotide
ggtgatcgctggtgtttttggaacgaacctc

SEQ ID NO: 318438 - DNA, 38 bp, Artificial Sequence
  Description of Artificial Sequence: Synthetic oligonucleotide
gtgatcgctggtgtttttggaacgaacctcttaatatc

SEQ ID NO: 318439 - DNA, 41 bp, Artificial Sequence
  Description of Artificial Sequence: Synthetic oligonucleotide
tgatcgctggtgtttttggaacgaacctcttaatatcttac

SEQ ID NO: 318440 - DNA, 40 bp, Artificial Sequence
  Description of Artificial Sequence: Synthetic oligonucleotide
gatcgctggtgtttttggaacgaacctcttaatatcttac

SEQ ID NO: 318441 - DNA, 40 bp, Artificial Sequence
  Description of Artificial Sequence: Synthetic oligonucleotide
atcgctggtgtttttggaacgaacctcttaatatcttacg

SEQ ID NO: 318442 - DNA, 39 bp, Artificial Sequence
  Description of Artificial Sequence: Synthetic oligonucleotide
tcgctggtgtttttggaacgaacctcttaatatcttacg

SEQ ID NO: 318443 - DNA, 38 bp, Artificial Sequence
  Description of Artificial Sequence: Synthetic oligonucleotide
cgctggtgtttttggaacgaacctcttaatatcttacg

SEQ ID NO: 318444 - DNA, 38 bp, Artificial Sequence
  Description of Artificial Sequence: Synthetic oligonucleotide
gctggtgtttttggaacgaacctcttaatatcttacgg

SEQ ID NO: 318445 - DNA, 42 bp, Artificial Sequence
  Description of Artificial Sequence: Synthetic oligonucleotide
ctggtgtttttggaacgaacctcttaatatcttacggttttc

SEQ ID NO: 318446 - DNA, 42 bp, Artificial Sequence
  Description of Artificial Sequence: Synthetic oligonucleotide
tggtgtttttggaacgaacctcttaatatcttacggttttcg

SEQ ID NO: 318447 - DNA, 41 bp, Artificial Sequence
  Description of Artificial Sequence: Synthetic oligonucleotide
ggtgtttttggaacgaacctcttaatatcttacggttttcg

SEQ ID NO: 318448 - DNA, 41 bp, Artificial Sequence
  Description of Artificial Sequence: Synthetic oligonucleotide
gtgtttttggaacgaacctcttaatatcttacggttttcgc

SEQ ID NO: 318449 - DNA, 41 bp, Artificial Sequence
  Description of Artificial Sequence: Synthetic oligonucleotide
tgtttttggaacgaacctcttaatatcttacggttttcgcc

SEQ ID NO: 318450 - DNA, 40 bp, Artificial Sequence
  Description of Artificial Sequence: Synthetic oligonucleotide
gtttttggaacgaacctcttaatatcttacggttttcgcc

SEQ ID NO: 318451 - DNA, 40 bp, Artificial Sequence
  Description of Artificial Sequence: Synthetic oligonucleotide
tttttggaacgaacctcttaatatcttacggttttcgccg

SEQ ID NO: 318452 - DNA, 39 bp, Artificial Sequence
  Description of Artificial Sequence: Synthetic oligonucleotide
ttttggaacgaacctcttaatatcttacggttttcgccg

SEQ ID NO: 318453 - DNA, 38 bp, Artificial Sequence
  Description of Artificial Sequence: Synthetic oligonucleotide
tttggaacgaacctcttaatatcttacggttttcgccg

SEQ ID NO: 318454 - DNA, 37 bp, Artificial Sequence
  Description of Artificial Sequence: Synthetic oligonucleotide
ttggaacgaacctcttaatatcttacggttttcgccg

SEQ ID NO: 318455 - DNA, 36 bp, Artificial Sequence
  Description of Artificial Sequence: Synthetic oligonucleotide
tggaacgaacctcttaatatcttacggttttcgccg

SEQ ID NO: 318456 - DNA, 35 bp, Artificial Sequence
  Description of Artificial Sequence: Synthetic oligonucleotide
ggaacgaacctcttaatatcttacggttttcgccg

SEQ ID NO: 318457 - DNA, 36 bp, Artificial Sequence
  Description of Artificial Sequence: Synthetic oligonucleotide
gaacgaacctcttaatatcttacggttttcgccgac

SEQ ID NO: 318458 - DNA, 37 bp, Artificial Sequence
  Description of Artificial Sequence: Synthetic oligonucleotide
aacgaacctcttaatatcttacggttttcgccgacag

SEQ ID NO: 318459 - DNA, 36 bp, Artificial Sequence
  Description of Artificial Sequence: Synthetic oligonucleotide
acgaacctcttaatatcttacggttttcgccgacag

SEQ ID NO: 318460 - DNA, 35 bp, Artificial Sequence
  Description of Artificial Sequence: Synthetic oligonucleotide
cgaacctcttaatatcttacggttttcgccgacag

SEQ ID NO: 318461 - DNA, 40 bp, Artificial Sequence
  Description of Artificial Sequence: Synthetic oligonucleotide
gaacctcttaatatcttacggttttcgccgacagataaag

SEQ ID NO: 318462 - DNA, 44 bp, Artificial Sequence
  Description of Artificial Sequence: Synthetic oligonucleotide
aacctcttaatatcttacggttttcgccgacagataaagaatag

SEQ ID NO: 318463 - DNA, 43 bp, Artificial Sequence
  Description of Artificial Sequence: Synthetic oligonucleotide
acctcttaatatcttacggttttcgccgacagataaagaatag

SEQ ID NO: 318464 - DNA, 42 bp, Artificial Sequence
  Description of Artificial Sequence: Synthetic oligonucleotide
cctcttaatatcttacggttttcgccgacagataaagaatag

SEQ ID NO: 318465 - DNA, 42 bp, Artificial Sequence
  Description of Artificial Sequence: Synthetic oligonucleotide
ctcttaatatcttacggttttcgccgacagataaagaatagc

SEQ ID NO: 318466 - DNA, 42 bp, Artificial Sequence
  Description of Artificial Sequence: Synthetic oligonucleotide
tcttaatatcttacggttttcgccgacagataaagaatagcc

SEQ ID NO: 318467 - DNA, 41 bp, Artificial Sequence
  Description of Artificial Sequence: Synthetic oligonucleotide
cttaatatcttacggttttcgccgacagataaagaatagcc

SEQ ID NO: 318468 - DNA, 41 bp, Artificial Sequence
  Description of Artificial Sequence: Synthetic oligonucleotide
ttaatatcttacggttttcgccgacagataaagaatagccc

SEQ ID NO: 318469 - DNA, 40 bp, Artificial Sequence
  Description of Artificial Sequence: Synthetic oligonucleotide
taatatcttacggttttcgccgacagataaagaatagccc

SEQ ID NO: 318470 - DNA, 39 bp, Artificial Sequence
  Description of Artificial Sequence: Synthetic oligonucleotide
aatatcttacggttttcgccgacagataaagaatagccc

SEQ ID NO: 318471 - DNA, 38 bp, Artificial Sequence
  Description of Artificial Sequence: Synthetic oligonucleotide
atatcttacggttttcgccgacagataaagaatagccc

SEQ ID NO: 318472 - DNA, 37 bp, Artificial Sequence
  Description of Artificial Sequence: Synthetic oligonucleotide
tatcttacggttttcgccgacagataaagaatagccc

SEQ ID NO: 318473 - DNA, 36 bp, Artificial Sequence
  Description of Artificial Sequence: Synthetic oligonucleotide
atcttacggttttcgccgacagataaagaatagccc

SEQ ID NO: 318474 - DNA, 35 bp, Artificial Sequence
  Description of Artificial Sequence: Synthetic oligonucleotide
tcttacggttttcgccgacagataaagaatagccc

SEQ ID NO: 318475 - DNA, 34 bp, Artificial Sequence
  Description of Artificial Sequence: Synthetic oligonucleotide
cttacggttttcgccgacagataaagaatagccc

SEQ ID NO: 318476 - DNA, 36 bp, Artificial Sequence
  Description of Artificial Sequence: Synthetic oligonucleotide
ttacggttttcgccgacagataaagaatagcccatc

SEQ ID NO: 318477 - DNA, 35 bp, Artificial Sequence
  Description of Artificial Sequence: Synthetic oligonucleotide
tacggttttcgccgacagataaagaatagcccatc

SEQ ID NO: 318478 - DNA, 34 bp, Artificial Sequence
  Description of Artificial Sequence: Synthetic oligonucleotide
acggttttcgccgacagataaagaatagcccatc

SEQ ID NO: 318479 - DNA, 33 bp, Artificial Sequence
  Description of Artificial Sequence: Synthetic oligonucleotide
cggttttcgccgacagataaagaatagcccatc

SEQ ID NO: 318480 - DNA, 34 bp, Artificial Sequence
  Description of Artificial Sequence: Synthetic oligonucleotide
ggttttcgccgacagataaagaatagcccatctc

SEQ ID NO: 318481 - DNA, 36 bp, Artificial Sequence
  Description of Artificial Sequence: Synthetic oligonucleotide
gttttcgccgacagataaagaatagcccatctcatg

SEQ ID NO: 318482 - DNA, 41 bp, Artificial Sequence
  Description of Artificial Sequence: Synthetic oligonucleotide
ttttcgccgacagataaagaatagcccatctcatgtaaaac

SEQ ID NO: 318483 - DNA, 40 bp, Artificial Sequence
  Description of Artificial Sequence: Synthetic oligonucleotide
tttcgccgacagataaagaatagcccatctcatgtaaaac

SEQ ID NO: 318484 - DNA, 39 bp, Artificial Sequence
  Description of Artificial Sequence: Synthetic oligonucleotide
ttcgccgacagataaagaatagcccatctcatgtaaaac

SEQ ID NO: 318485 - DNA, 38 bp, Artificial Sequence
  Description of Artificial Sequence: Synthetic oligonucleotide
tcgccgacagataaagaatagcccatctcatgtaaaac

SEQ ID NO: 318486 - DNA, 37 bp, Artificial Sequence
  Description of Artificial Sequence: Synthetic oligonucleotide
cgccgacagataaagaatagcccatctcatgtaaaac

SEQ ID NO: 318487 - DNA, 37 bp, Artificial Sequence
  Description of Artificial Sequence: Synthetic oligonucleotide
gccgacagataaagaatagcccatctcatgtaaaacg

SEQ ID NO: 318488 - DNA, 38 bp, Artificial Sequence
  Description of Artificial Sequence: Synthetic oligonucleotide
ccgacagataaagaatagcccatctcatgtaaaacgtc

SEQ ID NO: 318489 - DNA, 39 bp, Artificial Sequence
  Description of Artificial Sequence: Synthetic oligonucleotide
cgacagataaagaatagcccatctcatgtaaaacgtctc

SEQ ID NO: 318490 - DNA, 39 bp, Artificial Sequence
  Description of Artificial Sequence: Synthetic oligonucleotide
gacagataaagaatagcccatctcatgtaaaacgtctcc

SEQ ID NO: 318491 - DNA, 39 bp, Artificial Sequence
  Description of Artificial Sequence: Synthetic oligonucleotide
acagataaagaatagcccatctcatgtaaaacgtctccc

SEQ ID NO: 318492 - DNA, 38 bp, Artificial Sequence
  Description of Artificial Sequence: Synthetic oligonucleotide
cagataaagaatagcccatctcatgtaaaacgtctccc

SEQ ID NO: 318493 - DNA, 38 bp, Artificial Sequence
  Description of Artificial Sequence: Synthetic oligonucleotide
agataaagaatagcccatctcatgtaaaacgtctcccc

SEQ ID NO: 318494 - DNA, 37 bp, Artificial Sequence
  Description of Artificial Sequence: Synthetic oligonucleotide
gataaagaatagcccatctcatgtaaaacgtctcccc

SEQ ID NO: 318495 - DNA, 38 bp, Artificial Sequence
  Description of Artificial Sequence: Synthetic oligonucleotide
ataaagaatagcccatctcatgtaaaacgtctcccctc

SEQ ID NO: 318496 - DNA, 37 bp, Artificial Sequence
  Description of Artificial Sequence: Synthetic oligonucleotide
taaagaatagcccatctcatgtaaaacgtctcccctc

SEQ ID NO: 318497 - DNA, 36 bp, Artificial Sequence
  Description of Artificial Sequence: Synthetic oligonucleotide
aaagaatagcccatctcatgtaaaacgtctcccctc

SEQ ID NO: 318498 - DNA, 35 bp, Artificial Sequence
  Description of Artificial Sequence: Synthetic oligonucleotide
aagaatagcccatctcatgtaaaacgtctcccctc

SEQ ID NO: 318499 - DNA, 34 bp, Artificial Sequence
  Description of Artificial Sequence: Synthetic oligonucleotide
agaatagcccatctcatgtaaaacgtctcccctc

SEQ ID NO: 318500 - DNA, 33 bp, Artificial Sequence
  Description of Artificial Sequence: Synthetic oligonucleotide
gaatagcccatctcatgtaaaacgtctcccctc

SEQ ID NO: 318501 - DNA, 34 bp, Artificial Sequence
  Description of Artificial Sequence: Synthetic oligonucleotide
aatagcccatctcatgtaaaacgtctcccctctc

SEQ ID NO: 318502 - DNA, 33 bp, Artificial Sequence
  Description of Artificial Sequence: Synthetic oligonucleotide
atagcccatctcatgtaaaacgtctcccctctc

SEQ ID NO: 318503 - DNA, 32 bp, Artificial Sequence
  Description of Artificial Sequence: Synthetic oligonucleotide
tagcccatctcatgtaaaacgtctcccctctc

SEQ ID NO: 318504 - DNA, 31 bp, Artificial Sequence
  Description of Artificial Sequence: Synthetic oligonucleotide
agcccatctcatgtaaaacgtctcccctctc

SEQ ID NO: 318505 - DNA, 30 bp, Artificial Sequence
  Description of Artificial Sequence: Synthetic oligonucleotide
gcccatctcatgtaaaacgtctcccctctc

SEQ ID NO: 318506 - DNA, 30 bp, Artificial Sequence
  Description of Artificial Sequence: Synthetic oligonucleotide
cccatctcatgtaaaacgtctcccctctcc

SEQ ID NO: 318507 - DNA, 31 bp, Artificial Sequence
  Description of Artificial Sequence: Synthetic oligonucleotide
ccatctcatgtaaaacgtctcccctctcctg

SEQ ID NO: 318508 - DNA, 32 bp, Artificial Sequence
  Description of Artificial Sequence: Synthetic oligonucleotide
catctcatgtaaaacgtctcccctctcctgac

SEQ ID NO: 318509 - DNA, 33 bp, Artificial Sequence
  Description of Artificial Sequence: Synthetic oligonucleotide
atctcatgtaaaacgtctcccctctcctgacac

SEQ ID NO: 318510 - DNA, 32 bp, Artificial Sequence
  Description of Artificial Sequence: Synthetic oligonucleotide
tctcatgtaaaacgtctcccctctcctgacac

SEQ ID NO: 318511 - DNA, 31 bp, Artificial Sequence
  Description of Artificial Sequence: Synthetic oligonucleotide
ctcatgtaaaacgtctcccctctcctgacac

SEQ ID NO: 318512 - DNA, 32 bp, Artificial Sequence
  Description of Artificial Sequence: Synthetic oligonucleotide
tcatgtaaaacgtctcccctctcctgacacac

SEQ ID NO: 318513 - DNA, 31 bp, Artificial Sequence
  Description of Artificial Sequence: Synthetic oligonucleotide
catgtaaaacgtctcccctctcctgacacac

SEQ ID NO: 318514 - DNA, 32 bp, Artificial Sequence
  Description of Artificial Sequence: Synthetic oligonucleotide
atgtaaaacgtctcccctctcctgacacacac

SEQ ID NO: 318515 - DNA, 31 bp, Artificial Sequence
  Description of Artificial Sequence: Synthetic oligonucleotide
tgtaaaacgtctcccctctcctgacacacac

SEQ ID NO: 318516 - DNA, 30 bp, Artificial Sequence
  Description of Artificial Sequence: Synthetic oligonucleotide
gtaaaacgtctcccctctcctgacacacac

SEQ ID NO: 318517 - DNA, 30 bp, Artificial Sequence
  Description of Artificial Sequence: Synthetic oligonucleotide
taaaacgtctcccctctcctgacacacacg

SEQ ID NO: 318518 - DNA, 29 bp, Artificial Sequence
  Description of Artificial Sequence: Synthetic oligonucleotide
aaaacgtctcccctctcctgacacacacg

SEQ ID NO: 318519 - DNA, 28 bp, Artificial Sequence
  Description of Artificial Sequence: Synthetic oligonucleotide
aaacgtctcccctctcctgacacacacg

SEQ ID NO: 318520 - DNA, 27 bp, Artificial Sequence
  Description of Artificial Sequence: Synthetic oligonucleotide
aacgtctcccctctcctgacacacacg

SEQ ID NO: 318521 - DNA, 27 bp, Artificial Sequence
  Description of Artificial Sequence: Synthetic oligonucleotide
acgtctcccctctcctgacacacacgt

SEQ ID NO: 318522 - DNA, 26 bp, Artificial Sequence
  Description of Artificial Sequence: Synthetic oligonucleotide
cgtctcccctctcctgacacacacgt

SEQ ID NO: 318523 - DNA, 26 bp, Artificial Sequence
  Description of Artificial Sequence: Synthetic oligonucleotide
gtctcccctctcctgacacacacgtg

SEQ ID NO: 318524 - DNA, 26 bp, Artificial Sequence
  Description of Artificial Sequence: Synthetic oligonucleotide
tctcccctctcctgacacacacgtgc

SEQ ID NO: 318525 - DNA, 25 bp, Artificial Sequence
  Description of Artificial Sequence: Synthetic oligonucleotide
ctcccctctcctgacacacacgtgc

SEQ ID NO: 318526 - DNA, 27 bp, Artificial Sequence
  Description of Artificial Sequence: Synthetic oligonucleotide
tcccctctcctgacacacacgtgcctt

SEQ ID NO: 318527 - DNA, 27 bp, Artificial Sequence
  Description of Artificial Sequence: Synthetic oligonucleotide
cccctctcctgacacacacgtgcctta

SEQ ID NO: 318528 - DNA, 29 bp, Artificial Sequence
  Description of Artificial Sequence: Synthetic oligonucleotide
ccctctcctgacacacacgtgccttaaag

SEQ ID NO: 318529 - DNA, 31 bp, Artificial Sequence
  Description of Artificial Sequence: Synthetic oligonucleotide
cctctcctgacacacacgtgccttaaagttc

SEQ ID NO: 318530 - DNA, 32 bp, Artificial Sequence
  Description of Artificial Sequence: Synthetic oligonucleotide
ctctcctgacacacacgtgccttaaagttctg

SEQ ID NO: 318531 - DNA, 34 bp, Artificial Sequence
  Description of Artificial Sequence: Synthetic oligonucleotide
tctcctgacacacacgtgccttaaagttctgtag

SEQ ID NO: 318532 - DNA, 33 bp, Artificial Sequence
  Description of Artificial Sequence: Synthetic oligonucleotide
ctcctgacacacacgtgccttaaagttctgtag

SEQ ID NO: 318533 - DNA, 38 bp, Artificial Sequence
  Description of Artificial Sequence: Synthetic oligonucleotide
tcctgacacacacgtgccttaaagttctgtagaaatag

SEQ ID NO: 318534 - DNA, 37 bp, Artificial Sequence
  Description of Artificial Sequence: Synthetic oligonucleotide
cctgacacacacgtgccttaaagttctgtagaaatag

SEQ ID NO: 318535 - DNA, 42 bp, Artificial Sequence
  Description of Artificial Sequence: Synthetic oligonucleotide
ctgacacacacgtgccttaaagttctgtagaaatagaatatc

SEQ ID NO: 318536 - DNA, 42 bp, Artificial Sequence
  Description of Artificial Sequence: Synthetic oligonucleotide
tgacacacacgtgccttaaagttctgtagaaatagaatatcc

SEQ ID NO: 318537 - DNA, 41 bp, Artificial Sequence
  Description of Artificial Sequence: Synthetic oligonucleotide
gacacacacgtgccttaaagttctgtagaaatagaatatcc

SEQ ID NO: 318538 - DNA, 42 bp, Artificial Sequence
  Description of Artificial Sequence: Synthetic oligonucleotide
acacacacgtgccttaaagttctgtagaaatagaatatccag

SEQ ID NO: 318539 - DNA, 41 bp, Artificial Sequence
  Description of Artificial Sequence: Synthetic oligonucleotide
cacacacgtgccttaaagttctgtagaaatagaatatccag

SEQ ID NO: 318540 - DNA, 42 bp, Artificial Sequence
  Description of Artificial Sequence: Synthetic oligonucleotide
acacacgtgccttaaagttctgtagaaatagaatatccagag

SEQ ID NO: 318541 - DNA, 41 bp, Artificial Sequence
  Description of Artificial Sequence: Synthetic oligonucleotide
cacacgtgccttaaagttctgtagaaatagaatatccagag

SEQ ID NO: 318542 - DNA, 42 bp, Artificial Sequence
  Description of Artificial Sequence: Synthetic oligonucleotide
acacgtgccttaaagttctgtagaaatagaatatccagagag

SEQ ID NO: 318543 - DNA, 41 bp, Artificial Sequence
  Description of Artificial Sequence: Synthetic oligonucleotide
cacgtgccttaaagttctgtagaaatagaatatccagagag

SEQ ID NO: 318544 - DNA, 43 bp, Artificial Sequence
  Description of Artificial Sequence: Synthetic oligonucleotide
acgtgccttaaagttctgtagaaatagaatatccagagagaag

SEQ ID NO: 318545 - DNA, 42 bp, Artificial Sequence
  Description of Artificial Sequence: Synthetic oligonucleotide
cgtgccttaaagttctgtagaaatagaatatccagagagaag

SEQ ID NO: 318546 - DNA, 43 bp, Artificial Sequence
  Description of Artificial Sequence: Synthetic oligonucleotide
gtgccttaaagttctgtagaaatagaatatccagagagaagtg

SEQ ID NO: 318547 - DNA, 45 bp, Artificial Sequence
  Description of Artificial Sequence: Synthetic oligonucleotide
tgccttaaagttctgtagaaatagaatatccagagagaagtgatc

SEQ ID NO: 318548 - DNA, 44 bp, Artificial Sequence
  Description of Artificial Sequence: Synthetic oligonucleotide
gccttaaagttctgtagaaatagaatatccagagagaagtgatc

SEQ ID NO: 318549 - DNA, 47 bp, Artificial Sequence
  Description of Artificial Sequence: Synthetic oligonucleotide
ccttaaagttctgtagaaatagaatatccagagagaagtgatcattg

SEQ ID NO: 318550 - DNA, 55 bp, Artificial Sequence
  Description of Artificial Sequence: Synthetic oligonucleotide
atgtatggataaataatctatgtattacttttgtcaggatttgtgagcaaatcag

SEQ ID NO: 318551 - DNA, 54 bp, Artificial Sequence
  Description of Artificial Sequence: Synthetic oligonucleotide
tgtatggataaataatctatgtattacttttgtcaggatttgtgagcaaatcag

SEQ ID NO: 318552 - DNA, 53 bp, Artificial Sequence
  Description of Artificial Sequence: Synthetic oligonucleotide
gtatggataaataatctatgtattacttttgtcaggatttgtgagcaaatcag

SEQ ID NO: 318553 - DNA, 53 bp, Artificial Sequence
  Description of Artificial Sequence: Synthetic oligonucleotide
tatggataaataatctatgtattacttttgtcaggatttgtgagcaaatcagc

SEQ ID NO: 318554 - DNA, 52 bp, Artificial Sequence
  Description of Artificial Sequence: Synthetic oligonucleotide
atggataaataatctatgtattacttttgtcaggatttgtgagcaaatcagc

SEQ ID NO: 318555 - DNA, 51 bp, Artificial Sequence
  Description of Artificial Sequence: Synthetic oligonucleotide
tggataaataatctatgtattacttttgtcaggatttgtgagcaaatcagc

SEQ ID NO: 318556 - DNA, 50 bp, Artificial Sequence
  Description of Artificial Sequence: Synthetic oligonucleotide
ggataaataatctatgtattacttttgtcaggatttgtgagcaaatcagc

SEQ ID NO: 318557 - DNA, 52 bp, Artificial Sequence
  Description of Artificial Sequence: Synthetic oligonucleotide
gataaataatctatgtattacttttgtcaggatttgtgagcaaatcagcatc

SEQ ID NO: 318558 - DNA, 54 bp, Artificial Sequence
  Description of Artificial Sequence: Synthetic oligonucleotide
ataaataatctatgtattacttttgtcaggatttgtgagcaaatcagcatctag

SEQ ID NO: 318559 - DNA, 53 bp, Artificial Sequence
  Description of Artificial Sequence: Synthetic oligonucleotide
taaataatctatgtattacttttgtcaggatttgtgagcaaatcagcatctag

SEQ ID NO: 318560 - DNA, 52 bp, Artificial Sequence
  Description of Artificial Sequence: Synthetic oligonucleotide
aaataatctatgtattacttttgtcaggatttgtgagcaaatcagcatctag

SEQ ID NO: 318561 - DNA, 51 bp, Artificial Sequence
  Description of Artificial Sequence: Synthetic oligonucleotide
aataatctatgtattacttttgtcaggatttgtgagcaaatcagcatctag

SEQ ID NO: 318562 - DNA, 50 bp, Artificial Sequence
  Description of Artificial Sequence: Synthetic oligonucleotide
ataatctatgtattacttttgtcaggatttgtgagcaaatcagcatctag

SEQ ID NO: 318563 - DNA, 49 bp, Artificial Sequence
  Description of Artificial Sequence: Synthetic oligonucleotide
taatctatgtattacttttgtcaggatttgtgagcaaatcagcatctag

SEQ ID NO: 318564 - DNA, 48 bp, Artificial Sequence
  Description of Artificial Sequence: Synthetic oligonucleotide
aatctatgtattacttttgtcaggatttgtgagcaaatcagcatctag

SEQ ID NO: 318565 - DNA, 47 bp, Artificial Sequence
  Description of Artificial Sequence: Synthetic oligonucleotide
atctatgtattacttttgtcaggatttgtgagcaaatcagcatctag

SEQ ID NO: 318566 - DNA, 46 bp, Artificial Sequence
  Description of Artificial Sequence: Synthetic oligonucleotide
tctatgtattacttttgtcaggatttgtgagcaaatcagcatctag

SEQ ID NO: 318567 - DNA, 45 bp, Artificial Sequence
  Description of Artificial Sequence: Synthetic oligonucleotide
ctatgtattacttttgtcaggatttgtgagcaaatcagcatctag

SEQ ID NO: 318568 - DNA, 47 bp, Artificial Sequence
  Description of Artificial Sequence: Synthetic oligonucleotide
tatgtattacttttgtcaggatttgtgagcaaatcagcatctagtac

SEQ ID NO: 318569 - DNA, 46 bp, Artificial Sequence
  Description of Artificial Sequence: Synthetic oligonucleotide
atgtattacttttgtcaggatttgtgagcaaatcagcatctagtac

SEQ ID NO: 318570 - DNA, 45 bp, Artificial Sequence
  Description of Artificial Sequence: Synthetic oligonucleotide
tgtattacttttgtcaggatttgtgagcaaatcagcatctagtac

SEQ ID NO: 318571 - DNA, 44 bp, Artificial Sequence
  Description of Artificial Sequence: Synthetic oligonucleotide
gtattacttttgtcaggatttgtgagcaaatcagcatctagtac

SEQ ID NO: 318572 - DNA, 44 bp, Artificial Sequence
  Description of Artificial Sequence: Synthetic oligonucleotide
tattacttttgtcaggatttgtgagcaaatcagcatctagtacc

SEQ ID NO: 318573 - DNA, 43 bp, Artificial Sequence
  Description of Artificial Sequence: Synthetic oligonucleotide
attacttttgtcaggatttgtgagcaaatcagcatctagtacc

SEQ ID NO: 318574 - DNA, 42 bp, Artificial Sequence
  Description of Artificial Sequence: Synthetic oligonucleotide
ttacttttgtcaggatttgtgagcaaatcagcatctagtacc

SEQ ID NO: 318575 - DNA, 41 bp, Artificial Sequence
  Description of Artificial Sequence: Synthetic oligonucleotide
tacttttgtcaggatttgtgagcaaatcagcatctagtacc

SEQ ID NO: 318576 - DNA, 40 bp, Artificial Sequence
  Description of Artificial Sequence: Synthetic oligonucleotide
acttttgtcaggatttgtgagcaaatcagcatctagtacc

SEQ ID NO: 318577 - DNA, 39 bp, Artificial Sequence
  Description of Artificial Sequence: Synthetic oligonucleotide
cttttgtcaggatttgtgagcaaatcagcatctagtacc

SEQ ID NO: 318578 - DNA, 40 bp, Artificial Sequence
  Description of Artificial Sequence: Synthetic oligonucleotide
ttttgtcaggatttgtgagcaaatcagcatctagtaccac

SEQ ID NO: 318579 - DNA, 39 bp, Artificial Sequence
  Description of Artificial Sequence: Synthetic oligonucleotide
tttgtcaggatttgtgagcaaatcagcatctagtaccac

SEQ ID NO: 318580 - DNA, 38 bp, Artificial Sequence
  Description of Artificial Sequence: Synthetic oligonucleotide
ttgtcaggatttgtgagcaaatcagcatctagtaccac

SEQ ID NO: 318581 - DNA, 37 bp, Artificial Sequence
  Description of Artificial Sequence: Synthetic oligonucleotide
tgtcaggatttgtgagcaaatcagcatctagtaccac

SEQ ID NO: 318582 - DNA, 36 bp, Artificial Sequence
  Description of Artificial Sequence: Synthetic oligonucleotide
gtcaggatttgtgagcaaatcagcatctagtaccac

SEQ ID NO: 318583 - DNA, 37 bp, Artificial Sequence
  Description of Artificial Sequence: Synthetic oligonucleotide
tcaggatttgtgagcaaatcagcatctagtaccactc

SEQ ID NO: 318584 - DNA, 36 bp, Artificial Sequence
  Description of Artificial Sequence: Synthetic oligonucleotide
caggatttgtgagcaaatcagcatctagtaccactc

SEQ ID NO: 318585 - DNA, 36 bp, Artificial Sequence
  Description of Artificial Sequence: Synthetic oligonucleotide
aggatttgtgagcaaatcagcatctagtaccactcg

SEQ ID NO: 318586 - DNA, 35 bp, Artificial Sequence
  Description of Artificial Sequence: Synthetic oligonucleotide
ggatttgtgagcaaatcagcatctagtaccactcg

SEQ ID NO: 318587 - DNA, 36 bp, Artificial Sequence
  Description of Artificial Sequence: Synthetic oligonucleotide
gatttgtgagcaaatcagcatctagtaccactcgtg

SEQ ID NO: 318588 - DNA, 37 bp, Artificial Sequence
  Description of Artificial Sequence: Synthetic oligonucleotide
atttgtgagcaaatcagcatctagtaccactcgtgtg

SEQ ID NO: 318589 - DNA, 36 bp, Artificial Sequence
  Description of Artificial Sequence: Synthetic oligonucleotide
tttgtgagcaaatcagcatctagtaccactcgtgtg

SEQ ID NO: 318590 - DNA, 35 bp, Artificial Sequence
  Description of Artificial Sequence: Synthetic oligonucleotide
ttgtgagcaaatcagcatctagtaccactcgtgtg

SEQ ID NO: 318591 - DNA, 34 bp, Artificial Sequence
  Description of Artificial Sequence: Synthetic oligonucleotide
tgtgagcaaatcagcatctagtaccactcgtgtg

SEQ ID NO: 318592 - DNA, 33 bp, Artificial Sequence
  Description of Artificial Sequence: Synthetic oligonucleotide
gtgagcaaatcagcatctagtaccactcgtgtg

SEQ ID NO: 318593 - DNA, 33 bp, Artificial Sequence
  Description of Artificial Sequence: Synthetic oligonucleotide
tgagcaaatcagcatctagtaccactcgtgtgg

SEQ ID NO: 318594 - DNA, 32 bp, Artificial Sequence
  Description of Artificial Sequence: Synthetic oligonucleotide
gagcaaatcagcatctagtaccactcgtgtgg

SEQ ID NO: 318595 - DNA, 32 bp, Artificial Sequence
  Description of Artificial Sequence: Synthetic oligonucleotide
agcaaatcagcatctagtaccactcgtgtggc

SEQ ID NO: 318596 - DNA, 31 bp, Artificial Sequence
  Description of Artificial Sequence: Synthetic oligonucleotide
gcaaatcagcatctagtaccactcgtgtggc

SEQ ID NO: 318597 - DNA, 34 bp, Artificial Sequence
  Description of Artificial Sequence: Synthetic oligonucleotide
caaatcagcatctagtaccactcgtgtggcaaag

SEQ ID NO: 318598 - DNA, 34 bp, Artificial Sequence
  Description of Artificial Sequence: Synthetic oligonucleotide
aaatcagcatctagtaccactcgtgtggcaaagc

SEQ ID NO: 318599 - DNA, 33 bp, Artificial Sequence
  Description of Artificial Sequence: Synthetic oligonucleotide
aatcagcatctagtaccactcgtgtggcaaagc

SEQ ID NO: 318600 - DNA, 32 bp, Artificial Sequence
  Description of Artificial Sequence: Synthetic oligonucleotide
atcagcatctagtaccactcgtgtggcaaagc

SEQ ID NO: 318601 - DNA, 31 bp, Artificial Sequence
  Description of Artificial Sequence: Synthetic oligonucleotide
tcagcatctagtaccactcgtgtggcaaagc

SEQ ID NO: 318602 - DNA, 30 bp, Artificial Sequence
  Description of Artificial Sequence: Synthetic oligonucleotide
cagcatctagtaccactcgtgtggcaaagc

SEQ ID NO: 318603 - DNA, 31 bp, Artificial Sequence
  Description of Artificial Sequence: Synthetic oligonucleotide
agcatctagtaccactcgtgtggcaaagcac

SEQ ID NO: 318604 - DNA, 30 bp, Artificial Sequence
  Description of Artificial Sequence: Synthetic oligonucleotide
gcatctagtaccactcgtgtggcaaagcac

SEQ ID NO: 318605 - DNA, 31 bp, Artificial Sequence
  Description of Artificial Sequence: Synthetic oligonucleotide
catctagtaccactcgtgtggcaaagcacac

SEQ ID NO: 318606 - DNA, 33 bp, Artificial Sequence
  Description of Artificial Sequence: Synthetic oligonucleotide
atctagtaccactcgtgtggcaaagcacacttc

SEQ ID NO: 318607 - DNA, 32 bp, Artificial Sequence
  Description of Artificial Sequence: Synthetic oligonucleotide
tctagtaccactcgtgtggcaaagcacacttc

SEQ ID NO: 318608 - DNA, 31 bp, Artificial Sequence
  Description of Artificial Sequence: Synthetic oligonucleotide
ctagtaccactcgtgtggcaaagcacacttc

SEQ ID NO: 318609 - DNA, 33 bp, Artificial Sequence
  Description of Artificial Sequence: Synthetic oligonucleotide
tagtaccactcgtgtggcaaagcacacttctac

SEQ ID NO: 318610 - DNA, 32 bp, Artificial Sequence
  Description of Artificial Sequence: Synthetic oligonucleotide
agtaccactcgtgtggcaaagcacacttctac

SEQ ID NO: 318611 - DNA, 31 bp, Artificial Sequence
  Description of Artificial Sequence: Synthetic oligonucleotide
gtaccactcgtgtggcaaagcacacttctac

SEQ ID NO: 318612 - DNA, 31 bp, Artificial Sequence
  Description of Artificial Sequence: Synthetic oligonucleotide
taccactcgtgtggcaaagcacacttctacc

SEQ ID NO: 318613 - DNA, 30 bp, Artificial Sequence
  Description of Artificial Sequence: Synthetic oligonucleotide
accactcgtgtggcaaagcacacttctacc

SEQ ID NO: 318614 - DNA, 29 bp, Artificial Sequence
  Description of Artificial Sequence: Synthetic oligonucleotide
ccactcgtgtggcaaagcacacttctacc

SEQ ID NO: 318615 - DNA, 30 bp, Artificial Sequence
  Description of Artificial Sequence: Synthetic oligonucleotide
cactcgtgtggcaaagcacacttctacctc

SEQ ID NO: 318616 - DNA, 32 bp, Artificial Sequence
  Description of Artificial Sequence: Synthetic oligonucleotide
actcgtgtggcaaagcacacttctacctcttc

SEQ ID NO: 318617 - DNA, 31 bp, Artificial Sequence
  Description of Artificial Sequence: Synthetic oligonucleotide
ctcgtgtggcaaagcacacttctacctcttc

SEQ ID NO: 318618 - DNA, 33 bp, Artificial Sequence
  Description of Artificial Sequence: Synthetic oligonucleotide
tcgtgtggcaaagcacacttctacctcttctac

SEQ ID NO: 318619 - DNA, 32 bp, Artificial Sequence
  Description of Artificial Sequence: Synthetic oligonucleotide
cgtgtggcaaagcacacttctacctcttctac

SEQ ID NO: 318620 - DNA, 33 bp, Artificial Sequence
  Description of Artificial Sequence: Synthetic oligonucleotide
gtgtggcaaagcacacttctacctcttctacag

SEQ ID NO: 318621 - DNA, 34 bp, Artificial Sequence
  Description of Artificial Sequence: Synthetic oligonucleotide
tgtggcaaagcacacttctacctcttctacagtc

SEQ ID NO: 318622 - DNA, 33 bp, Artificial Sequence
  Description of Artificial Sequence: Synthetic oligonucleotide
gtggcaaagcacacttctacctcttctacagtc

SEQ ID NO: 318623 - DNA, 34 bp, Artificial Sequence
  Description of Artificial Sequence: Synthetic oligonucleotide
tggcaaagcacacttctacctcttctacagtcac

SEQ ID NO: 318624 - DNA, 33 bp, Artificial Sequence
  Description of Artificial Sequence: Synthetic oligonucleotide
ggcaaagcacacttctacctcttctacagtcac

SEQ ID NO: 318625 - DNA, 36 bp, Artificial Sequence
  Description of Artificial Sequence: Synthetic oligonucleotide
gcaaagcacacttctacctcttctacagtcacaatg

SEQ ID NO: 318626 - DNA, 37 bp, Artificial Sequence
  Description of Artificial Sequence: Synthetic oligonucleotide
caaagcacacttctacctcttctacagtcacaatgag

SEQ ID NO: 318627 - DNA, 40 bp, Artificial Sequence
  Description of Artificial Sequence: Synthetic oligonucleotide
aaagcacacttctacctcttctacagtcacaatgagttac

SEQ ID NO: 318628 - DNA, 39 bp, Artificial Sequence
  Description of Artificial Sequence: Synthetic oligonucleotide
aagcacacttctacctcttctacagtcacaatgagttac

SEQ ID NO: 318629 - DNA, 38 bp, Artificial Sequence
  Description of Artificial Sequence: Synthetic oligonucleotide
agcacacttctacctcttctacagtcacaatgagttac

SEQ ID NO: 318630 - DNA, 37 bp, Artificial Sequence
  Description of Artificial Sequence: Synthetic oligonucleotide
gcacacttctacctcttctacagtcacaatgagttac

SEQ ID NO: 318631 - DNA, 39 bp, Artificial Sequence
  Description of Artificial Sequence: Synthetic oligonucleotide
cacacttctacctcttctacagtcacaatgagttacatg

SEQ ID NO: 318632 - DNA, 40 bp, Artificial Sequence
  Description of Artificial Sequence: Synthetic oligonucleotide
acacttctacctcttctacagtcacaatgagttacatgtc

SEQ ID NO: 318633 - DNA, 39 bp, Artificial Sequence
  Description of Artificial Sequence: Synthetic oligonucleotide
cacttctacctcttctacagtcacaatgagttacatgtc

SEQ ID NO: 318634 - DNA, 41 bp, Artificial Sequence
  Description of Artificial Sequence: Synthetic oligonucleotide
acttctacctcttctacagtcacaatgagttacatgtcatc

SEQ ID NO: 318635 - DNA, 40 bp, Artificial Sequence
  Description of Artificial Sequence: Synthetic oligonucleotide
cttctacctcttctacagtcacaatgagttacatgtcatc

SEQ ID NO: 318636 - DNA, 41 bp, Artificial Sequence
  Description of Artificial Sequence: Synthetic oligonucleotide
ttctacctcttctacagtcacaatgagttacatgtcatcac

SEQ ID NO: 318637 - DNA, 40 bp, Artificial Sequence
  Description of Artificial Sequence: Synthetic oligonucleotide
tctacctcttctacagtcacaatgagttacatgtcatcac

SEQ ID NO: 318638 - DNA, 39 bp, Artificial Sequence
  Description of Artificial Sequence: Synthetic oligonucleotide
ctacctcttctacagtcacaatgagttacatgtcatcac

SEQ ID NO: 318639 - DNA, 40 bp, Artificial Sequence
  Description of Artificial Sequence: Synthetic oligonucleotide
tacctcttctacagtcacaatgagttacatgtcatcacag

SEQ ID NO: 318640 - DNA, 39 bp, Artificial Sequence
  Description of Artificial Sequence: Synthetic oligonucleotide
acctcttctacagtcacaatgagttacatgtcatcacag

SEQ ID NO: 318641 - DNA, 38 bp, Artificial Sequence
  Description of Artificial Sequence: Synthetic oligonucleotide
cctcttctacagtcacaatgagttacatgtcatcacag

SEQ ID NO: 318642 - DNA, 39 bp, Artificial Sequence
  Description of Artificial Sequence: Synthetic oligonucleotide
ctcttctacagtcacaatgagttacatgtcatcacagtc

SEQ ID NO: 318643 - DNA, 42 bp, Artificial Sequence
  Description of Artificial Sequence: Synthetic oligonucleotide
ttctacagtcacaatgagttacatgtcatcacagtcaaatgg

SEQ ID NO: 318644 - DNA, 41 bp, Artificial Sequence
  Description of Artificial Sequence: Synthetic oligonucleotide
tctacagtcacaatgagttacatgtcatcacagtcaaatgg

SEQ ID NO: 318645 - DNA, 40 bp, Artificial Sequence
  Description of Artificial Sequence: Synthetic oligonucleotide
ctacagtcacaatgagttacatgtcatcacagtcaaatgg

SEQ ID NO: 318646 - DNA, 40 bp, Artificial Sequence
  Description of Artificial Sequence: Synthetic oligonucleotide
tacagtcacaatgagttacatgtcatcacagtcaaatggg

SEQ ID NO: 318647 - DNA, 39 bp, Artificial Sequence
  Description of Artificial Sequence: Synthetic oligonucleotide
acagtcacaatgagttacatgtcatcacagtcaaatggg

SEQ ID NO: 318648 - DNA, 38 bp, Artificial Sequence
  Description of Artificial Sequence: Synthetic oligonucleotide
cagtcacaatgagttacatgtcatcacagtcaaatggg

SEQ ID NO: 318649 - DNA, 42 bp, Artificial Sequence
  Description of Artificial Sequence: Synthetic oligonucleotide
agtcacaatgagttacatgtcatcacagtcaaatgggaaaac

SEQ ID NO: 318650 - DNA, 41 bp, Artificial Sequence
  Description of Artificial Sequence: Synthetic oligonucleotide
gtcacaatgagttacatgtcatcacagtcaaatgggaaaac

SEQ ID NO: 318651 - DNA, 42 bp, Artificial Sequence
  Description of Artificial Sequence: Synthetic oligonucleotide
tcacaatgagttacatgtcatcacagtcaaatgggaaaacac

SEQ ID NO: 318652 - DNA, 41 bp, Artificial Sequence
  Description of Artificial Sequence: Synthetic oligonucleotide
cacaatgagttacatgtcatcacagtcaaatgggaaaacac

SEQ ID NO: 318653 - DNA, 42 bp, Artificial Sequence
  Description of Artificial Sequence: Synthetic oligonucleotide
acaatgagttacatgtcatcacagtcaaatgggaaaacactc

SEQ ID NO: 318654 - DNA, 41 bp, Artificial Sequence
  Description of Artificial Sequence: Synthetic oligonucleotide
caatgagttacatgtcatcacagtcaaatgggaaaacactc

SEQ ID NO: 318655 - DNA, 48 bp, Artificial Sequence
  Description of Artificial Sequence: Synthetic oligonucleotide
aatgagttacatgtcatcacagtcaaatgggaaaacactcataaattg

SEQ ID NO: 318656 - DNA, 47 bp, Artificial Sequence
  Description of Artificial Sequence: Synthetic oligonucleotide
atgagttacatgtcatcacagtcaaatgggaaaacactcataaattg

SEQ ID NO: 318657 - DNA, 46 bp, Artificial Sequence
  Description of Artificial Sequence: Synthetic oligonucleotide
tgagttacatgtcatcacagtcaaatgggaaaacactcataaattg

SEQ ID NO: 318658 - DNA, 45 bp, Artificial Sequence
  Description of Artificial Sequence: Synthetic oligonucleotide
gagttacatgtcatcacagtcaaatgggaaaacactcataaattg

SEQ ID NO: 318659 - DNA, 45 bp, Artificial Sequence
  Description of Artificial Sequence: Synthetic oligonucleotide
agttacatgtcatcacagtcaaatgggaaaacactcataaattgg

SEQ ID NO: 318660 - DNA, 44 bp, Artificial Sequence
  Description of Artificial Sequence: Synthetic oligonucleotide
gttacatgtcatcacagtcaaatgggaaaacactcataaattgg

SEQ ID NO: 318661 - DNA, 45 bp, Artificial Sequence
  Description of Artificial Sequence: Synthetic oligonucleotide
ttacatgtcatcacagtcaaatgggaaaacactcataaattggtg

SEQ ID NO: 318662 - DNA, 44 bp, Artificial Sequence
  Description of Artificial Sequence: Synthetic oligonucleotide
tacatgtcatcacagtcaaatgggaaaacactcataaattggtg

SEQ ID NO: 318663 - DNA, 43 bp, Artificial Sequence
  Description of Artificial Sequence: Synthetic oligonucleotide
acatgtcatcacagtcaaatgggaaaacactcataaattggtg

SEQ ID NO: 318664 - DNA, 42 bp, Artificial Sequence
  Description of Artificial Sequence: Synthetic oligonucleotide
catgtcatcacagtcaaatgggaaaacactcataaattggtg

SEQ ID NO: 318665 - DNA, 42 bp, Artificial Sequence
  Description of Artificial Sequence: Synthetic oligonucleotide
atgtcatcacagtcaaatgggaaaacactcataaattggtgg

SEQ ID NO: 318666 - DNA, 41 bp, Artificial Sequence
  Description of Artificial Sequence: Synthetic oligonucleotide
tgtcatcacagtcaaatgggaaaacactcataaattggtgg

SEQ ID NO: 318667 - DNA, 40 bp, Artificial Sequence
  Description of Artificial Sequence: Synthetic oligonucleotide
gtcatcacagtcaaatgggaaaacactcataaattggtgg

SEQ ID NO: 318668 - DNA, 40 bp, Artificial Sequence
  Description of Artificial Sequence: Synthetic oligonucleotide
tcatcacagtcaaatgggaaaacactcataaattggtggc

SEQ ID NO: 318669 - DNA, 39 bp, Artificial Sequence
  Description of Artificial Sequence: Synthetic oligonucleotide
catcacagtcaaatgggaaaacactcataaattggtggc

SEQ ID NO: 318670 - DNA, 39 bp, Artificial Sequence
  Description of Artificial Sequence: Synthetic oligonucleotide
atcacagtcaaatgggaaaacactcataaattggtggcc

SEQ ID NO: 318671 - DNA, 38 bp, Artificial Sequence
  Description of Artificial Sequence: Synthetic oligonucleotide
tcacagtcaaatgggaaaacactcataaattggtggcc

SEQ ID NO: 318672 - DNA, 37 bp, Artificial Sequence
  Description of Artificial Sequence: Synthetic oligonucleotide
cacagtcaaatgggaaaacactcataaattggtggcc

SEQ ID NO: 318673 - DNA, 37 bp, Artificial Sequence
  Description of Artificial Sequence: Synthetic oligonucleotide
acagtcaaatgggaaaacactcataaattggtggccg

SEQ ID NO: 318674 - DNA, 36 bp, Artificial Sequence
  Description of Artificial Sequence: Synthetic oligonucleotide
cagtcaaatgggaaaacactcataaattggtggccg

SEQ ID NO: 318675 - DNA, 38 bp, Artificial Sequence
  Description of Artificial Sequence: Synthetic oligonucleotide
agtcaaatgggaaaacactcataaattggtggccgatg

SEQ ID NO: 318676 - DNA, 37 bp, Artificial Sequence
  Description of Artificial Sequence: Synthetic oligonucleotide
gtcaaatgggaaaacactcataaattggtggccgatg

SEQ ID NO: 318677 - DNA, 37 bp, Artificial Sequence
  Description of Artificial Sequence: Synthetic oligonucleotide
tcaaatgggaaaacactcataaattggtggccgatgg

SEQ ID NO: 318678 - DNA, 36 bp, Artificial Sequence
  Description of Artificial Sequence: Synthetic oligonucleotide
caaatgggaaaacactcataaattggtggccgatgg

SEQ ID NO: 318679 - DNA, 36 bp, Artificial Sequence
  Description of Artificial Sequence: Synthetic oligonucleotide
aaatgggaaaacactcataaattggtggccgatggc

SEQ ID NO: 318680 - DNA, 35 bp, Artificial Sequence
  Description of Artificial Sequence: Synthetic oligonucleotide
aatgggaaaacactcataaattggtggccgatggc

SEQ ID NO: 318681 - DNA, 34 bp, Artificial Sequence
  Description of Artificial Sequence: Synthetic oligonucleotide
atgggaaaacactcataaattggtggccgatggc

SEQ ID NO: 318682 - DNA, 33 bp, Artificial Sequence
  Description of Artificial Sequence: Synthetic oligonucleotide
tgggaaaacactcataaattggtggccgatggc

SEQ ID NO: 318683 - DNA, 32 bp, Artificial Sequence
  Description of Artificial Sequence: Synthetic oligonucleotide
gggaaaacactcataaattggtggccgatggc

SEQ ID NO: 318684 - DNA, 33 bp, Artificial Sequence
  Description of Artificial Sequence: Synthetic oligonucleotide
ggaaaacactcataaattggtggccgatggctc

SEQ ID NO: 318685 - DNA, 33 bp, Artificial Sequence
  Description of Artificial Sequence: Synthetic oligonucleotide
gaaaacactcataaattggtggccgatggctcc

SEQ ID NO: 318686 - DNA, 34 bp, Artificial Sequence
  Description of Artificial Sequence: Synthetic oligonucleotide
aaaacactcataaattggtggccgatggctcctg

SEQ ID NO: 318687 - DNA, 33 bp, Artificial Sequence
  Description of Artificial Sequence: Synthetic oligonucleotide
aaacactcataaattggtggccgatggctcctg

SEQ ID NO: 318688 - DNA, 32 bp, Artificial Sequence
  Description of Artificial Sequence: Synthetic oligonucleotide
aacactcataaattggtggccgatggctcctg

SEQ ID NO: 318689 - DNA, 31 bp, Artificial Sequence
  Description of Artificial Sequence: Synthetic oligonucleotide
acactcataaattggtggccgatggctcctg

SEQ ID NO: 318690 - DNA, 30 bp, Artificial Sequence
  Description of Artificial Sequence: Synthetic oligonucleotide
cactcataaattggtggccgatggctcctg

SEQ ID NO: 318691 - DNA, 38 bp, Artificial Sequence
  Description of Artificial Sequence: Synthetic oligonucleotide
actcataaattggtggccgatggctcctgttattttag

SEQ ID NO: 318692 - DNA, 37 bp, Artificial Sequence
  Description of Artificial Sequence: Synthetic oligonucleotide
ctcataaattggtggccgatggctcctgttattttag

SEQ ID NO: 318693 - DNA, 38 bp, Artificial Sequence
  Description of Artificial Sequence: Synthetic oligonucleotide
tcataaattggtggccgatggctcctgttattttagag

SEQ ID NO: 318694 - DNA, 37 bp, Artificial Sequence
  Description of Artificial Sequence: Synthetic oligonucleotide
cataaattggtggccgatggctcctgttattttagag

SEQ ID NO: 318695 - DNA, 37 bp, Artificial Sequence
  Description of Artificial Sequence: Synthetic oligonucleotide
ataaattggtggccgatggctcctgttattttagagg

SEQ ID NO: 318696 - DNA, 36 bp, Artificial Sequence
  Description of Artificial Sequence: Synthetic oligonucleotide
taaattggtggccgatggctcctgttattttagagg

SEQ ID NO: 318697 - DNA, 35 bp, Artificial Sequence
  Description of Artificial Sequence: Synthetic oligonucleotide
aaattggtggccgatggctcctgttattttagagg

SEQ ID NO: 318698 - DNA, 34 bp, Artificial Sequence
  Description of Artificial Sequence: Synthetic oligonucleotide
aattggtggccgatggctcctgttattttagagg

SEQ ID NO: 318699 - DNA, 33 bp, Artificial Sequence
  Description of Artificial Sequence: Synthetic oligonucleotide
attggtggccgatggctcctgttattttagagg

SEQ ID NO: 318700 - DNA, 32 bp, Artificial Sequence
  Description of Artificial Sequence: Synthetic oligonucleotide
ttggtggccgatggctcctgttattttagagg

SEQ ID NO: 318701 - DNA, 31 bp, Artificial Sequence
  Description of Artificial Sequence: Synthetic oligonucleotide
tggtggccgatggctcctgttattttagagg

SEQ ID NO: 318702 - DNA, 30 bp, Artificial Sequence
  Description of Artificial Sequence: Synthetic oligonucleotide
ggtggccgatggctcctgttattttagagg

SEQ ID NO: 318703 - DNA, 31 bp, Artificial Sequence
  Description of Artificial Sequence: Synthetic oligonucleotide
gtggccgatggctcctgttattttagaggtg

SEQ ID NO: 318704 - DNA, 33 bp, Artificial Sequence
  Description of Artificial Sequence: Synthetic oligonucleotide
tggccgatggctcctgttattttagaggtgatg

SEQ ID NO: 318705 - DNA, 32 bp, Artificial Sequence
  Description of Artificial Sequence: Synthetic oligonucleotide
ggccgatggctcctgttattttagaggtgatg

SEQ ID NO: 318706 - DNA, 32 bp, Artificial Sequence
  Description of Artificial Sequence: Synthetic oligonucleotide
gccgatggctcctgttattttagaggtgatgg

SEQ ID NO: 318707 - DNA, 34 bp, Artificial Sequence
  Description of Artificial Sequence: Synthetic oligonucleotide
ccgatggctcctgttattttagaggtgatggttg

SEQ ID NO: 318708 - DNA, 36 bp, Artificial Sequence
  Description of Artificial Sequence: Synthetic oligonucleotide
cgatggctcctgttattttagaggtgatggttgttg

SEQ ID NO: 318709 - DNA, 38 bp, Artificial Sequence
  Description of Artificial Sequence: Synthetic oligonucleotide
gatggctcctgttattttagaggtgatggttgttgttg

SEQ ID NO: 318710 - DNA, 40 bp, Artificial Sequence
  Description of Artificial Sequence: Synthetic oligonucleotide
atggctcctgttattttagaggtgatggttgttgttgatg

SEQ ID NO: 318711 - DNA, 39 bp, Artificial Sequence
  Description of Artificial Sequence: Synthetic oligonucleotide
tggctcctgttattttagaggtgatggttgttgttgatg

SEQ ID NO: 318712 - DNA, 38 bp, Artificial Sequence
  Description of Artificial Sequence: Synthetic oligonucleotide
ggctcctgttattttagaggtgatggttgttgttgatg

SEQ ID NO: 318713 - DNA, 38 bp, Artificial Sequence
  Description of Artificial Sequence: Synthetic oligonucleotide
gctcctgttattttagaggtgatggttgttgttgatgg

SEQ ID NO: 318714 - DNA, 41 bp, Artificial Sequence
  Description of Artificial Sequence: Synthetic oligonucleotide
ctcctgttattttagaggtgatggttgttgttgatggaatg

SEQ ID NO: 318715 - DNA, 43 bp, Artificial Sequence
  Description of Artificial Sequence: Synthetic oligonucleotide
tcctgttattttagaggtgatggttgttgttgatggaatgatg

SEQ ID NO: 318716 - DNA, 42 bp, Artificial Sequence
  Description of Artificial Sequence: Synthetic oligonucleotide
cctgttattttagaggtgatggttgttgttgatggaatgatg

SEQ ID NO: 318717 - DNA, 44 bp, Artificial Sequence
  Description of Artificial Sequence: Synthetic oligonucleotide
ctgttattttagaggtgatggttgttgttgatggaatgatgatc

SEQ ID NO: 318718 - DNA, 51 bp, Artificial Sequence
  Description of Artificial Sequence: Synthetic oligonucleotide
tgttattttagaggtgatggttgttgttgatggaatgatgatcttaattac

SEQ ID NO: 318719 - DNA, 50 bp, Artificial Sequence
  Description of Artificial Sequence: Synthetic oligonucleotide
gttattttagaggtgatggttgttgttgatggaatgatgatcttaattac

SEQ ID NO: 318720 - DNA, 53 bp, Artificial Sequence
  Description of Artificial Sequence: Synthetic oligonucleotide
ttattttagaggtgatggttgttgttgatggaatgatgatcttaattacttac

SEQ ID NO: 318721 - DNA, 52 bp, Artificial Sequence
  Description of Artificial Sequence: Synthetic oligonucleotide
tattttagaggtgatggttgttgttgatggaatgatgatcttaattacttac

SEQ ID NO: 318722 - DNA, 51 bp, Artificial Sequence
  Description of Artificial Sequence: Synthetic oligonucleotide
attttagaggtgatggttgttgttgatggaatgatgatcttaattacttac

SEQ ID NO: 318723 - DNA, 50 bp, Artificial Sequence
  Description of Artificial Sequence: Synthetic oligonucleotide
ttttagaggtgatggttgttgttgatggaatgatgatcttaattacttac

SEQ ID NO: 318724 - DNA, 49 bp, Artificial Sequence
  Description of Artificial Sequence: Synthetic oligonucleotide
tttagaggtgatggttgttgttgatggaatgatgatcttaattacttac

SEQ ID NO: 318725 - DNA, 48 bp, Artificial Sequence
  Description of Artificial Sequence: Synthetic oligonucleotide
ttagaggtgatggttgttgttgatggaatgatgatcttaattacttac

SEQ ID NO: 318726 - DNA, 47 bp, Artificial Sequence
  Description of Artificial Sequence: Synthetic oligonucleotide
tagaggtgatggttgttgttgatggaatgatgatcttaattacttac

SEQ ID NO: 318727 - DNA, 46 bp, Artificial Sequence
  Description of Artificial Sequence: Synthetic oligonucleotide
agaggtgatggttgttgttgatggaatgatgatcttaattacttac

SEQ ID NO: 318728 - DNA, 45 bp, Artificial Sequence
  Description of Artificial Sequence: Synthetic oligonucleotide
gaggtgatggttgttgttgatggaatgatgatcttaattacttac

SEQ ID NO: 318729 - DNA, 46 bp, Artificial Sequence
  Description of Artificial Sequence: Synthetic oligonucleotide
aggtgatggttgttgttgatggaatgatgatcttaattacttactg

SEQ ID NO: 318730 - DNA, 45 bp, Artificial Sequence
  Description of Artificial Sequence: Synthetic oligonucleotide
ggtgatggttgttgttgatggaatgatgatcttaattacttactg

SEQ ID NO: 318731 - DNA, 49 bp, Artificial Sequence
  Description of Artificial Sequence: Synthetic oligonucleotide
gtgatggttgttgttgatggaatgatgatcttaattacttactgtaatc

SEQ ID NO: 318732 - DNA, 49 bp, Artificial Sequence
  Description of Artificial Sequence: Synthetic oligonucleotide
tgatggttgttgttgatggaatgatgatcttaattacttactgtaatcg

SEQ ID NO: 318733 - DNA, 48 bp, Artificial Sequence
  Description of Artificial Sequence: Synthetic oligonucleotide
gatggttgttgttgatggaatgatgatcttaattacttactgtaatcg

SEQ ID NO: 318734 - DNA, 50 bp, Artificial Sequence
  Description of Artificial Sequence: Synthetic oligonucleotide
atggttgttgttgatggaatgatgatcttaattacttactgtaatcgatg

SEQ ID NO: 318735 - DNA, 49 bp, Artificial Sequence
  Description of Artificial Sequence: Synthetic oligonucleotide
tggttgttgttgatggaatgatgatcttaattacttactgtaatcgatg

SEQ ID NO: 318736 - DNA, 48 bp, Artificial Sequence
  Description of Artificial Sequence: Synthetic oligonucleotide
ggttgttgttgatggaatgatgatcttaattacttactgtaatcgatg

SEQ ID NO: 318737 - DNA, 31 bp, Artificial Sequence
  Description of Artificial Sequence: Synthetic oligonucleotide
atggtgcatgtgactcctgtggagaagtcag

SEQ ID NO: 318738 - DNA, 30 bp, Artificial Sequence
  Description of Artificial Sequence: Synthetic oligonucleotide
tggtgcatgtgactcctgtggagaagtcag

SEQ ID NO: 318739 - DNA, 29 bp, Artificial Sequence
  Description of Artificial Sequence: Synthetic oligonucleotide
ggtgcatgtgactcctgtggagaagtcag

SEQ ID NO: 318740 - DNA, 29 bp, Artificial Sequence
  Description of Artificial Sequence: Synthetic oligonucleotide
gtgcatgtgactcctgtggagaagtcagc

SEQ ID NO: 318741 - DNA, 29 bp, Artificial Sequence
  Description of Artificial Sequence: Synthetic oligonucleotide
tgcatgtgactcctgtggagaagtcagcc

SEQ ID NO: 318742 - DNA, 28 bp, Artificial Sequence
  Description of Artificial Sequence: Synthetic oligonucleotide
gcatgtgactcctgtggagaagtcagcc

SEQ ID NO: 318743 - DNA, 28 bp, Artificial Sequence
  Description of Artificial Sequence: Synthetic oligonucleotide
catgtgactcctgtggagaagtcagccg

SEQ ID NO: 318744 - DNA, 31 bp, Artificial Sequence
  Description of Artificial Sequence: Synthetic oligonucleotide
atgtgactcctgtggagaagtcagccgttac

SEQ ID NO: 318745 - DNA, 30 bp, Artificial Sequence
  Description of Artificial Sequence: Synthetic oligonucleotide
tgtgactcctgtggagaagtcagccgttac

SEQ ID NO: 318746 - DNA, 29 bp, Artificial Sequence
  Description of Artificial Sequence: Synthetic oligonucleotide
gtgactcctgtggagaagtcagccgttac

SEQ ID NO: 318747 - DNA, 30 bp, Artificial Sequence
  Description of Artificial Sequence: Synthetic oligonucleotide
tgactcctgtggagaagtcagccgttactc

SEQ ID NO: 318748 - DNA, 29 bp, Artificial Sequence
  Description of Artificial Sequence: Synthetic oligonucleotide
gactcctgtggagaagtcagccgttactc

SEQ ID NO: 318749 - DNA, 29 bp, Artificial Sequence
  Description of Artificial Sequence: Synthetic oligonucleotide
actcctgtggagaagtcagccgttactcc

SEQ ID NO: 318750 - DNA, 28 bp, Artificial Sequence
  Description of Artificial Sequence: Synthetic oligonucleotide
ctcctgtggagaagtcagccgttactcc

SEQ ID NO: 318751 - DNA, 28 bp, Artificial Sequence
  Description of Artificial Sequence: Synthetic oligonucleotide
tcctgtggagaagtcagccgttactccc

SEQ ID NO: 318752 - DNA, 27 bp, Artificial Sequence
  Description of Artificial Sequence: Synthetic oligonucleotide
cctgtggagaagtcagccgttactccc

SEQ ID NO: 318753 - DNA, 27 bp, Artificial Sequence
  Description of Artificial Sequence: Synthetic oligonucleotide
ctgtggagaagtcagccgttactcccc

SEQ ID NO: 318754 - DNA, 28 bp, Artificial Sequence
  Description of Artificial Sequence: Synthetic oligonucleotide
tgtggagaagtcagccgttactcccctg

SEQ ID NO: 318755 - DNA, 27 bp, Artificial Sequence
  Description of Artificial Sequence: Synthetic oligonucleotide
gtggagaagtcagccgttactcccctg

SEQ ID NO: 318756 - DNA, 28 bp, Artificial Sequence
  Description of Artificial Sequence: Synthetic oligonucleotide
tggagaagtcagccgttactcccctgtg

SEQ ID NO: 318757 - DNA, 27 bp, Artificial Sequence
  Description of Artificial Sequence: Synthetic oligonucleotide
ggagaagtcagccgttactcccctgtg

SEQ ID NO: 318758 - DNA, 27 bp, Artificial Sequence
  Description of Artificial Sequence: Synthetic oligonucleotide
gagaagtcagccgttactcccctgtgg

SEQ ID NO: 318759 - DNA, 27 bp, Artificial Sequence
  Description of Artificial Sequence: Synthetic oligonucleotide
agaagtcagccgttactcccctgtggg

SEQ ID NO: 318760 - DNA, 26 bp, Artificial Sequence
  Description of Artificial Sequence: Synthetic oligonucleotide
gaagtcagccgttactcccctgtggg

SEQ ID NO: 318761 - DNA, 26 bp, Artificial Sequence
  Description of Artificial Sequence: Synthetic oligonucleotide
aagtcagccgttactcccctgtgggc

SEQ ID NO: 318762 - DNA, 25 bp, Artificial Sequence
  Description of Artificial Sequence: Synthetic oligonucleotide
agtcagccgttactcccctgtgggc

SEQ ID NO: 318763 - DNA, 24 bp, Artificial Sequence
  Description of Artificial Sequence: Synthetic oligonucleotide
gtcagccgttactcccctgtgggc

SEQ ID NO: 318764 - DNA, 26 bp, Artificial Sequence
  Description of Artificial Sequence: Synthetic oligonucleotide
tcagccgttactcccctgtgggccaa

SEQ ID NO: 318765 - DNA, 25 bp, Artificial Sequence
  Description of Artificial Sequence: Synthetic oligonucleotide
cagccgttactcccctgtgggccaa

SEQ ID NO: 318766 - DNA, 25 bp, Artificial Sequence
  Description of Artificial Sequence: Synthetic oligonucleotide
agccgttactcccctgtgggccaag

SEQ ID NO: 318767 - DNA, 24 bp, Artificial Sequence
  Description of Artificial Sequence: Synthetic oligonucleotide
gccgttactcccctgtgggccaag

SEQ ID NO: 318768 - DNA, 25 bp, Artificial Sequence
  Description of Artificial Sequence: Synthetic oligonucleotide
ccgttactcccctgtgggccaaggt

SEQ ID NO: 318769 - DNA, 27 bp, Artificial Sequence
  Description of Artificial Sequence: Synthetic oligonucleotide
cgttactcccctgtgggccaaggtgaa

SEQ ID NO: 318770 - DNA, 27 bp, Artificial Sequence
  Description of Artificial Sequence: Synthetic oligonucleotide
gttactcccctgtgggccaaggtgaag

SEQ ID NO: 318771 - DNA, 27 bp, Artificial Sequence
  Description of Artificial Sequence: Synthetic oligonucleotide
ttactcccctgtgggccaaggtgaagg

SEQ ID NO: 318772 - DNA, 27 bp, Artificial Sequence
  Description of Artificial Sequence: Synthetic oligonucleotide
tactcccctgtgggccaaggtgaaggt

SEQ ID NO: 318773 - DNA, 26 bp, Artificial Sequence
  Description of Artificial Sequence: Synthetic oligonucleotide
actcccctgtgggccaaggtgaaggt

SEQ ID NO: 318774 - DNA, 25 bp, Artificial Sequence
  Description of Artificial Sequence: Synthetic oligonucleotide
ctcccctgtgggccaaggtgaaggt

SEQ ID NO: 318775 - DNA, 25 bp, Artificial Sequence
  Description of Artificial Sequence: Synthetic oligonucleotide
tcccctgtgggccaaggtgaaggtg

SEQ ID NO: 318776 - DNA, 24 bp, Artificial Sequence
  Description of Artificial Sequence: Synthetic oligonucleotide
cccctgtgggccaaggtgaaggtg

SEQ ID NO: 318777 - DNA, 26 bp, Artificial Sequence
  Description of Artificial Sequence: Synthetic oligonucleotide
ccctgtgggccaaggtgaaggtggat

SEQ ID NO: 318778 - DNA, 27 bp, Artificial Sequence
  Description of Artificial Sequence: Synthetic oligonucleotide
cctgtgggccaaggtgaaggtggatga

SEQ ID NO: 318779 - DNA, 28 bp, Artificial Sequence
  Description of Artificial Sequence: Synthetic oligonucleotide
ctgtgggccaaggtgaaggtggatgaac

SEQ ID NO: 318780 - DNA, 30 bp, Artificial Sequence
  Description of Artificial Sequence: Synthetic oligonucleotide
tgtgggccaaggtgaaggtggatgaacttg

SEQ ID NO: 318781 - DNA, 29 bp, Artificial Sequence
  Description of Artificial Sequence: Synthetic oligonucleotide
gtgggccaaggtgaaggtggatgaacttg

SEQ ID NO: 318782 - DNA, 29 bp, Artificial Sequence
  Description of Artificial Sequence: Synthetic oligonucleotide
tgggccaaggtgaaggtggatgaacttgg

SEQ ID NO: 318783 - DNA, 28 bp, Artificial Sequence
  Description of Artificial Sequence: Synthetic oligonucleotide
gggccaaggtgaaggtggatgaacttgg

SEQ ID NO: 318784 - DNA, 29 bp, Artificial Sequence
  Description of Artificial Sequence: Synthetic oligonucleotide
ggccaaggtgaaggtggatgaacttggtg

SEQ ID NO: 318785 - DNA, 29 bp, Artificial Sequence
  Description of Artificial Sequence: Synthetic oligonucleotide
gccaaggtgaaggtggatgaacttggtgg

SEQ ID NO: 318786 - DNA, 30 bp, Artificial Sequence
  Description of Artificial Sequence: Synthetic oligonucleotide
ccaaggtgaaggtggatgaacttggtggtg

SEQ ID NO: 318787 - DNA, 31 bp, Artificial Sequence
  Description of Artificial Sequence: Synthetic oligonucleotide
caaggtgaaggtggatgaacttggtggtgtg

SEQ ID NO: 318788 - DNA, 31 bp, Artificial Sequence
  Description of Artificial Sequence: Synthetic oligonucleotide
aaggtgaaggtggatgaacttggtggtgtgg

SEQ ID NO: 318789 - DNA, 30 bp, Artificial Sequence
  Description of Artificial Sequence: Synthetic oligonucleotide
aggtgaaggtggatgaacttggtggtgtgg

SEQ ID NO: 318790 - DNA, 29 bp, Artificial Sequence
  Description of Artificial Sequence: Synthetic oligonucleotide
ggtgaaggtggatgaacttggtggtgtgg

SEQ ID NO: 318791 - DNA, 29 bp, Artificial Sequence
  Description of Artificial Sequence: Synthetic oligonucleotide
gtgaaggtggatgaacttggtggtgtggc

SEQ ID NO: 318792 - DNA, 29 bp, Artificial Sequence
  Description of Artificial Sequence: Synthetic oligonucleotide
tgaaggtggatgaacttggtggtgtggcc

SEQ ID NO: 318793 - DNA, 28 bp, Artificial Sequence
  Description of Artificial Sequence: Synthetic oligonucleotide
gaaggtggatgaacttggtggtgtggcc

SEQ ID NO: 318794 - DNA, 28 bp, Artificial Sequence
  Description of Artificial Sequence: Synthetic oligonucleotide
aaggtggatgaacttggtggtgtggccc

SEQ ID NO: 318795 - DNA, 27 bp, Artificial Sequence
  Description of Artificial Sequence: Synthetic oligonucleotide
aggtggatgaacttggtggtgtggccc

SEQ ID NO: 318796 - DNA, 27 bp, Artificial Sequence
  Description of Artificial Sequence: Synthetic oligonucleotide
ggtggatgaacttggtggtgtggccct

SEQ ID NO: 318797 - DNA, 27 bp, Artificial Sequence
  Description of Artificial Sequence: Synthetic oligonucleotide
gtggatgaacttggtggtgtggccctg

SEQ ID NO: 318798 - DNA, 27 bp, Artificial Sequence
  Description of Artificial Sequence: Synthetic oligonucleotide
tggatgaacttggtggtgtggccctgg

SEQ ID NO: 318799 - DNA, 26 bp, Artificial Sequence
  Description of Artificial Sequence: Synthetic oligonucleotide
ggatgaacttggtggtgtggccctgg

SEQ ID NO: 318800 - DNA, 26 bp, Artificial Sequence
  Description of Artificial Sequence: Synthetic oligonucleotide
gatgaacttggtggtgtggccctggg

SEQ ID NO: 318801 - DNA, 27 bp, Artificial Sequence
  Description of Artificial Sequence: Synthetic oligonucleotide
atgaacttggtggtgtggccctgggga

SEQ ID NO: 318802 - DNA, 26 bp, Artificial Sequence
  Description of Artificial Sequence: Synthetic oligonucleotide
tgaacttggtggtgtggccctgggga

SEQ ID NO: 318803 - DNA, 25 bp, Artificial Sequence
  Description of Artificial Sequence: Synthetic oligonucleotide
gaacttggtggtgtggccctgggga

SEQ ID NO: 318804 - DNA, 25 bp, Artificial Sequence
  Description of Artificial Sequence: Synthetic oligonucleotide
aacttggtggtgtggccctggggag

SEQ ID NO: 318805 - DNA, 24 bp, Artificial Sequence
  Description of Artificial Sequence: Synthetic oligonucleotide
acttggtggtgtggccctggggag

SEQ ID NO: 318806 - DNA, 23 bp, Artificial Sequence
  Description of Artificial Sequence: Synthetic oligonucleotide
cttggtggtgtggccctggggag

SEQ ID NO: 318807 - DNA, 23 bp, Artificial Sequence
  Description of Artificial Sequence: Synthetic oligonucleotide
ttggtggtgtggccctggggagg

SEQ ID NO: 318808 - DNA, 22 bp, Artificial Sequence
  Description of Artificial Sequence: Synthetic oligonucleotide
tggtggtgtggccctggggagg

SEQ ID NO: 318809 - DNA, 21 bp, Artificial Sequence
  Description of Artificial Sequence: Synthetic oligonucleotide
ggtggtgtggccctggggagg

SEQ ID NO: 318810 - DNA, 22 bp, Artificial Sequence
  Description of Artificial Sequence: Synthetic oligonucleotide
gtggtgtggccctggggaggct

SEQ ID NO: 318811 - DNA, 22 bp, Artificial Sequence
  Description of Artificial Sequence: Synthetic oligonucleotide
tggtgtggccctggggaggctg

SEQ ID NO: 318812 - DNA, 21 bp, Artificial Sequence
  Description of Artificial Sequence: Synthetic oligonucleotide
ggtgtggccctggggaggctg

SEQ ID NO: 318813 - DNA, 22 bp, Artificial Sequence
  Description of Artificial Sequence: Synthetic oligonucleotide
gtgtggccctggggaggctgct

SEQ ID NO: 318814 - DNA, 22 bp, Artificial Sequence
  Description of Artificial Sequence: Synthetic oligonucleotide
tgtggccctggggaggctgctg

SEQ ID NO: 318815 - DNA, 21 bp, Artificial Sequence
  Description of Artificial Sequence: Synthetic oligonucleotide
gtggccctggggaggctgctg

SEQ ID NO: 318816 - DNA, 22 bp, Artificial Sequence
  Description of Artificial Sequence: Synthetic oligonucleotide
tggccctggggaggctgctgct

SEQ ID NO: 318817 - DNA, 21 bp, Artificial Sequence
  Description of Artificial Sequence: Synthetic oligonucleotide
ggccctggggaggctgctgct

SEQ ID NO: 318818 - DNA, 21 bp, Artificial Sequence
  Description of Artificial Sequence: Synthetic oligonucleotide
gccctggggaggctgctgctg

SEQ ID NO: 318819 - DNA, 22 bp, Artificial Sequence
  Description of Artificial Sequence: Synthetic oligonucleotide
ccctggggaggctgctgctggt

SEQ ID NO: 318820 - DNA, 24 bp, Artificial Sequence
  Description of Artificial Sequence: Synthetic oligonucleotide
cctggggaggctgctgctggtcta

SEQ ID NO: 318821 - DNA, 24 bp, Artificial Sequence
  Description of Artificial Sequence: Synthetic oligonucleotide
ctggggaggctgctgctggtctac

SEQ ID NO: 318822 - DNA, 24 bp, Artificial Sequence
  Description of Artificial Sequence: Synthetic oligonucleotide
tggggaggctgctgctggtctacc

SEQ ID NO: 318823 - DNA, 23 bp, Artificial Sequence
  Description of Artificial Sequence: Synthetic oligonucleotide
ggggaggctgctgctggtctacc

SEQ ID NO: 318824 - DNA, 25 bp, Artificial Sequence
  Description of Artificial Sequence: Synthetic oligonucleotide
gggaggctgctgctggtctaccgtt

SEQ ID NO: 318825 - DNA, 25 bp, Artificial Sequence
  Description of Artificial Sequence: Synthetic oligonucleotide
ggaggctgctgctggtctaccgttg

SEQ ID NO: 318826 - DNA, 26 bp, Artificial Sequence
  Description of Artificial Sequence: Synthetic oligonucleotide
gaggctgctgctggtctaccgttgga

SEQ ID NO: 318827 - DNA, 26 bp, Artificial Sequence
  Description of Artificial Sequence: Synthetic oligonucleotide
aggctgctgctggtctaccgttggac

SEQ ID NO: 318828 - DNA, 25 bp, Artificial Sequence
  Description of Artificial Sequence: Synthetic oligonucleotide
ggctgctgctggtctaccgttggac

SEQ ID NO: 318829 - DNA, 25 bp, Artificial Sequence
  Description of Artificial Sequence: Synthetic oligonucleotide
gctgctgctggtctaccgttggacc

SEQ ID NO: 318830 - DNA, 26 bp, Artificial Sequence
  Description of Artificial Sequence: Synthetic oligonucleotide
ctgctgctggtctaccgttggaccca

SEQ ID NO: 318831 - DNA, 27 bp, Artificial Sequence
  Description of Artificial Sequence: Synthetic oligonucleotide
tgctgctggtctaccgttggacccaca

SEQ ID NO: 318832 - DNA, 26 bp, Artificial Sequence
  Description of Artificial Sequence: Synthetic oligonucleotide
gctgctggtctaccgttggacccaca

SEQ ID NO: 318833 - DNA, 26 bp, Artificial Sequence
  Description of Artificial Sequence: Synthetic oligonucleotide
ctgctggtctaccgttggacccacag

SEQ ID NO: 318834 - DNA, 27 bp, Artificial Sequence
  Description of Artificial Sequence: Synthetic oligonucleotide
tgctggtctaccgttggacccacaggt

SEQ ID NO: 318835 - DNA, 27 bp, Artificial Sequence
  Description of Artificial Sequence: Synthetic oligonucleotide
gctggtctaccgttggacccacaggtt

SEQ ID NO: 318836 - DNA, 27 bp, Artificial Sequence
  Description of Artificial Sequence: Synthetic oligonucleotide
ctggtctaccgttggacccacaggttc

SEQ ID NO: 318837 - DNA, 30 bp, Artificial Sequence
  Description of Artificial Sequence: Synthetic oligonucleotide
tggtctaccgttggacccacaggttctttc

SEQ ID NO: 318838 - DNA, 29 bp, Artificial Sequence
  Description of Artificial Sequence: Synthetic oligonucleotide
ggtctaccgttggacccacaggttctttc

SEQ ID NO: 318839 - DNA, 30 bp, Artificial Sequence
  Description of Artificial Sequence: Synthetic oligonucleotide
gtctaccgttggacccacaggttctttcag

SEQ ID NO: 318840 - DNA, 31 bp, Artificial Sequence
  Description of Artificial Sequence: Synthetic oligonucleotide
tctaccgttggacccacaggttctttcagtc

SEQ ID NO: 318841 - DNA, 30 bp, Artificial Sequence
  Description of Artificial Sequence: Synthetic oligonucleotide
ctaccgttggacccacaggttctttcagtc

SEQ ID NO: 318842 - DNA, 30 bp, Artificial Sequence
  Description of Artificial Sequence: Synthetic oligonucleotide
taccgttggacccacaggttctttcagtcc

SEQ ID NO: 318843 - DNA, 29 bp, Artificial Sequence
  Description of Artificial Sequence: Synthetic oligonucleotide
accgttggacccacaggttctttcagtcc

SEQ ID NO: 318844 - DNA, 28 bp, Artificial Sequence
  Description of Artificial Sequence: Synthetic oligonucleotide
ccgttggacccacaggttctttcagtcc

SEQ ID NO: 318845 - DNA, 31 bp, Artificial Sequence
  Description of Artificial Sequence: Synthetic oligonucleotide
cgttggacccacaggttctttcagtcctttg

SEQ ID NO: 318846 - DNA, 31 bp, Artificial Sequence
  Description of Artificial Sequence: Synthetic oligonucleotide
gttggacccacaggttctttcagtcctttgc

SEQ ID NO: 318847 - DNA, 31 bp, Artificial Sequence
  Description of Artificial Sequence: Synthetic oligonucleotide
ttggacccacaggttctttcagtcctttgcg

SEQ ID NO: 318848 - DNA, 30 bp, Artificial Sequence
  Description of Artificial Sequence: Synthetic oligonucleotide
tggacccacaggttctttcagtcctttgcg

SEQ ID NO: 318849 - DNA, 29 bp, Artificial Sequence
  Description of Artificial Sequence: Synthetic oligonucleotide
ggacccacaggttctttcagtcctttgcg

SEQ ID NO: 318850 - DNA, 29 bp, Artificial Sequence
  Description of Artificial Sequence: Synthetic oligonucleotide
gacccacaggttctttcagtcctttgcgg

SEQ ID NO: 318851 - DNA, 31 bp, Artificial Sequence
  Description of Artificial Sequence: Synthetic oligonucleotide
acccacaggttctttcagtcctttgcggatc

SEQ ID NO: 318852 - DNA, 30 bp, Artificial Sequence
  Description of Artificial Sequence: Synthetic oligonucleotide
cccacaggttctttcagtcctttgcggatc

SEQ ID NO: 318853 - DNA, 31 bp, Artificial Sequence
  Description of Artificial Sequence: Synthetic oligonucleotide
ccacaggttctttcagtcctttgcggatctg

SEQ ID NO: 318854 - DNA, 32 bp, Artificial Sequence
  Description of Artificial Sequence: Synthetic oligonucleotide
cacaggttctttcagtcctttgcggatctgtc

SEQ ID NO: 318855 - DNA, 32 bp, Artificial Sequence
  Description of Artificial Sequence: Synthetic oligonucleotide
acaggttctttcagtcctttgcggatctgtcg

SEQ ID NO: 318856 - DNA, 31 bp, Artificial Sequence
  Description of Artificial Sequence: Synthetic oligonucleotide
caggttctttcagtcctttgcggatctgtcg

SEQ ID NO: 318857 - DNA, 32 bp, Artificial Sequence
  Description of Artificial Sequence: Synthetic oligonucleotide
aggttctttcagtcctttgcggatctgtcgac

SEQ ID NO: 318858 - DNA, 31 bp, Artificial Sequence
  Description of Artificial Sequence: Synthetic oligonucleotide
ggttctttcagtcctttgcggatctgtcgac

SEQ ID NO: 318859 - DNA, 32 bp, Artificial Sequence
  Description of Artificial Sequence: Synthetic oligonucleotide
gttctttcagtcctttgcggatctgtcgactc

SEQ ID NO: 318860 - DNA, 32 bp, Artificial Sequence
  Description of Artificial Sequence: Synthetic oligonucleotide
ttctttcagtcctttgcggatctgtcgactcc

SEQ ID NO: 318861 - DNA, 31 bp, Artificial Sequence
  Description of Artificial Sequence: Synthetic oligonucleotide
tctttcagtcctttgcggatctgtcgactcc

SEQ ID NO: 318862 - DNA, 30 bp, Artificial Sequence
  Description of Artificial Sequence: Synthetic oligonucleotide
ctttcagtcctttgcggatctgtcgactcc

SEQ ID NO: 318863 - DNA, 31 bp, Artificial Sequence
  Description of Artificial Sequence: Synthetic oligonucleotide
tttcagtcctttgcggatctgtcgactcctg

SEQ ID NO: 318864 - DNA, 30 bp, Artificial Sequence
  Description of Artificial Sequence: Synthetic oligonucleotide
ttcagtcctttgcggatctgtcgactcctg

SEQ ID NO: 318865 - DNA, 29 bp, Artificial Sequence
  Description of Artificial Sequence: Synthetic oligonucleotide
tcagtcctttgcggatctgtcgactcctg

SEQ ID NO: 318866 - DNA, 28 bp, Artificial Sequence
  Description of Artificial Sequence: Synthetic oligonucleotide
cagtcctttgcggatctgtcgactcctg

SEQ ID NO: 318867 - DNA, 30 bp, Artificial Sequence
  Description of Artificial Sequence: Synthetic oligonucleotide
agtcctttgcggatctgtcgactcctgatc

SEQ ID NO: 318868 - DNA, 29 bp, Artificial Sequence
  Description of Artificial Sequence: Synthetic oligonucleotide
gtcctttgcggatctgtcgactcctgatc

SEQ ID NO: 318869 - DNA, 29 bp, Artificial Sequence
  Description of Artificial Sequence: Synthetic oligonucleotide
tcctttgcggatctgtcgactcctgatcc

SEQ ID NO: 318870 - DNA, 28 bp, Artificial Sequence
  Description of Artificial Sequence: Synthetic oligonucleotide
cctttgcggatctgtcgactcctgatcc

SEQ ID NO: 318871 - DNA, 29 bp, Artificial Sequence
  Description of Artificial Sequence: Synthetic oligonucleotide
ctttgcggatctgtcgactcctgatcctg

SEQ ID NO: 318872 - DNA, 33 bp, Artificial Sequence
  Description of Artificial Sequence: Synthetic oligonucleotide
tttgcggatctgtcgactcctgatcctgttatg

SEQ ID NO: 318873 - DNA, 32 bp, Artificial Sequence
  Description of Artificial Sequence: Synthetic oligonucleotide
ttgcggatctgtcgactcctgatcctgttatg

SEQ ID NO: 318874 - DNA, 31 bp, Artificial Sequence
  Description of Artificial Sequence: Synthetic oligonucleotide
tgcggatctgtcgactcctgatcctgttatg

SEQ ID NO: 318875 - DNA, 30 bp, Artificial Sequence
  Description of Artificial Sequence: Synthetic oligonucleotide
gcggatctgtcgactcctgatcctgttatg

SEQ ID NO: 318876 - DNA, 30 bp, Artificial Sequence
  Description of Artificial Sequence: Synthetic oligonucleotide
cggatctgtcgactcctgatcctgttatgg

SEQ ID NO: 318877 - DNA, 30 bp, Artificial Sequence
  Description of Artificial Sequence: Synthetic oligonucleotide
ggatctgtcgactcctgatcctgttatggc

SEQ ID NO: 318878 - DNA, 30 bp, Artificial Sequence
  Description of Artificial Sequence: Synthetic oligonucleotide
gatctgtcgactcctgatcctgttatggcc

SEQ ID NO: 318879 - DNA, 32 bp, Artificial Sequence
  Description of Artificial Sequence: Synthetic oligonucleotide
atctgtcgactcctgatcctgttatggccaac

SEQ ID NO: 318880 - DNA, 31 bp, Artificial Sequence
  Description of Artificial Sequence: Synthetic oligonucleotide
tctgtcgactcctgatcctgttatggccaac

SEQ ID NO: 318881 - DNA, 30 bp, Artificial Sequence
  Description of Artificial Sequence: Synthetic oligonucleotide
ctgtcgactcctgatcctgttatggccaac

SEQ ID NO: 318882 - DNA, 30 bp, Artificial Sequence
  Description of Artificial Sequence: Synthetic oligonucleotide
tgtcgactcctgatcctgttatggccaacc

SEQ ID NO: 318883 - DNA, 29 bp, Artificial Sequence
  Description of Artificial Sequence: Synthetic oligonucleotide
gtcgactcctgatcctgttatggccaacc

SEQ ID NO: 318884 - DNA, 29 bp, Artificial Sequence
  Description of Artificial Sequence: Synthetic oligonucleotide
tcgactcctgatcctgttatggccaaccc

SEQ ID NO: 318885 - DNA, 28 bp, Artificial Sequence
  Description of Artificial Sequence: Synthetic oligonucleotide
cgactcctgatcctgttatggccaaccc

SEQ ID NO: 318886 - DNA, 31 bp, Artificial Sequence
  Description of Artificial Sequence: Synthetic oligonucleotide
gactcctgatcctgttatggccaaccctaac

SEQ ID NO: 318887 - DNA, 31 bp, Artificial Sequence
  Description of Artificial Sequence: Synthetic oligonucleotide
actcctgatcctgttatggccaaccctaacg

SEQ ID NO: 318888 - DNA, 30 bp, Artificial Sequence
  Description of Artificial Sequence: Synthetic oligonucleotide
ctcctgatcctgttatggccaaccctaacg

SEQ ID NO: 318889 - DNA, 31 bp, Artificial Sequence
  Description of Artificial Sequence: Synthetic oligonucleotide
tcctgatcctgttatggccaaccctaacgtg

SEQ ID NO: 318890 - DNA, 30 bp, Artificial Sequence
  Description of Artificial Sequence: Synthetic oligonucleotide
cctgatcctgttatggccaaccctaacgtg

SEQ ID NO: 318891 - DNA, 32 bp, Artificial Sequence
  Description of Artificial Sequence: Synthetic oligonucleotide
ctgatcctgttatggccaaccctaacgtgaag

SEQ ID NO: 318892 - DNA, 32 bp, Artificial Sequence
  Description of Artificial Sequence: Synthetic oligonucleotide
tgatcctgttatggccaaccctaacgtgaagg

SEQ ID NO: 318893 - DNA, 31 bp, Artificial Sequence
  Description of Artificial Sequence: Synthetic oligonucleotide
gatcctgttatggccaaccctaacgtgaagg

SEQ ID NO: 318894 - DNA, 31 bp, Artificial Sequence
  Description of Artificial Sequence: Synthetic oligonucleotide
atcctgttatggccaaccctaacgtgaaggc

SEQ ID NO: 318895 - DNA, 30 bp, Artificial Sequence
  Description of Artificial Sequence: Synthetic oligonucleotide
tcctgttatggccaaccctaacgtgaaggc

SEQ ID NO: 318896 - DNA, 29 bp, Artificial Sequence
  Description of Artificial Sequence: Synthetic oligonucleotide
cctgttatggccaaccctaacgtgaaggc

SEQ ID NO: 318897 - DNA, 30 bp, Artificial Sequence
  Description of Artificial Sequence: Synthetic oligonucleotide
ctgttatggccaaccctaacgtgaaggctg

SEQ ID NO: 318898 - DNA, 32 bp, Artificial Sequence
  Description of Artificial Sequence: Synthetic oligonucleotide
tgttatggccaaccctaacgtgaaggctgatg

SEQ ID NO: 318899 - DNA, 31 bp, Artificial Sequence
  Description of Artificial Sequence: Synthetic oligonucleotide
gttatggccaaccctaacgtgaaggctgatg

SEQ ID NO: 318900 - DNA, 31 bp, Artificial Sequence
  Description of Artificial Sequence: Synthetic oligonucleotide
ttatggccaaccctaacgtgaaggctgatgg

SEQ ID NO: 318901 - DNA, 30 bp, Artificial Sequence
  Description of Artificial Sequence: Synthetic oligonucleotide
tatggccaaccctaacgtgaaggctgatgg

SEQ ID NO: 318902 - DNA, 29 bp, Artificial Sequence
  Description of Artificial Sequence: Synthetic oligonucleotide
atggccaaccctaacgtgaaggctgatgg

SEQ ID NO: 318903 - DNA, 28 bp, Artificial Sequence
  Description of Artificial Sequence: Synthetic oligonucleotide
tggccaaccctaacgtgaaggctgatgg

SEQ ID NO: 318904 - DNA, 27 bp, Artificial Sequence
  Description of Artificial Sequence: Synthetic oligonucleotide
ggccaaccctaacgtgaaggctgatgg

SEQ ID NO: 318905 - DNA, 27 bp, Artificial Sequence
  Description of Artificial Sequence: Synthetic oligonucleotide
gccaaccctaacgtgaaggctgatggc

SEQ ID NO: 318906 - DNA, 29 bp, Artificial Sequence
  Description of Artificial Sequence: Synthetic oligonucleotide
ccaaccctaacgtgaaggctgatggcaag

SEQ ID NO: 318907 - DNA, 32 bp, Artificial Sequence
  Description of Artificial Sequence: Synthetic oligonucleotide
caaccctaacgtgaaggctgatggcaagatag

SEQ ID NO: 318908 - DNA, 33 bp, Artificial Sequence
  Description of Artificial Sequence: Synthetic oligonucleotide
aaccctaacgtgaaggctgatggcaagatagtg

SEQ ID NO: 318909 - DNA, 32 bp, Artificial Sequence
  Description of Artificial Sequence: Synthetic oligonucleotide
accctaacgtgaaggctgatggcaagatagtg

SEQ ID NO: 318910 - DNA, 31 bp, Artificial Sequence
  Description of Artificial Sequence: Synthetic oligonucleotide
ccctaacgtgaaggctgatggcaagatagtg

SEQ ID NO: 318911 - DNA, 31 bp, Artificial Sequence
  Description of Artificial Sequence: Synthetic oligonucleotide
cctaacgtgaaggctgatggcaagatagtgc

SEQ ID NO: 318912 - DNA, 32 bp, Artificial Sequence
  Description of Artificial Sequence: Synthetic oligonucleotide
ctaacgtgaaggctgatggcaagatagtgctc

SEQ ID NO: 318913 - DNA, 32 bp, Artificial Sequence
  Description of Artificial Sequence: Synthetic oligonucleotide
taacgtgaaggctgatggcaagatagtgctcg

SEQ ID NO: 318914 - DNA, 31 bp, Artificial Sequence
  Description of Artificial Sequence: Synthetic oligonucleotide
aacgtgaaggctgatggcaagatagtgctcg

SEQ ID NO: 318915 - DNA, 30 bp, Artificial Sequence
  Description of Artificial Sequence: Synthetic oligonucleotide
acgtgaaggctgatggcaagatagtgctcg

SEQ ID NO: 318916 - DNA, 29 bp, Artificial Sequence
  Description of Artificial Sequence: Synthetic oligonucleotide
cgtgaaggctgatggcaagatagtgctcg

SEQ ID NO: 318917 - DNA, 29 bp, Artificial Sequence
  Description of Artificial Sequence: Synthetic oligonucleotide
gtgaaggctgatggcaagatagtgctcgg

SEQ ID NO: 318918 - DNA, 30 bp, Artificial Sequence
  Description of Artificial Sequence: Synthetic oligonucleotide
tgaaggctgatggcaagatagtgctcggag

SEQ ID NO: 318919 - DNA, 29 bp, Artificial Sequence
  Description of Artificial Sequence: Synthetic oligonucleotide
gaaggctgatggcaagatagtgctcggag

SEQ ID NO: 318920 - DNA, 29 bp, Artificial Sequence
  Description of Artificial Sequence: Synthetic oligonucleotide
aaggctgatggcaagatagtgctcggagc

SEQ ID NO: 318921 - DNA, 28 bp, Artificial Sequence
  Description of Artificial Sequence: Synthetic oligonucleotide
aggctgatggcaagatagtgctcggagc

SEQ ID NO: 318922 - DNA, 27 bp, Artificial Sequence
  Description of Artificial Sequence: Synthetic oligonucleotide
ggctgatggcaagatagtgctcggagc

SEQ ID NO: 318923 - DNA, 27 bp, Artificial Sequence
  Description of Artificial Sequence: Synthetic oligonucleotide
gctgatggcaagatagtgctcggagcc

SEQ ID NO: 318924 - DNA, 31 bp, Artificial Sequence
  Description of Artificial Sequence: Synthetic oligonucleotide
ctgatggcaagatagtgctcggagcctttag

SEQ ID NO: 318925 - DNA, 32 bp, Artificial Sequence
  Description of Artificial Sequence: Synthetic oligonucleotide
tgatggcaagatagtgctcggagcctttagtc

SEQ ID NO: 318926 - DNA, 31 bp, Artificial Sequence
  Description of Artificial Sequence: Synthetic oligonucleotide
gatggcaagatagtgctcggagcctttagtc

SEQ ID NO: 318927 - DNA, 33 bp, Artificial Sequence
  Description of Artificial Sequence: Synthetic oligonucleotide
atggcaagatagtgctcggagcctttagtcatg

SEQ ID NO: 318928 - DNA, 32 bp, Artificial Sequence
  Description of Artificial Sequence: Synthetic oligonucleotide
tggcaagatagtgctcggagcctttagtcatg

SEQ ID NO: 318929 - DNA, 31 bp, Artificial Sequence
  Description of Artificial Sequence: Synthetic oligonucleotide
ggcaagatagtgctcggagcctttagtcatg

SEQ ID NO: 318930 - DNA, 31 bp, Artificial Sequence
  Description of Artificial Sequence: Synthetic oligonucleotide
gcaagatagtgctcggagcctttagtcatgg

SEQ ID NO: 318931 - DNA, 31 bp, Artificial Sequence
  Description of Artificial Sequence: Synthetic oligonucleotide
caagatagtgctcggagcctttagtcatggc

SEQ ID NO: 318932 - DNA, 31 bp, Artificial Sequence
  Description of Artificial Sequence: Synthetic oligonucleotide
aagatagtgctcggagcctttagtcatggcc

SEQ ID NO: 318933 - DNA, 30 bp, Artificial Sequence
  Description of Artificial Sequence: Synthetic oligonucleotide
agatagtgctcggagcctttagtcatggcc

SEQ ID NO: 318934 - DNA, 29 bp, Artificial Sequence
  Description of Artificial Sequence: Synthetic oligonucleotide
gatagtgctcggagcctttagtcatggcc

SEQ ID NO: 318935 - DNA, 30 bp, Artificial Sequence
  Description of Artificial Sequence: Synthetic oligonucleotide
atagtgctcggagcctttagtcatggcctg

SEQ ID NO: 318936 - DNA, 29 bp, Artificial Sequence
  Description of Artificial Sequence: Synthetic oligonucleotide
tagtgctcggagcctttagtcatggcctg

SEQ ID NO: 318937 - DNA, 28 bp, Artificial Sequence
  Description of Artificial Sequence: Synthetic oligonucleotide
agtgctcggagcctttagtcatggcctg

SEQ ID NO: 318938 - DNA, 27 bp, Artificial Sequence
  Description of Artificial Sequence: Synthetic oligonucleotide
gtgctcggagcctttagtcatggcctg

SEQ ID NO: 318939 - DNA, 27 bp, Artificial Sequence
  Description of Artificial Sequence: Synthetic oligonucleotide
tgctcggagcctttagtcatggcctgg

SEQ ID NO: 318940 - DNA, 26 bp, Artificial Sequence
  Description of Artificial Sequence: Synthetic oligonucleotide
gctcggagcctttagtcatggcctgg

SEQ ID NO: 318941 - DNA, 27 bp, Artificial Sequence
  Description of Artificial Sequence: Synthetic oligonucleotide
ctcggagcctttagtcatggcctgggt

SEQ ID NO: 318942 - DNA, 27 bp, Artificial Sequence
  Description of Artificial Sequence: Synthetic oligonucleotide
tcggagcctttagtcatggcctgggtc

SEQ ID NO: 318943 - DNA, 27 bp, Artificial Sequence
  Description of Artificial Sequence: Synthetic oligonucleotide
cggagcctttagtcatggcctgggtca

SEQ ID NO: 318944 - DNA, 27 bp, Artificial Sequence
  Description of Artificial Sequence: Synthetic oligonucleotide
ggagcctttagtcatggcctgggtcac

SEQ ID NO: 318945 - DNA, 27 bp, Artificial Sequence
  Description of Artificial Sequence: Synthetic oligonucleotide
gagcctttagtcatggcctgggtcacc

SEQ ID NO: 318946 - DNA, 28 bp, Artificial Sequence
  Description of Artificial Sequence: Synthetic oligonucleotide
agcctttagtcatggcctgggtcacctg

SEQ ID NO: 318947 - DNA, 27 bp, Artificial Sequence
  Description of Artificial Sequence: Synthetic oligonucleotide
gcctttagtcatggcctgggtcacctg

SEQ ID NO: 318948 - DNA, 27 bp, Artificial Sequence
  Description of Artificial Sequence: Synthetic oligonucleotide
cctttagtcatggcctgggtcacctgg

SEQ ID NO: 318949 - DNA, 28 bp, Artificial Sequence
  Description of Artificial Sequence: Synthetic oligonucleotide
ctttagtcatggcctgggtcacctggag

SEQ ID NO: 318950 - DNA, 30 bp, Artificial Sequence
  Description of Artificial Sequence: Synthetic oligonucleotide
tttagtcatggcctgggtcacctggagaac

SEQ ID NO: 318951 - DNA, 29 bp, Artificial Sequence
  Description of Artificial Sequence: Synthetic oligonucleotide
ttagtcatggcctgggtcacctggagaac

SEQ ID NO: 318952 - DNA, 28 bp, Artificial Sequence
  Description of Artificial Sequence: Synthetic oligonucleotide
tagtcatggcctgggtcacctggagaac

SEQ ID NO: 318953 - DNA, 27 bp, Artificial Sequence
  Description of Artificial Sequence: Synthetic oligonucleotide
agtcatggcctgggtcacctggagaac

SEQ ID NO: 318954 - DNA, 26 bp, Artificial Sequence
  Description of Artificial Sequence: Synthetic oligonucleotide
gtcatggcctgggtcacctggagaac

SEQ ID NO: 318955 - DNA, 27 bp, Artificial Sequence
  Description of Artificial Sequence: Synthetic oligonucleotide
tcatggcctgggtcacctggagaacct

SEQ ID NO: 318956 - DNA, 26 bp, Artificial Sequence
  Description of Artificial Sequence: Synthetic oligonucleotide
catggcctgggtcacctggagaacct

SEQ ID NO: 318957 - DNA, 27 bp, Artificial Sequence
  Description of Artificial Sequence: Synthetic oligonucleotide
atggcctgggtcacctggagaacctca

SEQ ID NO: 318958 - DNA, 27 bp, Artificial Sequence
  Description of Artificial Sequence: Synthetic oligonucleotide
tggcctgggtcacctggagaacctcaa

SEQ ID NO: 318959 - DNA, 26 bp, Artificial Sequence
  Description of Artificial Sequence: Synthetic oligonucleotide
ggcctgggtcacctggagaacctcaa

SEQ ID NO: 318960 - DNA, 26 bp, Artificial Sequence
  Description of Artificial Sequence: Synthetic oligonucleotide
gcctgggtcacctggagaacctcaag

SEQ ID NO: 318961 - DNA, 26 bp, Artificial Sequence
  Description of Artificial Sequence: Synthetic oligonucleotide
cctgggtcacctggagaacctcaagc

SEQ ID NO: 318962 - DNA, 26 bp, Artificial Sequence
  Description of Artificial Sequence: Synthetic oligonucleotide
ctgggtcacctggagaacctcaagcg

SEQ ID NO: 318963 - DNA, 27 bp, Artificial Sequence
  Description of Artificial Sequence: Synthetic oligonucleotide
tgggtcacctggagaacctcaagcgca

SEQ ID NO: 318964 - DNA, 26 bp, Artificial Sequence
  Description of Artificial Sequence: Synthetic oligonucleotide
gggtcacctggagaacctcaagcgca

SEQ ID NO: 318965 - DNA, 26 bp, Artificial Sequence
  Description of Artificial Sequence: Synthetic oligonucleotide
ggtcacctggagaacctcaagcgcac

SEQ ID NO: 318966 - DNA, 27 bp, Artificial Sequence
  Description of Artificial Sequence: Synthetic oligonucleotide
gtcacctggagaacctcaagcgcacct

SEQ ID NO: 318967 - DNA, 29 bp, Artificial Sequence
  Description of Artificial Sequence: Synthetic oligonucleotide
tcacctggagaacctcaagcgcacctttg

SEQ ID NO: 318968 - DNA, 28 bp, Artificial Sequence
  Description of Artificial Sequence: Synthetic oligonucleotide
cacctggagaacctcaagcgcacctttg

SEQ ID NO: 318969 - DNA, 28 bp, Artificial Sequence
  Description of Artificial Sequence: Synthetic oligonucleotide
acctggagaacctcaagcgcacctttgg

SEQ ID NO: 318970 - DNA, 27 bp, Artificial Sequence
  Description of Artificial Sequence: Synthetic oligonucleotide
cctggagaacctcaagcgcacctttgg

SEQ ID NO: 318971 - DNA, 27 bp, Artificial Sequence
  Description of Artificial Sequence: Synthetic oligonucleotide
ctggagaacctcaagcgcacctttggc

SEQ ID NO: 318972 - DNA, 28 bp, Artificial Sequence
  Description of Artificial Sequence: Synthetic oligonucleotide
tggagaacctcaagcgcacctttggcac

SEQ ID NO: 318973 - DNA, 27 bp, Artificial Sequence
  Description of Artificial Sequence: Synthetic oligonucleotide
ggagaacctcaagcgcacctttggcac

SEQ ID NO: 318974 - DNA, 28 bp, Artificial Sequence
  Description of Artificial Sequence: Synthetic oligonucleotide
gagaacctcaagcgcacctttggcacac

SEQ ID NO: 318975 - DNA, 29 bp, Artificial Sequence
  Description of Artificial Sequence: Synthetic oligonucleotide
agaacctcaagcgcacctttggcacactg

SEQ ID NO: 318976 - DNA, 28 bp, Artificial Sequence
  Description of Artificial Sequence: Synthetic oligonucleotide
gaacctcaagcgcacctttggcacactg

SEQ ID NO: 318977 - DNA, 29 bp, Artificial Sequence
  Description of Artificial Sequence: Synthetic oligonucleotide
aacctcaagcgcacctttggcacactgag

SEQ ID NO: 318978 - DNA, 28 bp, Artificial Sequence
  Description of Artificial Sequence: Synthetic oligonucleotide
acctcaagcgcacctttggcacactgag

SEQ ID NO: 318979 - DNA, 27 bp, Artificial Sequence
  Description of Artificial Sequence: Synthetic oligonucleotide
cctcaagcgcacctttggcacactgag

SEQ ID NO: 318980 - DNA, 28 bp, Artificial Sequence
  Description of Artificial Sequence: Synthetic oligonucleotide
ctcaagcgcacctttggcacactgagag

SEQ ID NO: 318981 - DNA, 29 bp, Artificial Sequence
  Description of Artificial Sequence: Synthetic oligonucleotide
tcaagcgcacctttggcacactgagagag

SEQ ID NO: 318982 - DNA, 28 bp, Artificial Sequence
  Description of Artificial Sequence: Synthetic oligonucleotide
caagcgcacctttggcacactgagagag

SEQ ID NO: 318983 - DNA, 28 bp, Artificial Sequence
  Description of Artificial Sequence: Synthetic oligonucleotide
aagcgcacctttggcacactgagagagc

SEQ ID NO: 318984 - DNA, 27 bp, Artificial Sequence
  Description of Artificial Sequence: Synthetic oligonucleotide
agcgcacctttggcacactgagagagc

SEQ ID NO: 318985 - DNA, 27 bp, Artificial Sequence
  Description of Artificial Sequence: Synthetic oligonucleotide
gcgcacctttggcacactgagagagct

SEQ ID NO: 318986 - DNA, 27 bp, Artificial Sequence
  Description of Artificial Sequence: Synthetic oligonucleotide
cgcacctttggcacactgagagagctg

SEQ ID NO: 318987 - DNA, 27 bp, Artificial Sequence
  Description of Artificial Sequence: Synthetic oligonucleotide
gcacctttggcacactgagagagctgc

SEQ ID NO: 318988 - DNA, 28 bp, Artificial Sequence
  Description of Artificial Sequence: Synthetic oligonucleotide
cacctttggcacactgagagagctgcac

SEQ ID NO: 318989 - DNA, 29 bp, Artificial Sequence
  Description of Artificial Sequence: Synthetic oligonucleotide
acctttggcacactgagagagctgcacag

SEQ ID NO: 318990 - DNA, 28 bp, Artificial Sequence
  Description of Artificial Sequence: Synthetic oligonucleotide
cctttggcacactgagagagctgcacag

SEQ ID NO: 318991 - DNA, 29 bp, Artificial Sequence
  Description of Artificial Sequence: Synthetic oligonucleotide
ctttggcacactgagagagctgcacagtg

SEQ ID NO: 318992 - DNA, 30 bp, Artificial Sequence
  Description of Artificial Sequence: Synthetic oligonucleotide
tttggcacactgagagagctgcacagtgac

SEQ ID NO: 318993 - DNA, 29 bp, Artificial Sequence
  Description of Artificial Sequence: Synthetic oligonucleotide
ttggcacactgagagagctgcacagtgac

SEQ ID NO: 318994 - DNA, 28 bp, Artificial Sequence
  Description of Artificial Sequence: Synthetic oligonucleotide
tggcacactgagagagctgcacagtgac

SEQ ID NO: 318995 - DNA, 27 bp, Artificial Sequence
  Description of Artificial Sequence: Synthetic oligonucleotide
ggcacactgagagagctgcacagtgac

SEQ ID NO: 318996 - DNA, 29 bp, Artificial Sequence
  Description of Artificial Sequence: Synthetic oligonucleotide
gcacactgagagagctgcacagtgacaag

SEQ ID NO: 318997 - DNA, 29 bp, Artificial Sequence
  Description of Artificial Sequence: Synthetic oligonucleotide
cacactgagagagctgcacagtgacaagc

SEQ ID NO: 318998 - DNA, 30 bp, Artificial Sequence
  Description of Artificial Sequence: Synthetic oligonucleotide
acactgagagagctgcacagtgacaagcag

SEQ ID NO: 318999 - DNA, 29 bp, Artificial Sequence
  Description of Artificial Sequence: Synthetic oligonucleotide
cactgagagagctgcacagtgacaagcag

SEQ ID NO: 319000 - DNA, 29 bp, Artificial Sequence
  Description of Artificial Sequence: Synthetic oligonucleotide
actgagagagctgcacagtgacaagcagc

SEQ ID NO: 319001 - DNA, 28 bp, Artificial Sequence
  Description of Artificial Sequence: Synthetic oligonucleotide
ctgagagagctgcacagtgacaagcagc

SEQ ID NO: 319002 - DNA, 29 bp, Artificial Sequence
  Description of Artificial Sequence: Synthetic oligonucleotide
tgagagagctgcacagtgacaagcagcac

SEQ ID NO: 319003 - DNA, 28 bp, Artificial Sequence
  Description of Artificial Sequence: Synthetic oligonucleotide
gagagagctgcacagtgacaagcagcac

SEQ ID NO: 319004 - DNA, 28 bp, Artificial Sequence
  Description of Artificial Sequence: Synthetic oligonucleotide
agagagctgcacagtgacaagcagcacg

SEQ ID NO: 319005 - DNA, 27 bp, Artificial Sequence
  Description of Artificial Sequence: Synthetic oligonucleotide
gagagctgcacagtgacaagcagcacg

SEQ ID NO: 319006 - DNA, 28 bp, Artificial Sequence
  Description of Artificial Sequence: Synthetic oligonucleotide
agagctgcacagtgacaagcagcacgtg

SEQ ID NO: 319007 - DNA, 27 bp, Artificial Sequence
  Description of Artificial Sequence: Synthetic oligonucleotide
gagctgcacagtgacaagcagcacgtg

SEQ ID NO: 319008 - DNA, 27 bp, Artificial Sequence
  Description of Artificial Sequence: Synthetic oligonucleotide
agctgcacagtgacaagcagcacgtgg

SEQ ID NO: 319009 - DNA, 27 bp, Artificial Sequence
  Description of Artificial Sequence: Synthetic oligonucleotide
gctgcacagtgacaagcagcacgtgga

SEQ ID NO: 319010 - DNA, 28 bp, Artificial Sequence
  Description of Artificial Sequence: Synthetic oligonucleotide
ctgcacagtgacaagcagcacgtggaac

SEQ ID NO: 319011 - DNA, 28 bp, Artificial Sequence
  Description of Artificial Sequence: Synthetic oligonucleotide
tgcacagtgacaagcagcacgtggaacc

SEQ ID NO: 319012 - DNA, 27 bp, Artificial Sequence
  Description of Artificial Sequence: Synthetic oligonucleotide
gcacagtgacaagcagcacgtggaacc

SEQ ID NO: 319013 - DNA, 28 bp, Artificial Sequence
  Description of Artificial Sequence: Synthetic oligonucleotide
cacagtgacaagcagcacgtggaacctg

SEQ ID NO: 319014 - DNA, 29 bp, Artificial Sequence
  Description of Artificial Sequence: Synthetic oligonucleotide
acagtgacaagcagcacgtggaacctgag

SEQ ID NO: 319015 - DNA, 28 bp, Artificial Sequence
  Description of Artificial Sequence: Synthetic oligonucleotide
cagtgacaagcagcacgtggaacctgag

SEQ ID NO: 319016 - DNA, 30 bp, Artificial Sequence
  Description of Artificial Sequence: Synthetic oligonucleotide
agtgacaagcagcacgtggaacctgagaac

SEQ ID NO: 319017 - DNA, 29 bp, Artificial Sequence
  Description of Artificial Sequence: Synthetic oligonucleotide
gtgacaagcagcacgtggaacctgagaac

SEQ ID NO: 319018 - DNA, 31 bp, Artificial Sequence
  Description of Artificial Sequence: Synthetic oligonucleotide
tgacaagcagcacgtggaacctgagaacatc

SEQ ID NO: 319019 - DNA, 30 bp, Artificial Sequence
  Description of Artificial Sequence: Synthetic oligonucleotide
gacaagcagcacgtggaacctgagaacatc

SEQ ID NO: 319020 - DNA, 31 bp, Artificial Sequence
  Description of Artificial Sequence: Synthetic oligonucleotide
acaagcagcacgtggaacctgagaacatcag

SEQ ID NO: 319021 - DNA, 30 bp, Artificial Sequence
  Description of Artificial Sequence: Synthetic oligonucleotide
caagcagcacgtggaacctgagaacatcag

SEQ ID NO: 319022 - DNA, 30 bp, Artificial Sequence
  Description of Artificial Sequence: Synthetic oligonucleotide
aagcagcacgtggaacctgagaacatcagg

SEQ ID NO: 319023 - DNA, 29 bp, Artificial Sequence
  Description of Artificial Sequence: Synthetic oligonucleotide
agcagcacgtggaacctgagaacatcagg

SEQ ID NO: 319024 - DNA, 28 bp, Artificial Sequence
  Description of Artificial Sequence: Synthetic oligonucleotide
gcagcacgtggaacctgagaacatcagg

SEQ ID NO: 319025 - DNA, 28 bp, Artificial Sequence
  Description of Artificial Sequence: Synthetic oligonucleotide
cagcacgtggaacctgagaacatcaggc

SEQ ID NO: 319026 - DNA, 29 bp, Artificial Sequence
  Description of Artificial Sequence: Synthetic oligonucleotide
agcacgtggaacctgagaacatcaggctc

SEQ ID NO: 319027 - DNA, 28 bp, Artificial Sequence
  Description of Artificial Sequence: Synthetic oligonucleotide
gcacgtggaacctgagaacatcaggctc

SEQ ID NO: 319028 - DNA, 28 bp, Artificial Sequence
  Description of Artificial Sequence: Synthetic oligonucleotide
cacgtggaacctgagaacatcaggctcc

SEQ ID NO: 319029 - DNA, 29 bp, Artificial Sequence
  Description of Artificial Sequence: Synthetic oligonucleotide
acgtggaacctgagaacatcaggctccag

SEQ ID NO: 319030 - DNA, 28 bp, Artificial Sequence
  Description of Artificial Sequence: Synthetic oligonucleotide
cgtggaacctgagaacatcaggctccag

SEQ ID NO: 319031 - DNA, 28 bp, Artificial Sequence
  Description of Artificial Sequence: Synthetic oligonucleotide
gtggaacctgagaacatcaggctccagg

SEQ ID NO: 319032 - DNA, 28 bp, Artificial Sequence
  Description of Artificial Sequence: Synthetic oligonucleotide
tggaacctgagaacatcaggctccaggg

SEQ ID NO: 319033 - DNA, 27 bp, Artificial Sequence
  Description of Artificial Sequence: Synthetic oligonucleotide
ggaacctgagaacatcaggctccaggg

SEQ ID NO: 319034 - DNA, 27 bp, Artificial Sequence
  Description of Artificial Sequence: Synthetic oligonucleotide
gaacctgagaacatcaggctccagggc

SEQ ID NO: 319035 - DNA, 29 bp, Artificial Sequence
  Description of Artificial Sequence: Synthetic oligonucleotide
aacctgagaacatcaggctccagggcaac

SEQ ID NO: 319036 - DNA, 28 bp, Artificial Sequence
  Description of Artificial Sequence: Synthetic oligonucleotide
acctgagaacatcaggctccagggcaac

SEQ ID NO: 319037 - DNA, 27 bp, Artificial Sequence
  Description of Artificial Sequence: Synthetic oligonucleotide
cctgagaacatcaggctccagggcaac

SEQ ID NO: 319038 - DNA, 27 bp, Artificial Sequence
  Description of Artificial Sequence: Synthetic oligonucleotide
ctgagaacatcaggctccagggcaacg

SEQ ID NO: 319039 - DNA, 28 bp, Artificial Sequence
  Description of Artificial Sequence: Synthetic oligonucleotide
tgagaacatcaggctccagggcaacgtc

SEQ ID NO: 319040 - DNA, 27 bp, Artificial Sequence
  Description of Artificial Sequence: Synthetic oligonucleotide
gagaacatcaggctccagggcaacgtc

SEQ ID NO: 319041 - DNA, 27 bp, Artificial Sequence
  Description of Artificial Sequence: Synthetic oligonucleotide
agaacatcaggctccagggcaacgtcc

SEQ ID NO: 319042 - DNA, 27 bp, Artificial Sequence
  Description of Artificial Sequence: Synthetic oligonucleotide
gaacatcaggctccagggcaacgtcct

SEQ ID NO: 319043 - DNA, 27 bp, Artificial Sequence
  Description of Artificial Sequence: Synthetic oligonucleotide
aacatcaggctccagggcaacgtcctg

SEQ ID NO: 319044 - DNA, 26 bp, Artificial Sequence
  Description of Artificial Sequence: Synthetic oligonucleotide
acatcaggctccagggcaacgtcctg

SEQ ID NO: 319045 - DNA, 25 bp, Artificial Sequence
  Description of Artificial Sequence: Synthetic oligonucleotide
catcaggctccagggcaacgtcctg

SEQ ID NO: 319046 - DNA, 26 bp, Artificial Sequence
  Description of Artificial Sequence: Synthetic oligonucleotide
atcaggctccagggcaacgtcctggt

SEQ ID NO: 319047 - DNA, 25 bp, Artificial Sequence
  Description of Artificial Sequence: Synthetic oligonucleotide
tcaggctccagggcaacgtcctggt

SEQ ID NO: 319048 - DNA, 24 bp, Artificial Sequence
  Description of Artificial Sequence: Synthetic oligonucleotide
caggctccagggcaacgtcctggt

SEQ ID NO: 319049 - DNA, 25 bp, Artificial Sequence
  Description of Artificial Sequence: Synthetic oligonucleotide
aggctccagggcaacgtcctggtct

SEQ ID NO: 319050 - DNA, 24 bp, Artificial Sequence
  Description of Artificial Sequence: Synthetic oligonucleotide
ggctccagggcaacgtcctggtct

SEQ ID NO: 319051 - DNA, 25 bp, Artificial Sequence
  Description of Artificial Sequence: Synthetic oligonucleotide
gctccagggcaacgtcctggtctgt

SEQ ID NO: 319052 - DNA, 26 bp, Artificial Sequence
  Description of Artificial Sequence: Synthetic oligonucleotide
ctccagggcaacgtcctggtctgtct

SEQ ID NO: 319053 - DNA, 26 bp, Artificial Sequence
  Description of Artificial Sequence: Synthetic oligonucleotide
tccagggcaacgtcctggtctgtctg

SEQ ID NO: 319054 - DNA, 25 bp, Artificial Sequence
  Description of Artificial Sequence: Synthetic oligonucleotide
ccagggcaacgtcctggtctgtctg

SEQ ID NO: 319055 - DNA, 26 bp, Artificial Sequence
  Description of Artificial Sequence: Synthetic oligonucleotide
cagggcaacgtcctggtctgtctgct

SEQ ID NO: 319056 - DNA, 26 bp, Artificial Sequence
  Description of Artificial Sequence: Synthetic oligonucleotide
agggcaacgtcctggtctgtctgctg

SEQ ID NO: 319057 - DNA, 25 bp, Artificial Sequence
  Description of Artificial Sequence: Synthetic oligonucleotide
gggcaacgtcctggtctgtctgctg

SEQ ID NO: 319058 - DNA, 25 bp, Artificial Sequence
  Description of Artificial Sequence: Synthetic oligonucleotide
ggcaacgtcctggtctgtctgctgg

SEQ ID NO: 319059 - DNA, 25 bp, Artificial Sequence
  Description of Artificial Sequence: Synthetic oligonucleotide
gcaacgtcctggtctgtctgctggc

SEQ ID NO: 319060 - DNA, 25 bp, Artificial Sequence
  Description of Artificial Sequence: Synthetic oligonucleotide
caacgtcctggtctgtctgctggcc

SEQ ID NO: 319061 - DNA, 27 bp, Artificial Sequence
  Description of Artificial Sequence: Synthetic oligonucleotide
aacgtcctggtctgtctgctggccctt

SEQ ID NO: 319062 - DNA, 26 bp, Artificial Sequence
  Description of Artificial Sequence: Synthetic oligonucleotide
acgtcctggtctgtctgctggccctt

SEQ ID NO: 319063 - DNA, 25 bp, Artificial Sequence
  Description of Artificial Sequence: Synthetic oligonucleotide
cgtcctggtctgtctgctggccctt

SEQ ID NO: 319064 - DNA, 26 bp, Artificial Sequence
  Description of Artificial Sequence: Synthetic oligonucleotide
gtcctggtctgtctgctggcccttca

SEQ ID NO: 319065 - DNA, 27 bp, Artificial Sequence
  Description of Artificial Sequence: Synthetic oligonucleotide
tcctggtctgtctgctggcccttcact

SEQ ID NO: 319066 - DNA, 27 bp, Artificial Sequence
  Description of Artificial Sequence: Synthetic oligonucleotide
cctggtctgtctgctggcccttcactt

SEQ ID NO: 319067 - DNA, 28 bp, Artificial Sequence
  Description of Artificial Sequence: Synthetic oligonucleotide
ctggtctgtctgctggcccttcactttg

SEQ ID NO: 319068 - DNA, 28 bp, Artificial Sequence
  Description of Artificial Sequence: Synthetic oligonucleotide
tggtctgtctgctggcccttcactttgg

SEQ ID NO: 319069 - DNA, 27 bp, Artificial Sequence
  Description of Artificial Sequence: Synthetic oligonucleotide
ggtctgtctgctggcccttcactttgg

SEQ ID NO: 319070 - DNA, 27 bp, Artificial Sequence
  Description of Artificial Sequence: Synthetic oligonucleotide
gtctgtctgctggcccttcactttggg

SEQ ID NO: 319071 - DNA, 30 bp, Artificial Sequence
  Description of Artificial Sequence: Synthetic oligonucleotide
tctgtctgctggcccttcactttgggaaag

SEQ ID NO: 319072 - DNA, 29 bp, Artificial Sequence
  Description of Artificial Sequence: Synthetic oligonucleotide
ctgtctgctggcccttcactttgggaaag

SEQ ID NO: 319073 - DNA, 33 bp, Artificial Sequence
  Description of Artificial Sequence: Synthetic oligonucleotide
tgtctgctggcccttcactttgggaaagaattc

SEQ ID NO: 319074 - DNA, 32 bp, Artificial Sequence
  Description of Artificial Sequence: Synthetic oligonucleotide
gtctgctggcccttcactttgggaaagaattc

SEQ ID NO: 319075 - DNA, 33 bp, Artificial Sequence
  Description of Artificial Sequence: Synthetic oligonucleotide
tctgctggcccttcactttgggaaagaattctc

SEQ ID NO: 319076 - DNA, 32 bp, Artificial Sequence
  Description of Artificial Sequence: Synthetic oligonucleotide
ctgctggcccttcactttgggaaagaattctc

SEQ ID NO: 319077 - DNA, 32 bp, Artificial Sequence
  Description of Artificial Sequence: Synthetic oligonucleotide
tgctggcccttcactttgggaaagaattctcc

SEQ ID NO: 319078 - DNA, 31 bp, Artificial Sequence
  Description of Artificial Sequence: Synthetic oligonucleotide
gctggcccttcactttgggaaagaattctcc

SEQ ID NO: 319079 - DNA, 31 bp, Artificial Sequence
  Description of Artificial Sequence: Synthetic oligonucleotide
ctggcccttcactttgggaaagaattctccc

SEQ ID NO: 319080 - DNA, 31 bp, Artificial Sequence
  Description of Artificial Sequence: Synthetic oligonucleotide
tggcccttcactttgggaaagaattctcccc

SEQ ID NO: 319081 - DNA, 30 bp, Artificial Sequence
  Description of Artificial Sequence: Synthetic oligonucleotide
ggcccttcactttgggaaagaattctcccc

SEQ ID NO: 319082 - DNA, 31 bp, Artificial Sequence
  Description of Artificial Sequence: Synthetic oligonucleotide
gcccttcactttgggaaagaattctccccac

SEQ ID NO: 319083 - DNA, 31 bp, Artificial Sequence
  Description of Artificial Sequence: Synthetic oligonucleotide
cccttcactttgggaaagaattctccccacc

SEQ ID NO: 319084 - DNA, 32 bp, Artificial Sequence
  Description of Artificial Sequence: Synthetic oligonucleotide
ccttcactttgggaaagaattctccccaccag

SEQ ID NO: 319085 - DNA, 33 bp, Artificial Sequence
  Description of Artificial Sequence: Synthetic oligonucleotide
cttcactttgggaaagaattctccccaccagag

SEQ ID NO: 319086 - DNA, 33 bp, Artificial Sequence
  Description of Artificial Sequence: Synthetic oligonucleotide
ttcactttgggaaagaattctccccaccagagc

SEQ ID NO: 319087 - DNA, 32 bp, Artificial Sequence
  Description of Artificial Sequence: Synthetic oligonucleotide
tcactttgggaaagaattctccccaccagagc

SEQ ID NO: 319088 - DNA, 31 bp, Artificial Sequence
  Description of Artificial Sequence: Synthetic oligonucleotide
cactttgggaaagaattctccccaccagagc

SEQ ID NO: 319089 - DNA, 32 bp, Artificial Sequence
  Description of Artificial Sequence: Synthetic oligonucleotide
actttgggaaagaattctccccaccagagcag

SEQ ID NO: 319090 - DNA, 31 bp, Artificial Sequence
  Description of Artificial Sequence: Synthetic oligonucleotide
ctttgggaaagaattctccccaccagagcag

SEQ ID NO: 319091 - DNA, 31 bp, Artificial Sequence
  Description of Artificial Sequence: Synthetic oligonucleotide
tttgggaaagaattctccccaccagagcagg

SEQ ID NO: 319092 - DNA, 30 bp, Artificial Sequence
  Description of Artificial Sequence: Synthetic oligonucleotide
ttgggaaagaattctccccaccagagcagg

SEQ ID NO: 319093 - DNA, 29 bp, Artificial Sequence
  Description of Artificial Sequence: Synthetic oligonucleotide
tgggaaagaattctccccaccagagcagg

SEQ ID NO: 319094 - DNA, 28 bp, Artificial Sequence
  Description of Artificial Sequence: Synthetic oligonucleotide
gggaaagaattctccccaccagagcagg

SEQ ID NO: 319095 - DNA, 28 bp, Artificial Sequence
  Description of Artificial Sequence: Synthetic oligonucleotide
ggaaagaattctccccaccagagcaggc

SEQ ID NO: 319096 - DNA, 29 bp, Artificial Sequence
  Description of Artificial Sequence: Synthetic oligonucleotide
gaaagaattctccccaccagagcaggctg

SEQ ID NO: 319097 - DNA, 29 bp, Artificial Sequence
  Description of Artificial Sequence: Synthetic oligonucleotide
aaagaattctccccaccagagcaggctgc

SEQ ID NO: 319098 - DNA, 28 bp, Artificial Sequence
  Description of Artificial Sequence: Synthetic oligonucleotide
aagaattctccccaccagagcaggctgc

SEQ ID NO: 319099 - DNA, 27 bp, Artificial Sequence
  Description of Artificial Sequence: Synthetic oligonucleotide
agaattctccccaccagagcaggctgc

SEQ ID NO: 319100 - DNA, 26 bp, Artificial Sequence
  Description of Artificial Sequence: Synthetic oligonucleotide
gaattctccccaccagagcaggctgc

SEQ ID NO: 319101 - DNA, 27 bp, Artificial Sequence
  Description of Artificial Sequence: Synthetic oligonucleotide
aattctccccaccagagcaggctgcgt

SEQ ID NO: 319102 - DNA, 27 bp, Artificial Sequence
  Description of Artificial Sequence: Synthetic oligonucleotide
attctccccaccagagcaggctgcgta

SEQ ID NO: 319103 - DNA, 27 bp, Artificial Sequence
  Description of Artificial Sequence: Synthetic oligonucleotide
ttctccccaccagagcaggctgcgtat

SEQ ID NO: 319104 - DNA, 26 bp, Artificial Sequence
  Description of Artificial Sequence: Synthetic oligonucleotide
tctccccaccagagcaggctgcgtat

SEQ ID NO: 319105 - DNA, 25 bp, Artificial Sequence
  Description of Artificial Sequence: Synthetic oligonucleotide
ctccccaccagagcaggctgcgtat

SEQ ID NO: 319106 - DNA, 26 bp, Artificial Sequence
  Description of Artificial Sequence: Synthetic oligonucleotide
tccccaccagagcaggctgcgtatca

SEQ ID NO: 319107 - DNA, 25 bp, Artificial Sequence
  Description of Artificial Sequence: Synthetic oligonucleotide
ccccaccagagcaggctgcgtatca

SEQ ID NO: 319108 - DNA, 27 bp, Artificial Sequence
  Description of Artificial Sequence: Synthetic oligonucleotide
cccaccagagcaggctgcgtatcagaa

SEQ ID NO: 319109 - DNA, 28 bp, Artificial Sequence
  Description of Artificial Sequence: Synthetic oligonucleotide
ccaccagagcaggctgcgtatcagaaac

SEQ ID NO: 319110 - DNA, 29 bp, Artificial Sequence
  Description of Artificial Sequence: Synthetic oligonucleotide
caccagagcaggctgcgtatcagaaactg

SEQ ID NO: 319111 - DNA, 29 bp, Artificial Sequence
  Description of Artificial Sequence: Synthetic oligonucleotide
accagagcaggctgcgtatcagaaactgg

SEQ ID NO: 319112 - DNA, 28 bp, Artificial Sequence
  Description of Artificial Sequence: Synthetic oligonucleotide
ccagagcaggctgcgtatcagaaactgg

SEQ ID NO: 319113 - DNA, 29 bp, Artificial Sequence
  Description of Artificial Sequence: Synthetic oligonucleotide
cagagcaggctgcgtatcagaaactggtg

SEQ ID NO: 319114 - DNA, 29 bp, Artificial Sequence
  Description of Artificial Sequence: Synthetic oligonucleotide
agagcaggctgcgtatcagaaactggtgg

SEQ ID NO: 319115 - DNA, 28 bp, Artificial Sequence
  Description of Artificial Sequence: Synthetic oligonucleotide
gagcaggctgcgtatcagaaactggtgg

SEQ ID NO: 319116 - DNA, 28 bp, Artificial Sequence
  Description of Artificial Sequence: Synthetic oligonucleotide
agcaggctgcgtatcagaaactggtggc

SEQ ID NO: 319117 - DNA, 27 bp, Artificial Sequence
  Description of Artificial Sequence: Synthetic oligonucleotide
gcaggctgcgtatcagaaactggtggc

SEQ ID NO: 319118 - DNA, 28 bp, Artificial Sequence
  Description of Artificial Sequence: Synthetic oligonucleotide
caggctgcgtatcagaaactggtggctg

SEQ ID NO: 319119 - DNA, 28 bp, Artificial Sequence
  Description of Artificial Sequence: Synthetic oligonucleotide
aggctgcgtatcagaaactggtggctgc

SEQ ID NO: 319120 - DNA, 27 bp, Artificial Sequence
  Description of Artificial Sequence: Synthetic oligonucleotide
ggctgcgtatcagaaactggtggctgc

SEQ ID NO: 319121 - DNA, 28 bp, Artificial Sequence
  Description of Artificial Sequence: Synthetic oligonucleotide
gctgcgtatcagaaactggtggctgctg

SEQ ID NO: 319122 - DNA, 29 bp, Artificial Sequence
  Description of Artificial Sequence: Synthetic oligonucleotide
ctgcgtatcagaaactggtggctgctgtg

SEQ ID NO: 319123 - DNA, 29 bp, Artificial Sequence
  Description of Artificial Sequence: Synthetic oligonucleotide
tgcgtatcagaaactggtggctgctgtgg

SEQ ID NO: 319124 - DNA, 28 bp, Artificial Sequence
  Description of Artificial Sequence: Synthetic oligonucleotide
gcgtatcagaaactggtggctgctgtgg

SEQ ID NO: 319125 - DNA, 28 bp, Artificial Sequence
  Description of Artificial Sequence: Synthetic oligonucleotide
cgtatcagaaactggtggctgctgtggc

SEQ ID NO: 319126 - DNA, 32 bp, Artificial Sequence
  Description of Artificial Sequence: Synthetic oligonucleotide
gtatcagaaactggtggctgctgtggctaaag

SEQ ID NO: 319127 - DNA, 32 bp, Artificial Sequence
  Description of Artificial Sequence: Synthetic oligonucleotide
tatcagaaactggtggctgctgtggctaaagc

SEQ ID NO: 319128 - DNA, 31 bp, Artificial Sequence
  Description of Artificial Sequence: Synthetic oligonucleotide
atcagaaactggtggctgctgtggctaaagc

SEQ ID NO: 319129 - DNA, 30 bp, Artificial Sequence
  Description of Artificial Sequence: Synthetic oligonucleotide
tcagaaactggtggctgctgtggctaaagc

SEQ ID NO: 319130 - DNA, 29 bp, Artificial Sequence
  Description of Artificial Sequence: Synthetic oligonucleotide
cagaaactggtggctgctgtggctaaagc

SEQ ID NO: 319131 - DNA, 29 bp, Artificial Sequence
  Description of Artificial Sequence: Synthetic oligonucleotide
agaaactggtggctgctgtggctaaagcc

SEQ ID NO: 319132 - DNA, 28 bp, Artificial Sequence
  Description of Artificial Sequence: Synthetic oligonucleotide
gaaactggtggctgctgtggctaaagcc

SEQ ID NO: 319133 - DNA, 28 bp, Artificial Sequence
  Description of Artificial Sequence: Synthetic oligonucleotide
aaactggtggctgctgtggctaaagccc

SEQ ID NO: 319134 - DNA, 27 bp, Artificial Sequence
  Description of Artificial Sequence: Synthetic oligonucleotide
aactggtggctgctgtggctaaagccc

SEQ ID NO: 319135 - DNA, 27 bp, Artificial Sequence
  Description of Artificial Sequence: Synthetic oligonucleotide
actggtggctgctgtggctaaagccct

SEQ ID NO: 319136 - DNA, 26 bp, Artificial Sequence
  Description of Artificial Sequence: Synthetic oligonucleotide
ctggtggctgctgtggctaaagccct

SEQ ID NO: 319137 - DNA, 26 bp, Artificial Sequence
  Description of Artificial Sequence: Synthetic oligonucleotide
tggtggctgctgtggctaaagccctg

SEQ ID NO: 319138 - DNA, 25 bp, Artificial Sequence
  Description of Artificial Sequence: Synthetic oligonucleotide
ggtggctgctgtggctaaagccctg

SEQ ID NO: 319139 - DNA, 25 bp, Artificial Sequence
  Description of Artificial Sequence: Synthetic oligonucleotide
gtggctgctgtggctaaagccctgg

SEQ ID NO: 319140 - DNA, 25 bp, Artificial Sequence
  Description of Artificial Sequence: Synthetic oligonucleotide
tggctgctgtggctaaagccctggc

SEQ ID NO: 319141 - DNA, 24 bp, Artificial Sequence
  Description of Artificial Sequence: Synthetic oligonucleotide
ggctgctgtggctaaagccctggc

SEQ ID NO: 319142 - DNA, 24 bp, Artificial Sequence
  Description of Artificial Sequence: Synthetic oligonucleotide
gctgctgtggctaaagccctggcc

SEQ ID NO: 319143 - DNA, 25 bp, Artificial Sequence
  Description of Artificial Sequence: Synthetic oligonucleotide
ctgctgtggctaaagccctggccga

SEQ ID NO: 319144 - DNA, 27 bp, Artificial Sequence
  Description of Artificial Sequence: Synthetic oligonucleotide
tgctgtggctaaagccctggccgacaa

SEQ ID NO: 319145 - DNA, 26 bp, Artificial Sequence
  Description of Artificial Sequence: Synthetic oligonucleotide
gctgtggctaaagccctggccgacaa

SEQ ID NO: 319146 - DNA, 27 bp, Artificial Sequence
  Description of Artificial Sequence: Synthetic oligonucleotide
ctgtggctaaagccctggccgacaagt

SEQ ID NO: 319147 - DNA, 29 bp, Artificial Sequence
  Description of Artificial Sequence: Synthetic oligonucleotide
tgtggctaaagccctggccgacaagtatc

SEQ ID NO: 319148 - DNA, 28 bp, Artificial Sequence
  Description of Artificial Sequence: Synthetic oligonucleotide
gtggctaaagccctggccgacaagtatc

SEQ ID NO: 319149 - DNA, 29 bp, Artificial Sequence
  Description of Artificial Sequence: Synthetic oligonucleotide
tggctaaagccctggccgacaagtatctc

SEQ ID NO: 319150 - DNA, 28 bp, Artificial Sequence
  Description of Artificial Sequence: Synthetic oligonucleotide
ggctaaagccctggccgacaagtatctc

SEQ ID NO: 319151 - DNA, 27 bp, Artificial Sequence
  Description of Artificial Sequence: Synthetic oligonucleotide
atggtgctgactcctgccgtcaagacc

SEQ ID NO: 319152 - DNA, 27 bp, Artificial Sequence
  Description of Artificial Sequence: Synthetic oligonucleotide
tggtgctgactcctgccgtcaagacca

SEQ ID NO: 319153 - DNA, 27 bp, Artificial Sequence
  Description of Artificial Sequence: Synthetic oligonucleotide
ggtgctgactcctgccgtcaagaccaa

SEQ ID NO: 319154 - DNA, 27 bp, Artificial Sequence
  Description of Artificial Sequence: Synthetic oligonucleotide
gtgctgactcctgccgtcaagaccaag

SEQ ID NO: 319155 - DNA, 27 bp, Artificial Sequence
  Description of Artificial Sequence: Synthetic oligonucleotide
tgctgactcctgccgtcaagaccaagg

SEQ ID NO: 319156 - DNA, 27 bp, Artificial Sequence
  Description of Artificial Sequence: Synthetic oligonucleotide
gctgactcctgccgtcaagaccaaggt

SEQ ID NO: 319157 - DNA, 27 bp, Artificial Sequence
  Description of Artificial Sequence: Synthetic oligonucleotide
ctgactcctgccgtcaagaccaaggtc

SEQ ID NO: 319158 - DNA, 29 bp, Artificial Sequence
  Description of Artificial Sequence: Synthetic oligonucleotide
tgactcctgccgtcaagaccaaggtcaag

SEQ ID NO: 319159 - DNA, 28 bp, Artificial Sequence
  Description of Artificial Sequence: Synthetic oligonucleotide
gactcctgccgtcaagaccaaggtcaag

SEQ ID NO: 319160 - DNA, 28 bp, Artificial Sequence
  Description of Artificial Sequence: Synthetic oligonucleotide
actcctgccgtcaagaccaaggtcaagg

SEQ ID NO: 319161 - DNA, 27 bp, Artificial Sequence
  Description of Artificial Sequence: Synthetic oligonucleotide
ctcctgccgtcaagaccaaggtcaagg

SEQ ID NO: 319162 - DNA, 27 bp, Artificial Sequence
  Description of Artificial Sequence: Synthetic oligonucleotide
tcctgccgtcaagaccaaggtcaaggc

SEQ ID NO: 319163 - DNA, 26 bp, Artificial Sequence
  Description of Artificial Sequence: Synthetic oligonucleotide
cctgccgtcaagaccaaggtcaaggc

SEQ ID NO: 319164 - DNA, 26 bp, Artificial Sequence
  Description of Artificial Sequence: Synthetic oligonucleotide
ctgccgtcaagaccaaggtcaaggcc

SEQ ID NO: 319165 - DNA, 26 bp, Artificial Sequence
  Description of Artificial Sequence: Synthetic oligonucleotide
tgccgtcaagaccaaggtcaaggccc

SEQ ID NO: 319166 - DNA, 25 bp, Artificial Sequence
  Description of Artificial Sequence: Synthetic oligonucleotide
gccgtcaagaccaaggtcaaggccc

SEQ ID NO: 319167 - DNA, 25 bp, Artificial Sequence
  Description of Artificial Sequence: Synthetic oligonucleotide
ccgtcaagaccaaggtcaaggcccc

SEQ ID NO: 319168 - DNA, 26 bp, Artificial Sequence
  Description of Artificial Sequence: Synthetic oligonucleotide
cgtcaagaccaaggtcaaggccccct

SEQ ID NO: 319169 - DNA, 26 bp, Artificial Sequence
  Description of Artificial Sequence: Synthetic oligonucleotide
gtcaagaccaaggtcaaggccccctg

SEQ ID NO: 319170 - DNA, 26 bp, Artificial Sequence
  Description of Artificial Sequence: Synthetic oligonucleotide
tcaagaccaaggtcaaggccccctgg

SEQ ID NO: 319171 - DNA, 25 bp, Artificial Sequence
  Description of Artificial Sequence: Synthetic oligonucleotide
caagaccaaggtcaaggccccctgg

SEQ ID NO: 319172 - DNA, 25 bp, Artificial Sequence
  Description of Artificial Sequence: Synthetic oligonucleotide
aagaccaaggtcaaggccccctggg

SEQ ID NO: 319173 - DNA, 24 bp, Artificial Sequence
  Description of Artificial Sequence: Synthetic oligonucleotide
agaccaaggtcaaggccccctggg

SEQ ID NO: 319174 - DNA, 23 bp, Artificial Sequence
  Description of Artificial Sequence: Synthetic oligonucleotide
gaccaaggtcaaggccccctggg

SEQ ID NO: 319175 - DNA, 26 bp, Artificial Sequence
  Description of Artificial Sequence: Synthetic oligonucleotide
accaaggtcaaggccccctggggtat

SEQ ID NO: 319176 - DNA, 25 bp, Artificial Sequence
  Description of Artificial Sequence: Synthetic oligonucleotide
ccaaggtcaaggccccctggggtat

SEQ ID NO: 319177 - DNA, 25 bp, Artificial Sequence
  Description of Artificial Sequence: Synthetic oligonucleotide
caaggtcaaggccccctggggtatg

SEQ ID NO: 319178 - DNA, 26 bp, Artificial Sequence
  Description of Artificial Sequence: Synthetic oligonucleotide
aaggtcaaggccccctggggtatggt

SEQ ID NO: 319179 - DNA, 25 bp, Artificial Sequence
  Description of Artificial Sequence: Synthetic oligonucleotide
aggtcaaggccccctggggtatggt

SEQ ID NO: 319180 - DNA, 24 bp, Artificial Sequence
  Description of Artificial Sequence: Synthetic oligonucleotide
ggtcaaggccccctggggtatggt

SEQ ID NO: 319181 - DNA, 24 bp, Artificial Sequence
  Description of Artificial Sequence: Synthetic oligonucleotide
gtcaaggccccctggggtatggtc

SEQ ID NO: 319182 - DNA, 24 bp, Artificial Sequence
  Description of Artificial Sequence: Synthetic oligonucleotide
tcaaggccccctggggtatggtcg

SEQ ID NO: 319183 - DNA, 23 bp, Artificial Sequence
  Description of Artificial Sequence: Synthetic oligonucleotide
caaggccccctggggtatggtcg

SEQ ID NO: 319184 - DNA, 23 bp, Artificial Sequence
  Description of Artificial Sequence: Synthetic oligonucleotide
aaggccccctggggtatggtcgg

SEQ ID NO: 319185 - DNA, 22 bp, Artificial Sequence
  Description of Artificial Sequence: Synthetic oligonucleotide
aggccccctggggtatggtcgg

SEQ ID NO: 319186 - DNA, 21 bp, Artificial Sequence
  Description of Artificial Sequence: Synthetic oligonucleotide
ggccccctggggtatggtcgg

SEQ ID NO: 319187 - DNA, 21 bp, Artificial Sequence
  Description of Artificial Sequence: Synthetic oligonucleotide
gccccctggggtatggtcggc

SEQ ID NO: 319188 - DNA, 21 bp, Artificial Sequence
  Description of Artificial Sequence: Synthetic oligonucleotide
ccccctggggtatggtcggcg

SEQ ID NO: 319189 - DNA, 21 bp, Artificial Sequence
  Description of Artificial Sequence: Synthetic oligonucleotide
cccctggggtatggtcggcgc

SEQ ID NO: 319190 - DNA, 21 bp, Artificial Sequence
  Description of Artificial Sequence: Synthetic oligonucleotide
ccctggggtatggtcggcgcc

SEQ ID NO: 319191 - DNA, 22 bp, Artificial Sequence
  Description of Artificial Sequence: Synthetic oligonucleotide
cctggggtatggtcggcgccca

SEQ ID NO: 319192 - DNA, 22 bp, Artificial Sequence
  Description of Artificial Sequence: Synthetic oligonucleotide
ctggggtatggtcggcgcccac

SEQ ID NO: 319193 - DNA, 22 bp, Artificial Sequence
  Description of Artificial Sequence: Synthetic oligonucleotide
tggggtatggtcggcgcccacg

SEQ ID NO: 319194 - DNA, 21 bp, Artificial Sequence
  Description of Artificial Sequence: Synthetic oligonucleotide
ggggtatggtcggcgcccacg

SEQ ID NO: 319195 - DNA, 22 bp, Artificial Sequence
  Description of Artificial Sequence: Synthetic oligonucleotide
gggtatggtcggcgcccacgct

SEQ ID NO: 319196 - DNA, 22 bp, Artificial Sequence
  Description of Artificial Sequence: Synthetic oligonucleotide
ggtatggtcggcgcccacgctg

SEQ ID NO: 319197 - DNA, 22 bp, Artificial Sequence
  Description of Artificial Sequence: Synthetic oligonucleotide
gtatggtcggcgcccacgctgg

SEQ ID NO: 319198 - DNA, 22 bp, Artificial Sequence
  Description of Artificial Sequence: Synthetic oligonucleotide
tatggtcggcgcccacgctggc

SEQ ID NO: 319199 - DNA, 21 bp, Artificial Sequence
  Description of Artificial Sequence: Synthetic oligonucleotide
atggtcggcgcccacgctggc

SEQ ID NO: 319200 - DNA, 20 bp, Artificial Sequence
  Description of Artificial Sequence: Synthetic oligonucleotide
tggtcggcgcccacgctggc

SEQ ID NO: 319201 - DNA, 20 bp, Artificial Sequence
  Description of Artificial Sequence: Synthetic oligonucleotide
ggtcggcgcccacgctggct

SEQ ID NO: 319202 - DNA, 20 bp, Artificial Sequence
  Description of Artificial Sequence: Synthetic oligonucleotide
gtcggcgcccacgctggcca

SEQ ID NO: 319203 - DNA, 23 bp, Artificial Sequence
  Description of Artificial Sequence: Synthetic oligonucleotide
tcggcgcccacgctggccagtat

SEQ ID NO: 319204 - DNA, 22 bp, Artificial Sequence
  Description of Artificial Sequence: Synthetic oligonucleotide
cggcgcccacgctggccagtat

SEQ ID NO: 319205 - DNA, 22 bp, Artificial Sequence
  Description of Artificial Sequence: Synthetic oligonucleotide
ggcgcccacgctggccagtatg

SEQ ID NO: 319206 - DNA, 23 bp, Artificial Sequence
  Description of Artificial Sequence: Synthetic oligonucleotide
gcgcccacgctggccagtatggt

SEQ ID NO: 319207 - DNA, 23 bp, Artificial Sequence
  Description of Artificial Sequence: Synthetic oligonucleotide
cgcccacgctggccagtatggtg

SEQ ID NO: 319208 - DNA, 23 bp, Artificial Sequence
  Description of Artificial Sequence: Synthetic oligonucleotide
gcccacgctggccagtatggtgg

SEQ ID NO: 319209 - DNA, 23 bp, Artificial Sequence
  Description of Artificial Sequence: Synthetic oligonucleotide
cccacgctggccagtatggtggg

SEQ ID NO: 319210 - DNA, 24 bp, Artificial Sequence
  Description of Artificial Sequence: Synthetic oligonucleotide
ccacgctggccagtatggtgggga

SEQ ID NO: 319211 - DNA, 24 bp, Artificial Sequence
  Description of Artificial Sequence: Synthetic oligonucleotide
cacgctggccagtatggtggggag

SEQ ID NO: 319212 - DNA, 24 bp, Artificial Sequence
  Description of Artificial Sequence: Synthetic oligonucleotide
acgctggccagtatggtggggagg

SEQ ID NO: 319213 - DNA, 23 bp, Artificial Sequence
  Description of Artificial Sequence: Synthetic oligonucleotide
cgctggccagtatggtggggagg

SEQ ID NO: 319214 - DNA, 23 bp, Artificial Sequence
  Description of Artificial Sequence: Synthetic oligonucleotide
gctggccagtatggtggggaggc

SEQ ID NO: 319215 - DNA, 23 bp, Artificial Sequence
  Description of Artificial Sequence: Synthetic oligonucleotide
ctggccagtatggtggggaggcc

SEQ ID NO: 319216 - DNA, 24 bp, Artificial Sequence
  Description of Artificial Sequence: Synthetic oligonucleotide
tggccagtatggtggggaggccct

SEQ ID NO: 319217 - DNA, 23 bp, Artificial Sequence
  Description of Artificial Sequence: Synthetic oligonucleotide
ggccagtatggtggggaggccct

SEQ ID NO: 319218 - DNA, 23 bp, Artificial Sequence
  Description of Artificial Sequence: Synthetic oligonucleotide
gccagtatggtggggaggccctc

SEQ ID NO: 319219 - DNA, 24 bp, Artificial Sequence
  Description of Artificial Sequence: Synthetic oligonucleotide
ccagtatggtggggaggccctcga

SEQ ID NO: 319220 - DNA, 25 bp, Artificial Sequence
  Description of Artificial Sequence: Synthetic oligonucleotide
cagtatggtggggaggccctcgaga

SEQ ID NO: 319221 - DNA, 25 bp, Artificial Sequence
  Description of Artificial Sequence: Synthetic oligonucleotide
agtatggtggggaggccctcgagag

SEQ ID NO: 319222 - DNA, 24 bp, Artificial Sequence
  Description of Artificial Sequence: Synthetic oligonucleotide
gtatggtggggaggccctcgagag

SEQ ID NO: 319223 - DNA, 26 bp, Artificial Sequence
  Description of Artificial Sequence: Synthetic oligonucleotide
tatggtggggaggccctcgagaggat

SEQ ID NO: 319224 - DNA, 25 bp, Artificial Sequence
  Description of Artificial Sequence: Synthetic oligonucleotide
atggtggggaggccctcgagaggat

SEQ ID NO: 319225 - DNA, 24 bp, Artificial Sequence
  Description of Artificial Sequence: Synthetic oligonucleotide
tggtggggaggccctcgagaggat

SEQ ID NO: 319226 - DNA, 23 bp, Artificial Sequence
  Description of Artificial Sequence: Synthetic oligonucleotide
ggtggggaggccctcgagaggat

SEQ ID NO: 319227 - DNA, 25 bp, Artificial Sequence
  Description of Artificial Sequence: Synthetic oligonucleotide
gtggggaggccctcgagaggatgat

SEQ ID NO: 319228 - DNA, 25 bp, Artificial Sequence
  Description of Artificial Sequence: Synthetic oligonucleotide
tggggaggccctcgagaggatgatc

SEQ ID NO: 319229 - DNA, 24 bp, Artificial Sequence
  Description of Artificial Sequence: Synthetic oligonucleotide
ggggaggccctcgagaggatgatc

SEQ ID NO: 319230 - DNA, 25 bp, Artificial Sequence
  Description of Artificial Sequence: Synthetic oligonucleotide
gggaggccctcgagaggatgatcct

SEQ ID NO: 319231 - DNA, 26 bp, Artificial Sequence
  Description of Artificial Sequence: Synthetic oligonucleotide
ggaggccctcgagaggatgatcctgt

SEQ ID NO: 319232 - DNA, 26 bp, Artificial Sequence
  Description of Artificial Sequence: Synthetic oligonucleotide
gaggccctcgagaggatgatcctgtc

SEQ ID NO: 319233 - DNA, 27 bp, Artificial Sequence
  Description of Artificial Sequence: Synthetic oligonucleotide
aggccctcgagaggatgatcctgtcct

SEQ ID NO: 319234 - DNA, 27 bp, Artificial Sequence
  Description of Artificial Sequence: Synthetic oligonucleotide
ggccctcgagaggatgatcctgtccta

SEQ ID NO: 319235 - DNA, 27 bp, Artificial Sequence
  Description of Artificial Sequence: Synthetic oligonucleotide
gccctcgagaggatgatcctgtcctac

SEQ ID NO: 319236 - DNA, 27 bp, Artificial Sequence
  Description of Artificial Sequence: Synthetic oligonucleotide
ccctcgagaggatgatcctgtcctacc

SEQ ID NO: 319237 - DNA, 27 bp, Artificial Sequence
  Description of Artificial Sequence: Synthetic oligonucleotide
cctcgagaggatgatcctgtcctaccc

SEQ ID NO: 319238 - DNA, 27 bp, Artificial Sequence
  Description of Artificial Sequence: Synthetic oligonucleotide
ctcgagaggatgatcctgtcctacccc

SEQ ID NO: 319239 - DNA, 28 bp, Artificial Sequence
  Description of Artificial Sequence: Synthetic oligonucleotide
tcgagaggatgatcctgtcctaccccac

SEQ ID NO: 319240 - DNA, 27 bp, Artificial Sequence
  Description of Artificial Sequence: Synthetic oligonucleotide
cgagaggatgatcctgtcctaccccac

SEQ ID NO: 319241 - DNA, 27 bp, Artificial Sequence
  Description of Artificial Sequence: Synthetic oligonucleotide
gagaggatgatcctgtcctaccccacc

SEQ ID NO: 319242 - DNA, 28 bp, Artificial Sequence
  Description of Artificial Sequence: Synthetic oligonucleotide
agaggatgatcctgtcctaccccaccac

SEQ ID NO: 319243 - DNA, 27 bp, Artificial Sequence
  Description of Artificial Sequence: Synthetic oligonucleotide
gaggatgatcctgtcctaccccaccac

SEQ ID NO: 319244 - DNA, 27 bp, Artificial Sequence
  Description of Artificial Sequence: Synthetic oligonucleotide
aggatgatcctgtcctaccccaccacg

SEQ ID NO: 319245 - DNA, 27 bp, Artificial Sequence
  Description of Artificial Sequence: Synthetic oligonucleotide
ggatgatcctgtcctaccccaccacga

SEQ ID NO: 319246 - DNA, 28 bp, Artificial Sequence
  Description of Artificial Sequence: Synthetic oligonucleotide
gatgatcctgtcctaccccaccacgaag

SEQ ID NO: 319247 - DNA, 29 bp, Artificial Sequence
  Description of Artificial Sequence: Synthetic oligonucleotide
atgatcctgtcctaccccaccacgaagac

SEQ ID NO: 319248 - DNA, 28 bp, Artificial Sequence
  Description of Artificial Sequence: Synthetic oligonucleotide
tgatcctgtcctaccccaccacgaagac

SEQ ID NO: 319249 - DNA, 27 bp, Artificial Sequence
  Description of Artificial Sequence: Synthetic oligonucleotide
gatcctgtcctaccccaccacgaagac

SEQ ID NO: 319250 - DNA, 27 bp, Artificial Sequence
  Description of Artificial Sequence: Synthetic oligonucleotide
atcctgtcctaccccaccacgaagacc

SEQ ID NO: 319251 - DNA, 27 bp, Artificial Sequence
  Description of Artificial Sequence: Synthetic oligonucleotide
tcctgtcctaccccaccacgaagacct

SEQ ID NO: 319252 - DNA, 27 bp, Artificial Sequence
  Description of Artificial Sequence: Synthetic oligonucleotide
cctgtcctaccccaccacgaagaccta

SEQ ID NO: 319253 - DNA, 27 bp, Artificial Sequence
  Description of Artificial Sequence: Synthetic oligonucleotide
ctgtcctaccccaccacgaagacctac

SEQ ID NO: 319254 - DNA, 29 bp, Artificial Sequence
  Description of Artificial Sequence: Synthetic oligonucleotide
tgtcctaccccaccacgaagacctacatc

SEQ ID NO: 319255 - DNA, 28 bp, Artificial Sequence
  Description of Artificial Sequence: Synthetic oligonucleotide
gtcctaccccaccacgaagacctacatc

SEQ ID NO: 319256 - DNA, 28 bp, Artificial Sequence
  Description of Artificial Sequence: Synthetic oligonucleotide
tcctaccccaccacgaagacctacatcc

SEQ ID NO: 319257 - DNA, 27 bp, Artificial Sequence
  Description of Artificial Sequence: Synthetic oligonucleotide
cctaccccaccacgaagacctacatcc

SEQ ID NO: 319258 - DNA, 27 bp, Artificial Sequence
  Description of Artificial Sequence: Synthetic oligonucleotide
ctaccccaccacgaagacctacatccc

SEQ ID NO: 319259 - DNA, 27 bp, Artificial Sequence
  Description of Artificial Sequence: Synthetic oligonucleotide
taccccaccacgaagacctacatcccg

SEQ ID NO: 319260 - DNA, 26 bp, Artificial Sequence
  Description of Artificial Sequence: Synthetic oligonucleotide
accccaccacgaagacctacatcccg

SEQ ID NO: 319261 - DNA, 25 bp, Artificial Sequence
  Description of Artificial Sequence: Synthetic oligonucleotide
ccccaccacgaagacctacatcccg

SEQ ID NO: 319262 - DNA, 26 bp, Artificial Sequence
  Description of Artificial Sequence: Synthetic oligonucleotide
cccaccacgaagacctacatcccgca

SEQ ID NO: 319263 - DNA, 27 bp, Artificial Sequence
  Description of Artificial Sequence: Synthetic oligonucleotide
ccaccacgaagacctacatcccgcact

SEQ ID NO: 319264 - DNA, 28 bp, Artificial Sequence
  Description of Artificial Sequence: Synthetic oligonucleotide
caccacgaagacctacatcccgcactac

SEQ ID NO: 319265 - DNA, 28 bp, Artificial Sequence
  Description of Artificial Sequence: Synthetic oligonucleotide
accacgaagacctacatcccgcactacg

SEQ ID NO: 319266 - DNA, 27 bp, Artificial Sequence
  Description of Artificial Sequence: Synthetic oligonucleotide
ccacgaagacctacatcccgcactacg

SEQ ID NO: 319267 - DNA, 28 bp, Artificial Sequence
  Description of Artificial Sequence: Synthetic oligonucleotide
cacgaagacctacatcccgcactacgac

SEQ ID NO: 319268 - DNA, 28 bp, Artificial Sequence
  Description of Artificial Sequence: Synthetic oligonucleotide
acgaagacctacatcccgcactacgacc

SEQ ID NO: 319269 - DNA, 27 bp, Artificial Sequence
  Description of Artificial Sequence: Synthetic oligonucleotide
cgaagacctacatcccgcactacgacc

SEQ ID NO: 319270 - DNA, 28 bp, Artificial Sequence
  Description of Artificial Sequence: Synthetic oligonucleotide
gaagacctacatcccgcactacgacctg

SEQ ID NO: 319271 - DNA, 29 bp, Artificial Sequence
  Description of Artificial Sequence: Synthetic oligonucleotide
aagacctacatcccgcactacgacctgag

SEQ ID NO: 319272 - DNA, 28 bp, Artificial Sequence
  Description of Artificial Sequence: Synthetic oligonucleotide
agacctacatcccgcactacgacctgag

SEQ ID NO: 319273 - DNA, 27 bp, Artificial Sequence
  Description of Artificial Sequence: Synthetic oligonucleotide
gacctacatcccgcactacgacctgag

SEQ ID NO: 319274 - DNA, 27 bp, Artificial Sequence
  Description of Artificial Sequence: Synthetic oligonucleotide
acctacatcccgcactacgacctgagg

SEQ ID NO: 319275 - DNA, 26 bp, Artificial Sequence
  Description of Artificial Sequence: Synthetic oligonucleotide
cctacatcccgcactacgacctgagg

SEQ ID NO: 319276 - DNA, 27 bp, Artificial Sequence
  Description of Artificial Sequence: Synthetic oligonucleotide
ctacatcccgcactacgacctgaggca

SEQ ID NO: 319277 - DNA, 27 bp, Artificial Sequence
  Description of Artificial Sequence: Synthetic oligonucleotide
tacatcccgcactacgacctgaggcac

SEQ ID NO: 319278 - DNA, 26 bp, Artificial Sequence
  Description of Artificial Sequence: Synthetic oligonucleotide
acatcccgcactacgacctgaggcac

SEQ ID NO: 319279 - DNA, 25 bp, Artificial Sequence
  Description of Artificial Sequence: Synthetic oligonucleotide
catcccgcactacgacctgaggcac

SEQ ID NO: 319280 - DNA, 25 bp, Artificial Sequence
  Description of Artificial Sequence: Synthetic oligonucleotide
atcccgcactacgacctgaggcacg

SEQ ID NO: 319281 - DNA, 24 bp, Artificial Sequence
  Description of Artificial Sequence: Synthetic oligonucleotide
tcccgcactacgacctgaggcacg

SEQ ID NO: 319282 - DNA, 23 bp, Artificial Sequence
  Description of Artificial Sequence: Synthetic oligonucleotide
cccgcactacgacctgaggcacg

SEQ ID NO: 319283 - DNA, 23 bp, Artificial Sequence
  Description of Artificial Sequence: Synthetic oligonucleotide
ccgcactacgacctgaggcacgg

SEQ ID NO: 319284 - DNA, 24 bp, Artificial Sequence
  Description of Artificial Sequence: Synthetic oligonucleotide
cgcactacgacctgaggcacggct

SEQ ID NO: 319285 - DNA, 25 bp, Artificial Sequence
  Description of Artificial Sequence: Synthetic oligonucleotide
gcactacgacctgaggcacggctct

SEQ ID NO: 319286 - DNA, 25 bp, Artificial Sequence
  Description of Artificial Sequence: Synthetic oligonucleotide
cactacgacctgaggcacggctctc

SEQ ID NO: 319287 - DNA, 25 bp, Artificial Sequence
  Description of Artificial Sequence: Synthetic oligonucleotide
actacgacctgaggcacggctctcc

SEQ ID NO: 319288 - DNA, 24 bp, Artificial Sequence
  Description of Artificial Sequence: Synthetic oligonucleotide
ctacgacctgaggcacggctctcc

SEQ ID NO: 319289 - DNA, 24 bp, Artificial Sequence
  Description of Artificial Sequence: Synthetic oligonucleotide
tacgacctgaggcacggctctccc

SEQ ID NO: 319290 - DNA, 23 bp, Artificial Sequence
  Description of Artificial Sequence: Synthetic oligonucleotide
acgacctgaggcacggctctccc

SEQ ID NO: 319291 - DNA, 22 bp, Artificial Sequence
  Description of Artificial Sequence: Synthetic oligonucleotide
cgacctgaggcacggctctccc

SEQ ID NO: 319292 - DNA, 23 bp, Artificial Sequence
  Description of Artificial Sequence: Synthetic oligonucleotide
gacctgaggcacggctctcccca

SEQ ID NO: 319293 - DNA, 23 bp, Artificial Sequence
  Description of Artificial Sequence: Synthetic oligonucleotide
acctgaggcacggctctccccag

SEQ ID NO: 319294 - DNA, 22 bp, Artificial Sequence
  Description of Artificial Sequence: Synthetic oligonucleotide
cctgaggcacggctctccccag

SEQ ID NO: 319295 - DNA, 26 bp, Artificial Sequence
  Description of Artificial Sequence: Synthetic oligonucleotide
ctgaggcacggctctccccaggttat

SEQ ID NO: 319296 - DNA, 26 bp, Artificial Sequence
  Description of Artificial Sequence: Synthetic oligonucleotide
tgaggcacggctctccccaggttatg

SEQ ID NO: 319297 - DNA, 25 bp, Artificial Sequence
  Description of Artificial Sequence: Synthetic oligonucleotide
gaggcacggctctccccaggttatg

SEQ ID NO: 319298 - DNA, 25 bp, Artificial Sequence
  Description of Artificial Sequence: Synthetic oligonucleotide
aggcacggctctccccaggttatgg

SEQ ID NO: 319299 - DNA, 24 bp, Artificial Sequence
  Description of Artificial Sequence: Synthetic oligonucleotide
ggcacggctctccccaggttatgg

SEQ ID NO: 319300 - DNA, 24 bp, Artificial Sequence
  Description of Artificial Sequence: Synthetic oligonucleotide
gcacggctctccccaggttatggg

SEQ ID NO: 319301 - DNA, 24 bp, Artificial Sequence
  Description of Artificial Sequence: Synthetic oligonucleotide
cacggctctccccaggttatgggc

SEQ ID NO: 319302 - DNA, 25 bp, Artificial Sequence
  Description of Artificial Sequence: Synthetic oligonucleotide
acggctctccccaggttatgggcca

SEQ ID NO: 319303 - DNA, 24 bp, Artificial Sequence
  Description of Artificial Sequence: Synthetic oligonucleotide
cggctctccccaggttatgggcca

SEQ ID NO: 319304 - DNA, 24 bp, Artificial Sequence
  Description of Artificial Sequence: Synthetic oligonucleotide
ggctctccccaggttatgggccac

SEQ ID NO: 319305 - DNA, 24 bp, Artificial Sequence
  Description of Artificial Sequence: Synthetic oligonucleotide
gctctccccaggttatgggccacg

SEQ ID NO: 319306 - DNA, 24 bp, Artificial Sequence
  Description of Artificial Sequence: Synthetic oligonucleotide
ctctccccaggttatgggccacgg

SEQ ID NO: 319307 - DNA, 26 bp, Artificial Sequence
  Description of Artificial Sequence: Synthetic oligonucleotide
tctccccaggttatgggccacgggaa

SEQ ID NO: 319308 - DNA, 25 bp, Artificial Sequence
  Description of Artificial Sequence: Synthetic oligonucleotide
ctccccaggttatgggccacgggaa

SEQ ID NO: 319309 - DNA, 27 bp, Artificial Sequence
  Description of Artificial Sequence: Synthetic oligonucleotide
tccccaggttatgggccacgggaagaa

SEQ ID NO: 319310 - DNA, 26 bp, Artificial Sequence
  Description of Artificial Sequence: Synthetic oligonucleotide
ccccaggttatgggccacgggaagaa

SEQ ID NO: 319311 - DNA, 26 bp, Artificial Sequence
  Description of Artificial Sequence: Synthetic oligonucleotide
cccaggttatgggccacgggaagaag

SEQ ID NO: 319312 - DNA, 27 bp, Artificial Sequence
  Description of Artificial Sequence: Synthetic oligonucleotide
ccaggttatgggccacgggaagaaggt

SEQ ID NO: 319313 - DNA, 27 bp, Artificial Sequence
  Description of Artificial Sequence: Synthetic oligonucleotide
caggttatgggccacgggaagaaggtg

SEQ ID NO: 319314 - DNA, 27 bp, Artificial Sequence
  Description of Artificial Sequence: Synthetic oligonucleotide
aggttatgggccacgggaagaaggtgc

SEQ ID NO: 319315 - DNA, 26 bp, Artificial Sequence
  Description of Artificial Sequence: Synthetic oligonucleotide
ggttatgggccacgggaagaaggtgc

SEQ ID NO: 319316 - DNA, 26 bp, Artificial Sequence
  Description of Artificial Sequence: Synthetic oligonucleotide
gttatgggccacgggaagaaggtgcc

SEQ ID NO: 319317 - DNA, 26 bp, Artificial Sequence
  Description of Artificial Sequence: Synthetic oligonucleotide
ttatgggccacgggaagaaggtgccc

SEQ ID NO: 319318 - DNA, 25 bp, Artificial Sequence
  Description of Artificial Sequence: Synthetic oligonucleotide
tatgggccacgggaagaaggtgccc

SEQ ID NO: 319319 - DNA, 24 bp, Artificial Sequence
  Description of Artificial Sequence: Synthetic oligonucleotide
atgggccacgggaagaaggtgccc

SEQ ID NO: 319320 - DNA, 23 bp, Artificial Sequence
  Description of Artificial Sequence: Synthetic oligonucleotide
tgggccacgggaagaaggtgccc

SEQ ID NO: 319321 - DNA, 22 bp, Artificial Sequence
  Description of Artificial Sequence: Synthetic oligonucleotide
gggccacgggaagaaggtgccc

SEQ ID NO: 319322 - DNA, 23 bp, Artificial Sequence
  Description of Artificial Sequence: Synthetic oligonucleotide
ggccacgggaagaaggtgcccga

SEQ ID NO: 319323 - DNA, 23 bp, Artificial Sequence
  Description of Artificial Sequence: Synthetic oligonucleotide
gccacgggaagaaggtgcccgac

SEQ ID NO: 319324 - DNA, 23 bp, Artificial Sequence
  Description of Artificial Sequence: Synthetic oligonucleotide
ccacgggaagaaggtgcccgacg

SEQ ID NO: 319325 - DNA, 23 bp, Artificial Sequence
  Description of Artificial Sequence: Synthetic oligonucleotide
cacgggaagaaggtgcccgacgc

SEQ ID NO: 319326 - DNA, 23 bp, Artificial Sequence
  Description of Artificial Sequence: Synthetic oligonucleotide
acgggaagaaggtgcccgacgcg

SEQ ID NO: 319327 - DNA, 22 bp, Artificial Sequence
  Description of Artificial Sequence: Synthetic oligonucleotide
cgggaagaaggtgcccgacgcg

SEQ ID NO: 319328 - DNA, 23 bp, Artificial Sequence
  Description of Artificial Sequence: Synthetic oligonucleotide
gggaagaaggtgcccgacgcgca

SEQ ID NO: 319329 - DNA, 24 bp, Artificial Sequence
  Description of Artificial Sequence: Synthetic oligonucleotide
ggaagaaggtgcccgacgcgcaga

SEQ ID NO: 319330 - DNA, 24 bp, Artificial Sequence
  Description of Artificial Sequence: Synthetic oligonucleotide
gaagaaggtgcccgacgcgcagac

SEQ ID NO: 319331 - DNA, 26 bp, Artificial Sequence
  Description of Artificial Sequence: Synthetic oligonucleotide
aagaaggtgcccgacgcgcagaccaa

SEQ ID NO: 319332 - DNA, 25 bp, Artificial Sequence
  Description of Artificial Sequence: Synthetic oligonucleotide
agaaggtgcccgacgcgcagaccaa

SEQ ID NO: 319333 - DNA, 24 bp, Artificial Sequence
  Description of Artificial Sequence: Synthetic oligonucleotide
gaaggtgcccgacgcgcagaccaa

SEQ ID NO: 319334 - DNA, 24 bp, Artificial Sequence
  Description of Artificial Sequence: Synthetic oligonucleotide
aaggtgcccgacgcgcagaccaac

SEQ ID NO: 319335 - DNA, 23 bp, Artificial Sequence
  Description of Artificial Sequence: Synthetic oligonucleotide
aggtgcccgacgcgcagaccaac

SEQ ID NO: 319336 - DNA, 22 bp, Artificial Sequence
  Description of Artificial Sequence: Synthetic oligonucleotide
ggtgcccgacgcgcagaccaac

SEQ ID NO: 319337 - DNA, 22 bp, Artificial Sequence
  Description of Artificial Sequence: Synthetic oligonucleotide
gtgcccgacgcgcagaccaacg

SEQ ID NO: 319338 - DNA, 22 bp, Artificial Sequence
  Description of Artificial Sequence: Synthetic oligonucleotide
tgcccgacgcgcagaccaacgc

SEQ ID NO: 319339 - DNA, 21 bp, Artificial Sequence
  Description of Artificial Sequence: Synthetic oligonucleotide
gcccgacgcgcagaccaacgc

SEQ ID NO: 319340 - DNA, 21 bp, Artificial Sequence
  Description of Artificial Sequence: Synthetic oligonucleotide
cccgacgcgcagaccaacgcg

SEQ ID NO: 319341 - DNA, 22 bp, Artificial Sequence
  Description of Artificial Sequence: Synthetic oligonucleotide
ccgacgcgcagaccaacgcggt

SEQ ID NO: 319342 - DNA, 22 bp, Artificial Sequence
  Description of Artificial Sequence: Synthetic oligonucleotide
cgacgcgcagaccaacgcggtg

SEQ ID NO: 319343 - DNA, 22 bp, Artificial Sequence
  Description of Artificial Sequence: Synthetic oligonucleotide
gacgcgcagaccaacgcggtgg

SEQ ID NO: 319344 - DNA, 22 bp, Artificial Sequence
  Description of Artificial Sequence: Synthetic oligonucleotide
acgcgcagaccaacgcggtggc

SEQ ID NO: 319345 - DNA, 21 bp, Artificial Sequence
  Description of Artificial Sequence: Synthetic oligonucleotide
cgcgcagaccaacgcggtggc

SEQ ID NO: 319346 - DNA, 21 bp, Artificial Sequence
  Description of Artificial Sequence: Synthetic oligonucleotide
gcgcagaccaacgcggtggcg

SEQ ID NO: 319347 - DNA, 22 bp, Artificial Sequence
  Description of Artificial Sequence: Synthetic oligonucleotide
cgcagaccaacgcggtggcgca

SEQ ID NO: 319348 - DNA, 22 bp, Artificial Sequence
  Description of Artificial Sequence: Synthetic oligonucleotide
gcagaccaacgcggtggcgcac

SEQ ID NO: 319349 - DNA, 23 bp, Artificial Sequence
  Description of Artificial Sequence: Synthetic oligonucleotide
cagaccaacgcggtggcgcacct

SEQ ID NO: 319350 - DNA, 23 bp, Artificial Sequence
  Description of Artificial Sequence: Synthetic oligonucleotide
agaccaacgcggtggcgcacctg

SEQ ID NO: 319351 - DNA, 22 bp, Artificial Sequence
  Description of Artificial Sequence: Synthetic oligonucleotide
gaccaacgcggtggcgcacctg

SEQ ID NO: 319352 - DNA, 23 bp, Artificial Sequence
  Description of Artificial Sequence: Synthetic oligonucleotide
accaacgcggtggcgcacctgga

SEQ ID NO: 319353 - DNA, 22 bp, Artificial Sequence
  Description of Artificial Sequence: Synthetic oligonucleotide
ccaacgcggtggcgcacctgga

SEQ ID NO: 319354 - DNA, 22 bp, Artificial Sequence
  Description of Artificial Sequence: Synthetic oligonucleotide
caacgcggtggcgcacctggac

SEQ ID NO: 319355 - DNA, 23 bp, Artificial Sequence
  Description of Artificial Sequence: Synthetic oligonucleotide
aacgcggtggcgcacctggacga

SEQ ID NO: 319356 - DNA, 22 bp, Artificial Sequence
  Description of Artificial Sequence: Synthetic oligonucleotide
acgcggtggcgcacctggacga

SEQ ID NO: 319357 - DNA, 21 bp, Artificial Sequence
  Description of Artificial Sequence: Synthetic oligonucleotide
cgcggtggcgcacctggacga

SEQ ID NO: 319358 - DNA, 23 bp, Artificial Sequence
  Description of Artificial Sequence: Synthetic oligonucleotide
gcggtggcgcacctggacgacaa

SEQ ID NO: 319359 - DNA, 23 bp, Artificial Sequence
  Description of Artificial Sequence: Synthetic oligonucleotide
cggtggcgcacctggacgacaag

SEQ ID NO: 319360 - DNA, 23 bp, Artificial Sequence
  Description of Artificial Sequence: Synthetic oligonucleotide
ggtggcgcacctggacgacaagc

SEQ ID NO: 319361 - DNA, 23 bp, Artificial Sequence
  Description of Artificial Sequence: Synthetic oligonucleotide
gtggcgcacctggacgacaagcc

SEQ ID NO: 319362 - DNA, 25 bp, Artificial Sequence
  Description of Artificial Sequence: Synthetic oligonucleotide
tggcgcacctggacgacaagcccaa

SEQ ID NO: 319363 - DNA, 24 bp, Artificial Sequence
  Description of Artificial Sequence: Synthetic oligonucleotide
ggcgcacctggacgacaagcccaa

SEQ ID NO: 319364 - DNA, 24 bp, Artificial Sequence
  Description of Artificial Sequence: Synthetic oligonucleotide
gcgcacctggacgacaagcccaac

SEQ ID NO: 319365 - DNA, 24 bp, Artificial Sequence
  Description of Artificial Sequence: Synthetic oligonucleotide
cgcacctggacgacaagcccaacg

SEQ ID NO: 319366 - DNA, 24 bp, Artificial Sequence
  Description of Artificial Sequence: Synthetic oligonucleotide
gcacctggacgacaagcccaacgc

SEQ ID NO: 319367 - DNA, 24 bp, Artificial Sequence
  Description of Artificial Sequence: Synthetic oligonucleotide
cacctggacgacaagcccaacgcc

SEQ ID NO: 319368 - DNA, 25 bp, Artificial Sequence
  Description of Artificial Sequence: Synthetic oligonucleotide
acctggacgacaagcccaacgccct

SEQ ID NO: 319369 - DNA, 24 bp, Artificial Sequence
  Description of Artificial Sequence: Synthetic oligonucleotide
cctggacgacaagcccaacgccct

SEQ ID NO: 319370 - DNA, 25 bp, Artificial Sequence
  Description of Artificial Sequence: Synthetic oligonucleotide
ctggacgacaagcccaacgccctgt

SEQ ID NO: 319371 - DNA, 25 bp, Artificial Sequence
  Description of Artificial Sequence: Synthetic oligonucleotide
tggacgacaagcccaacgccctgtc

SEQ ID NO: 319372 - DNA, 24 bp, Artificial Sequence
  Description of Artificial Sequence: Synthetic oligonucleotide
ggacgacaagcccaacgccctgtc

SEQ ID NO: 319373 - DNA, 24 bp, Artificial Sequence
  Description of Artificial Sequence: Synthetic oligonucleotide
gacgacaagcccaacgccctgtcc

SEQ ID NO: 319374 - DNA, 24 bp, Artificial Sequence
  Description of Artificial Sequence: Synthetic oligonucleotide
acgacaagcccaacgccctgtccg

SEQ ID NO: 319375 - DNA, 23 bp, Artificial Sequence
  Description of Artificial Sequence: Synthetic oligonucleotide
cgacaagcccaacgccctgtccg

SEQ ID NO: 319376 - DNA, 23 bp, Artificial Sequence
  Description of Artificial Sequence: Synthetic oligonucleotide
gacaagcccaacgccctgtccgc

SEQ ID NO: 319377 - DNA, 23 bp, Artificial Sequence
  Description of Artificial Sequence: Synthetic oligonucleotide
acaagcccaacgccctgtccgcc

SEQ ID NO: 319378 - DNA, 22 bp, Artificial Sequence
  Description of Artificial Sequence: Synthetic oligonucleotide
caagcccaacgccctgtccgcc

SEQ ID NO: 319379 - DNA, 23 bp, Artificial Sequence
  Description of Artificial Sequence: Synthetic oligonucleotide
aagcccaacgccctgtccgccgt

SEQ ID NO: 319380 - DNA, 22 bp, Artificial Sequence
  Description of Artificial Sequence: Synthetic oligonucleotide
agcccaacgccctgtccgccgt

SEQ ID NO: 319381 - DNA, 21 bp, Artificial Sequence
  Description of Artificial Sequence: Synthetic oligonucleotide
gcccaacgccctgtccgccgt

SEQ ID NO: 319382 - DNA, 22 bp, Artificial Sequence
  Description of Artificial Sequence: Synthetic oligonucleotide
cccaacgccctgtccgccgtga

SEQ ID NO: 319383 - DNA, 22 bp, Artificial Sequence
  Description of Artificial Sequence: Synthetic oligonucleotide
ccaacgccctgtccgccgtgag

SEQ ID NO: 319384 - DNA, 22 bp, Artificial Sequence
  Description of Artificial Sequence: Synthetic oligonucleotide
caacgccctgtccgccgtgagc

SEQ ID NO: 319385 - DNA, 23 bp, Artificial Sequence
  Description of Artificial Sequence: Synthetic oligonucleotide
aacgccctgtccgccgtgagcga

SEQ ID NO: 319386 - DNA, 22 bp, Artificial Sequence
  Description of Artificial Sequence: Synthetic oligonucleotide
acgccctgtccgccgtgagcga

SEQ ID NO: 319387 - DNA, 21 bp, Artificial Sequence
  Description of Artificial Sequence: Synthetic oligonucleotide
cgccctgtccgccgtgagcga

SEQ ID NO: 319388 - DNA, 21 bp, Artificial Sequence
  Description of Artificial Sequence: Synthetic oligonucleotide
gccctgtccgccgtgagcgac

SEQ ID NO: 319389 - DNA, 22 bp, Artificial Sequence
  Description of Artificial Sequence: Synthetic oligonucleotide
ccctgtccgccgtgagcgacca

SEQ ID NO: 319390 - DNA, 22 bp, Artificial Sequence
  Description of Artificial Sequence: Synthetic oligonucleotide
cctgtccgccgtgagcgaccag

SEQ ID NO: 319391 - DNA, 23 bp, Artificial Sequence
  Description of Artificial Sequence: Synthetic oligonucleotide
ctgtccgccgtgagcgaccagca

SEQ ID NO: 319392 - DNA, 23 bp, Artificial Sequence
  Description of Artificial Sequence: Synthetic oligonucleotide
tgtccgccgtgagcgaccagcac

SEQ ID NO: 319393 - DNA, 22 bp, Artificial Sequence
  Description of Artificial Sequence: Synthetic oligonucleotide
gtccgccgtgagcgaccagcac

SEQ ID NO: 319394 - DNA, 22 bp, Artificial Sequence
  Description of Artificial Sequence: Synthetic oligonucleotide
tccgccgtgagcgaccagcacg

SEQ ID NO: 319395 - DNA, 21 bp, Artificial Sequence
  Description of Artificial Sequence: Synthetic oligonucleotide
ccgccgtgagcgaccagcacg

SEQ ID NO: 319396 - DNA, 21 bp, Artificial Sequence
  Description of Artificial Sequence: Synthetic oligonucleotide
cgccgtgagcgaccagcacgc

SEQ ID NO: 319397 - DNA, 21 bp, Artificial Sequence
  Description of Artificial Sequence: Synthetic oligonucleotide
gccgtgagcgaccagcacgcg

SEQ ID NO: 319398 - DNA, 22 bp, Artificial Sequence
  Description of Artificial Sequence: Synthetic oligonucleotide
ccgtgagcgaccagcacgcgca

SEQ ID NO: 319399 - DNA, 24 bp, Artificial Sequence
  Description of Artificial Sequence: Synthetic oligonucleotide
cgtgagcgaccagcacgcgcagaa

SEQ ID NO: 319400 - DNA, 24 bp, Artificial Sequence
  Description of Artificial Sequence: Synthetic oligonucleotide
gtgagcgaccagcacgcgcagaag

SEQ ID NO: 319401 - DNA, 26 bp, Artificial Sequence
  Description of Artificial Sequence: Synthetic oligonucleotide
tgagcgaccagcacgcgcagaagctt

SEQ ID NO: 319402 - DNA, 25 bp, Artificial Sequence
  Description of Artificial Sequence: Synthetic oligonucleotide
gagcgaccagcacgcgcagaagctt

SEQ ID NO: 319403 - DNA, 25 bp, Artificial Sequence
  Description of Artificial Sequence: Synthetic oligonucleotide
agcgaccagcacgcgcagaagcttc

SEQ ID NO: 319404 - DNA, 24 bp, Artificial Sequence
  Description of Artificial Sequence: Synthetic oligonucleotide
gcgaccagcacgcgcagaagcttc

SEQ ID NO: 319405 - DNA, 24 bp, Artificial Sequence
  Description of Artificial Sequence: Synthetic oligonucleotide
cgaccagcacgcgcagaagcttcg

SEQ ID NO: 319406 - DNA, 24 bp, Artificial Sequence
  Description of Artificial Sequence: Synthetic oligonucleotide
gaccagcacgcgcagaagcttcgg

SEQ ID NO: 319407 - DNA, 25 bp, Artificial Sequence
  Description of Artificial Sequence: Synthetic oligonucleotide
accagcacgcgcagaagcttcggct

SEQ ID NO: 319408 - DNA, 24 bp, Artificial Sequence
  Description of Artificial Sequence: Synthetic oligonucleotide
ccagcacgcgcagaagcttcggct

SEQ ID NO: 319409 - DNA, 24 bp, Artificial Sequence
  Description of Artificial Sequence: Synthetic oligonucleotide
cagcacgcgcagaagcttcggctg

SEQ ID NO: 319410 - DNA, 25 bp, Artificial Sequence
  Description of Artificial Sequence: Synthetic oligonucleotide
agcacgcgcagaagcttcggctgga

SEQ ID NO: 319411 - DNA, 24 bp, Artificial Sequence
  Description of Artificial Sequence: Synthetic oligonucleotide
gcacgcgcagaagcttcggctgga

SEQ ID NO: 319412 - DNA, 24 bp, Artificial Sequence
  Description of Artificial Sequence: Synthetic oligonucleotide
cacgcgcagaagcttcggctggac

SEQ ID NO: 319413 - DNA, 24 bp, Artificial Sequence
  Description of Artificial Sequence: Synthetic oligonucleotide
acgcgcagaagcttcggctggacc

SEQ ID NO: 319414 - DNA, 23 bp, Artificial Sequence
  Description of Artificial Sequence: Synthetic oligonucleotide
cgcgcagaagcttcggctggacc

SEQ ID NO: 319415 - DNA, 23 bp, Artificial Sequence
  Description of Artificial Sequence: Synthetic oligonucleotide
gcgcagaagcttcggctggaccc

SEQ ID NO: 319416 - DNA, 23 bp, Artificial Sequence
  Description of Artificial Sequence: Synthetic oligonucleotide
cgcagaagcttcggctggacccg

SEQ ID NO: 319417 - DNA, 24 bp, Artificial Sequence
  Description of Artificial Sequence: Synthetic oligonucleotide
gcagaagcttcggctggacccgga

SEQ ID NO: 319418 - DNA, 26 bp, Artificial Sequence
  Description of Artificial Sequence: Synthetic oligonucleotide
cagaagcttcggctggacccggacaa

SEQ ID NO: 319419 - DNA, 27 bp, Artificial Sequence
  Description of Artificial Sequence: Synthetic oligonucleotide
agaagcttcggctggacccggacaact

SEQ ID NO: 319420 - DNA, 27 bp, Artificial Sequence
  Description of Artificial Sequence: Synthetic oligonucleotide
gaagcttcggctggacccggacaactt

SEQ ID NO: 319421 - DNA, 27 bp, Artificial Sequence
  Description of Artificial Sequence: Synthetic oligonucleotide
aagcttcggctggacccggacaacttc

SEQ ID NO: 319422 - DNA, 27 bp, Artificial Sequence
  Description of Artificial Sequence: Synthetic oligonucleotide
agcttcggctggacccggacaacttca

SEQ ID NO: 319423 - DNA, 27 bp, Artificial Sequence
  Description of Artificial Sequence: Synthetic oligonucleotide
gcttcggctggacccggacaacttcaa

SEQ ID NO: 319424 - DNA, 27 bp, Artificial Sequence
  Description of Artificial Sequence: Synthetic oligonucleotide
cttcggctggacccggacaacttcaac

SEQ ID NO: 319425 - DNA, 27 bp, Artificial Sequence
  Description of Artificial Sequence: Synthetic oligonucleotide
ttcggctggacccggacaacttcaacc

SEQ ID NO: 319426 - DNA, 27 bp, Artificial Sequence
  Description of Artificial Sequence: Synthetic oligonucleotide
tcggctggacccggacaacttcaacct

SEQ ID NO: 319427 - DNA, 26 bp, Artificial Sequence
  Description of Artificial Sequence: Synthetic oligonucleotide
cggctggacccggacaacttcaacct

SEQ ID NO: 319428 - DNA, 26 bp, Artificial Sequence
  Description of Artificial Sequence: Synthetic oligonucleotide
ggctggacccggacaacttcaacctc

SEQ ID NO: 319429 - DNA, 27 bp, Artificial Sequence
  Description of Artificial Sequence: Synthetic oligonucleotide
gctggacccggacaacttcaacctcct

SEQ ID NO: 319430 - DNA, 29 bp, Artificial Sequence
  Description of Artificial Sequence: Synthetic oligonucleotide
ctggacccggacaacttcaacctcctaag

SEQ ID NO: 319431 - DNA, 29 bp, Artificial Sequence
  Description of Artificial Sequence: Synthetic oligonucleotide
tggacccggacaacttcaacctcctaagc

SEQ ID NO: 319432 - DNA, 28 bp, Artificial Sequence
  Description of Artificial Sequence: Synthetic oligonucleotide
ggacccggacaacttcaacctcctaagc

SEQ ID NO: 319433 - DNA, 28 bp, Artificial Sequence
  Description of Artificial Sequence: Synthetic oligonucleotide
gacccggacaacttcaacctcctaagcg

SEQ ID NO: 319434 - DNA, 29 bp, Artificial Sequence
  Description of Artificial Sequence: Synthetic oligonucleotide
acccggacaacttcaacctcctaagcgac

SEQ ID NO: 319435 - DNA, 28 bp, Artificial Sequence
  Description of Artificial Sequence: Synthetic oligonucleotide
cccggacaacttcaacctcctaagcgac

SEQ ID NO: 319436 - DNA, 29 bp, Artificial Sequence
  Description of Artificial Sequence: Synthetic oligonucleotide
ccggacaacttcaacctcctaagcgactg

SEQ ID NO: 319437 - DNA, 29 bp, Artificial Sequence
  Description of Artificial Sequence: Synthetic oligonucleotide
cggacaacttcaacctcctaagcgactgc

SEQ ID NO: 319438 - DNA, 29 bp, Artificial Sequence
  Description of Artificial Sequence: Synthetic oligonucleotide
ggacaacttcaacctcctaagcgactgcc

SEQ ID NO: 319439 - DNA, 30 bp, Artificial Sequence
  Description of Artificial Sequence: Synthetic oligonucleotide
gacaacttcaacctcctaagcgactgcctg

SEQ ID NO: 319440 - DNA, 30 bp, Artificial Sequence
  Description of Artificial Sequence: Synthetic oligonucleotide
acaacttcaacctcctaagcgactgcctgc

SEQ ID NO: 319441 - DNA, 29 bp, Artificial Sequence
  Description of Artificial Sequence: Synthetic oligonucleotide
caacttcaacctcctaagcgactgcctgc

SEQ ID NO: 319442 - DNA, 30 bp, Artificial Sequence
  Description of Artificial Sequence: Synthetic oligonucleotide
aacttcaacctcctaagcgactgcctgcag

SEQ ID NO: 319443 - DNA, 29 bp, Artificial Sequence
  Description of Artificial Sequence: Synthetic oligonucleotide
acttcaacctcctaagcgactgcctgcag

SEQ ID NO: 319444 - DNA, 28 bp, Artificial Sequence
  Description of Artificial Sequence: Synthetic oligonucleotide
cttcaacctcctaagcgactgcctgcag

SEQ ID NO: 319445 - DNA, 28 bp, Artificial Sequence
  Description of Artificial Sequence: Synthetic oligonucleotide
ttcaacctcctaagcgactgcctgcagg

SEQ ID NO: 319446 - DNA, 27 bp, Artificial Sequence
  Description of Artificial Sequence: Synthetic oligonucleotide
tcaacctcctaagcgactgcctgcagg

SEQ ID NO: 319447 - DNA, 27 bp, Artificial Sequence
  Description of Artificial Sequence: Synthetic oligonucleotide
caacctcctaagcgactgcctgcaggt

SEQ ID NO: 319448 - DNA, 27 bp, Artificial Sequence
  Description of Artificial Sequence: Synthetic oligonucleotide
aacctcctaagcgactgcctgcaggtg

SEQ ID NO: 319449 - DNA, 27 bp, Artificial Sequence
  Description of Artificial Sequence: Synthetic oligonucleotide
acctcctaagcgactgcctgcaggtga

SEQ ID NO: 319450 - DNA, 26 bp, Artificial Sequence
  Description of Artificial Sequence: Synthetic oligonucleotide
cctcctaagcgactgcctgcaggtga

SEQ ID NO: 319451 - DNA, 26 bp, Artificial Sequence
  Description of Artificial Sequence: Synthetic oligonucleotide
ctcctaagcgactgcctgcaggtgac

SEQ ID NO: 319452 - DNA, 26 bp, Artificial Sequence
  Description of Artificial Sequence: Synthetic oligonucleotide
tcctaagcgactgcctgcaggtgacc

SEQ ID NO: 319453 - DNA, 25 bp, Artificial Sequence
  Description of Artificial Sequence: Synthetic oligonucleotide
cctaagcgactgcctgcaggtgacc

SEQ ID NO: 319454 - DNA, 26 bp, Artificial Sequence
  Description of Artificial Sequence: Synthetic oligonucleotide
ctaagcgactgcctgcaggtgaccct

SEQ ID NO: 319455 - DNA, 26 bp, Artificial Sequence
  Description of Artificial Sequence: Synthetic oligonucleotide
taagcgactgcctgcaggtgaccctc

SEQ ID NO: 319456 - DNA, 25 bp, Artificial Sequence
  Description of Artificial Sequence: Synthetic oligonucleotide
aagcgactgcctgcaggtgaccctc

SEQ ID NO: 319457 - DNA, 24 bp, Artificial Sequence
  Description of Artificial Sequence: Synthetic oligonucleotide
agcgactgcctgcaggtgaccctc

SEQ ID NO: 319458 - DNA, 23 bp, Artificial Sequence
  Description of Artificial Sequence: Synthetic oligonucleotide
gcgactgcctgcaggtgaccctc

SEQ ID NO: 319459 - DNA, 23 bp, Artificial Sequence
  Description of Artificial Sequence: Synthetic oligonucleotide
cgactgcctgcaggtgaccctcg

SEQ ID NO: 319460 - DNA, 23 bp, Artificial Sequence
  Description of Artificial Sequence: Synthetic oligonucleotide
gactgcctgcaggtgaccctcgc

SEQ ID NO: 319461 - DNA, 23 bp, Artificial Sequence
  Description of Artificial Sequence: Synthetic oligonucleotide
actgcctgcaggtgaccctcgcc

SEQ ID NO: 319462 - DNA, 22 bp, Artificial Sequence
  Description of Artificial Sequence: Synthetic oligonucleotide
ctgcctgcaggtgaccctcgcc

SEQ ID NO: 319463 - DNA, 22 bp, Artificial Sequence
  Description of Artificial Sequence: Synthetic oligonucleotide
tgcctgcaggtgaccctcgccg

SEQ ID NO: 319464 - DNA, 21 bp, Artificial Sequence
  Description of Artificial Sequence: Synthetic oligonucleotide
gcctgcaggtgaccctcgccg

SEQ ID NO: 319465 - DNA, 21 bp, Artificial Sequence
  Description of Artificial Sequence: Synthetic oligonucleotide
cctgcaggtgaccctcgccgc

SEQ ID NO: 319466 - DNA, 21 bp, Artificial Sequence
  Description of Artificial Sequence: Synthetic oligonucleotide
ctgcaggtgaccctcgccgcc

SEQ ID NO: 319467 - DNA, 22 bp, Artificial Sequence
  Description of Artificial Sequence: Synthetic oligonucleotide
tgcaggtgaccctcgccgccca

SEQ ID NO: 319468 - DNA, 21 bp, Artificial Sequence
  Description of Artificial Sequence: Synthetic oligonucleotide
gcaggtgaccctcgccgccca

SEQ ID NO: 319469 - DNA, 21 bp, Artificial Sequence
  Description of Artificial Sequence: Synthetic oligonucleotide
caggtgaccctcgccgcccac

SEQ ID NO: 319470 - DNA, 22 bp, Artificial Sequence
  Description of Artificial Sequence: Synthetic oligonucleotide
aggtgaccctcgccgcccacgt

SEQ ID NO: 319471 - DNA, 21 bp, Artificial Sequence
  Description of Artificial Sequence: Synthetic oligonucleotide
ggtgaccctcgccgcccacgt

SEQ ID NO: 319472 - DNA, 21 bp, Artificial Sequence
  Description of Artificial Sequence: Synthetic oligonucleotide
gtgaccctcgccgcccacgtc

SEQ ID NO: 319473 - DNA, 21 bp, Artificial Sequence
  Description of Artificial Sequence: Synthetic oligonucleotide
tgaccctcgccgcccacgtcc

SEQ ID NO: 319474 - DNA, 20 bp, Artificial Sequence
  Description of Artificial Sequence: Synthetic oligonucleotide
gaccctcgccgcccacgtcc

SEQ ID NO: 319475 - DNA, 20 bp, Artificial Sequence
  Description of Artificial Sequence: Synthetic oligonucleotide
accctcgccgcccacgtccc

SEQ ID NO: 319476 - DNA, 20 bp, Artificial Sequence
  Description of Artificial Sequence: Synthetic oligonucleotide
ccctcgccgcccacgtccct

SEQ ID NO: 319477 - DNA, 20 bp, Artificial Sequence
  Description of Artificial Sequence: Synthetic oligonucleotide
cctcgccgcccacgtcccct

SEQ ID NO: 319478 - DNA, 20 bp, Artificial Sequence
  Description of Artificial Sequence: Synthetic oligonucleotide
ctcgccgcccacgtccccgt

SEQ ID NO: 319479 - DNA, 20 bp, Artificial Sequence
  Description of Artificial Sequence: Synthetic oligonucleotide
tcgccgcccacgtccccgct

SEQ ID NO: 319480 - DNA, 20 bp, Artificial Sequence
  Description of Artificial Sequence: Synthetic oligonucleotide
cgccgcccacgtccccgctt

SEQ ID NO: 319481 - DNA, 20 bp, Artificial Sequence
  Description of Artificial Sequence: Synthetic oligonucleotide
gccgcccacgtccccgcctt

SEQ ID NO: 319482 - DNA, 20 bp, Artificial Sequence
  Description of Artificial Sequence: Synthetic oligonucleotide
ccgcccacgtccccgccgtt

SEQ ID NO: 319483 - DNA, 21 bp, Artificial Sequence
  Description of Artificial Sequence: Synthetic oligonucleotide
cgcccacgtccccgccgtgtt

SEQ ID NO: 319484 - DNA, 22 bp, Artificial Sequence
  Description of Artificial Sequence: Synthetic oligonucleotide
gcccacgtccccgccgtgttca

SEQ ID NO: 319485 - DNA, 22 bp, Artificial Sequence
  Description of Artificial Sequence: Synthetic oligonucleotide
cccacgtccccgccgtgttcac

SEQ ID NO: 319486 - DNA, 22 bp, Artificial Sequence
  Description of Artificial Sequence: Synthetic oligonucleotide
ccacgtccccgccgtgttcacc

SEQ ID NO: 319487 - DNA, 22 bp, Artificial Sequence
  Description of Artificial Sequence: Synthetic oligonucleotide
cacgtccccgccgtgttcaccc

SEQ ID NO: 319488 - DNA, 23 bp, Artificial Sequence
  Description of Artificial Sequence: Synthetic oligonucleotide
acgtccccgccgtgttcacccca

SEQ ID NO: 319489 - DNA, 22 bp, Artificial Sequence
  Description of Artificial Sequence: Synthetic oligonucleotide
cgtccccgccgtgttcacccca

SEQ ID NO: 319490 - DNA, 22 bp, Artificial Sequence
  Description of Artificial Sequence: Synthetic oligonucleotide
gtccccgccgtgttcaccccag

SEQ ID NO: 319491 - DNA, 22 bp, Artificial Sequence
  Description of Artificial Sequence: Synthetic oligonucleotide
tccccgccgtgttcaccccagc

SEQ ID NO: 319492 - DNA, 21 bp, Artificial Sequence
  Description of Artificial Sequence: Synthetic oligonucleotide
ccccgccgtgttcaccccagc

SEQ ID NO: 319493 - DNA, 21 bp, Artificial Sequence
  Description of Artificial Sequence: Synthetic oligonucleotide
cccgccgtgttcaccccagcg

SEQ ID NO: 319494 - DNA, 22 bp, Artificial Sequence
  Description of Artificial Sequence: Synthetic oligonucleotide
ccgccgtgttcaccccagcggt

SEQ ID NO: 319495 - DNA, 22 bp, Artificial Sequence
  Description of Artificial Sequence: Synthetic oligonucleotide
cgccgtgttcaccccagcggtg

SEQ ID NO: 319496 - DNA, 23 bp, Artificial Sequence
  Description of Artificial Sequence: Synthetic oligonucleotide
gccgtgttcaccccagcggtgca

SEQ ID NO: 319497 - DNA, 23 bp, Artificial Sequence
  Description of Artificial Sequence: Synthetic oligonucleotide
ccgtgttcaccccagcggtgcac

SEQ ID NO: 319498 - DNA, 23 bp, Artificial Sequence
  Description of Artificial Sequence: Synthetic oligonucleotide
cgtgttcaccccagcggtgcacc

SEQ ID NO: 319499 - DNA, 23 bp, Artificial Sequence
  Description of Artificial Sequence: Synthetic oligonucleotide
gtgttcaccccagcggtgcaccc

SEQ ID NO: 319500 - DNA, 24 bp, Artificial Sequence
  Description of Artificial Sequence: Synthetic oligonucleotide
tgttcaccccagcggtgcacccct

SEQ ID NO: 319501 - DNA, 23 bp, Artificial Sequence
  Description of Artificial Sequence: Synthetic oligonucleotide
gttcaccccagcggtgcacccct

SEQ ID NO: 319502 - DNA, 23 bp, Artificial Sequence
  Description of Artificial Sequence: Synthetic oligonucleotide
ttcaccccagcggtgcacccctc

SEQ ID NO: 319503 - DNA, 22 bp, Artificial Sequence
  Description of Artificial Sequence: Synthetic oligonucleotide
tcaccccagcggtgcacccctc

SEQ ID NO: 319504 - DNA, 21 bp, Artificial Sequence
  Description of Artificial Sequence: Synthetic oligonucleotide
caccccagcggtgcacccctc

SEQ ID NO: 319505 - DNA, 21 bp, Artificial Sequence
  Description of Artificial Sequence: Synthetic oligonucleotide
accccagcggtgcacccctcc

SEQ ID NO: 319506 - DNA, 20 bp, Artificial Sequence
  Description of Artificial Sequence: Synthetic oligonucleotide
ccccagcggtgcacccctcc

SEQ ID NO: 319507 - DNA, 21 bp, Artificial Sequence
  Description of Artificial Sequence: Synthetic oligonucleotide
cccagcggtgcacccctccct

SEQ ID NO: 319508 - DNA, 21 bp, Artificial Sequence
  Description of Artificial Sequence: Synthetic oligonucleotide
ccagcggtgcacccctccctg

SEQ ID NO: 319509 - DNA, 22 bp, Artificial Sequence
  Description of Artificial Sequence: Synthetic oligonucleotide
cagcggtgcacccctccctggt

SEQ ID NO: 319510 - DNA, 24 bp, Artificial Sequence
  Description of Artificial Sequence: Synthetic oligonucleotide
agcggtgcacccctccctggtcaa

SEQ ID NO: 319511 - DNA, 23 bp, Artificial Sequence
  Description of Artificial Sequence: Synthetic oligonucleotide
gcggtgcacccctccctggtcaa

SEQ ID NO: 319512 - DNA, 25 bp, Artificial Sequence
  Description of Artificial Sequence: Synthetic oligonucleotide
cggtgcacccctccctggtcaagtt

SEQ ID NO: 319513 - DNA, 25 bp, Artificial Sequence
  Description of Artificial Sequence: Synthetic oligonucleotide
ggtgcacccctccctggtcaagttc

SEQ ID NO: 319514 - DNA, 26 bp, Artificial Sequence
  Description of Artificial Sequence: Synthetic oligonucleotide
gtgcacccctccctggtcaagttcct

SEQ ID NO: 319515 - DNA, 26 bp, Artificial Sequence
  Description of Artificial Sequence: Synthetic oligonucleotide
tgcacccctccctggtcaagttcctc

SEQ ID NO: 319516 - DNA, 25 bp, Artificial Sequence
  Description of Artificial Sequence: Synthetic oligonucleotide
gcacccctccctggtcaagttcctc

SEQ ID NO: 319517 - DNA, 25 bp, Artificial Sequence
  Description of Artificial Sequence: Synthetic oligonucleotide
cacccctccctggtcaagttcctcg

SEQ ID NO: 319518 - DNA, 27 bp, Artificial Sequence
  Description of Artificial Sequence: Synthetic oligonucleotide
acccctccctggtcaagttcctcgctt

SEQ ID NO: 319519 - DNA, 26 bp, Artificial Sequence
  Description of Artificial Sequence: Synthetic oligonucleotide
cccctccctggtcaagttcctcgctt

SEQ ID NO: 319520 - DNA, 27 bp, Artificial Sequence
  Description of Artificial Sequence: Synthetic oligonucleotide
ccctccctggtcaagttcctcgcttct

SEQ ID NO: 319521 - DNA, 27 bp, Artificial Sequence
  Description of Artificial Sequence: Synthetic oligonucleotide
cctccctggtcaagttcctcgcttctg

SEQ ID NO: 319522 - DNA, 28 bp, Artificial Sequence
  Description of Artificial Sequence: Synthetic oligonucleotide
ctccctggtcaagttcctcgcttctgtg

SEQ ID NO: 319523 - DNA, 29 bp, Artificial Sequence
  Description of Artificial Sequence: Synthetic oligonucleotide
tccctggtcaagttcctcgcttctgtgtg

SEQ ID NO: 319524 - DNA, 28 bp, Artificial Sequence
  Description of Artificial Sequence: Synthetic oligonucleotide
ccctggtcaagttcctcgcttctgtgtg

SEQ ID NO: 319525 - DNA, 28 bp, Artificial Sequence
  Description of Artificial Sequence: Synthetic oligonucleotide
cctggtcaagttcctcgcttctgtgtgc

SEQ ID NO: 319526 - DNA, 29 bp, Artificial Sequence
  Description of Artificial Sequence: Synthetic oligonucleotide
ctggtcaagttcctcgcttctgtgtgcac

SEQ ID NO: 319527 - DNA, 29 bp, Artificial Sequence
  Description of Artificial Sequence: Synthetic oligonucleotide
tggtcaagttcctcgcttctgtgtgcacc

SEQ ID NO: 319528 - DNA, 28 bp, Artificial Sequence
  Description of Artificial Sequence: Synthetic oligonucleotide
ggtcaagttcctcgcttctgtgtgcacc

SEQ ID NO: 319529 - DNA, 28 bp, Artificial Sequence
  Description of Artificial Sequence: Synthetic oligonucleotide
gtcaagttcctcgcttctgtgtgcaccg

SEQ ID NO: 319530 - DNA, 29 bp, Artificial Sequence
  Description of Artificial Sequence: Synthetic oligonucleotide
tcaagttcctcgcttctgtgtgcaccgtg

SEQ ID NO: 319531 - DNA, 28 bp, Artificial Sequence
  Description of Artificial Sequence: Synthetic oligonucleotide
caagttcctcgcttctgtgtgcaccgtg

SEQ ID NO: 319532 - DNA, 28 bp, Artificial Sequence
  Description of Artificial Sequence: Synthetic oligonucleotide
aagttcctcgcttctgtgtgcaccgtgc

SEQ ID NO: 319533 - DNA, 27 bp, Artificial Sequence
  Description of Artificial Sequence: Synthetic oligonucleotide
agttcctcgcttctgtgtgcaccgtgc

SEQ ID NO: 319534 - DNA, 27 bp, Artificial Sequence
  Description of Artificial Sequence: Synthetic oligonucleotide
gttcctcgcttctgtgtgcaccgtgca

SEQ ID NO: 319535 - DNA, 27 bp, Artificial Sequence
  Description of Artificial Sequence: Synthetic oligonucleotide
ttcctcgcttctgtgtgcaccgtgcag

SEQ ID NO: 319536 - DNA, 27 bp, Artificial Sequence
  Description of Artificial Sequence: Synthetic oligonucleotide
tcctcgcttctgtgtgcaccgtgcaga

SEQ ID NO: 319537 - DNA, 26 bp, Artificial Sequence
  Description of Artificial Sequence: Synthetic oligonucleotide
cctcgcttctgtgtgcaccgtgcaga

SEQ ID NO: 319538 - DNA, 26 bp, Artificial Sequence
  Description of Artificial Sequence: Synthetic oligonucleotide
ctcgcttctgtgtgcaccgtgcagac

SEQ ID NO: 319539 - DNA, 27 bp, Artificial Sequence
  Description of Artificial Sequence: Synthetic oligonucleotide
tcgcttctgtgtgcaccgtgcagacct

SEQ ID NO: 319540 - DNA, 26 bp, Artificial Sequence
  Description of Artificial Sequence: Synthetic oligonucleotide
cgcttctgtgtgcaccgtgcagacct

SEQ ID NO: 319541 - DNA, 26 bp, Artificial Sequence
  Description of Artificial Sequence: Synthetic oligonucleotide
gcttctgtgtgcaccgtgcagacctc

SEQ ID NO: 319542 - DNA, 27 bp, Artificial Sequence
  Description of Artificial Sequence: Synthetic oligonucleotide
cttctgtgtgcaccgtgcagacctcca

SEQ ID NO: 319543 - DNA, 31 bp, Artificial Sequence
  Description of Artificial Sequence: Synthetic oligonucleotide
ttctgtgtgcaccgtgcagacctccaattac

SEQ ID NO: 319544 - DNA, 30 bp, Artificial Sequence
  Description of Artificial Sequence: Synthetic oligonucleotide
tctgtgtgcaccgtgcagacctccaattac

SEQ ID NO: 319545 - DNA, 29 bp, Artificial Sequence
  Description of Artificial Sequence: Synthetic oligonucleotide
ctgtgtgcaccgtgcagacctccaattac

SEQ ID NO: 319546 - DNA, 29 bp, Artificial Sequence
  Description of Artificial Sequence: Synthetic oligonucleotide
tgtgtgcaccgtgcagacctccaattacc

SEQ ID NO: 319547 - DNA, 28 bp, Artificial Sequence
  Description of Artificial Sequence: Synthetic oligonucleotide
gtgtgcaccgtgcagacctccaattacc

SEQ ID NO: 319548 - DNA, 28 bp, Artificial Sequence
  Description of Artificial Sequence: Synthetic oligonucleotide
tgtgcaccgtgcagacctccaattaccg

SEQ ID NO: 319549 - DNA, 27 bp, Artificial Sequence
  Description of Artificial Sequence: Synthetic oligonucleotide
gtgcaccgtgcagacctccaattaccg

SEQ ID NO: 319550 - DNA, 37 bp, Artificial Sequence
  Description of Artificial Sequence: Synthetic oligonucleotide
ataggcactcactctctctccctattggtgtattttc

SEQ ID NO: 319551 - DNA, 36 bp, Artificial Sequence
  Description of Artificial Sequence: Synthetic oligonucleotide
taggcactcactctctctccctattggtgtattttc

SEQ ID NO: 319552 - DNA, 35 bp, Artificial Sequence
  Description of Artificial Sequence: Synthetic oligonucleotide
aggcactcactctctctccctattggtgtattttc

SEQ ID NO: 319553 - DNA, 34 bp, Artificial Sequence
  Description of Artificial Sequence: Synthetic oligonucleotide
ggcactcactctctctccctattggtgtattttc

SEQ ID NO: 319554 - DNA, 34 bp, Artificial Sequence
  Description of Artificial Sequence: Synthetic oligonucleotide
gcactcactctctctccctattggtgtattttcc

SEQ ID NO: 319555 - DNA, 34 bp, Artificial Sequence
  Description of Artificial Sequence: Synthetic oligonucleotide
cactcactctctctccctattggtgtattttccc

SEQ ID NO: 319556 - DNA, 35 bp, Artificial Sequence
  Description of Artificial Sequence: Synthetic oligonucleotide
actcactctctctccctattggtgtattttccctc

SEQ ID NO: 319557 - DNA, 34 bp, Artificial Sequence
  Description of Artificial Sequence: Synthetic oligonucleotide
ctcactctctctccctattggtgtattttccctc

SEQ ID NO: 319558 - DNA, 34 bp, Artificial Sequence
  Description of Artificial Sequence: Synthetic oligonucleotide
tcactctctctccctattggtgtattttccctcc

SEQ ID NO: 319559 - DNA, 33 bp, Artificial Sequence
  Description of Artificial Sequence: Synthetic oligonucleotide
cactctctctccctattggtgtattttccctcc

SEQ ID NO: 319560 - DNA, 33 bp, Artificial Sequence
  Description of Artificial Sequence: Synthetic oligonucleotide
actctctctccctattggtgtattttccctccc

SEQ ID NO: 319561 - DNA, 32 bp, Artificial Sequence
  Description of Artificial Sequence: Synthetic oligonucleotide
ctctctctccctattggtgtattttccctccc

SEQ ID NO: 319562 - DNA, 35 bp, Artificial Sequence
  Description of Artificial Sequence: Synthetic oligonucleotide
tctctctccctattggtgtattttccctcccttag

SEQ ID NO: 319563 - DNA, 34 bp, Artificial Sequence
  Description of Artificial Sequence: Synthetic oligonucleotide
ctctctccctattggtgtattttccctcccttag

SEQ ID NO: 319564 - DNA, 34 bp, Artificial Sequence
  Description of Artificial Sequence: Synthetic oligonucleotide
tctctccctattggtgtattttccctcccttagg

SEQ ID NO: 319565 - DNA, 33 bp, Artificial Sequence
  Description of Artificial Sequence: Synthetic oligonucleotide
ctctccctattggtgtattttccctcccttagg

SEQ ID NO: 319566 - DNA, 33 bp, Artificial Sequence
  Description of Artificial Sequence: Synthetic oligonucleotide
tctccctattggtgtattttccctcccttaggc

SEQ ID NO: 319567 - DNA, 32 bp, Artificial Sequence
  Description of Artificial Sequence: Synthetic oligonucleotide
ctccctattggtgtattttccctcccttaggc

SEQ ID NO: 319568 - DNA, 33 bp, Artificial Sequence
  Description of Artificial Sequence: Synthetic oligonucleotide
tccctattggtgtattttccctcccttaggcag

SEQ ID NO: 319569 - DNA, 32 bp, Artificial Sequence
  Description of Artificial Sequence: Synthetic oligonucleotide
ccctattggtgtattttccctcccttaggcag

SEQ ID NO: 319570 - DNA, 32 bp, Artificial Sequence
  Description of Artificial Sequence: Synthetic oligonucleotide
cctattggtgtattttccctcccttaggcagc

SEQ ID NO: 319571 - DNA, 33 bp, Artificial Sequence
  Description of Artificial Sequence: Synthetic oligonucleotide
ctattggtgtattttccctcccttaggcagctg

SEQ ID NO: 319572 - DNA, 33 bp, Artificial Sequence
  Description of Artificial Sequence: Synthetic oligonucleotide
tattggtgtattttccctcccttaggcagctgg

SEQ ID NO: 319573 - DNA, 32 bp, Artificial Sequence
  Description of Artificial Sequence: Synthetic oligonucleotide
attggtgtattttccctcccttaggcagctgg

SEQ ID NO: 319574 - DNA, 31 bp, Artificial Sequence
  Description of Artificial Sequence: Synthetic oligonucleotide
ttggtgtattttccctcccttaggcagctgg

SEQ ID NO: 319575 - DNA, 30 bp, Artificial Sequence
  Description of Artificial Sequence: Synthetic oligonucleotide
tggtgtattttccctcccttaggcagctgg

SEQ ID NO: 319576 - DNA, 29 bp, Artificial Sequence
  Description of Artificial Sequence: Synthetic oligonucleotide
ggtgtattttccctcccttaggcagctgg

SEQ ID NO: 319577 - DNA, 30 bp, Artificial Sequence
  Description of Artificial Sequence: Synthetic oligonucleotide
gtgtattttccctcccttaggcagctggtg

SEQ ID NO: 319578 - DNA, 30 bp, Artificial Sequence
  Description of Artificial Sequence: Synthetic oligonucleotide
tgtattttccctcccttaggcagctggtgg

SEQ ID NO: 319579 - DNA, 29 bp, Artificial Sequence
  Description of Artificial Sequence: Synthetic oligonucleotide
gtattttccctcccttaggcagctggtgg

SEQ ID NO: 319580 - DNA, 30 bp, Artificial Sequence
  Description of Artificial Sequence: Synthetic oligonucleotide
tattttccctcccttaggcagctggtggtg

SEQ ID NO: 319581 - DNA, 29 bp, Artificial Sequence
  Description of Artificial Sequence: Synthetic oligonucleotide
attttccctcccttaggcagctggtggtg

SEQ ID NO: 319582 - DNA, 28 bp, Artificial Sequence
  Description of Artificial Sequence: Synthetic oligonucleotide
ttttccctcccttaggcagctggtggtg

SEQ ID NO: 319583 - DNA, 27 bp, Artificial Sequence
  Description of Artificial Sequence: Synthetic oligonucleotide
tttccctcccttaggcagctggtggtg

SEQ ID NO: 319584 - DNA, 27 bp, Artificial Sequence
  Description of Artificial Sequence: Synthetic oligonucleotide
ttccctcccttaggcagctggtggtgt

SEQ ID NO: 319585 - DNA, 27 bp, Artificial Sequence
  Description of Artificial Sequence: Synthetic oligonucleotide
tccctcccttaggcagctggtggtgta

SEQ ID NO: 319586 - DNA, 26 bp, Artificial Sequence
  Description of Artificial Sequence: Synthetic oligonucleotide
ccctcccttaggcagctggtggtgta

SEQ ID NO: 319587 - DNA, 26 bp, Artificial Sequence
  Description of Artificial Sequence: Synthetic oligonucleotide
cctcccttaggcagctggtggtgtac

SEQ ID NO: 319588 - DNA, 26 bp, Artificial Sequence
  Description of Artificial Sequence: Synthetic oligonucleotide
ctcccttaggcagctggtggtgtacc

SEQ ID NO: 319589 - DNA, 27 bp, Artificial Sequence
  Description of Artificial Sequence: Synthetic oligonucleotide
tcccttaggcagctggtggtgtaccct

SEQ ID NO: 319590 - DNA, 27 bp, Artificial Sequence
  Description of Artificial Sequence: Synthetic oligonucleotide
cccttaggcagctggtggtgtaccctt

SEQ ID NO: 319591 - DNA, 27 bp, Artificial Sequence
  Description of Artificial Sequence: Synthetic oligonucleotide
ccttaggcagctggtggtgtacccttg

SEQ ID NO: 319592 - DNA, 27 bp, Artificial Sequence
  Description of Artificial Sequence: Synthetic oligonucleotide
cttaggcagctggtggtgtacccttgg

SEQ ID NO: 319593 - DNA, 28 bp, Artificial Sequence
  Description of Artificial Sequence: Synthetic oligonucleotide
ttaggcagctggtggtgtacccttggtc

SEQ ID NO: 319594 - DNA, 27 bp, Artificial Sequence
  Description of Artificial Sequence: Synthetic oligonucleotide
taggcagctggtggtgtacccttggtc

SEQ ID NO: 319595 - DNA, 26 bp, Artificial Sequence
  Description of Artificial Sequence: Synthetic oligonucleotide
aggcagctggtggtgtacccttggtc

SEQ ID NO: 319596 - DNA, 25 bp, Artificial Sequence
  Description of Artificial Sequence: Synthetic oligonucleotide
ggcagctggtggtgtacccttggtc

SEQ ID NO: 319597 - DNA, 25 bp, Artificial Sequence
  Description of Artificial Sequence: Synthetic oligonucleotide
gcagctggtggtgtacccttggtcc

SEQ ID NO: 319598 - DNA, 26 bp, Artificial Sequence
  Description of Artificial Sequence: Synthetic oligonucleotide
cagctggtggtgtacccttggtccca

SEQ ID NO: 319599 - DNA, 27 bp, Artificial Sequence
  Description of Artificial Sequence: Synthetic oligonucleotide
agctggtggtgtacccttggtcccaga

SEQ ID NO: 319600 - DNA, 26 bp, Artificial Sequence
  Description of Artificial Sequence: Synthetic oligonucleotide
gctggtggtgtacccttggtcccaga

SEQ ID NO: 319601 - DNA, 26 bp, Artificial Sequence
  Description of Artificial Sequence: Synthetic oligonucleotide
ctggtggtgtacccttggtcccagag

SEQ ID NO: 319602 - DNA, 27 bp, Artificial Sequence
  Description of Artificial Sequence: Synthetic oligonucleotide
tggtggtgtacccttggtcccagaggt

SEQ ID NO: 319603 - DNA, 27 bp, Artificial Sequence
  Description of Artificial Sequence: Synthetic oligonucleotide
ggtggtgtacccttggtcccagaggta

SEQ ID NO: 319604 - DNA, 27 bp, Artificial Sequence
  Description of Artificial Sequence: Synthetic oligonucleotide
gtggtgtacccttggtcccagaggtac

SEQ ID NO: 319605 - DNA, 30 bp, Artificial Sequence
  Description of Artificial Sequence: Synthetic oligonucleotide
tggtgtacccttggtcccagaggtactttg

SEQ ID NO: 319606 - DNA, 29 bp, Artificial Sequence
  Description of Artificial Sequence: Synthetic oligonucleotide
ggtgtacccttggtcccagaggtactttg

SEQ ID NO: 319607 - DNA, 30 bp, Artificial Sequence
  Description of Artificial Sequence: Synthetic oligonucleotide
gtgtacccttggtcccagaggtactttgag

SEQ ID NO: 319608 - DNA, 31 bp, Artificial Sequence
  Description of Artificial Sequence: Synthetic oligonucleotide
tgtacccttggtcccagaggtactttgagtc

SEQ ID NO: 319609 - DNA, 30 bp, Artificial Sequence
  Description of Artificial Sequence: Synthetic oligonucleotide
gtacccttggtcccagaggtactttgagtc

SEQ ID NO: 319610 - DNA, 30 bp, Artificial Sequence
  Description of Artificial Sequence: Synthetic oligonucleotide
tacccttggtcccagaggtactttgagtcg

SEQ ID NO: 319611 - DNA, 29 bp, Artificial Sequence
  Description of Artificial Sequence: Synthetic oligonucleotide
acccttggtcccagaggtactttgagtcg

SEQ ID NO: 319612 - DNA, 28 bp, Artificial Sequence
  Description of Artificial Sequence: Synthetic oligonucleotide
cccttggtcccagaggtactttgagtcg

SEQ ID NO: 319613 - DNA, 31 bp, Artificial Sequence
  Description of Artificial Sequence: Synthetic oligonucleotide
ccttggtcccagaggtactttgagtcgtttg

SEQ ID NO: 319614 - DNA, 31 bp, Artificial Sequence
  Description of Artificial Sequence: Synthetic oligonucleotide
cttggtcccagaggtactttgagtcgtttgg

SEQ ID NO: 319615 - DNA, 31 bp, Artificial Sequence
  Description of Artificial Sequence: Synthetic oligonucleotide
ttggtcccagaggtactttgagtcgtttggg

SEQ ID NO: 319616 - DNA, 30 bp, Artificial Sequence
  Description of Artificial Sequence: Synthetic oligonucleotide
tggtcccagaggtactttgagtcgtttggg

SEQ ID NO: 319617 - DNA, 29 bp, Artificial Sequence
  Description of Artificial Sequence: Synthetic oligonucleotide
ggtcccagaggtactttgagtcgtttggg

SEQ ID NO: 319618 - DNA, 29 bp, Artificial Sequence
  Description of Artificial Sequence: Synthetic oligonucleotide
gtcccagaggtactttgagtcgtttgggg

SEQ ID NO: 319619 - DNA, 31 bp, Artificial Sequence
  Description of Artificial Sequence: Synthetic oligonucleotide
tcccagaggtactttgagtcgtttggggatg

SEQ ID NO: 319620 - DNA, 30 bp, Artificial Sequence
  Description of Artificial Sequence: Synthetic oligonucleotide
cccagaggtactttgagtcgtttggggatg

SEQ ID NO: 319621 - DNA, 31 bp, Artificial Sequence
  Description of Artificial Sequence: Synthetic oligonucleotide
ccagaggtactttgagtcgtttggggatgtg

SEQ ID NO: 319622 - DNA, 32 bp, Artificial Sequence
  Description of Artificial Sequence: Synthetic oligonucleotide
cagaggtactttgagtcgtttggggatgtgtc

SEQ ID NO: 319623 - DNA, 32 bp, Artificial Sequence
  Description of Artificial Sequence: Synthetic oligonucleotide
agaggtactttgagtcgtttggggatgtgtcc

SEQ ID NO: 319624 - DNA, 31 bp, Artificial Sequence
  Description of Artificial Sequence: Synthetic oligonucleotide
gaggtactttgagtcgtttggggatgtgtcc

SEQ ID NO: 319625 - DNA, 32 bp, Artificial Sequence
  Description of Artificial Sequence: Synthetic oligonucleotide
aggtactttgagtcgtttggggatgtgtccac

SEQ ID NO: 319626 - DNA, 31 bp, Artificial Sequence
  Description of Artificial Sequence: Synthetic oligonucleotide
ggtactttgagtcgtttggggatgtgtccac

SEQ ID NO: 319627 - DNA, 32 bp, Artificial Sequence
  Description of Artificial Sequence: Synthetic oligonucleotide
gtactttgagtcgtttggggatgtgtccactc

SEQ ID NO: 319628 - DNA, 32 bp, Artificial Sequence
  Description of Artificial Sequence: Synthetic oligonucleotide
tactttgagtcgtttggggatgtgtccactcg

SEQ ID NO: 319629 - DNA, 31 bp, Artificial Sequence
  Description of Artificial Sequence: Synthetic oligonucleotide
actttgagtcgtttggggatgtgtccactcg

SEQ ID NO: 319630 - DNA, 30 bp, Artificial Sequence
  Description of Artificial Sequence: Synthetic oligonucleotide
ctttgagtcgtttggggatgtgtccactcg

SEQ ID NO: 319631 - DNA, 31 bp, Artificial Sequence
  Description of Artificial Sequence: Synthetic oligonucleotide
tttgagtcgtttggggatgtgtccactcgtg

SEQ ID NO: 319632 - DNA, 30 bp, Artificial Sequence
  Description of Artificial Sequence: Synthetic oligonucleotide
ttgagtcgtttggggatgtgtccactcgtg

SEQ ID NO: 319633 - DNA, 29 bp, Artificial Sequence
  Description of Artificial Sequence: Synthetic oligonucleotide
tgagtcgtttggggatgtgtccactcgtg

SEQ ID NO: 319634 - DNA, 28 bp, Artificial Sequence
  Description of Artificial Sequence: Synthetic oligonucleotide
gagtcgtttggggatgtgtccactcgtg

SEQ ID NO: 319635 - DNA, 30 bp, Artificial Sequence
  Description of Artificial Sequence: Synthetic oligonucleotide
agtcgtttggggatgtgtccactcgtgatg

SEQ ID NO: 319636 - DNA, 29 bp, Artificial Sequence
  Description of Artificial Sequence: Synthetic oligonucleotide
gtcgtttggggatgtgtccactcgtgatg

SEQ ID NO: 319637 - DNA, 29 bp, Artificial Sequence
  Description of Artificial Sequence: Synthetic oligonucleotide
tcgtttggggatgtgtccactcgtgatgc

SEQ ID NO: 319638 - DNA, 28 bp, Artificial Sequence
  Description of Artificial Sequence: Synthetic oligonucleotide
cgtttggggatgtgtccactcgtgatgc

SEQ ID NO: 319639 - DNA, 29 bp, Artificial Sequence
  Description of Artificial Sequence: Synthetic oligonucleotide
gtttggggatgtgtccactcgtgatgctg

SEQ ID NO: 319640 - DNA, 33 bp, Artificial Sequence
  Description of Artificial Sequence: Synthetic oligonucleotide
tttggggatgtgtccactcgtgatgctgtaatg

SEQ ID NO: 319641 - DNA, 32 bp, Artificial Sequence
  Description of Artificial Sequence: Synthetic oligonucleotide
ttggggatgtgtccactcgtgatgctgtaatg

SEQ ID NO: 319642 - DNA, 31 bp, Artificial Sequence
  Description of Artificial Sequence: Synthetic oligonucleotide
tggggatgtgtccactcgtgatgctgtaatg

SEQ ID NO: 319643 - DNA, 30 bp, Artificial Sequence
  Description of Artificial Sequence: Synthetic oligonucleotide
ggggatgtgtccactcgtgatgctgtaatg

SEQ ID NO: 319644 - DNA, 30 bp, Artificial Sequence
  Description of Artificial Sequence: Synthetic oligonucleotide
gggatgtgtccactcgtgatgctgtaatgg

SEQ ID NO: 319645 - DNA, 30 bp, Artificial Sequence
  Description of Artificial Sequence: Synthetic oligonucleotide
ggatgtgtccactcgtgatgctgtaatggg

SEQ ID NO: 319646 - DNA, 30 bp, Artificial Sequence
  Description of Artificial Sequence: Synthetic oligonucleotide
gatgtgtccactcgtgatgctgtaatgggc

SEQ ID NO: 319647 - DNA, 32 bp, Artificial Sequence
  Description of Artificial Sequence: Synthetic oligonucleotide
atgtgtccactcgtgatgctgtaatgggcaac

SEQ ID NO: 319648 - DNA, 31 bp, Artificial Sequence
  Description of Artificial Sequence: Synthetic oligonucleotide
tgtgtccactcgtgatgctgtaatgggcaac

SEQ ID NO: 319649 - DNA, 30 bp, Artificial Sequence
  Description of Artificial Sequence: Synthetic oligonucleotide
gtgtccactcgtgatgctgtaatgggcaac

SEQ ID NO: 319650 - DNA, 30 bp, Artificial Sequence
  Description of Artificial Sequence: Synthetic oligonucleotide
tgtccactcgtgatgctgtaatgggcaacg

SEQ ID NO: 319651 - DNA, 29 bp, Artificial Sequence
  Description of Artificial Sequence: Synthetic oligonucleotide
gtccactcgtgatgctgtaatgggcaacg

SEQ ID NO: 319652 - DNA, 29 bp, Artificial Sequence
  Description of Artificial Sequence: Synthetic oligonucleotide
tccactcgtgatgctgtaatgggcaacgc

SEQ ID NO: 319653 - DNA, 28 bp, Artificial Sequence
  Description of Artificial Sequence: Synthetic oligonucleotide
ccactcgtgatgctgtaatgggcaacgc

SEQ ID NO: 319654 - DNA, 31 bp, Artificial Sequence
  Description of Artificial Sequence: Synthetic oligonucleotide
cactcgtgatgctgtaatgggcaacgctaag

SEQ ID NO: 319655 - DNA, 31 bp, Artificial Sequence
  Description of Artificial Sequence: Synthetic oligonucleotide
actcgtgatgctgtaatgggcaacgctaagg

SEQ ID NO: 319656 - DNA, 30 bp, Artificial Sequence
  Description of Artificial Sequence: Synthetic oligonucleotide
ctcgtgatgctgtaatgggcaacgctaagg

SEQ ID NO: 319657 - DNA, 31 bp, Artificial Sequence
  Description of Artificial Sequence: Synthetic oligonucleotide
tcgtgatgctgtaatgggcaacgctaaggtg

SEQ ID NO: 319658 - DNA, 30 bp, Artificial Sequence
  Description of Artificial Sequence: Synthetic oligonucleotide
cgtgatgctgtaatgggcaacgctaaggtg

SEQ ID NO: 319659 - DNA, 32 bp, Artificial Sequence
  Description of Artificial Sequence: Synthetic oligonucleotide
gtgatgctgtaatgggcaacgctaaggtgatg

SEQ ID NO: 319660 - DNA, 32 bp, Artificial Sequence
  Description of Artificial Sequence: Synthetic oligonucleotide
tgatgctgtaatgggcaacgctaaggtgatgg

SEQ ID NO: 319661 - DNA, 31 bp, Artificial Sequence
  Description of Artificial Sequence: Synthetic oligonucleotide
gatgctgtaatgggcaacgctaaggtgatgg

SEQ ID NO: 319662 - DNA, 31 bp, Artificial Sequence
  Description of Artificial Sequence: Synthetic oligonucleotide
atgctgtaatgggcaacgctaaggtgatggc

SEQ ID NO: 319663 - DNA, 30 bp, Artificial Sequence
  Description of Artificial Sequence: Synthetic oligonucleotide
tgctgtaatgggcaacgctaaggtgatggc

SEQ ID NO: 319664 - DNA, 29 bp, Artificial Sequence
  Description of Artificial Sequence: Synthetic oligonucleotide
gctgtaatgggcaacgctaaggtgatggc

SEQ ID NO: 319665 - DNA, 30 bp, Artificial Sequence
  Description of Artificial Sequence: Synthetic oligonucleotide
ctgtaatgggcaacgctaaggtgatggctc

SEQ ID NO: 319666 - DNA, 32 bp, Artificial Sequence
  Description of Artificial Sequence: Synthetic oligonucleotide
tgtaatgggcaacgctaaggtgatggctcatg

SEQ ID NO: 319667 - DNA, 26 bp, Artificial Sequence
  Description of Artificial Sequence: Synthetic oligonucleotide
atgtggctcgggagccatcctcagct

SEQ ID NO: 319668 - DNA, 25 bp, Artificial Sequence
  Description of Artificial Sequence: Synthetic oligonucleotide
tgtggctcgggagccatcctcagct

SEQ ID NO: 319669 - DNA, 24 bp, Artificial Sequence
  Description of Artificial Sequence: Synthetic oligonucleotide
gtggctcgggagccatcctcagct

SEQ ID NO: 319670 - DNA, 25 bp, Artificial Sequence
  Description of Artificial Sequence: Synthetic oligonucleotide
tggctcgggagccatcctcagctct

SEQ ID NO: 319671 - DNA, 24 bp, Artificial Sequence
  Description of Artificial Sequence: Synthetic oligonucleotide
ggctcgggagccatcctcagctct

SEQ ID NO: 319672 - DNA, 24 bp, Artificial Sequence
  Description of Artificial Sequence: Synthetic oligonucleotide
gctcgggagccatcctcagctctg

SEQ ID NO: 319673 - DNA, 24 bp, Artificial Sequence
  Description of Artificial Sequence: Synthetic oligonucleotide
ctcgggagccatcctcagctctgg

SEQ ID NO: 319674 - DNA, 25 bp, Artificial Sequence
  Description of Artificial Sequence: Synthetic oligonucleotide
tcgggagccatcctcagctctggct

SEQ ID NO: 319675 - DNA, 24 bp, Artificial Sequence
  Description of Artificial Sequence: Synthetic oligonucleotide
cgggagccatcctcagctctggct

SEQ ID NO: 319676 - DNA, 24 bp, Artificial Sequence
  Description of Artificial Sequence: Synthetic oligonucleotide
gggagccatcctcagctctggctg

SEQ ID NO: 319677 - DNA, 24 bp, Artificial Sequence
  Description of Artificial Sequence: Synthetic oligonucleotide
ggagccatcctcagctctggctgg

SEQ ID NO: 319678 - DNA, 24 bp, Artificial Sequence
  Description of Artificial Sequence: Synthetic oligonucleotide
gagccatcctcagctctggctggc

SEQ ID NO: 319679 - DNA, 26 bp, Artificial Sequence
  Description of Artificial Sequence: Synthetic oligonucleotide
agccatcctcagctctggctggcctt

SEQ ID NO: 319680 - DNA, 25 bp, Artificial Sequence
  Description of Artificial Sequence: Synthetic oligonucleotide
gccatcctcagctctggctggcctt

SEQ ID NO: 319681 - DNA, 25 bp, Artificial Sequence
  Description of Artificial Sequence: Synthetic oligonucleotide
ccatcctcagctctggctggccttc

SEQ ID NO: 319682 - DNA, 26 bp, Artificial Sequence
  Description of Artificial Sequence: Synthetic oligonucleotide
catcctcagctctggctggccttcgt

SEQ ID NO: 319683 - DNA, 26 bp, Artificial Sequence
  Description of Artificial Sequence: Synthetic oligonucleotide
atcctcagctctggctggccttcgtg

SEQ ID NO: 319684 - DNA, 25 bp, Artificial Sequence
  Description of Artificial Sequence: Synthetic oligonucleotide
tcctcagctctggctggccttcgtg

SEQ ID NO: 319685 - DNA, 24 bp, Artificial Sequence
  Description of Artificial Sequence: Synthetic oligonucleotide
cctcagctctggctggccttcgtg

SEQ ID NO: 319686 - DNA, 26 bp, Artificial Sequence
  Description of Artificial Sequence: Synthetic oligonucleotide
ctcagctctggctggccttcgtgcta

SEQ ID NO: 319687 - DNA, 27 bp, Artificial Sequence
  Description of Artificial Sequence: Synthetic oligonucleotide
tcagctctggctggccttcgtgctagt

SEQ ID NO: 319688 - DNA, 26 bp, Artificial Sequence
  Description of Artificial Sequence: Synthetic oligonucleotide
cagctctggctggccttcgtgctagt

SEQ ID NO: 319689 - DNA, 27 bp, Artificial Sequence
  Description of Artificial Sequence: Synthetic oligonucleotide
agctctggctggccttcgtgctagtct

SEQ ID NO: 319690 - DNA, 26 bp, Artificial Sequence
  Description of Artificial Sequence: Synthetic oligonucleotide
gctctggctggccttcgtgctagtct

SEQ ID NO: 319691 - DNA, 27 bp, Artificial Sequence
  Description of Artificial Sequence: Synthetic oligonucleotide
ctctggctggccttcgtgctagtctct

SEQ ID NO: 319692 - DNA, 27 bp, Artificial Sequence
  Description of Artificial Sequence: Synthetic oligonucleotide
tctggctggccttcgtgctagtctctg

SEQ ID NO: 319693 - DNA, 27 bp, Artificial Sequence
  Description of Artificial Sequence: Synthetic oligonucleotide
ctggctggccttcgtgctagtctctgt

SEQ ID NO: 319694 - DNA, 27 bp, Artificial Sequence
  Description of Artificial Sequence: Synthetic oligonucleotide
tggctggccttcgtgctagtctctgtc

SEQ ID NO: 319695 - DNA, 26 bp, Artificial Sequence
  Description of Artificial Sequence: Synthetic oligonucleotide
ggctggccttcgtgctagtctctgtc

SEQ ID NO: 319696 - DNA, 27 bp, Artificial Sequence
  Description of Artificial Sequence: Synthetic oligonucleotide
gctggccttcgtgctagtctctgtcct

SEQ ID NO: 319697 - DNA, 27 bp, Artificial Sequence
  Description of Artificial Sequence: Synthetic oligonucleotide
ctggccttcgtgctagtctctgtcctc

SEQ ID NO: 319698 - DNA, 28 bp, Artificial Sequence
  Description of Artificial Sequence: Synthetic oligonucleotide
tggccttcgtgctagtctctgtcctctc

SEQ ID NO: 319699 - DNA, 27 bp, Artificial Sequence
  Description of Artificial Sequence: Synthetic oligonucleotide
ggccttcgtgctagtctctgtcctctc

SEQ ID NO: 319700 - DNA, 28 bp, Artificial Sequence
  Description of Artificial Sequence: Synthetic oligonucleotide
gccttcgtgctagtctctgtcctctcag

SEQ ID NO: 319701 - DNA, 32 bp, Artificial Sequence
  Description of Artificial Sequence: Synthetic oligonucleotide
ccttcgtgctagtctctgtcctctcagtaatc

SEQ ID NO: 319702 - DNA, 34 bp, Artificial Sequence
  Description of Artificial Sequence: Synthetic oligonucleotide
cttcgtgctagtctctgtcctctcagtaatcttc

SEQ ID NO: 319703 - DNA, 36 bp, Artificial Sequence
  Description of Artificial Sequence: Synthetic oligonucleotide
ttcgtgctagtctctgtcctctcagtaatcttcatc

SEQ ID NO: 319704 - DNA, 35 bp, Artificial Sequence
  Description of Artificial Sequence: Synthetic oligonucleotide
tcgtgctagtctctgtcctctcagtaatcttcatc

SEQ ID NO: 319705 - DNA, 34 bp, Artificial Sequence
  Description of Artificial Sequence: Synthetic oligonucleotide
cgtgctagtctctgtcctctcagtaatcttcatc

SEQ ID NO: 319706 - DNA, 34 bp, Artificial Sequence
  Description of Artificial Sequence: Synthetic oligonucleotide
gtgctagtctctgtcctctcagtaatcttcatcc

SEQ ID NO: 319707 - DNA, 35 bp, Artificial Sequence
  Description of Artificial Sequence: Synthetic oligonucleotide
tgctagtctctgtcctctcagtaatcttcatcctc

SEQ ID NO: 319708 - DNA, 34 bp, Artificial Sequence
  Description of Artificial Sequence: Synthetic oligonucleotide
gctagtctctgtcctctcagtaatcttcatcctc

SEQ ID NO: 319709 - DNA, 34 bp, Artificial Sequence
  Description of Artificial Sequence: Synthetic oligonucleotide
ctagtctctgtcctctcagtaatcttcatcctcc

SEQ ID NO: 319710 - DNA, 38 bp, Artificial Sequence
  Description of Artificial Sequence: Synthetic oligonucleotide
tagtctctgtcctctcagtaatcttcatcctccataac

SEQ ID NO: 319711 - DNA, 37 bp, Artificial Sequence
  Description of Artificial Sequence: Synthetic oligonucleotide
agtctctgtcctctcagtaatcttcatcctccataac

SEQ ID NO: 319712 - DNA, 36 bp, Artificial Sequence
  Description of Artificial Sequence: Synthetic oligonucleotide
gtctctgtcctctcagtaatcttcatcctccataac

SEQ ID NO: 319713 - DNA, 36 bp, Artificial Sequence
  Description of Artificial Sequence: Synthetic oligonucleotide
tctctgtcctctcagtaatcttcatcctccataacc

SEQ ID NO: 319714 - DNA, 35 bp, Artificial Sequence
  Description of Artificial Sequence: Synthetic oligonucleotide
ctctgtcctctcagtaatcttcatcctccataacc

SEQ ID NO: 319715 - DNA, 37 bp, Artificial Sequence
  Description of Artificial Sequence: Synthetic oligonucleotide
tctgtcctctcagtaatcttcatcctccataaccatc

SEQ ID NO: 319716 - DNA, 36 bp, Artificial Sequence
  Description of Artificial Sequence: Synthetic oligonucleotide
ctgtcctctcagtaatcttcatcctccataaccatc

SEQ ID NO: 319717 - DNA, 38 bp, Artificial Sequence
  Description of Artificial Sequence: Synthetic oligonucleotide
tgtcctctcagtaatcttcatcctccataaccatcaag

SEQ ID NO: 319718 - DNA, 37 bp, Artificial Sequence
  Description of Artificial Sequence: Synthetic oligonucleotide
gtcctctcagtaatcttcatcctccataaccatcaag

SEQ ID NO: 319719 - DNA, 38 bp, Artificial Sequence
  Description of Artificial Sequence: Synthetic oligonucleotide
tcctctcagtaatcttcatcctccataaccatcaagag

SEQ ID NO: 319720 - DNA, 37 bp, Artificial Sequence
  Description of Artificial Sequence: Synthetic oligonucleotide
cctctcagtaatcttcatcctccataaccatcaagag

SEQ ID NO: 319721 - DNA, 38 bp, Artificial Sequence
  Description of Artificial Sequence: Synthetic oligonucleotide
ctctcagtaatcttcatcctccataaccatcaagagag

SEQ ID NO: 319722 - DNA, 38 bp, Artificial Sequence
  Description of Artificial Sequence: Synthetic oligonucleotide
tctcagtaatcttcatcctccataaccatcaagagagc

SEQ ID NO: 319723 - DNA, 37 bp, Artificial Sequence
  Description of Artificial Sequence: Synthetic oligonucleotide
ctcagtaatcttcatcctccataaccatcaagagagc

SEQ ID NO: 319724 - DNA, 40 bp, Artificial Sequence
  Description of Artificial Sequence: Synthetic oligonucleotide
tcagtaatcttcatcctccataaccatcaagagagctttc

SEQ ID NO: 319725 - DNA, 39 bp, Artificial Sequence
  Description of Artificial Sequence: Synthetic oligonucleotide
cagtaatcttcatcctccataaccatcaagagagctttc

SEQ ID NO: 319726 - DNA, 39 bp, Artificial Sequence
  Description of Artificial Sequence: Synthetic oligonucleotide
agtaatcttcatcctccataaccatcaagagagctttcc

SEQ ID NO: 319727 - DNA, 38 bp, Artificial Sequence
  Description of Artificial Sequence: Synthetic oligonucleotide
gtaatcttcatcctccataaccatcaagagagctttcc

SEQ ID NO: 319728 - DNA, 39 bp, Artificial Sequence
  Description of Artificial Sequence: Synthetic oligonucleotide
taatcttcatcctccataaccatcaagagagctttccag

SEQ ID NO: 319729 - DNA, 38 bp, Artificial Sequence
  Description of Artificial Sequence: Synthetic oligonucleotide
aatcttcatcctccataaccatcaagagagctttccag

SEQ ID NO: 319730 - DNA, 37 bp, Artificial Sequence
  Description of Artificial Sequence: Synthetic oligonucleotide
atcttcatcctccataaccatcaagagagctttccag

SEQ ID NO: 319731 - DNA, 36 bp, Artificial Sequence
  Description of Artificial Sequence: Synthetic oligonucleotide
tcttcatcctccataaccatcaagagagctttccag

SEQ ID NO: 319732 - DNA, 35 bp, Artificial Sequence
  Description of Artificial Sequence: Synthetic oligonucleotide
cttcatcctccataaccatcaagagagctttccag

SEQ ID NO: 319733 - DNA, 37 bp, Artificial Sequence
  Description of Artificial Sequence: Synthetic oligonucleotide
ttcatcctccataaccatcaagagagctttccagatg

SEQ ID NO: 319734 - DNA, 36 bp, Artificial Sequence
  Description of Artificial Sequence: Synthetic oligonucleotide
tcatcctccataaccatcaagagagctttccagatg

SEQ ID NO: 319735 - DNA, 35 bp, Artificial Sequence
  Description of Artificial Sequence: Synthetic oligonucleotide
catcctccataaccatcaagagagctttccagatg

SEQ ID NO: 319736 - DNA, 35 bp, Artificial Sequence
  Description of Artificial Sequence: Synthetic oligonucleotide
atcctccataaccatcaagagagctttccagatgg

SEQ ID NO: 319737 - DNA, 34 bp, Artificial Sequence
  Description of Artificial Sequence: Synthetic oligonucleotide
tcctccataaccatcaagagagctttccagatgg

SEQ ID NO: 319738 - DNA, 33 bp, Artificial Sequence
  Description of Artificial Sequence: Synthetic oligonucleotide
cctccataaccatcaagagagctttccagatgg

SEQ ID NO: 319739 - DNA, 33 bp, Artificial Sequence
  Description of Artificial Sequence: Synthetic oligonucleotide
ctccataaccatcaagagagctttccagatggc

SEQ ID NO: 319740 - DNA, 33 bp, Artificial Sequence
  Description of Artificial Sequence: Synthetic oligonucleotide
tccataaccatcaagagagctttccagatggcc

SEQ ID NO: 319741 - DNA, 32 bp, Artificial Sequence
  Description of Artificial Sequence: Synthetic oligonucleotide
ccataaccatcaagagagctttccagatggcc

SEQ ID NO: 319742 - DNA, 34 bp, Artificial Sequence
  Description of Artificial Sequence: Synthetic oligonucleotide
cataaccatcaagagagctttccagatggcctag

SEQ ID NO: 319743 - DNA, 34 bp, Artificial Sequence
  Description of Artificial Sequence: Synthetic oligonucleotide
ataaccatcaagagagctttccagatggcctagc

SEQ ID NO: 319744 - DNA, 33 bp, Artificial Sequence
  Description of Artificial Sequence: Synthetic oligonucleotide
taaccatcaagagagctttccagatggcctagc

SEQ ID NO: 319745 - DNA, 32 bp, Artificial Sequence
  Description of Artificial Sequence: Synthetic oligonucleotide
aaccatcaagagagctttccagatggcctagc

SEQ ID NO: 319746 - DNA, 31 bp, Artificial Sequence
  Description of Artificial Sequence: Synthetic oligonucleotide
accatcaagagagctttccagatggcctagc

SEQ ID NO: 319747 - DNA, 30 bp, Artificial Sequence
  Description of Artificial Sequence: Synthetic oligonucleotide
ccatcaagagagctttccagatggcctagc

SEQ ID NO: 319748 - DNA, 30 bp, Artificial Sequence
  Description of Artificial Sequence: Synthetic oligonucleotide
catcaagagagctttccagatggcctagcc

SEQ ID NO: 319749 - DNA, 30 bp, Artificial Sequence
  Description of Artificial Sequence: Synthetic oligonucleotide
atcaagagagctttccagatggcctagccc

SEQ ID NO: 319750 - DNA, 29 bp, Artificial Sequence
  Description of Artificial Sequence: Synthetic oligonucleotide
tcaagagagctttccagatggcctagccc

SEQ ID NO: 319751 - DNA, 28 bp, Artificial Sequence
  Description of Artificial Sequence: Synthetic oligonucleotide
caagagagctttccagatggcctagccc

SEQ ID NO: 319752 - DNA, 29 bp, Artificial Sequence
  Description of Artificial Sequence: Synthetic oligonucleotide
aagagagctttccagatggcctagccctg

SEQ ID NO: 319753 - DNA, 28 bp, Artificial Sequence
  Description of Artificial Sequence: Synthetic oligonucleotide
agagagctttccagatggcctagccctg

SEQ ID NO: 319754 - DNA, 27 bp, Artificial Sequence
  Description of Artificial Sequence: Synthetic oligonucleotide
gagagctttccagatggcctagccctg

SEQ ID NO: 319755 - DNA, 28 bp, Artificial Sequence
  Description of Artificial Sequence: Synthetic oligonucleotide
agagctttccagatggcctagccctgtc

SEQ ID NO: 319756 - DNA, 27 bp, Artificial Sequence
  Description of Artificial Sequence: Synthetic oligonucleotide
gagctttccagatggcctagccctgtc

SEQ ID NO: 319757 - DNA, 27 bp, Artificial Sequence
  Description of Artificial Sequence: Synthetic oligonucleotide
agctttccagatggcctagccctgtcg

SEQ ID NO: 319758 - DNA, 27 bp, Artificial Sequence
  Description of Artificial Sequence: Synthetic oligonucleotide
gctttccagatggcctagccctgtcga

SEQ ID NO: 319759 - DNA, 28 bp, Artificial Sequence
  Description of Artificial Sequence: Synthetic oligonucleotide
ctttccagatggcctagccctgtcgatg

SEQ ID NO: 319760 - DNA, 28 bp, Artificial Sequence
  Description of Artificial Sequence: Synthetic oligonucleotide
tttccagatggcctagccctgtcgatgc

SEQ ID NO: 319761 - DNA, 27 bp, Artificial Sequence
  Description of Artificial Sequence: Synthetic oligonucleotide
ttccagatggcctagccctgtcgatgc

SEQ ID NO: 319762 - DNA, 27 bp, Artificial Sequence
  Description of Artificial Sequence: Synthetic oligonucleotide
tccagatggcctagccctgtcgatgct

SEQ ID NO: 319763 - DNA, 26 bp, Artificial Sequence
  Description of Artificial Sequence: Synthetic oligonucleotide
ccagatggcctagccctgtcgatgct

SEQ ID NO: 319764 - DNA, 27 bp, Artificial Sequence
  Description of Artificial Sequence: Synthetic oligonucleotide
cagatggcctagccctgtcgatgctgt

SEQ ID NO: 319765 - DNA, 27 bp, Artificial Sequence
  Description of Artificial Sequence: Synthetic oligonucleotide
agatggcctagccctgtcgatgctgtg

SEQ ID NO: 319766 - DNA, 27 bp, Artificial Sequence
  Description of Artificial Sequence: Synthetic oligonucleotide
gatggcctagccctgtcgatgctgtgt

SEQ ID NO: 319767 - DNA, 27 bp, Artificial Sequence
  Description of Artificial Sequence: Synthetic oligonucleotide
atggcctagccctgtcgatgctgtgtc

SEQ ID NO: 319768 - DNA, 26 bp, Artificial Sequence
  Description of Artificial Sequence: Synthetic oligonucleotide
tggcctagccctgtcgatgctgtgtc

SEQ ID NO: 319769 - DNA, 25 bp, Artificial Sequence
  Description of Artificial Sequence: Synthetic oligonucleotide
ggcctagccctgtcgatgctgtgtc

SEQ ID NO: 319770 - DNA, 26 bp, Artificial Sequence
  Description of Artificial Sequence: Synthetic oligonucleotide
gcctagccctgtcgatgctgtgtcca

SEQ ID NO: 319771 - DNA, 27 bp, Artificial Sequence
  Description of Artificial Sequence: Synthetic oligonucleotide
cctagccctgtcgatgctgtgtccaca

SEQ ID NO: 319772 - DNA, 27 bp, Artificial Sequence
  Description of Artificial Sequence: Synthetic oligonucleotide
ctagccctgtcgatgctgtgtccacac

SEQ ID NO: 319773 - DNA, 27 bp, Artificial Sequence
  Description of Artificial Sequence: Synthetic oligonucleotide
tagccctgtcgatgctgtgtccacacc

SEQ ID NO: 319774 - DNA, 26 bp, Artificial Sequence
  Description of Artificial Sequence: Synthetic oligonucleotide
agccctgtcgatgctgtgtccacacc

SEQ ID NO: 319775 - DNA, 25 bp, Artificial Sequence
  Description of Artificial Sequence: Synthetic oligonucleotide
gccctgtcgatgctgtgtccacacc

SEQ ID NO: 319776 - DNA, 25 bp, Artificial Sequence
  Description of Artificial Sequence: Synthetic oligonucleotide
ccctgtcgatgctgtgtccacaccg

SEQ ID NO: 319777 - DNA, 25 bp, Artificial Sequence
  Description of Artificial Sequence: Synthetic oligonucleotide
cctgtcgatgctgtgtccacaccgc

SEQ ID NO: 319778 - DNA, 25 bp, Artificial Sequence
  Description of Artificial Sequence: Synthetic oligonucleotide
ctgtcgatgctgtgtccacaccgcc

SEQ ID NO: 319779 - DNA, 25 bp, Artificial Sequence
  Description of Artificial Sequence: Synthetic oligonucleotide
tgtcgatgctgtgtccacaccgccg

SEQ ID NO: 319780 - DNA, 24 bp, Artificial Sequence
  Description of Artificial Sequence: Synthetic oligonucleotide
gtcgatgctgtgtccacaccgccg

SEQ ID NO: 319781 - DNA, 24 bp, Artificial Sequence
  Description of Artificial Sequence: Synthetic oligonucleotide
tcgatgctgtgtccacaccgccgc

SEQ ID NO: 319782 - DNA, 23 bp, Artificial Sequence
  Description of Artificial Sequence: Synthetic oligonucleotide
cgatgctgtgtccacaccgccgc

SEQ ID NO: 319783 - DNA, 24 bp, Artificial Sequence
  Description of Artificial Sequence: Synthetic oligonucleotide
gatgctgtgtccacaccgccgcca

SEQ ID NO: 319784 - DNA, 24 bp, Artificial Sequence
  Description of Artificial Sequence: Synthetic oligonucleotide
atgctgtgtccacaccgccgccag

SEQ ID NO: 319785 - DNA, 23 bp, Artificial Sequence
  Description of Artificial Sequence: Synthetic oligonucleotide
tgctgtgtccacaccgccgccag

SEQ ID NO: 319786 - DNA, 22 bp, Artificial Sequence
  Description of Artificial Sequence: Synthetic oligonucleotide
gctgtgtccacaccgccgccag

SEQ ID NO: 319787 - DNA, 23 bp, Artificial Sequence
  Description of Artificial Sequence: Synthetic oligonucleotide
ctgtgtccacaccgccgccaggt

SEQ ID NO: 319788 - DNA, 24 bp, Artificial Sequence
  Description of Artificial Sequence: Synthetic oligonucleotide
tgtgtccacaccgccgccaggtga

SEQ ID NO: 319789 - DNA, 23 bp, Artificial Sequence
  Description of Artificial Sequence: Synthetic oligonucleotide
gtgtccacaccgccgccaggtga

SEQ ID NO: 319790 - DNA, 24 bp, Artificial Sequence
  Description of Artificial Sequence: Synthetic oligonucleotide
tgtccacaccgccgccaggtgaca

SEQ ID NO: 319791 - DNA, 23 bp, Artificial Sequence
  Description of Artificial Sequence: Synthetic oligonucleotide
gtccacaccgccgccaggtgaca

SEQ ID NO: 319792 - DNA, 23 bp, Artificial Sequence
  Description of Artificial Sequence: Synthetic oligonucleotide
tccacaccgccgccaggtgacac

SEQ ID NO: 319793 - DNA, 22 bp, Artificial Sequence
  Description of Artificial Sequence: Synthetic oligonucleotide
ccacaccgccgccaggtgacac

SEQ ID NO: 319794 - DNA, 22 bp, Artificial Sequence
  Description of Artificial Sequence: Synthetic oligonucleotide
cacaccgccgccaggtgacacc

SEQ ID NO: 319795 - DNA, 22 bp, Artificial Sequence
  Description of Artificial Sequence: Synthetic oligonucleotide
acaccgccgccaggtgacaccg

SEQ ID NO: 319796 - DNA, 21 bp, Artificial Sequence
  Description of Artificial Sequence: Synthetic oligonucleotide
caccgccgccaggtgacaccg

SEQ ID NO: 319797 - DNA, 21 bp, Artificial Sequence
  Description of Artificial Sequence: Synthetic oligonucleotide
accgccgccaggtgacaccgc

SEQ ID NO: 319798 - DNA, 20 bp, Artificial Sequence
  Description of Artificial Sequence: Synthetic oligonucleotide
ccgccgccaggtgacaccgc

SEQ ID NO: 319799 - DNA, 21 bp, Artificial Sequence
  Description of Artificial Sequence: Synthetic oligonucleotide
cgccgccaggtgacaccgcca

SEQ ID NO: 319800 - DNA, 22 bp, Artificial Sequence
  Description of Artificial Sequence: Synthetic oligonucleotide
gccgccaggtgacaccgccagt

SEQ ID NO: 319801 - DNA, 22 bp, Artificial Sequence
  Description of Artificial Sequence: Synthetic oligonucleotide
ccgccaggtgacaccgccagtg

SEQ ID NO: 319802 - DNA, 22 bp, Artificial Sequence
  Description of Artificial Sequence: Synthetic oligonucleotide
cgccaggtgacaccgccagtgg

SEQ ID NO: 319803 - DNA, 22 bp, Artificial Sequence
  Description of Artificial Sequence: Synthetic oligonucleotide
gccaggtgacaccgccagtggc

SEQ ID NO: 319804 - DNA, 24 bp, Artificial Sequence
  Description of Artificial Sequence: Synthetic oligonucleotide
ccaggtgacaccgccagtggcctt

SEQ ID NO: 319805 - DNA, 26 bp, Artificial Sequence
  Description of Artificial Sequence: Synthetic oligonucleotide
caggtgacaccgccagtggccttctt

SEQ ID NO: 319806 - DNA, 27 bp, Artificial Sequence
  Description of Artificial Sequence: Synthetic oligonucleotide
aggtgacaccgccagtggccttcttct

SEQ ID NO: 319807 - DNA, 26 bp, Artificial Sequence
  Description of Artificial Sequence: Synthetic oligonucleotide
ggtgacaccgccagtggccttcttct

SEQ ID NO: 319808 - DNA, 26 bp, Artificial Sequence
  Description of Artificial Sequence: Synthetic oligonucleotide
gtgacaccgccagtggccttcttctg

SEQ ID NO: 319809 - DNA, 26 bp, Artificial Sequence
  Description of Artificial Sequence: Synthetic oligonucleotide
tgacaccgccagtggccttcttctgc

SEQ ID NO: 319810 - DNA, 25 bp, Artificial Sequence
  Description of Artificial Sequence: Synthetic oligonucleotide
gacaccgccagtggccttcttctgc

SEQ ID NO: 319811 - DNA, 26 bp, Artificial Sequence
  Description of Artificial Sequence: Synthetic oligonucleotide
acaccgccagtggccttcttctgcca

SEQ ID NO: 319812 - DNA, 25 bp, Artificial Sequence
  Description of Artificial Sequence: Synthetic oligonucleotide
caccgccagtggccttcttctgcca

SEQ ID NO: 319813 - DNA, 25 bp, Artificial Sequence
  Description of Artificial Sequence: Synthetic oligonucleotide
accgccagtggccttcttctgccag

SEQ ID NO: 319814 - DNA, 24 bp, Artificial Sequence
  Description of Artificial Sequence: Synthetic oligonucleotide
ccgccagtggccttcttctgccag

SEQ ID NO: 319815 - DNA, 24 bp, Artificial Sequence
  Description of Artificial Sequence: Synthetic oligonucleotide
cgccagtggccttcttctgccagc

SEQ ID NO: 319816 - DNA, 24 bp, Artificial Sequence
  Description of Artificial Sequence: Synthetic oligonucleotide
gccagtggccttcttctgccagcc

SEQ ID NO: 319817 - DNA, 24 bp, Artificial Sequence
  Description of Artificial Sequence: Synthetic oligonucleotide
ccagtggccttcttctgccagccg

SEQ ID NO: 319818 - DNA, 24 bp, Artificial Sequence
  Description of Artificial Sequence: Synthetic oligonucleotide
cagtggccttcttctgccagccgg

SEQ ID NO: 319819 - DNA, 26 bp, Artificial Sequence
  Description of Artificial Sequence: Synthetic oligonucleotide
agtggccttcttctgccagccgggta

SEQ ID NO: 319820 - DNA, 25 bp, Artificial Sequence
  Description of Artificial Sequence: Synthetic oligonucleotide
gtggccttcttctgccagccgggta

SEQ ID NO: 319821 - DNA, 26 bp, Artificial Sequence
  Description of Artificial Sequence: Synthetic oligonucleotide
tggccttcttctgccagccgggtaca

SEQ ID NO: 319822 - DNA, 25 bp, Artificial Sequence
  Description of Artificial Sequence: Synthetic oligonucleotide
ggccttcttctgccagccgggtaca

SEQ ID NO: 319823 - DNA, 25 bp, Artificial Sequence
  Description of Artificial Sequence: Synthetic oligonucleotide
gccttcttctgccagccgggtacag

SEQ ID NO: 319824 - DNA, 25 bp, Artificial Sequence
  Description of Artificial Sequence: Synthetic oligonucleotide
ccttcttctgccagccgggtacagc

SEQ ID NO: 319825 - DNA, 27 bp, Artificial Sequence
  Description of Artificial Sequence: Synthetic oligonucleotide
cttcttctgccagccgggtacagcgat

SEQ ID NO: 319826 - DNA, 27 bp, Artificial Sequence
  Description of Artificial Sequence: Synthetic oligonucleotide
ttcttctgccagccgggtacagcgatg

SEQ ID NO: 319827 - DNA, 26 bp, Artificial Sequence
  Description of Artificial Sequence: Synthetic oligonucleotide
tcttctgccagccgggtacagcgatg

SEQ ID NO: 319828 - DNA, 25 bp, Artificial Sequence
  Description of Artificial Sequence: Synthetic oligonucleotide
cttctgccagccgggtacagcgatg

SEQ ID NO: 319829 - DNA, 25 bp, Artificial Sequence
  Description of Artificial Sequence: Synthetic oligonucleotide
ttctgccagccgggtacagcgatgg

SEQ ID NO: 319830 - DNA, 24 bp, Artificial Sequence
  Description of Artificial Sequence: Synthetic oligonucleotide
tctgccagccgggtacagcgatgg

SEQ ID NO: 319831 - DNA, 23 bp, Artificial Sequence
  Description of Artificial Sequence: Synthetic oligonucleotide
ctgccagccgggtacagcgatgg

SEQ ID NO: 319832 - DNA, 23 bp, Artificial Sequence
  Description of Artificial Sequence: Synthetic oligonucleotide
tgccagccgggtacagcgatggg

SEQ ID NO: 319833 - DNA, 22 bp, Artificial Sequence
  Description of Artificial Sequence: Synthetic oligonucleotide
gccagccgggtacagcgatggg

SEQ ID NO: 319834 - DNA, 22 bp, Artificial Sequence
  Description of Artificial Sequence: Synthetic oligonucleotide
ccagccgggtacagcgatgggc

SEQ ID NO: 319835 - DNA, 22 bp, Artificial Sequence
  Description of Artificial Sequence: Synthetic oligonucleotide
cagccgggtacagcgatgggcg

SEQ ID NO: 319836 - DNA, 22 bp, Artificial Sequence
  Description of Artificial Sequence: Synthetic oligonucleotide
agccgggtacagcgatgggcgc

SEQ ID NO: 319837 - DNA, 21 bp, Artificial Sequence
  Description of Artificial Sequence: Synthetic oligonucleotide
gccgggtacagcgatgggcgc

SEQ ID NO: 319838 - DNA, 23 bp, Artificial Sequence
  Description of Artificial Sequence: Synthetic oligonucleotide
ccgggtacagcgatgggcgccaa

SEQ ID NO: 319839 - DNA, 23 bp, Artificial Sequence
  Description of Artificial Sequence: Synthetic oligonucleotide
cgggtacagcgatgggcgccaac

SEQ ID NO: 319840 - DNA, 23 bp, Artificial Sequence
  Description of Artificial Sequence: Synthetic oligonucleotide
gggtacagcgatgggcgccaacg

SEQ ID NO: 319841 - DNA, 23 bp, Artificial Sequence
  Description of Artificial Sequence: Synthetic oligonucleotide
ggtacagcgatgggcgccaacgc

SEQ ID NO: 319842 - DNA, 24 bp, Artificial Sequence
  Description of Artificial Sequence: Synthetic oligonucleotide
gtacagcgatgggcgccaacgcct

SEQ ID NO: 319843 - DNA, 24 bp, Artificial Sequence
  Description of Artificial Sequence: Synthetic oligonucleotide
tacagcgatgggcgccaacgcctg

SEQ ID NO: 319844 - DNA, 23 bp, Artificial Sequence
  Description of Artificial Sequence: Synthetic oligonucleotide
acagcgatgggcgccaacgcctg

SEQ ID NO: 319845 - DNA, 22 bp, Artificial Sequence
  Description of Artificial Sequence: Synthetic oligonucleotide
cagcgatgggcgccaacgcctg

SEQ ID NO: 319846 - DNA, 23 bp, Artificial Sequence
  Description of Artificial Sequence: Synthetic oligonucleotide
agcgatgggcgccaacgcctgct

SEQ ID NO: 319847 - DNA, 22 bp, Artificial Sequence
  Description of Artificial Sequence: Synthetic oligonucleotide
gcgatgggcgccaacgcctgct

SEQ ID NO: 319848 - DNA, 24 bp, Artificial Sequence
  Description of Artificial Sequence: Synthetic oligonucleotide
cgatgggcgccaacgcctgctctt

SEQ ID NO: 319849 - DNA, 24 bp, Artificial Sequence
  Description of Artificial Sequence: Synthetic oligonucleotide
gatgggcgccaacgcctgctcttc

SEQ ID NO: 319850 - DNA, 25 bp, Artificial Sequence
  Description of Artificial Sequence: Synthetic oligonucleotide
atgggcgccaacgcctgctcttcct

SEQ ID NO: 319851 - DNA, 24 bp, Artificial Sequence
  Description of Artificial Sequence: Synthetic oligonucleotide
tgggcgccaacgcctgctcttcct

SEQ ID NO: 319852 - DNA, 23 bp, Artificial Sequence
  Description of Artificial Sequence: Synthetic oligonucleotide
gggcgccaacgcctgctcttcct

SEQ ID NO: 319853 - DNA, 24 bp, Artificial Sequence
  Description of Artificial Sequence: Synthetic oligonucleotide
ggcgccaacgcctgctcttcctga

SEQ ID NO: 319854 - DNA, 24 bp, Artificial Sequence
  Description of Artificial Sequence: Synthetic oligonucleotide
gcgccaacgcctgctcttcctgac

SEQ ID NO: 319855 - DNA, 24 bp, Artificial Sequence
  Description of Artificial Sequence: Synthetic oligonucleotide
cgccaacgcctgctcttcctgacc

SEQ ID NO: 319856 - DNA, 24 bp, Artificial Sequence
  Description of Artificial Sequence: Synthetic oligonucleotide
gccaacgcctgctcttcctgaccc

SEQ ID NO: 319857 - DNA, 25 bp, Artificial Sequence
  Description of Artificial Sequence: Synthetic oligonucleotide
ccaacgcctgctcttcctgacccca

SEQ ID NO: 319858 - DNA, 25 bp, Artificial Sequence
  Description of Artificial Sequence: Synthetic oligonucleotide
caacgcctgctcttcctgaccccag

SEQ ID NO: 319859 - DNA, 26 bp, Artificial Sequence
  Description of Artificial Sequence: Synthetic oligonucleotide
aacgcctgctcttcctgaccccagca

SEQ ID NO: 319860 - DNA, 25 bp, Artificial Sequence
  Description of Artificial Sequence: Synthetic oligonucleotide
acgcctgctcttcctgaccccagca

SEQ ID NO: 319861 - DNA, 24 bp, Artificial Sequence
  Description of Artificial Sequence: Synthetic oligonucleotide
cgcctgctcttcctgaccccagca

SEQ ID NO: 319862 - DNA, 24 bp, Artificial Sequence
  Description of Artificial Sequence: Synthetic oligonucleotide
gcctgctcttcctgaccccagcac

SEQ ID NO: 319863 - DNA, 24 bp, Artificial Sequence
  Description of Artificial Sequence: Synthetic oligonucleotide
cctgctcttcctgaccccagcacg

SEQ ID NO: 319864 - DNA, 25 bp, Artificial Sequence
  Description of Artificial Sequence: Synthetic oligonucleotide
ctgctcttcctgaccccagcacgct

SEQ ID NO: 319865 - DNA, 25 bp, Artificial Sequence
  Description of Artificial Sequence: Synthetic oligonucleotide
tgctcttcctgaccccagcacgctg

SEQ ID NO: 319866 - DNA, 24 bp, Artificial Sequence
  Description of Artificial Sequence: Synthetic oligonucleotide
gctcttcctgaccccagcacgctg

SEQ ID NO: 319867 - DNA, 26 bp, Artificial Sequence
  Description of Artificial Sequence: Synthetic oligonucleotide
ctcttcctgaccccagcacgctgctt

SEQ ID NO: 319868 - DNA, 26 bp, Artificial Sequence
  Description of Artificial Sequence: Synthetic oligonucleotide
tcttcctgaccccagcacgctgcttc

SEQ ID NO: 319869 - DNA, 25 bp, Artificial Sequence
  Description of Artificial Sequence: Synthetic oligonucleotide
cttcctgaccccagcacgctgcttc

SEQ ID NO: 319870 - DNA, 25 bp, Artificial Sequence
  Description of Artificial Sequence: Synthetic oligonucleotide
ttcctgaccccagcacgctgcttcc

SEQ ID NO: 319871 - DNA, 24 bp, Artificial Sequence
  Description of Artificial Sequence: Synthetic oligonucleotide
tcctgaccccagcacgctgcttcc

SEQ ID NO: 319872 - DNA, 23 bp, Artificial Sequence
  Description of Artificial Sequence: Synthetic oligonucleotide
cctgaccccagcacgctgcttcc

SEQ ID NO: 319873 - DNA, 24 bp, Artificial Sequence
  Description of Artificial Sequence: Synthetic oligonucleotide
ctgaccccagcacgctgcttccca

SEQ ID NO: 319874 - DNA, 25 bp, Artificial Sequence
  Description of Artificial Sequence: Synthetic oligonucleotide
tgaccccagcacgctgcttcccact

SEQ ID NO: 319875 - DNA, 24 bp, Artificial Sequence
  Description of Artificial Sequence: Synthetic oligonucleotide
gaccccagcacgctgcttcccact

SEQ ID NO: 319876 - DNA, 24 bp, Artificial Sequence
  Description of Artificial Sequence: Synthetic oligonucleotide
accccagcacgctgcttcccactc

SEQ ID NO: 319877 - DNA, 23 bp, Artificial Sequence
  Description of Artificial Sequence: Synthetic oligonucleotide
ccccagcacgctgcttcccactc

SEQ ID NO: 319878 - DNA, 23 bp, Artificial Sequence
  Description of Artificial Sequence: Synthetic oligonucleotide
cccagcacgctgcttcccactcc

SEQ ID NO: 319879 - DNA, 23 bp, Artificial Sequence
  Description of Artificial Sequence: Synthetic oligonucleotide
ccagcacgctgcttcccactccg

SEQ ID NO: 319880 - DNA, 23 bp, Artificial Sequence
  Description of Artificial Sequence: Synthetic oligonucleotide
cagcacgctgcttcccactccgg

SEQ ID NO: 319881 - DNA, 24 bp, Artificial Sequence
  Description of Artificial Sequence: Synthetic oligonucleotide
agcacgctgcttcccactccggca

SEQ ID NO: 319882 - DNA, 23 bp, Artificial Sequence
  Description of Artificial Sequence: Synthetic oligonucleotide
gcacgctgcttcccactccggca

SEQ ID NO: 319883 - DNA, 23 bp, Artificial Sequence
  Description of Artificial Sequence: Synthetic oligonucleotide
cacgctgcttcccactccggcac

SEQ ID NO: 319884 - DNA, 24 bp, Artificial Sequence
  Description of Artificial Sequence: Synthetic oligonucleotide
acgctgcttcccactccggcacgt

SEQ ID NO: 319885 - DNA, 23 bp, Artificial Sequence
  Description of Artificial Sequence: Synthetic oligonucleotide
cgctgcttcccactccggcacgt

SEQ ID NO: 319886 - DNA, 23 bp, Artificial Sequence
  Description of Artificial Sequence: Synthetic oligonucleotide
gctgcttcccactccggcacgtg

SEQ ID NO: 319887 - DNA, 24 bp, Artificial Sequence
  Description of Artificial Sequence: Synthetic oligonucleotide
ctgcttcccactccggcacgtgga

SEQ ID NO: 319888 - DNA, 25 bp, Artificial Sequence
  Description of Artificial Sequence: Synthetic oligonucleotide
tgcttcccactccggcacgtggact

SEQ ID NO: 319889 - DNA, 24 bp, Artificial Sequence
  Description of Artificial Sequence: Synthetic oligonucleotide
gcttcccactccggcacgtggact

SEQ ID NO: 319890 - DNA, 25 bp, Artificial Sequence
  Description of Artificial Sequence: Synthetic oligonucleotide
cttcccactccggcacgtggactgt

SEQ ID NO: 319891 - DNA, 27 bp, Artificial Sequence
  Description of Artificial Sequence: Synthetic oligonucleotide
ttcccactccggcacgtggactgtcaa

SEQ ID NO: 319892 - DNA, 26 bp, Artificial Sequence
  Description of Artificial Sequence: Synthetic oligonucleotide
tcccactccggcacgtggactgtcaa

SEQ ID NO: 319893 - DNA, 25 bp, Artificial Sequence
  Description of Artificial Sequence: Synthetic oligonucleotide
cccactccggcacgtggactgtcaa

SEQ ID NO: 319894 - DNA, 25 bp, Artificial Sequence
  Description of Artificial Sequence: Synthetic oligonucleotide
ccactccggcacgtggactgtcaac

SEQ ID NO: 319895 - DNA, 25 bp, Artificial Sequence
  Description of Artificial Sequence: Synthetic oligonucleotide
cactccggcacgtggactgtcaacc

SEQ ID NO: 319896 - DNA, 25 bp, Artificial Sequence
  Description of Artificial Sequence: Synthetic oligonucleotide
actccggcacgtggactgtcaaccc

SEQ ID NO: 319897 - DNA, 24 bp, Artificial Sequence
  Description of Artificial Sequence: Synthetic oligonucleotide
ctccggcacgtggactgtcaaccc

SEQ ID NO: 319898 - DNA, 27 bp, Artificial Sequence
  Description of Artificial Sequence: Synthetic oligonucleotide
tccggcacgtggactgtcaaccccaat

SEQ ID NO: 319899 - DNA, 26 bp, Artificial Sequence
  Description of Artificial Sequence: Synthetic oligonucleotide
ccggcacgtggactgtcaaccccaat

SEQ ID NO: 319900 - DNA, 26 bp, Artificial Sequence
  Description of Artificial Sequence: Synthetic oligonucleotide
cggcacgtggactgtcaaccccaatg

SEQ ID NO: 319901 - DNA, 26 bp, Artificial Sequence
  Description of Artificial Sequence: Synthetic oligonucleotide
ggcacgtggactgtcaaccccaatgc

SEQ ID NO: 319902 - DNA, 26 bp, Artificial Sequence
  Description of Artificial Sequence: Synthetic oligonucleotide
gcacgtggactgtcaaccccaatgcc

SEQ ID NO: 319903 - DNA, 26 bp, Artificial Sequence
  Description of Artificial Sequence: Synthetic oligonucleotide
cacgtggactgtcaaccccaatgccc

SEQ ID NO: 319904 - DNA, 26 bp, Artificial Sequence
  Description of Artificial Sequence: Synthetic oligonucleotide
acgtggactgtcaaccccaatgcccg

SEQ ID NO: 319905 - DNA, 25 bp, Artificial Sequence
  Description of Artificial Sequence: Synthetic oligonucleotide
cgtggactgtcaaccccaatgcccg

SEQ ID NO: 319906 - DNA, 27 bp, Artificial Sequence
  Description of Artificial Sequence: Synthetic oligonucleotide
gtggactgtcaaccccaatgcccggtt

SEQ ID NO: 319907 - DNA, 28 bp, Artificial Sequence
  Description of Artificial Sequence: Synthetic oligonucleotide
tggactgtcaaccccaatgcccggtttg

SEQ ID NO: 319908 - DNA, 27 bp, Artificial Sequence
  Description of Artificial Sequence: Synthetic oligonucleotide
ggactgtcaaccccaatgcccggtttg

SEQ ID NO: 319909 - DNA, 27 bp, Artificial Sequence
  Description of Artificial Sequence: Synthetic oligonucleotide
gactgtcaaccccaatgcccggtttgg

SEQ ID NO: 319910 - DNA, 31 bp, Artificial Sequence
  Description of Artificial Sequence: Synthetic oligonucleotide
actgtcaaccccaatgcccggtttggaaatc

SEQ ID NO: 319911 - DNA, 30 bp, Artificial Sequence
  Description of Artificial Sequence: Synthetic oligonucleotide
ctgtcaaccccaatgcccggtttggaaatc

SEQ ID NO: 319912 - DNA, 31 bp, Artificial Sequence
  Description of Artificial Sequence: Synthetic oligonucleotide
tgtcaaccccaatgcccggtttggaaatcag

SEQ ID NO: 319913 - DNA, 30 bp, Artificial Sequence
  Description of Artificial Sequence: Synthetic oligonucleotide
gtcaaccccaatgcccggtttggaaatcag

SEQ ID NO: 319914 - DNA, 32 bp, Artificial Sequence
  Description of Artificial Sequence: Synthetic oligonucleotide
tcaaccccaatgcccggtttggaaatcagatg

SEQ ID NO: 319915 - DNA, 31 bp, Artificial Sequence
  Description of Artificial Sequence: Synthetic oligonucleotide
caaccccaatgcccggtttggaaatcagatg

SEQ ID NO: 319916 - DNA, 31 bp, Artificial Sequence
  Description of Artificial Sequence: Synthetic oligonucleotide
aaccccaatgcccggtttggaaatcagatgc

SEQ ID NO: 319917 - DNA, 30 bp, Artificial Sequence
  Description of Artificial Sequence: Synthetic oligonucleotide
accccaatgcccggtttggaaatcagatgc

SEQ ID NO: 319918 - DNA, 29 bp, Artificial Sequence
  Description of Artificial Sequence: Synthetic oligonucleotide
ccccaatgcccggtttggaaatcagatgc

SEQ ID NO: 319919 - DNA, 29 bp, Artificial Sequence
  Description of Artificial Sequence: Synthetic oligonucleotide
cccaatgcccggtttggaaatcagatgcg

SEQ ID NO: 319920 - DNA, 30 bp, Artificial Sequence
  Description of Artificial Sequence: Synthetic oligonucleotide
ccaatgcccggtttggaaatcagatgcgac

SEQ ID NO: 319921 - DNA, 31 bp, Artificial Sequence
  Description of Artificial Sequence: Synthetic oligonucleotide
caatgcccggtttggaaatcagatgcgacag

SEQ ID NO: 319922 - DNA, 34 bp, Artificial Sequence
  Description of Artificial Sequence: Synthetic oligonucleotide
aatgcccggtttggaaatcagatgcgacagtatg

SEQ ID NO: 319923 - DNA, 33 bp, Artificial Sequence
  Description of Artificial Sequence: Synthetic oligonucleotide
atgcccggtttggaaatcagatgcgacagtatg

SEQ ID NO: 319924 - DNA, 32 bp, Artificial Sequence
  Description of Artificial Sequence: Synthetic oligonucleotide
tgcccggtttggaaatcagatgcgacagtatg

SEQ ID NO: 319925 - DNA, 31 bp, Artificial Sequence
  Description of Artificial Sequence: Synthetic oligonucleotide
gcccggtttggaaatcagatgcgacagtatg

SEQ ID NO: 319926 - DNA, 31 bp, Artificial Sequence
  Description of Artificial Sequence: Synthetic oligonucleotide
cccggtttggaaatcagatgcgacagtatgg

SEQ ID NO: 319927 - DNA, 31 bp, Artificial Sequence
  Description of Artificial Sequence: Synthetic oligonucleotide
ccggtttggaaatcagatgcgacagtatggc

SEQ ID NO: 319928 - DNA, 32 bp, Artificial Sequence
  Description of Artificial Sequence: Synthetic oligonucleotide
cggtttggaaatcagatgcgacagtatggcac

SEQ ID NO: 319929 - DNA, 32 bp, Artificial Sequence
  Description of Artificial Sequence: Synthetic oligonucleotide
ggtttggaaatcagatgcgacagtatggcacg

SEQ ID NO: 319930 - DNA, 32 bp, Artificial Sequence
  Description of Artificial Sequence: Synthetic oligonucleotide
gtttggaaatcagatgcgacagtatggcacgc

SEQ ID NO: 319931 - DNA, 33 bp, Artificial Sequence
  Description of Artificial Sequence: Synthetic oligonucleotide
tttggaaatcagatgcgacagtatggcacgctg

SEQ ID NO: 319932 - DNA, 32 bp, Artificial Sequence
  Description of Artificial Sequence: Synthetic oligonucleotide
ttggaaatcagatgcgacagtatggcacgctg

SEQ ID NO: 319933 - DNA, 31 bp, Artificial Sequence
  Description of Artificial Sequence: Synthetic oligonucleotide
tggaaatcagatgcgacagtatggcacgctg

SEQ ID NO: 319934 - DNA, 30 bp, Artificial Sequence
  Description of Artificial Sequence: Synthetic oligonucleotide
ggaaatcagatgcgacagtatggcacgctg

SEQ ID NO: 319935 - DNA, 30 bp, Artificial Sequence
  Description of Artificial Sequence: Synthetic oligonucleotide
gaaatcagatgcgacagtatggcacgctgc

SEQ ID NO: 319936 - DNA, 31 bp, Artificial Sequence
  Description of Artificial Sequence: Synthetic oligonucleotide
aaatcagatgcgacagtatggcacgctgctc

SEQ ID NO: 319937 - DNA, 30 bp, Artificial Sequence
  Description of Artificial Sequence: Synthetic oligonucleotide
aatcagatgcgacagtatggcacgctgctc

SEQ ID NO: 319938 - DNA, 29 bp, Artificial Sequence
  Description of Artificial Sequence: Synthetic oligonucleotide
atcagatgcgacagtatggcacgctgctc

SEQ ID NO: 319939 - DNA, 28 bp, Artificial Sequence
  Description of Artificial Sequence: Synthetic oligonucleotide
tcagatgcgacagtatggcacgctgctc

SEQ ID NO: 319940 - DNA, 27 bp, Artificial Sequence
  Description of Artificial Sequence: Synthetic oligonucleotide
cagatgcgacagtatggcacgctgctc

SEQ ID NO: 319941 - DNA, 27 bp, Artificial Sequence
  Description of Artificial Sequence: Synthetic oligonucleotide
agatgcgacagtatggcacgctgctcg

SEQ ID NO: 319942 - DNA, 26 bp, Artificial Sequence
  Description of Artificial Sequence: Synthetic oligonucleotide
gatgcgacagtatggcacgctgctcg

SEQ ID NO: 319943 - DNA, 27 bp, Artificial Sequence
  Description of Artificial Sequence: Synthetic oligonucleotide
atgcgacagtatggcacgctgctcgct

SEQ ID NO: 319944 - DNA, 26 bp, Artificial Sequence
  Description of Artificial Sequence: Synthetic oligonucleotide
tgcgacagtatggcacgctgctcgct

SEQ ID NO: 319945 - DNA, 25 bp, Artificial Sequence
  Description of Artificial Sequence: Synthetic oligonucleotide
gcgacagtatggcacgctgctcgct

SEQ ID NO: 319946 - DNA, 26 bp, Artificial Sequence
  Description of Artificial Sequence: Synthetic oligonucleotide
cgacagtatggcacgctgctcgctct

SEQ ID NO: 319947 - DNA, 26 bp, Artificial Sequence
  Description of Artificial Sequence: Synthetic oligonucleotide
gacagtatggcacgctgctcgctctg

SEQ ID NO: 319948 - DNA, 26 bp, Artificial Sequence
  Description of Artificial Sequence: Synthetic oligonucleotide
acagtatggcacgctgctcgctctgg

SEQ ID NO: 319949 - DNA, 25 bp, Artificial Sequence
  Description of Artificial Sequence: Synthetic oligonucleotide
cagtatggcacgctgctcgctctgg

SEQ ID NO: 319950 - DNA, 25 bp, Artificial Sequence
  Description of Artificial Sequence: Synthetic oligonucleotide
agtatggcacgctgctcgctctggc

SEQ ID NO: 319951 - DNA, 24 bp, Artificial Sequence
  Description of Artificial Sequence: Synthetic oligonucleotide
gtatggcacgctgctcgctctggc

SEQ ID NO: 319952 - DNA, 24 bp, Artificial Sequence
  Description of Artificial Sequence: Synthetic oligonucleotide
tatggcacgctgctcgctctggcc

SEQ ID NO: 319953 - DNA, 23 bp, Artificial Sequence
  Description of Artificial Sequence: Synthetic oligonucleotide
atggcacgctgctcgctctggcc

SEQ ID NO: 319954 - DNA, 22 bp, Artificial Sequence
  Description of Artificial Sequence: Synthetic oligonucleotide
tggcacgctgctcgctctggcc

SEQ ID NO: 319955 - DNA, 21 bp, Artificial Sequence
  Description of Artificial Sequence: Synthetic oligonucleotide
ggcacgctgctcgctctggcc

SEQ ID NO: 319956 - DNA, 22 bp, Artificial Sequence
  Description of Artificial Sequence: Synthetic oligonucleotide
gcacgctgctcgctctggccga

SEQ ID NO: 319957 - DNA, 22 bp, Artificial Sequence
  Description of Artificial Sequence: Synthetic oligonucleotide
cacgctgctcgctctggccgag

SEQ ID NO: 319958 - DNA, 23 bp, Artificial Sequence
  Description of Artificial Sequence: Synthetic oligonucleotide
acgctgctcgctctggccgagct

SEQ ID NO: 319959 - DNA, 22 bp, Artificial Sequence
  Description of Artificial Sequence: Synthetic oligonucleotide
cgctgctcgctctggccgagct

SEQ ID NO: 319960 - DNA, 24 bp, Artificial Sequence
  Description of Artificial Sequence: Synthetic oligonucleotide
gctgctcgctctggccgagctcaa

SEQ ID NO: 319961 - DNA, 24 bp, Artificial Sequence
  Description of Artificial Sequence: Synthetic oligonucleotide
ctgctcgctctggccgagctcaac

SEQ ID NO: 319962 - DNA, 24 bp, Artificial Sequence
  Description of Artificial Sequence: Synthetic oligonucleotide
tgctcgctctggccgagctcaacg

SEQ ID NO: 319963 - DNA, 23 bp, Artificial Sequence
  Description of Artificial Sequence: Synthetic oligonucleotide
gctcgctctggccgagctcaacg

SEQ ID NO: 319964 - DNA, 23 bp, Artificial Sequence
  Description of Artificial Sequence: Synthetic oligonucleotide
ctcgctctggccgagctcaacgc

SEQ ID NO: 319965 - DNA, 23 bp, Artificial Sequence
  Description of Artificial Sequence: Synthetic oligonucleotide
tcgctctggccgagctcaacgcc

SEQ ID NO: 319966 - DNA, 22 bp, Artificial Sequence
  Description of Artificial Sequence: Synthetic oligonucleotide
cgctctggccgagctcaacgcc

SEQ ID NO: 319967 - DNA, 22 bp, Artificial Sequence
  Description of Artificial Sequence: Synthetic oligonucleotide
gctctggccgagctcaacgccc

SEQ ID NO: 319968 - DNA, 22 bp, Artificial Sequence
  Description of Artificial Sequence: Synthetic oligonucleotide
ctctggccgagctcaacgcccg

SEQ ID NO: 319969 - DNA, 22 bp, Artificial Sequence
  Description of Artificial Sequence: Synthetic oligonucleotide
tctggccgagctcaacgcccgc

SEQ ID NO: 319970 - DNA, 21 bp, Artificial Sequence
  Description of Artificial Sequence: Synthetic oligonucleotide
ctggccgagctcaacgcccgc

SEQ ID NO: 319971 - DNA, 21 bp, Artificial Sequence
  Description of Artificial Sequence: Synthetic oligonucleotide
tggccgagctcaacgcccgcc

SEQ ID NO: 319972 - DNA, 20 bp, Artificial Sequence
  Description of Artificial Sequence: Synthetic oligonucleotide
ggccgagctcaacgcccgcc

SEQ ID NO: 319973 - DNA, 20 bp, Artificial Sequence
  Description of Artificial Sequence: Synthetic oligonucleotide
gccgagctcaacgcccgccg

SEQ ID NO: 319974 - DNA, 20 bp, Artificial Sequence
  Description of Artificial Sequence: Synthetic oligonucleotide
ccgagctcaacgcccgccgg

SEQ ID NO: 319975 - DNA, 20 bp, Artificial Sequence
  Description of Artificial Sequence: Synthetic oligonucleotide
cgagctcaacgcccgccggg

SEQ ID NO: 319976 - DNA, 20 bp, Artificial Sequence
  Description of Artificial Sequence: Synthetic oligonucleotide
gagctcaacgcccgccgggc

SEQ ID NO: 319977 - DNA, 25 bp, Artificial Sequence
  Description of Artificial Sequence: Synthetic oligonucleotide
agctcaacgcccgccgggcgtttat

SEQ ID NO: 319978 - DNA, 24 bp, Artificial Sequence
  Description of Artificial Sequence: Synthetic oligonucleotide
gctcaacgcccgccgggcgtttat

SEQ ID NO: 319979 - DNA, 24 bp, Artificial Sequence
  Description of Artificial Sequence: Synthetic oligonucleotide
ctcaacgcccgccgggcgtttatc

SEQ ID NO: 319980 - DNA, 25 bp, Artificial Sequence
  Description of Artificial Sequence: Synthetic oligonucleotide
tcaacgcccgccgggcgtttatcct

SEQ ID NO: 319981 - DNA, 24 bp, Artificial Sequence
  Description of Artificial Sequence: Synthetic oligonucleotide
caacgcccgccgggcgtttatcct

SEQ ID NO: 319982 - DNA, 24 bp, Artificial Sequence
  Description of Artificial Sequence: Synthetic oligonucleotide
aacgcccgccgggcgtttatcctg

SEQ ID NO: 319983 - DNA, 23 bp, Artificial Sequence
  Description of Artificial Sequence: Synthetic oligonucleotide
acgcccgccgggcgtttatcctg

SEQ ID NO: 319984 - DNA, 22 bp, Artificial Sequence
  Description of Artificial Sequence: Synthetic oligonucleotide
cgcccgccgggcgtttatcctg

SEQ ID NO: 319985 - DNA, 22 bp, Artificial Sequence
  Description of Artificial Sequence: Synthetic oligonucleotide
gcccgccgggcgtttatcctgg

SEQ ID NO: 319986 - DNA, 23 bp, Artificial Sequence
  Description of Artificial Sequence: Synthetic oligonucleotide
cccgccgggcgtttatcctggct

SEQ ID NO: 319987 - DNA, 23 bp, Artificial Sequence
  Description of Artificial Sequence: Synthetic oligonucleotide
ccgccgggcgtttatcctggctg

SEQ ID NO: 319988 - DNA, 23 bp, Artificial Sequence
  Description of Artificial Sequence: Synthetic oligonucleotide
cgccgggcgtttatcctggctgc

SEQ ID NO: 319989 - DNA, 25 bp, Artificial Sequence
  Description of Artificial Sequence: Synthetic oligonucleotide
gccgggcgtttatcctggctgccat

SEQ ID NO: 319990 - DNA, 25 bp, Artificial Sequence
  Description of Artificial Sequence: Synthetic oligonucleotide
ccgggcgtttatcctggctgccatg

SEQ ID NO: 319991 - DNA, 27 bp, Artificial Sequence
  Description of Artificial Sequence: Synthetic oligonucleotide
cgggcgtttatcctggctgccatgctt

SEQ ID NO: 319992 - DNA, 27 bp, Artificial Sequence
  Description of Artificial Sequence: Synthetic oligonucleotide
gggcgtttatcctggctgccatgcttg

SEQ ID NO: 319993 - DNA, 27 bp, Artificial Sequence
  Description of Artificial Sequence: Synthetic oligonucleotide
ggcgtttatcctggctgccatgcttgc

SEQ ID NO: 319994 - DNA, 27 bp, Artificial Sequence
  Description of Artificial Sequence: Synthetic oligonucleotide
gcgtttatcctggctgccatgcttgcc

SEQ ID NO: 319995 - DNA, 27 bp, Artificial Sequence
  Description of Artificial Sequence: Synthetic oligonucleotide
cgtttatcctggctgccatgcttgccg

SEQ ID NO: 319996 - DNA, 27 bp, Artificial Sequence
  Description of Artificial Sequence: Synthetic oligonucleotide
gtttatcctggctgccatgcttgccgc

SEQ ID NO: 319997 - DNA, 27 bp, Artificial Sequence
  Description of Artificial Sequence: Synthetic oligonucleotide
tttatcctggctgccatgcttgccgcc

SEQ ID NO: 319998 - DNA, 26 bp, Artificial Sequence
  Description of Artificial Sequence: Synthetic oligonucleotide
ttatcctggctgccatgcttgccgcc

SEQ ID NO: 319999 - DNA, 25 bp, Artificial Sequence
  Description of Artificial Sequence: Synthetic oligonucleotide
tatcctggctgccatgcttgccgcc

SEQ ID NO: 320000 - DNA, 24 bp, Artificial Sequence
  Description of Artificial Sequence: Synthetic oligonucleotide
atcctggctgccatgcttgccgcc

SEQ ID NO: 320001 - DNA, 23 bp, Artificial Sequence
  Description of Artificial Sequence: Synthetic oligonucleotide
tcctggctgccatgcttgccgcc

SEQ ID NO: 320002 - DNA, 22 bp, Artificial Sequence
  Description of Artificial Sequence: Synthetic oligonucleotide
cctggctgccatgcttgccgcc

SEQ ID NO: 320003 - DNA, 23 bp, Artificial Sequence
  Description of Artificial Sequence: Synthetic oligonucleotide
ctggctgccatgcttgccgccct

SEQ ID NO: 320004 - DNA, 23 bp, Artificial Sequence
  Description of Artificial Sequence: Synthetic oligonucleotide
tggctgccatgcttgccgccctc

SEQ ID NO: 320005 - DNA, 22 bp, Artificial Sequence
  Description of Artificial Sequence: Synthetic oligonucleotide
ggctgccatgcttgccgccctc

SEQ ID NO: 320006 - DNA, 22 bp, Artificial Sequence
  Description of Artificial Sequence: Synthetic oligonucleotide
gctgccatgcttgccgccctcg

SEQ ID NO: 320007 - DNA, 22 bp, Artificial Sequence
  Description of Artificial Sequence: Synthetic oligonucleotide
ctgccatgcttgccgccctcgc

SEQ ID NO: 320008 - DNA, 22 bp, Artificial Sequence
  Description of Artificial Sequence: Synthetic oligonucleotide
tgccatgcttgccgccctcgcc

SEQ ID NO: 320009 - DNA, 21 bp, Artificial Sequence
  Description of Artificial Sequence: Synthetic oligonucleotide
gccatgcttgccgccctcgcc

SEQ ID NO: 320010 - DNA, 21 bp, Artificial Sequence
  Description of Artificial Sequence: Synthetic oligonucleotide
ccatgcttgccgccctcgccc

SEQ ID NO: 320011 - DNA, 21 bp, Artificial Sequence
  Description of Artificial Sequence: Synthetic oligonucleotide
catgcttgccgccctcgcccc

SEQ ID NO: 320012 - DNA, 21 bp, Artificial Sequence
  Description of Artificial Sequence: Synthetic oligonucleotide
atgcttgccgccctcgccccg

SEQ ID NO: 320013 - DNA, 20 bp, Artificial Sequence
  Description of Artificial Sequence: Synthetic oligonucleotide
tgcttgccgccctcgccccg

SEQ ID NO: 320014 - DNA, 20 bp, Artificial Sequence
  Description of Artificial Sequence: Synthetic oligonucleotide
gcttgccgccctcgccccgt

SEQ ID NO: 320015 - DNA, 23 bp, Artificial Sequence
  Description of Artificial Sequence: Synthetic oligonucleotide
cttgccgccctcgccccggtaat

SEQ ID NO: 320016 - DNA, 23 bp, Artificial Sequence
  Description of Artificial Sequence: Synthetic oligonucleotide
ttgccgccctcgccccggtaatc

SEQ ID NO: 320017 - DNA, 22 bp, Artificial Sequence
  Description of Artificial Sequence: Synthetic oligonucleotide
tgccgccctcgccccggtaatc

SEQ ID NO: 320018 - DNA, 21 bp, Artificial Sequence
  Description of Artificial Sequence: Synthetic oligonucleotide
gccgccctcgccccggtaatc

SEQ ID NO: 320019 - DNA, 21 bp, Artificial Sequence
  Description of Artificial Sequence: Synthetic oligonucleotide
ccgccctcgccccggtaatcc

SEQ ID NO: 320020 - DNA, 21 bp, Artificial Sequence
  Description of Artificial Sequence: Synthetic oligonucleotide
cgccctcgccccggtaatccg

SEQ ID NO: 320021 - DNA, 23 bp, Artificial Sequence
  Description of Artificial Sequence: Synthetic oligonucleotide
gccctcgccccggtaatccgcat

SEQ ID NO: 320022 - DNA, 24 bp, Artificial Sequence
  Description of Artificial Sequence: Synthetic oligonucleotide
ccctcgccccggtaatccgcatca

SEQ ID NO: 320023 - DNA, 24 bp, Artificial Sequence
  Description of Artificial Sequence: Synthetic oligonucleotide
cctcgccccggtaatccgcatcag

SEQ ID NO: 320024 - DNA, 24 bp, Artificial Sequence
  Description of Artificial Sequence: Synthetic oligonucleotide
ctcgccccggtaatccgcatcagc

SEQ ID NO: 320025 - DNA, 25 bp, Artificial Sequence
  Description of Artificial Sequence: Synthetic oligonucleotide
tcgccccggtaatccgcatcagcct

SEQ ID NO: 320026 - DNA, 24 bp, Artificial Sequence
  Description of Artificial Sequence: Synthetic oligonucleotide
cgccccggtaatccgcatcagcct

SEQ ID NO: 320027 - DNA, 24 bp, Artificial Sequence
  Description of Artificial Sequence: Synthetic oligonucleotide
gccccggtaatccgcatcagcctg

SEQ ID NO: 320028 - DNA, 24 bp, Artificial Sequence
  Description of Artificial Sequence: Synthetic oligonucleotide
ccccggtaatccgcatcagcctgc

SEQ ID NO: 320029 - DNA, 24 bp, Artificial Sequence
  Description of Artificial Sequence: Synthetic oligonucleotide
cccggtaatccgcatcagcctgcc

SEQ ID NO: 320030 - DNA, 24 bp, Artificial Sequence
  Description of Artificial Sequence: Synthetic oligonucleotide
ccggtaatccgcatcagcctgccc

SEQ ID NO: 320031 - DNA, 25 bp, Artificial Sequence
  Description of Artificial Sequence: Synthetic oligonucleotide
cggtaatccgcatcagcctgcccgt

SEQ ID NO: 320032 - DNA, 25 bp, Artificial Sequence
  Description of Artificial Sequence: Synthetic oligonucleotide
ggtaatccgcatcagcctgcccgtc

SEQ ID NO: 320033 - DNA, 26 bp, Artificial Sequence
  Description of Artificial Sequence: Synthetic oligonucleotide
gtaatccgcatcagcctgcccgtcct

SEQ ID NO: 320034 - DNA, 26 bp, Artificial Sequence
  Description of Artificial Sequence: Synthetic oligonucleotide
taatccgcatcagcctgcccgtcctg

SEQ ID NO: 320035 - DNA, 25 bp, Artificial Sequence
  Description of Artificial Sequence: Synthetic oligonucleotide
aatccgcatcagcctgcccgtcctg

SEQ ID NO: 320036 - DNA, 24 bp, Artificial Sequence
  Description of Artificial Sequence: Synthetic oligonucleotide
atccgcatcagcctgcccgtcctg

SEQ ID NO: 320037 - DNA, 23 bp, Artificial Sequence
  Description of Artificial Sequence: Synthetic oligonucleotide
tccgcatcagcctgcccgtcctg

SEQ ID NO: 320038 - DNA, 22 bp, Artificial Sequence
  Description of Artificial Sequence: Synthetic oligonucleotide
ccgcatcagcctgcccgtcctg

SEQ ID NO: 320039 - DNA, 22 bp, Artificial Sequence
  Description of Artificial Sequence: Synthetic oligonucleotide
cgcatcagcctgcccgtcctgg

SEQ ID NO: 320040 - DNA, 22 bp, Artificial Sequence
  Description of Artificial Sequence: Synthetic oligonucleotide
gcatcagcctgcccgtcctggc

SEQ ID NO: 320041 - DNA, 22 bp, Artificial Sequence
  Description of Artificial Sequence: Synthetic oligonucleotide
catcagcctgcccgtcctggcc

SEQ ID NO: 320042 - DNA, 22 bp, Artificial Sequence
  Description of Artificial Sequence: Synthetic oligonucleotide
atcagcctgcccgtcctggccc

SEQ ID NO: 320043 - DNA, 21 bp, Artificial Sequence
  Description of Artificial Sequence: Synthetic oligonucleotide
tcagcctgcccgtcctggccc

SEQ ID NO: 320044 - DNA, 20 bp, Artificial Sequence
  Description of Artificial Sequence: Synthetic oligonucleotide
cagcctgcccgtcctggccc

SEQ ID NO: 320045 - DNA, 21 bp, Artificial Sequence
  Description of Artificial Sequence: Synthetic oligonucleotide
agcctgcccgtcctggcccca

SEQ ID NO: 320046 - DNA, 20 bp, Artificial Sequence
  Description of Artificial Sequence: Synthetic oligonucleotide
gcctgcccgtcctggcccca

SEQ ID NO: 320047 - DNA, 22 bp, Artificial Sequence
  Description of Artificial Sequence: Synthetic oligonucleotide
cctgcccgtcctggccccacaa

SEQ ID NO: 320048 - DNA, 23 bp, Artificial Sequence
  Description of Artificial Sequence: Synthetic oligonucleotide
ctgcccgtcctggccccacaagt

SEQ ID NO: 320049 - DNA, 23 bp, Artificial Sequence
  Description of Artificial Sequence: Synthetic oligonucleotide
tgcccgtcctggccccacaagtg

SEQ ID NO: 320050 - DNA, 22 bp, Artificial Sequence
  Description of Artificial Sequence: Synthetic oligonucleotide
gcccgtcctggccccacaagtg

SEQ ID NO: 320051 - DNA, 23 bp, Artificial Sequence
  Description of Artificial Sequence: Synthetic oligonucleotide
cccgtcctggccccacaagtgga

SEQ ID NO: 320052 - DNA, 24 bp, Artificial Sequence
  Description of Artificial Sequence: Synthetic oligonucleotide
ccgtcctggccccacaagtggaca

SEQ ID NO: 320053 - DNA, 24 bp, Artificial Sequence
  Description of Artificial Sequence: Synthetic oligonucleotide
cgtcctggccccacaagtggacac

SEQ ID NO: 320054 - DNA, 24 bp, Artificial Sequence
  Description of Artificial Sequence: Synthetic oligonucleotide
gtcctggccccacaagtggacacc

SEQ ID NO: 320055 - DNA, 24 bp, Artificial Sequence
  Description of Artificial Sequence: Synthetic oligonucleotide
tcctggccccacaagtggacaccc

SEQ ID NO: 320056 - DNA, 23 bp, Artificial Sequence
  Description of Artificial Sequence: Synthetic oligonucleotide
cctggccccacaagtggacaccc

SEQ ID NO: 320057 - DNA, 23 bp, Artificial Sequence
  Description of Artificial Sequence: Synthetic oligonucleotide
ctggccccacaagtggacacccg

SEQ ID NO: 320058 - DNA, 24 bp, Artificial Sequence
  Description of Artificial Sequence: Synthetic oligonucleotide
tggccccacaagtggacacccgca

SEQ ID NO: 320059 - DNA, 23 bp, Artificial Sequence
  Description of Artificial Sequence: Synthetic oligonucleotide
ggccccacaagtggacacccgca

SEQ ID NO: 320060 - DNA, 23 bp, Artificial Sequence
  Description of Artificial Sequence: Synthetic oligonucleotide
gccccacaagtggacacccgcac

SEQ ID NO: 320061 - DNA, 23 bp, Artificial Sequence
  Description of Artificial Sequence: Synthetic oligonucleotide
ccccacaagtggacacccgcacg

SEQ ID NO: 320062 - DNA, 23 bp, Artificial Sequence
  Description of Artificial Sequence: Synthetic oligonucleotide
cccacaagtggacacccgcacgc

SEQ ID NO: 320063 - DNA, 23 bp, Artificial Sequence
  Description of Artificial Sequence: Synthetic oligonucleotide
ccacaagtggacacccgcacgcc

SEQ ID NO: 320064 - DNA, 24 bp, Artificial Sequence
  Description of Artificial Sequence: Synthetic oligonucleotide
cacaagtggacacccgcacgccct

SEQ ID NO: 320065 - DNA, 24 bp, Artificial Sequence
  Description of Artificial Sequence: Synthetic oligonucleotide
acaagtggacacccgcacgccctg

SEQ ID NO: 320066 - DNA, 23 bp, Artificial Sequence
  Description of Artificial Sequence: Synthetic oligonucleotide
caagtggacacccgcacgccctg

SEQ ID NO: 320067 - DNA, 23 bp, Artificial Sequence
  Description of Artificial Sequence: Synthetic oligonucleotide
aagtggacacccgcacgccctgg

SEQ ID NO: 320068 - DNA, 22 bp, Artificial Sequence
  Description of Artificial Sequence: Synthetic oligonucleotide
agtggacacccgcacgccctgg

SEQ ID NO: 320069 - DNA, 21 bp, Artificial Sequence
  Description of Artificial Sequence: Synthetic oligonucleotide
gtggacacccgcacgccctgg

SEQ ID NO: 320070 - DNA, 21 bp, Artificial Sequence
  Description of Artificial Sequence: Synthetic oligonucleotide
tggacacccgcacgccctggc

SEQ ID NO: 320071 - DNA, 20 bp, Artificial Sequence
  Description of Artificial Sequence: Synthetic oligonucleotide
ggacacccgcacgccctggc

SEQ ID NO: 320072 - DNA, 20 bp, Artificial Sequence
  Description of Artificial Sequence: Synthetic oligonucleotide
gacacccgcacgccctggcg

SEQ ID NO: 320073 - DNA, 20 bp, Artificial Sequence
  Description of Artificial Sequence: Synthetic oligonucleotide
acacccgcacgccctggcgg

SEQ ID NO: 320074 - DNA, 20 bp, Artificial Sequence
  Description of Artificial Sequence: Synthetic oligonucleotide
cacccgcacgccctggcggt

SEQ ID NO: 320075 - DNA, 20 bp, Artificial Sequence
  Description of Artificial Sequence: Synthetic oligonucleotide
acccgcacgccctggcggga

SEQ ID NO: 320076 - DNA, 20 bp, Artificial Sequence
  Description of Artificial Sequence: Synthetic oligonucleotide
cccgcacgccctggcgggat

SEQ ID NO: 320077 - DNA, 20 bp, Artificial Sequence
  Description of Artificial Sequence: Synthetic oligonucleotide
ccgcacgccctggcgggagt

SEQ ID NO: 320078 - DNA, 20 bp, Artificial Sequence
  Description of Artificial Sequence: Synthetic oligonucleotide
cgcacgccctggcgggaggt

SEQ ID NO: 320079 - DNA, 20 bp, Artificial Sequence
  Description of Artificial Sequence: Synthetic oligonucleotide
gcacgccctggcgggaggtg

SEQ ID NO: 320080 - DNA, 21 bp, Artificial Sequence
  Description of Artificial Sequence: Synthetic oligonucleotide
cacgccctggcgggaggtgca

SEQ ID NO: 320081 - DNA, 21 bp, Artificial Sequence
  Description of Artificial Sequence: Synthetic oligonucleotide
acgccctggcgggaggtgcag

SEQ ID NO: 320082 - DNA, 20 bp, Artificial Sequence
  Description of Artificial Sequence: Synthetic oligonucleotide
cgccctggcgggaggtgcag

SEQ ID NO: 320083 - DNA, 22 bp, Artificial Sequence
  Description of Artificial Sequence: Synthetic oligonucleotide
gccctggcgggaggtgcagctt

SEQ ID NO: 320084 - DNA, 23 bp, Artificial Sequence
  Description of Artificial Sequence: Synthetic oligonucleotide
ccctggcgggaggtgcagcttct

SEQ ID NO: 320085 - DNA, 23 bp, Artificial Sequence
  Description of Artificial Sequence: Synthetic oligonucleotide
cctggcgggaggtgcagcttctc

SEQ ID NO: 320086 - DNA, 24 bp, Artificial Sequence
  Description of Artificial Sequence: Synthetic oligonucleotide
ctggcgggaggtgcagcttctcga

SEQ ID NO: 320087 - DNA, 25 bp, Artificial Sequence
  Description of Artificial Sequence: Synthetic oligonucleotide
tggcgggaggtgcagcttctcgact

SEQ ID NO: 320088 - DNA, 24 bp, Artificial Sequence
  Description of Artificial Sequence: Synthetic oligonucleotide
ggcgggaggtgcagcttctcgact

SEQ ID NO: 320089 - DNA, 24 bp, Artificial Sequence
  Description of Artificial Sequence: Synthetic oligonucleotide
gcgggaggtgcagcttctcgactg

SEQ ID NO: 320090 - DNA, 26 bp, Artificial Sequence
  Description of Artificial Sequence: Synthetic oligonucleotide
cgggaggtgcagcttctcgactggat

SEQ ID NO: 320091 - DNA, 27 bp, Artificial Sequence
  Description of Artificial Sequence: Synthetic oligonucleotide
gggaggtgcagcttctcgactggatct

SEQ ID NO: 320092 - DNA, 27 bp, Artificial Sequence
  Description of Artificial Sequence: Synthetic oligonucleotide
ggaggtgcagcttctcgactggatctc

SEQ ID NO: 320093 - DNA, 27 bp, Artificial Sequence
  Description of Artificial Sequence: Synthetic oligonucleotide
gaggtgcagcttctcgactggatctcg

SEQ ID NO: 320094 - DNA, 27 bp, Artificial Sequence
  Description of Artificial Sequence: Synthetic oligonucleotide
aggtgcagcttctcgactggatctcgg

SEQ ID NO: 320095 - DNA, 27 bp, Artificial Sequence
  Description of Artificial Sequence: Synthetic oligonucleotide
ggtgcagcttctcgactggatctcgga

SEQ ID NO: 320096 - DNA, 27 bp, Artificial Sequence
  Description of Artificial Sequence: Synthetic oligonucleotide
gtgcagcttctcgactggatctcggag

SEQ ID NO: 320097 - DNA, 27 bp, Artificial Sequence
  Description of Artificial Sequence: Synthetic oligonucleotide
tgcagcttctcgactggatctcggagg

SEQ ID NO: 320098 - DNA, 27 bp, Artificial Sequence
  Description of Artificial Sequence: Synthetic oligonucleotide
gcagcttctcgactggatctcggagga

SEQ ID NO: 320099 - DNA, 27 bp, Artificial Sequence
  Description of Artificial Sequence: Synthetic oligonucleotide
cagcttctcgactggatctcggaggag

SEQ ID NO: 320100 - DNA, 29 bp, Artificial Sequence
  Description of Artificial Sequence: Synthetic oligonucleotide
agcttctcgactggatctcggaggagaac

SEQ ID NO: 320101 - DNA, 28 bp, Artificial Sequence
  Description of Artificial Sequence: Synthetic oligonucleotide
gcttctcgactggatctcggaggagaac

SEQ ID NO: 320102 - DNA, 28 bp, Artificial Sequence
  Description of Artificial Sequence: Synthetic oligonucleotide
cttctcgactggatctcggaggagaacg

SEQ ID NO: 320103 - DNA, 28 bp, Artificial Sequence
  Description of Artificial Sequence: Synthetic oligonucleotide
ttctcgactggatctcggaggagaacgc

SEQ ID NO: 320104 - DNA, 27 bp, Artificial Sequence
  Description of Artificial Sequence: Synthetic oligonucleotide
tctcgactggatctcggaggagaacgc

SEQ ID NO: 320105 - DNA, 26 bp, Artificial Sequence
  Description of Artificial Sequence: Synthetic oligonucleotide
ctcgactggatctcggaggagaacgc

SEQ ID NO: 320106 - DNA, 26 bp, Artificial Sequence
  Description of Artificial Sequence: Synthetic oligonucleotide
tcgactggatctcggaggagaacgcg

SEQ ID NO: 320107 - DNA, 25 bp, Artificial Sequence
  Description of Artificial Sequence: Synthetic oligonucleotide
cgactggatctcggaggagaacgcg

SEQ ID NO: 320108 - DNA, 26 bp, Artificial Sequence
  Description of Artificial Sequence: Synthetic oligonucleotide
gactggatctcggaggagaacgcgga

SEQ ID NO: 320109 - DNA, 27 bp, Artificial Sequence
  Description of Artificial Sequence: Synthetic oligonucleotide
actggatctcggaggagaacgcggact

SEQ ID NO: 320110 - DNA, 27 bp, Artificial Sequence
  Description of Artificial Sequence: Synthetic oligonucleotide
ctggatctcggaggagaacgcggacta

SEQ ID NO: 320111 - DNA, 27 bp, Artificial Sequence
  Description of Artificial Sequence: Synthetic oligonucleotide
tggatctcggaggagaacgcggactag

SEQ ID NO: 320112 - DNA, 27 bp, Artificial Sequence
  Description of Artificial Sequence: Synthetic oligonucleotide
ggatctcggaggagaacgcggactaga

SEQ ID NO: 320113 - DNA, 27 bp, Artificial Sequence
  Description of Artificial Sequence: Synthetic oligonucleotide
gatctcggaggagaacgcggactagag

SEQ ID NO: 320114 - DNA, 28 bp, Artificial Sequence
  Description of Artificial Sequence: Synthetic oligonucleotide
atctcggaggagaacgcggactagagag

SEQ ID NO: 320115 - DNA, 27 bp, Artificial Sequence
  Description of Artificial Sequence: Synthetic oligonucleotide
tctcggaggagaacgcggactagagag

SEQ ID NO: 320116 - DNA, 27 bp, Artificial Sequence
  Description of Artificial Sequence: Synthetic oligonucleotide
ctcggaggagaacgcggactagagaga

SEQ ID NO: 320117 - DNA, 28 bp, Artificial Sequence
  Description of Artificial Sequence: Synthetic oligonucleotide
tcggaggagaacgcggactagagagatc

SEQ ID NO: 320118 - DNA, 27 bp, Artificial Sequence
  Description of Artificial Sequence: Synthetic oligonucleotide
cggaggagaacgcggactagagagatc

SEQ ID NO: 320119 - DNA, 27 bp, Artificial Sequence
  Description of Artificial Sequence: Synthetic oligonucleotide
ggaggagaacgcggactagagagatcc

SEQ ID NO: 320120 - DNA, 30 bp, Artificial Sequence
  Description of Artificial Sequence: Synthetic oligonucleotide
gaggagaacgcggactagagagatccattc

SEQ ID NO: 320121 - DNA, 30 bp, Artificial Sequence
  Description of Artificial Sequence: Synthetic oligonucleotide
aggagaacgcggactagagagatccattcc

SEQ ID NO: 320122 - DNA, 29 bp, Artificial Sequence
  Description of Artificial Sequence: Synthetic oligonucleotide
ggagaacgcggactagagagatccattcc

SEQ ID NO: 320123 - DNA, 30 bp, Artificial Sequence
  Description of Artificial Sequence: Synthetic oligonucleotide
gagaacgcggactagagagatccattcctg

SEQ ID NO: 320124 - DNA, 32 bp, Artificial Sequence
  Description of Artificial Sequence: Synthetic oligonucleotide
agaacgcggactagagagatccattcctgaag

SEQ ID NO: 320125 - DNA, 31 bp, Artificial Sequence
  Description of Artificial Sequence: Synthetic oligonucleotide
gaacgcggactagagagatccattcctgaag

SEQ ID NO: 320126 - DNA, 31 bp, Artificial Sequence
  Description of Artificial Sequence: Synthetic oligonucleotide
aacgcggactagagagatccattcctgaagg

SEQ ID NO: 320127 - DNA, 30 bp, Artificial Sequence
  Description of Artificial Sequence: Synthetic oligonucleotide
acgcggactagagagatccattcctgaagg

SEQ ID NO: 320128 - DNA, 29 bp, Artificial Sequence
  Description of Artificial Sequence: Synthetic oligonucleotide
cgcggactagagagatccattcctgaagg

SEQ ID NO: 320129 - DNA, 30 bp, Artificial Sequence
  Description of Artificial Sequence: Synthetic oligonucleotide
gcggactagagagatccattcctgaaggtc

SEQ ID NO: 320130 - DNA, 31 bp, Artificial Sequence
  Description of Artificial Sequence: Synthetic oligonucleotide
cggactagagagatccattcctgaaggtctc

SEQ ID NO: 320131 - DNA, 32 bp, Artificial Sequence
  Description of Artificial Sequence: Synthetic oligonucleotide
ggactagagagatccattcctgaaggtctctg

SEQ ID NO: 320132 - DNA, 32 bp, Artificial Sequence
  Description of Artificial Sequence: Synthetic oligonucleotide
gactagagagatccattcctgaaggtctctgg

SEQ ID NO: 320133 - DNA, 32 bp, Artificial Sequence
  Description of Artificial Sequence: Synthetic oligonucleotide
actagagagatccattcctgaaggtctctggc

SEQ ID NO: 320134 - DNA, 31 bp, Artificial Sequence
  Description of Artificial Sequence: Synthetic oligonucleotide
ctagagagatccattcctgaaggtctctggc

SEQ ID NO: 320135 - DNA, 33 bp, Artificial Sequence
  Description of Artificial Sequence: Synthetic oligonucleotide
tagagagatccattcctgaaggtctctggctac

SEQ ID NO: 320136 - DNA, 32 bp, Artificial Sequence
  Description of Artificial Sequence: Synthetic oligonucleotide
agagagatccattcctgaaggtctctggctac

SEQ ID NO: 320137 - DNA, 31 bp, Artificial Sequence
  Description of Artificial Sequence: Synthetic oligonucleotide
gagagatccattcctgaaggtctctggctac

SEQ ID NO: 320138 - DNA, 31 bp, Artificial Sequence
  Description of Artificial Sequence: Synthetic oligonucleotide
agagatccattcctgaaggtctctggctacc

SEQ ID NO: 320139 - DNA, 30 bp, Artificial Sequence
  Description of Artificial Sequence: Synthetic oligonucleotide
gagatccattcctgaaggtctctggctacc

SEQ ID NO: 320140 - DNA, 30 bp, Artificial Sequence
  Description of Artificial Sequence: Synthetic oligonucleotide
agatccattcctgaaggtctctggctaccc

SEQ ID NO: 320141 - DNA, 29 bp, Artificial Sequence
  Description of Artificial Sequence: Synthetic oligonucleotide
gatccattcctgaaggtctctggctaccc

SEQ ID NO: 320142 - DNA, 29 bp, Artificial Sequence
  Description of Artificial Sequence: Synthetic oligonucleotide
atccattcctgaaggtctctggctacccc

SEQ ID NO: 320143 - DNA, 28 bp, Artificial Sequence
  Description of Artificial Sequence: Synthetic oligonucleotide
tccattcctgaaggtctctggctacccc

SEQ ID NO: 320144 - DNA, 27 bp, Artificial Sequence
  Description of Artificial Sequence: Synthetic oligonucleotide
ccattcctgaaggtctctggctacccc

SEQ ID NO: 320145 - DNA, 28 bp, Artificial Sequence
  Description of Artificial Sequence: Synthetic oligonucleotide
cattcctgaaggtctctggctacccctg

SEQ ID NO: 320146 - DNA, 28 bp, Artificial Sequence
  Description of Artificial Sequence: Synthetic oligonucleotide
attcctgaaggtctctggctacccctgc

SEQ ID NO: 320147 - DNA, 27 bp, Artificial Sequence
  Description of Artificial Sequence: Synthetic oligonucleotide
ttcctgaaggtctctggctacccctgc

SEQ ID NO: 320148 - DNA, 27 bp, Artificial Sequence
  Description of Artificial Sequence: Synthetic oligonucleotide
tcctgaaggtctctggctacccctgct

SEQ ID NO: 320149 - DNA, 26 bp, Artificial Sequence
  Description of Artificial Sequence: Synthetic oligonucleotide
cctgaaggtctctggctacccctgct

SEQ ID NO: 320150 - DNA, 27 bp, Artificial Sequence
  Description of Artificial Sequence: Synthetic oligonucleotide
ctgaaggtctctggctacccctgctca

SEQ ID NO: 320151 - DNA, 28 bp, Artificial Sequence
  Description of Artificial Sequence: Synthetic oligonucleotide
tgaaggtctctggctacccctgctcatg

SEQ ID NO: 320152 - DNA, 27 bp, Artificial Sequence
  Description of Artificial Sequence: Synthetic oligonucleotide
gaaggtctctggctacccctgctcatg

SEQ ID NO: 320153 - DNA, 27 bp, Artificial Sequence
  Description of Artificial Sequence: Synthetic oligonucleotide
aaggtctctggctacccctgctcatgg

SEQ ID NO: 320154 - DNA, 27 bp, Artificial Sequence
  Description of Artificial Sequence: Synthetic oligonucleotide
aggtctctggctacccctgctcatgga

SEQ ID NO: 320155 - DNA, 26 bp, Artificial Sequence
  Description of Artificial Sequence: Synthetic oligonucleotide
ggtctctggctacccctgctcatgga

SEQ ID NO: 320156 - DNA, 27 bp, Artificial Sequence
  Description of Artificial Sequence: Synthetic oligonucleotide
gtctctggctacccctgctcatggact

SEQ ID NO: 320157 - DNA, 29 bp, Artificial Sequence
  Description of Artificial Sequence: Synthetic oligonucleotide
tctctggctacccctgctcatggactttc

SEQ ID NO: 320158 - DNA, 28 bp, Artificial Sequence
  Description of Artificial Sequence: Synthetic oligonucleotide
ctctggctacccctgctcatggactttc

SEQ ID NO: 320159 - DNA, 30 bp, Artificial Sequence
  Description of Artificial Sequence: Synthetic oligonucleotide
tctggctacccctgctcatggactttcatc

SEQ ID NO: 320160 - DNA, 29 bp, Artificial Sequence
  Description of Artificial Sequence: Synthetic oligonucleotide
ctggctacccctgctcatggactttcatc

SEQ ID NO: 320161 - DNA, 29 bp, Artificial Sequence
  Description of Artificial Sequence: Synthetic oligonucleotide
tggctacccctgctcatggactttcatcc

SEQ ID NO: 320162 - DNA, 28 bp, Artificial Sequence
  Description of Artificial Sequence: Synthetic oligonucleotide
ggctacccctgctcatggactttcatcc

SEQ ID NO: 320163 - DNA, 29 bp, Artificial Sequence
  Description of Artificial Sequence: Synthetic oligonucleotide
gctacccctgctcatggactttcatccac

SEQ ID NO: 320164 - DNA, 29 bp, Artificial Sequence
  Description of Artificial Sequence: Synthetic oligonucleotide
ctacccctgctcatggactttcatccacc

SEQ ID NO: 320165 - DNA, 31 bp, Artificial Sequence
  Description of Artificial Sequence: Synthetic oligonucleotide
tacccctgctcatggactttcatccaccatc

SEQ ID NO: 320166 - DNA, 30 bp, Artificial Sequence
  Description of Artificial Sequence: Synthetic oligonucleotide
acccctgctcatggactttcatccaccatc

SEQ ID NO: 320167 - DNA, 29 bp, Artificial Sequence
  Description of Artificial Sequence: Synthetic oligonucleotide
cccctgctcatggactttcatccaccatc

SEQ ID NO: 320168 - DNA, 30 bp, Artificial Sequence
  Description of Artificial Sequence: Synthetic oligonucleotide
ccctgctcatggactttcatccaccatcac

SEQ ID NO: 320169 - DNA, 30 bp, Artificial Sequence
  Description of Artificial Sequence: Synthetic oligonucleotide
cctgctcatggactttcatccaccatcacc

SEQ ID NO: 320170 - DNA, 30 bp, Artificial Sequence
  Description of Artificial Sequence: Synthetic oligonucleotide
ctgctcatggactttcatccaccatcaccg

SEQ ID NO: 320171 - DNA, 30 bp, Artificial Sequence
  Description of Artificial Sequence: Synthetic oligonucleotide
tgctcatggactttcatccaccatcaccgg

SEQ ID NO: 320172 - DNA, 29 bp, Artificial Sequence
  Description of Artificial Sequence: Synthetic oligonucleotide
gctcatggactttcatccaccatcaccgg

SEQ ID NO: 320173 - DNA, 29 bp, Artificial Sequence
  Description of Artificial Sequence: Synthetic oligonucleotide
ctcatggactttcatccaccatcaccggg

SEQ ID NO: 320174 - DNA, 31 bp, Artificial Sequence
  Description of Artificial Sequence: Synthetic oligonucleotide
tcatggactttcatccaccatcaccgggaac

SEQ ID NO: 320175 - DNA, 30 bp, Artificial Sequence
  Description of Artificial Sequence: Synthetic oligonucleotide
catggactttcatccaccatcaccgggaac

SEQ ID NO: 320176 - DNA, 31 bp, Artificial Sequence
  Description of Artificial Sequence: Synthetic oligonucleotide
atggactttcatccaccatcaccgggaacac

SEQ ID NO: 320177 - DNA, 30 bp, Artificial Sequence
  Description of Artificial Sequence: Synthetic oligonucleotide
tggactttcatccaccatcaccgggaacac

SEQ ID NO: 320178 - DNA, 29 bp, Artificial Sequence
  Description of Artificial Sequence: Synthetic oligonucleotide
ggactttcatccaccatcaccgggaacac

SEQ ID NO: 320179 - DNA, 31 bp, Artificial Sequence
  Description of Artificial Sequence: Synthetic oligonucleotide
gactttcatccaccatcaccgggaacacatc

SEQ ID NO: 320180 - DNA, 31 bp, Artificial Sequence
  Description of Artificial Sequence: Synthetic oligonucleotide
actttcatccaccatcaccgggaacacatcc

SEQ ID NO: 320181 - DNA, 30 bp, Artificial Sequence
  Description of Artificial Sequence: Synthetic oligonucleotide
ctttcatccaccatcaccgggaacacatcc

SEQ ID NO: 320182 - DNA, 30 bp, Artificial Sequence
  Description of Artificial Sequence: Synthetic oligonucleotide
tttcatccaccatcaccgggaacacatccg

SEQ ID NO: 320183 - DNA, 29 bp, Artificial Sequence
  Description of Artificial Sequence: Synthetic oligonucleotide
ttcatccaccatcaccgggaacacatccg

SEQ ID NO: 320184 - DNA, 28 bp, Artificial Sequence
  Description of Artificial Sequence: Synthetic oligonucleotide
tcatccaccatcaccgggaacacatccg

SEQ ID NO: 320185 - DNA, 27 bp, Artificial Sequence
  Description of Artificial Sequence: Synthetic oligonucleotide
catccaccatcaccgggaacacatccg

SEQ ID NO: 320186 - DNA, 27 bp, Artificial Sequence
  Description of Artificial Sequence: Synthetic oligonucleotide
atccaccatcaccgggaacacatccgc

SEQ ID NO: 320187 - DNA, 27 bp, Artificial Sequence
  Description of Artificial Sequence: Synthetic oligonucleotide
tccaccatcaccgggaacacatccgca

SEQ ID NO: 320188 - DNA, 26 bp, Artificial Sequence
  Description of Artificial Sequence: Synthetic oligonucleotide
ccaccatcaccgggaacacatccgca

SEQ ID NO: 320189 - DNA, 27 bp, Artificial Sequence
  Description of Artificial Sequence: Synthetic oligonucleotide
caccatcaccgggaacacatccgcaga

SEQ ID NO: 320190 - DNA, 27 bp, Artificial Sequence
  Description of Artificial Sequence: Synthetic oligonucleotide
accatcaccgggaacacatccgcagac

SEQ ID NO: 320191 - DNA, 27 bp, Artificial Sequence
  Description of Artificial Sequence: Synthetic oligonucleotide
ccatcaccgggaacacatccgcagaca

SEQ ID NO: 320192 - DNA, 27 bp, Artificial Sequence
  Description of Artificial Sequence: Synthetic oligonucleotide
catcaccgggaacacatccgcagacag

SEQ ID NO: 320193 - DNA, 29 bp, Artificial Sequence
  Description of Artificial Sequence: Synthetic oligonucleotide
atcaccgggaacacatccgcagacagttc

SEQ ID NO: 320194 - DNA, 28 bp, Artificial Sequence
  Description of Artificial Sequence: Synthetic oligonucleotide
tcaccgggaacacatccgcagacagttc

SEQ ID NO: 320195 - DNA, 27 bp, Artificial Sequence
  Description of Artificial Sequence: Synthetic oligonucleotide
caccgggaacacatccgcagacagttc

SEQ ID NO: 320196 - DNA, 28 bp, Artificial Sequence
  Description of Artificial Sequence: Synthetic oligonucleotide
accgggaacacatccgcagacagttcac

SEQ ID NO: 320197 - DNA, 27 bp, Artificial Sequence
  Description of Artificial Sequence: Synthetic oligonucleotide
ccgggaacacatccgcagacagttcac

SEQ ID NO: 320198 - DNA, 27 bp, Artificial Sequence
  Description of Artificial Sequence: Synthetic oligonucleotide
cgggaacacatccgcagacagttcacc

SEQ ID NO: 320199 - DNA, 27 bp, Artificial Sequence
  Description of Artificial Sequence: Synthetic oligonucleotide
gggaacacatccgcagacagttcaccc

SEQ ID NO: 320200 - DNA, 28 bp, Artificial Sequence
  Description of Artificial Sequence: Synthetic oligonucleotide
ggaacacatccgcagacagttcacccag

SEQ ID NO: 320201 - DNA, 28 bp, Artificial Sequence
  Description of Artificial Sequence: Synthetic oligonucleotide
gaacacatccgcagacagttcacccagc

SEQ ID NO: 320202 - DNA, 29 bp, Artificial Sequence
  Description of Artificial Sequence: Synthetic oligonucleotide
aacacatccgcagacagttcacccagcac

SEQ ID NO: 320203 - DNA, 28 bp, Artificial Sequence
  Description of Artificial Sequence: Synthetic oligonucleotide
acacatccgcagacagttcacccagcac

SEQ ID NO: 320204 - DNA, 27 bp, Artificial Sequence
  Description of Artificial Sequence: Synthetic oligonucleotide
cacatccgcagacagttcacccagcac

SEQ ID NO: 320205 - DNA, 27 bp, Artificial Sequence
  Description of Artificial Sequence: Synthetic oligonucleotide
acatccgcagacagttcacccagcacg

SEQ ID NO: 320206 - DNA, 27 bp, Artificial Sequence
  Description of Artificial Sequence: Synthetic oligonucleotide
catccgcagacagttcacccagcacga

SEQ ID NO: 320207 - DNA, 27 bp, Artificial Sequence
  Description of Artificial Sequence: Synthetic oligonucleotide
atccgcagacagttcacccagcacgac

SEQ ID NO: 320208 - DNA, 26 bp, Artificial Sequence
  Description of Artificial Sequence: Synthetic oligonucleotide
tccgcagacagttcacccagcacgac

SEQ ID NO: 320209 - DNA, 25 bp, Artificial Sequence
  Description of Artificial Sequence: Synthetic oligonucleotide
ccgcagacagttcacccagcacgac

SEQ ID NO: 320210 - DNA, 26 bp, Artificial Sequence
  Description of Artificial Sequence: Synthetic oligonucleotide
cgcagacagttcacccagcacgacca

SEQ ID NO: 320211 - DNA, 26 bp, Artificial Sequence
  Description of Artificial Sequence: Synthetic oligonucleotide
gcagacagttcacccagcacgaccag

SEQ ID NO: 320212 - DNA, 27 bp, Artificial Sequence
  Description of Artificial Sequence: Synthetic oligonucleotide
cagacagttcacccagcacgaccagct

SEQ ID NO: 320213 - DNA, 28 bp, Artificial Sequence
  Description of Artificial Sequence: Synthetic oligonucleotide
agacagttcacccagcacgaccagcttc

SEQ ID NO: 320214 - DNA, 27 bp, Artificial Sequence
  Description of Artificial Sequence: Synthetic oligonucleotide
gacagttcacccagcacgaccagcttc

SEQ ID NO: 320215 - DNA, 27 bp, Artificial Sequence
  Description of Artificial Sequence: Synthetic oligonucleotide
acagttcacccagcacgaccagcttcg

SEQ ID NO: 320216 - DNA, 26 bp, Artificial Sequence
  Description of Artificial Sequence: Synthetic oligonucleotide
cagttcacccagcacgaccagcttcg

SEQ ID NO: 320217 - DNA, 26 bp, Artificial Sequence
  Description of Artificial Sequence: Synthetic oligonucleotide
agttcacccagcacgaccagcttcgg

SEQ ID NO: 320218 - DNA, 25 bp, Artificial Sequence
  Description of Artificial Sequence: Synthetic oligonucleotide
gttcacccagcacgaccagcttcgg

SEQ ID NO: 320219 - DNA, 27 bp, Artificial Sequence
  Description of Artificial Sequence: Synthetic oligonucleotide
ttcacccagcacgaccagcttcgggaa

SEQ ID NO: 320220 - DNA, 26 bp, Artificial Sequence
  Description of Artificial Sequence: Synthetic oligonucleotide
tcacccagcacgaccagcttcgggaa

SEQ ID NO: 320221 - DNA, 25 bp, Artificial Sequence
  Description of Artificial Sequence: Synthetic oligonucleotide
cacccagcacgaccagcttcgggaa

SEQ ID NO: 320222 - DNA, 26 bp, Artificial Sequence
  Description of Artificial Sequence: Synthetic oligonucleotide
acccagcacgaccagcttcgggaaca

SEQ ID NO: 320223 - DNA, 25 bp, Artificial Sequence
  Description of Artificial Sequence: Synthetic oligonucleotide
cccagcacgaccagcttcgggaaca

SEQ ID NO: 320224 - DNA, 25 bp, Artificial Sequence
  Description of Artificial Sequence: Synthetic oligonucleotide
ccagcacgaccagcttcgggaacag

SEQ ID NO: 320225 - DNA, 25 bp, Artificial Sequence
  Description of Artificial Sequence: Synthetic oligonucleotide
cagcacgaccagcttcgggaacagg

SEQ ID NO: 320226 - DNA, 25 bp, Artificial Sequence
  Description of Artificial Sequence: Synthetic oligonucleotide
agcacgaccagcttcgggaacaggc

SEQ ID NO: 320227 - DNA, 24 bp, Artificial Sequence
  Description of Artificial Sequence: Synthetic oligonucleotide
gcacgaccagcttcgggaacaggc

SEQ ID NO: 320228 - DNA, 24 bp, Artificial Sequence
  Description of Artificial Sequence: Synthetic oligonucleotide
cacgaccagcttcgggaacaggcg

SEQ ID NO: 320229 - DNA, 25 bp, Artificial Sequence
  Description of Artificial Sequence: Synthetic oligonucleotide
acgaccagcttcgggaacaggcgca

SEQ ID NO: 320230 - DNA, 24 bp, Artificial Sequence
  Description of Artificial Sequence: Synthetic oligonucleotide
cgaccagcttcgggaacaggcgca

SEQ ID NO: 320231 - DNA, 25 bp, Artificial Sequence
  Description of Artificial Sequence: Synthetic oligonucleotide
gaccagcttcgggaacaggcgcaga

SEQ ID NO: 320232 - DNA, 26 bp, Artificial Sequence
  Description of Artificial Sequence: Synthetic oligonucleotide
accagcttcgggaacaggcgcagact

SEQ ID NO: 320233 - DNA, 25 bp, Artificial Sequence
  Description of Artificial Sequence: Synthetic oligonucleotide
ccagcttcgggaacaggcgcagact

SEQ ID NO: 320234 - DNA, 26 bp, Artificial Sequence
  Description of Artificial Sequence: Synthetic oligonucleotide
cagcttcgggaacaggcgcagactgt

SEQ ID NO: 320235 - DNA, 26 bp, Artificial Sequence
  Description of Artificial Sequence: Synthetic oligonucleotide
agcttcgggaacaggcgcagactgtg

SEQ ID NO: 320236 - DNA, 25 bp, Artificial Sequence
  Description of Artificial Sequence: Synthetic oligonucleotide
gcttcgggaacaggcgcagactgtg

SEQ ID NO: 320237 - DNA, 26 bp, Artificial Sequence
  Description of Artificial Sequence: Synthetic oligonucleotide
cttcgggaacaggcgcagactgtgct

SEQ ID NO: 320238 - DNA, 26 bp, Artificial Sequence
  Description of Artificial Sequence: Synthetic oligonucleotide
ttcgggaacaggcgcagactgtgctg

SEQ ID NO: 320239 - DNA, 25 bp, Artificial Sequence
  Description of Artificial Sequence: Synthetic oligonucleotide
tcgggaacaggcgcagactgtgctg

SEQ ID NO: 320240 - DNA, 24 bp, Artificial Sequence
  Description of Artificial Sequence: Synthetic oligonucleotide
cgggaacaggcgcagactgtgctg

SEQ ID NO: 320241 - DNA, 24 bp, Artificial Sequence
  Description of Artificial Sequence: Synthetic oligonucleotide
gggaacaggcgcagactgtgctgg

SEQ ID NO: 320242 - DNA, 25 bp, Artificial Sequence
  Description of Artificial Sequence: Synthetic oligonucleotide
ggaacaggcgcagactgtgctggga

SEQ ID NO: 320243 - DNA, 26 bp, Artificial Sequence
  Description of Artificial Sequence: Synthetic oligonucleotide
gaacaggcgcagactgtgctgggaca

SEQ ID NO: 320244 - DNA, 26 bp, Artificial Sequence
  Description of Artificial Sequence: Synthetic oligonucleotide
aacaggcgcagactgtgctgggacag

SEQ ID NO: 320245 - DNA, 25 bp, Artificial Sequence
  Description of Artificial Sequence: Synthetic oligonucleotide
acaggcgcagactgtgctgggacag

SEQ ID NO: 320246 - DNA, 24 bp, Artificial Sequence
  Description of Artificial Sequence: Synthetic oligonucleotide
caggcgcagactgtgctgggacag

SEQ ID NO: 320247 - DNA, 25 bp, Artificial Sequence
  Description of Artificial Sequence: Synthetic oligonucleotide
aggcgcagactgtgctgggacagct

SEQ ID NO: 320248 - DNA, 24 bp, Artificial Sequence
  Description of Artificial Sequence: Synthetic oligonucleotide
ggcgcagactgtgctgggacagct

SEQ ID NO: 320249 - DNA, 24 bp, Artificial Sequence
  Description of Artificial Sequence: Synthetic oligonucleotide
gcgcagactgtgctgggacagctc

SEQ ID NO: 320250 - DNA, 24 bp, Artificial Sequence
  Description of Artificial Sequence: Synthetic oligonucleotide
cgcagactgtgctgggacagctcc

SEQ ID NO: 320251 - DNA, 24 bp, Artificial Sequence
  Description of Artificial Sequence: Synthetic oligonucleotide
gcagactgtgctgggacagctccg

SEQ ID NO: 320252 - DNA, 24 bp, Artificial Sequence
  Description of Artificial Sequence: Synthetic oligonucleotide
cagactgtgctgggacagctccgc

SEQ ID NO: 320253 - DNA, 25 bp, Artificial Sequence
  Description of Artificial Sequence: Synthetic oligonucleotide
agactgtgctgggacagctccgcgt

SEQ ID NO: 320254 - DNA, 24 bp, Artificial Sequence
  Description of Artificial Sequence: Synthetic oligonucleotide
gactgtgctgggacagctccgcgt

SEQ ID NO: 320255 - DNA, 24 bp, Artificial Sequence
  Description of Artificial Sequence: Synthetic oligonucleotide
actgtgctgggacagctccgcgtg

SEQ ID NO: 320256 - DNA, 23 bp, Artificial Sequence
  Description of Artificial Sequence: Synthetic oligonucleotide
ctgtgctgggacagctccgcgtg

SEQ ID NO: 320257 - DNA, 23 bp, Artificial Sequence
  Description of Artificial Sequence: Synthetic oligonucleotide
tgtgctgggacagctccgcgtgg

SEQ ID NO: 320258 - DNA, 22 bp, Artificial Sequence
  Description of Artificial Sequence: Synthetic oligonucleotide
gtgctgggacagctccgcgtgg

SEQ ID NO: 320259 - DNA, 22 bp, Artificial Sequence
  Description of Artificial Sequence: Synthetic oligonucleotide
tgctgggacagctccgcgtggg

SEQ ID NO: 320260 - DNA, 21 bp, Artificial Sequence
  Description of Artificial Sequence: Synthetic oligonucleotide
gctgggacagctccgcgtggg

SEQ ID NO: 320261 - DNA, 21 bp, Artificial Sequence
  Description of Artificial Sequence: Synthetic oligonucleotide
ctgggacagctccgcgtgggc

SEQ ID NO: 320262 - DNA, 21 bp, Artificial Sequence
  Description of Artificial Sequence: Synthetic oligonucleotide
tgggacagctccgcgtgggcc

SEQ ID NO: 320263 - DNA, 20 bp, Artificial Sequence
  Description of Artificial Sequence: Synthetic oligonucleotide
gggacagctccgcgtgggcc

SEQ ID NO: 320264 - DNA, 20 bp, Artificial Sequence
  Description of Artificial Sequence: Synthetic oligonucleotide
ggacagctccgcgtgggccg

SEQ ID NO: 320265 - DNA, 21 bp, Artificial Sequence
  Description of Artificial Sequence: Synthetic oligonucleotide
gacagctccgcgtgggccgca

SEQ ID NO: 320266 - DNA, 22 bp, Artificial Sequence
  Description of Artificial Sequence: Synthetic oligonucleotide
acagctccgcgtgggccgcaga

SEQ ID NO: 320267 - DNA, 21 bp, Artificial Sequence
  Description of Artificial Sequence: Synthetic oligonucleotide
cagctccgcgtgggccgcaga

SEQ ID NO: 320268 - DNA, 21 bp, Artificial Sequence
  Description of Artificial Sequence: Synthetic oligonucleotide
agctccgcgtgggccgcagag

SEQ ID NO: 320269 - DNA, 20 bp, Artificial Sequence
  Description of Artificial Sequence: Synthetic oligonucleotide
gctccgcgtgggccgcagag

SEQ ID NO: 320270 - DNA, 20 bp, Artificial Sequence
  Description of Artificial Sequence: Synthetic oligonucleotide
ctccgcgtgggccgcagagg

SEQ ID NO: 320271 - DNA, 20 bp, Artificial Sequence
  Description of Artificial Sequence: Synthetic oligonucleotide
tccgcgtgggccgcagaggg

SEQ ID NO: 320272 - DNA, 20 bp, Artificial Sequence
  Description of Artificial Sequence: Synthetic oligonucleotide
ccgcgtgggccgcagagggt

SEQ ID NO: 320273 - DNA, 20 bp, Artificial Sequence
  Description of Artificial Sequence: Synthetic oligonucleotide
cgcgtgggccgcagagggga

SEQ ID NO: 320274 - DNA, 20 bp, Artificial Sequence
  Description of Artificial Sequence: Synthetic oligonucleotide
gcgtgggccgcagaggggac

SEQ ID NO: 320275 - DNA, 20 bp, Artificial Sequence
  Description of Artificial Sequence: Synthetic oligonucleotide
cgtgggccgcagaggggacc

SEQ ID NO: 320276 - DNA, 20 bp, Artificial Sequence
  Description of Artificial Sequence: Synthetic oligonucleotide
gtgggccgcagaggggaccg

SEQ ID NO: 320277 - DNA, 20 bp, Artificial Sequence
  Description of Artificial Sequence: Synthetic oligonucleotide
tgggccgcagaggggaccgg

SEQ ID NO: 320278 - DNA, 20 bp, Artificial Sequence
  Description of Artificial Sequence: Synthetic oligonucleotide
gggccgcagaggggaccggt

SEQ ID NO: 320279 - DNA, 20 bp, Artificial Sequence
  Description of Artificial Sequence: Synthetic oligonucleotide
ggccgcagaggggaccggct

SEQ ID NO: 320280 - DNA, 20 bp, Artificial Sequence
  Description of Artificial Sequence: Synthetic oligonucleotide
gccgcagaggggaccggcct

SEQ ID NO: 320281 - DNA, 20 bp, Artificial Sequence
  Description of Artificial Sequence: Synthetic oligonucleotide
ccgcagaggggaccggccgt

SEQ ID NO: 320282 - DNA, 20 bp, Artificial Sequence
  Description of Artificial Sequence: Synthetic oligonucleotide
cgcagaggggaccggccgct

SEQ ID NO: 320283 - DNA, 20 bp, Artificial Sequence
  Description of Artificial Sequence: Synthetic oligonucleotide
gcagaggggaccggccgcgt

SEQ ID NO: 320284 - DNA, 20 bp, Artificial Sequence
  Description of Artificial Sequence: Synthetic oligonucleotide
cagaggggaccggccgcgca

SEQ ID NO: 320285 - DNA, 20 bp, Artificial Sequence
  Description of Artificial Sequence: Synthetic oligonucleotide
agaggggaccggccgcgcac

SEQ ID NO: 320286 - DNA, 20 bp, Artificial Sequence
  Description of Artificial Sequence: Synthetic oligonucleotide
gaggggaccggccgcgcact

SEQ ID NO: 320287 - DNA, 22 bp, Artificial Sequence
  Description of Artificial Sequence: Synthetic oligonucleotide
aggggaccggccgcgcaccatt

SEQ ID NO: 320288 - DNA, 21 bp, Artificial Sequence
  Description of Artificial Sequence: Synthetic oligonucleotide
ggggaccggccgcgcaccatt

SEQ ID NO: 320289 - DNA, 22 bp, Artificial Sequence
  Description of Artificial Sequence: Synthetic oligonucleotide
gggaccggccgcgcaccattgt

SEQ ID NO: 320290 - DNA, 22 bp, Artificial Sequence
  Description of Artificial Sequence: Synthetic oligonucleotide
ggaccggccgcgcaccattgtc

SEQ ID NO: 320291 - DNA, 22 bp, Artificial Sequence
  Description of Artificial Sequence: Synthetic oligonucleotide
gaccggccgcgcaccattgtcg

SEQ ID NO: 320292 - DNA, 22 bp, Artificial Sequence
  Description of Artificial Sequence: Synthetic oligonucleotide
accggccgcgcaccattgtcgg

SEQ ID NO: 320293 - DNA, 21 bp, Artificial Sequence
  Description of Artificial Sequence: Synthetic oligonucleotide
ccggccgcgcaccattgtcgg

SEQ ID NO: 320294 - DNA, 21 bp, Artificial Sequence
  Description of Artificial Sequence: Synthetic oligonucleotide
cggccgcgcaccattgtcggc

SEQ ID NO: 320295 - DNA, 22 bp, Artificial Sequence
  Description of Artificial Sequence: Synthetic oligonucleotide
ggccgcgcaccattgtcggcga

SEQ ID NO: 320296 - DNA, 22 bp, Artificial Sequence
  Description of Artificial Sequence: Synthetic oligonucleotide
gccgcgcaccattgtcggcgac

SEQ ID NO: 320297 - DNA, 23 bp, Artificial Sequence
  Description of Artificial Sequence: Synthetic oligonucleotide
ccgcgcaccattgtcggcgacca

SEQ ID NO: 320298 - DNA, 23 bp, Artificial Sequence
  Description of Artificial Sequence: Synthetic oligonucleotide
cgcgcaccattgtcggcgaccac

SEQ ID NO: 320299 - DNA, 24 bp, Artificial Sequence
  Description of Artificial Sequence: Synthetic oligonucleotide
gcgcaccattgtcggcgaccacgt

SEQ ID NO: 320300 - DNA, 24 bp, Artificial Sequence
  Description of Artificial Sequence: Synthetic oligonucleotide
cgcaccattgtcggcgaccacgtg

SEQ ID NO: 320301 - DNA, 24 bp, Artificial Sequence
  Description of Artificial Sequence: Synthetic oligonucleotide
gcaccattgtcggcgaccacgtgc

SEQ ID NO: 320302 - DNA, 24 bp, Artificial Sequence
  Description of Artificial Sequence: Synthetic oligonucleotide
caccattgtcggcgaccacgtgcg

SEQ ID NO: 320303 - DNA, 24 bp, Artificial Sequence
  Description of Artificial Sequence: Synthetic oligonucleotide
accattgtcggcgaccacgtgcgg

SEQ ID NO: 320304 - DNA, 23 bp, Artificial Sequence
  Description of Artificial Sequence: Synthetic oligonucleotide
ccattgtcggcgaccacgtgcgg

SEQ ID NO: 320305 - DNA, 23 bp, Artificial Sequence
  Description of Artificial Sequence: Synthetic oligonucleotide
cattgtcggcgaccacgtgcggc

SEQ ID NO: 320306 - DNA, 24 bp, Artificial Sequence
  Description of Artificial Sequence: Synthetic oligonucleotide
attgtcggcgaccacgtgcggcgt

SEQ ID NO: 320307 - DNA, 23 bp, Artificial Sequence
  Description of Artificial Sequence: Synthetic oligonucleotide
ttgtcggcgaccacgtgcggcgt

SEQ ID NO: 320308 - DNA, 22 bp, Artificial Sequence
  Description of Artificial Sequence: Synthetic oligonucleotide
tgtcggcgaccacgtgcggcgt

SEQ ID NO: 320309 - DNA, 21 bp, Artificial Sequence
  Description of Artificial Sequence: Synthetic oligonucleotide
gtcggcgaccacgtgcggcgt

SEQ ID NO: 320310 - DNA, 21 bp, Artificial Sequence
  Description of Artificial Sequence: Synthetic oligonucleotide
tcggcgaccacgtgcggcgtg

SEQ ID NO: 320311 - DNA, 20 bp, Artificial Sequence
  Description of Artificial Sequence: Synthetic oligonucleotide
cggcgaccacgtgcggcgtg

SEQ ID NO: 320312 - DNA, 20 bp, Artificial Sequence
  Description of Artificial Sequence: Synthetic oligonucleotide
ggcgaccacgtgcggcgtgg

SEQ ID NO: 320313 - DNA, 20 bp, Artificial Sequence
  Description of Artificial Sequence: Synthetic oligonucleotide
gcgaccacgtgcggcgtggg

SEQ ID NO: 320314 - DNA, 21 bp, Artificial Sequence
  Description of Artificial Sequence: Synthetic oligonucleotide
cgaccacgtgcggcgtgggga

SEQ ID NO: 320315 - DNA, 24 bp, Artificial Sequence
  Description of Artificial Sequence: Synthetic oligonucleotide
gaccacgtgcggcgtggggacaat

SEQ ID NO: 320316 - DNA, 25 bp, Artificial Sequence
  Description of Artificial Sequence: Synthetic oligonucleotide
accacgtgcggcgtggggacaatct

SEQ ID NO: 320317 - DNA, 24 bp, Artificial Sequence
  Description of Artificial Sequence: Synthetic oligonucleotide
ccacgtgcggcgtggggacaatct

SEQ ID NO: 320318 - DNA, 24 bp, Artificial Sequence
  Description of Artificial Sequence: Synthetic oligonucleotide
cacgtgcggcgtggggacaatctg

SEQ ID NO: 320319 - DNA, 25 bp, Artificial Sequence
  Description of Artificial Sequence: Synthetic oligonucleotide
acgtgcggcgtggggacaatctgca

SEQ ID NO: 320320 - DNA, 24 bp, Artificial Sequence
  Description of Artificial Sequence: Synthetic oligonucleotide
cgtgcggcgtggggacaatctgca

SEQ ID NO: 320321 - DNA, 24 bp, Artificial Sequence
  Description of Artificial Sequence: Synthetic oligonucleotide
gtgcggcgtggggacaatctgcag

SEQ ID NO: 320322 - DNA, 27 bp, Artificial Sequence
  Description of Artificial Sequence: Synthetic oligonucleotide
tgcggcgtggggacaatctgcaggata

SEQ ID NO: 320323 - DNA, 27 bp, Artificial Sequence
  Description of Artificial Sequence: Synthetic oligonucleotide
gcggcgtggggacaatctgcaggatat

SEQ ID NO: 320324 - DNA, 27 bp, Artificial Sequence
  Description of Artificial Sequence: Synthetic oligonucleotide
cggcgtggggacaatctgcaggatatg

SEQ ID NO: 320325 - DNA, 27 bp, Artificial Sequence
  Description of Artificial Sequence: Synthetic oligonucleotide
ggcgtggggacaatctgcaggatatgc

SEQ ID NO: 320326 - DNA, 27 bp, Artificial Sequence
  Description of Artificial Sequence: Synthetic oligonucleotide
gcgtggggacaatctgcaggatatgcc

SEQ ID NO: 320327 - DNA, 28 bp, Artificial Sequence
  Description of Artificial Sequence: Synthetic oligonucleotide
cgtggggacaatctgcaggatatgcctc

SEQ ID NO: 320328 - DNA, 29 bp, Artificial Sequence
  Description of Artificial Sequence: Synthetic oligonucleotide
gtggggacaatctgcaggatatgcctcac

SEQ ID NO: 320329 - DNA, 29 bp, Artificial Sequence
  Description of Artificial Sequence: Synthetic oligonucleotide
tggggacaatctgcaggatatgcctcacc

SEQ ID NO: 320330 - DNA, 28 bp, Artificial Sequence
  Description of Artificial Sequence: Synthetic oligonucleotide
ggggacaatctgcaggatatgcctcacc

SEQ ID NO: 320331 - DNA, 28 bp, Artificial Sequence
  Description of Artificial Sequence: Synthetic oligonucleotide
gggacaatctgcaggatatgcctcaccg

SEQ ID NO: 320332 - DNA, 28 bp, Artificial Sequence
  Description of Artificial Sequence: Synthetic oligonucleotide
ggacaatctgcaggatatgcctcaccgc

SEQ ID NO: 320333 - DNA, 29 bp, Artificial Sequence
  Description of Artificial Sequence: Synthetic oligonucleotide
gacaatctgcaggatatgcctcaccgctg

SEQ ID NO: 320334 - DNA, 29 bp, Artificial Sequence
  Description of Artificial Sequence: Synthetic oligonucleotide
acaatctgcaggatatgcctcaccgctgg

SEQ ID NO: 320335 - DNA, 28 bp, Artificial Sequence
  Description of Artificial Sequence: Synthetic oligonucleotide
caatctgcaggatatgcctcaccgctgg

SEQ ID NO: 320336 - DNA, 30 bp, Artificial Sequence
  Description of Artificial Sequence: Synthetic oligonucleotide
aatctgcaggatatgcctcaccgctggaag

SEQ ID NO: 320337 - DNA, 29 bp, Artificial Sequence
  Description of Artificial Sequence: Synthetic oligonucleotide
atctgcaggatatgcctcaccgctggaag

SEQ ID NO: 320338 - DNA, 28 bp, Artificial Sequence
  Description of Artificial Sequence: Synthetic oligonucleotide
tctgcaggatatgcctcaccgctggaag

SEQ ID NO: 320339 - DNA, 27 bp, Artificial Sequence
  Description of Artificial Sequence: Synthetic oligonucleotide
ctgcaggatatgcctcaccgctggaag

SEQ ID NO: 320340 - DNA, 27 bp, Artificial Sequence
  Description of Artificial Sequence: Synthetic oligonucleotide
tgcaggatatgcctcaccgctggaagc

SEQ ID NO: 320341 - DNA, 26 bp, Artificial Sequence
  Description of Artificial Sequence: Synthetic oligonucleotide
gcaggatatgcctcaccgctggaagc

SEQ ID NO: 320342 - DNA, 27 bp, Artificial Sequence
  Description of Artificial Sequence: Synthetic oligonucleotide
caggatatgcctcaccgctggaagcgt

SEQ ID NO: 320343 - DNA, 27 bp, Artificial Sequence
  Description of Artificial Sequence: Synthetic oligonucleotide
aggatatgcctcaccgctggaagcgtg

SEQ ID NO: 320344 - DNA, 27 bp, Artificial Sequence
  Description of Artificial Sequence: Synthetic oligonucleotide
ggatatgcctcaccgctggaagcgtgt

SEQ ID NO: 320345 - DNA, 27 bp, Artificial Sequence
  Description of Artificial Sequence: Synthetic oligonucleotide
gatatgcctcaccgctggaagcgtgtg

SEQ ID NO: 320346 - DNA, 27 bp, Artificial Sequence
  Description of Artificial Sequence: Synthetic oligonucleotide
atatgcctcaccgctggaagcgtgtgg

SEQ ID NO: 320347 - DNA, 27 bp, Artificial Sequence
  Description of Artificial Sequence: Synthetic oligonucleotide
tatgcctcaccgctggaagcgtgtggt

SEQ ID NO: 320348 - DNA, 26 bp, Artificial Sequence
  Description of Artificial Sequence: Synthetic oligonucleotide
atgcctcaccgctggaagcgtgtggt

SEQ ID NO: 320349 - DNA, 25 bp, Artificial Sequence
  Description of Artificial Sequence: Synthetic oligonucleotide
tgcctcaccgctggaagcgtgtggt

SEQ ID NO: 320350 - DNA, 24 bp, Artificial Sequence
  Description of Artificial Sequence: Synthetic oligonucleotide
gcctcaccgctggaagcgtgtggt

SEQ ID NO: 320351 - DNA, 24 bp, Artificial Sequence
  Description of Artificial Sequence: Synthetic oligonucleotide
cctcaccgctggaagcgtgtggtg

SEQ ID NO: 320352 - DNA, 24 bp, Artificial Sequence
  Description of Artificial Sequence: Synthetic oligonucleotide
ctcaccgctggaagcgtgtggtgg

SEQ ID NO: 320353 - DNA, 24 bp, Artificial Sequence
  Description of Artificial Sequence: Synthetic oligonucleotide
tcaccgctggaagcgtgtggtggc

SEQ ID NO: 320354 - DNA, 23 bp, Artificial Sequence
  Description of Artificial Sequence: Synthetic oligonucleotide
caccgctggaagcgtgtggtggc

SEQ ID NO: 320355 - DNA, 23 bp, Artificial Sequence
  Description of Artificial Sequence: Synthetic oligonucleotide
accgctggaagcgtgtggtggcc

SEQ ID NO: 320356 - DNA, 22 bp, Artificial Sequence
  Description of Artificial Sequence: Synthetic oligonucleotide
ccgctggaagcgtgtggtggcc

SEQ ID NO: 320357 - DNA, 23 bp, Artificial Sequence
  Description of Artificial Sequence: Synthetic oligonucleotide
cgctggaagcgtgtggtggccga

SEQ ID NO: 320358 - DNA, 24 bp, Artificial Sequence
  Description of Artificial Sequence: Synthetic oligonucleotide
gctggaagcgtgtggtggccgaca

SEQ ID NO: 320359 - DNA, 24 bp, Artificial Sequence
  Description of Artificial Sequence: Synthetic oligonucleotide
ctggaagcgtgtggtggccgacag

SEQ ID NO: 320360 - DNA, 24 bp, Artificial Sequence
  Description of Artificial Sequence: Synthetic oligonucleotide
tggaagcgtgtggtggccgacagc

SEQ ID NO: 320361 - DNA, 23 bp, Artificial Sequence
  Description of Artificial Sequence: Synthetic oligonucleotide
ggaagcgtgtggtggccgacagc

SEQ ID NO: 320362 - DNA, 23 bp, Artificial Sequence
  Description of Artificial Sequence: Synthetic oligonucleotide
gaagcgtgtggtggccgacagcg

SEQ ID NO: 320363 - DNA, 23 bp, Artificial Sequence
  Description of Artificial Sequence: Synthetic oligonucleotide
aagcgtgtggtggccgacagcgc

SEQ ID NO: 320364 - DNA, 22 bp, Artificial Sequence
  Description of Artificial Sequence: Synthetic oligonucleotide
agcgtgtggtggccgacagcgc

SEQ ID NO: 320365 - DNA, 21 bp, Artificial Sequence
  Description of Artificial Sequence: Synthetic oligonucleotide
gcgtgtggtggccgacagcgc

SEQ ID NO: 320366 - DNA, 23 bp, Artificial Sequence
  Description of Artificial Sequence: Synthetic oligonucleotide
cgtgtggtggccgacagcgcgta

SEQ ID NO: 320367 - DNA, 23 bp, Artificial Sequence
  Description of Artificial Sequence: Synthetic oligonucleotide
gtgtggtggccgacagcgcgtac

SEQ ID NO: 320368 - DNA, 24 bp, Artificial Sequence
  Description of Artificial Sequence: Synthetic oligonucleotide
tgtggtggccgacagcgcgtacct

SEQ ID NO: 320369 - DNA, 23 bp, Artificial Sequence
  Description of Artificial Sequence: Synthetic oligonucleotide
gtggtggccgacagcgcgtacct

SEQ ID NO: 320370 - DNA, 23 bp, Artificial Sequence
  Description of Artificial Sequence: Synthetic oligonucleotide
tggtggccgacagcgcgtacctc

SEQ ID NO: 320371 - DNA, 22 bp, Artificial Sequence
  Description of Artificial Sequence: Synthetic oligonucleotide
ggtggccgacagcgcgtacctc

SEQ ID NO: 320372 - DNA, 22 bp, Artificial Sequence
  Description of Artificial Sequence: Synthetic oligonucleotide
gtggccgacagcgcgtacctcc

SEQ ID NO: 320373 - DNA, 22 bp, Artificial Sequence
  Description of Artificial Sequence: Synthetic oligonucleotide
tggccgacagcgcgtacctccg

SEQ ID NO: 320374 - DNA, 21 bp, Artificial Sequence
  Description of Artificial Sequence: Synthetic oligonucleotide
ggccgacagcgcgtacctccg

SEQ ID NO: 320375 - DNA, 21 bp, Artificial Sequence
  Description of Artificial Sequence: Synthetic oligonucleotide
gccgacagcgcgtacctccgg

SEQ ID NO: 320376 - DNA, 22 bp, Artificial Sequence
  Description of Artificial Sequence: Synthetic oligonucleotide
ccgacagcgcgtacctccggga

SEQ ID NO: 320377 - DNA, 22 bp, Artificial Sequence
  Description of Artificial Sequence: Synthetic oligonucleotide
cgacagcgcgtacctccgggag

SEQ ID NO: 320378 - DNA, 22 bp, Artificial Sequence
  Description of Artificial Sequence: Synthetic oligonucleotide
gacagcgcgtacctccgggagg

SEQ ID NO: 320379 - DNA, 22 bp, Artificial Sequence
  Description of Artificial Sequence: Synthetic oligonucleotide
acagcgcgtacctccgggaggc

SEQ ID NO: 320380 - DNA, 21 bp, Artificial Sequence
  Description of Artificial Sequence: Synthetic oligonucleotide
cagcgcgtacctccgggaggc

SEQ ID NO: 320381 - DNA, 23 bp, Artificial Sequence
  Description of Artificial Sequence: Synthetic oligonucleotide
agcgcgtacctccgggaggccat

SEQ ID NO: 320382 - DNA, 22 bp, Artificial Sequence
  Description of Artificial Sequence: Synthetic oligonucleotide
gcgcgtacctccgggaggccat

SEQ ID NO: 320383 - DNA, 22 bp, Artificial Sequence
  Description of Artificial Sequence: Synthetic oligonucleotide
cgcgtacctccgggaggccatg

SEQ ID NO: 320384 - DNA, 23 bp, Artificial Sequence
  Description of Artificial Sequence: Synthetic oligonucleotide
gcgtacctccgggaggccatggt

SEQ ID NO: 320385 - DNA, 24 bp, Artificial Sequence
  Description of Artificial Sequence: Synthetic oligonucleotide
cgtacctccgggaggccatggtct

SEQ ID NO: 320386 - DNA, 24 bp, Artificial Sequence
  Description of Artificial Sequence: Synthetic oligonucleotide
gtacctccgggaggccatggtctg

SEQ ID NO: 320387 - DNA, 26 bp, Artificial Sequence
  Description of Artificial Sequence: Synthetic oligonucleotide
tacctccgggaggccatggtctggtt

SEQ ID NO: 320388 - DNA, 25 bp, Artificial Sequence
  Description of Artificial Sequence: Synthetic oligonucleotide
acctccgggaggccatggtctggtt

SEQ ID NO: 320389 - DNA, 24 bp, Artificial Sequence
  Description of Artificial Sequence: Synthetic oligonucleotide
cctccgggaggccatggtctggtt

SEQ ID NO: 320390 - DNA, 24 bp, Artificial Sequence
  Description of Artificial Sequence: Synthetic oligonucleotide
ctccgggaggccatggtctggttc

SEQ ID NO: 320391 - DNA, 24 bp, Artificial Sequence
  Description of Artificial Sequence: Synthetic oligonucleotide
tccgggaggccatggtctggttcc

SEQ ID NO: 320392 - DNA, 23 bp, Artificial Sequence
  Description of Artificial Sequence: Synthetic oligonucleotide
ccgggaggccatggtctggttcc

SEQ ID NO: 320393 - DNA, 23 bp, Artificial Sequence
  Description of Artificial Sequence: Synthetic oligonucleotide
cgggaggccatggtctggttccg

SEQ ID NO: 320394 - DNA, 23 bp, Artificial Sequence
  Description of Artificial Sequence: Synthetic oligonucleotide
gggaggccatggtctggttccgc

SEQ ID NO: 320395 - DNA, 23 bp, Artificial Sequence
  Description of Artificial Sequence: Synthetic oligonucleotide
ggaggccatggtctggttccgcg

SEQ ID NO: 320396 - DNA, 24 bp, Artificial Sequence
  Description of Artificial Sequence: Synthetic oligonucleotide
gaggccatggtctggttccgcgca

SEQ ID NO: 320397 - DNA, 24 bp, Artificial Sequence
  Description of Artificial Sequence: Synthetic oligonucleotide
aggccatggtctggttccgcgcac

SEQ ID NO: 320398 - DNA, 23 bp, Artificial Sequence
  Description of Artificial Sequence: Synthetic oligonucleotide
ggccatggtctggttccgcgcac

SEQ ID NO: 320399 - DNA, 23 bp, Artificial Sequence
  Description of Artificial Sequence: Synthetic oligonucleotide
gccatggtctggttccgcgcacg

SEQ ID NO: 320400 - DNA, 23 bp, Artificial Sequence
  Description of Artificial Sequence: Synthetic oligonucleotide
ccatggtctggttccgcgcacgg

SEQ ID NO: 320401 - DNA, 24 bp, Artificial Sequence
  Description of Artificial Sequence: Synthetic oligonucleotide
catggtctggttccgcgcacggca

SEQ ID NO: 320402 - DNA, 24 bp, Artificial Sequence
  Description of Artificial Sequence: Synthetic oligonucleotide
atggtctggttccgcgcacggcac

SEQ ID NO: 320403 - DNA, 23 bp, Artificial Sequence
  Description of Artificial Sequence: Synthetic oligonucleotide
tggtctggttccgcgcacggcac

SEQ ID NO: 320404 - DNA, 22 bp, Artificial Sequence
  Description of Artificial Sequence: Synthetic oligonucleotide
ggtctggttccgcgcacggcac

SEQ ID NO: 320405 - DNA, 24 bp, Artificial Sequence
  Description of Artificial Sequence: Synthetic oligonucleotide
gtctggttccgcgcacggcaccaa

SEQ ID NO: 320406 - DNA, 24 bp, Artificial Sequence
  Description of Artificial Sequence: Synthetic oligonucleotide
tctggttccgcgcacggcaccaag

SEQ ID NO: 320407 - DNA, 23 bp, Artificial Sequence
  Description of Artificial Sequence: Synthetic oligonucleotide
ctggttccgcgcacggcaccaag

SEQ ID NO: 320408 - DNA, 23 bp, Artificial Sequence
  Description of Artificial Sequence: Synthetic oligonucleotide
tggttccgcgcacggcaccaagc

SEQ ID NO: 320409 - DNA, 22 bp, Artificial Sequence
  Description of Artificial Sequence: Synthetic oligonucleotide
ggttccgcgcacggcaccaagc

SEQ ID NO: 320410 - DNA, 22 bp, Artificial Sequence
  Description of Artificial Sequence: Synthetic oligonucleotide
gttccgcgcacggcaccaagcc

SEQ ID NO: 320411 - DNA, 22 bp, Artificial Sequence
  Description of Artificial Sequence: Synthetic oligonucleotide
ttccgcgcacggcaccaagccc

SEQ ID NO: 320412 - DNA, 21 bp, Artificial Sequence
  Description of Artificial Sequence: Synthetic oligonucleotide
tccgcgcacggcaccaagccc

SEQ ID NO: 320413 - DNA, 20 bp, Artificial Sequence
  Description of Artificial Sequence: Synthetic oligonucleotide
ccgcgcacggcaccaagccc

SEQ ID NO: 320414 - DNA, 20 bp, Artificial Sequence
  Description of Artificial Sequence: Synthetic oligonucleotide
cgcgcacggcaccaagcccc

SEQ ID NO: 320415 - DNA, 20 bp, Artificial Sequence
  Description of Artificial Sequence: Synthetic oligonucleotide
gcgcacggcaccaagccccc

SEQ ID NO: 320416 - DNA, 24 bp, Artificial Sequence
  Description of Artificial Sequence: Synthetic oligonucleotide
cgcacggcaccaagcccccgattt

SEQ ID NO: 320417 - DNA, 24 bp, Artificial Sequence
  Description of Artificial Sequence: Synthetic oligonucleotide
gcacggcaccaagcccccgatttc

SEQ ID NO: 320418 - DNA, 25 bp, Artificial Sequence
  Description of Artificial Sequence: Synthetic oligonucleotide
cacggcaccaagcccccgatttcgt

SEQ ID NO: 320419 - DNA, 25 bp, Artificial Sequence
  Description of Artificial Sequence: Synthetic oligonucleotide
acggcaccaagcccccgatttcgtg

SEQ ID NO: 320420 - DNA, 24 bp, Artificial Sequence
  Description of Artificial Sequence: Synthetic oligonucleotide
cggcaccaagcccccgatttcgtg

SEQ ID NO: 320421 - DNA, 25 bp, Artificial Sequence
  Description of Artificial Sequence: Synthetic oligonucleotide
ggcaccaagcccccgatttcgtggt

SEQ ID NO: 320422 - DNA, 26 bp, Artificial Sequence
  Description of Artificial Sequence: Synthetic oligonucleotide
gcaccaagcccccgatttcgtggtga

SEQ ID NO: 320423 - DNA, 26 bp, Artificial Sequence
  Description of Artificial Sequence: Synthetic oligonucleotide
caccaagcccccgatttcgtggtgac

SEQ ID NO: 320424 - DNA, 27 bp, Artificial Sequence
  Description of Artificial Sequence: Synthetic oligonucleotide
accaagcccccgatttcgtggtgacca

SEQ ID NO: 320425 - DNA, 26 bp, Artificial Sequence
  Description of Artificial Sequence: Synthetic oligonucleotide
ccaagcccccgatttcgtggtgacca

SEQ ID NO: 320426 - DNA, 26 bp, Artificial Sequence
  Description of Artificial Sequence: Synthetic oligonucleotide
caagcccccgatttcgtggtgaccag

SEQ ID NO: 320427 - DNA, 27 bp, Artificial Sequence
  Description of Artificial Sequence: Synthetic oligonucleotide
aagcccccgatttcgtggtgaccagca

SEQ ID NO: 320428 - DNA, 27 bp, Artificial Sequence
  Description of Artificial Sequence: Synthetic oligonucleotide
agcccccgatttcgtggtgaccagcaa

SEQ ID NO: 320429 - DNA, 26 bp, Artificial Sequence
  Description of Artificial Sequence: Synthetic oligonucleotide
gcccccgatttcgtggtgaccagcaa

SEQ ID NO: 320430 - DNA, 26 bp, Artificial Sequence
  Description of Artificial Sequence: Synthetic oligonucleotide
cccccgatttcgtggtgaccagcaac

SEQ ID NO: 320431 - DNA, 26 bp, Artificial Sequence
  Description of Artificial Sequence: Synthetic oligonucleotide
ccccgatttcgtggtgaccagcaacc

SEQ ID NO: 320432 - DNA, 26 bp, Artificial Sequence
  Description of Artificial Sequence: Synthetic oligonucleotide
cccgatttcgtggtgaccagcaaccg

SEQ ID NO: 320433 - DNA, 27 bp, Artificial Sequence
  Description of Artificial Sequence: Synthetic oligonucleotide
ccgatttcgtggtgaccagcaaccgca

SEQ ID NO: 320434 - DNA, 28 bp, Artificial Sequence
  Description of Artificial Sequence: Synthetic oligonucleotide
cgatttcgtggtgaccagcaaccgcatg

SEQ ID NO: 320435 - DNA, 28 bp, Artificial Sequence
  Description of Artificial Sequence: Synthetic oligonucleotide
gatttcgtggtgaccagcaaccgcatgg

SEQ ID NO: 320436 - DNA, 29 bp, Artificial Sequence
  Description of Artificial Sequence: Synthetic oligonucleotide
atttcgtggtgaccagcaaccgcatggag

SEQ ID NO: 320437 - DNA, 28 bp, Artificial Sequence
  Description of Artificial Sequence: Synthetic oligonucleotide
tttcgtggtgaccagcaaccgcatggag

SEQ ID NO: 320438 - DNA, 27 bp, Artificial Sequence
  Description of Artificial Sequence: Synthetic oligonucleotide
ttcgtggtgaccagcaaccgcatggag

SEQ ID NO: 320439 - DNA, 27 bp, Artificial Sequence
  Description of Artificial Sequence: Synthetic oligonucleotide
tcgtggtgaccagcaaccgcatggagt

SEQ ID NO: 320440 - DNA, 26 bp, Artificial Sequence
  Description of Artificial Sequence: Synthetic oligonucleotide
cgtggtgaccagcaaccgcatggagt

SEQ ID NO: 320441 - DNA, 26 bp, Artificial Sequence
  Description of Artificial Sequence: Synthetic oligonucleotide
gtggtgaccagcaaccgcatggagtc

SEQ ID NO: 320442 - DNA, 27 bp, Artificial Sequence
  Description of Artificial Sequence: Synthetic oligonucleotide
tggtgaccagcaaccgcatggagtcgt

SEQ ID NO: 320443 - DNA, 26 bp, Artificial Sequence
  Description of Artificial Sequence: Synthetic oligonucleotide
ggtgaccagcaaccgcatggagtcgt

SEQ ID NO: 320444 - DNA, 27 bp, Artificial Sequence
  Description of Artificial Sequence: Synthetic oligonucleotide
gtgaccagcaaccgcatggagtcgtgt

SEQ ID NO: 320445 - DNA, 30 bp, Artificial Sequence
  Description of Artificial Sequence: Synthetic oligonucleotide
tgaccagcaaccgcatggagtcgtgtaaag

SEQ ID NO: 320446 - DNA, 29 bp, Artificial Sequence
  Description of Artificial Sequence: Synthetic oligonucleotide
gaccagcaaccgcatggagtcgtgtaaag

SEQ ID NO: 320447 - DNA, 33 bp, Artificial Sequence
  Description of Artificial Sequence: Synthetic oligonucleotide
accagcaaccgcatggagtcgtgtaaagataac

SEQ ID NO: 320448 - DNA, 32 bp, Artificial Sequence
  Description of Artificial Sequence: Synthetic oligonucleotide
ccagcaaccgcatggagtcgtgtaaagataac

SEQ ID NO: 320449 - DNA, 34 bp, Artificial Sequence
  Description of Artificial Sequence: Synthetic oligonucleotide
cagcaaccgcatggagtcgtgtaaagataacatc

SEQ ID NO: 320450 - DNA, 34 bp, Artificial Sequence
  Description of Artificial Sequence: Synthetic oligonucleotide
agcaaccgcatggagtcgtgtaaagataacatcg

SEQ ID NO: 320451 - DNA, 33 bp, Artificial Sequence
  Description of Artificial Sequence: Synthetic oligonucleotide
gcaaccgcatggagtcgtgtaaagataacatcg

SEQ ID NO: 320452 - DNA, 34 bp, Artificial Sequence
  Description of Artificial Sequence: Synthetic oligonucleotide
caaccgcatggagtcgtgtaaagataacatcgac

SEQ ID NO: 320453 - DNA, 35 bp, Artificial Sequence
  Description of Artificial Sequence: Synthetic oligonucleotide
aaccgcatggagtcgtgtaaagataacatcgactc

SEQ ID NO: 320454 - DNA, 34 bp, Artificial Sequence
  Description of Artificial Sequence: Synthetic oligonucleotide
accgcatggagtcgtgtaaagataacatcgactc

SEQ ID NO: 320455 - DNA, 33 bp, Artificial Sequence
  Description of Artificial Sequence: Synthetic oligonucleotide
ccgcatggagtcgtgtaaagataacatcgactc

SEQ ID NO: 320456 - DNA, 33 bp, Artificial Sequence
  Description of Artificial Sequence: Synthetic oligonucleotide
cgcatggagtcgtgtaaagataacatcgactcc

SEQ ID NO: 320457 - DNA, 34 bp, Artificial Sequence
  Description of Artificial Sequence: Synthetic oligonucleotide
gcatggagtcgtgtaaagataacatcgactcctc

SEQ ID NO: 320458 - DNA, 34 bp, Artificial Sequence
  Description of Artificial Sequence: Synthetic oligonucleotide
catggagtcgtgtaaagataacatcgactcctcc

SEQ ID NO: 320459 - DNA, 34 bp, Artificial Sequence
  Description of Artificial Sequence: Synthetic oligonucleotide
atggagtcgtgtaaagataacatcgactcctccc

SEQ ID NO: 320460 - DNA, 33 bp, Artificial Sequence
  Description of Artificial Sequence: Synthetic oligonucleotide
tggagtcgtgtaaagataacatcgactcctccc

SEQ ID NO: 320461 - DNA, 32 bp, Artificial Sequence
  Description of Artificial Sequence: Synthetic oligonucleotide
ggagtcgtgtaaagataacatcgactcctccc

SEQ ID NO: 320462 - DNA, 33 bp, Artificial Sequence
  Description of Artificial Sequence: Synthetic oligonucleotide
gagtcgtgtaaagataacatcgactcctcccag

SEQ ID NO: 320463 - DNA, 33 bp, Artificial Sequence
  Description of Artificial Sequence: Synthetic oligonucleotide
agtcgtgtaaagataacatcgactcctcccagg

SEQ ID NO: 320464 - DNA, 32 bp, Artificial Sequence
  Description of Artificial Sequence: Synthetic oligonucleotide
gtcgtgtaaagataacatcgactcctcccagg

SEQ ID NO: 320465 - DNA, 32 bp, Artificial Sequence
  Description of Artificial Sequence: Synthetic oligonucleotide
tcgtgtaaagataacatcgactcctcccaggc

SEQ ID NO: 320466 - DNA, 31 bp, Artificial Sequence
  Description of Artificial Sequence: Synthetic oligonucleotide
cgtgtaaagataacatcgactcctcccaggc

SEQ ID NO: 320467 - DNA, 31 bp, Artificial Sequence
  Description of Artificial Sequence: Synthetic oligonucleotide
gtgtaaagataacatcgactcctcccaggcc

SEQ ID NO: 320468 - DNA, 31 bp, Artificial Sequence
  Description of Artificial Sequence: Synthetic oligonucleotide
tgtaaagataacatcgactcctcccaggccg

SEQ ID NO: 320469 - DNA, 30 bp, Artificial Sequence
  Description of Artificial Sequence: Synthetic oligonucleotide
gtaaagataacatcgactcctcccaggccg

SEQ ID NO: 320470 - DNA, 32 bp, Artificial Sequence
  Description of Artificial Sequence: Synthetic oligonucleotide
taaagataacatcgactcctcccaggccgatg

SEQ ID NO: 320471 - DNA, 31 bp, Artificial Sequence
  Description of Artificial Sequence: Synthetic oligonucleotide
aaagataacatcgactcctcccaggccgatg

SEQ ID NO: 320472 - DNA, 30 bp, Artificial Sequence
  Description of Artificial Sequence: Synthetic oligonucleotide
aagataacatcgactcctcccaggccgatg

SEQ ID NO: 320473 - DNA, 29 bp, Artificial Sequence
  Description of Artificial Sequence: Synthetic oligonucleotide
agataacatcgactcctcccaggccgatg

SEQ ID NO: 320474 - DNA, 28 bp, Artificial Sequence
  Description of Artificial Sequence: Synthetic oligonucleotide
gataacatcgactcctcccaggccgatg

SEQ ID NO: 320475 - DNA, 29 bp, Artificial Sequence
  Description of Artificial Sequence: Synthetic oligonucleotide
ataacatcgactcctcccaggccgatgtg

SEQ ID NO: 320476 - DNA, 28 bp, Artificial Sequence
  Description of Artificial Sequence: Synthetic oligonucleotide
taacatcgactcctcccaggccgatgtg

SEQ ID NO: 320477 - DNA, 27 bp, Artificial Sequence
  Description of Artificial Sequence: Synthetic oligonucleotide
aacatcgactcctcccaggccgatgtg

SEQ ID NO: 320478 - DNA, 27 bp, Artificial Sequence
  Description of Artificial Sequence: Synthetic oligonucleotide
acatcgactcctcccaggccgatgtga

SEQ ID NO: 320479 - DNA, 26 bp, Artificial Sequence
  Description of Artificial Sequence: Synthetic oligonucleotide
catcgactcctcccaggccgatgtga

SEQ ID NO: 320480 - DNA, 26 bp, Artificial Sequence
  Description of Artificial Sequence: Synthetic oligonucleotide
atcgactcctcccaggccgatgtgac

SEQ ID NO: 320481 - DNA, 25 bp, Artificial Sequence
  Description of Artificial Sequence: Synthetic oligonucleotide
tcgactcctcccaggccgatgtgac

SEQ ID NO: 320482 - DNA, 24 bp, Artificial Sequence
  Description of Artificial Sequence: Synthetic oligonucleotide
cgactcctcccaggccgatgtgac

SEQ ID NO: 320483 - DNA, 27 bp, Artificial Sequence
  Description of Artificial Sequence: Synthetic oligonucleotide
gactcctcccaggccgatgtgaccttt

SEQ ID NO: 320484 - DNA, 27 bp, Artificial Sequence
  Description of Artificial Sequence: Synthetic oligonucleotide
actcctcccaggccgatgtgacctttg

SEQ ID NO: 320485 - DNA, 26 bp, Artificial Sequence
  Description of Artificial Sequence: Synthetic oligonucleotide
ctcctcccaggccgatgtgacctttg

SEQ ID NO: 320486 - DNA, 27 bp, Artificial Sequence
  Description of Artificial Sequence: Synthetic oligonucleotide
tcctcccaggccgatgtgacctttgct

SEQ ID NO: 320487 - DNA, 26 bp, Artificial Sequence
  Description of Artificial Sequence: Synthetic oligonucleotide
cctcccaggccgatgtgacctttgct

SEQ ID NO: 320488 - DNA, 26 bp, Artificial Sequence
  Description of Artificial Sequence: Synthetic oligonucleotide
ctcccaggccgatgtgacctttgctg

SEQ ID NO: 320489 - DNA, 26 bp, Artificial Sequence
  Description of Artificial Sequence: Synthetic oligonucleotide
tcccaggccgatgtgacctttgctgg

SEQ ID NO: 320490 - DNA, 25 bp, Artificial Sequence
  Description of Artificial Sequence: Synthetic oligonucleotide
cccaggccgatgtgacctttgctgg

SEQ ID NO: 320491 - DNA, 25 bp, Artificial Sequence
  Description of Artificial Sequence: Synthetic oligonucleotide
ccaggccgatgtgacctttgctggc

SEQ ID NO: 320492 - DNA, 27 bp, Artificial Sequence
  Description of Artificial Sequence: Synthetic oligonucleotide
caggccgatgtgacctttgctggccat

SEQ ID NO: 320493 - DNA, 27 bp, Artificial Sequence
  Description of Artificial Sequence: Synthetic oligonucleotide
aggccgatgtgacctttgctggccatg

SEQ ID NO: 320494 - DNA, 26 bp, Artificial Sequence
  Description of Artificial Sequence: Synthetic oligonucleotide
ggccgatgtgacctttgctggccatg

SEQ ID NO: 320495 - DNA, 27 bp, Artificial Sequence
  Description of Artificial Sequence: Synthetic oligonucleotide
gccgatgtgacctttgctggccatgga

SEQ ID NO: 320496 - DNA, 27 bp, Artificial Sequence
  Description of Artificial Sequence: Synthetic oligonucleotide
ccgatgtgacctttgctggccatggac

SEQ ID NO: 320497 - DNA, 28 bp, Artificial Sequence
  Description of Artificial Sequence: Synthetic oligonucleotide
cgatgtgacctttgctggccatggacag

SEQ ID NO: 320498 - DNA, 28 bp, Artificial Sequence
  Description of Artificial Sequence: Synthetic oligonucleotide
gatgtgacctttgctggccatggacagg

SEQ ID NO: 320499 - DNA, 29 bp, Artificial Sequence
  Description of Artificial Sequence: Synthetic oligonucleotide
atgtgacctttgctggccatggacaggtg

SEQ ID NO: 320500 - DNA, 28 bp, Artificial Sequence
  Description of Artificial Sequence: Synthetic oligonucleotide
tgtgacctttgctggccatggacaggtg

SEQ ID NO: 320501 - DNA, 27 bp, Artificial Sequence
  Description of Artificial Sequence: Synthetic oligonucleotide
gtgacctttgctggccatggacaggtg

SEQ ID NO: 320502 - DNA, 27 bp, Artificial Sequence
  Description of Artificial Sequence: Synthetic oligonucleotide
tgacctttgctggccatggacaggtgg

SEQ ID NO: 320503 - DNA, 26 bp, Artificial Sequence
  Description of Artificial Sequence: Synthetic oligonucleotide
gacctttgctggccatggacaggtgg

SEQ ID NO: 320504 - DNA, 27 bp, Artificial Sequence
  Description of Artificial Sequence: Synthetic oligonucleotide
acctttgctggccatggacaggtggct

SEQ ID NO: 320505 - DNA, 27 bp, Artificial Sequence
  Description of Artificial Sequence: Synthetic oligonucleotide
cctttgctggccatggacaggtggcta

SEQ ID NO: 320506 - DNA, 27 bp, Artificial Sequence
  Description of Artificial Sequence: Synthetic oligonucleotide
ctttgctggccatggacaggtggctac

SEQ ID NO: 320507 - DNA, 28 bp, Artificial Sequence
  Description of Artificial Sequence: Synthetic oligonucleotide
tttgctggccatggacaggtggctacac

SEQ ID NO: 320508 - DNA, 27 bp, Artificial Sequence
  Description of Artificial Sequence: Synthetic oligonucleotide
ttgctggccatggacaggtggctacac

SEQ ID NO: 320509 - DNA, 26 bp, Artificial Sequence
  Description of Artificial Sequence: Synthetic oligonucleotide
tgctggccatggacaggtggctacac

SEQ ID NO: 320510 - DNA, 25 bp, Artificial Sequence
  Description of Artificial Sequence: Synthetic oligonucleotide
gctggccatggacaggtggctacac

SEQ ID NO: 320511 - DNA, 25 bp, Artificial Sequence
  Description of Artificial Sequence: Synthetic oligonucleotide
ctggccatggacaggtggctacacc

SEQ ID NO: 320512 - DNA, 26 bp, Artificial Sequence
  Description of Artificial Sequence: Synthetic oligonucleotide
tggccatggacaggtggctacaccct

SEQ ID NO: 320513 - DNA, 25 bp, Artificial Sequence
  Description of Artificial Sequence: Synthetic oligonucleotide
ggccatggacaggtggctacaccct

SEQ ID NO: 320514 - DNA, 25 bp, Artificial Sequence
  Description of Artificial Sequence: Synthetic oligonucleotide
gccatggacaggtggctacaccctg

SEQ ID NO: 320515 - DNA, 27 bp, Artificial Sequence
  Description of Artificial Sequence: Synthetic oligonucleotide
ccatggacaggtggctacaccctggaa

SEQ ID NO: 320516 - DNA, 28 bp, Artificial Sequence
  Description of Artificial Sequence: Synthetic oligonucleotide
catggacaggtggctacaccctggaaag

SEQ ID NO: 320517 - DNA, 29 bp, Artificial Sequence
  Description of Artificial Sequence: Synthetic oligonucleotide
atggacaggtggctacaccctggaaagac

SEQ ID NO: 320518 - DNA, 28 bp, Artificial Sequence
  Description of Artificial Sequence: Synthetic oligonucleotide
tggacaggtggctacaccctggaaagac

SEQ ID NO: 320519 - DNA, 27 bp, Artificial Sequence
  Description of Artificial Sequence: Synthetic oligonucleotide
ggacaggtggctacaccctggaaagac

SEQ ID NO: 320520 - DNA, 30 bp, Artificial Sequence
  Description of Artificial Sequence: Synthetic oligonucleotide
gacaggtggctacaccctggaaagacattg

SEQ ID NO: 320521 - DNA, 30 bp, Artificial Sequence
  Description of Artificial Sequence: Synthetic oligonucleotide
acaggtggctacaccctggaaagacattgc

SEQ ID NO: 320522 - DNA, 29 bp, Artificial Sequence
  Description of Artificial Sequence: Synthetic oligonucleotide
caggtggctacaccctggaaagacattgc

SEQ ID NO: 320523 - DNA, 29 bp, Artificial Sequence
  Description of Artificial Sequence: Synthetic oligonucleotide
aggtggctacaccctggaaagacattgcc

SEQ ID NO: 320524 - DNA, 28 bp, Artificial Sequence
  Description of Artificial Sequence: Synthetic oligonucleotide
ggtggctacaccctggaaagacattgcc

SEQ ID NO: 320525 - DNA, 28 bp, Artificial Sequence
  Description of Artificial Sequence: Synthetic oligonucleotide
gtggctacaccctggaaagacattgccc

SEQ ID NO: 320526 - DNA, 29 bp, Artificial Sequence
  Description of Artificial Sequence: Synthetic oligonucleotide
tggctacaccctggaaagacattgccctg

SEQ ID NO: 320527 - DNA, 28 bp, Artificial Sequence
  Description of Artificial Sequence: Synthetic oligonucleotide
ggctacaccctggaaagacattgccctg

SEQ ID NO: 320528 - DNA, 28 bp, Artificial Sequence
  Description of Artificial Sequence: Synthetic oligonucleotide
gctacaccctggaaagacattgccctgc

SEQ ID NO: 320529 - DNA, 29 bp, Artificial Sequence
  Description of Artificial Sequence: Synthetic oligonucleotide
ctacaccctggaaagacattgccctgcac

SEQ ID NO: 320530 - DNA, 30 bp, Artificial Sequence
  Description of Artificial Sequence: Synthetic oligonucleotide
tacaccctggaaagacattgccctgcacac

SEQ ID NO: 320531 - DNA, 29 bp, Artificial Sequence
  Description of Artificial Sequence: Synthetic oligonucleotide
acaccctggaaagacattgccctgcacac

SEQ ID NO: 320532 - DNA, 28 bp, Artificial Sequence
  Description of Artificial Sequence: Synthetic oligonucleotide
caccctggaaagacattgccctgcacac

SEQ ID NO: 320533 - DNA, 29 bp, Artificial Sequence
  Description of Artificial Sequence: Synthetic oligonucleotide
accctggaaagacattgccctgcacacac

SEQ ID NO: 320534 - DNA, 28 bp, Artificial Sequence
  Description of Artificial Sequence: Synthetic oligonucleotide
ccctggaaagacattgccctgcacacac

SEQ ID NO: 320535 - DNA, 29 bp, Artificial Sequence
  Description of Artificial Sequence: Synthetic oligonucleotide
cctggaaagacattgccctgcacacacag

SEQ ID NO: 320536 - DNA, 30 bp, Artificial Sequence
  Description of Artificial Sequence: Synthetic oligonucleotide
ctggaaagacattgccctgcacacacagtg

SEQ ID NO: 320537 - DNA, 30 bp, Artificial Sequence
  Description of Artificial Sequence: Synthetic oligonucleotide
tggaaagacattgccctgcacacacagtgg

SEQ ID NO: 320538 - DNA, 29 bp, Artificial Sequence
  Description of Artificial Sequence: Synthetic oligonucleotide
ggaaagacattgccctgcacacacagtgg

SEQ ID NO: 320539 - DNA, 31 bp, Artificial Sequence
  Description of Artificial Sequence: Synthetic oligonucleotide
gaaagacattgccctgcacacacagtggaac

SEQ ID NO: 320540 - DNA, 31 bp, Artificial Sequence
  Description of Artificial Sequence: Synthetic oligonucleotide
aaagacattgccctgcacacacagtggaacc

SEQ ID NO: 320541 - DNA, 30 bp, Artificial Sequence
  Description of Artificial Sequence: Synthetic oligonucleotide
aagacattgccctgcacacacagtggaacc

SEQ ID NO: 320542 - DNA, 29 bp, Artificial Sequence
  Description of Artificial Sequence: Synthetic oligonucleotide
agacattgccctgcacacacagtggaacc

SEQ ID NO: 320543 - DNA, 28 bp, Artificial Sequence
  Description of Artificial Sequence: Synthetic oligonucleotide
gacattgccctgcacacacagtggaacc

SEQ ID NO: 320544 - DNA, 29 bp, Artificial Sequence
  Description of Artificial Sequence: Synthetic oligonucleotide
acattgccctgcacacacagtggaaccac

SEQ ID NO: 320545 - DNA, 28 bp, Artificial Sequence
  Description of Artificial Sequence: Synthetic oligonucleotide
cattgccctgcacacacagtggaaccac

SEQ ID NO: 320546 - DNA, 29 bp, Artificial Sequence
  Description of Artificial Sequence: Synthetic oligonucleotide
attgccctgcacacacagtggaaccacac

SEQ ID NO: 320547 - DNA, 28 bp, Artificial Sequence
  Description of Artificial Sequence: Synthetic oligonucleotide
ttgccctgcacacacagtggaaccacac

SEQ ID NO: 320548 - DNA, 27 bp, Artificial Sequence
  Description of Artificial Sequence: Synthetic oligonucleotide
tgccctgcacacacagtggaaccacac

SEQ ID NO: 320549 - DNA, 26 bp, Artificial Sequence
  Description of Artificial Sequence: Synthetic oligonucleotide
gccctgcacacacagtggaaccacac

SEQ ID NO: 320550 - DNA, 27 bp, Artificial Sequence
  Description of Artificial Sequence: Synthetic oligonucleotide
ccctgcacacacagtggaaccacacct

SEQ ID NO: 320551 - DNA, 31 bp, Artificial Sequence
  Description of Artificial Sequence: Synthetic oligonucleotide
cctgcacacacagtggaaccacacctttatg

SEQ ID NO: 320552 - DNA, 32 bp, Artificial Sequence
  Description of Artificial Sequence: Synthetic oligonucleotide
ctgcacacacagtggaaccacacctttatgac

SEQ ID NO: 320553 - DNA, 32 bp, Artificial Sequence
  Description of Artificial Sequence: Synthetic oligonucleotide
tgcacacacagtggaaccacacctttatgacc

SEQ ID NO: 320554 - DNA, 31 bp, Artificial Sequence
  Description of Artificial Sequence: Synthetic oligonucleotide
gcacacacagtggaaccacacctttatgacc

SEQ ID NO: 320555 - DNA, 34 bp, Artificial Sequence
  Description of Artificial Sequence: Synthetic oligonucleotide
cacacacagtggaaccacacctttatgaccaatg

SEQ ID NO: 320556 - DNA, 34 bp, Artificial Sequence
  Description of Artificial Sequence: Synthetic oligonucleotide
acacacagtggaaccacacctttatgaccaatgg

SEQ ID NO: 320557 - DNA, 33 bp, Artificial Sequence
  Description of Artificial Sequence: Synthetic oligonucleotide
cacacagtggaaccacacctttatgaccaatgg

SEQ ID NO: 320558 - DNA, 33 bp, Artificial Sequence
  Description of Artificial Sequence: Synthetic oligonucleotide
acacagtggaaccacacctttatgaccaatggc

SEQ ID NO: 320559 - DNA, 32 bp, Artificial Sequence
  Description of Artificial Sequence: Synthetic oligonucleotide
cacagtggaaccacacctttatgaccaatggc

SEQ ID NO: 320560 - DNA, 33 bp, Artificial Sequence
  Description of Artificial Sequence: Synthetic oligonucleotide
acagtggaaccacacctttatgaccaatggcac

SEQ ID NO: 320561 - DNA, 32 bp, Artificial Sequence
  Description of Artificial Sequence: Synthetic oligonucleotide
cagtggaaccacacctttatgaccaatggcac

SEQ ID NO: 320562 - DNA, 32 bp, Artificial Sequence
  Description of Artificial Sequence: Synthetic oligonucleotide
agtggaaccacacctttatgaccaatggcacc

SEQ ID NO: 320563 - DNA, 31 bp, Artificial Sequence
  Description of Artificial Sequence: Synthetic oligonucleotide
gtggaaccacacctttatgaccaatggcacc

SEQ ID NO: 320564 - DNA, 33 bp, Artificial Sequence
  Description of Artificial Sequence: Synthetic oligonucleotide
tggaaccacacctttatgaccaatggcaccttg

SEQ ID NO: 320565 - DNA, 32 bp, Artificial Sequence
  Description of Artificial Sequence: Synthetic oligonucleotide
ggaaccacacctttatgaccaatggcaccttg

SEQ ID NO: 320566 - DNA, 32 bp, Artificial Sequence
  Description of Artificial Sequence: Synthetic oligonucleotide
gaaccacacctttatgaccaatggcaccttgg

SEQ ID NO: 320567 - DNA, 32 bp, Artificial Sequence
  Description of Artificial Sequence: Synthetic oligonucleotide
aaccacacctttatgaccaatggcaccttggg

SEQ ID NO: 320568 - DNA, 31 bp, Artificial Sequence
  Description of Artificial Sequence: Synthetic oligonucleotide
accacacctttatgaccaatggcaccttggg

SEQ ID NO: 320569 - DNA, 30 bp, Artificial Sequence
  Description of Artificial Sequence: Synthetic oligonucleotide
ccacacctttatgaccaatggcaccttggg

SEQ ID NO: 320570 - DNA, 30 bp, Artificial Sequence
  Description of Artificial Sequence: Synthetic oligonucleotide
cacacctttatgaccaatggcaccttgggc

SEQ ID NO: 320571 - DNA, 32 bp, Artificial Sequence
  Description of Artificial Sequence: Synthetic oligonucleotide
acacctttatgaccaatggcaccttgggcttc

SEQ ID NO: 320572 - DNA, 31 bp, Artificial Sequence
  Description of Artificial Sequence: Synthetic oligonucleotide
cacctttatgaccaatggcaccttgggcttc

SEQ ID NO: 320573 - DNA, 32 bp, Artificial Sequence
  Description of Artificial Sequence: Synthetic oligonucleotide
acctttatgaccaatggcaccttgggcttctg

SEQ ID NO: 320574 - DNA, 31 bp, Artificial Sequence
  Description of Artificial Sequence: Synthetic oligonucleotide
cctttatgaccaatggcaccttgggcttctg

SEQ ID NO: 320575 - DNA, 31 bp, Artificial Sequence
  Description of Artificial Sequence: Synthetic oligonucleotide
ctttatgaccaatggcaccttgggcttctgg

SEQ ID NO: 320576 - DNA, 31 bp, Artificial Sequence
  Description of Artificial Sequence: Synthetic oligonucleotide
tttatgaccaatggcaccttgggcttctggc

SEQ ID NO: 320577 - DNA, 30 bp, Artificial Sequence
  Description of Artificial Sequence: Synthetic oligonucleotide
ttatgaccaatggcaccttgggcttctggc

SEQ ID NO: 320578 - DNA, 29 bp, Artificial Sequence
  Description of Artificial Sequence: Synthetic oligonucleotide
tatgaccaatggcaccttgggcttctggc

SEQ ID NO: 320579 - DNA, 28 bp, Artificial Sequence
  Description of Artificial Sequence: Synthetic oligonucleotide
atgaccaatggcaccttgggcttctggc

SEQ ID NO: 320580 - DNA, 27 bp, Artificial Sequence
  Description of Artificial Sequence: Synthetic oligonucleotide
tgaccaatggcaccttgggcttctggc

SEQ ID NO: 320581 - DNA, 26 bp, Artificial Sequence
  Description of Artificial Sequence: Synthetic oligonucleotide
gaccaatggcaccttgggcttctggc

SEQ ID NO: 320582 - DNA, 27 bp, Artificial Sequence
  Description of Artificial Sequence: Synthetic oligonucleotide
accaatggcaccttgggcttctggcct

SEQ ID NO: 320583 - DNA, 26 bp, Artificial Sequence
  Description of Artificial Sequence: Synthetic oligonucleotide
ccaatggcaccttgggcttctggcct

SEQ ID NO: 320584 - DNA, 26 bp, Artificial Sequence
  Description of Artificial Sequence: Synthetic oligonucleotide
caatggcaccttgggcttctggcctg

SEQ ID NO: 320585 - DNA, 26 bp, Artificial Sequence
  Description of Artificial Sequence: Synthetic oligonucleotide
aatggcaccttgggcttctggcctgc

SEQ ID NO: 320586 - DNA, 25 bp, Artificial Sequence
  Description of Artificial Sequence: Synthetic oligonucleotide
atggcaccttgggcttctggcctgc

SEQ ID NO: 320587 - DNA, 24 bp, Artificial Sequence
  Description of Artificial Sequence: Synthetic oligonucleotide
tggcaccttgggcttctggcctgc

SEQ ID NO: 320588 - DNA, 23 bp, Artificial Sequence
  Description of Artificial Sequence: Synthetic oligonucleotide
ggcaccttgggcttctggcctgc

SEQ ID NO: 320589 - DNA, 25 bp, Artificial Sequence
  Description of Artificial Sequence: Synthetic oligonucleotide
gcaccttgggcttctggcctgccta

SEQ ID NO: 320590 - DNA, 25 bp, Artificial Sequence
  Description of Artificial Sequence: Synthetic oligonucleotide
caccttgggcttctggcctgcctac

SEQ ID NO: 320591 - DNA, 26 bp, Artificial Sequence
  Description of Artificial Sequence: Synthetic oligonucleotide
accttgggcttctggcctgcctacca

SEQ ID NO: 320592 - DNA, 25 bp, Artificial Sequence
  Description of Artificial Sequence: Synthetic oligonucleotide
ccttgggcttctggcctgcctacca

SEQ ID NO: 320593 - DNA, 25 bp, Artificial Sequence
  Description of Artificial Sequence: Synthetic oligonucleotide
cttgggcttctggcctgcctaccag

SEQ ID NO: 320594 - DNA, 25 bp, Artificial Sequence
  Description of Artificial Sequence: Synthetic oligonucleotide
ttgggcttctggcctgcctaccagg

SEQ ID NO: 320595 - DNA, 24 bp, Artificial Sequence
  Description of Artificial Sequence: Synthetic oligonucleotide
tgggcttctggcctgcctaccagg

SEQ ID NO: 320596 - DNA, 23 bp, Artificial Sequence
  Description of Artificial Sequence: Synthetic oligonucleotide
gggcttctggcctgcctaccagg

SEQ ID NO: 320597 - DNA, 24 bp, Artificial Sequence
  Description of Artificial Sequence: Synthetic oligonucleotide
ggcttctggcctgcctaccaggct

SEQ ID NO: 320598 - DNA, 24 bp, Artificial Sequence
  Description of Artificial Sequence: Synthetic oligonucleotide
gcttctggcctgcctaccaggctg

SEQ ID NO: 320599 - DNA, 24 bp, Artificial Sequence
  Description of Artificial Sequence: Synthetic oligonucleotide
cttctggcctgcctaccaggctgg

SEQ ID NO: 320600 - DNA, 24 bp, Artificial Sequence
  Description of Artificial Sequence: Synthetic oligonucleotide
ttctggcctgcctaccaggctggc

SEQ ID NO: 320601 - DNA, 23 bp, Artificial Sequence
  Description of Artificial Sequence: Synthetic oligonucleotide
tctggcctgcctaccaggctggc

SEQ ID NO: 320602 - DNA, 22 bp, Artificial Sequence
  Description of Artificial Sequence: Synthetic oligonucleotide
ctggcctgcctaccaggctggc

SEQ ID NO: 320603 - DNA, 22 bp, Artificial Sequence
  Description of Artificial Sequence: Synthetic oligonucleotide
tggcctgcctaccaggctggcg

SEQ ID NO: 320604 - DNA, 21 bp, Artificial Sequence
  Description of Artificial Sequence: Synthetic oligonucleotide
ggcctgcctaccaggctggcg

SEQ ID NO: 320605 - DNA, 22 bp, Artificial Sequence
  Description of Artificial Sequence: Synthetic oligonucleotide
gcctgcctaccaggctggcggt

SEQ ID NO: 320606 - DNA, 23 bp, Artificial Sequence
  Description of Artificial Sequence: Synthetic oligonucleotide
cctgcctaccaggctggcggtga

SEQ ID NO: 320607 - DNA, 24 bp, Artificial Sequence
  Description of Artificial Sequence: Synthetic oligonucleotide
ctgcctaccaggctggcggtgaca

SEQ ID NO: 320608 - DNA, 25 bp, Artificial Sequence
  Description of Artificial Sequence: Synthetic oligonucleotide
tgcctaccaggctggcggtgacact

SEQ ID NO: 320609 - DNA, 24 bp, Artificial Sequence
  Description of Artificial Sequence: Synthetic oligonucleotide
gcctaccaggctggcggtgacact

SEQ ID NO: 320610 - DNA, 25 bp, Artificial Sequence
  Description of Artificial Sequence: Synthetic oligonucleotide
cctaccaggctggcggtgacactgt

SEQ ID NO: 320611 - DNA, 27 bp, Artificial Sequence
  Description of Artificial Sequence: Synthetic oligonucleotide
ctaccaggctggcggtgacactgtcaa

SEQ ID NO: 320612 - DNA, 27 bp, Artificial Sequence
  Description of Artificial Sequence: Synthetic oligonucleotide
taccaggctggcggtgacactgtcaac

SEQ ID NO: 320613 - DNA, 26 bp, Artificial Sequence
  Description of Artificial Sequence: Synthetic oligonucleotide
accaggctggcggtgacactgtcaac

SEQ ID NO: 320614 - DNA, 25 bp, Artificial Sequence
  Description of Artificial Sequence: Synthetic oligonucleotide
ccaggctggcggtgacactgtcaac

SEQ ID NO: 320615 - DNA, 26 bp, Artificial Sequence
  Description of Artificial Sequence: Synthetic oligonucleotide
caggctggcggtgacactgtcaacct

SEQ ID NO: 320616 - DNA, 26 bp, Artificial Sequence
  Description of Artificial Sequence: Synthetic oligonucleotide
aggctggcggtgacactgtcaacctg

SEQ ID NO: 320617 - DNA, 25 bp, Artificial Sequence
  Description of Artificial Sequence: Synthetic oligonucleotide
ggctggcggtgacactgtcaacctg

SEQ ID NO: 320618 - DNA, 25 bp, Artificial Sequence
  Description of Artificial Sequence: Synthetic oligonucleotide
gctggcggtgacactgtcaacctgg

SEQ ID NO: 320619 - DNA, 25 bp, Artificial Sequence
  Description of Artificial Sequence: Synthetic oligonucleotide
ctggcggtgacactgtcaacctggc

SEQ ID NO: 320620 - DNA, 27 bp, Artificial Sequence
  Description of Artificial Sequence: Synthetic oligonucleotide
tggcggtgacactgtcaacctggccat

SEQ ID NO: 320621 - DNA, 26 bp, Artificial Sequence
  Description of Artificial Sequence: Synthetic oligonucleotide
ggcggtgacactgtcaacctggccat

SEQ ID NO: 320622 - DNA, 27 bp, Artificial Sequence
  Description of Artificial Sequence: Synthetic oligonucleotide
gcggtgacactgtcaacctggccatct

SEQ ID NO: 320623 - DNA, 28 bp, Artificial Sequence
  Description of Artificial Sequence: Synthetic oligonucleotide
cggtgacactgtcaacctggccatcttc

SEQ ID NO: 320624 - DNA, 29 bp, Artificial Sequence
  Description of Artificial Sequence: Synthetic oligonucleotide
ggtgacactgtcaacctggccatcttcac

SEQ ID NO: 320625 - DNA, 29 bp, Artificial Sequence
  Description of Artificial Sequence: Synthetic oligonucleotide
gtgacactgtcaacctggccatcttcacc

SEQ ID NO: 320626 - DNA, 29 bp, Artificial Sequence
  Description of Artificial Sequence: Synthetic oligonucleotide
tgacactgtcaacctggccatcttcaccc

SEQ ID NO: 320627 - DNA, 28 bp, Artificial Sequence
  Description of Artificial Sequence: Synthetic oligonucleotide
gacactgtcaacctggccatcttcaccc

SEQ ID NO: 320628 - DNA, 29 bp, Artificial Sequence
  Description of Artificial Sequence: Synthetic oligonucleotide
acactgtcaacctggccatcttcaccctc

SEQ ID NO: 320629 - DNA, 28 bp, Artificial Sequence
  Description of Artificial Sequence: Synthetic oligonucleotide
cactgtcaacctggccatcttcaccctc

SEQ ID NO: 320630 - DNA, 28 bp, Artificial Sequence
  Description of Artificial Sequence: Synthetic oligonucleotide
actgtcaacctggccatcttcaccctcc

SEQ ID NO: 320631 - DNA, 27 bp, Artificial Sequence
  Description of Artificial Sequence: Synthetic oligonucleotide
ctgtcaacctggccatcttcaccctcc

SEQ ID NO: 320632 - DNA, 27 bp, Artificial Sequence
  Description of Artificial Sequence: Synthetic oligonucleotide
tgtcaacctggccatcttcaccctccc

SEQ ID NO: 320633 - DNA, 27 bp, Artificial Sequence
  Description of Artificial Sequence: Synthetic oligonucleotide
gtcaacctggccatcttcaccctccca

SEQ ID NO: 320634 - DNA, 27 bp, Artificial Sequence
  Description of Artificial Sequence: Synthetic oligonucleotide
tcaacctggccatcttcaccctcccag

SEQ ID NO: 320635 - DNA, 27 bp, Artificial Sequence
  Description of Artificial Sequence: Synthetic oligonucleotide
caacctggccatcttcaccctcccaga

SEQ ID NO: 320636 - DNA, 27 bp, Artificial Sequence
  Description of Artificial Sequence: Synthetic oligonucleotide
aacctggccatcttcaccctcccagac

SEQ ID NO: 320637 - DNA, 27 bp, Artificial Sequence
  Description of Artificial Sequence: Synthetic oligonucleotide
acctggccatcttcaccctcccagact

SEQ ID NO: 320638 - DNA, 26 bp, Artificial Sequence
  Description of Artificial Sequence: Synthetic oligonucleotide
cctggccatcttcaccctcccagact

SEQ ID NO: 320639 - DNA, 27 bp, Artificial Sequence
  Description of Artificial Sequence: Synthetic oligonucleotide
ctggccatcttcaccctcccagactct

SEQ ID NO: 320640 - DNA, 27 bp, Artificial Sequence
  Description of Artificial Sequence: Synthetic oligonucleotide
tggccatcttcaccctcccagactctc

SEQ ID NO: 320641 - DNA, 27 bp, Artificial Sequence
  Description of Artificial Sequence: Synthetic oligonucleotide
ggccatcttcaccctcccagactctca

SEQ ID NO: 320642 - DNA, 27 bp, Artificial Sequence
  Description of Artificial Sequence: Synthetic oligonucleotide
gccatcttcaccctcccagactctcag

SEQ ID NO: 320643 - DNA, 29 bp, Artificial Sequence
  Description of Artificial Sequence: Synthetic oligonucleotide
ccatcttcaccctcccagactctcagttc

SEQ ID NO: 320644 - DNA, 29 bp, Artificial Sequence
  Description of Artificial Sequence: Synthetic oligonucleotide
catcttcaccctcccagactctcagttcc

SEQ ID NO: 320645 - DNA, 30 bp, Artificial Sequence
  Description of Artificial Sequence: Synthetic oligonucleotide
atcttcaccctcccagactctcagttcctg

SEQ ID NO: 320646 - DNA, 29 bp, Artificial Sequence
  Description of Artificial Sequence: Synthetic oligonucleotide
tcttcaccctcccagactctcagttcctg

SEQ ID NO: 320647 - DNA, 28 bp, Artificial Sequence
  Description of Artificial Sequence: Synthetic oligonucleotide
cttcaccctcccagactctcagttcctg

SEQ ID NO: 320648 - DNA, 30 bp, Artificial Sequence
  Description of Artificial Sequence: Synthetic oligonucleotide
ttcaccctcccagactctcagttcctgatg

SEQ ID NO: 320649 - DNA, 29 bp, Artificial Sequence
  Description of Artificial Sequence: Synthetic oligonucleotide
tcaccctcccagactctcagttcctgatg

SEQ ID NO: 320650 - DNA, 28 bp, Artificial Sequence
  Description of Artificial Sequence: Synthetic oligonucleotide
caccctcccagactctcagttcctgatg

SEQ ID NO: 320651 - DNA, 30 bp, Artificial Sequence
  Description of Artificial Sequence: Synthetic oligonucleotide
accctcccagactctcagttcctgatgatc

SEQ ID NO: 320652 - DNA, 29 bp, Artificial Sequence
  Description of Artificial Sequence: Synthetic oligonucleotide
ccctcccagactctcagttcctgatgatc

SEQ ID NO: 320653 - DNA, 34 bp, Artificial Sequence
  Description of Artificial Sequence: Synthetic oligonucleotide
cctcccagactctcagttcctgatgatctttaac

SEQ ID NO: 320654 - DNA, 34 bp, Artificial Sequence
  Description of Artificial Sequence: Synthetic oligonucleotide
ctcccagactctcagttcctgatgatctttaacc

SEQ ID NO: 320655 - DNA, 34 bp, Artificial Sequence
  Description of Artificial Sequence: Synthetic oligonucleotide
tcccagactctcagttcctgatgatctttaaccc

SEQ ID NO: 320656 - DNA, 33 bp, Artificial Sequence
  Description of Artificial Sequence: Synthetic oligonucleotide
cccagactctcagttcctgatgatctttaaccc

SEQ ID NO: 320657 - DNA, 33 bp, Artificial Sequence
  Description of Artificial Sequence: Synthetic oligonucleotide
ccagactctcagttcctgatgatctttaacccg

SEQ ID NO: 320658 - DNA, 33 bp, Artificial Sequence
  Description of Artificial Sequence: Synthetic oligonucleotide
cagactctcagttcctgatgatctttaacccgg

SEQ ID NO: 320659 - DNA, 34 bp, Artificial Sequence
  Description of Artificial Sequence: Synthetic oligonucleotide
agactctcagttcctgatgatctttaacccggag

SEQ ID NO: 320660 - DNA, 33 bp, Artificial Sequence
  Description of Artificial Sequence: Synthetic oligonucleotide
gactctcagttcctgatgatctttaacccggag

SEQ ID NO: 320661 - DNA, 33 bp, Artificial Sequence
  Description of Artificial Sequence: Synthetic oligonucleotide
actctcagttcctgatgatctttaacccggagg

SEQ ID NO: 320662 - DNA, 32 bp, Artificial Sequence
  Description of Artificial Sequence: Synthetic oligonucleotide
ctctcagttcctgatgatctttaacccggagg

SEQ ID NO: 320663 - DNA, 32 bp, Artificial Sequence
  Description of Artificial Sequence: Synthetic oligonucleotide
tctcagttcctgatgatctttaacccggaggc

SEQ ID NO: 320664 - DNA, 31 bp, Artificial Sequence
  Description of Artificial Sequence: Synthetic oligonucleotide
ctcagttcctgatgatctttaacccggaggc

SEQ ID NO: 320665 - DNA, 31 bp, Artificial Sequence
  Description of Artificial Sequence: Synthetic oligonucleotide
tcagttcctgatgatctttaacccggaggcg

SEQ ID NO: 320666 - DNA, 30 bp, Artificial Sequence
  Description of Artificial Sequence: Synthetic oligonucleotide
cagttcctgatgatctttaacccggaggcg

SEQ ID NO: 320667 - DNA, 30 bp, Artificial Sequence
  Description of Artificial Sequence: Synthetic oligonucleotide
agttcctgatgatctttaacccggaggcgc

SEQ ID NO: 320668 - DNA, 29 bp, Artificial Sequence
  Description of Artificial Sequence: Synthetic oligonucleotide
gttcctgatgatctttaacccggaggcgc

SEQ ID NO: 320669 - DNA, 29 bp, Artificial Sequence
  Description of Artificial Sequence: Synthetic oligonucleotide
ttcctgatgatctttaacccggaggcgcc

SEQ ID NO: 320670 - DNA, 28 bp, Artificial Sequence
  Description of Artificial Sequence: Synthetic oligonucleotide
tcctgatgatctttaacccggaggcgcc

SEQ ID NO: 320671 - DNA, 27 bp, Artificial Sequence
  Description of Artificial Sequence: Synthetic oligonucleotide
cctgatgatctttaacccggaggcgcc

SEQ ID NO: 320672 - DNA, 27 bp, Artificial Sequence
  Description of Artificial Sequence: Synthetic oligonucleotide
ctgatgatctttaacccggaggcgccc

SEQ ID NO: 320673 - DNA, 29 bp, Artificial Sequence
  Description of Artificial Sequence: Synthetic oligonucleotide
tgatgatctttaacccggaggcgcccttc

SEQ ID NO: 320674 - DNA, 28 bp, Artificial Sequence
  Description of Artificial Sequence: Synthetic oligonucleotide
gatgatctttaacccggaggcgcccttc

SEQ ID NO: 320675 - DNA, 28 bp, Artificial Sequence
  Description of Artificial Sequence: Synthetic oligonucleotide
atgatctttaacccggaggcgcccttcc

SEQ ID NO: 320676 - DNA, 27 bp, Artificial Sequence
  Description of Artificial Sequence: Synthetic oligonucleotide
tgatctttaacccggaggcgcccttcc

SEQ ID NO: 320677 - DNA, 27 bp, Artificial Sequence
  Description of Artificial Sequence: Synthetic oligonucleotide
gatctttaacccggaggcgcccttcct

SEQ ID NO: 320678 - DNA, 27 bp, Artificial Sequence
  Description of Artificial Sequence: Synthetic oligonucleotide
atctttaacccggaggcgcccttcctg

SEQ ID NO: 320679 - DNA, 26 bp, Artificial Sequence
  Description of Artificial Sequence: Synthetic oligonucleotide
tctttaacccggaggcgcccttcctg

SEQ ID NO: 320680 - DNA, 25 bp, Artificial Sequence
  Description of Artificial Sequence: Synthetic oligonucleotide
ctttaacccggaggcgcccttcctg

SEQ ID NO: 320681 - DNA, 25 bp, Artificial Sequence
  Description of Artificial Sequence: Synthetic oligonucleotide
tttaacccggaggcgcccttcctgc

SEQ ID NO: 320682 - DNA, 24 bp, Artificial Sequence
  Description of Artificial Sequence: Synthetic oligonucleotide
ttaacccggaggcgcccttcctgc

SEQ ID NO: 320683 - DNA, 23 bp, Artificial Sequence
  Description of Artificial Sequence: Synthetic oligonucleotide
taacccggaggcgcccttcctgc

SEQ ID NO: 320684 - DNA, 22 bp, Artificial Sequence
  Description of Artificial Sequence: Synthetic oligonucleotide
aacccggaggcgcccttcctgc

SEQ ID NO: 320685 - DNA, 21 bp, Artificial Sequence
  Description of Artificial Sequence: Synthetic oligonucleotide
acccggaggcgcccttcctgc

SEQ ID NO: 320686 - DNA, 20 bp, Artificial Sequence
  Description of Artificial Sequence: Synthetic oligonucleotide
cccggaggcgcccttcctgc

SEQ ID NO: 320687 - DNA, 20 bp, Artificial Sequence
  Description of Artificial Sequence: Synthetic oligonucleotide
ccggaggcgcccttcctgcg

SEQ ID NO: 320688 - DNA, 20 bp, Artificial Sequence
  Description of Artificial Sequence: Synthetic oligonucleotide
cggaggcgcccttcctgcgc

SEQ ID NO: 320689 - DNA, 21 bp, Artificial Sequence
  Description of Artificial Sequence: Synthetic oligonucleotide
ggaggcgcccttcctgcgcga

SEQ ID NO: 320690 - DNA, 22 bp, Artificial Sequence
  Description of Artificial Sequence: Synthetic oligonucleotide
gaggcgcccttcctgcgcgagt

SEQ ID NO: 320691 - DNA, 22 bp, Artificial Sequence
  Description of Artificial Sequence: Synthetic oligonucleotide
aggcgcccttcctgcgcgagtg

SEQ ID NO: 320692 - DNA, 21 bp, Artificial Sequence
  Description of Artificial Sequence: Synthetic oligonucleotide
ggcgcccttcctgcgcgagtg

SEQ ID NO: 320693 - DNA, 21 bp, Artificial Sequence
  Description of Artificial Sequence: Synthetic oligonucleotide
gcgcccttcctgcgcgagtgg

SEQ ID NO: 320694 - DNA, 22 bp, Artificial Sequence
  Description of Artificial Sequence: Synthetic oligonucleotide
cgcccttcctgcgcgagtgggt

SEQ ID NO: 320695 - DNA, 22 bp, Artificial Sequence
  Description of Artificial Sequence: Synthetic oligonucleotide
gcccttcctgcgcgagtgggtc

SEQ ID NO: 320696 - DNA, 22 bp, Artificial Sequence
  Description of Artificial Sequence: Synthetic oligonucleotide
cccttcctgcgcgagtgggtcg

SEQ ID NO: 320697 - DNA, 22 bp, Artificial Sequence
  Description of Artificial Sequence: Synthetic oligonucleotide
ccttcctgcgcgagtgggtcgg

SEQ ID NO: 320698 - DNA, 27 bp, Artificial Sequence
  Description of Artificial Sequence: Synthetic oligonucleotide
cttcctgcgcgagtgggtcggcattaa

SEQ ID NO: 320699 - DNA, 28 bp, Artificial Sequence
  Description of Artificial Sequence: Synthetic oligonucleotide
ttcctgcgcgagtgggtcggcattaatc

SEQ ID NO: 320700 - DNA, 27 bp, Artificial Sequence
  Description of Artificial Sequence: Synthetic oligonucleotide
tcctgcgcgagtgggtcggcattaatc

SEQ ID NO: 320701 - DNA, 26 bp, Artificial Sequence
  Description of Artificial Sequence: Synthetic oligonucleotide
cctgcgcgagtgggtcggcattaatc

SEQ ID NO: 320702 - DNA, 27 bp, Artificial Sequence
  Description of Artificial Sequence: Synthetic oligonucleotide
ctgcgcgagtgggtcggcattaatcca

SEQ ID NO: 320703 - DNA, 27 bp, Artificial Sequence
  Description of Artificial Sequence: Synthetic oligonucleotide
tgcgcgagtgggtcggcattaatccag

SEQ ID NO: 320704 - DNA, 27 bp, Artificial Sequence
  Description of Artificial Sequence: Synthetic oligonucleotide
gcgcgagtgggtcggcattaatccaga

SEQ ID NO: 320705 - DNA, 27 bp, Artificial Sequence
  Description of Artificial Sequence: Synthetic oligonucleotide
cgcgagtgggtcggcattaatccagac

SEQ ID NO: 320706 - DNA, 29 bp, Artificial Sequence
  Description of Artificial Sequence: Synthetic oligonucleotide
gcgagtgggtcggcattaatccagacttg

SEQ ID NO: 320707 - DNA, 30 bp, Artificial Sequence
  Description of Artificial Sequence: Synthetic oligonucleotide
cgagtgggtcggcattaatccagacttgtg

SEQ ID NO: 320708 - DNA, 31 bp, Artificial Sequence
  Description of Artificial Sequence: Synthetic oligonucleotide
gagtgggtcggcattaatccagacttgtgtc

SEQ ID NO: 320709 - DNA, 31 bp, Artificial Sequence
  Description of Artificial Sequence: Synthetic oligonucleotide
agtgggtcggcattaatccagacttgtgtcc

SEQ ID NO: 320710 - DNA, 30 bp, Artificial Sequence
  Description of Artificial Sequence: Synthetic oligonucleotide
gtgggtcggcattaatccagacttgtgtcc

SEQ ID NO: 320711 - DNA, 31 bp, Artificial Sequence
  Description of Artificial Sequence: Synthetic oligonucleotide
tgggtcggcattaatccagacttgtgtccac

SEQ ID NO: 320712 - DNA, 30 bp, Artificial Sequence
  Description of Artificial Sequence: Synthetic oligonucleotide
gggtcggcattaatccagacttgtgtccac

SEQ ID NO: 320713 - DNA, 31 bp, Artificial Sequence
  Description of Artificial Sequence: Synthetic oligonucleotide
ggtcggcattaatccagacttgtgtccactc

SEQ ID NO: 320714 - DNA, 32 bp, Artificial Sequence
  Description of Artificial Sequence: Synthetic oligonucleotide
gtcggcattaatccagacttgtgtccactctg

SEQ ID NO: 320715 - DNA, 32 bp, Artificial Sequence
  Description of Artificial Sequence: Synthetic oligonucleotide
tcggcattaatccagacttgtgtccactctgc

SEQ ID NO: 320716 - DNA, 31 bp, Artificial Sequence
  Description of Artificial Sequence: Synthetic oligonucleotide
cggcattaatccagacttgtgtccactctgc

SEQ ID NO: 320717 - DNA, 32 bp, Artificial Sequence
  Description of Artificial Sequence: Synthetic oligonucleotide
ggcattaatccagacttgtgtccactctgcac

SEQ ID NO: 320718 - DNA, 35 bp, Artificial Sequence
  Description of Artificial Sequence: Synthetic oligonucleotide
gcattaatccagacttgtgtccactctgcacattg

SEQ ID NO: 320719 - DNA, 35 bp, Artificial Sequence
  Description of Artificial Sequence: Synthetic oligonucleotide
cattaatccagacttgtgtccactctgcacattgg

SEQ ID NO: 320720 - DNA, 35 bp, Artificial Sequence
  Description of Artificial Sequence: Synthetic oligonucleotide
attaatccagacttgtgtccactctgcacattggc

SEQ ID NO: 320721 - DNA, 34 bp, Artificial Sequence
  Description of Artificial Sequence: Synthetic oligonucleotide
ttaatccagacttgtgtccactctgcacattggc

SEQ ID NO: 320722 - DNA, 33 bp, Artificial Sequence
  Description of Artificial Sequence: Synthetic oligonucleotide
taatccagacttgtgtccactctgcacattggc

SEQ ID NO: 320723 - DNA, 32 bp, Artificial Sequence
  Description of Artificial Sequence: Synthetic oligonucleotide
aatccagacttgtgtccactctgcacattggc

SEQ ID NO: 320724 - DNA, 31 bp, Artificial Sequence
  Description of Artificial Sequence: Synthetic oligonucleotide
atccagacttgtgtccactctgcacattggc

SEQ ID NO: 320725 - DNA, 30 bp, Artificial Sequence
  Description of Artificial Sequence: Synthetic oligonucleotide
tccagacttgtgtccactctgcacattggc

SEQ ID NO: 320726 - DNA, 29 bp, Artificial Sequence
  Description of Artificial Sequence: Synthetic oligonucleotide
ccagacttgtgtccactctgcacattggc

SEQ ID NO: 320727 - DNA, 32 bp, Artificial Sequence
  Description of Artificial Sequence: Synthetic oligonucleotide
cagacttgtgtccactctgcacattggcttag

SEQ ID NO: 320728 - DNA, 32 bp, Artificial Sequence
  Description of Artificial Sequence: Synthetic oligonucleotide
agacttgtgtccactctgcacattggcttagc

SEQ ID NO: 320729 - DNA, 31 bp, Artificial Sequence
  Description of Artificial Sequence: Synthetic oligonucleotide
gacttgtgtccactctgcacattggcttagc

SEQ ID NO: 320730 - DNA, 31 bp, Artificial Sequence
  Description of Artificial Sequence: Synthetic oligonucleotide
acttgtgtccactctgcacattggcttagcc

SEQ ID NO: 320731 - DNA, 30 bp, Artificial Sequence
  Description of Artificial Sequence: Synthetic oligonucleotide
cttgtgtccactctgcacattggcttagcc

SEQ ID NO: 320732 - DNA, 32 bp, Artificial Sequence
  Description of Artificial Sequence: Synthetic oligonucleotide
ttgtgtccactctgcacattggcttagccttg

SEQ ID NO: 320733 - DNA, 31 bp, Artificial Sequence
  Description of Artificial Sequence: Synthetic oligonucleotide
tgtgtccactctgcacattggcttagccttg

SEQ ID NO: 320734 - DNA, 30 bp, Artificial Sequence
  Description of Artificial Sequence: Synthetic oligonucleotide
gtgtccactctgcacattggcttagccttg

SEQ ID NO: 320735 - DNA, 34 bp, Artificial Sequence
  Description of Artificial Sequence: Synthetic oligonucleotide
atgatgggcacttggaagctctgtcttttaagcg

SEQ ID NO: 320736 - DNA, 33 bp, Artificial Sequence
  Description of Artificial Sequence: Synthetic oligonucleotide
tgatgggcacttggaagctctgtcttttaagcg

SEQ ID NO: 320737 - DNA, 32 bp, Artificial Sequence
  Description of Artificial Sequence: Synthetic oligonucleotide
gatgggcacttggaagctctgtcttttaagcg

SEQ ID NO: 320738 - DNA, 32 bp, Artificial Sequence
  Description of Artificial Sequence: Synthetic oligonucleotide
atgggcacttggaagctctgtcttttaagcgc

SEQ ID NO: 320739 - DNA, 31 bp, Artificial Sequence
  Description of Artificial Sequence: Synthetic oligonucleotide
tgggcacttggaagctctgtcttttaagcgc

SEQ ID NO: 320740 - DNA, 30 bp, Artificial Sequence
  Description of Artificial Sequence: Synthetic oligonucleotide
gggcacttggaagctctgtcttttaagcgc

SEQ ID NO: 320741 - DNA, 30 bp, Artificial Sequence
  Description of Artificial Sequence: Synthetic oligonucleotide
ggcacttggaagctctgtcttttaagcgcg

SEQ ID NO: 320742 - DNA, 31 bp, Artificial Sequence
  Description of Artificial Sequence: Synthetic oligonucleotide
gcacttggaagctctgtcttttaagcgcgtc

SEQ ID NO: 320743 - DNA, 32 bp, Artificial Sequence
  Description of Artificial Sequence: Synthetic oligonucleotide
cacttggaagctctgtcttttaagcgcgtctg

SEQ ID NO: 320744 - DNA, 36 bp, Artificial Sequence
  Description of Artificial Sequence: Synthetic oligonucleotide
acttggaagctctgtcttttaagcgcgtctgttatc

SEQ ID NO: 320745 - DNA, 35 bp, Artificial Sequence
  Description of Artificial Sequence: Synthetic oligonucleotide
cttggaagctctgtcttttaagcgcgtctgttatc

SEQ ID NO: 320746 - DNA, 36 bp, Artificial Sequence
  Description of Artificial Sequence: Synthetic oligonucleotide
ttggaagctctgtcttttaagcgcgtctgttatctc

SEQ ID NO: 320747 - DNA, 35 bp, Artificial Sequence
  Description of Artificial Sequence: Synthetic oligonucleotide
tggaagctctgtcttttaagcgcgtctgttatctc

SEQ ID NO: 320748 - DNA, 34 bp, Artificial Sequence
  Description of Artificial Sequence: Synthetic oligonucleotide
ggaagctctgtcttttaagcgcgtctgttatctc

SEQ ID NO: 320749 - DNA, 35 bp, Artificial Sequence
  Description of Artificial Sequence: Synthetic oligonucleotide
gaagctctgtcttttaagcgcgtctgttatctctg

SEQ ID NO: 320750 - DNA, 35 bp, Artificial Sequence
  Description of Artificial Sequence: Synthetic oligonucleotide
aagctctgtcttttaagcgcgtctgttatctctgg

SEQ ID NO: 320751 - DNA, 34 bp, Artificial Sequence
  Description of Artificial Sequence: Synthetic oligonucleotide
agctctgtcttttaagcgcgtctgttatctctgg

SEQ ID NO: 320752 - DNA, 33 bp, Artificial Sequence
  Description of Artificial Sequence: Synthetic oligonucleotide
gctctgtcttttaagcgcgtctgttatctctgg

SEQ ID NO: 320753 - DNA, 33 bp, Artificial Sequence
  Description of Artificial Sequence: Synthetic oligonucleotide
ctctgtcttttaagcgcgtctgttatctctggc

SEQ ID NO: 320754 - DNA, 33 bp, Artificial Sequence
  Description of Artificial Sequence: Synthetic oligonucleotide
tctgtcttttaagcgcgtctgttatctctggcc

SEQ ID NO: 320755 - DNA, 32 bp, Artificial Sequence
  Description of Artificial Sequence: Synthetic oligonucleotide
ctgtcttttaagcgcgtctgttatctctggcc

SEQ ID NO: 320756 - DNA, 33 bp, Artificial Sequence
  Description of Artificial Sequence: Synthetic oligonucleotide
tgtcttttaagcgcgtctgttatctctggcctg

SEQ ID NO: 320757 - DNA, 32 bp, Artificial Sequence
  Description of Artificial Sequence: Synthetic oligonucleotide
gtcttttaagcgcgtctgttatctctggcctg

SEQ ID NO: 320758 - DNA, 38 bp, Artificial Sequence
  Description of Artificial Sequence: Synthetic oligonucleotide
tcttttaagcgcgtctgttatctctggcctgattttag

SEQ ID NO: 320759 - DNA, 37 bp, Artificial Sequence
  Description of Artificial Sequence: Synthetic oligonucleotide
cttttaagcgcgtctgttatctctggcctgattttag

SEQ ID NO: 320760 - DNA, 42 bp, Artificial Sequence
  Description of Artificial Sequence: Synthetic oligonucleotide
ttttaagcgcgtctgttatctctggcctgattttagtatttg

SEQ ID NO: 320761 - DNA, 41 bp, Artificial Sequence
  Description of Artificial Sequence: Synthetic oligonucleotide
tttaagcgcgtctgttatctctggcctgattttagtatttg

SEQ ID NO: 320762 - DNA, 40 bp, Artificial Sequence
  Description of Artificial Sequence: Synthetic oligonucleotide
ttaagcgcgtctgttatctctggcctgattttagtatttg

SEQ ID NO: 320763 - DNA, 39 bp, Artificial Sequence
  Description of Artificial Sequence: Synthetic oligonucleotide
taagcgcgtctgttatctctggcctgattttagtatttg

SEQ ID NO: 320764 - DNA, 38 bp, Artificial Sequence
  Description of Artificial Sequence: Synthetic oligonucleotide
aagcgcgtctgttatctctggcctgattttagtatttg

SEQ ID NO: 320765 - DNA, 37 bp, Artificial Sequence
  Description of Artificial Sequence: Synthetic oligonucleotide
agcgcgtctgttatctctggcctgattttagtatttg

SEQ ID NO: 320766 - DNA, 36 bp, Artificial Sequence
  Description of Artificial Sequence: Synthetic oligonucleotide
gcgcgtctgttatctctggcctgattttagtatttg

SEQ ID NO: 320767 - DNA, 40 bp, Artificial Sequence
  Description of Artificial Sequence: Synthetic oligonucleotide
cgcgtctgttatctctggcctgattttagtatttgttaac

SEQ ID NO: 320768 - DNA, 44 bp, Artificial Sequence
  Description of Artificial Sequence: Synthetic oligonucleotide
gcgtctgttatctctggcctgattttagtatttgttaacaatac

SEQ ID NO: 320769 - DNA, 45 bp, Artificial Sequence
  Description of Artificial Sequence: Synthetic oligonucleotide
cgtctgttatctctggcctgattttagtatttgttaacaatactg

SEQ ID NO: 320770 - DNA, 46 bp, Artificial Sequence
  Description of Artificial Sequence: Synthetic oligonucleotide
gtctgttatctctggcctgattttagtatttgttaacaatactgtg

SEQ ID NO: 320771 - DNA, 50 bp, Artificial Sequence
  Description of Artificial Sequence: Synthetic oligonucleotide
tctgttatctctggcctgattttagtatttgttaacaatactgtgttatg

SEQ ID NO: 320772 - DNA, 49 bp, Artificial Sequence
  Description of Artificial Sequence: Synthetic oligonucleotide
ctgttatctctggcctgattttagtatttgttaacaatactgtgttatg

SEQ ID NO: 320773 - DNA, 49 bp, Artificial Sequence
  Description of Artificial Sequence: Synthetic oligonucleotide
tgttatctctggcctgattttagtatttgttaacaatactgtgttatgg

SEQ ID NO: 320774 - DNA, 48 bp, Artificial Sequence
  Description of Artificial Sequence: Synthetic oligonucleotide
gttatctctggcctgattttagtatttgttaacaatactgtgttatgg

SEQ ID NO: 320775 - DNA, 48 bp, Artificial Sequence
  Description of Artificial Sequence: Synthetic oligonucleotide
ttatctctggcctgattttagtatttgttaacaatactgtgttatggg

SEQ ID NO: 320776 - DNA, 47 bp, Artificial Sequence
  Description of Artificial Sequence: Synthetic oligonucleotide
tatctctggcctgattttagtatttgttaacaatactgtgttatggg

SEQ ID NO: 320777 - DNA, 46 bp, Artificial Sequence
  Description of Artificial Sequence: Synthetic oligonucleotide
atctctggcctgattttagtatttgttaacaatactgtgttatggg

SEQ ID NO: 320778 - DNA, 45 bp, Artificial Sequence
  Description of Artificial Sequence: Synthetic oligonucleotide
tctctggcctgattttagtatttgttaacaatactgtgttatggg

SEQ ID NO: 320779 - DNA, 44 bp, Artificial Sequence
  Description of Artificial Sequence: Synthetic oligonucleotide
ctctggcctgattttagtatttgttaacaatactgtgttatggg

SEQ ID NO: 320780 - DNA, 45 bp, Artificial Sequence
  Description of Artificial Sequence: Synthetic oligonucleotide
tctggcctgattttagtatttgttaacaatactgtgttatgggac

SEQ ID NO: 320781 - DNA, 44 bp, Artificial Sequence
  Description of Artificial Sequence: Synthetic oligonucleotide
ctggcctgattttagtatttgttaacaatactgtgttatgggac

SEQ ID NO: 320782 - DNA, 50 bp, Artificial Sequence
  Description of Artificial Sequence: Synthetic oligonucleotide
tggcctgattttagtatttgttaacaatactgtgttatgggacaataaac

SEQ ID NO: 320783 - DNA, 49 bp, Artificial Sequence
  Description of Artificial Sequence: Synthetic oligonucleotide
ggcctgattttagtatttgttaacaatactgtgttatgggacaataaac

SEQ ID NO: 320784 - DNA, 49 bp, Artificial Sequence
  Description of Artificial Sequence: Synthetic oligonucleotide
gcctgattttagtatttgttaacaatactgtgttatgggacaataaacg

SEQ ID NO: 320785 - DNA, 53 bp, Artificial Sequence
  Description of Artificial Sequence: Synthetic oligonucleotide
cctgattttagtatttgttaacaatactgtgttatgggacaataaacgtattc

SEQ ID NO: 320786 - DNA, 54 bp, Artificial Sequence
  Description of Artificial Sequence: Synthetic oligonucleotide
ctgattttagtatttgttaacaatactgtgttatgggacaataaacgtattctg

SEQ ID NO: 320787 - DNA, 55 bp, Artificial Sequence
  Description of Artificial Sequence: Synthetic oligonucleotide
tgattttagtatttgttaacaatactgtgttatgggacaataaacgtattctgag

SEQ ID NO: 320788 - DNA, 54 bp, Artificial Sequence
  Description of Artificial Sequence: Synthetic oligonucleotide
gattttagtatttgttaacaatactgtgttatgggacaataaacgtattctgag

SEQ ID NO: 320789 - DNA, 54 bp, Artificial Sequence
  Description of Artificial Sequence: Synthetic oligonucleotide
attttagtatttgttaacaatactgtgttatgggacaataaacgtattctgagg

SEQ ID NO: 320790 - DNA, 53 bp, Artificial Sequence
  Description of Artificial Sequence: Synthetic oligonucleotide
ttttagtatttgttaacaatactgtgttatgggacaataaacgtattctgagg

SEQ ID NO: 320791 - DNA, 52 bp, Artificial Sequence
  Description of Artificial Sequence: Synthetic oligonucleotide
tttagtatttgttaacaatactgtgttatgggacaataaacgtattctgagg

SEQ ID NO: 320792 - DNA, 51 bp, Artificial Sequence
  Description of Artificial Sequence: Synthetic oligonucleotide
ttagtatttgttaacaatactgtgttatgggacaataaacgtattctgagg

SEQ ID NO: 320793 - DNA, 50 bp, Artificial Sequence
  Description of Artificial Sequence: Synthetic oligonucleotide
tagtatttgttaacaatactgtgttatgggacaataaacgtattctgagg

SEQ ID NO: 320794 - DNA, 49 bp, Artificial Sequence
  Description of Artificial Sequence: Synthetic oligonucleotide
agtatttgttaacaatactgtgttatgggacaataaacgtattctgagg

SEQ ID NO: 320795 - DNA, 48 bp, Artificial Sequence
  Description of Artificial Sequence: Synthetic oligonucleotide
gtatttgttaacaatactgtgttatgggacaataaacgtattctgagg

SEQ ID NO: 320796 - DNA, 48 bp, Artificial Sequence
  Description of Artificial Sequence: Synthetic oligonucleotide
tatttgttaacaatactgtgttatgggacaataaacgtattctgaggg

SEQ ID NO: 320797 - DNA, 47 bp, Artificial Sequence
  Description of Artificial Sequence: Synthetic oligonucleotide
atttgttaacaatactgtgttatgggacaataaacgtattctgaggg

SEQ ID NO: 320798 - DNA, 46 bp, Artificial Sequence
  Description of Artificial Sequence: Synthetic oligonucleotide
tttgttaacaatactgtgttatgggacaataaacgtattctgaggg

SEQ ID NO: 320799 - DNA, 45 bp, Artificial Sequence
  Description of Artificial Sequence: Synthetic oligonucleotide
ttgttaacaatactgtgttatgggacaataaacgtattctgaggg

SEQ ID NO: 320800 - DNA, 44 bp, Artificial Sequence
  Description of Artificial Sequence: Synthetic oligonucleotide
tgttaacaatactgtgttatgggacaataaacgtattctgaggg

SEQ ID NO: 320801 - DNA, 43 bp, Artificial Sequence
  Description of Artificial Sequence: Synthetic oligonucleotide
gttaacaatactgtgttatgggacaataaacgtattctgaggg

SEQ ID NO: 320802 - DNA, 43 bp, Artificial Sequence
  Description of Artificial Sequence: Synthetic oligonucleotide
ttaacaatactgtgttatgggacaataaacgtattctgagggg

SEQ ID NO: 320803 - DNA, 42 bp, Artificial Sequence
  Description of Artificial Sequence: Synthetic oligonucleotide
taacaatactgtgttatgggacaataaacgtattctgagggg

SEQ ID NO: 320804 - DNA, 41 bp, Artificial Sequence
  Description of Artificial Sequence: Synthetic oligonucleotide
aacaatactgtgttatgggacaataaacgtattctgagggg

SEQ ID NO: 320805 - DNA, 40 bp, Artificial Sequence
  Description of Artificial Sequence: Synthetic oligonucleotide
acaatactgtgttatgggacaataaacgtattctgagggg

SEQ ID NO: 320806 - DNA, 39 bp, Artificial Sequence
  Description of Artificial Sequence: Synthetic oligonucleotide
caatactgtgttatgggacaataaacgtattctgagggg

SEQ ID NO: 320807 - DNA, 40 bp, Artificial Sequence
  Description of Artificial Sequence: Synthetic oligonucleotide
aatactgtgttatgggacaataaacgtattctgaggggag

SEQ ID NO: 320808 - DNA, 39 bp, Artificial Sequence
  Description of Artificial Sequence: Synthetic oligonucleotide
atactgtgttatgggacaataaacgtattctgaggggag

SEQ ID NO: 320809 - DNA, 38 bp, Artificial Sequence
  Description of Artificial Sequence: Synthetic oligonucleotide
tactgtgttatgggacaataaacgtattctgaggggag

SEQ ID NO: 320810 - DNA, 37 bp, Artificial Sequence
  Description of Artificial Sequence: Synthetic oligonucleotide
actgtgttatgggacaataaacgtattctgaggggag

SEQ ID NO: 320811 - DNA, 36 bp, Artificial Sequence
  Description of Artificial Sequence: Synthetic oligonucleotide
ctgtgttatgggacaataaacgtattctgaggggag

SEQ ID NO: 320812 - DNA, 36 bp, Artificial Sequence
  Description of Artificial Sequence: Synthetic oligonucleotide
tgtgttatgggacaataaacgtattctgaggggagc

SEQ ID NO: 320813 - DNA, 35 bp, Artificial Sequence
  Description of Artificial Sequence: Synthetic oligonucleotide
gtgttatgggacaataaacgtattctgaggggagc

SEQ ID NO: 320814 - DNA, 36 bp, Artificial Sequence
  Description of Artificial Sequence: Synthetic oligonucleotide
tgttatgggacaataaacgtattctgaggggagctc

SEQ ID NO: 320815 - DNA, 35 bp, Artificial Sequence
  Description of Artificial Sequence: Synthetic oligonucleotide
gttatgggacaataaacgtattctgaggggagctc

SEQ ID NO: 320816 - DNA, 36 bp, Artificial Sequence
  Description of Artificial Sequence: Synthetic oligonucleotide
ttatgggacaataaacgtattctgaggggagctctg

SEQ ID NO: 320817 - DNA, 35 bp, Artificial Sequence
  Description of Artificial Sequence: Synthetic oligonucleotide
tatgggacaataaacgtattctgaggggagctctg

SEQ ID NO: 320818 - DNA, 34 bp, Artificial Sequence
  Description of Artificial Sequence: Synthetic oligonucleotide
atgggacaataaacgtattctgaggggagctctg

SEQ ID NO: 320819 - DNA, 33 bp, Artificial Sequence
  Description of Artificial Sequence: Synthetic oligonucleotide
tgggacaataaacgtattctgaggggagctctg

SEQ ID NO: 320820 - DNA, 32 bp, Artificial Sequence
  Description of Artificial Sequence: Synthetic oligonucleotide
gggacaataaacgtattctgaggggagctctg

SEQ ID NO: 320821 - DNA, 33 bp, Artificial Sequence
  Description of Artificial Sequence: Synthetic oligonucleotide
ggacaataaacgtattctgaggggagctctgtc

SEQ ID NO: 320822 - DNA, 33 bp, Artificial Sequence
  Description of Artificial Sequence: Synthetic oligonucleotide
gacaataaacgtattctgaggggagctctgtcg

SEQ ID NO: 320823 - DNA, 36 bp, Artificial Sequence
  Description of Artificial Sequence: Synthetic oligonucleotide
acaataaacgtattctgaggggagctctgtcgaatg

SEQ ID NO: 320824 - DNA, 35 bp, Artificial Sequence
  Description of Artificial Sequence: Synthetic oligonucleotide
caataaacgtattctgaggggagctctgtcgaatg

SEQ ID NO: 320825 - DNA, 35 bp, Artificial Sequence
  Description of Artificial Sequence: Synthetic oligonucleotide
aataaacgtattctgaggggagctctgtcgaatgc

SEQ ID NO: 320826 - DNA, 34 bp, Artificial Sequence
  Description of Artificial Sequence: Synthetic oligonucleotide
ataaacgtattctgaggggagctctgtcgaatgc

SEQ ID NO: 320827 - DNA, 33 bp, Artificial Sequence
  Description of Artificial Sequence: Synthetic oligonucleotide
taaacgtattctgaggggagctctgtcgaatgc

SEQ ID NO: 320828 - DNA, 32 bp, Artificial Sequence
  Description of Artificial Sequence: Synthetic oligonucleotide
aaacgtattctgaggggagctctgtcgaatgc

SEQ ID NO: 320829 - DNA, 31 bp, Artificial Sequence
  Description of Artificial Sequence: Synthetic oligonucleotide
aacgtattctgaggggagctctgtcgaatgc

SEQ ID NO: 320830 - DNA, 30 bp, Artificial Sequence
  Description of Artificial Sequence: Synthetic oligonucleotide
acgtattctgaggggagctctgtcgaatgc

SEQ ID NO: 320831 - DNA, 29 bp, Artificial Sequence
  Description of Artificial Sequence: Synthetic oligonucleotide
cgtattctgaggggagctctgtcgaatgc

SEQ ID NO: 320832 - DNA, 31 bp, Artificial Sequence
  Description of Artificial Sequence: Synthetic oligonucleotide
gtattctgaggggagctctgtcgaatgcttc

SEQ ID NO: 320833 - DNA, 32 bp, Artificial Sequence
  Description of Artificial Sequence: Synthetic oligonucleotide
tattctgaggggagctctgtcgaatgcttcag

SEQ ID NO: 320834 - DNA, 31 bp, Artificial Sequence
  Description of Artificial Sequence: Synthetic oligonucleotide
attctgaggggagctctgtcgaatgcttcag

SEQ ID NO: 320835 - DNA, 30 bp, Artificial Sequence
  Description of Artificial Sequence: Synthetic oligonucleotide
ttctgaggggagctctgtcgaatgcttcag

SEQ ID NO: 320836 - DNA, 29 bp, Artificial Sequence
  Description of Artificial Sequence: Synthetic oligonucleotide
tctgaggggagctctgtcgaatgcttcag

SEQ ID NO: 320837 - DNA, 28 bp, Artificial Sequence
  Description of Artificial Sequence: Synthetic oligonucleotide
ctgaggggagctctgtcgaatgcttcag

SEQ ID NO: 320838 - DNA, 29 bp, Artificial Sequence
  Description of Artificial Sequence: Synthetic oligonucleotide
tgaggggagctctgtcgaatgcttcagtg

SEQ ID NO: 320839 - DNA, 28 bp, Artificial Sequence
  Description of Artificial Sequence: Synthetic oligonucleotide
gaggggagctctgtcgaatgcttcagtg

SEQ ID NO: 320840 - DNA, 31 bp, Artificial Sequence
  Description of Artificial Sequence: Synthetic oligonucleotide
aggggagctctgtcgaatgcttcagtgttag

SEQ ID NO: 320841 - DNA, 30 bp, Artificial Sequence
  Description of Artificial Sequence: Synthetic oligonucleotide
ggggagctctgtcgaatgcttcagtgttag

SEQ ID NO: 320842 - DNA, 30 bp, Artificial Sequence
  Description of Artificial Sequence: Synthetic oligonucleotide
gggagctctgtcgaatgcttcagtgttagc

SEQ ID NO: 320843 - DNA, 31 bp, Artificial Sequence
  Description of Artificial Sequence: Synthetic oligonucleotide
ggagctctgtcgaatgcttcagtgttagcag

SEQ ID NO: 320844 - DNA, 33 bp, Artificial Sequence
  Description of Artificial Sequence: Synthetic oligonucleotide
gagctctgtcgaatgcttcagtgttagcagtag

SEQ ID NO: 320845 - DNA, 33 bp, Artificial Sequence
  Description of Artificial Sequence: Synthetic oligonucleotide
agctctgtcgaatgcttcagtgttagcagtagc

SEQ ID NO: 320846 - DNA, 32 bp, Artificial Sequence
  Description of Artificial Sequence: Synthetic oligonucleotide
gctctgtcgaatgcttcagtgttagcagtagc

SEQ ID NO: 320847 - DNA, 32 bp, Artificial Sequence
  Description of Artificial Sequence: Synthetic oligonucleotide
ctctgtcgaatgcttcagtgttagcagtagcc

SEQ ID NO: 320848 - DNA, 33 bp, Artificial Sequence
  Description of Artificial Sequence: Synthetic oligonucleotide
tctgtcgaatgcttcagtgttagcagtagcctg

SEQ ID NO: 320849 - DNA, 32 bp, Artificial Sequence
  Description of Artificial Sequence: Synthetic oligonucleotide
ctgtcgaatgcttcagtgttagcagtagcctg

SEQ ID NO: 320850 - DNA, 33 bp, Artificial Sequence
  Description of Artificial Sequence: Synthetic oligonucleotide
tgtcgaatgcttcagtgttagcagtagcctgtc

SEQ ID NO: 320851 - DNA, 32 bp, Artificial Sequence
  Description of Artificial Sequence: Synthetic oligonucleotide
gtcgaatgcttcagtgttagcagtagcctgtc

SEQ ID NO: 320852 - DNA, 34 bp, Artificial Sequence
  Description of Artificial Sequence: Synthetic oligonucleotide
tcgaatgcttcagtgttagcagtagcctgtcaac

SEQ ID NO: 320853 - DNA, 33 bp, Artificial Sequence
  Description of Artificial Sequence: Synthetic oligonucleotide
cgaatgcttcagtgttagcagtagcctgtcaac

SEQ ID NO: 320854 - DNA, 34 bp, Artificial Sequence
  Description of Artificial Sequence: Synthetic oligonucleotide
gaatgcttcagtgttagcagtagcctgtcaacag

SEQ ID NO: 320855 - DNA, 40 bp, Artificial Sequence
  Description of Artificial Sequence: Synthetic oligonucleotide
aatgcttcagtgttagcagtagcctgtcaacagatttttc

SEQ ID NO: 320856 - DNA, 39 bp, Artificial Sequence
  Description of Artificial Sequence: Synthetic oligonucleotide
atgcttcagtgttagcagtagcctgtcaacagatttttc

SEQ ID NO: 320857 - DNA, 38 bp, Artificial Sequence
  Description of Artificial Sequence: Synthetic oligonucleotide
tgcttcagtgttagcagtagcctgtcaacagatttttc

SEQ ID NO: 320858 - DNA, 37 bp, Artificial Sequence
  Description of Artificial Sequence: Synthetic oligonucleotide
gcttcagtgttagcagtagcctgtcaacagatttttc

SEQ ID NO: 320859 - DNA, 38 bp, Artificial Sequence
  Description of Artificial Sequence: Synthetic oligonucleotide
cttcagtgttagcagtagcctgtcaacagatttttcag

SEQ ID NO: 320860 - DNA, 38 bp, Artificial Sequence
  Description of Artificial Sequence: Synthetic oligonucleotide
ttcagtgttagcagtagcctgtcaacagatttttcagg

SEQ ID NO: 320861 - DNA, 37 bp, Artificial Sequence
  Description of Artificial Sequence: Synthetic oligonucleotide
tcagtgttagcagtagcctgtcaacagatttttcagg

SEQ ID NO: 320862 - DNA, 36 bp, Artificial Sequence
  Description of Artificial Sequence: Synthetic oligonucleotide
cagtgttagcagtagcctgtcaacagatttttcagg

SEQ ID NO: 320863 - DNA, 36 bp, Artificial Sequence
  Description of Artificial Sequence: Synthetic oligonucleotide
agtgttagcagtagcctgtcaacagatttttcaggg

SEQ ID NO: 320864 - DNA, 35 bp, Artificial Sequence
  Description of Artificial Sequence: Synthetic oligonucleotide
gtgttagcagtagcctgtcaacagatttttcaggg

SEQ ID NO: 320865 - DNA, 35 bp, Artificial Sequence
  Description of Artificial Sequence: Synthetic oligonucleotide
tgttagcagtagcctgtcaacagatttttcagggg

SEQ ID NO: 320866 - DNA, 34 bp, Artificial Sequence
  Description of Artificial Sequence: Synthetic oligonucleotide
gttagcagtagcctgtcaacagatttttcagggg

SEQ ID NO: 320867 - DNA, 37 bp, Artificial Sequence
  Description of Artificial Sequence: Synthetic oligonucleotide
ttagcagtagcctgtcaacagatttttcaggggaaag

SEQ ID NO: 320868 - DNA, 36 bp, Artificial Sequence
  Description of Artificial Sequence: Synthetic oligonucleotide
tagcagtagcctgtcaacagatttttcaggggaaag

SEQ ID NO: 320869 - DNA, 35 bp, Artificial Sequence
  Description of Artificial Sequence: Synthetic oligonucleotide
agcagtagcctgtcaacagatttttcaggggaaag

SEQ ID NO: 320870 - DNA, 34 bp, Artificial Sequence
  Description of Artificial Sequence: Synthetic oligonucleotide
gcagtagcctgtcaacagatttttcaggggaaag

SEQ ID NO: 320871 - DNA, 41 bp, Artificial Sequence
  Description of Artificial Sequence: Synthetic oligonucleotide
cagtagcctgtcaacagatttttcaggggaaagatttttac

SEQ ID NO: 320872 - DNA, 41 bp, Artificial Sequence
  Description of Artificial Sequence: Synthetic oligonucleotide
agtagcctgtcaacagatttttcaggggaaagatttttacc

SEQ ID NO: 320873 - DNA, 40 bp, Artificial Sequence
  Description of Artificial Sequence: Synthetic oligonucleotide
gtagcctgtcaacagatttttcaggggaaagatttttacc

SEQ ID NO: 320874 - DNA, 40 bp, Artificial Sequence
  Description of Artificial Sequence: Synthetic oligonucleotide
tagcctgtcaacagatttttcaggggaaagatttttaccc

SEQ ID NO: 320875 - DNA, 39 bp, Artificial Sequence
  Description of Artificial Sequence: Synthetic oligonucleotide
agcctgtcaacagatttttcaggggaaagatttttaccc

SEQ ID NO: 320876 - DNA, 38 bp, Artificial Sequence
  Description of Artificial Sequence: Synthetic oligonucleotide
gcctgtcaacagatttttcaggggaaagatttttaccc

SEQ ID NO: 320877 - DNA, 40 bp, Artificial Sequence
  Description of Artificial Sequence: Synthetic oligonucleotide
cctgtcaacagatttttcaggggaaagatttttaccctac

SEQ ID NO: 320878 - DNA, 41 bp, Artificial Sequence
  Description of Artificial Sequence: Synthetic oligonucleotide
ctgtcaacagatttttcaggggaaagatttttaccctacag

SEQ ID NO: 320879 - DNA, 46 bp, Artificial Sequence
  Description of Artificial Sequence: Synthetic oligonucleotide
tgtcaacagatttttcaggggaaagatttttaccctacagaaaatc

SEQ ID NO: 320880 - DNA, 45 bp, Artificial Sequence
  Description of Artificial Sequence: Synthetic oligonucleotide
gtcaacagatttttcaggggaaagatttttaccctacagaaaatc

SEQ ID NO: 320881 - DNA, 45 bp, Artificial Sequence
  Description of Artificial Sequence: Synthetic oligonucleotide
tcaacagatttttcaggggaaagatttttaccctacagaaaatcc

SEQ ID NO: 320882 - DNA, 44 bp, Artificial Sequence
  Description of Artificial Sequence: Synthetic oligonucleotide
caacagatttttcaggggaaagatttttaccctacagaaaatcc

SEQ ID NO: 320883 - DNA, 47 bp, Artificial Sequence
  Description of Artificial Sequence: Synthetic oligonucleotide
aacagatttttcaggggaaagatttttaccctacagaaaatccattg

SEQ ID NO: 320884 - DNA, 46 bp, Artificial Sequence
  Description of Artificial Sequence: Synthetic oligonucleotide
acagatttttcaggggaaagatttttaccctacagaaaatccattg

SEQ ID NO: 320885 - DNA, 45 bp, Artificial Sequence
  Description of Artificial Sequence: Synthetic oligonucleotide
cagatttttcaggggaaagatttttaccctacagaaaatccattg

SEQ ID NO: 320886 - DNA, 49 bp, Artificial Sequence
  Description of Artificial Sequence: Synthetic oligonucleotide
agatttttcaggggaaagatttttaccctacagaaaatccattgaaaag

SEQ ID NO: 320887 - DNA, 48 bp, Artificial Sequence
  Description of Artificial Sequence: Synthetic oligonucleotide
gatttttcaggggaaagatttttaccctacagaaaatccattgaaaag

SEQ ID NO: 320888 - DNA, 50 bp, Artificial Sequence
  Description of Artificial Sequence: Synthetic oligonucleotide
atttttcaggggaaagatttttaccctacagaaaatccattgaaaagtac

SEQ ID NO: 320889 - DNA, 49 bp, Artificial Sequence
  Description of Artificial Sequence: Synthetic oligonucleotide
tttttcaggggaaagatttttaccctacagaaaatccattgaaaagtac

SEQ ID NO: 320890 - DNA, 48 bp, Artificial Sequence
  Description of Artificial Sequence: Synthetic oligonucleotide
ttttcaggggaaagatttttaccctacagaaaatccattgaaaagtac

SEQ ID NO: 320891 - DNA, 47 bp, Artificial Sequence
  Description of Artificial Sequence: Synthetic oligonucleotide
tttcaggggaaagatttttaccctacagaaaatccattgaaaagtac

SEQ ID NO: 320892 - DNA, 46 bp, Artificial Sequence
  Description of Artificial Sequence: Synthetic oligonucleotide
ttcaggggaaagatttttaccctacagaaaatccattgaaaagtac

SEQ ID NO: 320893 - DNA, 45 bp, Artificial Sequence
  Description of Artificial Sequence: Synthetic oligonucleotide
tcaggggaaagatttttaccctacagaaaatccattgaaaagtac

SEQ ID NO: 320894 - DNA, 44 bp, Artificial Sequence
  Description of Artificial Sequence: Synthetic oligonucleotide
caggggaaagatttttaccctacagaaaatccattgaaaagtac

SEQ ID NO: 320895 - DNA, 44 bp, Artificial Sequence
  Description of Artificial Sequence: Synthetic oligonucleotide
aggggaaagatttttaccctacagaaaatccattgaaaagtacc

SEQ ID NO: 320896 - DNA, 43 bp, Artificial Sequence
  Description of Artificial Sequence: Synthetic oligonucleotide
ggggaaagatttttaccctacagaaaatccattgaaaagtacc

SEQ ID NO: 320897 - DNA, 43 bp, Artificial Sequence
  Description of Artificial Sequence: Synthetic oligonucleotide
gggaaagatttttaccctacagaaaatccattgaaaagtaccc

SEQ ID NO: 320898 - DNA, 45 bp, Artificial Sequence
  Description of Artificial Sequence: Synthetic oligonucleotide
ggaaagatttttaccctacagaaaatccattgaaaagtacccttg

SEQ ID NO: 320899 - DNA, 47 bp, Artificial Sequence
  Description of Artificial Sequence: Synthetic oligonucleotide
gaaagatttttaccctacagaaaatccattgaaaagtacccttgaag

SEQ ID NO: 320900 - DNA, 49 bp, Artificial Sequence
  Description of Artificial Sequence: Synthetic oligonucleotide
aaagatttttaccctacagaaaatccattgaaaagtacccttgaagaag

SEQ ID NO: 320901 - DNA, 48 bp, Artificial Sequence
  Description of Artificial Sequence: Synthetic oligonucleotide
aagatttttaccctacagaaaatccattgaaaagtacccttgaagaag

SEQ ID NO: 320902 - DNA, 47 bp, Artificial Sequence
  Description of Artificial Sequence: Synthetic oligonucleotide
agatttttaccctacagaaaatccattgaaaagtacccttgaagaag

SEQ ID NO: 320903 - DNA, 46 bp, Artificial Sequence
  Description of Artificial Sequence: Synthetic oligonucleotide
gatttttaccctacagaaaatccattgaaaagtacccttgaagaag

SEQ ID NO: 320904 - DNA, 46 bp, Artificial Sequence
  Description of Artificial Sequence: Synthetic oligonucleotide
atttttaccctacagaaaatccattgaaaagtacccttgaagaagc

SEQ ID NO: 320905 - DNA, 45 bp, Artificial Sequence
  Description of Artificial Sequence: Synthetic oligonucleotide
tttttaccctacagaaaatccattgaaaagtacccttgaagaagc

SEQ ID NO: 320906 - DNA, 44 bp, Artificial Sequence
  Description of Artificial Sequence: Synthetic oligonucleotide
ttttaccctacagaaaatccattgaaaagtacccttgaagaagc

SEQ ID NO: 320907 - DNA, 43 bp, Artificial Sequence
  Description of Artificial Sequence: Synthetic oligonucleotide
tttaccctacagaaaatccattgaaaagtacccttgaagaagc

SEQ ID NO: 320908 - DNA, 42 bp, Artificial Sequence
  Description of Artificial Sequence: Synthetic oligonucleotide
ttaccctacagaaaatccattgaaaagtacccttgaagaagc

SEQ ID NO: 320909 - DNA, 41 bp, Artificial Sequence
  Description of Artificial Sequence: Synthetic oligonucleotide
taccctacagaaaatccattgaaaagtacccttgaagaagc

SEQ ID NO: 320910 - DNA, 40 bp, Artificial Sequence
  Description of Artificial Sequence: Synthetic oligonucleotide
accctacagaaaatccattgaaaagtacccttgaagaagc

SEQ ID NO: 320911 - DNA, 39 bp, Artificial Sequence
  Description of Artificial Sequence: Synthetic oligonucleotide
ccctacagaaaatccattgaaaagtacccttgaagaagc

SEQ ID NO: 320912 - DNA, 41 bp, Artificial Sequence
  Description of Artificial Sequence: Synthetic oligonucleotide
cctacagaaaatccattgaaaagtacccttgaagaagctac

SEQ ID NO: 320913 - DNA, 41 bp, Artificial Sequence
  Description of Artificial Sequence: Synthetic oligonucleotide
ctacagaaaatccattgaaaagtacccttgaagaagctacc

SEQ ID NO: 320914 - DNA, 42 bp, Artificial Sequence
  Description of Artificial Sequence: Synthetic oligonucleotide
tacagaaaatccattgaaaagtacccttgaagaagctaccag

SEQ ID NO: 320915 - DNA, 41 bp, Artificial Sequence
  Description of Artificial Sequence: Synthetic oligonucleotide
acagaaaatccattgaaaagtacccttgaagaagctaccag

SEQ ID NO: 320916 - DNA, 40 bp, Artificial Sequence
  Description of Artificial Sequence: Synthetic oligonucleotide
cagaaaatccattgaaaagtacccttgaagaagctaccag

SEQ ID NO: 320917 - DNA, 40 bp, Artificial Sequence
  Description of Artificial Sequence: Synthetic oligonucleotide
agaaaatccattgaaaagtacccttgaagaagctaccagc

SEQ ID NO: 320918 - DNA, 39 bp, Artificial Sequence
  Description of Artificial Sequence: Synthetic oligonucleotide
gaaaatccattgaaaagtacccttgaagaagctaccagc

SEQ ID NO: 320919 - DNA, 42 bp, Artificial Sequence
  Description of Artificial Sequence: Synthetic oligonucleotide
aaaatccattgaaaagtacccttgaagaagctaccagctatg

SEQ ID NO: 320920 - DNA, 41 bp, Artificial Sequence
  Description of Artificial Sequence: Synthetic oligonucleotide
aaatccattgaaaagtacccttgaagaagctaccagctatg

SEQ ID NO: 320921 - DNA, 40 bp, Artificial Sequence
  Description of Artificial Sequence: Synthetic oligonucleotide
aatccattgaaaagtacccttgaagaagctaccagctatg

SEQ ID NO: 320922 - DNA, 39 bp, Artificial Sequence
  Description of Artificial Sequence: Synthetic oligonucleotide
atccattgaaaagtacccttgaagaagctaccagctatg

SEQ ID NO: 320923 - DNA, 38 bp, Artificial Sequence
  Description of Artificial Sequence: Synthetic oligonucleotide
tccattgaaaagtacccttgaagaagctaccagctatg

SEQ ID NO: 320924 - DNA, 37 bp, Artificial Sequence
  Description of Artificial Sequence: Synthetic oligonucleotide
ccattgaaaagtacccttgaagaagctaccagctatg

SEQ ID NO: 320925 - DNA, 38 bp, Artificial Sequence
  Description of Artificial Sequence: Synthetic oligonucleotide
cattgaaaagtacccttgaagaagctaccagctatgag

SEQ ID NO: 320926 - DNA, 40 bp, Artificial Sequence
  Description of Artificial Sequence: Synthetic oligonucleotide
attgaaaagtacccttgaagaagctaccagctatgagttc

SEQ ID NO: 320927 - DNA, 39 bp, Artificial Sequence
  Description of Artificial Sequence: Synthetic oligonucleotide
ttgaaaagtacccttgaagaagctaccagctatgagttc

SEQ ID NO: 320928 - DNA, 38 bp, Artificial Sequence
  Description of Artificial Sequence: Synthetic oligonucleotide
tgaaaagtacccttgaagaagctaccagctatgagttc

SEQ ID NO: 320929 - DNA, 37 bp, Artificial Sequence
  Description of Artificial Sequence: Synthetic oligonucleotide
gaaaagtacccttgaagaagctaccagctatgagttc

SEQ ID NO: 320930 - DNA, 39 bp, Artificial Sequence
  Description of Artificial Sequence: Synthetic oligonucleotide
aaaagtacccttgaagaagctaccagctatgagttcatg

SEQ ID NO: 320931 - DNA, 38 bp, Artificial Sequence
  Description of Artificial Sequence: Synthetic oligonucleotide
aaagtacccttgaagaagctaccagctatgagttcatg

SEQ ID NO: 320932 - DNA, 37 bp, Artificial Sequence
  Description of Artificial Sequence: Synthetic oligonucleotide
aagtacccttgaagaagctaccagctatgagttcatg

SEQ ID NO: 320933 - DNA, 36 bp, Artificial Sequence
  Description of Artificial Sequence: Synthetic oligonucleotide
agtacccttgaagaagctaccagctatgagttcatg

SEQ ID NO: 320934 - DNA, 35 bp, Artificial Sequence
  Description of Artificial Sequence: Synthetic oligonucleotide
gtacccttgaagaagctaccagctatgagttcatg

SEQ ID NO: 320935 - DNA, 35 bp, Artificial Sequence
  Description of Artificial Sequence: Synthetic oligonucleotide
tacccttgaagaagctaccagctatgagttcatgg

SEQ ID NO: 320936 - DNA, 34 bp, Artificial Sequence
  Description of Artificial Sequence: Synthetic oligonucleotide
acccttgaagaagctaccagctatgagttcatgg

SEQ ID NO: 320937 - DNA, 33 bp, Artificial Sequence
  Description of Artificial Sequence: Synthetic oligonucleotide
cccttgaagaagctaccagctatgagttcatgg

SEQ ID NO: 320938 - DNA, 35 bp, Artificial Sequence
  Description of Artificial Sequence: Synthetic oligonucleotide
ccttgaagaagctaccagctatgagttcatggttc

SEQ ID NO: 320939 - DNA, 35 bp, Artificial Sequence
  Description of Artificial Sequence: Synthetic oligonucleotide
cttgaagaagctaccagctatgagttcatggttcg

SEQ ID NO: 320940 - DNA, 37 bp, Artificial Sequence
  Description of Artificial Sequence: Synthetic oligonucleotide
ttgaagaagctaccagctatgagttcatggttcgtag

SEQ ID NO: 320941 - DNA, 36 bp, Artificial Sequence
  Description of Artificial Sequence: Synthetic oligonucleotide
tgaagaagctaccagctatgagttcatggttcgtag

SEQ ID NO: 320942 - DNA, 35 bp, Artificial Sequence
  Description of Artificial Sequence: Synthetic oligonucleotide
gaagaagctaccagctatgagttcatggttcgtag

SEQ ID NO: 320943 - DNA, 35 bp, Artificial Sequence
  Description of Artificial Sequence: Synthetic oligonucleotide
aagaagctaccagctatgagttcatggttcgtagc

SEQ ID NO: 320944 - DNA, 34 bp, Artificial Sequence
  Description of Artificial Sequence: Synthetic oligonucleotide
agaagctaccagctatgagttcatggttcgtagc

SEQ ID NO: 320945 - DNA, 33 bp, Artificial Sequence
  Description of Artificial Sequence: Synthetic oligonucleotide
gaagctaccagctatgagttcatggttcgtagc

SEQ ID NO: 320946 - DNA, 33 bp, Artificial Sequence
  Description of Artificial Sequence: Synthetic oligonucleotide
aagctaccagctatgagttcatggttcgtagcc

SEQ ID NO: 320947 - DNA, 32 bp, Artificial Sequence
  Description of Artificial Sequence: Synthetic oligonucleotide
agctaccagctatgagttcatggttcgtagcc

SEQ ID NO: 320948 - DNA, 31 bp, Artificial Sequence
  Description of Artificial Sequence: Synthetic oligonucleotide
gctaccagctatgagttcatggttcgtagcc

SEQ ID NO: 320949 - DNA, 32 bp, Artificial Sequence
  Description of Artificial Sequence: Synthetic oligonucleotide
ctaccagctatgagttcatggttcgtagccac

SEQ ID NO: 320950 - DNA, 35 bp, Artificial Sequence
  Description of Artificial Sequence: Synthetic oligonucleotide
taccagctatgagttcatggttcgtagccactatc

SEQ ID NO: 320951 - DNA, 34 bp, Artificial Sequence
  Description of Artificial Sequence: Synthetic oligonucleotide
accagctatgagttcatggttcgtagccactatc

SEQ ID NO: 320952 - DNA, 33 bp, Artificial Sequence
  Description of Artificial Sequence: Synthetic oligonucleotide
ccagctatgagttcatggttcgtagccactatc

SEQ ID NO: 320953 - DNA, 36 bp, Artificial Sequence
  Description of Artificial Sequence: Synthetic oligonucleotide
cagctatgagttcatggttcgtagccactatctaac

SEQ ID NO: 320954 - DNA, 37 bp, Artificial Sequence
  Description of Artificial Sequence: Synthetic oligonucleotide
agctatgagttcatggttcgtagccactatctaacag

SEQ ID NO: 320955 - DNA, 36 bp, Artificial Sequence
  Description of Artificial Sequence: Synthetic oligonucleotide
gctatgagttcatggttcgtagccactatctaacag

SEQ ID NO: 320956 - DNA, 39 bp, Artificial Sequence
  Description of Artificial Sequence: Synthetic oligonucleotide
ctatgagttcatggttcgtagccactatctaacagaaag

SEQ ID NO: 320957 - DNA, 40 bp, Artificial Sequence
  Description of Artificial Sequence: Synthetic oligonucleotide
tatgagttcatggttcgtagccactatctaacagaaagac

SEQ ID NO: 320958 - DNA, 39 bp, Artificial Sequence
  Description of Artificial Sequence: Synthetic oligonucleotide
atgagttcatggttcgtagccactatctaacagaaagac

SEQ ID NO: 320959 - DNA, 38 bp, Artificial Sequence
  Description of Artificial Sequence: Synthetic oligonucleotide
tgagttcatggttcgtagccactatctaacagaaagac

SEQ ID NO: 320960 - DNA, 37 bp, Artificial Sequence
  Description of Artificial Sequence: Synthetic oligonucleotide
gagttcatggttcgtagccactatctaacagaaagac

SEQ ID NO: 320961 - DNA, 38 bp, Artificial Sequence
  Description of Artificial Sequence: Synthetic oligonucleotide
agttcatggttcgtagccactatctaacagaaagactc

SEQ ID NO: 320962 - DNA, 37 bp, Artificial Sequence
  Description of Artificial Sequence: Synthetic oligonucleotide
gttcatggttcgtagccactatctaacagaaagactc

SEQ ID NO: 320963 - DNA, 38 bp, Artificial Sequence
  Description of Artificial Sequence: Synthetic oligonucleotide
ttcatggttcgtagccactatctaacagaaagactctc

SEQ ID NO: 320964 - DNA, 37 bp, Artificial Sequence
  Description of Artificial Sequence: Synthetic oligonucleotide
tcatggttcgtagccactatctaacagaaagactctc

SEQ ID NO: 320965 - DNA, 36 bp, Artificial Sequence
  Description of Artificial Sequence: Synthetic oligonucleotide
catggttcgtagccactatctaacagaaagactctc

SEQ ID NO: 320966 - DNA, 37 bp, Artificial Sequence
  Description of Artificial Sequence: Synthetic oligonucleotide
atggttcgtagccactatctaacagaaagactctctg

SEQ ID NO: 320967 - DNA, 36 bp, Artificial Sequence
  Description of Artificial Sequence: Synthetic oligonucleotide
tggttcgtagccactatctaacagaaagactctctg

SEQ ID NO: 320968 - DNA, 35 bp, Artificial Sequence
  Description of Artificial Sequence: Synthetic oligonucleotide
ggttcgtagccactatctaacagaaagactctctg

SEQ ID NO: 320969 - DNA, 37 bp, Artificial Sequence
  Description of Artificial Sequence: Synthetic oligonucleotide
gttcgtagccactatctaacagaaagactctctgatg

SEQ ID NO: 320970 - DNA, 39 bp, Artificial Sequence
  Description of Artificial Sequence: Synthetic oligonucleotide
ttcgtagccactatctaacagaaagactctctgatgaag

SEQ ID NO: 320971 - DNA, 38 bp, Artificial Sequence
  Description of Artificial Sequence: Synthetic oligonucleotide
tcgtagccactatctaacagaaagactctctgatgaag

SEQ ID NO: 320972 - DNA, 37 bp, Artificial Sequence
  Description of Artificial Sequence: Synthetic oligonucleotide
cgtagccactatctaacagaaagactctctgatgaag

SEQ ID NO: 320973 - DNA, 38 bp, Artificial Sequence
  Description of Artificial Sequence: Synthetic oligonucleotide
gtagccactatctaacagaaagactctctgatgaagag

SEQ ID NO: 320974 - DNA, 38 bp, Artificial Sequence
  Description of Artificial Sequence: Synthetic oligonucleotide
tagccactatctaacagaaagactctctgatgaagagg

SEQ ID NO: 320975 - DNA, 37 bp, Artificial Sequence
  Description of Artificial Sequence: Synthetic oligonucleotide
agccactatctaacagaaagactctctgatgaagagg

SEQ ID NO: 320976 - DNA, 36 bp, Artificial Sequence
  Description of Artificial Sequence: Synthetic oligonucleotide
gccactatctaacagaaagactctctgatgaagagg

SEQ ID NO: 320977 - DNA, 36 bp, Artificial Sequence
  Description of Artificial Sequence: Synthetic oligonucleotide
ccactatctaacagaaagactctctgatgaagaggc

SEQ ID NO: 320978 - DNA, 37 bp, Artificial Sequence
  Description of Artificial Sequence: Synthetic oligonucleotide
cactatctaacagaaagactctctgatgaagaggctc

SEQ ID NO: 320979 - DNA, 37 bp, Artificial Sequence
  Description of Artificial Sequence: Synthetic oligonucleotide
actatctaacagaaagactctctgatgaagaggctcg

SEQ ID NO: 320980 - DNA, 36 bp, Artificial Sequence
  Description of Artificial Sequence: Synthetic oligonucleotide
ctatctaacagaaagactctctgatgaagaggctcg

SEQ ID NO: 320981 - DNA, 36 bp, Artificial Sequence
  Description of Artificial Sequence: Synthetic oligonucleotide
tatctaacagaaagactctctgatgaagaggctcgg

SEQ ID NO: 320982 - DNA, 35 bp, Artificial Sequence
  Description of Artificial Sequence: Synthetic oligonucleotide
atctaacagaaagactctctgatgaagaggctcgg

SEQ ID NO: 320983 - DNA, 34 bp, Artificial Sequence
  Description of Artificial Sequence: Synthetic oligonucleotide
tctaacagaaagactctctgatgaagaggctcgg

SEQ ID NO: 320984 - DNA, 33 bp, Artificial Sequence
  Description of Artificial Sequence: Synthetic oligonucleotide
ctaacagaaagactctctgatgaagaggctcgg

SEQ ID NO: 320985 - DNA, 35 bp, Artificial Sequence
  Description of Artificial Sequence: Synthetic oligonucleotide
taacagaaagactctctgatgaagaggctcggttc

SEQ ID NO: 320986 - DNA, 34 bp, Artificial Sequence
  Description of Artificial Sequence: Synthetic oligonucleotide
aacagaaagactctctgatgaagaggctcggttc

SEQ ID NO: 320987 - DNA, 33 bp, Artificial Sequence
  Description of Artificial Sequence: Synthetic oligonucleotide
acagaaagactctctgatgaagaggctcggttc

SEQ ID NO: 320988 - DNA, 32 bp, Artificial Sequence
  Description of Artificial Sequence: Synthetic oligonucleotide
cagaaagactctctgatgaagaggctcggttc

SEQ ID NO: 320989 - DNA, 32 bp, Artificial Sequence
  Description of Artificial Sequence: Synthetic oligonucleotide
agaaagactctctgatgaagaggctcggttcc

SEQ ID NO: 320990 - DNA, 31 bp, Artificial Sequence
  Description of Artificial Sequence: Synthetic oligonucleotide
gaaagactctctgatgaagaggctcggttcc

SEQ ID NO: 320991 - DNA, 31 bp, Artificial Sequence
  Description of Artificial Sequence: Synthetic oligonucleotide
aaagactctctgatgaagaggctcggttccc

SEQ ID NO: 320992 - DNA, 30 bp, Artificial Sequence
  Description of Artificial Sequence: Synthetic oligonucleotide
aagactctctgatgaagaggctcggttccc

SEQ ID NO: 320993 - DNA, 29 bp, Artificial Sequence
  Description of Artificial Sequence: Synthetic oligonucleotide
agactctctgatgaagaggctcggttccc

SEQ ID NO: 320994 - DNA, 28 bp, Artificial Sequence
  Description of Artificial Sequence: Synthetic oligonucleotide
gactctctgatgaagaggctcggttccc

SEQ ID NO: 320995 - DNA, 32 bp, Artificial Sequence
  Description of Artificial Sequence: Synthetic oligonucleotide
actctctgatgaagaggctcggttcccttaag

SEQ ID NO: 320996 - DNA, 31 bp, Artificial Sequence
  Description of Artificial Sequence: Synthetic oligonucleotide
ctctctgatgaagaggctcggttcccttaag

SEQ ID NO: 320997 - DNA, 31 bp, Artificial Sequence
  Description of Artificial Sequence: Synthetic oligonucleotide
tctctgatgaagaggctcggttcccttaagc

SEQ ID NO: 320998 - DNA, 30 bp, Artificial Sequence
  Description of Artificial Sequence: Synthetic oligonucleotide
ctctgatgaagaggctcggttcccttaagc

SEQ ID NO: 320999 - DNA, 33 bp, Artificial Sequence
  Description of Artificial Sequence: Synthetic oligonucleotide
tctgatgaagaggctcggttcccttaagcttac

SEQ ID NO: 321000 - DNA, 32 bp, Artificial Sequence
  Description of Artificial Sequence: Synthetic oligonucleotide
ctgatgaagaggctcggttcccttaagcttac

SEQ ID NO: 321001 - DNA, 33 bp, Artificial Sequence
  Description of Artificial Sequence: Synthetic oligonucleotide
tgatgaagaggctcggttcccttaagcttacac

SEQ ID NO: 321002 - DNA, 32 bp, Artificial Sequence
  Description of Artificial Sequence: Synthetic oligonucleotide
gatgaagaggctcggttcccttaagcttacac

SEQ ID NO: 321003 - DNA, 33 bp, Artificial Sequence
  Description of Artificial Sequence: Synthetic oligonucleotide
atgaagaggctcggttcccttaagcttacactg

SEQ ID NO: 321004 - DNA, 32 bp, Artificial Sequence
  Description of Artificial Sequence: Synthetic oligonucleotide
tgaagaggctcggttcccttaagcttacactg

SEQ ID NO: 321005 - DNA, 31 bp, Artificial Sequence
  Description of Artificial Sequence: Synthetic oligonucleotide
gaagaggctcggttcccttaagcttacactg

SEQ ID NO: 321006 - DNA, 32 bp, Artificial Sequence
  Description of Artificial Sequence: Synthetic oligonucleotide
aagaggctcggttcccttaagcttacactgtg

SEQ ID NO: 321007 - DNA, 31 bp, Artificial Sequence
  Description of Artificial Sequence: Synthetic oligonucleotide
agaggctcggttcccttaagcttacactgtg

SEQ ID NO: 321008 - DNA, 30 bp, Artificial Sequence
  Description of Artificial Sequence: Synthetic oligonucleotide
gaggctcggttcccttaagcttacactgtg

SEQ ID NO: 321009 - DNA, 31 bp, Artificial Sequence
  Description of Artificial Sequence: Synthetic oligonucleotide
aggctcggttcccttaagcttacactgtgac

SEQ ID NO: 321010 - DNA, 30 bp, Artificial Sequence
  Description of Artificial Sequence: Synthetic oligonucleotide
ggctcggttcccttaagcttacactgtgac

SEQ ID NO: 321011 - DNA, 30 bp, Artificial Sequence
  Description of Artificial Sequence: Synthetic oligonucleotide
gctcggttcccttaagcttacactgtgacc

SEQ ID NO: 321012 - DNA, 32 bp, Artificial Sequence
  Description of Artificial Sequence: Synthetic oligonucleotide
ctcggttcccttaagcttacactgtgaccatc

SEQ ID NO: 321013 - DNA, 32 bp, Artificial Sequence
  Description of Artificial Sequence: Synthetic oligonucleotide
tcggttcccttaagcttacactgtgaccatcg

SEQ ID NO: 321014 - DNA, 31 bp, Artificial Sequence
  Description of Artificial Sequence: Synthetic oligonucleotide
cggttcccttaagcttacactgtgaccatcg

SEQ ID NO: 321015 - DNA, 32 bp, Artificial Sequence
  Description of Artificial Sequence: Synthetic oligonucleotide
ggttcccttaagcttacactgtgaccatcgac

SEQ ID NO: 321016 - DNA, 35 bp, Artificial Sequence
  Description of Artificial Sequence: Synthetic oligonucleotide
gttcccttaagcttacactgtgaccatcgacaaag

SEQ ID NO: 321017 - DNA, 36 bp, Artificial Sequence
  Description of Artificial Sequence: Synthetic oligonucleotide
ttcccttaagcttacactgtgaccatcgacaaagac

SEQ ID NO: 321018 - DNA, 35 bp, Artificial Sequence
  Description of Artificial Sequence: Synthetic oligonucleotide
tcccttaagcttacactgtgaccatcgacaaagac

SEQ ID NO: 321019 - DNA, 34 bp, Artificial Sequence
  Description of Artificial Sequence: Synthetic oligonucleotide
cccttaagcttacactgtgaccatcgacaaagac

SEQ ID NO: 321020 - DNA, 36 bp, Artificial Sequence
  Description of Artificial Sequence: Synthetic oligonucleotide
ccttaagcttacactgtgaccatcgacaaagactac

SEQ ID NO: 321021 - DNA, 36 bp, Artificial Sequence
  Description of Artificial Sequence: Synthetic oligonucleotide
cttaagcttacactgtgaccatcgacaaagactacg

SEQ ID NO: 321022 - DNA, 36 bp, Artificial Sequence
  Description of Artificial Sequence: Synthetic oligonucleotide
ttaagcttacactgtgaccatcgacaaagactacgg

SEQ ID NO: 321023 - DNA, 35 bp, Artificial Sequence
  Description of Artificial Sequence: Synthetic oligonucleotide
taagcttacactgtgaccatcgacaaagactacgg

SEQ ID NO: 321024 - DNA, 34 bp, Artificial Sequence
  Description of Artificial Sequence: Synthetic oligonucleotide
aagcttacactgtgaccatcgacaaagactacgg

SEQ ID NO: 321025 - DNA, 33 bp, Artificial Sequence
  Description of Artificial Sequence: Synthetic oligonucleotide
agcttacactgtgaccatcgacaaagactacgg

SEQ ID NO: 321026 - DNA, 32 bp, Artificial Sequence
  Description of Artificial Sequence: Synthetic oligonucleotide
gcttacactgtgaccatcgacaaagactacgg

SEQ ID NO: 321027 - DNA, 32 bp, Artificial Sequence
  Description of Artificial Sequence: Synthetic oligonucleotide
cttacactgtgaccatcgacaaagactacggc

SEQ ID NO: 321028 - DNA, 33 bp, Artificial Sequence
  Description of Artificial Sequence: Synthetic oligonucleotide
ttacactgtgaccatcgacaaagactacggcac

SEQ ID NO: 321029 - DNA, 32 bp, Artificial Sequence
  Description of Artificial Sequence: Synthetic oligonucleotide
tacactgtgaccatcgacaaagactacggcac

SEQ ID NO: 321030 - DNA, 31 bp, Artificial Sequence
  Description of Artificial Sequence: Synthetic oligonucleotide
acactgtgaccatcgacaaagactacggcac

SEQ ID NO: 321031 - DNA, 30 bp, Artificial Sequence
  Description of Artificial Sequence: Synthetic oligonucleotide
cactgtgaccatcgacaaagactacggcac

SEQ ID NO: 321032 - DNA, 34 bp, Artificial Sequence
  Description of Artificial Sequence: Synthetic oligonucleotide
actgtgaccatcgacaaagactacggcactttag

SEQ ID NO: 321033 - DNA, 33 bp, Artificial Sequence
  Description of Artificial Sequence: Synthetic oligonucleotide
ctgtgaccatcgacaaagactacggcactttag

SEQ ID NO: 321034 - DNA, 34 bp, Artificial Sequence
  Description of Artificial Sequence: Synthetic oligonucleotide
tgtgaccatcgacaaagactacggcactttagag

SEQ ID NO: 321035 - DNA, 33 bp, Artificial Sequence
  Description of Artificial Sequence: Synthetic oligonucleotide
gtgaccatcgacaaagactacggcactttagag

SEQ ID NO: 321036 - DNA, 34 bp, Artificial Sequence
  Description of Artificial Sequence: Synthetic oligonucleotide
tgaccatcgacaaagactacggcactttagagag

SEQ ID NO: 321037 - DNA, 33 bp, Artificial Sequence
  Description of Artificial Sequence: Synthetic oligonucleotide
gaccatcgacaaagactacggcactttagagag

SEQ ID NO: 321038 - DNA, 33 bp, Artificial Sequence
  Description of Artificial Sequence: Synthetic oligonucleotide
accatcgacaaagactacggcactttagagagg

SEQ ID NO: 321039 - DNA, 32 bp, Artificial Sequence
  Description of Artificial Sequence: Synthetic oligonucleotide
ccatcgacaaagactacggcactttagagagg

SEQ ID NO: 321040 - DNA, 32 bp, Artificial Sequence
  Description of Artificial Sequence: Synthetic oligonucleotide
catcgacaaagactacggcactttagagaggc

SEQ ID NO: 321041 - DNA, 33 bp, Artificial Sequence
  Description of Artificial Sequence: Synthetic oligonucleotide
atcgacaaagactacggcactttagagaggctc

SEQ ID NO: 321042 - DNA, 32 bp, Artificial Sequence
  Description of Artificial Sequence: Synthetic oligonucleotide
tcgacaaagactacggcactttagagaggctc

SEQ ID NO: 321043 - DNA, 31 bp, Artificial Sequence
  Description of Artificial Sequence: Synthetic oligonucleotide
cgacaaagactacggcactttagagaggctc

SEQ ID NO: 321044 - DNA, 33 bp, Artificial Sequence
  Description of Artificial Sequence: Synthetic oligonucleotide
gacaaagactacggcactttagagaggctcatc

SEQ ID NO: 321045 - DNA, 34 bp, Artificial Sequence
  Description of Artificial Sequence: Synthetic oligonucleotide
acaaagactacggcactttagagaggctcatcag

SEQ ID NO: 321046 - DNA, 33 bp, Artificial Sequence
  Description of Artificial Sequence: Synthetic oligonucleotide
caaagactacggcactttagagaggctcatcag

SEQ ID NO: 321047 - DNA, 33 bp, Artificial Sequence
  Description of Artificial Sequence: Synthetic oligonucleotide
aaagactacggcactttagagaggctcatcagg

SEQ ID NO: 321048 - DNA, 32 bp, Artificial Sequence
  Description of Artificial Sequence: Synthetic oligonucleotide
aagactacggcactttagagaggctcatcagg

SEQ ID NO: 321049 - DNA, 31 bp, Artificial Sequence
  Description of Artificial Sequence: Synthetic oligonucleotide
agactacggcactttagagaggctcatcagg

SEQ ID NO: 321050 - DNA, 30 bp, Artificial Sequence
  Description of Artificial Sequence: Synthetic oligonucleotide
gactacggcactttagagaggctcatcagg

SEQ ID NO: 321051 - DNA, 30 bp, Artificial Sequence
  Description of Artificial Sequence: Synthetic oligonucleotide
actacggcactttagagaggctcatcaggg

SEQ ID NO: 321052 - DNA, 29 bp, Artificial Sequence
  Description of Artificial Sequence: Synthetic oligonucleotide
ctacggcactttagagaggctcatcaggg

SEQ ID NO: 321053 - DNA, 29 bp, Artificial Sequence
  Description of Artificial Sequence: Synthetic oligonucleotide
tacggcactttagagaggctcatcagggc

SEQ ID NO: 321054 - DNA, 28 bp, Artificial Sequence
  Description of Artificial Sequence: Synthetic oligonucleotide
acggcactttagagaggctcatcagggc

SEQ ID NO: 321055 - DNA, 27 bp, Artificial Sequence
  Description of Artificial Sequence: Synthetic oligonucleotide
cggcactttagagaggctcatcagggc

SEQ ID NO: 321056 - DNA, 27 bp, Artificial Sequence
  Description of Artificial Sequence: Synthetic oligonucleotide
ggcactttagagaggctcatcagggcg

SEQ ID NO: 321057 - DNA, 35 bp, Artificial Sequence
  Description of Artificial Sequence: Synthetic oligonucleotide
gcactttagagaggctcatcagggcgaattatatg

SEQ ID NO: 321058 - DNA, 35 bp, Artificial Sequence
  Description of Artificial Sequence: Synthetic oligonucleotide
cactttagagaggctcatcagggcgaattatatgc

SEQ ID NO: 321059 - DNA, 35 bp, Artificial Sequence
  Description of Artificial Sequence: Synthetic oligonucleotide
actttagagaggctcatcagggcgaattatatgcc

SEQ ID NO: 321060 - DNA, 34 bp, Artificial Sequence
  Description of Artificial Sequence: Synthetic oligonucleotide
ctttagagaggctcatcagggcgaattatatgcc

SEQ ID NO: 321061 - DNA, 34 bp, Artificial Sequence
  Description of Artificial Sequence: Synthetic oligonucleotide
tttagagaggctcatcagggcgaattatatgccg

SEQ ID NO: 321062 - DNA, 33 bp, Artificial Sequence
  Description of Artificial Sequence: Synthetic oligonucleotide
ttagagaggctcatcagggcgaattatatgccg

SEQ ID NO: 321063 - DNA, 32 bp, Artificial Sequence
  Description of Artificial Sequence: Synthetic oligonucleotide
tagagaggctcatcagggcgaattatatgccg

SEQ ID NO: 321064 - DNA, 31 bp, Artificial Sequence
  Description of Artificial Sequence: Synthetic oligonucleotide
agagaggctcatcagggcgaattatatgccg

SEQ ID NO: 321065 - DNA, 30 bp, Artificial Sequence
  Description of Artificial Sequence: Synthetic oligonucleotide
gagaggctcatcagggcgaattatatgccg

SEQ ID NO: 321066 - DNA, 30 bp, Artificial Sequence
  Description of Artificial Sequence: Synthetic oligonucleotide
agaggctcatcagggcgaattatatgccgc

SEQ ID NO: 321067 - DNA, 29 bp, Artificial Sequence
  Description of Artificial Sequence: Synthetic oligonucleotide
gaggctcatcagggcgaattatatgccgc

SEQ ID NO: 321068 - DNA, 34 bp, Artificial Sequence
  Description of Artificial Sequence: Synthetic oligonucleotide
aggctcatcagggcgaattatatgccgcaaaatg

SEQ ID NO: 321069 - DNA, 33 bp, Artificial Sequence
  Description of Artificial Sequence: Synthetic oligonucleotide
ggctcatcagggcgaattatatgccgcaaaatg

SEQ ID NO: 321070 - DNA, 34 bp, Artificial Sequence
  Description of Artificial Sequence: Synthetic oligonucleotide
gctcatcagggcgaattatatgccgcaaaatgtc

SEQ ID NO: 321071 - DNA, 36 bp, Artificial Sequence
  Description of Artificial Sequence: Synthetic oligonucleotide
ctcatcagggcgaattatatgccgcaaaatgtcaac

SEQ ID NO: 321072 - DNA, 37 bp, Artificial Sequence
  Description of Artificial Sequence: Synthetic oligonucleotide
tcatcagggcgaattatatgccgcaaaatgtcaactg

SEQ ID NO: 321073 - DNA, 36 bp, Artificial Sequence
  Description of Artificial Sequence: Synthetic oligonucleotide
catcagggcgaattatatgccgcaaaatgtcaactg

SEQ ID NO: 321074 - DNA, 37 bp, Artificial Sequence
  Description of Artificial Sequence: Synthetic oligonucleotide
atcagggcgaattatatgccgcaaaatgtcaactgtg

SEQ ID NO: 321075 - DNA, 36 bp, Artificial Sequence
  Description of Artificial Sequence: Synthetic oligonucleotide
tcagggcgaattatatgccgcaaaatgtcaactgtg

SEQ ID NO: 321076 - DNA, 35 bp, Artificial Sequence
  Description of Artificial Sequence: Synthetic oligonucleotide
cagggcgaattatatgccgcaaaatgtcaactgtg

SEQ ID NO: 321077 - DNA, 36 bp, Artificial Sequence
  Description of Artificial Sequence: Synthetic oligonucleotide
agggcgaattatatgccgcaaaatgtcaactgtgtg

SEQ ID NO: 321078 - DNA, 35 bp, Artificial Sequence
  Description of Artificial Sequence: Synthetic oligonucleotide
gggcgaattatatgccgcaaaatgtcaactgtgtg

SEQ ID NO: 321079 - DNA, 35 bp, Artificial Sequence
  Description of Artificial Sequence: Synthetic oligonucleotide
ggcgaattatatgccgcaaaatgtcaactgtgtgc

SEQ ID NO: 321080 - DNA, 36 bp, Artificial Sequence
  Description of Artificial Sequence: Synthetic oligonucleotide
gcgaattatatgccgcaaaatgtcaactgtgtgctc

SEQ ID NO: 321081 - DNA, 36 bp, Artificial Sequence
  Description of Artificial Sequence: Synthetic oligonucleotide
cgaattatatgccgcaaaatgtcaactgtgtgctcc

SEQ ID NO: 321082 - DNA, 37 bp, Artificial Sequence
  Description of Artificial Sequence: Synthetic oligonucleotide
gaattatatgccgcaaaatgtcaactgtgtgctcctg

SEQ ID NO: 321083 - DNA, 37 bp, Artificial Sequence
  Description of Artificial Sequence: Synthetic oligonucleotide
aattatatgccgcaaaatgtcaactgtgtgctcctgg

SEQ ID NO: 321084 - DNA, 36 bp, Artificial Sequence
  Description of Artificial Sequence: Synthetic oligonucleotide
attatatgccgcaaaatgtcaactgtgtgctcctgg

SEQ ID NO: 321085 - DNA, 35 bp, Artificial Sequence
  Description of Artificial Sequence: Synthetic oligonucleotide
ttatatgccgcaaaatgtcaactgtgtgctcctgg

SEQ ID NO: 321086 - DNA, 34 bp, Artificial Sequence
  Description of Artificial Sequence: Synthetic oligonucleotide
tatatgccgcaaaatgtcaactgtgtgctcctgg

SEQ ID NO: 321087 - DNA, 33 bp, Artificial Sequence
  Description of Artificial Sequence: Synthetic oligonucleotide
atatgccgcaaaatgtcaactgtgtgctcctgg

SEQ ID NO: 321088 - DNA, 32 bp, Artificial Sequence
  Description of Artificial Sequence: Synthetic oligonucleotide
tatgccgcaaaatgtcaactgtgtgctcctgg

SEQ ID NO: 321089 - DNA, 31 bp, Artificial Sequence
  Description of Artificial Sequence: Synthetic oligonucleotide
atgccgcaaaatgtcaactgtgtgctcctgg

SEQ ID NO: 321090 - DNA, 30 bp, Artificial Sequence
  Description of Artificial Sequence: Synthetic oligonucleotide
tgccgcaaaatgtcaactgtgtgctcctgg

SEQ ID NO: 321091 - DNA, 29 bp, Artificial Sequence
  Description of Artificial Sequence: Synthetic oligonucleotide
gccgcaaaatgtcaactgtgtgctcctgg

SEQ ID NO: 321092 - DNA, 31 bp, Artificial Sequence
  Description of Artificial Sequence: Synthetic oligonucleotide
ccgcaaaatgtcaactgtgtgctcctggatc

SEQ ID NO: 321093 - DNA, 32 bp, Artificial Sequence
  Description of Artificial Sequence: Synthetic oligonucleotide
cgcaaaatgtcaactgtgtgctcctggatcac

SEQ ID NO: 321094 - DNA, 34 bp, Artificial Sequence
  Description of Artificial Sequence: Synthetic oligonucleotide
gcaaaatgtcaactgtgtgctcctggatcacaag

SEQ ID NO: 321095 - DNA, 34 bp, Artificial Sequence
  Description of Artificial Sequence: Synthetic oligonucleotide
caaaatgtcaactgtgtgctcctggatcacaagg

SEQ ID NO: 321096 - DNA, 34 bp, Artificial Sequence
  Description of Artificial Sequence: Synthetic oligonucleotide
aaaatgtcaactgtgtgctcctggatcacaaggc

SEQ ID NO: 321097 - DNA, 33 bp, Artificial Sequence
  Description of Artificial Sequence: Synthetic oligonucleotide
aaatgtcaactgtgtgctcctggatcacaaggc

SEQ ID NO: 321098 - DNA, 32 bp, Artificial Sequence
  Description of Artificial Sequence: Synthetic oligonucleotide
aatgtcaactgtgtgctcctggatcacaaggc

SEQ ID NO: 321099 - DNA, 31 bp, Artificial Sequence
  Description of Artificial Sequence: Synthetic oligonucleotide
atgtcaactgtgtgctcctggatcacaaggc

SEQ ID NO: 321100 - DNA, 30 bp, Artificial Sequence
  Description of Artificial Sequence: Synthetic oligonucleotide
tgtcaactgtgtgctcctggatcacaaggc

SEQ ID NO: 321101 - DNA, 29 bp, Artificial Sequence
  Description of Artificial Sequence: Synthetic oligonucleotide
gtcaactgtgtgctcctggatcacaaggc

SEQ ID NO: 321102 - DNA, 29 bp, Artificial Sequence
  Description of Artificial Sequence: Synthetic oligonucleotide
tcaactgtgtgctcctggatcacaaggcg

SEQ ID NO: 321103 - DNA, 28 bp, Artificial Sequence
  Description of Artificial Sequence: Synthetic oligonucleotide
caactgtgtgctcctggatcacaaggcg

SEQ ID NO: 321104 - DNA, 29 bp, Artificial Sequence
  Description of Artificial Sequence: Synthetic oligonucleotide
aactgtgtgctcctggatcacaaggcgac

SEQ ID NO: 321105 - DNA, 28 bp, Artificial Sequence
  Description of Artificial Sequence: Synthetic oligonucleotide
actgtgtgctcctggatcacaaggcgac

SEQ ID NO: 321106 - DNA, 27 bp, Artificial Sequence
  Description of Artificial Sequence: Synthetic oligonucleotide
ctgtgtgctcctggatcacaaggcgac

SEQ ID NO: 321107 - DNA, 27 bp, Artificial Sequence
  Description of Artificial Sequence: Synthetic oligonucleotide
tgtgtgctcctggatcacaaggcgacg

SEQ ID NO: 321108 - DNA, 26 bp, Artificial Sequence
  Description of Artificial Sequence: Synthetic oligonucleotide
gtgtgctcctggatcacaaggcgacg

SEQ ID NO: 321109 - DNA, 27 bp, Artificial Sequence
  Description of Artificial Sequence: Synthetic oligonucleotide
tgtgctcctggatcacaaggcgacgca

SEQ ID NO: 321110 - DNA, 27 bp, Artificial Sequence
  Description of Artificial Sequence: Synthetic oligonucleotide
gtgctcctggatcacaaggcgacgcat

SEQ ID NO: 321111 - DNA, 27 bp, Artificial Sequence
  Description of Artificial Sequence: Synthetic oligonucleotide
tgctcctggatcacaaggcgacgcatg

SEQ ID NO: 321112 - DNA, 26 bp, Artificial Sequence
  Description of Artificial Sequence: Synthetic oligonucleotide
gctcctggatcacaaggcgacgcatg

SEQ ID NO: 321113 - DNA, 26 bp, Artificial Sequence
  Description of Artificial Sequence: Synthetic oligonucleotide
ctcctggatcacaaggcgacgcatgc

SEQ ID NO: 321114 - DNA, 27 bp, Artificial Sequence
  Description of Artificial Sequence: Synthetic oligonucleotide
tcctggatcacaaggcgacgcatgcct

SEQ ID NO: 321115 - DNA, 27 bp, Artificial Sequence
  Description of Artificial Sequence: Synthetic oligonucleotide
cctggatcacaaggcgacgcatgcctt

SEQ ID NO: 321116 - DNA, 31 bp, Artificial Sequence
  Description of Artificial Sequence: Synthetic oligonucleotide
ctggatcacaaggcgacgcatgcctttatag

SEQ ID NO: 321117 - DNA, 31 bp, Artificial Sequence
  Description of Artificial Sequence: Synthetic oligonucleotide
tggatcacaaggcgacgcatgcctttatagg

SEQ ID NO: 321118 - DNA, 30 bp, Artificial Sequence
  Description of Artificial Sequence: Synthetic oligonucleotide
ggatcacaaggcgacgcatgcctttatagg

SEQ ID NO: 321119 - DNA, 31 bp, Artificial Sequence
  Description of Artificial Sequence: Synthetic oligonucleotide
gatcacaaggcgacgcatgcctttataggtg

SEQ ID NO: 321120 - DNA, 31 bp, Artificial Sequence
  Description of Artificial Sequence: Synthetic oligonucleotide
atcacaaggcgacgcatgcctttataggtgc

SEQ ID NO: 321121 - DNA, 30 bp, Artificial Sequence
  Description of Artificial Sequence: Synthetic oligonucleotide
tcacaaggcgacgcatgcctttataggtgc

SEQ ID NO: 321122 - DNA, 29 bp, Artificial Sequence
  Description of Artificial Sequence: Synthetic oligonucleotide
cacaaggcgacgcatgcctttataggtgc

SEQ ID NO: 321123 - DNA, 30 bp, Artificial Sequence
  Description of Artificial Sequence: Synthetic oligonucleotide
acaaggcgacgcatgcctttataggtgcag

SEQ ID NO: 321124 - DNA, 29 bp, Artificial Sequence
  Description of Artificial Sequence: Synthetic oligonucleotide
caaggcgacgcatgcctttataggtgcag

SEQ ID NO: 321125 - DNA, 30 bp, Artificial Sequence
  Description of Artificial Sequence: Synthetic oligonucleotide
aaggcgacgcatgcctttataggtgcagtc

SEQ ID NO: 321126 - DNA, 29 bp, Artificial Sequence
  Description of Artificial Sequence: Synthetic oligonucleotide
aggcgacgcatgcctttataggtgcagtc

SEQ ID NO: 321127 - DNA, 28 bp, Artificial Sequence
  Description of Artificial Sequence: Synthetic oligonucleotide
ggcgacgcatgcctttataggtgcagtc

SEQ ID NO: 321128 - DNA, 31 bp, Artificial Sequence
  Description of Artificial Sequence: Synthetic oligonucleotide
gcgacgcatgcctttataggtgcagtcaaac

SEQ ID NO: 321129 - DNA, 32 bp, Artificial Sequence
  Description of Artificial Sequence: Synthetic oligonucleotide
cgacgcatgcctttataggtgcagtcaaacag

SEQ ID NO: 321130 - DNA, 35 bp, Artificial Sequence
  Description of Artificial Sequence: Synthetic oligonucleotide
gacgcatgcctttataggtgcagtcaaacagttag

SEQ ID NO: 321131 - DNA, 36 bp, Artificial Sequence
  Description of Artificial Sequence: Synthetic oligonucleotide
acgcatgcctttataggtgcagtcaaacagttagtc

SEQ ID NO: 321132 - DNA, 35 bp, Artificial Sequence
  Description of Artificial Sequence: Synthetic oligonucleotide
cgcatgcctttataggtgcagtcaaacagttagtc

SEQ ID NO: 321133 - DNA, 36 bp, Artificial Sequence
  Description of Artificial Sequence: Synthetic oligonucleotide
gcatgcctttataggtgcagtcaaacagttagtcag

SEQ ID NO: 321134 - DNA, 36 bp, Artificial Sequence
  Description of Artificial Sequence: Synthetic oligonucleotide
catgcctttataggtgcagtcaaacagttagtcagc

SEQ ID NO: 321135 - DNA, 37 bp, Artificial Sequence
  Description of Artificial Sequence: Synthetic oligonucleotide
atgcctttataggtgcagtcaaacagttagtcagctg

SEQ ID NO: 321136 - DNA, 36 bp, Artificial Sequence
  Description of Artificial Sequence: Synthetic oligonucleotide
tgcctttataggtgcagtcaaacagttagtcagctg

SEQ ID NO: 321137 - DNA, 35 bp, Artificial Sequence
  Description of Artificial Sequence: Synthetic oligonucleotide
gcctttataggtgcagtcaaacagttagtcagctg

SEQ ID NO: 321138 - DNA, 35 bp, Artificial Sequence
  Description of Artificial Sequence: Synthetic oligonucleotide
cctttataggtgcagtcaaacagttagtcagctgc

SEQ ID NO: 321139 - DNA, 37 bp, Artificial Sequence
  Description of Artificial Sequence: Synthetic oligonucleotide
ctttataggtgcagtcaaacagttagtcagctgctac

SEQ ID NO: 321140 - DNA, 37 bp, Artificial Sequence
  Description of Artificial Sequence: Synthetic oligonucleotide
tttataggtgcagtcaaacagttagtcagctgctacc

SEQ ID NO: 321141 - DNA, 36 bp, Artificial Sequence
  Description of Artificial Sequence: Synthetic oligonucleotide
ttataggtgcagtcaaacagttagtcagctgctacc

SEQ ID NO: 321142 - DNA, 35 bp, Artificial Sequence
  Description of Artificial Sequence: Synthetic oligonucleotide
tataggtgcagtcaaacagttagtcagctgctacc

SEQ ID NO: 321143 - DNA, 34 bp, Artificial Sequence
  Description of Artificial Sequence: Synthetic oligonucleotide
ataggtgcagtcaaacagttagtcagctgctacc

SEQ ID NO: 321144 - DNA, 33 bp, Artificial Sequence
  Description of Artificial Sequence: Synthetic oligonucleotide
taggtgcagtcaaacagttagtcagctgctacc

SEQ ID NO: 321145 - DNA, 32 bp, Artificial Sequence
  Description of Artificial Sequence: Synthetic oligonucleotide
aggtgcagtcaaacagttagtcagctgctacc

SEQ ID NO: 321146 - DNA, 31 bp, Artificial Sequence
  Description of Artificial Sequence: Synthetic oligonucleotide
ggtgcagtcaaacagttagtcagctgctacc

SEQ ID NO: 321147 - DNA, 31 bp, Artificial Sequence
  Description of Artificial Sequence: Synthetic oligonucleotide
gtgcagtcaaacagttagtcagctgctaccc

SEQ ID NO: 321148 - DNA, 35 bp, Artificial Sequence
  Description of Artificial Sequence: Synthetic oligonucleotide
tgcagtcaaacagttagtcagctgctacccaaatg

SEQ ID NO: 321149 - DNA, 34 bp, Artificial Sequence
  Description of Artificial Sequence: Synthetic oligonucleotide
gcagtcaaacagttagtcagctgctacccaaatg

SEQ ID NO: 321150 - DNA, 34 bp, Artificial Sequence
  Description of Artificial Sequence: Synthetic oligonucleotide
cagtcaaacagttagtcagctgctacccaaatgc

SEQ ID NO: 321151 - DNA, 38 bp, Artificial Sequence
  Description of Artificial Sequence: Synthetic oligonucleotide
agtcaaacagttagtcagctgctacccaaatgcatttc

SEQ ID NO: 321152 - DNA, 37 bp, Artificial Sequence
  Description of Artificial Sequence: Synthetic oligonucleotide
gtcaaacagttagtcagctgctacccaaatgcatttc

SEQ ID NO: 321153 - DNA, 38 bp, Artificial Sequence
  Description of Artificial Sequence: Synthetic oligonucleotide
tcaaacagttagtcagctgctacccaaatgcatttctg

SEQ ID NO: 321154 - DNA, 37 bp, Artificial Sequence
  Description of Artificial Sequence: Synthetic oligonucleotide
caaacagttagtcagctgctacccaaatgcatttctg

SEQ ID NO: 321155 - DNA, 37 bp, Artificial Sequence
  Description of Artificial Sequence: Synthetic oligonucleotide
aaacagttagtcagctgctacccaaatgcatttctgg

SEQ ID NO: 321156 - DNA, 36 bp, Artificial Sequence
  Description of Artificial Sequence: Synthetic oligonucleotide
aacagttagtcagctgctacccaaatgcatttctgg

SEQ ID NO: 321157 - DNA, 35 bp, Artificial Sequence
  Description of Artificial Sequence: Synthetic oligonucleotide
acagttagtcagctgctacccaaatgcatttctgg

SEQ ID NO: 321158 - DNA, 34 bp, Artificial Sequence
  Description of Artificial Sequence: Synthetic oligonucleotide
cagttagtcagctgctacccaaatgcatttctgg

SEQ ID NO: 321159 - DNA, 34 bp, Artificial Sequence
  Description of Artificial Sequence: Synthetic oligonucleotide
agttagtcagctgctacccaaatgcatttctggc

SEQ ID NO: 321160 - DNA, 33 bp, Artificial Sequence
  Description of Artificial Sequence: Synthetic oligonucleotide
gttagtcagctgctacccaaatgcatttctggc

SEQ ID NO: 321161 - DNA, 35 bp, Artificial Sequence
  Description of Artificial Sequence: Synthetic oligonucleotide
ttagtcagctgctacccaaatgcatttctggctac

SEQ ID NO: 321162 - DNA, 34 bp, Artificial Sequence
  Description of Artificial Sequence: Synthetic oligonucleotide
tagtcagctgctacccaaatgcatttctggctac

SEQ ID NO: 321163 - DNA, 33 bp, Artificial Sequence
  Description of Artificial Sequence: Synthetic oligonucleotide
agtcagctgctacccaaatgcatttctggctac

SEQ ID NO: 321164 - DNA, 32 bp, Artificial Sequence
  Description of Artificial Sequence: Synthetic oligonucleotide
gtcagctgctacccaaatgcatttctggctac

SEQ ID NO: 321165 - DNA, 32 bp, Artificial Sequence
  Description of Artificial Sequence: Synthetic oligonucleotide
tcagctgctacccaaatgcatttctggctacc

SEQ ID NO: 321166 - DNA, 31 bp, Artificial Sequence
  Description of Artificial Sequence: Synthetic oligonucleotide
cagctgctacccaaatgcatttctggctacc

SEQ ID NO: 321167 - DNA, 33 bp, Artificial Sequence
  Description of Artificial Sequence: Synthetic oligonucleotide
agctgctacccaaatgcatttctggctaccaag

SEQ ID NO: 321168 - DNA, 32 bp, Artificial Sequence
  Description of Artificial Sequence: Synthetic oligonucleotide
gctgctacccaaatgcatttctggctaccaag

SEQ ID NO: 321169 - DNA, 34 bp, Artificial Sequence
  Description of Artificial Sequence: Synthetic oligonucleotide
ctgctacccaaatgcatttctggctaccaagaag

SEQ ID NO: 321170 - DNA, 34 bp, Artificial Sequence
  Description of Artificial Sequence: Synthetic oligonucleotide
tgctacccaaatgcatttctggctaccaagaagg

SEQ ID NO: 321171 - DNA, 33 bp, Artificial Sequence
  Description of Artificial Sequence: Synthetic oligonucleotide
gctacccaaatgcatttctggctaccaagaagg

SEQ ID NO: 321172 - DNA, 34 bp, Artificial Sequence
  Description of Artificial Sequence: Synthetic oligonucleotide
ctacccaaatgcatttctggctaccaagaaggtg

SEQ ID NO: 321173 - DNA, 35 bp, Artificial Sequence
  Description of Artificial Sequence: Synthetic oligonucleotide
tacccaaatgcatttctggctaccaagaaggtgtc

SEQ ID NO: 321174 - DNA, 34 bp, Artificial Sequence
  Description of Artificial Sequence: Synthetic oligonucleotide
acccaaatgcatttctggctaccaagaaggtgtc

SEQ ID NO: 321175 - DNA, 33 bp, Artificial Sequence
  Description of Artificial Sequence: Synthetic oligonucleotide
cccaaatgcatttctggctaccaagaaggtgtc

SEQ ID NO: 321176 - DNA, 33 bp, Artificial Sequence
  Description of Artificial Sequence: Synthetic oligonucleotide
ccaaatgcatttctggctaccaagaaggtgtcg

SEQ ID NO: 321177 - DNA, 33 bp, Artificial Sequence
  Description of Artificial Sequence: Synthetic oligonucleotide
caaatgcatttctggctaccaagaaggtgtcgg

SEQ ID NO: 321178 - DNA, 35 bp, Artificial Sequence
  Description of Artificial Sequence: Synthetic oligonucleotide
aaatgcatttctggctaccaagaaggtgtcggttg

SEQ ID NO: 321179 - DNA, 34 bp, Artificial Sequence
  Description of Artificial Sequence: Synthetic oligonucleotide
aatgcatttctggctaccaagaaggtgtcggttg

SEQ ID NO: 321180 - DNA, 33 bp, Artificial Sequence
  Description of Artificial Sequence: Synthetic oligonucleotide
atgcatttctggctaccaagaaggtgtcggttg

SEQ ID NO: 321181 - DNA, 32 bp, Artificial Sequence
  Description of Artificial Sequence: Synthetic oligonucleotide
tgcatttctggctaccaagaaggtgtcggttg

SEQ ID NO: 321182 - DNA, 31 bp, Artificial Sequence
  Description of Artificial Sequence: Synthetic oligonucleotide
gcatttctggctaccaagaaggtgtcggttg

SEQ ID NO: 321183 - DNA, 32 bp, Artificial Sequence
  Description of Artificial Sequence: Synthetic oligonucleotide
catttctggctaccaagaaggtgtcggttgtg

SEQ ID NO: 321184 - DNA, 35 bp, Artificial Sequence
  Description of Artificial Sequence: Synthetic oligonucleotide
atttctggctaccaagaaggtgtcggttgtgtatg

SEQ ID NO: 321185 - DNA, 34 bp, Artificial Sequence
  Description of Artificial Sequence: Synthetic oligonucleotide
tttctggctaccaagaaggtgtcggttgtgtatg

SEQ ID NO: 321186 - DNA, 33 bp, Artificial Sequence
  Description of Artificial Sequence: Synthetic oligonucleotide
ttctggctaccaagaaggtgtcggttgtgtatg

SEQ ID NO: 321187 - DNA, 32 bp, Artificial Sequence
  Description of Artificial Sequence: Synthetic oligonucleotide
tctggctaccaagaaggtgtcggttgtgtatg

SEQ ID NO: 321188 - DNA, 31 bp, Artificial Sequence
  Description of Artificial Sequence: Synthetic oligonucleotide
ctggctaccaagaaggtgtcggttgtgtatg

SEQ ID NO: 321189 - DNA, 31 bp, Artificial Sequence
  Description of Artificial Sequence: Synthetic oligonucleotide
tggctaccaagaaggtgtcggttgtgtatgg

SEQ ID NO: 321190 - DNA, 30 bp, Artificial Sequence
  Description of Artificial Sequence: Synthetic oligonucleotide
ggctaccaagaaggtgtcggttgtgtatgg

SEQ ID NO: 321191 - DNA, 30 bp, Artificial Sequence
  Description of Artificial Sequence: Synthetic oligonucleotide
gctaccaagaaggtgtcggttgtgtatggg

SEQ ID NO: 321192 - DNA, 30 bp, Artificial Sequence
  Description of Artificial Sequence: Synthetic oligonucleotide
ctaccaagaaggtgtcggttgtgtatgggg

SEQ ID NO: 321193 - DNA, 30 bp, Artificial Sequence
  Description of Artificial Sequence: Synthetic oligonucleotide
taccaagaaggtgtcggttgtgtatggggg

SEQ ID NO: 321194 - DNA, 29 bp, Artificial Sequence
  Description of Artificial Sequence: Synthetic oligonucleotide
accaagaaggtgtcggttgtgtatggggg

SEQ ID NO: 321195 - DNA, 28 bp, Artificial Sequence
  Description of Artificial Sequence: Synthetic oligonucleotide
ccaagaaggtgtcggttgtgtatggggg

SEQ ID NO: 321196 - DNA, 28 bp, Artificial Sequence
  Description of Artificial Sequence: Synthetic oligonucleotide
caagaaggtgtcggttgtgtatgggggg

SEQ ID NO: 321197 - DNA, 30 bp, Artificial Sequence
  Description of Artificial Sequence: Synthetic oligonucleotide
aagaaggtgtcggttgtgtatggggggttc

SEQ ID NO: 321198 - DNA, 29 bp, Artificial Sequence
  Description of Artificial Sequence: Synthetic oligonucleotide
agaaggtgtcggttgtgtatggggggttc

SEQ ID NO: 321199 - DNA, 28 bp, Artificial Sequence
  Description of Artificial Sequence: Synthetic oligonucleotide
gaaggtgtcggttgtgtatggggggttc

SEQ ID NO: 321200 - DNA, 29 bp, Artificial Sequence
  Description of Artificial Sequence: Synthetic oligonucleotide
aaggtgtcggttgtgtatggggggttctc

SEQ ID NO: 321201 - DNA, 28 bp, Artificial Sequence
  Description of Artificial Sequence: Synthetic oligonucleotide
aggtgtcggttgtgtatggggggttctc

SEQ ID NO: 321202 - DNA, 27 bp, Artificial Sequence
  Description of Artificial Sequence: Synthetic oligonucleotide
ggtgtcggttgtgtatggggggttctc

SEQ ID NO: 321203 - DNA, 27 bp, Artificial Sequence
  Description of Artificial Sequence: Synthetic oligonucleotide
gtgtcggttgtgtatggggggttctcc

SEQ ID NO: 321204 - DNA, 28 bp, Artificial Sequence
  Description of Artificial Sequence: Synthetic oligonucleotide
tgtcggttgtgtatggggggttctccag

SEQ ID NO: 321205 - DNA, 27 bp, Artificial Sequence
  Description of Artificial Sequence: Synthetic oligonucleotide
gtcggttgtgtatggggggttctccag

SEQ ID NO: 321206 - DNA, 27 bp, Artificial Sequence
  Description of Artificial Sequence: Synthetic oligonucleotide
tcggttgtgtatggggggttctccagg

SEQ ID NO: 321207 - DNA, 26 bp, Artificial Sequence
  Description of Artificial Sequence: Synthetic oligonucleotide
cggttgtgtatggggggttctccagg

SEQ ID NO: 321208 - DNA, 27 bp, Artificial Sequence
  Description of Artificial Sequence: Synthetic oligonucleotide
ggttgtgtatggggggttctccaggca

SEQ ID NO: 321209 - DNA, 27 bp, Artificial Sequence
  Description of Artificial Sequence: Synthetic oligonucleotide
gttgtgtatggggggttctccaggcac

SEQ ID NO: 321210 - DNA, 27 bp, Artificial Sequence
  Description of Artificial Sequence: Synthetic oligonucleotide
ttgtgtatggggggttctccaggcacc

SEQ ID NO: 321211 - DNA, 27 bp, Artificial Sequence
  Description of Artificial Sequence: Synthetic oligonucleotide
tgtgtatggggggttctccaggcacca

SEQ ID NO: 321212 - DNA, 26 bp, Artificial Sequence
  Description of Artificial Sequence: Synthetic oligonucleotide
gtgtatggggggttctccaggcacca

SEQ ID NO: 321213 - DNA, 26 bp, Artificial Sequence
  Description of Artificial Sequence: Synthetic oligonucleotide
tgtatggggggttctccaggcaccag

SEQ ID NO: 321214 - DNA, 25 bp, Artificial Sequence
  Description of Artificial Sequence: Synthetic oligonucleotide
gtatggggggttctccaggcaccag

SEQ ID NO: 321215 - DNA, 25 bp, Artificial Sequence
  Description of Artificial Sequence: Synthetic oligonucleotide
tatggggggttctccaggcaccagg

SEQ ID NO: 321216 - DNA, 24 bp, Artificial Sequence
  Description of Artificial Sequence: Synthetic oligonucleotide
atggggggttctccaggcaccagg

SEQ ID NO: 321217 - DNA, 23 bp, Artificial Sequence
  Description of Artificial Sequence: Synthetic oligonucleotide
tggggggttctccaggcaccagg

SEQ ID NO: 321218 - DNA, 22 bp, Artificial Sequence
  Description of Artificial Sequence: Synthetic oligonucleotide
ggggggttctccaggcaccagg

SEQ ID NO: 321219 - DNA, 23 bp, Artificial Sequence
  Description of Artificial Sequence: Synthetic oligonucleotide
gggggttctccaggcaccaggct

SEQ ID NO: 321220 - DNA, 24 bp, Artificial Sequence
  Description of Artificial Sequence: Synthetic oligonucleotide
ggggttctccaggcaccaggctga

SEQ ID NO: 321221 - DNA, 24 bp, Artificial Sequence
  Description of Artificial Sequence: Synthetic oligonucleotide
gggttctccaggcaccaggctgag

SEQ ID NO: 321222 - DNA, 25 bp, Artificial Sequence
  Description of Artificial Sequence: Synthetic oligonucleotide
ggttctccaggcaccaggctgagct

SEQ ID NO: 321223 - DNA, 27 bp, Artificial Sequence
  Description of Artificial Sequence: Synthetic oligonucleotide
gttctccaggcaccaggctgagctgaa

SEQ ID NO: 321224 - DNA, 27 bp, Artificial Sequence
  Description of Artificial Sequence: Synthetic oligonucleotide
ttctccaggcaccaggctgagctgaac

SEQ ID NO: 321225 - DNA, 27 bp, Artificial Sequence
  Description of Artificial Sequence: Synthetic oligonucleotide
tctccaggcaccaggctgagctgaact

SEQ ID NO: 321226 - DNA, 26 bp, Artificial Sequence
  Description of Artificial Sequence: Synthetic oligonucleotide
ctccaggcaccaggctgagctgaact

SEQ ID NO: 321227 - DNA, 26 bp, Artificial Sequence
  Description of Artificial Sequence: Synthetic oligonucleotide
tccaggcaccaggctgagctgaactg

SEQ ID NO: 321228 - DNA, 25 bp, Artificial Sequence
  Description of Artificial Sequence: Synthetic oligonucleotide
ccaggcaccaggctgagctgaactg

SEQ ID NO: 321229 - DNA, 25 bp, Artificial Sequence
  Description of Artificial Sequence: Synthetic oligonucleotide
caggcaccaggctgagctgaactgc

SEQ ID NO: 321230 - DNA, 26 bp, Artificial Sequence
  Description of Artificial Sequence: Synthetic oligonucleotide
aggcaccaggctgagctgaactgcgt

SEQ ID NO: 321231 - DNA, 25 bp, Artificial Sequence
  Description of Artificial Sequence: Synthetic oligonucleotide
ggcaccaggctgagctgaactgcgt

SEQ ID NO: 321232 - DNA, 25 bp, Artificial Sequence
  Description of Artificial Sequence: Synthetic oligonucleotide
gcaccaggctgagctgaactgcgtg

SEQ ID NO: 321233 - DNA, 27 bp, Artificial Sequence
  Description of Artificial Sequence: Synthetic oligonucleotide
caccaggctgagctgaactgcgtggaa

SEQ ID NO: 321234 - DNA, 27 bp, Artificial Sequence
  Description of Artificial Sequence: Synthetic oligonucleotide
accaggctgagctgaactgcgtggaag

SEQ ID NO: 321235 - DNA, 27 bp, Artificial Sequence
  Description of Artificial Sequence: Synthetic oligonucleotide
ccaggctgagctgaactgcgtggaaga

SEQ ID NO: 321236 - DNA, 27 bp, Artificial Sequence
  Description of Artificial Sequence: Synthetic oligonucleotide
caggctgagctgaactgcgtggaagac

SEQ ID NO: 321237 - DNA, 27 bp, Artificial Sequence
  Description of Artificial Sequence: Synthetic oligonucleotide
aggctgagctgaactgcgtggaagacc

SEQ ID NO: 321238 - DNA, 27 bp, Artificial Sequence
  Description of Artificial Sequence: Synthetic oligonucleotide
ggctgagctgaactgcgtggaagacca

SEQ ID NO: 321239 - DNA, 28 bp, Artificial Sequence
  Description of Artificial Sequence: Synthetic oligonucleotide
gctgagctgaactgcgtggaagaccatg

SEQ ID NO: 321240 - DNA, 29 bp, Artificial Sequence
  Description of Artificial Sequence: Synthetic oligonucleotide
ctgagctgaactgcgtggaagaccatgtg

SEQ ID NO: 321241 - DNA, 29 bp, Artificial Sequence
  Description of Artificial Sequence: Synthetic oligonucleotide
tgagctgaactgcgtggaagaccatgtgg

SEQ ID NO: 321242 - DNA, 28 bp, Artificial Sequence
  Description of Artificial Sequence: Synthetic oligonucleotide
gagctgaactgcgtggaagaccatgtgg

SEQ ID NO: 321243 - DNA, 28 bp, Artificial Sequence
  Description of Artificial Sequence: Synthetic oligonucleotide
agctgaactgcgtggaagaccatgtggc

SEQ ID NO: 321244 - DNA, 27 bp, Artificial Sequence
  Description of Artificial Sequence: Synthetic oligonucleotide
gctgaactgcgtggaagaccatgtggc

SEQ ID NO: 321245 - DNA, 27 bp, Artificial Sequence
  Description of Artificial Sequence: Synthetic oligonucleotide
ctgaactgcgtggaagaccatgtggcc

SEQ ID NO: 321246 - DNA, 28 bp, Artificial Sequence
  Description of Artificial Sequence: Synthetic oligonucleotide
tgaactgcgtggaagaccatgtggcctc

SEQ ID NO: 321247 - DNA, 27 bp, Artificial Sequence
  Description of Artificial Sequence: Synthetic oligonucleotide
gaactgcgtggaagaccatgtggcctc

SEQ ID NO: 321248 - DNA, 28 bp, Artificial Sequence
  Description of Artificial Sequence: Synthetic oligonucleotide
aactgcgtggaagaccatgtggcctcag

SEQ ID NO: 321249 - DNA, 27 bp, Artificial Sequence
  Description of Artificial Sequence: Synthetic oligonucleotide
actgcgtggaagaccatgtggcctcag

SEQ ID NO: 321250 - DNA, 27 bp, Artificial Sequence
  Description of Artificial Sequence: Synthetic oligonucleotide
ctgcgtggaagaccatgtggcctcaga

SEQ ID NO: 321251 - DNA, 28 bp, Artificial Sequence
  Description of Artificial Sequence: Synthetic oligonucleotide
tgcgtggaagaccatgtggcctcagaag

SEQ ID NO: 321252 - DNA, 27 bp, Artificial Sequence
  Description of Artificial Sequence: Synthetic oligonucleotide
gcgtggaagaccatgtggcctcagaag

SEQ ID NO: 321253 - DNA, 29 bp, Artificial Sequence
  Description of Artificial Sequence: Synthetic oligonucleotide
cgtggaagaccatgtggcctcagaagttc

SEQ ID NO: 321254 - DNA, 29 bp, Artificial Sequence
  Description of Artificial Sequence: Synthetic oligonucleotide
gtggaagaccatgtggcctcagaagttcc

SEQ ID NO: 321255 - DNA, 29 bp, Artificial Sequence
  Description of Artificial Sequence: Synthetic oligonucleotide
tggaagaccatgtggcctcagaagttccc

SEQ ID NO: 321256 - DNA, 28 bp, Artificial Sequence
  Description of Artificial Sequence: Synthetic oligonucleotide
ggaagaccatgtggcctcagaagttccc

SEQ ID NO: 321257 - DNA, 29 bp, Artificial Sequence
  Description of Artificial Sequence: Synthetic oligonucleotide
gaagaccatgtggcctcagaagttcccag

SEQ ID NO: 321258 - DNA, 29 bp, Artificial Sequence
  Description of Artificial Sequence: Synthetic oligonucleotide
aagaccatgtggcctcagaagttcccagg

SEQ ID NO: 321259 - DNA, 28 bp, Artificial Sequence
  Description of Artificial Sequence: Synthetic oligonucleotide
agaccatgtggcctcagaagttcccagg

SEQ ID NO: 321260 - DNA, 27 bp, Artificial Sequence
  Description of Artificial Sequence: Synthetic oligonucleotide
gaccatgtggcctcagaagttcccagg

SEQ ID NO: 321261 - DNA, 29 bp, Artificial Sequence
  Description of Artificial Sequence: Synthetic oligonucleotide
accatgtggcctcagaagttcccaggaag

SEQ ID NO: 321262 - DNA, 28 bp, Artificial Sequence
  Description of Artificial Sequence: Synthetic oligonucleotide
ccatgtggcctcagaagttcccaggaag

SEQ ID NO: 321263 - DNA, 31 bp, Artificial Sequence
  Description of Artificial Sequence: Synthetic oligonucleotide
catgtggcctcagaagttcccaggaagtatg

SEQ ID NO: 321264 - DNA, 32 bp, Artificial Sequence
  Description of Artificial Sequence: Synthetic oligonucleotide
atgtggcctcagaagttcccaggaagtatgac

SEQ ID NO: 321265 - DNA, 31 bp, Artificial Sequence
  Description of Artificial Sequence: Synthetic oligonucleotide
tgtggcctcagaagttcccaggaagtatgac

SEQ ID NO: 321266 - DNA, 30 bp, Artificial Sequence
  Description of Artificial Sequence: Synthetic oligonucleotide
gtggcctcagaagttcccaggaagtatgac

SEQ ID NO: 321267 - DNA, 32 bp, Artificial Sequence
  Description of Artificial Sequence: Synthetic oligonucleotide
tggcctcagaagttcccaggaagtatgacatc

SEQ ID NO: 321268 - DNA, 31 bp, Artificial Sequence
  Description of Artificial Sequence: Synthetic oligonucleotide
ggcctcagaagttcccaggaagtatgacatc

SEQ ID NO: 321269 - DNA, 33 bp, Artificial Sequence
  Description of Artificial Sequence: Synthetic oligonucleotide
gcctcagaagttcccaggaagtatgacatcaac

SEQ ID NO: 321270 - DNA, 34 bp, Artificial Sequence
  Description of Artificial Sequence: Synthetic oligonucleotide
cctcagaagttcccaggaagtatgacatcaacac

SEQ ID NO: 321271 - DNA, 34 bp, Artificial Sequence
  Description of Artificial Sequence: Synthetic oligonucleotide
ctcagaagttcccaggaagtatgacatcaacacg

SEQ ID NO: 321272 - DNA, 35 bp, Artificial Sequence
  Description of Artificial Sequence: Synthetic oligonucleotide
tcagaagttcccaggaagtatgacatcaacacgtg

SEQ ID NO: 321273 - DNA, 34 bp, Artificial Sequence
  Description of Artificial Sequence: Synthetic oligonucleotide
cagaagttcccaggaagtatgacatcaacacgtg

SEQ ID NO: 321274 - DNA, 34 bp, Artificial Sequence
  Description of Artificial Sequence: Synthetic oligonucleotide
agaagttcccaggaagtatgacatcaacacgtgc

SEQ ID NO: 321275 - DNA, 33 bp, Artificial Sequence
  Description of Artificial Sequence: Synthetic oligonucleotide
gaagttcccaggaagtatgacatcaacacgtgc

SEQ ID NO: 321276 - DNA, 33 bp, Artificial Sequence
  Description of Artificial Sequence: Synthetic oligonucleotide
aagttcccaggaagtatgacatcaacacgtgcg

SEQ ID NO: 321277 - DNA, 32 bp, Artificial Sequence
  Description of Artificial Sequence: Synthetic oligonucleotide
agttcccaggaagtatgacatcaacacgtgcg

SEQ ID NO: 321278 - DNA, 31 bp, Artificial Sequence
  Description of Artificial Sequence: Synthetic oligonucleotide
gttcccaggaagtatgacatcaacacgtgcg

SEQ ID NO: 321279 - DNA, 31 bp, Artificial Sequence
  Description of Artificial Sequence: Synthetic oligonucleotide
ttcccaggaagtatgacatcaacacgtgcgg

SEQ ID NO: 321280 - DNA, 30 bp, Artificial Sequence
  Description of Artificial Sequence: Synthetic oligonucleotide
tcccaggaagtatgacatcaacacgtgcgg

SEQ ID NO: 321281 - DNA, 29 bp, Artificial Sequence
  Description of Artificial Sequence: Synthetic oligonucleotide
cccaggaagtatgacatcaacacgtgcgg

SEQ ID NO: 321282 - DNA, 29 bp, Artificial Sequence
  Description of Artificial Sequence: Synthetic oligonucleotide
ccaggaagtatgacatcaacacgtgcggg

SEQ ID NO: 321283 - DNA, 29 bp, Artificial Sequence
  Description of Artificial Sequence: Synthetic oligonucleotide
caggaagtatgacatcaacacgtgcgggc

SEQ ID NO: 321284 - DNA, 31 bp, Artificial Sequence
  Description of Artificial Sequence: Synthetic oligonucleotide
aggaagtatgacatcaacacgtgcgggcaac

SEQ ID NO: 321285 - DNA, 30 bp, Artificial Sequence
  Description of Artificial Sequence: Synthetic oligonucleotide
ggaagtatgacatcaacacgtgcgggcaac

SEQ ID NO: 321286 - DNA, 31 bp, Artificial Sequence
  Description of Artificial Sequence: Synthetic oligonucleotide
gaagtatgacatcaacacgtgcgggcaacac

SEQ ID NO: 321287 - DNA, 34 bp, Artificial Sequence
  Description of Artificial Sequence: Synthetic oligonucleotide
aagtatgacatcaacacgtgcgggcaacactttc

SEQ ID NO: 321288 - DNA, 33 bp, Artificial Sequence
  Description of Artificial Sequence: Synthetic oligonucleotide
agtatgacatcaacacgtgcgggcaacactttc

SEQ ID NO: 321289 - DNA, 32 bp, Artificial Sequence
  Description of Artificial Sequence: Synthetic oligonucleotide
gtatgacatcaacacgtgcgggcaacactttc

SEQ ID NO: 321290 - DNA, 32 bp, Artificial Sequence
  Description of Artificial Sequence: Synthetic oligonucleotide
tatgacatcaacacgtgcgggcaacactttcc

SEQ ID NO: 321291 - DNA, 31 bp, Artificial Sequence
  Description of Artificial Sequence: Synthetic oligonucleotide
atgacatcaacacgtgcgggcaacactttcc

SEQ ID NO: 321292 - DNA, 30 bp, Artificial Sequence
  Description of Artificial Sequence: Synthetic oligonucleotide
tgacatcaacacgtgcgggcaacactttcc

SEQ ID NO: 321293 - DNA, 29 bp, Artificial Sequence
  Description of Artificial Sequence: Synthetic oligonucleotide
gacatcaacacgtgcgggcaacactttcc

SEQ ID NO: 321294 - DNA, 29 bp, Artificial Sequence
  Description of Artificial Sequence: Synthetic oligonucleotide
acatcaacacgtgcgggcaacactttccc

SEQ ID NO: 321295 - DNA, 28 bp, Artificial Sequence
  Description of Artificial Sequence: Synthetic oligonucleotide
catcaacacgtgcgggcaacactttccc

SEQ ID NO: 321296 - DNA, 28 bp, Artificial Sequence
  Description of Artificial Sequence: Synthetic oligonucleotide
atcaacacgtgcgggcaacactttcccc

SEQ ID NO: 321297 - DNA, 27 bp, Artificial Sequence
  Description of Artificial Sequence: Synthetic oligonucleotide
tcaacacgtgcgggcaacactttcccc

SEQ ID NO: 321298 - DNA, 27 bp, Artificial Sequence
  Description of Artificial Sequence: Synthetic oligonucleotide
caacacgtgcgggcaacactttcccca

SEQ ID NO: 321299 - DNA, 27 bp, Artificial Sequence
  Description of Artificial Sequence: Synthetic oligonucleotide
aacacgtgcgggcaacactttccccag

SEQ ID NO: 321300 - DNA, 27 bp, Artificial Sequence
  Description of Artificial Sequence: Synthetic oligonucleotide
acacgtgcgggcaacactttccccaga

SEQ ID NO: 321301 - DNA, 27 bp, Artificial Sequence
  Description of Artificial Sequence: Synthetic oligonucleotide
cacgtgcgggcaacactttccccagaa

SEQ ID NO: 321302 - DNA, 29 bp, Artificial Sequence
  Description of Artificial Sequence: Synthetic oligonucleotide
acgtgcgggcaacactttccccagaaaac

SEQ ID NO: 321303 - DNA, 28 bp, Artificial Sequence
  Description of Artificial Sequence: Synthetic oligonucleotide
cgtgcgggcaacactttccccagaaaac

SEQ ID NO: 321304 - DNA, 28 bp, Artificial Sequence
  Description of Artificial Sequence: Synthetic oligonucleotide
gtgcgggcaacactttccccagaaaacc

SEQ ID NO: 321305 - DNA, 30 bp, Artificial Sequence
  Description of Artificial Sequence: Synthetic oligonucleotide
tgcgggcaacactttccccagaaaaccaag

SEQ ID NO: 321306 - DNA, 29 bp, Artificial Sequence
  Description of Artificial Sequence: Synthetic oligonucleotide
gcgggcaacactttccccagaaaaccaag

SEQ ID NO: 321307 - DNA, 30 bp, Artificial Sequence
  Description of Artificial Sequence: Synthetic oligonucleotide
cgggcaacactttccccagaaaaccaagag

SEQ ID NO: 321308 - DNA, 30 bp, Artificial Sequence
  Description of Artificial Sequence: Synthetic oligonucleotide
gggcaacactttccccagaaaaccaagagg

SEQ ID NO: 321309 - DNA, 30 bp, Artificial Sequence
  Description of Artificial Sequence: Synthetic oligonucleotide
ggcaacactttccccagaaaaccaagaggg

SEQ ID NO: 321310 - DNA, 35 bp, Artificial Sequence
  Description of Artificial Sequence: Synthetic oligonucleotide
gcaacactttccccagaaaaccaagagggaaatac

SEQ ID NO: 321311 - DNA, 37 bp, Artificial Sequence
  Description of Artificial Sequence: Synthetic oligonucleotide
caacactttccccagaaaaccaagagggaaatacttc

SEQ ID NO: 321312 - DNA, 38 bp, Artificial Sequence
  Description of Artificial Sequence: Synthetic oligonucleotide
aacactttccccagaaaaccaagagggaaatacttcag

SEQ ID NO: 321313 - DNA, 37 bp, Artificial Sequence
  Description of Artificial Sequence: Synthetic oligonucleotide
acactttccccagaaaaccaagagggaaatacttcag

SEQ ID NO: 321314 - DNA, 36 bp, Artificial Sequence
  Description of Artificial Sequence: Synthetic oligonucleotide
cactttccccagaaaaccaagagggaaatacttcag

SEQ ID NO: 321315 - DNA, 39 bp, Artificial Sequence
  Description of Artificial Sequence: Synthetic oligonucleotide
actttccccagaaaaccaagagggaaatacttcagtatc

SEQ ID NO: 321316 - DNA, 38 bp, Artificial Sequence
  Description of Artificial Sequence: Synthetic oligonucleotide
ctttccccagaaaaccaagagggaaatacttcagtatc

SEQ ID NO: 321317 - DNA, 39 bp, Artificial Sequence
  Description of Artificial Sequence: Synthetic oligonucleotide
tttccccagaaaaccaagagggaaatacttcagtatcag

SEQ ID NO: 321318 - DNA, 38 bp, Artificial Sequence
  Description of Artificial Sequence: Synthetic oligonucleotide
ttccccagaaaaccaagagggaaatacttcagtatcag

SEQ ID NO: 321319 - DNA, 37 bp, Artificial Sequence
  Description of Artificial Sequence: Synthetic oligonucleotide
tccccagaaaaccaagagggaaatacttcagtatcag

SEQ ID NO: 321320 - DNA, 36 bp, Artificial Sequence
  Description of Artificial Sequence: Synthetic oligonucleotide
ccccagaaaaccaagagggaaatacttcagtatcag

SEQ ID NO: 321321 - DNA, 38 bp, Artificial Sequence
  Description of Artificial Sequence: Synthetic oligonucleotide
cccagaaaaccaagagggaaatacttcagtatcagaag

SEQ ID NO: 321322 - DNA, 38 bp, Artificial Sequence
  Description of Artificial Sequence: Synthetic oligonucleotide
ccagaaaaccaagagggaaatacttcagtatcagaagg

SEQ ID NO: 321323 - DNA, 38 bp, Artificial Sequence
  Description of Artificial Sequence: Synthetic oligonucleotide
cagaaaaccaagagggaaatacttcagtatcagaaggg

SEQ ID NO: 321324 - DNA, 45 bp, Artificial Sequence
  Description of Artificial Sequence: Synthetic oligonucleotide
agaaaaccaagagggaaatacttcagtatcagaagggattaaaag

SEQ ID NO: 321325 - DNA, 44 bp, Artificial Sequence
  Description of Artificial Sequence: Synthetic oligonucleotide
gaaaaccaagagggaaatacttcagtatcagaagggattaaaag

SEQ ID NO: 321326 - DNA, 44 bp, Artificial Sequence
  Description of Artificial Sequence: Synthetic oligonucleotide
aaaaccaagagggaaatacttcagtatcagaagggattaaaagg

SEQ ID NO: 321327 - DNA, 43 bp, Artificial Sequence
  Description of Artificial Sequence: Synthetic oligonucleotide
aaaccaagagggaaatacttcagtatcagaagggattaaaagg

SEQ ID NO: 321328 - DNA, 42 bp, Artificial Sequence
  Description of Artificial Sequence: Synthetic oligonucleotide
aaccaagagggaaatacttcagtatcagaagggattaaaagg

SEQ ID NO: 321329 - DNA, 41 bp, Artificial Sequence
  Description of Artificial Sequence: Synthetic oligonucleotide
accaagagggaaatacttcagtatcagaagggattaaaagg

SEQ ID NO: 321330 - DNA, 40 bp, Artificial Sequence
  Description of Artificial Sequence: Synthetic oligonucleotide
ccaagagggaaatacttcagtatcagaagggattaaaagg

SEQ ID NO: 321331 - DNA, 40 bp, Artificial Sequence
  Description of Artificial Sequence: Synthetic oligonucleotide
caagagggaaatacttcagtatcagaagggattaaaaggg

SEQ ID NO: 321332 - DNA, 48 bp, Artificial Sequence
  Description of Artificial Sequence: Synthetic oligonucleotide
aagagggaaatacttcagtatcagaagggattaaaagggaaatatatc

SEQ ID NO: 321333 - DNA, 47 bp, Artificial Sequence
  Description of Artificial Sequence: Synthetic oligonucleotide
agagggaaatacttcagtatcagaagggattaaaagggaaatatatc

SEQ ID NO: 321334 - DNA, 46 bp, Artificial Sequence
  Description of Artificial Sequence: Synthetic oligonucleotide
gagggaaatacttcagtatcagaagggattaaaagggaaatatatc

SEQ ID NO: 321335 - DNA, 47 bp, Artificial Sequence
  Description of Artificial Sequence: Synthetic oligonucleotide
agggaaatacttcagtatcagaagggattaaaagggaaatatatcac

SEQ ID NO: 321336 - DNA, 46 bp, Artificial Sequence
  Description of Artificial Sequence: Synthetic oligonucleotide
gggaaatacttcagtatcagaagggattaaaagggaaatatatcac

SEQ ID NO: 321337 - DNA, 46 bp, Artificial Sequence
  Description of Artificial Sequence: Synthetic oligonucleotide
ggaaatacttcagtatcagaagggattaaaagggaaatatatcacc

SEQ ID NO: 321338 - DNA, 46 bp, Artificial Sequence
  Description of Artificial Sequence: Synthetic oligonucleotide
gaaatacttcagtatcagaagggattaaaagggaaatatatcaccc

SEQ ID NO: 321339 - DNA, 46 bp, Artificial Sequence
  Description of Artificial Sequence: Synthetic oligonucleotide
aaatacttcagtatcagaagggattaaaagggaaatatatcacccg

SEQ ID NO: 321340 - DNA, 45 bp, Artificial Sequence
  Description of Artificial Sequence: Synthetic oligonucleotide
aatacttcagtatcagaagggattaaaagggaaatatatcacccg

SEQ ID NO: 321341 - DNA, 44 bp, Artificial Sequence
  Description of Artificial Sequence: Synthetic oligonucleotide
atacttcagtatcagaagggattaaaagggaaatatatcacccg

SEQ ID NO: 321342 - DNA, 43 bp, Artificial Sequence
  Description of Artificial Sequence: Synthetic oligonucleotide
tacttcagtatcagaagggattaaaagggaaatatatcacccg

SEQ ID NO: 321343 - DNA, 42 bp, Artificial Sequence
  Description of Artificial Sequence: Synthetic oligonucleotide
acttcagtatcagaagggattaaaagggaaatatatcacccg

SEQ ID NO: 321344 - DNA, 41 bp, Artificial Sequence
  Description of Artificial Sequence: Synthetic oligonucleotide
cttcagtatcagaagggattaaaagggaaatatatcacccg

SEQ ID NO: 321345 - DNA, 41 bp, Artificial Sequence
  Description of Artificial Sequence: Synthetic oligonucleotide
ttcagtatcagaagggattaaaagggaaatatatcacccgc

SEQ ID NO: 321346 - DNA, 40 bp, Artificial Sequence
  Description of Artificial Sequence: Synthetic oligonucleotide
tcagtatcagaagggattaaaagggaaatatatcacccgc

SEQ ID NO: 321347 - DNA, 39 bp, Artificial Sequence
  Description of Artificial Sequence: Synthetic oligonucleotide
cagtatcagaagggattaaaagggaaatatatcacccgc

SEQ ID NO: 321348 - DNA, 39 bp, Artificial Sequence
  Description of Artificial Sequence: Synthetic oligonucleotide
agtatcagaagggattaaaagggaaatatatcacccgcg

SEQ ID NO: 321349 - DNA, 38 bp, Artificial Sequence
  Description of Artificial Sequence: Synthetic oligonucleotide
gtatcagaagggattaaaagggaaatatatcacccgcg

SEQ ID NO: 321350 - DNA, 38 bp, Artificial Sequence
  Description of Artificial Sequence: Synthetic oligonucleotide
tatcagaagggattaaaagggaaatatatcacccgcgg

SEQ ID NO: 321351 - DNA, 37 bp, Artificial Sequence
  Description of Artificial Sequence: Synthetic oligonucleotide
atcagaagggattaaaagggaaatatatcacccgcgg

SEQ ID NO: 321352 - DNA, 36 bp, Artificial Sequence
  Description of Artificial Sequence: Synthetic oligonucleotide
tcagaagggattaaaagggaaatatatcacccgcgg

SEQ ID NO: 321353 - DNA, 35 bp, Artificial Sequence
  Description of Artificial Sequence: Synthetic oligonucleotide
cagaagggattaaaagggaaatatatcacccgcgg

SEQ ID NO: 321354 - DNA, 36 bp, Artificial Sequence
  Description of Artificial Sequence: Synthetic oligonucleotide
agaagggattaaaagggaaatatatcacccgcggag

SEQ ID NO: 321355 - DNA, 35 bp, Artificial Sequence
  Description of Artificial Sequence: Synthetic oligonucleotide
gaagggattaaaagggaaatatatcacccgcggag

SEQ ID NO: 321356 - DNA, 36 bp, Artificial Sequence
  Description of Artificial Sequence: Synthetic oligonucleotide
aagggattaaaagggaaatatatcacccgcggagtg

SEQ ID NO: 321357 - DNA, 35 bp, Artificial Sequence
  Description of Artificial Sequence: Synthetic oligonucleotide
agggattaaaagggaaatatatcacccgcggagtg

SEQ ID NO: 321358 - DNA, 34 bp, Artificial Sequence
  Description of Artificial Sequence: Synthetic oligonucleotide
gggattaaaagggaaatatatcacccgcggagtg

SEQ ID NO: 321359 - DNA, 34 bp, Artificial Sequence
  Description of Artificial Sequence: Synthetic oligonucleotide
ggattaaaagggaaatatatcacccgcggagtgc

SEQ ID NO: 321360 - DNA, 35 bp, Artificial Sequence
  Description of Artificial Sequence: Synthetic oligonucleotide
gattaaaagggaaatatatcacccgcggagtgctc

SEQ ID NO: 321361 - DNA, 35 bp, Artificial Sequence
  Description of Artificial Sequence: Synthetic oligonucleotide
attaaaagggaaatatatcacccgcggagtgctcc

SEQ ID NO: 321362 - DNA, 34 bp, Artificial Sequence
  Description of Artificial Sequence: Synthetic oligonucleotide
ttaaaagggaaatatatcacccgcggagtgctcc

SEQ ID NO: 321363 - DNA, 33 bp, Artificial Sequence
  Description of Artificial Sequence: Synthetic oligonucleotide
taaaagggaaatatatcacccgcggagtgctcc

SEQ ID NO: 321364 - DNA, 32 bp, Artificial Sequence
  Description of Artificial Sequence: Synthetic oligonucleotide
aaaagggaaatatatcacccgcggagtgctcc

SEQ ID NO: 321365 - DNA, 31 bp, Artificial Sequence
  Description of Artificial Sequence: Synthetic oligonucleotide
aaagggaaatatatcacccgcggagtgctcc

SEQ ID NO: 321366 - DNA, 30 bp, Artificial Sequence
  Description of Artificial Sequence: Synthetic oligonucleotide
aagggaaatatatcacccgcggagtgctcc

SEQ ID NO: 321367 - DNA, 29 bp, Artificial Sequence
  Description of Artificial Sequence: Synthetic oligonucleotide
agggaaatatatcacccgcggagtgctcc

SEQ ID NO: 321368 - DNA, 28 bp, Artificial Sequence
  Description of Artificial Sequence: Synthetic oligonucleotide
gggaaatatatcacccgcggagtgctcc

SEQ ID NO: 321369 - DNA, 28 bp, Artificial Sequence
  Description of Artificial Sequence: Synthetic oligonucleotide
ggaaatatatcacccgcggagtgctccc

SEQ ID NO: 321370 - DNA, 29 bp, Artificial Sequence
  Description of Artificial Sequence: Synthetic oligonucleotide
gaaatatatcacccgcggagtgctccctc

SEQ ID NO: 321371 - DNA, 29 bp, Artificial Sequence
  Description of Artificial Sequence: Synthetic oligonucleotide
aaatatatcacccgcggagtgctccctcc

SEQ ID NO: 321372 - DNA, 28 bp, Artificial Sequence
  Description of Artificial Sequence: Synthetic oligonucleotide
aatatatcacccgcggagtgctccctcc

SEQ ID NO: 321373 - DNA, 27 bp, Artificial Sequence
  Description of Artificial Sequence: Synthetic oligonucleotide
atatatcacccgcggagtgctccctcc

SEQ ID NO: 321374 - DNA, 27 bp, Artificial Sequence
  Description of Artificial Sequence: Synthetic oligonucleotide
tatatcacccgcggagtgctccctcct

SEQ ID NO: 321375 - DNA, 26 bp, Artificial Sequence
  Description of Artificial Sequence: Synthetic oligonucleotide
atatcacccgcggagtgctccctcct

SEQ ID NO: 321376 - DNA, 25 bp, Artificial Sequence
  Description of Artificial Sequence: Synthetic oligonucleotide
tatcacccgcggagtgctccctcct

SEQ ID NO: 321377 - DNA, 24 bp, Artificial Sequence
  Description of Artificial Sequence: Synthetic oligonucleotide
atcacccgcggagtgctccctcct

SEQ ID NO: 321378 - DNA, 23 bp, Artificial Sequence
  Description of Artificial Sequence: Synthetic oligonucleotide
tcacccgcggagtgctccctcct

SEQ ID NO: 321379 - DNA, 22 bp, Artificial Sequence
  Description of Artificial Sequence: Synthetic oligonucleotide
cacccgcggagtgctccctcct

SEQ ID NO: 321380 - DNA, 23 bp, Artificial Sequence
  Description of Artificial Sequence: Synthetic oligonucleotide
acccgcggagtgctccctcctga

SEQ ID NO: 321381 - DNA, 22 bp, Artificial Sequence
  Description of Artificial Sequence: Synthetic oligonucleotide
cccgcggagtgctccctcctga

SEQ ID NO: 321382 - DNA, 22 bp, Artificial Sequence
  Description of Artificial Sequence: Synthetic oligonucleotide
ccgcggagtgctccctcctgac

SEQ ID NO: 321383 - DNA, 23 bp, Artificial Sequence
  Description of Artificial Sequence: Synthetic oligonucleotide
cgcggagtgctccctcctgacga

SEQ ID NO: 321384 - DNA, 23 bp, Artificial Sequence
  Description of Artificial Sequence: Synthetic oligonucleotide
gcggagtgctccctcctgacgac

SEQ ID NO: 321385 - DNA, 23 bp, Artificial Sequence
  Description of Artificial Sequence: Synthetic oligonucleotide
cggagtgctccctcctgacgacg

SEQ ID NO: 321386 - DNA, 24 bp, Artificial Sequence
  Description of Artificial Sequence: Synthetic oligonucleotide
ggagtgctccctcctgacgacgct

SEQ ID NO: 321387 - DNA, 26 bp, Artificial Sequence
  Description of Artificial Sequence: Synthetic oligonucleotide
gagtgctccctcctgacgacgctgtt

SEQ ID NO: 321388 - DNA, 26 bp, Artificial Sequence
  Description of Artificial Sequence: Synthetic oligonucleotide
agtgctccctcctgacgacgctgttg

SEQ ID NO: 321389 - DNA, 25 bp, Artificial Sequence
  Description of Artificial Sequence: Synthetic oligonucleotide
gtgctccctcctgacgacgctgttg

SEQ ID NO: 321390 - DNA, 26 bp, Artificial Sequence
  Description of Artificial Sequence: Synthetic oligonucleotide
tgctccctcctgacgacgctgttgca

SEQ ID NO: 321391 - DNA, 25 bp, Artificial Sequence
  Description of Artificial Sequence: Synthetic oligonucleotide
gctccctcctgacgacgctgttgca

SEQ ID NO: 321392 - DNA, 25 bp, Artificial Sequence
  Description of Artificial Sequence: Synthetic oligonucleotide
ctccctcctgacgacgctgttgcac

SEQ ID NO: 321393 - DNA, 25 bp, Artificial Sequence
  Description of Artificial Sequence: Synthetic oligonucleotide
tccctcctgacgacgctgttgcacg

SEQ ID NO: 321394 - DNA, 24 bp, Artificial Sequence
  Description of Artificial Sequence: Synthetic oligonucleotide
ccctcctgacgacgctgttgcacg

SEQ ID NO: 321395 - DNA, 25 bp, Artificial Sequence
  Description of Artificial Sequence: Synthetic oligonucleotide
cctcctgacgacgctgttgcacgga

SEQ ID NO: 321396 - DNA, 27 bp, Artificial Sequence
  Description of Artificial Sequence: Synthetic oligonucleotide
ctcctgacgacgctgttgcacggacta

SEQ ID NO: 321397 - DNA, 31 bp, Artificial Sequence
  Description of Artificial Sequence: Synthetic oligonucleotide
tcctgacgacgctgttgcacggactaattac

SEQ ID NO: 321398 - DNA, 30 bp, Artificial Sequence
  Description of Artificial Sequence: Synthetic oligonucleotide
cctgacgacgctgttgcacggactaattac

SEQ ID NO: 321399 - DNA, 30 bp, Artificial Sequence
  Description of Artificial Sequence: Synthetic oligonucleotide
ctgacgacgctgttgcacggactaattacg

SEQ ID NO: 321400 - DNA, 31 bp, Artificial Sequence
  Description of Artificial Sequence: Synthetic oligonucleotide
tgacgacgctgttgcacggactaattacgtc

SEQ ID NO: 321401 - DNA, 30 bp, Artificial Sequence
  Description of Artificial Sequence: Synthetic oligonucleotide
gacgacgctgttgcacggactaattacgtc

SEQ ID NO: 321402 - DNA, 30 bp, Artificial Sequence
  Description of Artificial Sequence: Synthetic oligonucleotide
acgacgctgttgcacggactaattacgtcc

SEQ ID NO: 321403 - DNA, 29 bp, Artificial Sequence
  Description of Artificial Sequence: Synthetic oligonucleotide
cgacgctgttgcacggactaattacgtcc

SEQ ID NO: 321404 - DNA, 30 bp, Artificial Sequence
  Description of Artificial Sequence: Synthetic oligonucleotide
gacgctgttgcacggactaattacgtccac

SEQ ID NO: 321405 - DNA, 30 bp, Artificial Sequence
  Description of Artificial Sequence: Synthetic oligonucleotide
acgctgttgcacggactaattacgtccacg

SEQ ID NO: 321406 - DNA, 29 bp, Artificial Sequence
  Description of Artificial Sequence: Synthetic oligonucleotide
cgctgttgcacggactaattacgtccacg

SEQ ID NO: 321407 - DNA, 31 bp, Artificial Sequence
  Description of Artificial Sequence: Synthetic oligonucleotide
gctgttgcacggactaattacgtccacgaag

SEQ ID NO: 321408 - DNA, 33 bp, Artificial Sequence
  Description of Artificial Sequence: Synthetic oligonucleotide
ctgttgcacggactaattacgtccacgaagaac

SEQ ID NO: 321409 - DNA, 34 bp, Artificial Sequence
  Description of Artificial Sequence: Synthetic oligonucleotide
tgttgcacggactaattacgtccacgaagaactg

SEQ ID NO: 321410 - DNA, 33 bp, Artificial Sequence
  Description of Artificial Sequence: Synthetic oligonucleotide
gttgcacggactaattacgtccacgaagaactg

SEQ ID NO: 321411 - DNA, 38 bp, Artificial Sequence
  Description of Artificial Sequence: Synthetic oligonucleotide
ttgcacggactaattacgtccacgaagaactgtaaaac

SEQ ID NO: 321412 - DNA, 37 bp, Artificial Sequence
  Description of Artificial Sequence: Synthetic oligonucleotide
tgcacggactaattacgtccacgaagaactgtaaaac

SEQ ID NO: 321413 - DNA, 36 bp, Artificial Sequence
  Description of Artificial Sequence: Synthetic oligonucleotide
gcacggactaattacgtccacgaagaactgtaaaac

SEQ ID NO: 321414 - DNA, 36 bp, Artificial Sequence
  Description of Artificial Sequence: Synthetic oligonucleotide
cacggactaattacgtccacgaagaactgtaaaacc

SEQ ID NO: 321415 - DNA, 37 bp, Artificial Sequence
  Description of Artificial Sequence: Synthetic oligonucleotide
acggactaattacgtccacgaagaactgtaaaaccac

SEQ ID NO: 321416 - DNA, 36 bp, Artificial Sequence
  Description of Artificial Sequence: Synthetic oligonucleotide
cggactaattacgtccacgaagaactgtaaaaccac

SEQ ID NO: 321417 - DNA, 43 bp, Artificial Sequence
  Description of Artificial Sequence: Synthetic oligonucleotide
ggactaattacgtccacgaagaactgtaaaaccacaataattc

SEQ ID NO: 321418 - DNA, 43 bp, Artificial Sequence
  Description of Artificial Sequence: Synthetic oligonucleotide
gactaattacgtccacgaagaactgtaaaaccacaataattcc

SEQ ID NO: 321419 - DNA, 45 bp, Artificial Sequence
  Description of Artificial Sequence: Synthetic oligonucleotide
actaattacgtccacgaagaactgtaaaaccacaataattcctac

SEQ ID NO: 321420 - DNA, 44 bp, Artificial Sequence
  Description of Artificial Sequence: Synthetic oligonucleotide
ctaattacgtccacgaagaactgtaaaaccacaataattcctac

SEQ ID NO: 321421 - DNA, 44 bp, Artificial Sequence
  Description of Artificial Sequence: Synthetic oligonucleotide
taattacgtccacgaagaactgtaaaaccacaataattcctacc

SEQ ID NO: 321422 - DNA, 43 bp, Artificial Sequence
  Description of Artificial Sequence: Synthetic oligonucleotide
aattacgtccacgaagaactgtaaaaccacaataattcctacc

SEQ ID NO: 321423 - DNA, 42 bp, Artificial Sequence
  Description of Artificial Sequence: Synthetic oligonucleotide
attacgtccacgaagaactgtaaaaccacaataattcctacc

SEQ ID NO: 321424 - DNA, 41 bp, Artificial Sequence
  Description of Artificial Sequence: Synthetic oligonucleotide
ttacgtccacgaagaactgtaaaaccacaataattcctacc

SEQ ID NO: 321425 - DNA, 40 bp, Artificial Sequence
  Description of Artificial Sequence: Synthetic oligonucleotide
tacgtccacgaagaactgtaaaaccacaataattcctacc

SEQ ID NO: 321426 - DNA, 39 bp, Artificial Sequence
  Description of Artificial Sequence: Synthetic oligonucleotide
acgtccacgaagaactgtaaaaccacaataattcctacc

SEQ ID NO: 321427 - DNA, 38 bp, Artificial Sequence
  Description of Artificial Sequence: Synthetic oligonucleotide
cgtccacgaagaactgtaaaaccacaataattcctacc

SEQ ID NO: 321428 - DNA, 39 bp, Artificial Sequence
  Description of Artificial Sequence: Synthetic oligonucleotide
gtccacgaagaactgtaaaaccacaataattcctacctg

SEQ ID NO: 321429 - DNA, 46 bp, Artificial Sequence
  Description of Artificial Sequence: Synthetic oligonucleotide
tccacgaagaactgtaaaaccacaataattcctacctgattaaaag

SEQ ID NO: 321430 - DNA, 45 bp, Artificial Sequence
  Description of Artificial Sequence: Synthetic oligonucleotide
ccacgaagaactgtaaaaccacaataattcctacctgattaaaag

SEQ ID NO: 321431 - DNA, 47 bp, Artificial Sequence
  Description of Artificial Sequence: Synthetic oligonucleotide
cacgaagaactgtaaaaccacaataattcctacctgattaaaagaac

SEQ ID NO: 321432 - DNA, 58 bp, Artificial Sequence
  Description of Artificial Sequence: Synthetic oligonucleotide
acgaagaactgtaaaaccacaataattcctacctgattaaaagaacaaaatttaaaac

SEQ ID NO: 321433 - DNA, 57 bp, Artificial Sequence
  Description of Artificial Sequence: Synthetic oligonucleotide
cgaagaactgtaaaaccacaataattcctacctgattaaaagaacaaaatttaaaac

SEQ ID NO: 321434 - DNA, 58 bp, Artificial Sequence
  Description of Artificial Sequence: Synthetic oligonucleotide
gaagaactgtaaaaccacaataattcctacctgattaaaagaacaaaatttaaaactc

SEQ ID NO: 321435 - DNA, 58 bp, Artificial Sequence
  Description of Artificial Sequence: Synthetic oligonucleotide
aagaactgtaaaaccacaataattcctacctgattaaaagaacaaaatttaaaactcc

SEQ ID NO: 321436 - DNA, 57 bp, Artificial Sequence
  Description of Artificial Sequence: Synthetic oligonucleotide
agaactgtaaaaccacaataattcctacctgattaaaagaacaaaatttaaaactcc

SEQ ID NO: 321437 - DNA, 56 bp, Artificial Sequence
  Description of Artificial Sequence: Synthetic oligonucleotide
gaactgtaaaaccacaataattcctacctgattaaaagaacaaaatttaaaactcc

SEQ ID NO: 321438 - DNA, 57 bp, Artificial Sequence
  Description of Artificial Sequence: Synthetic oligonucleotide
aactgtaaaaccacaataattcctacctgattaaaagaacaaaatttaaaactcctg

SEQ ID NO: 321439 - DNA, 56 bp, Artificial Sequence
  Description of Artificial Sequence: Synthetic oligonucleotide
actgtaaaaccacaataattcctacctgattaaaagaacaaaatttaaaactcctg

SEQ ID NO: 321440 - DNA, 55 bp, Artificial Sequence
  Description of Artificial Sequence: Synthetic oligonucleotide
ctgtaaaaccacaataattcctacctgattaaaagaacaaaatttaaaactcctg

SEQ ID NO: 321441 - DNA, 55 bp, Artificial Sequence
  Description of Artificial Sequence: Synthetic oligonucleotide
tgtaaaaccacaataattcctacctgattaaaagaacaaaatttaaaactcctgc

SEQ ID NO: 321442 - DNA, 54 bp, Artificial Sequence
  Description of Artificial Sequence: Synthetic oligonucleotide
gtaaaaccacaataattcctacctgattaaaagaacaaaatttaaaactcctgc

SEQ ID NO: 321443 - DNA, 55 bp, Artificial Sequence
  Description of Artificial Sequence: Synthetic oligonucleotide
taaaaccacaataattcctacctgattaaaagaacaaaatttaaaactcctgctc

SEQ ID NO: 321444 - DNA, 54 bp, Artificial Sequence
  Description of Artificial Sequence: Synthetic oligonucleotide
aaaaccacaataattcctacctgattaaaagaacaaaatttaaaactcctgctc

SEQ ID NO: 321445 - DNA, 53 bp, Artificial Sequence
  Description of Artificial Sequence: Synthetic oligonucleotide
aaaccacaataattcctacctgattaaaagaacaaaatttaaaactcctgctc

SEQ ID NO: 321446 - DNA, 52 bp, Artificial Sequence
  Description of Artificial Sequence: Synthetic oligonucleotide
aaccacaataattcctacctgattaaaagaacaaaatttaaaactcctgctc

SEQ ID NO: 321447 - DNA, 51 bp, Artificial Sequence
  Description of Artificial Sequence: Synthetic oligonucleotide
accacaataattcctacctgattaaaagaacaaaatttaaaactcctgctc

SEQ ID NO: 321448 - DNA, 50 bp, Artificial Sequence
  Description of Artificial Sequence: Synthetic oligonucleotide
ccacaataattcctacctgattaaaagaacaaaatttaaaactcctgctc

SEQ ID NO: 321449 - DNA, 50 bp, Artificial Sequence
  Description of Artificial Sequence: Synthetic oligonucleotide
cacaataattcctacctgattaaaagaacaaaatttaaaactcctgctcc

SEQ ID NO: 321450 - DNA, 51 bp, Artificial Sequence
  Description of Artificial Sequence: Synthetic oligonucleotide
acaataattcctacctgattaaaagaacaaaatttaaaactcctgctcctc

SEQ ID NO: 321451 - DNA, 50 bp, Artificial Sequence
  Description of Artificial Sequence: Synthetic oligonucleotide
caataattcctacctgattaaaagaacaaaatttaaaactcctgctcctc

SEQ ID NO: 321452 - DNA, 52 bp, Artificial Sequence
  Description of Artificial Sequence: Synthetic oligonucleotide
aataattcctacctgattaaaagaacaaaatttaaaactcctgctcctcatg

SEQ ID NO: 321453 - DNA, 51 bp, Artificial Sequence
  Description of Artificial Sequence: Synthetic oligonucleotide
ataattcctacctgattaaaagaacaaaatttaaaactcctgctcctcatg

SEQ ID NO: 321454 - DNA, 50 bp, Artificial Sequence
  Description of Artificial Sequence: Synthetic oligonucleotide
taattcctacctgattaaaagaacaaaatttaaaactcctgctcctcatg

SEQ ID NO: 321455 - DNA, 49 bp, Artificial Sequence
  Description of Artificial Sequence: Synthetic oligonucleotide
aattcctacctgattaaaagaacaaaatttaaaactcctgctcctcatg

SEQ ID NO: 321456 - DNA, 48 bp, Artificial Sequence
  Description of Artificial Sequence: Synthetic oligonucleotide
attcctacctgattaaaagaacaaaatttaaaactcctgctcctcatg

SEQ ID NO: 321457 - DNA, 47 bp, Artificial Sequence
  Description of Artificial Sequence: Synthetic oligonucleotide
ttcctacctgattaaaagaacaaaatttaaaactcctgctcctcatg

SEQ ID NO: 321458 - DNA, 46 bp, Artificial Sequence
  Description of Artificial Sequence: Synthetic oligonucleotide
tcctacctgattaaaagaacaaaatttaaaactcctgctcctcatg

SEQ ID NO: 321459 - DNA, 45 bp, Artificial Sequence
  Description of Artificial Sequence: Synthetic oligonucleotide
cctacctgattaaaagaacaaaatttaaaactcctgctcctcatg

SEQ ID NO: 321460 - DNA, 46 bp, Artificial Sequence
  Description of Artificial Sequence: Synthetic oligonucleotide
ctacctgattaaaagaacaaaatttaaaactcctgctcctcatgtc

SEQ ID NO: 321461 - DNA, 48 bp, Artificial Sequence
  Description of Artificial Sequence: Synthetic oligonucleotide
tacctgattaaaagaacaaaatttaaaactcctgctcctcatgtcatg

SEQ ID NO: 321462 - DNA, 47 bp, Artificial Sequence
  Description of Artificial Sequence: Synthetic oligonucleotide
acctgattaaaagaacaaaatttaaaactcctgctcctcatgtcatg

SEQ ID NO: 321463 - DNA, 46 bp, Artificial Sequence
  Description of Artificial Sequence: Synthetic oligonucleotide
cctgattaaaagaacaaaatttaaaactcctgctcctcatgtcatg

SEQ ID NO: 321464 - DNA, 46 bp, Artificial Sequence
  Description of Artificial Sequence: Synthetic oligonucleotide
ctgattaaaagaacaaaatttaaaactcctgctcctcatgtcatgg

SEQ ID NO: 321465 - DNA, 47 bp, Artificial Sequence
  Description of Artificial Sequence: Synthetic oligonucleotide
tgattaaaagaacaaaatttaaaactcctgctcctcatgtcatggtg

SEQ ID NO: 321466 - DNA, 46 bp, Artificial Sequence
  Description of Artificial Sequence: Synthetic oligonucleotide
gattaaaagaacaaaatttaaaactcctgctcctcatgtcatggtg

SEQ ID NO: 321467 - DNA, 51 bp, Artificial Sequence
  Description of Artificial Sequence: Synthetic oligonucleotide
attaaaagaacaaaatttaaaactcctgctcctcatgtcatggtgatatac

SEQ ID NO: 321468 - DNA, 50 bp, Artificial Sequence
  Description of Artificial Sequence: Synthetic oligonucleotide
ttaaaagaacaaaatttaaaactcctgctcctcatgtcatggtgatatac

SEQ ID NO: 321469 - DNA, 49 bp, Artificial Sequence
  Description of Artificial Sequence: Synthetic oligonucleotide
taaaagaacaaaatttaaaactcctgctcctcatgtcatggtgatatac

SEQ ID NO: 321470 - DNA, 48 bp, Artificial Sequence
  Description of Artificial Sequence: Synthetic oligonucleotide
aaaagaacaaaatttaaaactcctgctcctcatgtcatggtgatatac

SEQ ID NO: 321471 - DNA, 47 bp, Artificial Sequence
  Description of Artificial Sequence: Synthetic oligonucleotide
aaagaacaaaatttaaaactcctgctcctcatgtcatggtgatatac

SEQ ID NO: 321472 - DNA, 46 bp, Artificial Sequence
  Description of Artificial Sequence: Synthetic oligonucleotide
aagaacaaaatttaaaactcctgctcctcatgtcatggtgatatac

SEQ ID NO: 321473 - DNA, 45 bp, Artificial Sequence
  Description of Artificial Sequence: Synthetic oligonucleotide
agaacaaaatttaaaactcctgctcctcatgtcatggtgatatac

SEQ ID NO: 321474 - DNA, 44 bp, Artificial Sequence
  Description of Artificial Sequence: Synthetic oligonucleotide
gaacaaaatttaaaactcctgctcctcatgtcatggtgatatac

SEQ ID NO: 321475 - DNA, 47 bp, Artificial Sequence
  Description of Artificial Sequence: Synthetic oligonucleotide
aacaaaatttaaaactcctgctcctcatgtcatggtgatatactttg

SEQ ID NO: 321476 - DNA, 46 bp, Artificial Sequence
  Description of Artificial Sequence: Synthetic oligonucleotide
acaaaatttaaaactcctgctcctcatgtcatggtgatatactttg

SEQ ID NO: 321477 - DNA, 45 bp, Artificial Sequence
  Description of Artificial Sequence: Synthetic oligonucleotide
caaaatttaaaactcctgctcctcatgtcatggtgatatactttg

SEQ ID NO: 321478 - DNA, 45 bp, Artificial Sequence
  Description of Artificial Sequence: Synthetic oligonucleotide
aaaatttaaaactcctgctcctcatgtcatggtgatatactttgg

SEQ ID NO: 321479 - DNA, 44 bp, Artificial Sequence
  Description of Artificial Sequence: Synthetic oligonucleotide
aaatttaaaactcctgctcctcatgtcatggtgatatactttgg

SEQ ID NO: 321480 - DNA, 43 bp, Artificial Sequence
  Description of Artificial Sequence: Synthetic oligonucleotide
aatttaaaactcctgctcctcatgtcatggtgatatactttgg

SEQ ID NO: 321481 - DNA, 42 bp, Artificial Sequence
  Description of Artificial Sequence: Synthetic oligonucleotide
atttaaaactcctgctcctcatgtcatggtgatatactttgg

SEQ ID NO: 321482 - DNA, 41 bp, Artificial Sequence
  Description of Artificial Sequence: Synthetic oligonucleotide
tttaaaactcctgctcctcatgtcatggtgatatactttgg

SEQ ID NO: 321483 - DNA, 40 bp, Artificial Sequence
  Description of Artificial Sequence: Synthetic oligonucleotide
ttaaaactcctgctcctcatgtcatggtgatatactttgg

SEQ ID NO: 321484 - DNA, 39 bp, Artificial Sequence
  Description of Artificial Sequence: Synthetic oligonucleotide
taaaactcctgctcctcatgtcatggtgatatactttgg

SEQ ID NO: 321485 - DNA, 38 bp, Artificial Sequence
  Description of Artificial Sequence: Synthetic oligonucleotide
aaaactcctgctcctcatgtcatggtgatatactttgg

SEQ ID NO: 321486 - DNA, 37 bp, Artificial Sequence
  Description of Artificial Sequence: Synthetic oligonucleotide
aaactcctgctcctcatgtcatggtgatatactttgg

SEQ ID NO: 321487 - DNA, 36 bp, Artificial Sequence
  Description of Artificial Sequence: Synthetic oligonucleotide
aactcctgctcctcatgtcatggtgatatactttgg

SEQ ID NO: 321488 - DNA, 35 bp, Artificial Sequence
  Description of Artificial Sequence: Synthetic oligonucleotide
actcctgctcctcatgtcatggtgatatactttgg

SEQ ID NO: 321489 - DNA, 34 bp, Artificial Sequence
  Description of Artificial Sequence: Synthetic oligonucleotide
ctcctgctcctcatgtcatggtgatatactttgg

SEQ ID NO: 321490 - DNA, 34 bp, Artificial Sequence
  Description of Artificial Sequence: Synthetic oligonucleotide
tcctgctcctcatgtcatggtgatatactttggc

SEQ ID NO: 321491 - DNA, 33 bp, Artificial Sequence
  Description of Artificial Sequence: Synthetic oligonucleotide
cctgctcctcatgtcatggtgatatactttggc

SEQ ID NO: 321492 - DNA, 34 bp, Artificial Sequence
  Description of Artificial Sequence: Synthetic oligonucleotide
ctgctcctcatgtcatggtgatatactttggctc

SEQ ID NO: 321493 - DNA, 34 bp, Artificial Sequence
  Description of Artificial Sequence: Synthetic oligonucleotide
tgctcctcatgtcatggtgatatactttggctcg

SEQ ID NO: 321494 - DNA, 33 bp, Artificial Sequence
  Description of Artificial Sequence: Synthetic oligonucleotide
gctcctcatgtcatggtgatatactttggctcg

SEQ ID NO: 321495 - DNA, 33 bp, Artificial Sequence
  Description of Artificial Sequence: Synthetic oligonucleotide
ctcctcatgtcatggtgatatactttggctcgg

SEQ ID NO: 321496 - DNA, 33 bp, Artificial Sequence
  Description of Artificial Sequence: Synthetic oligonucleotide
tcctcatgtcatggtgatatactttggctcggc

SEQ ID NO: 321497 - DNA, 32 bp, Artificial Sequence
  Description of Artificial Sequence: Synthetic oligonucleotide
cctcatgtcatggtgatatactttggctcggc

SEQ ID NO: 321498 - DNA, 32 bp, Artificial Sequence
  Description of Artificial Sequence: Synthetic oligonucleotide
ctcatgtcatggtgatatactttggctcggcc

SEQ ID NO: 321499 - DNA, 34 bp, Artificial Sequence
  Description of Artificial Sequence: Synthetic oligonucleotide
tcatgtcatggtgatatactttggctcggcctac

SEQ ID NO: 321500 - DNA, 33 bp, Artificial Sequence
  Description of Artificial Sequence: Synthetic oligonucleotide
catgtcatggtgatatactttggctcggcctac

SEQ ID NO: 321501 - DNA, 33 bp, Artificial Sequence
  Description of Artificial Sequence: Synthetic oligonucleotide
atgtcatggtgatatactttggctcggcctacg

SEQ ID NO: 321502 - DNA, 32 bp, Artificial Sequence
  Description of Artificial Sequence: Synthetic oligonucleotide
tgtcatggtgatatactttggctcggcctacg

SEQ ID NO: 321503 - DNA, 31 bp, Artificial Sequence
  Description of Artificial Sequence: Synthetic oligonucleotide
gtcatggtgatatactttggctcggcctacg

SEQ ID NO: 321504 - DNA, 32 bp, Artificial Sequence
  Description of Artificial Sequence: Synthetic oligonucleotide
tcatggtgatatactttggctcggcctacgag

SEQ ID NO: 321505 - DNA, 31 bp, Artificial Sequence
  Description of Artificial Sequence: Synthetic oligonucleotide
catggtgatatactttggctcggcctacgag

SEQ ID NO: 321506 - DNA, 31 bp, Artificial Sequence
  Description of Artificial Sequence: Synthetic oligonucleotide
atggtgatatactttggctcggcctacgagg

SEQ ID NO: 321507 - DNA, 30 bp, Artificial Sequence
  Description of Artificial Sequence: Synthetic oligonucleotide
tggtgatatactttggctcggcctacgagg

SEQ ID NO: 321508 - DNA, 29 bp, Artificial Sequence
  Description of Artificial Sequence: Synthetic oligonucleotide
ggtgatatactttggctcggcctacgagg

SEQ ID NO: 321509 - DNA, 29 bp, Artificial Sequence
  Description of Artificial Sequence: Synthetic oligonucleotide
gtgatatactttggctcggcctacgaggc

SEQ ID NO: 321510 - DNA, 30 bp, Artificial Sequence
  Description of Artificial Sequence: Synthetic oligonucleotide
tgatatactttggctcggcctacgaggctc

SEQ ID NO: 321511 - DNA, 29 bp, Artificial Sequence
  Description of Artificial Sequence: Synthetic oligonucleotide
gatatactttggctcggcctacgaggctc

SEQ ID NO: 321512 - DNA, 30 bp, Artificial Sequence
  Description of Artificial Sequence: Synthetic oligonucleotide
atatactttggctcggcctacgaggctctc

SEQ ID NO: 321513 - DNA, 29 bp, Artificial Sequence
  Description of Artificial Sequence: Synthetic oligonucleotide
tatactttggctcggcctacgaggctctc

SEQ ID NO: 321514 - DNA, 28 bp, Artificial Sequence
  Description of Artificial Sequence: Synthetic oligonucleotide
atactttggctcggcctacgaggctctc

SEQ ID NO: 321515 - DNA, 27 bp, Artificial Sequence
  Description of Artificial Sequence: Synthetic oligonucleotide
tactttggctcggcctacgaggctctc

SEQ ID NO: 321516 - DNA, 27 bp, Artificial Sequence
  Description of Artificial Sequence: Synthetic oligonucleotide
actttggctcggcctacgaggctctca

SEQ ID NO: 321517 - DNA, 26 bp, Artificial Sequence
  Description of Artificial Sequence: Synthetic oligonucleotide
ctttggctcggcctacgaggctctca

SEQ ID NO: 321518 - DNA, 27 bp, Artificial Sequence
  Description of Artificial Sequence: Synthetic oligonucleotide
tttggctcggcctacgaggctctcact

SEQ ID NO: 321519 - DNA, 27 bp, Artificial Sequence
  Description of Artificial Sequence: Synthetic oligonucleotide
ttggctcggcctacgaggctctcacta

SEQ ID NO: 321520 - DNA, 26 bp, Artificial Sequence
  Description of Artificial Sequence: Synthetic oligonucleotide
tggctcggcctacgaggctctcacta

SEQ ID NO: 321521 - DNA, 25 bp, Artificial Sequence
  Description of Artificial Sequence: Synthetic oligonucleotide
ggctcggcctacgaggctctcacta

SEQ ID NO: 321522 - DNA, 25 bp, Artificial Sequence
  Description of Artificial Sequence: Synthetic oligonucleotide
gctcggcctacgaggctctcactag

SEQ ID NO: 321523 - DNA, 25 bp, Artificial Sequence
  Description of Artificial Sequence: Synthetic oligonucleotide
ctcggcctacgaggctctcactagg

SEQ ID NO: 321524 - DNA, 26 bp, Artificial Sequence
  Description of Artificial Sequence: Synthetic oligonucleotide
tcggcctacgaggctctcactaggga

SEQ ID NO: 321525 - DNA, 25 bp, Artificial Sequence
  Description of Artificial Sequence: Synthetic oligonucleotide
cggcctacgaggctctcactaggga

SEQ ID NO: 321526 - DNA, 27 bp, Artificial Sequence
  Description of Artificial Sequence: Synthetic oligonucleotide
ggcctacgaggctctcactagggactt

SEQ ID NO: 321527 - DNA, 28 bp, Artificial Sequence
  Description of Artificial Sequence: Synthetic oligonucleotide
gcctacgaggctctcactagggactttc

SEQ ID NO: 321528 - DNA, 28 bp, Artificial Sequence
  Description of Artificial Sequence: Synthetic oligonucleotide
cctacgaggctctcactagggactttcc

SEQ ID NO: 321529 - DNA, 31 bp, Artificial Sequence
  Description of Artificial Sequence: Synthetic oligonucleotide
ctacgaggctctcactagggactttcctaac

SEQ ID NO: 321530 - DNA, 33 bp, Artificial Sequence
  Description of Artificial Sequence: Synthetic oligonucleotide
tacgaggctctcactagggactttcctaacttc

SEQ ID NO: 321531 - DNA, 32 bp, Artificial Sequence
  Description of Artificial Sequence: Synthetic oligonucleotide
acgaggctctcactagggactttcctaacttc

SEQ ID NO: 321532 - DNA, 31 bp, Artificial Sequence
  Description of Artificial Sequence: Synthetic oligonucleotide
cgaggctctcactagggactttcctaacttc

SEQ ID NO: 321533 - DNA, 31 bp, Artificial Sequence
  Description of Artificial Sequence: Synthetic oligonucleotide
gaggctctcactagggactttcctaacttcg

SEQ ID NO: 321534 - DNA, 32 bp, Artificial Sequence
  Description of Artificial Sequence: Synthetic oligonucleotide
aggctctcactagggactttcctaacttcgac

SEQ ID NO: 321535 - DNA, 31 bp, Artificial Sequence
  Description of Artificial Sequence: Synthetic oligonucleotide
ggctctcactagggactttcctaacttcgac

SEQ ID NO: 321536 - DNA, 31 bp, Artificial Sequence
  Description of Artificial Sequence: Synthetic oligonucleotide
gctctcactagggactttcctaacttcgacc

SEQ ID NO: 321537 - DNA, 32 bp, Artificial Sequence
  Description of Artificial Sequence: Synthetic oligonucleotide
ctctcactagggactttcctaacttcgacctc

SEQ ID NO: 321538 - DNA, 32 bp, Artificial Sequence
  Description of Artificial Sequence: Synthetic oligonucleotide
tctcactagggactttcctaacttcgacctcc

SEQ ID NO: 321539 - DNA, 31 bp, Artificial Sequence
  Description of Artificial Sequence: Synthetic oligonucleotide
ctcactagggactttcctaacttcgacctcc

SEQ ID NO: 321540 - DNA, 33 bp, Artificial Sequence
  Description of Artificial Sequence: Synthetic oligonucleotide
tcactagggactttcctaacttcgacctccaag

SEQ ID NO: 321541 - DNA, 32 bp, Artificial Sequence
  Description of Artificial Sequence: Synthetic oligonucleotide
cactagggactttcctaacttcgacctccaag

SEQ ID NO: 321542 - DNA, 33 bp, Artificial Sequence
  Description of Artificial Sequence: Synthetic oligonucleotide
actagggactttcctaacttcgacctccaagag

SEQ ID NO: 321543 - DNA, 32 bp, Artificial Sequence
  Description of Artificial Sequence: Synthetic oligonucleotide
ctagggactttcctaacttcgacctccaagag

SEQ ID NO: 321544 - DNA, 32 bp, Artificial Sequence
  Description of Artificial Sequence: Synthetic oligonucleotide
tagggactttcctaacttcgacctccaagagc

SEQ ID NO: 321545 - DNA, 31 bp, Artificial Sequence
  Description of Artificial Sequence: Synthetic oligonucleotide
agggactttcctaacttcgacctccaagagc

SEQ ID NO: 321546 - DNA, 30 bp, Artificial Sequence
  Description of Artificial Sequence: Synthetic oligonucleotide
gggactttcctaacttcgacctccaagagc

SEQ ID NO: 321547 - DNA, 31 bp, Artificial Sequence
  Description of Artificial Sequence: Synthetic oligonucleotide
ggactttcctaacttcgacctccaagagcag

SEQ ID NO: 321548 - DNA, 31 bp, Artificial Sequence
  Description of Artificial Sequence: Synthetic oligonucleotide
gactttcctaacttcgacctccaagagcagc

SEQ ID NO: 321549 - DNA, 32 bp, Artificial Sequence
  Description of Artificial Sequence: Synthetic oligonucleotide
actttcctaacttcgacctccaagagcagctc

SEQ ID NO: 321550 - DNA, 31 bp, Artificial Sequence
  Description of Artificial Sequence: Synthetic oligonucleotide
ctttcctaacttcgacctccaagagcagctc

SEQ ID NO: 321551 - DNA, 31 bp, Artificial Sequence
  Description of Artificial Sequence: Synthetic oligonucleotide
tttcctaacttcgacctccaagagcagctcg

SEQ ID NO: 321552 - DNA, 30 bp, Artificial Sequence
  Description of Artificial Sequence: Synthetic oligonucleotide
ttcctaacttcgacctccaagagcagctcg

SEQ ID NO: 321553 - DNA, 29 bp, Artificial Sequence
  Description of Artificial Sequence: Synthetic oligonucleotide
tcctaacttcgacctccaagagcagctcg

SEQ ID NO: 321554 - DNA, 28 bp, Artificial Sequence
  Description of Artificial Sequence: Synthetic oligonucleotide
cctaacttcgacctccaagagcagctcg

SEQ ID NO: 321555 - DNA, 28 bp, Artificial Sequence
  Description of Artificial Sequence: Synthetic oligonucleotide
ctaacttcgacctccaagagcagctcgc

SEQ ID NO: 321556 - DNA, 29 bp, Artificial Sequence
  Description of Artificial Sequence: Synthetic oligonucleotide
taacttcgacctccaagagcagctcgcag

SEQ ID NO: 321557 - DNA, 28 bp, Artificial Sequence
  Description of Artificial Sequence: Synthetic oligonucleotide
aacttcgacctccaagagcagctcgcag

SEQ ID NO: 321558 - DNA, 27 bp, Artificial Sequence
  Description of Artificial Sequence: Synthetic oligonucleotide
acttcgacctccaagagcagctcgcag

SEQ ID NO: 321559 - DNA, 27 bp, Artificial Sequence
  Description of Artificial Sequence: Synthetic oligonucleotide
cttcgacctccaagagcagctcgcagt

SEQ ID NO: 321560 - DNA, 28 bp, Artificial Sequence
  Description of Artificial Sequence: Synthetic oligonucleotide
ttcgacctccaagagcagctcgcagttg

SEQ ID NO: 321561 - DNA, 27 bp, Artificial Sequence
  Description of Artificial Sequence: Synthetic oligonucleotide
tcgacctccaagagcagctcgcagttg

SEQ ID NO: 321562 - DNA, 27 bp, Artificial Sequence
  Description of Artificial Sequence: Synthetic oligonucleotide
cgacctccaagagcagctcgcagttga

SEQ ID NO: 321563 - DNA, 27 bp, Artificial Sequence
  Description of Artificial Sequence: Synthetic oligonucleotide
gacctccaagagcagctcgcagttgac

SEQ ID NO: 321564 - DNA, 30 bp, Artificial Sequence
  Description of Artificial Sequence: Synthetic oligonucleotide
acctccaagagcagctcgcagttgacttac

SEQ ID NO: 321565 - DNA, 29 bp, Artificial Sequence
  Description of Artificial Sequence: Synthetic oligonucleotide
cctccaagagcagctcgcagttgacttac

SEQ ID NO: 321566 - DNA, 30 bp, Artificial Sequence
  Description of Artificial Sequence: Synthetic oligonucleotide
ctccaagagcagctcgcagttgacttacac

SEQ ID NO: 321567 - DNA, 31 bp, Artificial Sequence
  Description of Artificial Sequence: Synthetic oligonucleotide
tccaagagcagctcgcagttgacttacactc

SEQ ID NO: 321568 - DNA, 30 bp, Artificial Sequence
  Description of Artificial Sequence: Synthetic oligonucleotide
ccaagagcagctcgcagttgacttacactc

SEQ ID NO: 321569 - DNA, 30 bp, Artificial Sequence
  Description of Artificial Sequence: Synthetic oligonucleotide
caagagcagctcgcagttgacttacactcc

SEQ ID NO: 321570 - DNA, 31 bp, Artificial Sequence
  Description of Artificial Sequence: Synthetic oligonucleotide
aagagcagctcgcagttgacttacactcctg

SEQ ID NO: 321571 - DNA, 30 bp, Artificial Sequence
  Description of Artificial Sequence: Synthetic oligonucleotide
agagcagctcgcagttgacttacactcctg

SEQ ID NO: 321572 - DNA, 29 bp, Artificial Sequence
  Description of Artificial Sequence: Synthetic oligonucleotide
gagcagctcgcagttgacttacactcctg

SEQ ID NO: 321573 - DNA, 29 bp, Artificial Sequence
  Description of Artificial Sequence: Synthetic oligonucleotide
agcagctcgcagttgacttacactcctgg

SEQ ID NO: 321574 - DNA, 28 bp, Artificial Sequence
  Description of Artificial Sequence: Synthetic oligonucleotide
gcagctcgcagttgacttacactcctgg

SEQ ID NO: 321575 - DNA, 29 bp, Artificial Sequence
  Description of Artificial Sequence: Synthetic oligonucleotide
cagctcgcagttgacttacactcctggtc

SEQ ID NO: 321576 - DNA, 29 bp, Artificial Sequence
  Description of Artificial Sequence: Synthetic oligonucleotide
agctcgcagttgacttacactcctggtcg

SEQ ID NO: 321577 - DNA, 28 bp, Artificial Sequence
  Description of Artificial Sequence: Synthetic oligonucleotide
gctcgcagttgacttacactcctggtcg

SEQ ID NO: 321578 - DNA, 30 bp, Artificial Sequence
  Description of Artificial Sequence: Synthetic oligonucleotide
ctcgcagttgacttacactcctggtcgaag

SEQ ID NO: 321579 - DNA, 30 bp, Artificial Sequence
  Description of Artificial Sequence: Synthetic oligonucleotide
tcgcagttgacttacactcctggtcgaagg

SEQ ID NO: 321580 - DNA, 29 bp, Artificial Sequence
  Description of Artificial Sequence: Synthetic oligonucleotide
cgcagttgacttacactcctggtcgaagg

SEQ ID NO: 321581 - DNA, 30 bp, Artificial Sequence
  Description of Artificial Sequence: Synthetic oligonucleotide
gcagttgacttacactcctggtcgaaggac

SEQ ID NO: 321582 - DNA, 31 bp, Artificial Sequence
  Description of Artificial Sequence: Synthetic oligonucleotide
cagttgacttacactcctggtcgaaggacac

SEQ ID NO: 321583 - DNA, 31 bp, Artificial Sequence
  Description of Artificial Sequence: Synthetic oligonucleotide
agttgacttacactcctggtcgaaggacacc

SEQ ID NO: 321584 - DNA, 30 bp, Artificial Sequence
  Description of Artificial Sequence: Synthetic oligonucleotide
gttgacttacactcctggtcgaaggacacc

SEQ ID NO: 321585 - DNA, 32 bp, Artificial Sequence
  Description of Artificial Sequence: Synthetic oligonucleotide
ttgacttacactcctggtcgaaggacaccaac

SEQ ID NO: 321586 - DNA, 31 bp, Artificial Sequence
  Description of Artificial Sequence: Synthetic oligonucleotide
tgacttacactcctggtcgaaggacaccaac

SEQ ID NO: 321587 - DNA, 30 bp, Artificial Sequence
  Description of Artificial Sequence: Synthetic oligonucleotide
gacttacactcctggtcgaaggacaccaac

SEQ ID NO: 321588 - DNA, 31 bp, Artificial Sequence
  Description of Artificial Sequence: Synthetic oligonucleotide
acttacactcctggtcgaaggacaccaacag

SEQ ID NO: 321589 - DNA, 30 bp, Artificial Sequence
  Description of Artificial Sequence: Synthetic oligonucleotide
cttacactcctggtcgaaggacaccaacag

SEQ ID NO: 321590 - DNA, 30 bp, Artificial Sequence
  Description of Artificial Sequence: Synthetic oligonucleotide
ttacactcctggtcgaaggacaccaacagc

SEQ ID NO: 321591 - DNA, 29 bp, Artificial Sequence
  Description of Artificial Sequence: Synthetic oligonucleotide
tacactcctggtcgaaggacaccaacagc

SEQ ID NO: 321592 - DNA, 28 bp, Artificial Sequence
  Description of Artificial Sequence: Synthetic oligonucleotide
acactcctggtcgaaggacaccaacagc

SEQ ID NO: 321593 - DNA, 27 bp, Artificial Sequence
  Description of Artificial Sequence: Synthetic oligonucleotide
cactcctggtcgaaggacaccaacagc

SEQ ID NO: 321594 - DNA, 27 bp, Artificial Sequence
  Description of Artificial Sequence: Synthetic oligonucleotide
actcctggtcgaaggacaccaacagcc

SEQ ID NO: 321595 - DNA, 26 bp, Artificial Sequence
  Description of Artificial Sequence: Synthetic oligonucleotide
ctcctggtcgaaggacaccaacagcc

SEQ ID NO: 321596 - DNA, 26 bp, Artificial Sequence
  Description of Artificial Sequence: Synthetic oligonucleotide
tcctggtcgaaggacaccaacagccc

SEQ ID NO: 321597 - DNA, 25 bp, Artificial Sequence
  Description of Artificial Sequence: Synthetic oligonucleotide
cctggtcgaaggacaccaacagccc

SEQ ID NO: 321598 - DNA, 25 bp, Artificial Sequence
  Description of Artificial Sequence: Synthetic oligonucleotide
ctggtcgaaggacaccaacagcccc

SEQ ID NO: 321599 - DNA, 26 bp, Artificial Sequence
  Description of Artificial Sequence: Synthetic oligonucleotide
tggtcgaaggacaccaacagccccgt

SEQ ID NO: 321600 - DNA, 25 bp, Artificial Sequence
  Description of Artificial Sequence: Synthetic oligonucleotide
ggtcgaaggacaccaacagccccgt

SEQ ID NO: 321601 - DNA, 25 bp, Artificial Sequence
  Description of Artificial Sequence: Synthetic oligonucleotide
gtcgaaggacaccaacagccccgtc

SEQ ID NO: 321602 - DNA, 27 bp, Artificial Sequence
  Description of Artificial Sequence: Synthetic oligonucleotide
tcgaaggacaccaacagccccgtcgaa

SEQ ID NO: 321603 - DNA, 26 bp, Artificial Sequence
  Description of Artificial Sequence: Synthetic oligonucleotide
cgaaggacaccaacagccccgtcgaa

SEQ ID NO: 321604 - DNA, 27 bp, Artificial Sequence
  Description of Artificial Sequence: Synthetic oligonucleotide
gaaggacaccaacagccccgtcgaaca

SEQ ID NO: 321605 - DNA, 30 bp, Artificial Sequence
  Description of Artificial Sequence: Synthetic oligonucleotide
aaggacaccaacagccccgtcgaacatttg

SEQ ID NO: 321606 - DNA, 29 bp, Artificial Sequence
  Description of Artificial Sequence: Synthetic oligonucleotide
aggacaccaacagccccgtcgaacatttg

SEQ ID NO: 321607 - DNA, 28 bp, Artificial Sequence
  Description of Artificial Sequence: Synthetic oligonucleotide
ggacaccaacagccccgtcgaacatttg

SEQ ID NO: 321608 - DNA, 29 bp, Artificial Sequence
  Description of Artificial Sequence: Synthetic oligonucleotide
gacaccaacagccccgtcgaacatttgtg

SEQ ID NO: 321609 - DNA, 29 bp, Artificial Sequence
  Description of Artificial Sequence: Synthetic oligonucleotide
acaccaacagccccgtcgaacatttgtgg

SEQ ID NO: 321610 - DNA, 28 bp, Artificial Sequence
  Description of Artificial Sequence: Synthetic oligonucleotide
caccaacagccccgtcgaacatttgtgg

SEQ ID NO: 321611 - DNA, 28 bp, Artificial Sequence
  Description of Artificial Sequence: Synthetic oligonucleotide
accaacagccccgtcgaacatttgtggg

SEQ ID NO: 321612 - DNA, 27 bp, Artificial Sequence
  Description of Artificial Sequence: Synthetic oligonucleotide
ccaacagccccgtcgaacatttgtggg

SEQ ID NO: 321613 - DNA, 28 bp, Artificial Sequence
  Description of Artificial Sequence: Synthetic oligonucleotide
caacagccccgtcgaacatttgtgggtg

SEQ ID NO: 321614 - DNA, 29 bp, Artificial Sequence
  Description of Artificial Sequence: Synthetic oligonucleotide
aacagccccgtcgaacatttgtgggtgac

SEQ ID NO: 321615 - DNA, 28 bp, Artificial Sequence
  Description of Artificial Sequence: Synthetic oligonucleotide
acagccccgtcgaacatttgtgggtgac

SEQ ID NO: 321616 - DNA, 27 bp, Artificial Sequence
  Description of Artificial Sequence: Synthetic oligonucleotide
cagccccgtcgaacatttgtgggtgac

SEQ ID NO: 321617 - DNA, 28 bp, Artificial Sequence
  Description of Artificial Sequence: Synthetic oligonucleotide
agccccgtcgaacatttgtgggtgacag

SEQ ID NO: 321618 - DNA, 27 bp, Artificial Sequence
  Description of Artificial Sequence: Synthetic oligonucleotide
gccccgtcgaacatttgtgggtgacag

SEQ ID NO: 321619 - DNA, 28 bp, Artificial Sequence
  Description of Artificial Sequence: Synthetic oligonucleotide
ccccgtcgaacatttgtgggtgacagtc

SEQ ID NO: 321620 - DNA, 30 bp, Artificial Sequence
  Description of Artificial Sequence: Synthetic oligonucleotide
cccgtcgaacatttgtgggtgacagtcaac

SEQ ID NO: 321621 - DNA, 31 bp, Artificial Sequence
  Description of Artificial Sequence: Synthetic oligonucleotide
ccgtcgaacatttgtgggtgacagtcaacag

SEQ ID NO: 321622 - DNA, 31 bp, Artificial Sequence
  Description of Artificial Sequence: Synthetic oligonucleotide
cgtcgaacatttgtgggtgacagtcaacagg

SEQ ID NO: 321623 - DNA, 34 bp, Artificial Sequence
  Description of Artificial Sequence: Synthetic oligonucleotide
gtcgaacatttgtgggtgacagtcaacaggaatc

SEQ ID NO: 321624 - DNA, 34 bp, Artificial Sequence
  Description of Artificial Sequence: Synthetic oligonucleotide
tcgaacatttgtgggtgacagtcaacaggaatcc

SEQ ID NO: 321625 - DNA, 33 bp, Artificial Sequence
  Description of Artificial Sequence: Synthetic oligonucleotide
cgaacatttgtgggtgacagtcaacaggaatcc

SEQ ID NO: 321626 - DNA, 33 bp, Artificial Sequence
  Description of Artificial Sequence: Synthetic oligonucleotide
gaacatttgtgggtgacagtcaacaggaatccc

SEQ ID NO: 321627 - DNA, 33 bp, Artificial Sequence
  Description of Artificial Sequence: Synthetic oligonucleotide
aacatttgtgggtgacagtcaacaggaatcccg

SEQ ID NO: 321628 - DNA, 32 bp, Artificial Sequence
  Description of Artificial Sequence: Synthetic oligonucleotide
acatttgtgggtgacagtcaacaggaatcccg

SEQ ID NO: 321629 - DNA, 31 bp, Artificial Sequence
  Description of Artificial Sequence: Synthetic oligonucleotide
catttgtgggtgacagtcaacaggaatcccg

SEQ ID NO: 321630 - DNA, 31 bp, Artificial Sequence
  Description of Artificial Sequence: Synthetic oligonucleotide
atttgtgggtgacagtcaacaggaatcccgg

SEQ ID NO: 321631 - DNA, 30 bp, Artificial Sequence
  Description of Artificial Sequence: Synthetic oligonucleotide
tttgtgggtgacagtcaacaggaatcccgg

SEQ ID NO: 321632 - DNA, 29 bp, Artificial Sequence
  Description of Artificial Sequence: Synthetic oligonucleotide
ttgtgggtgacagtcaacaggaatcccgg

SEQ ID NO: 321633 - DNA, 28 bp, Artificial Sequence
  Description of Artificial Sequence: Synthetic oligonucleotide
tgtgggtgacagtcaacaggaatcccgg

SEQ ID NO: 321634 - DNA, 27 bp, Artificial Sequence
  Description of Artificial Sequence: Synthetic oligonucleotide
gtgggtgacagtcaacaggaatcccgg

SEQ ID NO: 321635 - DNA, 28 bp, Artificial Sequence
  Description of Artificial Sequence: Synthetic oligonucleotide
tgggtgacagtcaacaggaatcccggtg

SEQ ID NO: 321636 - DNA, 27 bp, Artificial Sequence
  Description of Artificial Sequence: Synthetic oligonucleotide
gggtgacagtcaacaggaatcccggtg

SEQ ID NO: 321637 - DNA, 29 bp, Artificial Sequence
  Description of Artificial Sequence: Synthetic oligonucleotide
ggtgacagtcaacaggaatcccggtgtac

SEQ ID NO: 321638 - DNA, 29 bp, Artificial Sequence
  Description of Artificial Sequence: Synthetic oligonucleotide
gtgacagtcaacaggaatcccggtgtacc

SEQ ID NO: 321639 - DNA, 30 bp, Artificial Sequence
  Description of Artificial Sequence: Synthetic oligonucleotide
tgacagtcaacaggaatcccggtgtacctg

SEQ ID NO: 321640 - DNA, 29 bp, Artificial Sequence
  Description of Artificial Sequence: Synthetic oligonucleotide
gacagtcaacaggaatcccggtgtacctg

SEQ ID NO: 321641 - DNA, 29 bp, Artificial Sequence
  Description of Artificial Sequence: Synthetic oligonucleotide
acagtcaacaggaatcccggtgtacctgg

SEQ ID NO: 321642 - DNA, 28 bp, Artificial Sequence
  Description of Artificial Sequence: Synthetic oligonucleotide
cagtcaacaggaatcccggtgtacctgg

SEQ ID NO: 321643 - DNA, 28 bp, Artificial Sequence
  Description of Artificial Sequence: Synthetic oligonucleotide
agtcaacaggaatcccggtgtacctggc

SEQ ID NO: 321644 - DNA, 27 bp, Artificial Sequence
  Description of Artificial Sequence: Synthetic oligonucleotide
gtcaacaggaatcccggtgtacctggc

SEQ ID NO: 321645 - DNA, 28 bp, Artificial Sequence
  Description of Artificial Sequence: Synthetic oligonucleotide
tcaacaggaatcccggtgtacctggctc

SEQ ID NO: 321646 - DNA, 27 bp, Artificial Sequence
  Description of Artificial Sequence: Synthetic oligonucleotide
caacaggaatcccggtgtacctggctc

SEQ ID NO: 321647 - DNA, 30 bp, Artificial Sequence
  Description of Artificial Sequence: Synthetic oligonucleotide
aacaggaatcccggtgtacctggctctttg

SEQ ID NO: 321648 - DNA, 29 bp, Artificial Sequence
  Description of Artificial Sequence: Synthetic oligonucleotide
acaggaatcccggtgtacctggctctttg

SEQ ID NO: 321649 - DNA, 28 bp, Artificial Sequence
  Description of Artificial Sequence: Synthetic oligonucleotide
caggaatcccggtgtacctggctctttg

SEQ ID NO: 321650 - DNA, 28 bp, Artificial Sequence
  Description of Artificial Sequence: Synthetic oligonucleotide
aggaatcccggtgtacctggctctttgc

SEQ ID NO: 321651 - DNA, 27 bp, Artificial Sequence
  Description of Artificial Sequence: Synthetic oligonucleotide
ggaatcccggtgtacctggctctttgc

SEQ ID NO: 321652 - DNA, 27 bp, Artificial Sequence
  Description of Artificial Sequence: Synthetic oligonucleotide
gaatcccggtgtacctggctctttgcc

SEQ ID NO: 321653 - DNA, 31 bp, Artificial Sequence
  Description of Artificial Sequence: Synthetic oligonucleotide
aatcccggtgtacctggctctttgccaaatg

SEQ ID NO: 321654 - DNA, 30 bp, Artificial Sequence
  Description of Artificial Sequence: Synthetic oligonucleotide
atcccggtgtacctggctctttgccaaatg

SEQ ID NO: 321655 - DNA, 29 bp, Artificial Sequence
  Description of Artificial Sequence: Synthetic oligonucleotide
tcccggtgtacctggctctttgccaaatg

SEQ ID NO: 321656 - DNA, 28 bp, Artificial Sequence
  Description of Artificial Sequence: Synthetic oligonucleotide
cccggtgtacctggctctttgccaaatg

SEQ ID NO: 321657 - DNA, 28 bp, Artificial Sequence
  Description of Artificial Sequence: Synthetic oligonucleotide
ccggtgtacctggctctttgccaaatgg

SEQ ID NO: 321658 - DNA, 30 bp, Artificial Sequence
  Description of Artificial Sequence: Synthetic oligonucleotide
cggtgtacctggctctttgccaaatggatc

SEQ ID NO: 321659 - DNA, 30 bp, Artificial Sequence
  Description of Artificial Sequence: Synthetic oligonucleotide
ggtgtacctggctctttgccaaatggatcc

SEQ ID NO: 321660 - DNA, 31 bp, Artificial Sequence
  Description of Artificial Sequence: Synthetic oligonucleotide
gtgtacctggctctttgccaaatggatcctg

SEQ ID NO: 321661 - DNA, 31 bp, Artificial Sequence
  Description of Artificial Sequence: Synthetic oligonucleotide
tgtacctggctctttgccaaatggatcctgg

SEQ ID NO: 321662 - DNA, 30 bp, Artificial Sequence
  Description of Artificial Sequence: Synthetic oligonucleotide
gtacctggctctttgccaaatggatcctgg

SEQ ID NO: 321663 - DNA, 31 bp, Artificial Sequence
  Description of Artificial Sequence: Synthetic oligonucleotide
tacctggctctttgccaaatggatcctggac

SEQ ID NO: 321664 - DNA, 30 bp, Artificial Sequence
  Description of Artificial Sequence: Synthetic oligonucleotide
acctggctctttgccaaatggatcctggac

SEQ ID NO: 321665 - DNA, 29 bp, Artificial Sequence
  Description of Artificial Sequence: Synthetic oligonucleotide
cctggctctttgccaaatggatcctggac

SEQ ID NO: 321666 - DNA, 30 bp, Artificial Sequence
  Description of Artificial Sequence: Synthetic oligonucleotide
ctggctctttgccaaatggatcctggacag

SEQ ID NO: 321667 - DNA, 30 bp, Artificial Sequence
  Description of Artificial Sequence: Synthetic oligonucleotide
tggctctttgccaaatggatcctggacagg

SEQ ID NO: 321668 - DNA, 29 bp, Artificial Sequence
  Description of Artificial Sequence: Synthetic oligonucleotide
ggctctttgccaaatggatcctggacagg

SEQ ID NO: 321669 - DNA, 32 bp, Artificial Sequence
  Description of Artificial Sequence: Synthetic oligonucleotide
gctctttgccaaatggatcctggacaggaaac

SEQ ID NO: 321670 - DNA, 32 bp, Artificial Sequence
  Description of Artificial Sequence: Synthetic oligonucleotide
ctctttgccaaatggatcctggacaggaaacc

SEQ ID NO: 321671 - DNA, 33 bp, Artificial Sequence
  Description of Artificial Sequence: Synthetic oligonucleotide
tctttgccaaatggatcctggacaggaaacctc

SEQ ID NO: 321672 - DNA, 32 bp, Artificial Sequence
  Description of Artificial Sequence: Synthetic oligonucleotide
ctttgccaaatggatcctggacaggaaacctc

SEQ ID NO: 321673 - DNA, 33 bp, Artificial Sequence
  Description of Artificial Sequence: Synthetic oligonucleotide
tttgccaaatggatcctggacaggaaacctctg

SEQ ID NO: 321674 - DNA, 32 bp, Artificial Sequence
  Description of Artificial Sequence: Synthetic oligonucleotide
ttgccaaatggatcctggacaggaaacctctg

SEQ ID NO: 321675 - DNA, 31 bp, Artificial Sequence
  Description of Artificial Sequence: Synthetic oligonucleotide
tgccaaatggatcctggacaggaaacctctg

SEQ ID NO: 321676 - DNA, 30 bp, Artificial Sequence
  Description of Artificial Sequence: Synthetic oligonucleotide
gccaaatggatcctggacaggaaacctctg

SEQ ID NO: 321677 - DNA, 31 bp, Artificial Sequence
  Description of Artificial Sequence: Synthetic oligonucleotide
ccaaatggatcctggacaggaaacctctgag

SEQ ID NO: 321678 - DNA, 31 bp, Artificial Sequence
  Description of Artificial Sequence: Synthetic oligonucleotide
caaatggatcctggacaggaaacctctgagc

SEQ ID NO: 321679 - DNA, 37 bp, Artificial Sequence
  Description of Artificial Sequence: Synthetic oligonucleotide
aaatggatcctggacaggaaacctctgagctataatg

SEQ ID NO: 321680 - DNA, 36 bp, Artificial Sequence
  Description of Artificial Sequence: Synthetic oligonucleotide
aatggatcctggacaggaaacctctgagctataatg

SEQ ID NO: 321681 - DNA, 35 bp, Artificial Sequence
  Description of Artificial Sequence: Synthetic oligonucleotide
atggatcctggacaggaaacctctgagctataatg

SEQ ID NO: 321682 - DNA, 34 bp, Artificial Sequence
  Description of Artificial Sequence: Synthetic oligonucleotide
tggatcctggacaggaaacctctgagctataatg

SEQ ID NO: 321683 - DNA, 33 bp, Artificial Sequence
  Description of Artificial Sequence: Synthetic oligonucleotide
ggatcctggacaggaaacctctgagctataatg

SEQ ID NO: 321684 - DNA, 34 bp, Artificial Sequence
  Description of Artificial Sequence: Synthetic oligonucleotide
gatcctggacaggaaacctctgagctataatgtg

SEQ ID NO: 321685 - DNA, 34 bp, Artificial Sequence
  Description of Artificial Sequence: Synthetic oligonucleotide
atcctggacaggaaacctctgagctataatgtgg

SEQ ID NO: 321686 - DNA, 33 bp, Artificial Sequence
  Description of Artificial Sequence: Synthetic oligonucleotide
tcctggacaggaaacctctgagctataatgtgg

SEQ ID NO: 321687 - DNA, 32 bp, Artificial Sequence
  Description of Artificial Sequence: Synthetic oligonucleotide
cctggacaggaaacctctgagctataatgtgg

SEQ ID NO: 321688 - DNA, 33 bp, Artificial Sequence
  Description of Artificial Sequence: Synthetic oligonucleotide
ctggacaggaaacctctgagctataatgtggag

SEQ ID NO: 321689 - DNA, 34 bp, Artificial Sequence
  Description of Artificial Sequence: Synthetic oligonucleotide
tggacaggaaacctctgagctataatgtggagtg

SEQ ID NO: 321690 - DNA, 33 bp, Artificial Sequence
  Description of Artificial Sequence: Synthetic oligonucleotide
ggacaggaaacctctgagctataatgtggagtg

SEQ ID NO: 321691 - DNA, 34 bp, Artificial Sequence
  Description of Artificial Sequence: Synthetic oligonucleotide
gacaggaaacctctgagctataatgtggagtgag

SEQ ID NO: 321692 - DNA, 36 bp, Artificial Sequence
  Description of Artificial Sequence: Synthetic oligonucleotide
acaggaaacctctgagctataatgtggagtgagatg

SEQ ID NO: 321693 - DNA, 35 bp, Artificial Sequence
  Description of Artificial Sequence: Synthetic oligonucleotide
caggaaacctctgagctataatgtggagtgagatg

SEQ ID NO: 321694 - DNA, 35 bp, Artificial Sequence
  Description of Artificial Sequence: Synthetic oligonucleotide
aggaaacctctgagctataatgtggagtgagatgg

SEQ ID NO: 321695 - DNA, 34 bp, Artificial Sequence
  Description of Artificial Sequence: Synthetic oligonucleotide
ggaaacctctgagctataatgtggagtgagatgg

SEQ ID NO: 321696 - DNA, 36 bp, Artificial Sequence
  Description of Artificial Sequence: Synthetic oligonucleotide
gaaacctctgagctataatgtggagtgagatggaag

SEQ ID NO: 321697 - DNA, 37 bp, Artificial Sequence
  Description of Artificial Sequence: Synthetic oligonucleotide
aaacctctgagctataatgtggagtgagatggaagac

SEQ ID NO: 321698 - DNA, 36 bp, Artificial Sequence
  Description of Artificial Sequence: Synthetic oligonucleotide
aacctctgagctataatgtggagtgagatggaagac

SEQ ID NO: 321699 - DNA, 35 bp, Artificial Sequence
  Description of Artificial Sequence: Synthetic oligonucleotide
acctctgagctataatgtggagtgagatggaagac

SEQ ID NO: 321700 - DNA, 34 bp, Artificial Sequence
  Description of Artificial Sequence: Synthetic oligonucleotide
cctctgagctataatgtggagtgagatggaagac

SEQ ID NO: 321701 - DNA, 35 bp, Artificial Sequence
  Description of Artificial Sequence: Synthetic oligonucleotide
ctctgagctataatgtggagtgagatggaagactg

SEQ ID NO: 321702 - DNA, 36 bp, Artificial Sequence
  Description of Artificial Sequence: Synthetic oligonucleotide
tctgagctataatgtggagtgagatggaagactgac

SEQ ID NO: 321703 - DNA, 35 bp, Artificial Sequence
  Description of Artificial Sequence: Synthetic oligonucleotide
ctgagctataatgtggagtgagatggaagactgac

SEQ ID NO: 321704 - DNA, 36 bp, Artificial Sequence
  Description of Artificial Sequence: Synthetic oligonucleotide
tgagctataatgtggagtgagatggaagactgacac

SEQ ID NO: 321705 - DNA, 35 bp, Artificial Sequence
  Description of Artificial Sequence: Synthetic oligonucleotide
gagctataatgtggagtgagatggaagactgacac

SEQ ID NO: 321706 - DNA, 35 bp, Artificial Sequence
  Description of Artificial Sequence: Synthetic oligonucleotide
agctataatgtggagtgagatggaagactgacacg

SEQ ID NO: 321707 - DNA, 34 bp, Artificial Sequence
  Description of Artificial Sequence: Synthetic oligonucleotide
gctataatgtggagtgagatggaagactgacacg

SEQ ID NO: 321708 - DNA, 34 bp, Artificial Sequence
  Description of Artificial Sequence: Synthetic oligonucleotide
ctataatgtggagtgagatggaagactgacacgg

SEQ ID NO: 321709 - DNA, 35 bp, Artificial Sequence
  Description of Artificial Sequence: Synthetic oligonucleotide
tataatgtggagtgagatggaagactgacacggag

SEQ ID NO: 321710 - DNA, 34 bp, Artificial Sequence
  Description of Artificial Sequence: Synthetic oligonucleotide
ataatgtggagtgagatggaagactgacacggag

SEQ ID NO: 321711 - DNA, 33 bp, Artificial Sequence
  Description of Artificial Sequence: Synthetic oligonucleotide
taatgtggagtgagatggaagactgacacggag

SEQ ID NO: 321712 - DNA, 32 bp, Artificial Sequence
  Description of Artificial Sequence: Synthetic oligonucleotide
aatgtggagtgagatggaagactgacacggag

SEQ ID NO: 321713 - DNA, 31 bp, Artificial Sequence
  Description of Artificial Sequence: Synthetic oligonucleotide
atgtggagtgagatggaagactgacacggag

SEQ ID NO: 321714 - DNA, 30 bp, Artificial Sequence
  Description of Artificial Sequence: Synthetic oligonucleotide
tgtggagtgagatggaagactgacacggag

SEQ ID NO: 321715 - DNA, 29 bp, Artificial Sequence
  Description of Artificial Sequence: Synthetic oligonucleotide
gtggagtgagatggaagactgacacggag

SEQ ID NO: 321716 - DNA, 29 bp, Artificial Sequence
  Description of Artificial Sequence: Synthetic oligonucleotide
tggagtgagatggaagactgacacggagc

SEQ ID NO: 321717 - DNA, 28 bp, Artificial Sequence
  Description of Artificial Sequence: Synthetic oligonucleotide
ggagtgagatggaagactgacacggagc

SEQ ID NO: 321718 - DNA, 28 bp, Artificial Sequence
  Description of Artificial Sequence: Synthetic oligonucleotide
gagtgagatggaagactgacacggagcc

SEQ ID NO: 321719 - DNA, 29 bp, Artificial Sequence
  Description of Artificial Sequence: Synthetic oligonucleotide
agtgagatggaagactgacacggagcctg

SEQ ID NO: 321720 - DNA, 28 bp, Artificial Sequence
  Description of Artificial Sequence: Synthetic oligonucleotide
gtgagatggaagactgacacggagcctg

SEQ ID NO: 321721 - DNA, 28 bp, Artificial Sequence
  Description of Artificial Sequence: Synthetic oligonucleotide
tgagatggaagactgacacggagcctgc

SEQ ID NO: 321722 - DNA, 27 bp, Artificial Sequence
  Description of Artificial Sequence: Synthetic oligonucleotide
gagatggaagactgacacggagcctgc

SEQ ID NO: 321723 - DNA, 27 bp, Artificial Sequence
  Description of Artificial Sequence: Synthetic oligonucleotide
agatggaagactgacacggagcctgcc

SEQ ID NO: 321724 - DNA, 27 bp, Artificial Sequence
  Description of Artificial Sequence: Synthetic oligonucleotide
gatggaagactgacacggagcctgcca

SEQ ID NO: 321725 - DNA, 27 bp, Artificial Sequence
  Description of Artificial Sequence: Synthetic oligonucleotide
atggaagactgacacggagcctgccac

SEQ ID NO: 321726 - DNA, 26 bp, Artificial Sequence
  Description of Artificial Sequence: Synthetic oligonucleotide
tggaagactgacacggagcctgccac

SEQ ID NO: 321727 - DNA, 25 bp, Artificial Sequence
  Description of Artificial Sequence: Synthetic oligonucleotide
ggaagactgacacggagcctgccac

SEQ ID NO: 321728 - DNA, 25 bp, Artificial Sequence
  Description of Artificial Sequence: Synthetic oligonucleotide
gaagactgacacggagcctgccacg

SEQ ID NO: 321729 - DNA, 25 bp, Artificial Sequence
  Description of Artificial Sequence: Synthetic oligonucleotide
aagactgacacggagcctgccacgg

SEQ ID NO: 321730 - DNA, 24 bp, Artificial Sequence
  Description of Artificial Sequence: Synthetic oligonucleotide
agactgacacggagcctgccacgg

SEQ ID NO: 321731 - DNA, 23 bp, Artificial Sequence
  Description of Artificial Sequence: Synthetic oligonucleotide
gactgacacggagcctgccacgg

SEQ ID NO: 321732 - DNA, 23 bp, Artificial Sequence
  Description of Artificial Sequence: Synthetic oligonucleotide
actgacacggagcctgccacggg

SEQ ID NO: 321733 - DNA, 22 bp, Artificial Sequence
  Description of Artificial Sequence: Synthetic oligonucleotide
ctgacacggagcctgccacggg

SEQ ID NO: 321734 - DNA, 23 bp, Artificial Sequence
  Description of Artificial Sequence: Synthetic oligonucleotide
tgacacggagcctgccacgggca

SEQ ID NO: 321735 - DNA, 22 bp, Artificial Sequence
  Description of Artificial Sequence: Synthetic oligonucleotide
gacacggagcctgccacgggca

SEQ ID NO: 321736 - DNA, 25 bp, Artificial Sequence
  Description of Artificial Sequence: Synthetic oligonucleotide
acacggagcctgccacgggcactat

SEQ ID NO: 321737 - DNA, 24 bp, Artificial Sequence
  Description of Artificial Sequence: Synthetic oligonucleotide
cacggagcctgccacgggcactat

SEQ ID NO: 321738 - DNA, 26 bp, Artificial Sequence
  Description of Artificial Sequence: Synthetic oligonucleotide
acggagcctgccacgggcactatgta

SEQ ID NO: 321739 - DNA, 25 bp, Artificial Sequence
  Description of Artificial Sequence: Synthetic oligonucleotide
cggagcctgccacgggcactatgta

SEQ ID NO: 321740 - DNA, 27 bp, Artificial Sequence
  Description of Artificial Sequence: Synthetic oligonucleotide
ggagcctgccacgggcactatgtagat

SEQ ID NO: 321741 - DNA, 27 bp, Artificial Sequence
  Description of Artificial Sequence: Synthetic oligonucleotide
gagcctgccacgggcactatgtagatg

SEQ ID NO: 321742 - DNA, 27 bp, Artificial Sequence
  Description of Artificial Sequence: Synthetic oligonucleotide
agcctgccacgggcactatgtagatgg

SEQ ID NO: 321743 - DNA, 27 bp, Artificial Sequence
  Description of Artificial Sequence: Synthetic oligonucleotide
gcctgccacgggcactatgtagatggt

SEQ ID NO: 321744 - DNA, 31 bp, Artificial Sequence
  Description of Artificial Sequence: Synthetic oligonucleotide
cctgccacgggcactatgtagatggtatttc

SEQ ID NO: 321745 - DNA, 34 bp, Artificial Sequence
  Description of Artificial Sequence: Synthetic oligonucleotide
ctgccacgggcactatgtagatggtatttctatc

SEQ ID NO: 321746 - DNA, 37 bp, Artificial Sequence
  Description of Artificial Sequence: Synthetic oligonucleotide
tgccacgggcactatgtagatggtatttctatctatg

SEQ ID NO: 321747 - DNA, 36 bp, Artificial Sequence
  Description of Artificial Sequence: Synthetic oligonucleotide
gccacgggcactatgtagatggtatttctatctatg

SEQ ID NO: 321748 - DNA, 36 bp, Artificial Sequence
  Description of Artificial Sequence: Synthetic oligonucleotide
ccacgggcactatgtagatggtatttctatctatgg

SEQ ID NO: 321749 - DNA, 39 bp, Artificial Sequence
  Description of Artificial Sequence: Synthetic oligonucleotide
cacgggcactatgtagatggtatttctatctatggtaac

SEQ ID NO: 321750 - DNA, 39 bp, Artificial Sequence
  Description of Artificial Sequence: Synthetic oligonucleotide
acgggcactatgtagatggtatttctatctatggtaacg

SEQ ID NO: 321751 - DNA, 38 bp, Artificial Sequence
  Description of Artificial Sequence: Synthetic oligonucleotide
cgggcactatgtagatggtatttctatctatggtaacg

SEQ ID NO: 321752 - DNA, 38 bp, Artificial Sequence
  Description of Artificial Sequence: Synthetic oligonucleotide
gggcactatgtagatggtatttctatctatggtaacgg

SEQ ID NO: 321753 - DNA, 39 bp, Artificial Sequence
  Description of Artificial Sequence: Synthetic oligonucleotide
ggcactatgtagatggtatttctatctatggtaacggag

SEQ ID NO: 321754 - DNA, 40 bp, Artificial Sequence
  Description of Artificial Sequence: Synthetic oligonucleotide
gcactatgtagatggtatttctatctatggtaacggagac

SEQ ID NO: 321755 - DNA, 45 bp, Artificial Sequence
  Description of Artificial Sequence: Synthetic oligonucleotide
cactatgtagatggtatttctatctatggtaacggagacataaag

SEQ ID NO: 321756 - DNA, 46 bp, Artificial Sequence
  Description of Artificial Sequence: Synthetic oligonucleotide
actatgtagatggtatttctatctatggtaacggagacataaagtg

SEQ ID NO: 321757 - DNA, 45 bp, Artificial Sequence
  Description of Artificial Sequence: Synthetic oligonucleotide
ctatgtagatggtatttctatctatggtaacggagacataaagtg

SEQ ID NO: 321758 - DNA, 45 bp, Artificial Sequence
  Description of Artificial Sequence: Synthetic oligonucleotide
tatgtagatggtatttctatctatggtaacggagacataaagtgg

SEQ ID NO: 321759 - DNA, 44 bp, Artificial Sequence
  Description of Artificial Sequence: Synthetic oligonucleotide
atgtagatggtatttctatctatggtaacggagacataaagtgg

SEQ ID NO: 321760 - DNA, 43 bp, Artificial Sequence
  Description of Artificial Sequence: Synthetic oligonucleotide
tgtagatggtatttctatctatggtaacggagacataaagtgg

SEQ ID NO: 321761 - DNA, 42 bp, Artificial Sequence
  Description of Artificial Sequence: Synthetic oligonucleotide
gtagatggtatttctatctatggtaacggagacataaagtgg

SEQ ID NO: 321762 - DNA, 42 bp, Artificial Sequence
  Description of Artificial Sequence: Synthetic oligonucleotide
tagatggtatttctatctatggtaacggagacataaagtggc

SEQ ID NO: 321763 - DNA, 41 bp, Artificial Sequence
  Description of Artificial Sequence: Synthetic oligonucleotide
agatggtatttctatctatggtaacggagacataaagtggc

SEQ ID NO: 321764 - DNA, 40 bp, Artificial Sequence
  Description of Artificial Sequence: Synthetic oligonucleotide
gatggtatttctatctatggtaacggagacataaagtggc

SEQ ID NO: 321765 - DNA, 41 bp, Artificial Sequence
  Description of Artificial Sequence: Synthetic oligonucleotide
atggtatttctatctatggtaacggagacataaagtggcag

SEQ ID NO: 321766 - DNA, 40 bp, Artificial Sequence
  Description of Artificial Sequence: Synthetic oligonucleotide
tggtatttctatctatggtaacggagacataaagtggcag

SEQ ID NO: 321767 - DNA, 39 bp, Artificial Sequence
  Description of Artificial Sequence: Synthetic oligonucleotide
ggtatttctatctatggtaacggagacataaagtggcag

SEQ ID NO: 321768 - DNA, 39 bp, Artificial Sequence
  Description of Artificial Sequence: Synthetic oligonucleotide
gtatttctatctatggtaacggagacataaagtggcagg

SEQ ID NO: 321769 - DNA, 45 bp, Artificial Sequence
  Description of Artificial Sequence: Synthetic oligonucleotide
tatttctatctatggtaacggagacataaagtggcaggttaattc

SEQ ID NO: 321770 - DNA, 44 bp, Artificial Sequence
  Description of Artificial Sequence: Synthetic oligonucleotide
atttctatctatggtaacggagacataaagtggcaggttaattc

SEQ ID NO: 321771 - DNA, 43 bp, Artificial Sequence
  Description of Artificial Sequence: Synthetic oligonucleotide
tttctatctatggtaacggagacataaagtggcaggttaattc

SEQ ID NO: 321772 - DNA, 42 bp, Artificial Sequence
  Description of Artificial Sequence: Synthetic oligonucleotide
ttctatctatggtaacggagacataaagtggcaggttaattc

SEQ ID NO: 321773 - DNA, 41 bp, Artificial Sequence
  Description of Artificial Sequence: Synthetic oligonucleotide
tctatctatggtaacggagacataaagtggcaggttaattc

SEQ ID NO: 321774 - DNA, 40 bp, Artificial Sequence
  Description of Artificial Sequence: Synthetic oligonucleotide
ctatctatggtaacggagacataaagtggcaggttaattc

SEQ ID NO: 321775 - DNA, 41 bp, Artificial Sequence
  Description of Artificial Sequence: Synthetic oligonucleotide
tatctatggtaacggagacataaagtggcaggttaattctc

SEQ ID NO: 321776 - DNA, 40 bp, Artificial Sequence
  Description of Artificial Sequence: Synthetic oligonucleotide
atctatggtaacggagacataaagtggcaggttaattctc

SEQ ID NO: 321777 - DNA, 39 bp, Artificial Sequence
  Description of Artificial Sequence: Synthetic oligonucleotide
tctatggtaacggagacataaagtggcaggttaattctc

SEQ ID NO: 321778 - DNA, 38 bp, Artificial Sequence
  Description of Artificial Sequence: Synthetic oligonucleotide
ctatggtaacggagacataaagtggcaggttaattctc

SEQ ID NO: 321779 - DNA, 38 bp, Artificial Sequence
  Description of Artificial Sequence: Synthetic oligonucleotide
tatggtaacggagacataaagtggcaggttaattctcc

SEQ ID NO: 321780 - DNA, 37 bp, Artificial Sequence
  Description of Artificial Sequence: Synthetic oligonucleotide
atggtaacggagacataaagtggcaggttaattctcc

SEQ ID NO: 321781 - DNA, 36 bp, Artificial Sequence
  Description of Artificial Sequence: Synthetic oligonucleotide
tggtaacggagacataaagtggcaggttaattctcc

SEQ ID NO: 321782 - DNA, 35 bp, Artificial Sequence
  Description of Artificial Sequence: Synthetic oligonucleotide
ggtaacggagacataaagtggcaggttaattctcc

SEQ ID NO: 321783 - DNA, 37 bp, Artificial Sequence
  Description of Artificial Sequence: Synthetic oligonucleotide
gtaacggagacataaagtggcaggttaattctccaag

SEQ ID NO: 321784 - DNA, 37 bp, Artificial Sequence
  Description of Artificial Sequence: Synthetic oligonucleotide
taacggagacataaagtggcaggttaattctccaagc

SEQ ID NO: 321785 - DNA, 36 bp, Artificial Sequence
  Description of Artificial Sequence: Synthetic oligonucleotide
aacggagacataaagtggcaggttaattctccaagc

SEQ ID NO: 321786 - DNA, 35 bp, Artificial Sequence
  Description of Artificial Sequence: Synthetic oligonucleotide
acggagacataaagtggcaggttaattctccaagc

SEQ ID NO: 321787 - DNA, 34 bp, Artificial Sequence
  Description of Artificial Sequence: Synthetic oligonucleotide
cggagacataaagtggcaggttaattctccaagc

SEQ ID NO: 321788 - DNA, 34 bp, Artificial Sequence
  Description of Artificial Sequence: Synthetic oligonucleotide
ggagacataaagtggcaggttaattctccaagcc

SEQ ID NO: 321789 - DNA, 35 bp, Artificial Sequence
  Description of Artificial Sequence: Synthetic oligonucleotide
gagacataaagtggcaggttaattctccaagcctg

SEQ ID NO: 321790 - DNA, 38 bp, Artificial Sequence
  Description of Artificial Sequence: Synthetic oligonucleotide
agacataaagtggcaggttaattctccaagcctgattg

SEQ ID NO: 321791 - DNA, 37 bp, Artificial Sequence
  Description of Artificial Sequence: Synthetic oligonucleotide
gacataaagtggcaggttaattctccaagcctgattg

SEQ ID NO: 321792 - DNA, 37 bp, Artificial Sequence
  Description of Artificial Sequence: Synthetic oligonucleotide
acataaagtggcaggttaattctccaagcctgattgc

SEQ ID NO: 321793 - DNA, 36 bp, Artificial Sequence
  Description of Artificial Sequence: Synthetic oligonucleotide
cataaagtggcaggttaattctccaagcctgattgc

SEQ ID NO: 321794 - DNA, 39 bp, Artificial Sequence
  Description of Artificial Sequence: Synthetic oligonucleotide
ataaagtggcaggttaattctccaagcctgattgctaac

SEQ ID NO: 321795 - DNA, 38 bp, Artificial Sequence
  Description of Artificial Sequence: Synthetic oligonucleotide
taaagtggcaggttaattctccaagcctgattgctaac

SEQ ID NO: 321796 - DNA, 37 bp, Artificial Sequence
  Description of Artificial Sequence: Synthetic oligonucleotide
aaagtggcaggttaattctccaagcctgattgctaac

SEQ ID NO: 321797 - DNA, 36 bp, Artificial Sequence
  Description of Artificial Sequence: Synthetic oligonucleotide
aagtggcaggttaattctccaagcctgattgctaac

SEQ ID NO: 321798 - DNA, 35 bp, Artificial Sequence
  Description of Artificial Sequence: Synthetic oligonucleotide
agtggcaggttaattctccaagcctgattgctaac

SEQ ID NO: 321799 - DNA, 34 bp, Artificial Sequence
  Description of Artificial Sequence: Synthetic oligonucleotide
gtggcaggttaattctccaagcctgattgctaac

SEQ ID NO: 321800 - DNA, 36 bp, Artificial Sequence
  Description of Artificial Sequence: Synthetic oligonucleotide
tggcaggttaattctccaagcctgattgctaacatg

SEQ ID NO: 321801 - DNA, 35 bp, Artificial Sequence
  Description of Artificial Sequence: Synthetic oligonucleotide
ggcaggttaattctccaagcctgattgctaacatg

SEQ ID NO: 321802 - DNA, 38 bp, Artificial Sequence
  Description of Artificial Sequence: Synthetic oligonucleotide
gcaggttaattctccaagcctgattgctaacatgtttg

SEQ ID NO: 321803 - DNA, 39 bp, Artificial Sequence
  Description of Artificial Sequence: Synthetic oligonucleotide
caggttaattctccaagcctgattgctaacatgtttgag

SEQ ID NO: 321804 - DNA, 39 bp, Artificial Sequence
  Description of Artificial Sequence: Synthetic oligonucleotide
aggttaattctccaagcctgattgctaacatgtttgagc

SEQ ID NO: 321805 - DNA, 38 bp, Artificial Sequence
  Description of Artificial Sequence: Synthetic oligonucleotide
ggttaattctccaagcctgattgctaacatgtttgagc

SEQ ID NO: 321806 - DNA, 44 bp, Artificial Sequence
  Description of Artificial Sequence: Synthetic oligonucleotide
gttaattctccaagcctgattgctaacatgtttgagctaaatac

SEQ ID NO: 321807 - DNA, 44 bp, Artificial Sequence
  Description of Artificial Sequence: Synthetic oligonucleotide
ttaattctccaagcctgattgctaacatgtttgagctaaatacc

SEQ ID NO: 321808 - DNA, 43 bp, Artificial Sequence
  Description of Artificial Sequence: Synthetic oligonucleotide
taattctccaagcctgattgctaacatgtttgagctaaatacc

SEQ ID NO: 321809 - DNA, 42 bp, Artificial Sequence
  Description of Artificial Sequence: Synthetic oligonucleotide
aattctccaagcctgattgctaacatgtttgagctaaatacc

SEQ ID NO: 321810 - DNA, 41 bp, Artificial Sequence
  Description of Artificial Sequence: Synthetic oligonucleotide
attctccaagcctgattgctaacatgtttgagctaaatacc

SEQ ID NO: 321811 - DNA, 40 bp, Artificial Sequence
  Description of Artificial Sequence: Synthetic oligonucleotide
ttctccaagcctgattgctaacatgtttgagctaaatacc

SEQ ID NO: 321812 - DNA, 39 bp, Artificial Sequence
  Description of Artificial Sequence: Synthetic oligonucleotide
tctccaagcctgattgctaacatgtttgagctaaatacc

SEQ ID NO: 321813 - DNA, 38 bp, Artificial Sequence
  Description of Artificial Sequence: Synthetic oligonucleotide
ctccaagcctgattgctaacatgtttgagctaaatacc

SEQ ID NO: 321814 - DNA, 40 bp, Artificial Sequence
  Description of Artificial Sequence: Synthetic oligonucleotide
tccaagcctgattgctaacatgtttgagctaaatacctac

SEQ ID NO: 321815 - DNA, 39 bp, Artificial Sequence
  Description of Artificial Sequence: Synthetic oligonucleotide
ccaagcctgattgctaacatgtttgagctaaatacctac

SEQ ID NO: 321816 - DNA, 39 bp, Artificial Sequence
  Description of Artificial Sequence: Synthetic oligonucleotide
caagcctgattgctaacatgtttgagctaaatacctacg

SEQ ID NO: 321817 - DNA, 39 bp, Artificial Sequence
  Description of Artificial Sequence: Synthetic oligonucleotide
aagcctgattgctaacatgtttgagctaaatacctacgc

SEQ ID NO: 321818 - DNA, 38 bp, Artificial Sequence
  Description of Artificial Sequence: Synthetic oligonucleotide
agcctgattgctaacatgtttgagctaaatacctacgc

SEQ ID NO: 321819 - DNA, 37 bp, Artificial Sequence
  Description of Artificial Sequence: Synthetic oligonucleotide
gcctgattgctaacatgtttgagctaaatacctacgc

SEQ ID NO: 321820 - DNA, 37 bp, Artificial Sequence
  Description of Artificial Sequence: Synthetic oligonucleotide
cctgattgctaacatgtttgagctaaatacctacgcc

SEQ ID NO: 321821 - DNA, 37 bp, Artificial Sequence
  Description of Artificial Sequence: Synthetic oligonucleotide
ctgattgctaacatgtttgagctaaatacctacgccc

SEQ ID NO: 321822 - DNA, 40 bp, Artificial Sequence
  Description of Artificial Sequence: Synthetic oligonucleotide
tgattgctaacatgtttgagctaaatacctacgcccttac

SEQ ID NO: 321823 - DNA, 39 bp, Artificial Sequence
  Description of Artificial Sequence: Synthetic oligonucleotide
gattgctaacatgtttgagctaaatacctacgcccttac

SEQ ID NO: 321824 - DNA, 40 bp, Artificial Sequence
  Description of Artificial Sequence: Synthetic oligonucleotide
attgctaacatgtttgagctaaatacctacgcccttactg

SEQ ID NO: 321825 - DNA, 39 bp, Artificial Sequence
  Description of Artificial Sequence: Synthetic oligonucleotide
ttgctaacatgtttgagctaaatacctacgcccttactg

SEQ ID NO: 321826 - DNA, 38 bp, Artificial Sequence
  Description of Artificial Sequence: Synthetic oligonucleotide
tgctaacatgtttgagctaaatacctacgcccttactg

SEQ ID NO: 321827 - DNA, 37 bp, Artificial Sequence
  Description of Artificial Sequence: Synthetic oligonucleotide
gctaacatgtttgagctaaatacctacgcccttactg

SEQ ID NO: 321828 - DNA, 38 bp, Artificial Sequence
  Description of Artificial Sequence: Synthetic oligonucleotide
ctaacatgtttgagctaaatacctacgcccttactgag

SEQ ID NO: 321829 - DNA, 38 bp, Artificial Sequence
  Description of Artificial Sequence: Synthetic oligonucleotide
taacatgtttgagctaaatacctacgcccttactgagg

SEQ ID NO: 321830 - DNA, 37 bp, Artificial Sequence
  Description of Artificial Sequence: Synthetic oligonucleotide
aacatgtttgagctaaatacctacgcccttactgagg

SEQ ID NO: 321831 - DNA, 36 bp, Artificial Sequence
  Description of Artificial Sequence: Synthetic oligonucleotide
acatgtttgagctaaatacctacgcccttactgagg

SEQ ID NO: 321832 - DNA, 35 bp, Artificial Sequence
  Description of Artificial Sequence: Synthetic oligonucleotide
catgtttgagctaaatacctacgcccttactgagg

SEQ ID NO: 321833 - DNA, 38 bp, Artificial Sequence
  Description of Artificial Sequence: Synthetic oligonucleotide
atgtttgagctaaatacctacgcccttactgaggaatg

SEQ ID NO: 321834 - DNA, 37 bp, Artificial Sequence
  Description of Artificial Sequence: Synthetic oligonucleotide
tgtttgagctaaatacctacgcccttactgaggaatg

SEQ ID NO: 321835 - DNA, 36 bp, Artificial Sequence
  Description of Artificial Sequence: Synthetic oligonucleotide
gtttgagctaaatacctacgcccttactgaggaatg

SEQ ID NO: 321836 - DNA, 36 bp, Artificial Sequence
  Description of Artificial Sequence: Synthetic oligonucleotide
tttgagctaaatacctacgcccttactgaggaatgc

SEQ ID NO: 321837 - DNA, 35 bp, Artificial Sequence
  Description of Artificial Sequence: Synthetic oligonucleotide
ttgagctaaatacctacgcccttactgaggaatgc

SEQ ID NO: 321838 - DNA, 34 bp, Artificial Sequence
  Description of Artificial Sequence: Synthetic oligonucleotide
tgagctaaatacctacgcccttactgaggaatgc

SEQ ID NO: 321839 - DNA, 33 bp, Artificial Sequence
  Description of Artificial Sequence: Synthetic oligonucleotide
gagctaaatacctacgcccttactgaggaatgc

SEQ ID NO: 321840 - DNA, 33 bp, Artificial Sequence
  Description of Artificial Sequence: Synthetic oligonucleotide
agctaaatacctacgcccttactgaggaatgcc

SEQ ID NO: 321841 - DNA, 32 bp, Artificial Sequence
  Description of Artificial Sequence: Synthetic oligonucleotide
gctaaatacctacgcccttactgaggaatgcc

SEQ ID NO: 321842 - DNA, 34 bp, Artificial Sequence
  Description of Artificial Sequence: Synthetic oligonucleotide
ctaaatacctacgcccttactgaggaatgccttg

SEQ ID NO: 321843 - DNA, 36 bp, Artificial Sequence
  Description of Artificial Sequence: Synthetic oligonucleotide
taaatacctacgcccttactgaggaatgccttgaac

SEQ ID NO: 321844 - DNA, 35 bp, Artificial Sequence
  Description of Artificial Sequence: Synthetic oligonucleotide
aaatacctacgcccttactgaggaatgccttgaac

SEQ ID NO: 321845 - DNA, 34 bp, Artificial Sequence
  Description of Artificial Sequence: Synthetic oligonucleotide
aatacctacgcccttactgaggaatgccttgaac

SEQ ID NO: 321846 - DNA, 33 bp, Artificial Sequence
  Description of Artificial Sequence: Synthetic oligonucleotide
atacctacgcccttactgaggaatgccttgaac

SEQ ID NO: 321847 - DNA, 32 bp, Artificial Sequence
  Description of Artificial Sequence: Synthetic oligonucleotide
tacctacgcccttactgaggaatgccttgaac

SEQ ID NO: 321848 - DNA, 31 bp, Artificial Sequence
  Description of Artificial Sequence: Synthetic oligonucleotide
acctacgcccttactgaggaatgccttgaac

SEQ ID NO: 321849 - DNA, 30 bp, Artificial Sequence
  Description of Artificial Sequence: Synthetic oligonucleotide
cctacgcccttactgaggaatgccttgaac

SEQ ID NO: 321850 - DNA, 31 bp, Artificial Sequence
  Description of Artificial Sequence: Synthetic oligonucleotide
ctacgcccttactgaggaatgccttgaactg

SEQ ID NO: 321851 - DNA, 32 bp, Artificial Sequence
  Description of Artificial Sequence: Synthetic oligonucleotide
tacgcccttactgaggaatgccttgaactgag

SEQ ID NO: 321852 - DNA, 31 bp, Artificial Sequence
  Description of Artificial Sequence: Synthetic oligonucleotide
acgcccttactgaggaatgccttgaactgag

SEQ ID NO: 321853 - DNA, 30 bp, Artificial Sequence
  Description of Artificial Sequence: Synthetic oligonucleotide
cgcccttactgaggaatgccttgaactgag

SEQ ID NO: 321854 - DNA, 30 bp, Artificial Sequence
  Description of Artificial Sequence: Synthetic oligonucleotide
gcccttactgaggaatgccttgaactgagg

SEQ ID NO: 321855 - DNA, 30 bp, Artificial Sequence
  Description of Artificial Sequence: Synthetic oligonucleotide
cccttactgaggaatgccttgaactgaggg

SEQ ID NO: 321856 - DNA, 32 bp, Artificial Sequence
  Description of Artificial Sequence: Synthetic oligonucleotide
ccttactgaggaatgccttgaactgagggatc

SEQ ID NO: 321857 - DNA, 32 bp, Artificial Sequence
  Description of Artificial Sequence: Synthetic oligonucleotide
cttactgaggaatgccttgaactgagggatcg

SEQ ID NO: 321858 - DNA, 32 bp, Artificial Sequence
  Description of Artificial Sequence: Synthetic oligonucleotide
ttactgaggaatgccttgaactgagggatcgc

SEQ ID NO: 321859 - DNA, 31 bp, Artificial Sequence
  Description of Artificial Sequence: Synthetic oligonucleotide
tactgaggaatgccttgaactgagggatcgc

SEQ ID NO: 321860 - DNA, 30 bp, Artificial Sequence
  Description of Artificial Sequence: Synthetic oligonucleotide
actgaggaatgccttgaactgagggatcgc

SEQ ID NO: 321861 - DNA, 29 bp, Artificial Sequence
  Description of Artificial Sequence: Synthetic oligonucleotide
ctgaggaatgccttgaactgagggatcgc

SEQ ID NO: 321862 - DNA, 29 bp, Artificial Sequence
  Description of Artificial Sequence: Synthetic oligonucleotide
tgaggaatgccttgaactgagggatcgcg

SEQ ID NO: 321863 - DNA, 28 bp, Artificial Sequence
  Description of Artificial Sequence: Synthetic oligonucleotide
gaggaatgccttgaactgagggatcgcg

SEQ ID NO: 321864 - DNA, 31 bp, Artificial Sequence
  Description of Artificial Sequence: Synthetic oligonucleotide
aggaatgccttgaactgagggatcgcgaaac

SEQ ID NO: 321865 - DNA, 30 bp, Artificial Sequence
  Description of Artificial Sequence: Synthetic oligonucleotide
ggaatgccttgaactgagggatcgcgaaac

SEQ ID NO: 321866 - DNA, 32 bp, Artificial Sequence
  Description of Artificial Sequence: Synthetic oligonucleotide
gaatgccttgaactgagggatcgcgaaacaac

SEQ ID NO: 321867 - DNA, 32 bp, Artificial Sequence
  Description of Artificial Sequence: Synthetic oligonucleotide
aatgccttgaactgagggatcgcgaaacaacc

SEQ ID NO: 321868 - DNA, 31 bp, Artificial Sequence
  Description of Artificial Sequence: Synthetic oligonucleotide
atgccttgaactgagggatcgcgaaacaacc

SEQ ID NO: 321869 - DNA, 30 bp, Artificial Sequence
  Description of Artificial Sequence: Synthetic oligonucleotide
tgccttgaactgagggatcgcgaaacaacc

SEQ ID NO: 321870 - DNA, 29 bp, Artificial Sequence
  Description of Artificial Sequence: Synthetic oligonucleotide
gccttgaactgagggatcgcgaaacaacc

SEQ ID NO: 321871 - DNA, 29 bp, Artificial Sequence
  Description of Artificial Sequence: Synthetic oligonucleotide
ccttgaactgagggatcgcgaaacaaccc

SEQ ID NO: 321872 - DNA, 30 bp, Artificial Sequence
  Description of Artificial Sequence: Synthetic oligonucleotide
cttgaactgagggatcgcgaaacaaccctc

SEQ ID NO: 321873 - DNA, 33 bp, Artificial Sequence
  Description of Artificial Sequence: Synthetic oligonucleotide
ttgaactgagggatcgcgaaacaaccctcaaac

SEQ ID NO: 321874 - DNA, 32 bp, Artificial Sequence
  Description of Artificial Sequence: Synthetic oligonucleotide
tgaactgagggatcgcgaaacaaccctcaaac

SEQ ID NO: 321875 - DNA, 31 bp, Artificial Sequence
  Description of Artificial Sequence: Synthetic oligonucleotide
gaactgagggatcgcgaaacaaccctcaaac

SEQ ID NO: 321876 - DNA, 32 bp, Artificial Sequence
  Description of Artificial Sequence: Synthetic oligonucleotide
aactgagggatcgcgaaacaaccctcaaacag

SEQ ID NO: 321877 - DNA, 31 bp, Artificial Sequence
  Description of Artificial Sequence: Synthetic oligonucleotide
actgagggatcgcgaaacaaccctcaaacag

SEQ ID NO: 321878 - DNA, 30 bp, Artificial Sequence
  Description of Artificial Sequence: Synthetic oligonucleotide
ctgagggatcgcgaaacaaccctcaaacag

SEQ ID NO: 321879 - DNA, 31 bp, Artificial Sequence
  Description of Artificial Sequence: Synthetic oligonucleotide
tgagggatcgcgaaacaaccctcaaacagag

SEQ ID NO: 321880 - DNA, 30 bp, Artificial Sequence
  Description of Artificial Sequence: Synthetic oligonucleotide
gagggatcgcgaaacaaccctcaaacagag

SEQ ID NO: 321881 - DNA, 31 bp, Artificial Sequence
  Description of Artificial Sequence: Synthetic oligonucleotide
agggatcgcgaaacaaccctcaaacagagtg

SEQ ID NO: 321882 - DNA, 30 bp, Artificial Sequence
  Description of Artificial Sequence: Synthetic oligonucleotide
gggatcgcgaaacaaccctcaaacagagtg

SEQ ID NO: 321883 - DNA, 33 bp, Artificial Sequence
  Description of Artificial Sequence: Synthetic oligonucleotide
ggatcgcgaaacaaccctcaaacagagtgaatc

SEQ ID NO: 321884 - DNA, 34 bp, Artificial Sequence
  Description of Artificial Sequence: Synthetic oligonucleotide
gatcgcgaaacaaccctcaaacagagtgaatctg

SEQ ID NO: 321885 - DNA, 34 bp, Artificial Sequence
  Description of Artificial Sequence: Synthetic oligonucleotide
atcgcgaaacaaccctcaaacagagtgaatctgc

SEQ ID NO: 321886 - DNA, 33 bp, Artificial Sequence
  Description of Artificial Sequence: Synthetic oligonucleotide
tcgcgaaacaaccctcaaacagagtgaatctgc

SEQ ID NO: 321887 - DNA, 32 bp, Artificial Sequence
  Description of Artificial Sequence: Synthetic oligonucleotide
cgcgaaacaaccctcaaacagagtgaatctgc

SEQ ID NO: 321888 - DNA, 32 bp, Artificial Sequence
  Description of Artificial Sequence: Synthetic oligonucleotide
gcgaaacaaccctcaaacagagtgaatctgcg

SEQ ID NO: 321889 - DNA, 35 bp, Artificial Sequence
  Description of Artificial Sequence: Synthetic oligonucleotide
cgaaacaaccctcaaacagagtgaatctgcgatac

SEQ ID NO: 321890 - DNA, 37 bp, Artificial Sequence
  Description of Artificial Sequence: Synthetic oligonucleotide
gaaacaaccctcaaacagagtgaatctgcgatactac

SEQ ID NO: 321891 - DNA, 37 bp, Artificial Sequence
  Description of Artificial Sequence: Synthetic oligonucleotide
aaacaaccctcaaacagagtgaatctgcgatactacc

SEQ ID NO: 321892 - DNA, 36 bp, Artificial Sequence
  Description of Artificial Sequence: Synthetic oligonucleotide
aacaaccctcaaacagagtgaatctgcgatactacc

SEQ ID NO: 321893 - DNA, 35 bp, Artificial Sequence
  Description of Artificial Sequence: Synthetic oligonucleotide
acaaccctcaaacagagtgaatctgcgatactacc

SEQ ID NO: 321894 - DNA, 34 bp, Artificial Sequence
  Description of Artificial Sequence: Synthetic oligonucleotide
caaccctcaaacagagtgaatctgcgatactacc

SEQ ID NO: 321895 - DNA, 34 bp, Artificial Sequence
  Description of Artificial Sequence: Synthetic oligonucleotide
aaccctcaaacagagtgaatctgcgatactaccc

SEQ ID NO: 321896 - DNA, 33 bp, Artificial Sequence
  Description of Artificial Sequence: Synthetic oligonucleotide
accctcaaacagagtgaatctgcgatactaccc

SEQ ID NO: 321897 - DNA, 32 bp, Artificial Sequence
  Description of Artificial Sequence: Synthetic oligonucleotide
ccctcaaacagagtgaatctgcgatactaccc

SEQ ID NO: 321898 - DNA, 33 bp, Artificial Sequence
  Description of Artificial Sequence: Synthetic oligonucleotide
cctcaaacagagtgaatctgcgatactacccag

SEQ ID NO: 321899 - DNA, 33 bp, Artificial Sequence
  Description of Artificial Sequence: Synthetic oligonucleotide
ctcaaacagagtgaatctgcgatactacccagc

SEQ ID NO: 321900 - DNA, 34 bp, Artificial Sequence
  Description of Artificial Sequence: Synthetic oligonucleotide
tcaaacagagtgaatctgcgatactacccagctg

SEQ ID NO: 321901 - DNA, 33 bp, Artificial Sequence
  Description of Artificial Sequence: Synthetic oligonucleotide
caaacagagtgaatctgcgatactacccagctg

SEQ ID NO: 321902 - DNA, 33 bp, Artificial Sequence
  Description of Artificial Sequence: Synthetic oligonucleotide
aaacagagtgaatctgcgatactacccagctgc

SEQ ID NO: 321903 - DNA, 32 bp, Artificial Sequence
  Description of Artificial Sequence: Synthetic oligonucleotide
aacagagtgaatctgcgatactacccagctgc

SEQ ID NO: 321904 - DNA, 31 bp, Artificial Sequence
  Description of Artificial Sequence: Synthetic oligonucleotide
acagagtgaatctgcgatactacccagctgc

SEQ ID NO: 321905 - DNA, 30 bp, Artificial Sequence
  Description of Artificial Sequence: Synthetic oligonucleotide
cagagtgaatctgcgatactacccagctgc

SEQ ID NO: 321906 - DNA, 37 bp, Artificial Sequence
  Description of Artificial Sequence: Synthetic oligonucleotide
agagtgaatctgcgatactacccagctgctatttttg

SEQ ID NO: 321907 - DNA, 36 bp, Artificial Sequence
  Description of Artificial Sequence: Synthetic oligonucleotide
gagtgaatctgcgatactacccagctgctatttttg

SEQ ID NO: 321908 - DNA, 29 bp, Artificial Sequence
  Description of Artificial Sequence: Synthetic oligonucleotide
atggacaagatttggtggctcgcagcctg

SEQ ID NO: 321909 - DNA, 28 bp, Artificial Sequence
  Description of Artificial Sequence: Synthetic oligonucleotide
tggacaagatttggtggctcgcagcctg

SEQ ID NO: 321910 - DNA, 27 bp, Artificial Sequence
  Description of Artificial Sequence: Synthetic oligonucleotide
ggacaagatttggtggctcgcagcctg

SEQ ID NO: 321911 - DNA, 27 bp, Artificial Sequence
  Description of Artificial Sequence: Synthetic oligonucleotide
gacaagatttggtggctcgcagcctgc

SEQ ID NO: 321912 - DNA, 27 bp, Artificial Sequence
  Description of Artificial Sequence: Synthetic oligonucleotide
acaagatttggtggctcgcagcctgcg

SEQ ID NO: 321913 - DNA, 26 bp, Artificial Sequence
  Description of Artificial Sequence: Synthetic oligonucleotide
caagatttggtggctcgcagcctgcg

SEQ ID NO: 321914 - DNA, 27 bp, Artificial Sequence
  Description of Artificial Sequence: Synthetic oligonucleotide
aagatttggtggctcgcagcctgcgga

SEQ ID NO: 321915 - DNA, 26 bp, Artificial Sequence
  Description of Artificial Sequence: Synthetic oligonucleotide
agatttggtggctcgcagcctgcgga

SEQ ID NO: 321916 - DNA, 25 bp, Artificial Sequence
  Description of Artificial Sequence: Synthetic oligonucleotide
gatttggtggctcgcagcctgcgga

SEQ ID NO: 321917 - DNA, 26 bp, Artificial Sequence
  Description of Artificial Sequence: Synthetic oligonucleotide
atttggtggctcgcagcctgcggact

SEQ ID NO: 321918 - DNA, 25 bp, Artificial Sequence
  Description of Artificial Sequence: Synthetic oligonucleotide
tttggtggctcgcagcctgcggact

SEQ ID NO: 321919 - DNA, 24 bp, Artificial Sequence
  Description of Artificial Sequence: Synthetic oligonucleotide
ttggtggctcgcagcctgcggact

SEQ ID NO: 321920 - DNA, 23 bp, Artificial Sequence
  Description of Artificial Sequence: Synthetic oligonucleotide
tggtggctcgcagcctgcggact

SEQ ID NO: 321921 - DNA, 22 bp, Artificial Sequence
  Description of Artificial Sequence: Synthetic oligonucleotide
ggtggctcgcagcctgcggact

SEQ ID NO: 321922 - DNA, 23 bp, Artificial Sequence
  Description of Artificial Sequence: Synthetic oligonucleotide
gtggctcgcagcctgcggactct

SEQ ID NO: 321923 - DNA, 23 bp, Artificial Sequence
  Description of Artificial Sequence: Synthetic oligonucleotide
tggctcgcagcctgcggactctg

SEQ ID NO: 321924 - DNA, 22 bp, Artificial Sequence
  Description of Artificial Sequence: Synthetic oligonucleotide
ggctcgcagcctgcggactctg

SEQ ID NO: 321925 - DNA, 22 bp, Artificial Sequence
  Description of Artificial Sequence: Synthetic oligonucleotide
gctcgcagcctgcggactctgc

SEQ ID NO: 321926 - DNA, 23 bp, Artificial Sequence
  Description of Artificial Sequence: Synthetic oligonucleotide
ctcgcagcctgcggactctgcgt

SEQ ID NO: 321927 - DNA, 23 bp, Artificial Sequence
  Description of Artificial Sequence: Synthetic oligonucleotide
tcgcagcctgcggactctgcgtc

SEQ ID NO: 321928 - DNA, 22 bp, Artificial Sequence
  Description of Artificial Sequence: Synthetic oligonucleotide
cgcagcctgcggactctgcgtc

SEQ ID NO: 321929 - DNA, 23 bp, Artificial Sequence
  Description of Artificial Sequence: Synthetic oligonucleotide
gcagcctgcggactctgcgtcgt

SEQ ID NO: 321930 - DNA, 23 bp, Artificial Sequence
  Description of Artificial Sequence: Synthetic oligonucleotide
cagcctgcggactctgcgtcgtg

SEQ ID NO: 321931 - DNA, 23 bp, Artificial Sequence
  Description of Artificial Sequence: Synthetic oligonucleotide
agcctgcggactctgcgtcgtgc

SEQ ID NO: 321932 - DNA, 22 bp, Artificial Sequence
  Description of Artificial Sequence: Synthetic oligonucleotide
gcctgcggactctgcgtcgtgc

SEQ ID NO: 321933 - DNA, 22 bp, Artificial Sequence
  Description of Artificial Sequence: Synthetic oligonucleotide
cctgcggactctgcgtcgtgcc

SEQ ID NO: 321934 - DNA, 22 bp, Artificial Sequence
  Description of Artificial Sequence: Synthetic oligonucleotide
ctgcggactctgcgtcgtgccg

SEQ ID NO: 321935 - DNA, 23 bp, Artificial Sequence
  Description of Artificial Sequence: Synthetic oligonucleotide
tgcggactctgcgtcgtgccgca

SEQ ID NO: 321936 - DNA, 22 bp, Artificial Sequence
  Description of Artificial Sequence: Synthetic oligonucleotide
gcggactctgcgtcgtgccgca

SEQ ID NO: 321937 - DNA, 23 bp, Artificial Sequence
  Description of Artificial Sequence: Synthetic oligonucleotide
cggactctgcgtcgtgccgcaga

SEQ ID NO: 321938 - DNA, 23 bp, Artificial Sequence
  Description of Artificial Sequence: Synthetic oligonucleotide
ggactctgcgtcgtgccgcagag

SEQ ID NO: 321939 - DNA, 23 bp, Artificial Sequence
  Description of Artificial Sequence: Synthetic oligonucleotide
gactctgcgtcgtgccgcagagc

SEQ ID NO: 321940 - DNA, 24 bp, Artificial Sequence
  Description of Artificial Sequence: Synthetic oligonucleotide
actctgcgtcgtgccgcagagcct

SEQ ID NO: 321941 - DNA, 23 bp, Artificial Sequence
  Description of Artificial Sequence: Synthetic oligonucleotide
ctctgcgtcgtgccgcagagcct

SEQ ID NO: 321942 - DNA, 23 bp, Artificial Sequence
  Description of Artificial Sequence: Synthetic oligonucleotide
tctgcgtcgtgccgcagagcctg

SEQ ID NO: 321943 - DNA, 22 bp, Artificial Sequence
  Description of Artificial Sequence: Synthetic oligonucleotide
ctgcgtcgtgccgcagagcctg

SEQ ID NO: 321944 - DNA, 22 bp, Artificial Sequence
  Description of Artificial Sequence: Synthetic oligonucleotide
tgcgtcgtgccgcagagcctgg

SEQ ID NO: 321945 - DNA, 21 bp, Artificial Sequence
  Description of Artificial Sequence: Synthetic oligonucleotide
gcgtcgtgccgcagagcctgg

SEQ ID NO: 321946 - DNA, 21 bp, Artificial Sequence
  Description of Artificial Sequence: Synthetic oligonucleotide
cgtcgtgccgcagagcctggc

SEQ ID NO: 321947 - DNA, 21 bp, Artificial Sequence
  Description of Artificial Sequence: Synthetic oligonucleotide
gtcgtgccgcagagcctggcc

SEQ ID NO: 321948 - DNA, 22 bp, Artificial Sequence
  Description of Artificial Sequence: Synthetic oligonucleotide
tcgtgccgcagagcctggccca

SEQ ID NO: 321949 - DNA, 21 bp, Artificial Sequence
  Description of Artificial Sequence: Synthetic oligonucleotide
cgtgccgcagagcctggccca

SEQ ID NO: 321950 - DNA, 23 bp, Artificial Sequence
  Description of Artificial Sequence: Synthetic oligonucleotide
gtgccgcagagcctggcccagat

SEQ ID NO: 321951 - DNA, 23 bp, Artificial Sequence
  Description of Artificial Sequence: Synthetic oligonucleotide
tgccgcagagcctggcccagatc

SEQ ID NO: 321952 - DNA, 22 bp, Artificial Sequence
  Description of Artificial Sequence: Synthetic oligonucleotide
gccgcagagcctggcccagatc

SEQ ID NO: 321953 - DNA, 26 bp, Artificial Sequence
  Description of Artificial Sequence: Synthetic oligonucleotide
ccgcagagcctggcccagatcgatat

SEQ ID NO: 321954 - DNA, 27 bp, Artificial Sequence
  Description of Artificial Sequence: Synthetic oligonucleotide
cgcagagcctggcccagatcgatatga

SEQ ID NO: 321955 - DNA, 33 bp, Artificial Sequence
  Description of Artificial Sequence: Synthetic oligonucleotide
gcagagcctggcccagatcgatatgaatataag

SEQ ID NO: 321956 - DNA, 33 bp, Artificial Sequence
  Description of Artificial Sequence: Synthetic oligonucleotide
cagagcctggcccagatcgatatgaatataagc

SEQ ID NO: 321957 - DNA, 34 bp, Artificial Sequence
  Description of Artificial Sequence: Synthetic oligonucleotide
agagcctggcccagatcgatatgaatataagctg

SEQ ID NO: 321958 - DNA, 33 bp, Artificial Sequence
  Description of Artificial Sequence: Synthetic oligonucleotide
gagcctggcccagatcgatatgaatataagctg

SEQ ID NO: 321959 - DNA, 33 bp, Artificial Sequence
  Description of Artificial Sequence: Synthetic oligonucleotide
agcctggcccagatcgatatgaatataagctgc

SEQ ID NO: 321960 - DNA, 32 bp, Artificial Sequence
  Description of Artificial Sequence: Synthetic oligonucleotide
gcctggcccagatcgatatgaatataagctgc

SEQ ID NO: 321961 - DNA, 32 bp, Artificial Sequence
  Description of Artificial Sequence: Synthetic oligonucleotide
cctggcccagatcgatatgaatataagctgcc

SEQ ID NO: 321962 - DNA, 32 bp, Artificial Sequence
  Description of Artificial Sequence: Synthetic oligonucleotide
ctggcccagatcgatatgaatataagctgccg

SEQ ID NO: 321963 - DNA, 32 bp, Artificial Sequence
  Description of Artificial Sequence: Synthetic oligonucleotide
tggcccagatcgatatgaatataagctgccgc

SEQ ID NO: 321964 - DNA, 31 bp, Artificial Sequence
  Description of Artificial Sequence: Synthetic oligonucleotide
ggcccagatcgatatgaatataagctgccgc

SEQ ID NO: 321965 - DNA, 34 bp, Artificial Sequence
  Description of Artificial Sequence: Synthetic oligonucleotide
gcccagatcgatatgaatataagctgccgcttag

SEQ ID NO: 321966 - DNA, 34 bp, Artificial Sequence
  Description of Artificial Sequence: Synthetic oligonucleotide
cccagatcgatatgaatataagctgccgcttagc

SEQ ID NO: 321967 - DNA, 35 bp, Artificial Sequence
  Description of Artificial Sequence: Synthetic oligonucleotide
ccagatcgatatgaatataagctgccgcttagcag

SEQ ID NO: 321968 - DNA, 35 bp, Artificial Sequence
  Description of Artificial Sequence: Synthetic oligonucleotide
cagatcgatatgaatataagctgccgcttagcagg

SEQ ID NO: 321969 - DNA, 36 bp, Artificial Sequence
  Description of Artificial Sequence: Synthetic oligonucleotide
agatcgatatgaatataagctgccgcttagcaggtg

SEQ ID NO: 321970 - DNA, 35 bp, Artificial Sequence
  Description of Artificial Sequence: Synthetic oligonucleotide
gatcgatatgaatataagctgccgcttagcaggtg

SEQ ID NO: 321971 - DNA, 39 bp, Artificial Sequence
  Description of Artificial Sequence: Synthetic oligonucleotide
atcgatatgaatataagctgccgcttagcaggtgtaatc

SEQ ID NO: 321972 - DNA, 38 bp, Artificial Sequence
  Description of Artificial Sequence: Synthetic oligonucleotide
tcgatatgaatataagctgccgcttagcaggtgtaatc

SEQ ID NO: 321973 - DNA, 37 bp, Artificial Sequence
  Description of Artificial Sequence: Synthetic oligonucleotide
cgatatgaatataagctgccgcttagcaggtgtaatc

SEQ ID NO: 321974 - DNA, 37 bp, Artificial Sequence
  Description of Artificial Sequence: Synthetic oligonucleotide
gatatgaatataagctgccgcttagcaggtgtaatcc

SEQ ID NO: 321975 - DNA, 38 bp, Artificial Sequence
  Description of Artificial Sequence: Synthetic oligonucleotide
atatgaatataagctgccgcttagcaggtgtaatccac

SEQ ID NO: 321976 - DNA, 37 bp, Artificial Sequence
  Description of Artificial Sequence: Synthetic oligonucleotide
tatgaatataagctgccgcttagcaggtgtaatccac

SEQ ID NO: 321977 - DNA, 36 bp, Artificial Sequence
  Description of Artificial Sequence: Synthetic oligonucleotide
atgaatataagctgccgcttagcaggtgtaatccac

SEQ ID NO: 321978 - DNA, 35 bp, Artificial Sequence
  Description of Artificial Sequence: Synthetic oligonucleotide
tgaatataagctgccgcttagcaggtgtaatccac

SEQ ID NO: 321979 - DNA, 34 bp, Artificial Sequence
  Description of Artificial Sequence: Synthetic oligonucleotide
gaatataagctgccgcttagcaggtgtaatccac

SEQ ID NO: 321980 - DNA, 34 bp, Artificial Sequence
  Description of Artificial Sequence: Synthetic oligonucleotide
aatataagctgccgcttagcaggtgtaatccacg

SEQ ID NO: 321981 - DNA, 33 bp, Artificial Sequence
  Description of Artificial Sequence: Synthetic oligonucleotide
atataagctgccgcttagcaggtgtaatccacg

SEQ ID NO: 321982 - DNA, 32 bp, Artificial Sequence
  Description of Artificial Sequence: Synthetic oligonucleotide
tataagctgccgcttagcaggtgtaatccacg

SEQ ID NO: 321983 - DNA, 31 bp, Artificial Sequence
  Description of Artificial Sequence: Synthetic oligonucleotide
ataagctgccgcttagcaggtgtaatccacg

SEQ ID NO: 321984 - DNA, 30 bp, Artificial Sequence
  Description of Artificial Sequence: Synthetic oligonucleotide
taagctgccgcttagcaggtgtaatccacg

SEQ ID NO: 321985 - DNA, 29 bp, Artificial Sequence
  Description of Artificial Sequence: Synthetic oligonucleotide
aagctgccgcttagcaggtgtaatccacg

SEQ ID NO: 321986 - DNA, 28 bp, Artificial Sequence
  Description of Artificial Sequence: Synthetic oligonucleotide
agctgccgcttagcaggtgtaatccacg

SEQ ID NO: 321987 - DNA, 27 bp, Artificial Sequence
  Description of Artificial Sequence: Synthetic oligonucleotide
gctgccgcttagcaggtgtaatccacg

SEQ ID NO: 321988 - DNA, 28 bp, Artificial Sequence
  Description of Artificial Sequence: Synthetic oligonucleotide
ctgccgcttagcaggtgtaatccacgtg

SEQ ID NO: 321989 - DNA, 28 bp, Artificial Sequence
  Description of Artificial Sequence: Synthetic oligonucleotide
tgccgcttagcaggtgtaatccacgtgg

SEQ ID NO: 321990 - DNA, 27 bp, Artificial Sequence
  Description of Artificial Sequence: Synthetic oligonucleotide
gccgcttagcaggtgtaatccacgtgg

SEQ ID NO: 321991 - DNA, 28 bp, Artificial Sequence
  Description of Artificial Sequence: Synthetic oligonucleotide
ccgcttagcaggtgtaatccacgtggtg

SEQ ID NO: 321992 - DNA, 34 bp, Artificial Sequence
  Description of Artificial Sequence: Synthetic oligonucleotide
cgcttagcaggtgtaatccacgtggtgaaaaatg

SEQ ID NO: 321993 - DNA, 34 bp, Artificial Sequence
  Description of Artificial Sequence: Synthetic oligonucleotide
gcttagcaggtgtaatccacgtggtgaaaaatgg

SEQ ID NO: 321994 - DNA, 35 bp, Artificial Sequence
  Description of Artificial Sequence: Synthetic oligonucleotide
cttagcaggtgtaatccacgtggtgaaaaatggac

SEQ ID NO: 321995 - DNA, 35 bp, Artificial Sequence
  Description of Artificial Sequence: Synthetic oligonucleotide
ttagcaggtgtaatccacgtggtgaaaaatggacg

SEQ ID NO: 321996 - DNA, 34 bp, Artificial Sequence
  Description of Artificial Sequence: Synthetic oligonucleotide
tagcaggtgtaatccacgtggtgaaaaatggacg

SEQ ID NO: 321997 - DNA, 33 bp, Artificial Sequence
  Description of Artificial Sequence: Synthetic oligonucleotide
agcaggtgtaatccacgtggtgaaaaatggacg

SEQ ID NO: 321998 - DNA, 32 bp, Artificial Sequence
  Description of Artificial Sequence: Synthetic oligonucleotide
gcaggtgtaatccacgtggtgaaaaatggacg

SEQ ID NO: 321999 - DNA, 32 bp, Artificial Sequence
  Description of Artificial Sequence: Synthetic oligonucleotide
caggtgtaatccacgtggtgaaaaatggacgc

SEQ ID NO: 322000 - DNA, 34 bp, Artificial Sequence
  Description of Artificial Sequence: Synthetic oligonucleotide
aggtgtaatccacgtggtgaaaaatggacgctac

SEQ ID NO: 322001 - DNA, 33 bp, Artificial Sequence
  Description of Artificial Sequence: Synthetic oligonucleotide
ggtgtaatccacgtggtgaaaaatggacgctac

SEQ ID NO: 322002 - DNA, 34 bp, Artificial Sequence
  Description of Artificial Sequence: Synthetic oligonucleotide
gtgtaatccacgtggtgaaaaatggacgctacag

SEQ ID NO: 322003 - DNA, 34 bp, Artificial Sequence
  Description of Artificial Sequence: Synthetic oligonucleotide
tgtaatccacgtggtgaaaaatggacgctacagc

SEQ ID NO: 322004 - DNA, 33 bp, Artificial Sequence
  Description of Artificial Sequence: Synthetic oligonucleotide
gtaatccacgtggtgaaaaatggacgctacagc

SEQ ID NO: 322005 - DNA, 35 bp, Artificial Sequence
  Description of Artificial Sequence: Synthetic oligonucleotide
taatccacgtggtgaaaaatggacgctacagcttc

SEQ ID NO: 322006 - DNA, 34 bp, Artificial Sequence
  Description of Artificial Sequence: Synthetic oligonucleotide
aatccacgtggtgaaaaatggacgctacagcttc

SEQ ID NO: 322007 - DNA, 33 bp, Artificial Sequence
  Description of Artificial Sequence: Synthetic oligonucleotide
atccacgtggtgaaaaatggacgctacagcttc

SEQ ID NO: 322008 - DNA, 32 bp, Artificial Sequence
  Description of Artificial Sequence: Synthetic oligonucleotide
tccacgtggtgaaaaatggacgctacagcttc

SEQ ID NO: 322009 - DNA, 31 bp, Artificial Sequence
  Description of Artificial Sequence: Synthetic oligonucleotide
ccacgtggtgaaaaatggacgctacagcttc

SEQ ID NO: 322010 - DNA, 32 bp, Artificial Sequence
  Description of Artificial Sequence: Synthetic oligonucleotide
cacgtggtgaaaaatggacgctacagcttctc

SEQ ID NO: 322011 - DNA, 33 bp, Artificial Sequence
  Description of Artificial Sequence: Synthetic oligonucleotide
acgtggtgaaaaatggacgctacagcttctctc

SEQ ID NO: 322012 - DNA, 32 bp, Artificial Sequence
  Description of Artificial Sequence: Synthetic oligonucleotide
cgtggtgaaaaatggacgctacagcttctctc

SEQ ID NO: 322013 - DNA, 32 bp, Artificial Sequence
  Description of Artificial Sequence: Synthetic oligonucleotide
gtggtgaaaaatggacgctacagcttctctcg

SEQ ID NO: 322014 - DNA, 32 bp, Artificial Sequence
  Description of Artificial Sequence: Synthetic oligonucleotide
tggtgaaaaatggacgctacagcttctctcgg

SEQ ID NO: 322015 - DNA, 31 bp, Artificial Sequence
  Description of Artificial Sequence: Synthetic oligonucleotide
ggtgaaaaatggacgctacagcttctctcgg

SEQ ID NO: 322016 - DNA, 32 bp, Artificial Sequence
  Description of Artificial Sequence: Synthetic oligonucleotide
gtgaaaaatggacgctacagcttctctcggag

SEQ ID NO: 322017 - DNA, 32 bp, Artificial Sequence
  Description of Artificial Sequence: Synthetic oligonucleotide
tgaaaaatggacgctacagcttctctcggagg

SEQ ID NO: 322018 - DNA, 31 bp, Artificial Sequence
  Description of Artificial Sequence: Synthetic oligonucleotide
gaaaaatggacgctacagcttctctcggagg

SEQ ID NO: 322019 - DNA, 31 bp, Artificial Sequence
  Description of Artificial Sequence: Synthetic oligonucleotide
aaaaatggacgctacagcttctctcggaggg

SEQ ID NO: 322020 - DNA, 30 bp, Artificial Sequence
  Description of Artificial Sequence: Synthetic oligonucleotide
aaaatggacgctacagcttctctcggaggg

SEQ ID NO: 322021 - DNA, 29 bp, Artificial Sequence
  Description of Artificial Sequence: Synthetic oligonucleotide
aaatggacgctacagcttctctcggaggg

SEQ ID NO: 322022 - DNA, 28 bp, Artificial Sequence
  Description of Artificial Sequence: Synthetic oligonucleotide
aatggacgctacagcttctctcggaggg

SEQ ID NO: 322023 - DNA, 27 bp, Artificial Sequence
  Description of Artificial Sequence: Synthetic oligonucleotide
atggacgctacagcttctctcggaggg

SEQ ID NO: 322024 - DNA, 27 bp, Artificial Sequence
  Description of Artificial Sequence: Synthetic oligonucleotide
tggacgctacagcttctctcggaggga

SEQ ID NO: 322025 - DNA, 26 bp, Artificial Sequence
  Description of Artificial Sequence: Synthetic oligonucleotide
ggacgctacagcttctctcggaggga

SEQ ID NO: 322026 - DNA, 26 bp, Artificial Sequence
  Description of Artificial Sequence: Synthetic oligonucleotide
gacgctacagcttctctcggagggag

SEQ ID NO: 322027 - DNA, 26 bp, Artificial Sequence
  Description of Artificial Sequence: Synthetic oligonucleotide
acgctacagcttctctcggagggagg

SEQ ID NO: 322028 - DNA, 25 bp, Artificial Sequence
  Description of Artificial Sequence: Synthetic oligonucleotide
cgctacagcttctctcggagggagg

SEQ ID NO: 322029 - DNA, 25 bp, Artificial Sequence
  Description of Artificial Sequence: Synthetic oligonucleotide
gctacagcttctctcggagggaggc

SEQ ID NO: 322030 - DNA, 25 bp, Artificial Sequence
  Description of Artificial Sequence: Synthetic oligonucleotide
ctacagcttctctcggagggaggcc

SEQ ID NO: 322031 - DNA, 25 bp, Artificial Sequence
  Description of Artificial Sequence: Synthetic oligonucleotide
tacagcttctctcggagggaggccg

SEQ ID NO: 322032 - DNA, 24 bp, Artificial Sequence
  Description of Artificial Sequence: Synthetic oligonucleotide
acagcttctctcggagggaggccg

SEQ ID NO: 322033 - DNA, 23 bp, Artificial Sequence
  Description of Artificial Sequence: Synthetic oligonucleotide
cagcttctctcggagggaggccg

SEQ ID NO: 322034 - DNA, 24 bp, Artificial Sequence
  Description of Artificial Sequence: Synthetic oligonucleotide
agcttctctcggagggaggccgca

SEQ ID NO: 322035 - DNA, 23 bp, Artificial Sequence
  Description of Artificial Sequence: Synthetic oligonucleotide
gcttctctcggagggaggccgca

SEQ ID NO: 322036 - DNA, 24 bp, Artificial Sequence
  Description of Artificial Sequence: Synthetic oligonucleotide
cttctctcggagggaggccgcaga

SEQ ID NO: 322037 - DNA, 24 bp, Artificial Sequence
  Description of Artificial Sequence: Synthetic oligonucleotide
ttctctcggagggaggccgcagac

SEQ ID NO: 322038 - DNA, 23 bp, Artificial Sequence
  Description of Artificial Sequence: Synthetic oligonucleotide
tctctcggagggaggccgcagac

SEQ ID NO: 322039 - DNA, 22 bp, Artificial Sequence
  Description of Artificial Sequence: Synthetic oligonucleotide
ctctcggagggaggccgcagac

SEQ ID NO: 322040 - DNA, 23 bp, Artificial Sequence
  Description of Artificial Sequence: Synthetic oligonucleotide
tctcggagggaggccgcagacct

SEQ ID NO: 322041 - DNA, 22 bp, Artificial Sequence
  Description of Artificial Sequence: Synthetic oligonucleotide
ctcggagggaggccgcagacct

SEQ ID NO: 322042 - DNA, 23 bp, Artificial Sequence
  Description of Artificial Sequence: Synthetic oligonucleotide
tcggagggaggccgcagacctct

SEQ ID NO: 322043 - DNA, 22 bp, Artificial Sequence
  Description of Artificial Sequence: Synthetic oligonucleotide
cggagggaggccgcagacctct

SEQ ID NO: 322044 - DNA, 22 bp, Artificial Sequence
  Description of Artificial Sequence: Synthetic oligonucleotide
ggagggaggccgcagacctctg

SEQ ID NO: 322045 - DNA, 24 bp, Artificial Sequence
  Description of Artificial Sequence: Synthetic oligonucleotide
gagggaggccgcagacctctgcta

SEQ ID NO: 322046 - DNA, 24 bp, Artificial Sequence
  Description of Artificial Sequence: Synthetic oligonucleotide
agggaggccgcagacctctgctag

SEQ ID NO: 322047 - DNA, 23 bp, Artificial Sequence
  Description of Artificial Sequence: Synthetic oligonucleotide
gggaggccgcagacctctgctag

SEQ ID NO: 322048 - DNA, 23 bp, Artificial Sequence
  Description of Artificial Sequence: Synthetic oligonucleotide
ggaggccgcagacctctgctagg

SEQ ID NO: 322049 - DNA, 26 bp, Artificial Sequence
  Description of Artificial Sequence: Synthetic oligonucleotide
gaggccgcagacctctgctaggcttt

SEQ ID NO: 322050 - DNA, 27 bp, Artificial Sequence
  Description of Artificial Sequence: Synthetic oligonucleotide
aggccgcagacctctgctaggctttca

SEQ ID NO: 322051 - DNA, 27 bp, Artificial Sequence
  Description of Artificial Sequence: Synthetic oligonucleotide
ggccgcagacctctgctaggctttcat

SEQ ID NO: 322052 - DNA, 29 bp, Artificial Sequence
  Description of Artificial Sequence: Synthetic oligonucleotide
gccgcagacctctgctaggctttcattag

SEQ ID NO: 322053 - DNA, 29 bp, Artificial Sequence
  Description of Artificial Sequence: Synthetic oligonucleotide
ccgcagacctctgctaggctttcattagc

SEQ ID NO: 322054 - DNA, 30 bp, Artificial Sequence
  Description of Artificial Sequence: Synthetic oligonucleotide
cgcagacctctgctaggctttcattagcac

SEQ ID NO: 322055 - DNA, 30 bp, Artificial Sequence
  Description of Artificial Sequence: Synthetic oligonucleotide
gcagacctctgctaggctttcattagcacc

SEQ ID NO: 322056 - DNA, 32 bp, Artificial Sequence
  Description of Artificial Sequence: Synthetic oligonucleotide
cagacctctgctaggctttcattagcaccttc

SEQ ID NO: 322057 - DNA, 32 bp, Artificial Sequence
  Description of Artificial Sequence: Synthetic oligonucleotide
agacctctgctaggctttcattagcaccttcc

SEQ ID NO: 322058 - DNA, 31 bp, Artificial Sequence
  Description of Artificial Sequence: Synthetic oligonucleotide
gacctctgctaggctttcattagcaccttcc

SEQ ID NO: 322059 - DNA, 31 bp, Artificial Sequence
  Description of Artificial Sequence: Synthetic oligonucleotide
acctctgctaggctttcattagcaccttccc

SEQ ID NO: 322060 - DNA, 30 bp, Artificial Sequence
  Description of Artificial Sequence: Synthetic oligonucleotide
cctctgctaggctttcattagcaccttccc

SEQ ID NO: 322061 - DNA, 30 bp, Artificial Sequence
  Description of Artificial Sequence: Synthetic oligonucleotide
ctctgctaggctttcattagcaccttcccc

SEQ ID NO: 322062 - DNA, 31 bp, Artificial Sequence
  Description of Artificial Sequence: Synthetic oligonucleotide
tctgctaggctttcattagcaccttccccac

SEQ ID NO: 322063 - DNA, 30 bp, Artificial Sequence
  Description of Artificial Sequence: Synthetic oligonucleotide
ctgctaggctttcattagcaccttccccac

SEQ ID NO: 322064 - DNA, 33 bp, Artificial Sequence
  Description of Artificial Sequence: Synthetic oligonucleotide
tgctaggctttcattagcaccttccccacaatg

SEQ ID NO: 322065 - DNA, 32 bp, Artificial Sequence
  Description of Artificial Sequence: Synthetic oligonucleotide
gctaggctttcattagcaccttccccacaatg

SEQ ID NO: 322066 - DNA, 32 bp, Artificial Sequence
  Description of Artificial Sequence: Synthetic oligonucleotide
ctaggctttcattagcaccttccccacaatgc

SEQ ID NO: 322067 - DNA, 32 bp, Artificial Sequence
  Description of Artificial Sequence: Synthetic oligonucleotide
taggctttcattagcaccttccccacaatgcc

SEQ ID NO: 322068 - DNA, 31 bp, Artificial Sequence
  Description of Artificial Sequence: Synthetic oligonucleotide
aggctttcattagcaccttccccacaatgcc

SEQ ID NO: 322069 - DNA, 30 bp, Artificial Sequence
  Description of Artificial Sequence: Synthetic oligonucleotide
ggctttcattagcaccttccccacaatgcc

SEQ ID NO: 322070 - DNA, 30 bp, Artificial Sequence
  Description of Artificial Sequence: Synthetic oligonucleotide
gctttcattagcaccttccccacaatgccc

SEQ ID NO: 322071 - DNA, 30 bp, Artificial Sequence
  Description of Artificial Sequence: Synthetic oligonucleotide
ctttcattagcaccttccccacaatgcccc

SEQ ID NO: 322072 - DNA, 31 bp, Artificial Sequence
  Description of Artificial Sequence: Synthetic oligonucleotide
tttcattagcaccttccccacaatgccccag

SEQ ID NO: 322073 - DNA, 30 bp, Artificial Sequence
  Description of Artificial Sequence: Synthetic oligonucleotide
ttcattagcaccttccccacaatgccccag

SEQ ID NO: 322074 - DNA, 29 bp, Artificial Sequence
  Description of Artificial Sequence: Synthetic oligonucleotide
tcattagcaccttccccacaatgccccag

SEQ ID NO: 322075 - DNA, 28 bp, Artificial Sequence
  Description of Artificial Sequence: Synthetic oligonucleotide
cattagcaccttccccacaatgccccag

SEQ ID NO: 322076 - DNA, 30 bp, Artificial Sequence
  Description of Artificial Sequence: Synthetic oligonucleotide
attagcaccttccccacaatgccccagatg

SEQ ID NO: 322077 - DNA, 29 bp, Artificial Sequence
  Description of Artificial Sequence: Synthetic oligonucleotide
ttagcaccttccccacaatgccccagatg

SEQ ID NO: 322078 - DNA, 28 bp, Artificial Sequence
  Description of Artificial Sequence: Synthetic oligonucleotide
tagcaccttccccacaatgccccagatg

SEQ ID NO: 322079 - DNA, 27 bp, Artificial Sequence
  Description of Artificial Sequence: Synthetic oligonucleotide
agcaccttccccacaatgccccagatg

SEQ ID NO: 322080 - DNA, 26 bp, Artificial Sequence
  Description of Artificial Sequence: Synthetic oligonucleotide
gcaccttccccacaatgccccagatg

SEQ ID NO: 322081 - DNA, 27 bp, Artificial Sequence
  Description of Artificial Sequence: Synthetic oligonucleotide
caccttccccacaatgccccagatggt

SEQ ID NO: 322082 - DNA, 27 bp, Artificial Sequence
  Description of Artificial Sequence: Synthetic oligonucleotide
accttccccacaatgccccagatggtg

SEQ ID NO: 322083 - DNA, 27 bp, Artificial Sequence
  Description of Artificial Sequence: Synthetic oligonucleotide
ccttccccacaatgccccagatggtga

SEQ ID NO: 322084 - DNA, 29 bp, Artificial Sequence
  Description of Artificial Sequence: Synthetic oligonucleotide
cttccccacaatgccccagatggtgaaag

SEQ ID NO: 322085 - DNA, 29 bp, Artificial Sequence
  Description of Artificial Sequence: Synthetic oligonucleotide
ttccccacaatgccccagatggtgaaagc

SEQ ID NO: 322086 - DNA, 28 bp, Artificial Sequence
  Description of Artificial Sequence: Synthetic oligonucleotide
tccccacaatgccccagatggtgaaagc

SEQ ID NO: 322087 - DNA, 27 bp, Artificial Sequence
  Description of Artificial Sequence: Synthetic oligonucleotide
ccccacaatgccccagatggtgaaagc

SEQ ID NO: 322088 - DNA, 28 bp, Artificial Sequence
  Description of Artificial Sequence: Synthetic oligonucleotide
cccacaatgccccagatggtgaaagctc

SEQ ID NO: 322089 - DNA, 29 bp, Artificial Sequence
  Description of Artificial Sequence: Synthetic oligonucleotide
ccacaatgccccagatggtgaaagctctc

SEQ ID NO: 322090 - DNA, 30 bp, Artificial Sequence
  Description of Artificial Sequence: Synthetic oligonucleotide
cacaatgccccagatggtgaaagctctcag

SEQ ID NO: 322091 - DNA, 30 bp, Artificial Sequence
  Description of Artificial Sequence: Synthetic oligonucleotide
acaatgccccagatggtgaaagctctcagc

SEQ ID NO: 322092 - DNA, 29 bp, Artificial Sequence
  Description of Artificial Sequence: Synthetic oligonucleotide
caatgccccagatggtgaaagctctcagc

SEQ ID NO: 322093 - DNA, 31 bp, Artificial Sequence
  Description of Artificial Sequence: Synthetic oligonucleotide
aatgccccagatggtgaaagctctcagcatc

SEQ ID NO: 322094 - DNA, 30 bp, Artificial Sequence
  Description of Artificial Sequence: Synthetic oligonucleotide
atgccccagatggtgaaagctctcagcatc

SEQ ID NO: 322095 - DNA, 29 bp, Artificial Sequence
  Description of Artificial Sequence: Synthetic oligonucleotide
tgccccagatggtgaaagctctcagcatc

SEQ ID NO: 322096 - DNA, 28 bp, Artificial Sequence
  Description of Artificial Sequence: Synthetic oligonucleotide
gccccagatggtgaaagctctcagcatc

SEQ ID NO: 322097 - DNA, 28 bp, Artificial Sequence
  Description of Artificial Sequence: Synthetic oligonucleotide
ccccagatggtgaaagctctcagcatcg

SEQ ID NO: 322098 - DNA, 28 bp, Artificial Sequence
  Description of Artificial Sequence: Synthetic oligonucleotide
cccagatggtgaaagctctcagcatcgg

SEQ ID NO: 322099 - DNA, 32 bp, Artificial Sequence
  Description of Artificial Sequence: Synthetic oligonucleotide
ccagatggtgaaagctctcagcatcggaattg

SEQ ID NO: 322100 - DNA, 33 bp, Artificial Sequence
  Description of Artificial Sequence: Synthetic oligonucleotide
cagatggtgaaagctctcagcatcggaattgag

SEQ ID NO: 322101 - DNA, 34 bp, Artificial Sequence
  Description of Artificial Sequence: Synthetic oligonucleotide
agatggtgaaagctctcagcatcggaattgagac

SEQ ID NO: 322102 - DNA, 33 bp, Artificial Sequence
  Description of Artificial Sequence: Synthetic oligonucleotide
gatggtgaaagctctcagcatcggaattgagac

SEQ ID NO: 322103 - DNA, 33 bp, Artificial Sequence
  Description of Artificial Sequence: Synthetic oligonucleotide
atggtgaaagctctcagcatcggaattgagacc

SEQ ID NO: 322104 - DNA, 32 bp, Artificial Sequence
  Description of Artificial Sequence: Synthetic oligonucleotide
tggtgaaagctctcagcatcggaattgagacc

SEQ ID NO: 322105 - DNA, 31 bp, Artificial Sequence
  Description of Artificial Sequence: Synthetic oligonucleotide
ggtgaaagctctcagcatcggaattgagacc

SEQ ID NO: 322106 - DNA, 32 bp, Artificial Sequence
  Description of Artificial Sequence: Synthetic oligonucleotide
gtgaaagctctcagcatcggaattgagacctc

SEQ ID NO: 322107 - DNA, 32 bp, Artificial Sequence
  Description of Artificial Sequence: Synthetic oligonucleotide
tgaaagctctcagcatcggaattgagacctcc

SEQ ID NO: 322108 - DNA, 31 bp, Artificial Sequence
  Description of Artificial Sequence: Synthetic oligonucleotide
gaaagctctcagcatcggaattgagacctcc

SEQ ID NO: 322109 - DNA, 32 bp, Artificial Sequence
  Description of Artificial Sequence: Synthetic oligonucleotide
aaagctctcagcatcggaattgagacctccag

SEQ ID NO: 322110 - DNA, 31 bp, Artificial Sequence
  Description of Artificial Sequence: Synthetic oligonucleotide
aagctctcagcatcggaattgagacctccag

SEQ ID NO: 322111 - DNA, 30 bp, Artificial Sequence
  Description of Artificial Sequence: Synthetic oligonucleotide
agctctcagcatcggaattgagacctccag

SEQ ID NO: 322112 - DNA, 29 bp, Artificial Sequence
  Description of Artificial Sequence: Synthetic oligonucleotide
gctctcagcatcggaattgagacctccag

SEQ ID NO: 322113 - DNA, 29 bp, Artificial Sequence
  Description of Artificial Sequence: Synthetic oligonucleotide
ctctcagcatcggaattgagacctccagg

SEQ ID NO: 322114 - DNA, 32 bp, Artificial Sequence
  Description of Artificial Sequence: Synthetic oligonucleotide
tctcagcatcggaattgagacctccaggtatg

SEQ ID NO: 322115 - DNA, 31 bp, Artificial Sequence
  Description of Artificial Sequence: Synthetic oligonucleotide
ctcagcatcggaattgagacctccaggtatg

SEQ ID NO: 322116 - DNA, 31 bp, Artificial Sequence
  Description of Artificial Sequence: Synthetic oligonucleotide
tcagcatcggaattgagacctccaggtatgg

SEQ ID NO: 322117 - DNA, 30 bp, Artificial Sequence
  Description of Artificial Sequence: Synthetic oligonucleotide
cagcatcggaattgagacctccaggtatgg

SEQ ID NO: 322118 - DNA, 30 bp, Artificial Sequence
  Description of Artificial Sequence: Synthetic oligonucleotide
agcatcggaattgagacctccaggtatggc

SEQ ID NO: 322119 - DNA, 29 bp, Artificial Sequence
  Description of Artificial Sequence: Synthetic oligonucleotide
gcatcggaattgagacctccaggtatggc

SEQ ID NO: 322120 - DNA, 31 bp, Artificial Sequence
  Description of Artificial Sequence: Synthetic oligonucleotide
catcggaattgagacctccaggtatggcttc

SEQ ID NO: 322121 - DNA, 34 bp, Artificial Sequence
  Description of Artificial Sequence: Synthetic oligonucleotide
atcggaattgagacctccaggtatggcttcatag

SEQ ID NO: 322122 - DNA, 33 bp, Artificial Sequence
  Description of Artificial Sequence: Synthetic oligonucleotide
tcggaattgagacctccaggtatggcttcatag

SEQ ID NO: 322123 - DNA, 32 bp, Artificial Sequence
  Description of Artificial Sequence: Synthetic oligonucleotide
cggaattgagacctccaggtatggcttcatag

SEQ ID NO: 322124 - DNA, 34 bp, Artificial Sequence
  Description of Artificial Sequence: Synthetic oligonucleotide
ggaattgagacctccaggtatggcttcatagaac

SEQ ID NO: 322125 - DNA, 34 bp, Artificial Sequence
  Description of Artificial Sequence: Synthetic oligonucleotide
gaattgagacctccaggtatggcttcatagaacg

SEQ ID NO: 322126 - DNA, 34 bp, Artificial Sequence
  Description of Artificial Sequence: Synthetic oligonucleotide
aattgagacctccaggtatggcttcatagaacgg

SEQ ID NO: 322127 - DNA, 33 bp, Artificial Sequence
  Description of Artificial Sequence: Synthetic oligonucleotide
attgagacctccaggtatggcttcatagaacgg

SEQ ID NO: 322128 - DNA, 32 bp, Artificial Sequence
  Description of Artificial Sequence: Synthetic oligonucleotide
ttgagacctccaggtatggcttcatagaacgg

SEQ ID NO: 322129 - DNA, 31 bp, Artificial Sequence
  Description of Artificial Sequence: Synthetic oligonucleotide
tgagacctccaggtatggcttcatagaacgg

SEQ ID NO: 322130 - DNA, 30 bp, Artificial Sequence
  Description of Artificial Sequence: Synthetic oligonucleotide
gagacctccaggtatggcttcatagaacgg

SEQ ID NO: 322131 - DNA, 30 bp, Artificial Sequence
  Description of Artificial Sequence: Synthetic oligonucleotide
agacctccaggtatggcttcatagaacggc

SEQ ID NO: 322132 - DNA, 29 bp, Artificial Sequence
  Description of Artificial Sequence: Synthetic oligonucleotide
gacctccaggtatggcttcatagaacggc

SEQ ID NO: 322133 - DNA, 30 bp, Artificial Sequence
  Description of Artificial Sequence: Synthetic oligonucleotide
acctccaggtatggcttcatagaacggcac

SEQ ID NO: 322134 - DNA, 29 bp, Artificial Sequence
  Description of Artificial Sequence: Synthetic oligonucleotide
cctccaggtatggcttcatagaacggcac

SEQ ID NO: 322135 - DNA, 29 bp, Artificial Sequence
  Description of Artificial Sequence: Synthetic oligonucleotide
ctccaggtatggcttcatagaacggcacg

SEQ ID NO: 322136 - DNA, 30 bp, Artificial Sequence
  Description of Artificial Sequence: Synthetic oligonucleotide
tccaggtatggcttcatagaacggcacgtg

SEQ ID NO: 322137 - DNA, 29 bp, Artificial Sequence
  Description of Artificial Sequence: Synthetic oligonucleotide
ccaggtatggcttcatagaacggcacgtg

SEQ ID NO: 322138 - DNA, 29 bp, Artificial Sequence
  Description of Artificial Sequence: Synthetic oligonucleotide
caggtatggcttcatagaacggcacgtgg

SEQ ID NO: 322139 - DNA, 30 bp, Artificial Sequence
  Description of Artificial Sequence: Synthetic oligonucleotide
aggtatggcttcatagaacggcacgtggag

SEQ ID NO: 322140 - DNA, 29 bp, Artificial Sequence
  Description of Artificial Sequence: Synthetic oligonucleotide
ggtatggcttcatagaacggcacgtggag

SEQ ID NO: 322141 - DNA, 32 bp, Artificial Sequence
  Description of Artificial Sequence: Synthetic oligonucleotide
gtatggcttcatagaacggcacgtggagattc

SEQ ID NO: 322142 - DNA, 32 bp, Artificial Sequence
  Description of Artificial Sequence: Synthetic oligonucleotide
tatggcttcatagaacggcacgtggagattcc

SEQ ID NO: 322143 - DNA, 31 bp, Artificial Sequence
  Description of Artificial Sequence: Synthetic oligonucleotide
atggcttcatagaacggcacgtggagattcc

SEQ ID NO: 322144 - DNA, 30 bp, Artificial Sequence
  Description of Artificial Sequence: Synthetic oligonucleotide
tggcttcatagaacggcacgtggagattcc

SEQ ID NO: 322145 - DNA, 29 bp, Artificial Sequence
  Description of Artificial Sequence: Synthetic oligonucleotide
ggcttcatagaacggcacgtggagattcc

SEQ ID NO: 322146 - DNA, 29 bp, Artificial Sequence
  Description of Artificial Sequence: Synthetic oligonucleotide
gcttcatagaacggcacgtggagattccc

SEQ ID NO: 322147 - DNA, 29 bp, Artificial Sequence
  Description of Artificial Sequence: Synthetic oligonucleotide
cttcatagaacggcacgtggagattcccc

SEQ ID NO: 322148 - DNA, 29 bp, Artificial Sequence
  Description of Artificial Sequence: Synthetic oligonucleotide
ttcatagaacggcacgtggagattccccg

SEQ ID NO: 322149 - DNA, 28 bp, Artificial Sequence
  Description of Artificial Sequence: Synthetic oligonucleotide
tcatagaacggcacgtggagattccccg

SEQ ID NO: 322150 - DNA, 27 bp, Artificial Sequence
  Description of Artificial Sequence: Synthetic oligonucleotide
catagaacggcacgtggagattccccg

SEQ ID NO: 322151 - DNA, 27 bp, Artificial Sequence
  Description of Artificial Sequence: Synthetic oligonucleotide
atagaacggcacgtggagattccccgc

SEQ ID NO: 322152 - DNA, 27 bp, Artificial Sequence
  Description of Artificial Sequence: Synthetic oligonucleotide
tagaacggcacgtggagattccccgca

SEQ ID NO: 322153 - DNA, 27 bp, Artificial Sequence
  Description of Artificial Sequence: Synthetic oligonucleotide
agaacggcacgtggagattccccgcat

SEQ ID NO: 322154 - DNA, 26 bp, Artificial Sequence
  Description of Artificial Sequence: Synthetic oligonucleotide
gaacggcacgtggagattccccgcat

SEQ ID NO: 322155 - DNA, 26 bp, Artificial Sequence
  Description of Artificial Sequence: Synthetic oligonucleotide
aacggcacgtggagattccccgcatc

SEQ ID NO: 322156 - DNA, 25 bp, Artificial Sequence
  Description of Artificial Sequence: Synthetic oligonucleotide
acggcacgtggagattccccgcatc

SEQ ID NO: 322157 - DNA, 24 bp, Artificial Sequence
  Description of Artificial Sequence: Synthetic oligonucleotide
cggcacgtggagattccccgcatc

SEQ ID NO: 322158 - DNA, 25 bp, Artificial Sequence
  Description of Artificial Sequence: Synthetic oligonucleotide
ggcacgtggagattccccgcatcca

SEQ ID NO: 322159 - DNA, 25 bp, Artificial Sequence
  Description of Artificial Sequence: Synthetic oligonucleotide
gcacgtggagattccccgcatccac

SEQ ID NO: 322160 - DNA, 25 bp, Artificial Sequence
  Description of Artificial Sequence: Synthetic oligonucleotide
cacgtggagattccccgcatccacc

SEQ ID NO: 322161 - DNA, 25 bp, Artificial Sequence
  Description of Artificial Sequence: Synthetic oligonucleotide
acgtggagattccccgcatccaccc

SEQ ID NO: 322162 - DNA, 24 bp, Artificial Sequence
  Description of Artificial Sequence: Synthetic oligonucleotide
cgtggagattccccgcatccaccc

SEQ ID NO: 322163 - DNA, 26 bp, Artificial Sequence
  Description of Artificial Sequence: Synthetic oligonucleotide
gtggagattccccgcatccaccccta

SEQ ID NO: 322164 - DNA, 27 bp, Artificial Sequence
  Description of Artificial Sequence: Synthetic oligonucleotide
tggagattccccgcatccacccctact

SEQ ID NO: 322165 - DNA, 26 bp, Artificial Sequence
  Description of Artificial Sequence: Synthetic oligonucleotide
ggagattccccgcatccacccctact

SEQ ID NO: 322166 - DNA, 26 bp, Artificial Sequence
  Description of Artificial Sequence: Synthetic oligonucleotide
gagattccccgcatccacccctactc

SEQ ID NO: 322167 - DNA, 27 bp, Artificial Sequence
  Description of Artificial Sequence: Synthetic oligonucleotide
agattccccgcatccacccctactcca

SEQ ID NO: 322168 - DNA, 27 bp, Artificial Sequence
  Description of Artificial Sequence: Synthetic oligonucleotide
gattccccgcatccacccctactccat

SEQ ID NO: 322169 - DNA, 27 bp, Artificial Sequence
  Description of Artificial Sequence: Synthetic oligonucleotide
attccccgcatccacccctactccatc

SEQ ID NO: 322170 - DNA, 27 bp, Artificial Sequence
  Description of Artificial Sequence: Synthetic oligonucleotide
ttccccgcatccacccctactccatct

SEQ ID NO: 322171 - DNA, 26 bp, Artificial Sequence
  Description of Artificial Sequence: Synthetic oligonucleotide
tccccgcatccacccctactccatct

SEQ ID NO: 322172 - DNA, 25 bp, Artificial Sequence
  Description of Artificial Sequence: Synthetic oligonucleotide
ccccgcatccacccctactccatct

SEQ ID NO: 322173 - DNA, 26 bp, Artificial Sequence
  Description of Artificial Sequence: Synthetic oligonucleotide
cccgcatccacccctactccatctct

SEQ ID NO: 322174 - DNA, 26 bp, Artificial Sequence
  Description of Artificial Sequence: Synthetic oligonucleotide
ccgcatccacccctactccatctctg

SEQ ID NO: 322175 - DNA, 27 bp, Artificial Sequence
  Description of Artificial Sequence: Synthetic oligonucleotide
cgcatccacccctactccatctctgca

SEQ ID NO: 322176 - DNA, 27 bp, Artificial Sequence
  Description of Artificial Sequence: Synthetic oligonucleotide
gcatccacccctactccatctctgcag

SEQ ID NO: 322177 - DNA, 27 bp, Artificial Sequence
  Description of Artificial Sequence: Synthetic oligonucleotide
catccacccctactccatctctgcagc

SEQ ID NO: 322178 - DNA, 30 bp, Artificial Sequence
  Description of Artificial Sequence: Synthetic oligonucleotide
atccacccctactccatctctgcagcaaag

SEQ ID NO: 322179 - DNA, 29 bp, Artificial Sequence
  Description of Artificial Sequence: Synthetic oligonucleotide
tccacccctactccatctctgcagcaaag

SEQ ID NO: 322180 - DNA, 28 bp, Artificial Sequence
  Description of Artificial Sequence: Synthetic oligonucleotide
ccacccctactccatctctgcagcaaag

SEQ ID NO: 322181 - DNA, 30 bp, Artificial Sequence
  Description of Artificial Sequence: Synthetic oligonucleotide
cacccctactccatctctgcagcaaagaac

SEQ ID NO: 322182 - DNA, 31 bp, Artificial Sequence
  Description of Artificial Sequence: Synthetic oligonucleotide
acccctactccatctctgcagcaaagaacac

SEQ ID NO: 322183 - DNA, 30 bp, Artificial Sequence
  Description of Artificial Sequence: Synthetic oligonucleotide
cccctactccatctctgcagcaaagaacac

SEQ ID NO: 322184 - DNA, 31 bp, Artificial Sequence
  Description of Artificial Sequence: Synthetic oligonucleotide
ccctactccatctctgcagcaaagaacacag

SEQ ID NO: 322185 - DNA, 31 bp, Artificial Sequence
  Description of Artificial Sequence: Synthetic oligonucleotide
cctactccatctctgcagcaaagaacacagg

SEQ ID NO: 322186 - DNA, 31 bp, Artificial Sequence
  Description of Artificial Sequence: Synthetic oligonucleotide
ctactccatctctgcagcaaagaacacaggg

SEQ ID NO: 322187 - DNA, 31 bp, Artificial Sequence
  Description of Artificial Sequence: Synthetic oligonucleotide
tactccatctctgcagcaaagaacacagggc

SEQ ID NO: 322188 - DNA, 30 bp, Artificial Sequence
  Description of Artificial Sequence: Synthetic oligonucleotide
actccatctctgcagcaaagaacacagggc

SEQ ID NO: 322189 - DNA, 29 bp, Artificial Sequence
  Description of Artificial Sequence: Synthetic oligonucleotide
ctccatctctgcagcaaagaacacagggc

SEQ ID NO: 322190 - DNA, 30 bp, Artificial Sequence
  Description of Artificial Sequence: Synthetic oligonucleotide
tccatctctgcagcaaagaacacagggctg

SEQ ID NO: 322191 - DNA, 29 bp, Artificial Sequence
  Description of Artificial Sequence: Synthetic oligonucleotide
ccatctctgcagcaaagaacacagggctg

SEQ ID NO: 322192 - DNA, 31 bp, Artificial Sequence
  Description of Artificial Sequence: Synthetic oligonucleotide
catctctgcagcaaagaacacagggctgtac

SEQ ID NO: 322193 - DNA, 33 bp, Artificial Sequence
  Description of Artificial Sequence: Synthetic oligonucleotide
atctctgcagcaaagaacacagggctgtacatc

SEQ ID NO: 322194 - DNA, 32 bp, Artificial Sequence
  Description of Artificial Sequence: Synthetic oligonucleotide
tctctgcagcaaagaacacagggctgtacatc

SEQ ID NO: 322195 - DNA, 31 bp, Artificial Sequence
  Description of Artificial Sequence: Synthetic oligonucleotide
ctctgcagcaaagaacacagggctgtacatc

SEQ ID NO: 322196 - DNA, 31 bp, Artificial Sequence
  Description of Artificial Sequence: Synthetic oligonucleotide
tctgcagcaaagaacacagggctgtacatcc

SEQ ID NO: 322197 - DNA, 30 bp, Artificial Sequence
  Description of Artificial Sequence: Synthetic oligonucleotide
ctgcagcaaagaacacagggctgtacatcc

SEQ ID NO: 322198 - DNA, 31 bp, Artificial Sequence
  Description of Artificial Sequence: Synthetic oligonucleotide
tgcagcaaagaacacagggctgtacatccac

SEQ ID NO: 322199 - DNA, 30 bp, Artificial Sequence
  Description of Artificial Sequence: Synthetic oligonucleotide
gcagcaaagaacacagggctgtacatccac

SEQ ID NO: 322200 - DNA, 31 bp, Artificial Sequence
  Description of Artificial Sequence: Synthetic oligonucleotide
cagcaaagaacacagggctgtacatccacac

SEQ ID NO: 322201 - DNA, 33 bp, Artificial Sequence
  Description of Artificial Sequence: Synthetic oligonucleotide
agcaaagaacacagggctgtacatccacacatc

SEQ ID NO: 322202 - DNA, 32 bp, Artificial Sequence
  Description of Artificial Sequence: Synthetic oligonucleotide
gcaaagaacacagggctgtacatccacacatc

SEQ ID NO: 322203 - DNA, 32 bp, Artificial Sequence
  Description of Artificial Sequence: Synthetic oligonucleotide
caaagaacacagggctgtacatccacacatcc

SEQ ID NO: 322204 - DNA, 34 bp, Artificial Sequence
  Description of Artificial Sequence: Synthetic oligonucleotide
aaagaacacagggctgtacatccacacatccaag

SEQ ID NO: 322205 - DNA, 33 bp, Artificial Sequence
  Description of Artificial Sequence: Synthetic oligonucleotide
aagaacacagggctgtacatccacacatccaag

SEQ ID NO: 322206 - DNA, 32 bp, Artificial Sequence
  Description of Artificial Sequence: Synthetic oligonucleotide
agaacacagggctgtacatccacacatccaag

SEQ ID NO: 322207 - DNA, 31 bp, Artificial Sequence
  Description of Artificial Sequence: Synthetic oligonucleotide
gaacacagggctgtacatccacacatccaag

SEQ ID NO: 322208 - DNA, 32 bp, Artificial Sequence
  Description of Artificial Sequence: Synthetic oligonucleotide
aacacagggctgtacatccacacatccaagac

SEQ ID NO: 322209 - DNA, 31 bp, Artificial Sequence
  Description of Artificial Sequence: Synthetic oligonucleotide
acacagggctgtacatccacacatccaagac

SEQ ID NO: 322210 - DNA, 30 bp, Artificial Sequence
  Description of Artificial Sequence: Synthetic oligonucleotide
cacagggctgtacatccacacatccaagac

SEQ ID NO: 322211 - DNA, 30 bp, Artificial Sequence
  Description of Artificial Sequence: Synthetic oligonucleotide
acagggctgtacatccacacatccaagacc

SEQ ID NO: 322212 - DNA, 29 bp, Artificial Sequence
  Description of Artificial Sequence: Synthetic oligonucleotide
cagggctgtacatccacacatccaagacc

SEQ ID NO: 322213 - DNA, 30 bp, Artificial Sequence
  Description of Artificial Sequence: Synthetic oligonucleotide
agggctgtacatccacacatccaagacctc

SEQ ID NO: 322214 - DNA, 29 bp, Artificial Sequence
  Description of Artificial Sequence: Synthetic oligonucleotide
gggctgtacatccacacatccaagacctc

SEQ ID NO: 322215 - DNA, 29 bp, Artificial Sequence
  Description of Artificial Sequence: Synthetic oligonucleotide
ggctgtacatccacacatccaagacctcc

SEQ ID NO: 322216 - DNA, 29 bp, Artificial Sequence
  Description of Artificial Sequence: Synthetic oligonucleotide
gctgtacatccacacatccaagacctccc

SEQ ID NO: 322217 - DNA, 30 bp, Artificial Sequence
  Description of Artificial Sequence: Synthetic oligonucleotide
ctgtacatccacacatccaagacctcccag

SEQ ID NO: 322218 - DNA, 33 bp, Artificial Sequence
  Description of Artificial Sequence: Synthetic oligonucleotide
tgtacatccacacatccaagacctcccagaatg

SEQ ID NO: 322219 - DNA, 32 bp, Artificial Sequence
  Description of Artificial Sequence: Synthetic oligonucleotide
gtacatccacacatccaagacctcccagaatg

SEQ ID NO: 322220 - DNA, 33 bp, Artificial Sequence
  Description of Artificial Sequence: Synthetic oligonucleotide
tacatccacacatccaagacctcccagaatgac

SEQ ID NO: 322221 - DNA, 32 bp, Artificial Sequence
  Description of Artificial Sequence: Synthetic oligonucleotide
acatccacacatccaagacctcccagaatgac

SEQ ID NO: 322222 - DNA, 31 bp, Artificial Sequence
  Description of Artificial Sequence: Synthetic oligonucleotide
catccacacatccaagacctcccagaatgac

SEQ ID NO: 322223 - DNA, 32 bp, Artificial Sequence
  Description of Artificial Sequence: Synthetic oligonucleotide
atccacacatccaagacctcccagaatgacac

SEQ ID NO: 322224 - DNA, 31 bp, Artificial Sequence
  Description of Artificial Sequence: Synthetic oligonucleotide
tccacacatccaagacctcccagaatgacac

SEQ ID NO: 322225 - DNA, 30 bp, Artificial Sequence
  Description of Artificial Sequence: Synthetic oligonucleotide
ccacacatccaagacctcccagaatgacac

SEQ ID NO: 322226 - DNA, 35 bp, Artificial Sequence
  Description of Artificial Sequence: Synthetic oligonucleotide
cacacatccaagacctcccagaatgacacattttg

SEQ ID NO: 322227 - DNA, 35 bp, Artificial Sequence
  Description of Artificial Sequence: Synthetic oligonucleotide
acacatccaagacctcccagaatgacacattttgc

SEQ ID NO: 322228 - DNA, 34 bp, Artificial Sequence
  Description of Artificial Sequence: Synthetic oligonucleotide
cacatccaagacctcccagaatgacacattttgc

SEQ ID NO: 322229 - DNA, 36 bp, Artificial Sequence
  Description of Artificial Sequence: Synthetic oligonucleotide
acatccaagacctcccagaatgacacattttgcttc

SEQ ID NO: 322230 - DNA, 35 bp, Artificial Sequence
  Description of Artificial Sequence: Synthetic oligonucleotide
catccaagacctcccagaatgacacattttgcttc

SEQ ID NO: 322231 - DNA, 38 bp, Artificial Sequence
  Description of Artificial Sequence: Synthetic oligonucleotide
atccaagacctcccagaatgacacattttgcttcaaag

SEQ ID NO: 322232 - DNA, 37 bp, Artificial Sequence
  Description of Artificial Sequence: Synthetic oligonucleotide
tccaagacctcccagaatgacacattttgcttcaaag

SEQ ID NO: 322233 - DNA, 36 bp, Artificial Sequence
  Description of Artificial Sequence: Synthetic oligonucleotide
ccaagacctcccagaatgacacattttgcttcaaag

SEQ ID NO: 322234 - DNA, 36 bp, Artificial Sequence
  Description of Artificial Sequence: Synthetic oligonucleotide
caagacctcccagaatgacacattttgcttcaaagc

SEQ ID NO: 322235 - DNA, 38 bp, Artificial Sequence
  Description of Artificial Sequence: Synthetic oligonucleotide
aagacctcccagaatgacacattttgcttcaaagcttc

SEQ ID NO: 322236 - DNA, 37 bp, Artificial Sequence
  Description of Artificial Sequence: Synthetic oligonucleotide
agacctcccagaatgacacattttgcttcaaagcttc

SEQ ID NO: 322237 - DNA, 36 bp, Artificial Sequence
  Description of Artificial Sequence: Synthetic oligonucleotide
gacctcccagaatgacacattttgcttcaaagcttc

SEQ ID NO: 322238 - DNA, 37 bp, Artificial Sequence
  Description of Artificial Sequence: Synthetic oligonucleotide
acctcccagaatgacacattttgcttcaaagcttcag

SEQ ID NO: 322239 - DNA, 36 bp, Artificial Sequence
  Description of Artificial Sequence: Synthetic oligonucleotide
cctcccagaatgacacattttgcttcaaagcttcag

SEQ ID NO: 322240 - DNA, 36 bp, Artificial Sequence
  Description of Artificial Sequence: Synthetic oligonucleotide
ctcccagaatgacacattttgcttcaaagcttcagc

SEQ ID NO: 322241 - DNA, 37 bp, Artificial Sequence
  Description of Artificial Sequence: Synthetic oligonucleotide
tcccagaatgacacattttgcttcaaagcttcagctg

SEQ ID NO: 322242 - DNA, 36 bp, Artificial Sequence
  Description of Artificial Sequence: Synthetic oligonucleotide
cccagaatgacacattttgcttcaaagcttcagctg

SEQ ID NO: 322243 - DNA, 36 bp, Artificial Sequence
  Description of Artificial Sequence: Synthetic oligonucleotide
ccagaatgacacattttgcttcaaagcttcagctgc

SEQ ID NO: 322244 - DNA, 37 bp, Artificial Sequence
  Description of Artificial Sequence: Synthetic oligonucleotide
cagaatgacacattttgcttcaaagcttcagctgcac

SEQ ID NO: 322245 - DNA, 37 bp, Artificial Sequence
  Description of Artificial Sequence: Synthetic oligonucleotide
agaatgacacattttgcttcaaagcttcagctgcacc

SEQ ID NO: 322246 - DNA, 36 bp, Artificial Sequence
  Description of Artificial Sequence: Synthetic oligonucleotide
gaatgacacattttgcttcaaagcttcagctgcacc

SEQ ID NO: 322247 - DNA, 37 bp, Artificial Sequence
  Description of Artificial Sequence: Synthetic oligonucleotide
aatgacacattttgcttcaaagcttcagctgcacctg

SEQ ID NO: 322248 - DNA, 36 bp, Artificial Sequence
  Description of Artificial Sequence: Synthetic oligonucleotide
atgacacattttgcttcaaagcttcagctgcacctg

SEQ ID NO: 322249 - DNA, 35 bp, Artificial Sequence
  Description of Artificial Sequence: Synthetic oligonucleotide
tgacacattttgcttcaaagcttcagctgcacctg

SEQ ID NO: 322250 - DNA, 34 bp, Artificial Sequence
  Description of Artificial Sequence: Synthetic oligonucleotide
gacacattttgcttcaaagcttcagctgcacctg

SEQ ID NO: 322251 - DNA, 36 bp, Artificial Sequence
  Description of Artificial Sequence: Synthetic oligonucleotide
acacattttgcttcaaagcttcagctgcacctgaag

SEQ ID NO: 322252 - DNA, 35 bp, Artificial Sequence
  Description of Artificial Sequence: Synthetic oligonucleotide
cacattttgcttcaaagcttcagctgcacctgaag

SEQ ID NO: 322253 - DNA, 37 bp, Artificial Sequence
  Description of Artificial Sequence: Synthetic oligonucleotide
acattttgcttcaaagcttcagctgcacctgaagtag

SEQ ID NO: 322254 - DNA, 36 bp, Artificial Sequence
  Description of Artificial Sequence: Synthetic oligonucleotide
cattttgcttcaaagcttcagctgcacctgaagtag

SEQ ID NO: 322255 - DNA, 39 bp, Artificial Sequence
  Description of Artificial Sequence: Synthetic oligonucleotide
attttgcttcaaagcttcagctgcacctgaagtagattg

SEQ ID NO: 322256 - DNA, 38 bp, Artificial Sequence
  Description of Artificial Sequence: Synthetic oligonucleotide
ttttgcttcaaagcttcagctgcacctgaagtagattg

SEQ ID NO: 322257 - DNA, 37 bp, Artificial Sequence
  Description of Artificial Sequence: Synthetic oligonucleotide
tttgcttcaaagcttcagctgcacctgaagtagattg

SEQ ID NO: 322258 - DNA, 36 bp, Artificial Sequence
  Description of Artificial Sequence: Synthetic oligonucleotide
ttgcttcaaagcttcagctgcacctgaagtagattg

SEQ ID NO: 322259 - DNA, 35 bp, Artificial Sequence
  Description of Artificial Sequence: Synthetic oligonucleotide
tgcttcaaagcttcagctgcacctgaagtagattg

SEQ ID NO: 322260 - DNA, 34 bp, Artificial Sequence
  Description of Artificial Sequence: Synthetic oligonucleotide
gcttcaaagcttcagctgcacctgaagtagattg

SEQ ID NO: 322261 - DNA, 36 bp, Artificial Sequence
  Description of Artificial Sequence: Synthetic oligonucleotide
cttcaaagcttcagctgcacctgaagtagattgtac

SEQ ID NO: 322262 - DNA, 38 bp, Artificial Sequence
  Description of Artificial Sequence: Synthetic oligonucleotide
ttcaaagcttcagctgcacctgaagtagattgtacttc

SEQ ID NO: 322263 - DNA, 37 bp, Artificial Sequence
  Description of Artificial Sequence: Synthetic oligonucleotide
tcaaagcttcagctgcacctgaagtagattgtacttc

SEQ ID NO: 322264 - DNA, 36 bp, Artificial Sequence
  Description of Artificial Sequence: Synthetic oligonucleotide
caaagcttcagctgcacctgaagtagattgtacttc

SEQ ID NO: 322265 - DNA, 37 bp, Artificial Sequence
  Description of Artificial Sequence: Synthetic oligonucleotide
aaagcttcagctgcacctgaagtagattgtacttcag

SEQ ID NO: 322266 - DNA, 36 bp, Artificial Sequence
  Description of Artificial Sequence: Synthetic oligonucleotide
aagcttcagctgcacctgaagtagattgtacttcag

SEQ ID NO: 322267 - DNA, 35 bp, Artificial Sequence
  Description of Artificial Sequence: Synthetic oligonucleotide
agcttcagctgcacctgaagtagattgtacttcag

SEQ ID NO: 322268 - DNA, 34 bp, Artificial Sequence
  Description of Artificial Sequence: Synthetic oligonucleotide
gcttcagctgcacctgaagtagattgtacttcag

SEQ ID NO: 322269 - DNA, 35 bp, Artificial Sequence
  Description of Artificial Sequence: Synthetic oligonucleotide
cttcagctgcacctgaagtagattgtacttcagtc

SEQ ID NO: 322270 - DNA, 36 bp, Artificial Sequence
  Description of Artificial Sequence: Synthetic oligonucleotide
ttcagctgcacctgaagtagattgtacttcagtcac

SEQ ID NO: 322271 - DNA, 35 bp, Artificial Sequence
  Description of Artificial Sequence: Synthetic oligonucleotide
tcagctgcacctgaagtagattgtacttcagtcac

SEQ ID NO: 322272 - DNA, 34 bp, Artificial Sequence
  Description of Artificial Sequence: Synthetic oligonucleotide
cagctgcacctgaagtagattgtacttcagtcac

SEQ ID NO: 322273 - DNA, 35 bp, Artificial Sequence
  Description of Artificial Sequence: Synthetic oligonucleotide
agctgcacctgaagtagattgtacttcagtcacac

SEQ ID NO: 322274 - DNA, 34 bp, Artificial Sequence
  Description of Artificial Sequence: Synthetic oligonucleotide
gctgcacctgaagtagattgtacttcagtcacac

SEQ ID NO: 322275 - DNA, 35 bp, Artificial Sequence
  Description of Artificial Sequence: Synthetic oligonucleotide
ctgcacctgaagtagattgtacttcagtcacacac

SEQ ID NO: 322276 - DNA, 35 bp, Artificial Sequence
  Description of Artificial Sequence: Synthetic oligonucleotide
tgcacctgaagtagattgtacttcagtcacacacc

SEQ ID NO: 322277 - DNA, 34 bp, Artificial Sequence
  Description of Artificial Sequence: Synthetic oligonucleotide
gcacctgaagtagattgtacttcagtcacacacc

SEQ ID NO: 322278 - DNA, 35 bp, Artificial Sequence
  Description of Artificial Sequence: Synthetic oligonucleotide
cacctgaagtagattgtacttcagtcacacacctg

SEQ ID NO: 322279 - DNA, 35 bp, Artificial Sequence
  Description of Artificial Sequence: Synthetic oligonucleotide
acctgaagtagattgtacttcagtcacacacctgc

SEQ ID NO: 322280 - DNA, 34 bp, Artificial Sequence
  Description of Artificial Sequence: Synthetic oligonucleotide
cctgaagtagattgtacttcagtcacacacctgc

SEQ ID NO: 322281 - DNA, 34 bp, Artificial Sequence
  Description of Artificial Sequence: Synthetic oligonucleotide
ctgaagtagattgtacttcagtcacacacctgcc

SEQ ID NO: 322282 - DNA, 34 bp, Artificial Sequence
  Description of Artificial Sequence: Synthetic oligonucleotide
tgaagtagattgtacttcagtcacacacctgccc

SEQ ID NO: 322283 - DNA, 33 bp, Artificial Sequence
  Description of Artificial Sequence: Synthetic oligonucleotide
gaagtagattgtacttcagtcacacacctgccc

SEQ ID NO: 322284 - DNA, 36 bp, Artificial Sequence
  Description of Artificial Sequence: Synthetic oligonucleotide
aagtagattgtacttcagtcacacacctgcccattg

SEQ ID NO: 322285 - DNA, 35 bp, Artificial Sequence
  Description of Artificial Sequence: Synthetic oligonucleotide
agtagattgtacttcagtcacacacctgcccattg

SEQ ID NO: 322286 - DNA, 34 bp, Artificial Sequence
  Description of Artificial Sequence: Synthetic oligonucleotide
gtagattgtacttcagtcacacacctgcccattg

SEQ ID NO: 322287 - DNA, 34 bp, Artificial Sequence
  Description of Artificial Sequence: Synthetic oligonucleotide
tagattgtacttcagtcacacacctgcccattgc

SEQ ID NO: 322288 - DNA, 33 bp, Artificial Sequence
  Description of Artificial Sequence: Synthetic oligonucleotide
agattgtacttcagtcacacacctgcccattgc

SEQ ID NO: 322289 - DNA, 32 bp, Artificial Sequence
  Description of Artificial Sequence: Synthetic oligonucleotide
gattgtacttcagtcacacacctgcccattgc

SEQ ID NO: 322290 - DNA, 32 bp, Artificial Sequence
  Description of Artificial Sequence: Synthetic oligonucleotide
attgtacttcagtcacacacctgcccattgcc

SEQ ID NO: 322291 - DNA, 31 bp, Artificial Sequence
  Description of Artificial Sequence: Synthetic oligonucleotide
ttgtacttcagtcacacacctgcccattgcc

SEQ ID NO: 322292 - DNA, 30 bp, Artificial Sequence
  Description of Artificial Sequence: Synthetic oligonucleotide
tgtacttcagtcacacacctgcccattgcc

SEQ ID NO: 322293 - DNA, 29 bp, Artificial Sequence
  Description of Artificial Sequence: Synthetic oligonucleotide
gtacttcagtcacacacctgcccattgcc

SEQ ID NO: 322294 - DNA, 32 bp, Artificial Sequence
  Description of Artificial Sequence: Synthetic oligonucleotide
tacttcagtcacacacctgcccattgcctttg

SEQ ID NO: 322295 - DNA, 31 bp, Artificial Sequence
  Description of Artificial Sequence: Synthetic oligonucleotide
acttcagtcacacacctgcccattgcctttg

SEQ ID NO: 322296 - DNA, 30 bp, Artificial Sequence
  Description of Artificial Sequence: Synthetic oligonucleotide
cttcagtcacacacctgcccattgcctttg

SEQ ID NO: 322297 - DNA, 32 bp, Artificial Sequence
  Description of Artificial Sequence: Synthetic oligonucleotide
ttcagtcacacacctgcccattgcctttgaag

SEQ ID NO: 322298 - DNA, 31 bp, Artificial Sequence
  Description of Artificial Sequence: Synthetic oligonucleotide
tcagtcacacacctgcccattgcctttgaag

SEQ ID NO: 322299 - DNA, 30 bp, Artificial Sequence
  Description of Artificial Sequence: Synthetic oligonucleotide
cagtcacacacctgcccattgcctttgaag

SEQ ID NO: 322300 - DNA, 30 bp, Artificial Sequence
  Description of Artificial Sequence: Synthetic oligonucleotide
agtcacacacctgcccattgcctttgaagg

SEQ ID NO: 322301 - DNA, 29 bp, Artificial Sequence
  Description of Artificial Sequence: Synthetic oligonucleotide
gtcacacacctgcccattgcctttgaagg

SEQ ID NO: 322302 - DNA, 30 bp, Artificial Sequence
  Description of Artificial Sequence: Synthetic oligonucleotide
tcacacacctgcccattgcctttgaaggac

SEQ ID NO: 322303 - DNA, 29 bp, Artificial Sequence
  Description of Artificial Sequence: Synthetic oligonucleotide
cacacacctgcccattgcctttgaaggac

SEQ ID NO: 322304 - DNA, 29 bp, Artificial Sequence
  Description of Artificial Sequence: Synthetic oligonucleotide
acacacctgcccattgcctttgaaggacc

SEQ ID NO: 322305 - DNA, 28 bp, Artificial Sequence
  Description of Artificial Sequence: Synthetic oligonucleotide
cacacctgcccattgcctttgaaggacc

SEQ ID NO: 322306 - DNA, 33 bp, Artificial Sequence
  Description of Artificial Sequence: Synthetic oligonucleotide
acacctgcccattgcctttgaaggaccaatttc

SEQ ID NO: 322307 - DNA, 32 bp, Artificial Sequence
  Description of Artificial Sequence: Synthetic oligonucleotide
cacctgcccattgcctttgaaggaccaatttc

SEQ ID NO: 322308 - DNA, 32 bp, Artificial Sequence
  Description of Artificial Sequence: Synthetic oligonucleotide
acctgcccattgcctttgaaggaccaatttcc

SEQ ID NO: 322309 - DNA, 31 bp, Artificial Sequence
  Description of Artificial Sequence: Synthetic oligonucleotide
cctgcccattgcctttgaaggaccaatttcc

SEQ ID NO: 322310 - DNA, 35 bp, Artificial Sequence
  Description of Artificial Sequence: Synthetic oligonucleotide
ctgcccattgcctttgaaggaccaatttccataac

SEQ ID NO: 322311 - DNA, 39 bp, Artificial Sequence
  Description of Artificial Sequence: Synthetic oligonucleotide
tgcccattgcctttgaaggaccaatttccataactaatg

SEQ ID NO: 322312 - DNA, 38 bp, Artificial Sequence
  Description of Artificial Sequence: Synthetic oligonucleotide
gcccattgcctttgaaggaccaatttccataactaatg

SEQ ID NO: 322313 - DNA, 42 bp, Artificial Sequence
  Description of Artificial Sequence: Synthetic oligonucleotide
cccattgcctttgaaggaccaatttccataactaatgttaac

SEQ ID NO: 322314 - DNA, 42 bp, Artificial Sequence
  Description of Artificial Sequence: Synthetic oligonucleotide
ccattgcctttgaaggaccaatttccataactaatgttaacc

SEQ ID NO: 322315 - DNA, 42 bp, Artificial Sequence
  Description of Artificial Sequence: Synthetic oligonucleotide
cattgcctttgaaggaccaatttccataactaatgttaaccg

SEQ ID NO: 322316 - DNA, 43 bp, Artificial Sequence
  Description of Artificial Sequence: Synthetic oligonucleotide
attgcctttgaaggaccaatttccataactaatgttaaccgag

SEQ ID NO: 322317 - DNA, 42 bp, Artificial Sequence
  Description of Artificial Sequence: Synthetic oligonucleotide
ttgcctttgaaggaccaatttccataactaatgttaaccgag

SEQ ID NO: 322318 - DNA, 41 bp, Artificial Sequence
  Description of Artificial Sequence: Synthetic oligonucleotide
tgcctttgaaggaccaatttccataactaatgttaaccgag

SEQ ID NO: 322319 - DNA, 40 bp, Artificial Sequence
  Description of Artificial Sequence: Synthetic oligonucleotide
gcctttgaaggaccaatttccataactaatgttaaccgag

SEQ ID NO: 322320 - DNA, 42 bp, Artificial Sequence
  Description of Artificial Sequence: Synthetic oligonucleotide
cctttgaaggaccaatttccataactaatgttaaccgagatg

SEQ ID NO: 322321 - DNA, 42 bp, Artificial Sequence
  Description of Artificial Sequence: Synthetic oligonucleotide
ctttgaaggaccaatttccataactaatgttaaccgagatgg

SEQ ID NO: 322322 - DNA, 42 bp, Artificial Sequence
  Description of Artificial Sequence: Synthetic oligonucleotide
tttgaaggaccaatttccataactaatgttaaccgagatggc

SEQ ID NO: 322323 - DNA, 41 bp, Artificial Sequence
  Description of Artificial Sequence: Synthetic oligonucleotide
ttgaaggaccaatttccataactaatgttaaccgagatggc

SEQ ID NO: 322324 - DNA, 40 bp, Artificial Sequence
  Description of Artificial Sequence: Synthetic oligonucleotide
tgaaggaccaatttccataactaatgttaaccgagatggc

SEQ ID NO: 322325 - DNA, 39 bp, Artificial Sequence
  Description of Artificial Sequence: Synthetic oligonucleotide
gaaggaccaatttccataactaatgttaaccgagatggc

SEQ ID NO: 322326 - DNA, 40 bp, Artificial Sequence
  Description of Artificial Sequence: Synthetic oligonucleotide
aaggaccaatttccataactaatgttaaccgagatggcac

SEQ ID NO: 322327 - DNA, 39 bp, Artificial Sequence
  Description of Artificial Sequence: Synthetic oligonucleotide
aggaccaatttccataactaatgttaaccgagatggcac

SEQ ID NO: 322328 - DNA, 38 bp, Artificial Sequence
  Description of Artificial Sequence: Synthetic oligonucleotide
ggaccaatttccataactaatgttaaccgagatggcac

SEQ ID NO: 322329 - DNA, 38 bp, Artificial Sequence
  Description of Artificial Sequence: Synthetic oligonucleotide
gaccaatttccataactaatgttaaccgagatggcacc

SEQ ID NO: 322330 - DNA, 38 bp, Artificial Sequence
  Description of Artificial Sequence: Synthetic oligonucleotide
accaatttccataactaatgttaaccgagatggcaccg

SEQ ID NO: 322331 - DNA, 37 bp, Artificial Sequence
  Description of Artificial Sequence: Synthetic oligonucleotide
ccaatttccataactaatgttaaccgagatggcaccg

SEQ ID NO: 322332 - DNA, 37 bp, Artificial Sequence
  Description of Artificial Sequence: Synthetic oligonucleotide
caatttccataactaatgttaaccgagatggcaccgg

SEQ ID NO: 322333 - DNA, 37 bp, Artificial Sequence
  Description of Artificial Sequence: Synthetic oligonucleotide
aatttccataactaatgttaaccgagatggcaccggc

SEQ ID NO: 322334 - DNA, 36 bp, Artificial Sequence
  Description of Artificial Sequence: Synthetic oligonucleotide
atttccataactaatgttaaccgagatggcaccggc

SEQ ID NO: 322335 - DNA, 35 bp, Artificial Sequence
  Description of Artificial Sequence: Synthetic oligonucleotide
tttccataactaatgttaaccgagatggcaccggc

SEQ ID NO: 322336 - DNA, 34 bp, Artificial Sequence
  Description of Artificial Sequence: Synthetic oligonucleotide
ttccataactaatgttaaccgagatggcaccggc

SEQ ID NO: 322337 - DNA, 33 bp, Artificial Sequence
  Description of Artificial Sequence: Synthetic oligonucleotide
tccataactaatgttaaccgagatggcaccggc

SEQ ID NO: 322338 - DNA, 32 bp, Artificial Sequence
  Description of Artificial Sequence: Synthetic oligonucleotide
ccataactaatgttaaccgagatggcaccggc

SEQ ID NO: 322339 - DNA, 35 bp, Artificial Sequence
  Description of Artificial Sequence: Synthetic oligonucleotide
cataactaatgttaaccgagatggcaccggctatg

SEQ ID NO: 322340 - DNA, 36 bp, Artificial Sequence
  Description of Artificial Sequence: Synthetic oligonucleotide
ataactaatgttaaccgagatggcaccggctatgtc

SEQ ID NO: 322341 - DNA, 35 bp, Artificial Sequence
  Description of Artificial Sequence: Synthetic oligonucleotide
taactaatgttaaccgagatggcaccggctatgtc

SEQ ID NO: 322342 - DNA, 34 bp, Artificial Sequence
  Description of Artificial Sequence: Synthetic oligonucleotide
aactaatgttaaccgagatggcaccggctatgtc

SEQ ID NO: 322343 - DNA, 33 bp, Artificial Sequence
  Description of Artificial Sequence: Synthetic oligonucleotide
actaatgttaaccgagatggcaccggctatgtc

SEQ ID NO: 322344 - DNA, 32 bp, Artificial Sequence
  Description of Artificial Sequence: Synthetic oligonucleotide
ctaatgttaaccgagatggcaccggctatgtc

SEQ ID NO: 322345 - DNA, 32 bp, Artificial Sequence
  Description of Artificial Sequence: Synthetic oligonucleotide
taatgttaaccgagatggcaccggctatgtcc

SEQ ID NO: 322346 - DNA, 31 bp, Artificial Sequence
  Description of Artificial Sequence: Synthetic oligonucleotide
aatgttaaccgagatggcaccggctatgtcc

SEQ ID NO: 322347 - DNA, 30 bp, Artificial Sequence
  Description of Artificial Sequence: Synthetic oligonucleotide
atgttaaccgagatggcaccggctatgtcc

SEQ ID NO: 322348 - DNA, 29 bp, Artificial Sequence
  Description of Artificial Sequence: Synthetic oligonucleotide
tgttaaccgagatggcaccggctatgtcc

SEQ ID NO: 322349 - DNA, 28 bp, Artificial Sequence
  Description of Artificial Sequence: Synthetic oligonucleotide
gttaaccgagatggcaccggctatgtcc

SEQ ID NO: 322350 - DNA, 29 bp, Artificial Sequence
  Description of Artificial Sequence: Synthetic oligonucleotide
ttaaccgagatggcaccggctatgtcctg

SEQ ID NO: 322351 - DNA, 28 bp, Artificial Sequence
  Description of Artificial Sequence: Synthetic oligonucleotide
taaccgagatggcaccggctatgtcctg

SEQ ID NO: 322352 - DNA, 27 bp, Artificial Sequence
  Description of Artificial Sequence: Synthetic oligonucleotide
aaccgagatggcaccggctatgtcctg

SEQ ID NO: 322353 - DNA, 27 bp, Artificial Sequence
  Description of Artificial Sequence: Synthetic oligonucleotide
accgagatggcaccggctatgtcctga

SEQ ID NO: 322354 - DNA, 27 bp, Artificial Sequence
  Description of Artificial Sequence: Synthetic oligonucleotide
ccgagatggcaccggctatgtcctgaa

SEQ ID NO: 322355 - DNA, 28 bp, Artificial Sequence
  Description of Artificial Sequence: Synthetic oligonucleotide
cgagatggcaccggctatgtcctgaaag

SEQ ID NO: 322356 - DNA, 28 bp, Artificial Sequence
  Description of Artificial Sequence: Synthetic oligonucleotide
gagatggcaccggctatgtcctgaaagg

SEQ ID NO: 322357 - DNA, 29 bp, Artificial Sequence
  Description of Artificial Sequence: Synthetic oligonucleotide
agatggcaccggctatgtcctgaaaggag

SEQ ID NO: 322358 - DNA, 28 bp, Artificial Sequence
  Description of Artificial Sequence: Synthetic oligonucleotide
gatggcaccggctatgtcctgaaaggag

SEQ ID NO: 322359 - DNA, 32 bp, Artificial Sequence
  Description of Artificial Sequence: Synthetic oligonucleotide
atggcaccggctatgtcctgaaaggagattac

SEQ ID NO: 322360 - DNA, 31 bp, Artificial Sequence
  Description of Artificial Sequence: Synthetic oligonucleotide
tggcaccggctatgtcctgaaaggagattac

SEQ ID NO: 322361 - DNA, 30 bp, Artificial Sequence
  Description of Artificial Sequence: Synthetic oligonucleotide
ggcaccggctatgtcctgaaaggagattac

SEQ ID NO: 322362 - DNA, 31 bp, Artificial Sequence
  Description of Artificial Sequence: Synthetic oligonucleotide
gcaccggctatgtcctgaaaggagattacag

SEQ ID NO: 322363 - DNA, 33 bp, Artificial Sequence
  Description of Artificial Sequence: Synthetic oligonucleotide
caccggctatgtcctgaaaggagattacagaac

SEQ ID NO: 322364 - DNA, 33 bp, Artificial Sequence
  Description of Artificial Sequence: Synthetic oligonucleotide
accggctatgtcctgaaaggagattacagaacg

SEQ ID NO: 322365 - DNA, 32 bp, Artificial Sequence
  Description of Artificial Sequence: Synthetic oligonucleotide
ccggctatgtcctgaaaggagattacagaacg

SEQ ID NO: 322366 - DNA, 35 bp, Artificial Sequence
  Description of Artificial Sequence: Synthetic oligonucleotide
cggctatgtcctgaaaggagattacagaacgtatc

SEQ ID NO: 322367 - DNA, 35 bp, Artificial Sequence
  Description of Artificial Sequence: Synthetic oligonucleotide
ggctatgtcctgaaaggagattacagaacgtatcc

SEQ ID NO: 322368 - DNA, 36 bp, Artificial Sequence
  Description of Artificial Sequence: Synthetic oligonucleotide
gctatgtcctgaaaggagattacagaacgtatcctg

SEQ ID NO: 322369 - DNA, 38 bp, Artificial Sequence
  Description of Artificial Sequence: Synthetic oligonucleotide
ctatgtcctgaaaggagattacagaacgtatcctgaag

SEQ ID NO: 322370 - DNA, 39 bp, Artificial Sequence
  Description of Artificial Sequence: Synthetic oligonucleotide
tatgtcctgaaaggagattacagaacgtatcctgaagtc

SEQ ID NO: 322371 - DNA, 38 bp, Artificial Sequence
  Description of Artificial Sequence: Synthetic oligonucleotide
atgtcctgaaaggagattacagaacgtatcctgaagtc

SEQ ID NO: 322372 - DNA, 37 bp, Artificial Sequence
  Description of Artificial Sequence: Synthetic oligonucleotide
tgtcctgaaaggagattacagaacgtatcctgaagtc

SEQ ID NO: 322373 - DNA, 36 bp, Artificial Sequence
  Description of Artificial Sequence: Synthetic oligonucleotide
gtcctgaaaggagattacagaacgtatcctgaagtc

SEQ ID NO: 322374 - DNA, 38 bp, Artificial Sequence
  Description of Artificial Sequence: Synthetic oligonucleotide
tcctgaaaggagattacagaacgtatcctgaagtcatc

SEQ ID NO: 322375 - DNA, 37 bp, Artificial Sequence
  Description of Artificial Sequence: Synthetic oligonucleotide
cctgaaaggagattacagaacgtatcctgaagtcatc

SEQ ID NO: 322376 - DNA, 39 bp, Artificial Sequence
  Description of Artificial Sequence: Synthetic oligonucleotide
ctgaaaggagattacagaacgtatcctgaagtcatctac

SEQ ID NO: 322377 - DNA, 39 bp, Artificial Sequence
  Description of Artificial Sequence: Synthetic oligonucleotide
tgaaaggagattacagaacgtatcctgaagtcatctacc

SEQ ID NO: 322378 - DNA, 38 bp, Artificial Sequence
  Description of Artificial Sequence: Synthetic oligonucleotide
gaaaggagattacagaacgtatcctgaagtcatctacc

SEQ ID NO: 322379 - DNA, 38 bp, Artificial Sequence
  Description of Artificial Sequence: Synthetic oligonucleotide
aaaggagattacagaacgtatcctgaagtcatctaccc

SEQ ID NO: 322380 - DNA, 37 bp, Artificial Sequence
  Description of Artificial Sequence: Synthetic oligonucleotide
aaggagattacagaacgtatcctgaagtcatctaccc

SEQ ID NO: 322381 - DNA, 36 bp, Artificial Sequence
  Description of Artificial Sequence: Synthetic oligonucleotide
aggagattacagaacgtatcctgaagtcatctaccc

SEQ ID NO: 322382 - DNA, 35 bp, Artificial Sequence
  Description of Artificial Sequence: Synthetic oligonucleotide
ggagattacagaacgtatcctgaagtcatctaccc

SEQ ID NO: 322383 - DNA, 35 bp, Artificial Sequence
  Description of Artificial Sequence: Synthetic oligonucleotide
gagattacagaacgtatcctgaagtcatctacccg

SEQ ID NO: 322384 - DNA, 36 bp, Artificial Sequence
  Description of Artificial Sequence: Synthetic oligonucleotide
agattacagaacgtatcctgaagtcatctacccgag

SEQ ID NO: 322385 - DNA, 35 bp, Artificial Sequence
  Description of Artificial Sequence: Synthetic oligonucleotide
gattacagaacgtatcctgaagtcatctacccgag

SEQ ID NO: 322386 - DNA, 35 bp, Artificial Sequence
  Description of Artificial Sequence: Synthetic oligonucleotide
attacagaacgtatcctgaagtcatctacccgagc

SEQ ID NO: 322387 - DNA, 34 bp, Artificial Sequence
  Description of Artificial Sequence: Synthetic oligonucleotide
ttacagaacgtatcctgaagtcatctacccgagc

SEQ ID NO: 322388 - DNA, 33 bp, Artificial Sequence
  Description of Artificial Sequence: Synthetic oligonucleotide
tacagaacgtatcctgaagtcatctacccgagc

SEQ ID NO: 322389 - DNA, 32 bp, Artificial Sequence
  Description of Artificial Sequence: Synthetic oligonucleotide
acagaacgtatcctgaagtcatctacccgagc

SEQ ID NO: 322390 - DNA, 31 bp, Artificial Sequence
  Description of Artificial Sequence: Synthetic oligonucleotide
cagaacgtatcctgaagtcatctacccgagc

SEQ ID NO: 322391 - DNA, 33 bp, Artificial Sequence
  Description of Artificial Sequence: Synthetic oligonucleotide
agaacgtatcctgaagtcatctacccgagcaac

SEQ ID NO: 322392 - DNA, 32 bp, Artificial Sequence
  Description of Artificial Sequence: Synthetic oligonucleotide
gaacgtatcctgaagtcatctacccgagcaac

SEQ ID NO: 322393 - DNA, 32 bp, Artificial Sequence
  Description of Artificial Sequence: Synthetic oligonucleotide
aacgtatcctgaagtcatctacccgagcaacc

SEQ ID NO: 322394 - DNA, 31 bp, Artificial Sequence
  Description of Artificial Sequence: Synthetic oligonucleotide
acgtatcctgaagtcatctacccgagcaacc

SEQ ID NO: 322395 - DNA, 30 bp, Artificial Sequence
  Description of Artificial Sequence: Synthetic oligonucleotide
cgtatcctgaagtcatctacccgagcaacc

SEQ ID NO: 322396 - DNA, 30 bp, Artificial Sequence
  Description of Artificial Sequence: Synthetic oligonucleotide
gtatcctgaagtcatctacccgagcaaccc

SEQ ID NO: 322397 - DNA, 32 bp, Artificial Sequence
  Description of Artificial Sequence: Synthetic oligonucleotide
tatcctgaagtcatctacccgagcaacccttc

SEQ ID NO: 322398 - DNA, 31 bp, Artificial Sequence
  Description of Artificial Sequence: Synthetic oligonucleotide
atcctgaagtcatctacccgagcaacccttc

SEQ ID NO: 322399 - DNA, 30 bp, Artificial Sequence
  Description of Artificial Sequence: Synthetic oligonucleotide
tcctgaagtcatctacccgagcaacccttc

SEQ ID NO: 322400 - DNA, 29 bp, Artificial Sequence
  Description of Artificial Sequence: Synthetic oligonucleotide
cctgaagtcatctacccgagcaacccttc

SEQ ID NO: 322401 - DNA, 30 bp, Artificial Sequence
  Description of Artificial Sequence: Synthetic oligonucleotide
ctgaagtcatctacccgagcaacccttctg

SEQ ID NO: 322402 - DNA, 32 bp, Artificial Sequence
  Description of Artificial Sequence: Synthetic oligonucleotide
tgaagtcatctacccgagcaacccttctgatg

SEQ ID NO: 322403 - DNA, 31 bp, Artificial Sequence
  Description of Artificial Sequence: Synthetic oligonucleotide
gaagtcatctacccgagcaacccttctgatg

SEQ ID NO: 322404 - DNA, 33 bp, Artificial Sequence
  Description of Artificial Sequence: Synthetic oligonucleotide
aagtcatctacccgagcaacccttctgatgatg

SEQ ID NO: 322405 - DNA, 32 bp, Artificial Sequence
  Description of Artificial Sequence: Synthetic oligonucleotide
agtcatctacccgagcaacccttctgatgatg

SEQ ID NO: 322406 - DNA, 31 bp, Artificial Sequence
  Description of Artificial Sequence: Synthetic oligonucleotide
gtcatctacccgagcaacccttctgatgatg

SEQ ID NO: 322407 - DNA, 32 bp, Artificial Sequence
  Description of Artificial Sequence: Synthetic oligonucleotide
tcatctacccgagcaacccttctgatgatgtc

SEQ ID NO: 322408 - DNA, 31 bp, Artificial Sequence
  Description of Artificial Sequence: Synthetic oligonucleotide
catctacccgagcaacccttctgatgatgtc

SEQ ID NO: 322409 - DNA, 31 bp, Artificial Sequence
  Description of Artificial Sequence: Synthetic oligonucleotide
atctacccgagcaacccttctgatgatgtcg

SEQ ID NO: 322410 - DNA, 30 bp, Artificial Sequence
  Description of Artificial Sequence: Synthetic oligonucleotide
tctacccgagcaacccttctgatgatgtcg

SEQ ID NO: 322411 - DNA, 29 bp, Artificial Sequence
  Description of Artificial Sequence: Synthetic oligonucleotide
ctacccgagcaacccttctgatgatgtcg

SEQ ID NO: 322412 - DNA, 30 bp, Artificial Sequence
  Description of Artificial Sequence: Synthetic oligonucleotide
tacccgagcaacccttctgatgatgtcgtg

SEQ ID NO: 322413 - DNA, 29 bp, Artificial Sequence
  Description of Artificial Sequence: Synthetic oligonucleotide
acccgagcaacccttctgatgatgtcgtg

SEQ ID NO: 322414 - DNA, 28 bp, Artificial Sequence
  Description of Artificial Sequence: Synthetic oligonucleotide
cccgagcaacccttctgatgatgtcgtg

SEQ ID NO: 322415 - DNA, 29 bp, Artificial Sequence
  Description of Artificial Sequence: Synthetic oligonucleotide
ccgagcaacccttctgatgatgtcgtgag

SEQ ID NO: 322416 - DNA, 29 bp, Artificial Sequence
  Description of Artificial Sequence: Synthetic oligonucleotide
cgagcaacccttctgatgatgtcgtgagc

SEQ ID NO: 322417 - DNA, 30 bp, Artificial Sequence
  Description of Artificial Sequence: Synthetic oligonucleotide
gagcaacccttctgatgatgtcgtgagcag

SEQ ID NO: 322418 - DNA, 30 bp, Artificial Sequence
  Description of Artificial Sequence: Synthetic oligonucleotide
agcaacccttctgatgatgtcgtgagcagg

SEQ ID NO: 322419 - DNA, 29 bp, Artificial Sequence
  Description of Artificial Sequence: Synthetic oligonucleotide
gcaacccttctgatgatgtcgtgagcagg

SEQ ID NO: 322420 - DNA, 29 bp, Artificial Sequence
  Description of Artificial Sequence: Synthetic oligonucleotide
caacccttctgatgatgtcgtgagcaggg

SEQ ID NO: 322421 - DNA, 29 bp, Artificial Sequence
  Description of Artificial Sequence: Synthetic oligonucleotide
aacccttctgatgatgtcgtgagcagggg

SEQ ID NO: 322422 - DNA, 28 bp, Artificial Sequence
  Description of Artificial Sequence: Synthetic oligonucleotide
acccttctgatgatgtcgtgagcagggg

SEQ ID NO: 322423 - DNA, 27 bp, Artificial Sequence
  Description of Artificial Sequence: Synthetic oligonucleotide
cccttctgatgatgtcgtgagcagggg

SEQ ID NO: 322424 - DNA, 27 bp, Artificial Sequence
  Description of Artificial Sequence: Synthetic oligonucleotide
ccttctgatgatgtcgtgagcaggggc

SEQ ID NO: 322425 - DNA, 28 bp, Artificial Sequence
  Description of Artificial Sequence: Synthetic oligonucleotide
cttctgatgatgtcgtgagcaggggctc

SEQ ID NO: 322426 - DNA, 28 bp, Artificial Sequence
  Description of Artificial Sequence: Synthetic oligonucleotide
ttctgatgatgtcgtgagcaggggctcc

SEQ ID NO: 322427 - DNA, 27 bp, Artificial Sequence
  Description of Artificial Sequence: Synthetic oligonucleotide
tctgatgatgtcgtgagcaggggctcc

SEQ ID NO: 322428 - DNA, 27 bp, Artificial Sequence
  Description of Artificial Sequence: Synthetic oligonucleotide
ctgatgatgtcgtgagcaggggctcct

SEQ ID NO: 322429 - DNA, 27 bp, Artificial Sequence
  Description of Artificial Sequence: Synthetic oligonucleotide
tgatgatgtcgtgagcaggggctcctc

SEQ ID NO: 322430 - DNA, 26 bp, Artificial Sequence
  Description of Artificial Sequence: Synthetic oligonucleotide
gatgatgtcgtgagcaggggctcctc

SEQ ID NO: 322431 - DNA, 27 bp, Artificial Sequence
  Description of Artificial Sequence: Synthetic oligonucleotide
atgatgtcgtgagcaggggctcctcct

SEQ ID NO: 322432 - DNA, 26 bp, Artificial Sequence
  Description of Artificial Sequence: Synthetic oligonucleotide
tgatgtcgtgagcaggggctcctcct

SEQ ID NO: 322433 - DNA, 25 bp, Artificial Sequence
  Description of Artificial Sequence: Synthetic oligonucleotide
gatgtcgtgagcaggggctcctcct

SEQ ID NO: 322434 - DNA, 26 bp, Artificial Sequence
  Description of Artificial Sequence: Synthetic oligonucleotide
atgtcgtgagcaggggctcctcctgt

SEQ ID NO: 322435 - DNA, 25 bp, Artificial Sequence
  Description of Artificial Sequence: Synthetic oligonucleotide
tgtcgtgagcaggggctcctcctgt

SEQ ID NO: 322436 - DNA, 24 bp, Artificial Sequence
  Description of Artificial Sequence: Synthetic oligonucleotide
gtcgtgagcaggggctcctcctgt

SEQ ID NO: 322437 - DNA, 27 bp, Artificial Sequence
  Description of Artificial Sequence: Synthetic oligonucleotide
tcgtgagcaggggctcctcctgtgaaa

SEQ ID NO: 322438 - DNA, 26 bp, Artificial Sequence
  Description of Artificial Sequence: Synthetic oligonucleotide
cgtgagcaggggctcctcctgtgaaa

SEQ ID NO: 322439 - DNA, 26 bp, Artificial Sequence
  Description of Artificial Sequence: Synthetic oligonucleotide
gtgagcaggggctcctcctgtgaaag

SEQ ID NO: 322440 - DNA, 27 bp, Artificial Sequence
  Description of Artificial Sequence: Synthetic oligonucleotide
tgagcaggggctcctcctgtgaaagga

SEQ ID NO: 322441 - DNA, 26 bp, Artificial Sequence
  Description of Artificial Sequence: Synthetic oligonucleotide
gagcaggggctcctcctgtgaaagga

SEQ ID NO: 322442 - DNA, 26 bp, Artificial Sequence
  Description of Artificial Sequence: Synthetic oligonucleotide
agcaggggctcctcctgtgaaaggac

SEQ ID NO: 322443 - DNA, 25 bp, Artificial Sequence
  Description of Artificial Sequence: Synthetic oligonucleotide
gcaggggctcctcctgtgaaaggac

SEQ ID NO: 322444 - DNA, 26 bp, Artificial Sequence
  Description of Artificial Sequence: Synthetic oligonucleotide
caggggctcctcctgtgaaaggacca

SEQ ID NO: 322445 - DNA, 26 bp, Artificial Sequence
  Description of Artificial Sequence: Synthetic oligonucleotide
aggggctcctcctgtgaaaggaccag

SEQ ID NO: 322446 - DNA, 25 bp, Artificial Sequence
  Description of Artificial Sequence: Synthetic oligonucleotide
ggggctcctcctgtgaaaggaccag

SEQ ID NO: 322447 - DNA, 26 bp, Artificial Sequence
  Description of Artificial Sequence: Synthetic oligonucleotide
gggctcctcctgtgaaaggaccagca

SEQ ID NO: 322448 - DNA, 27 bp, Artificial Sequence
  Description of Artificial Sequence: Synthetic oligonucleotide
ggctcctcctgtgaaaggaccagcact

SEQ ID NO: 322449 - DNA, 28 bp, Artificial Sequence
  Description of Artificial Sequence: Synthetic oligonucleotide
gctcctcctgtgaaaggaccagcacttc

SEQ ID NO: 322450 - DNA, 29 bp, Artificial Sequence
  Description of Artificial Sequence: Synthetic oligonucleotide
ctcctcctgtgaaaggaccagcacttctg

SEQ ID NO: 322451 - DNA, 29 bp, Artificial Sequence
  Description of Artificial Sequence: Synthetic oligonucleotide
tcctcctgtgaaaggaccagcacttctgg

SEQ ID NO: 322452 - DNA, 28 bp, Artificial Sequence
  Description of Artificial Sequence: Synthetic oligonucleotide
cctcctgtgaaaggaccagcacttctgg

SEQ ID NO: 322453 - DNA, 29 bp, Artificial Sequence
  Description of Artificial Sequence: Synthetic oligonucleotide
ctcctgtgaaaggaccagcacttctggag

SEQ ID NO: 322454 - DNA, 29 bp, Artificial Sequence
  Description of Artificial Sequence: Synthetic oligonucleotide
tcctgtgaaaggaccagcacttctggagg

SEQ ID NO: 322455 - DNA, 28 bp, Artificial Sequence
  Description of Artificial Sequence: Synthetic oligonucleotide
cctgtgaaaggaccagcacttctggagg

SEQ ID NO: 322456 - DNA, 31 bp, Artificial Sequence
  Description of Artificial Sequence: Synthetic oligonucleotide
ctgtgaaaggaccagcacttctggaggttac

SEQ ID NO: 322457 - DNA, 33 bp, Artificial Sequence
  Description of Artificial Sequence: Synthetic oligonucleotide
tgtgaaaggaccagcacttctggaggttacttc

SEQ ID NO: 322458 - DNA, 32 bp, Artificial Sequence
  Description of Artificial Sequence: Synthetic oligonucleotide
gtgaaaggaccagcacttctggaggttacttc

SEQ ID NO: 322459 - DNA, 37 bp, Artificial Sequence
  Description of Artificial Sequence: Synthetic oligonucleotide
tgaaaggaccagcacttctggaggttacttcttttac

SEQ ID NO: 322460 - DNA, 36 bp, Artificial Sequence
  Description of Artificial Sequence: Synthetic oligonucleotide
gaaaggaccagcacttctggaggttacttcttttac

SEQ ID NO: 322461 - DNA, 37 bp, Artificial Sequence
  Description of Artificial Sequence: Synthetic oligonucleotide
aaaggaccagcacttctggaggttacttcttttacag

SEQ ID NO: 322462 - DNA, 36 bp, Artificial Sequence
  Description of Artificial Sequence: Synthetic oligonucleotide
aaggaccagcacttctggaggttacttcttttacag

SEQ ID NO: 322463 - DNA, 35 bp, Artificial Sequence
  Description of Artificial Sequence: Synthetic oligonucleotide
aggaccagcacttctggaggttacttcttttacag

SEQ ID NO: 322464 - DNA, 34 bp, Artificial Sequence
  Description of Artificial Sequence: Synthetic oligonucleotide
ggaccagcacttctggaggttacttcttttacag

SEQ ID NO: 322465 - DNA, 34 bp, Artificial Sequence
  Description of Artificial Sequence: Synthetic oligonucleotide
gaccagcacttctggaggttacttcttttacagc

SEQ ID NO: 322466 - DNA, 38 bp, Artificial Sequence
  Description of Artificial Sequence: Synthetic oligonucleotide
accagcacttctggaggttacttcttttacagcttttc

SEQ ID NO: 322467 - DNA, 37 bp, Artificial Sequence
  Description of Artificial Sequence: Synthetic oligonucleotide
ccagcacttctggaggttacttcttttacagcttttc

SEQ ID NO: 322468 - DNA, 39 bp, Artificial Sequence
  Description of Artificial Sequence: Synthetic oligonucleotide
cagcacttctggaggttacttcttttacagcttttctac

SEQ ID NO: 322469 - DNA, 40 bp, Artificial Sequence
  Description of Artificial Sequence: Synthetic oligonucleotide
agcacttctggaggttacttcttttacagcttttctacag

SEQ ID NO: 322470 - DNA, 39 bp, Artificial Sequence
  Description of Artificial Sequence: Synthetic oligonucleotide
gcacttctggaggttacttcttttacagcttttctacag

SEQ ID NO: 322471 - DNA, 41 bp, Artificial Sequence
  Description of Artificial Sequence: Synthetic oligonucleotide
cacttctggaggttacttcttttacagcttttctacagtac

SEQ ID NO: 322472 - DNA, 42 bp, Artificial Sequence
  Description of Artificial Sequence: Synthetic oligonucleotide
acttctggaggttacttcttttacagcttttctacagtacac

SEQ ID NO: 322473 - DNA, 41 bp, Artificial Sequence
  Description of Artificial Sequence: Synthetic oligonucleotide
cttctggaggttacttcttttacagcttttctacagtacac

SEQ ID NO: 322474 - DNA, 41 bp, Artificial Sequence
  Description of Artificial Sequence: Synthetic oligonucleotide
ttctggaggttacttcttttacagcttttctacagtacacc

SEQ ID NO: 322475 - DNA, 40 bp, Artificial Sequence
  Description of Artificial Sequence: Synthetic oligonucleotide
tctggaggttacttcttttacagcttttctacagtacacc

SEQ ID NO: 322476 - DNA, 39 bp, Artificial Sequence
  Description of Artificial Sequence: Synthetic oligonucleotide
ctggaggttacttcttttacagcttttctacagtacacc

SEQ ID NO: 322477 - DNA, 39 bp, Artificial Sequence
  Description of Artificial Sequence: Synthetic oligonucleotide
tggaggttacttcttttacagcttttctacagtacaccc

SEQ ID NO: 322478 - DNA, 38 bp, Artificial Sequence
  Description of Artificial Sequence: Synthetic oligonucleotide
ggaggttacttcttttacagcttttctacagtacaccc

SEQ ID NO: 322479 - DNA, 38 bp, Artificial Sequence
  Description of Artificial Sequence: Synthetic oligonucleotide
gaggttacttcttttacagcttttctacagtacacccc

SEQ ID NO: 322480 - DNA, 40 bp, Artificial Sequence
  Description of Artificial Sequence: Synthetic oligonucleotide
aggttacttcttttacagcttttctacagtacaccccttc

SEQ ID NO: 322481 - DNA, 39 bp, Artificial Sequence
  Description of Artificial Sequence: Synthetic oligonucleotide
ggttacttcttttacagcttttctacagtacaccccttc

SEQ ID NO: 322482 - DNA, 39 bp, Artificial Sequence
  Description of Artificial Sequence: Synthetic oligonucleotide
gttacttcttttacagcttttctacagtacaccccttcc

SEQ ID NO: 322483 - DNA, 39 bp, Artificial Sequence
  Description of Artificial Sequence: Synthetic oligonucleotide
ttacttcttttacagcttttctacagtacaccccttccc

SEQ ID NO: 322484 - DNA, 38 bp, Artificial Sequence
  Description of Artificial Sequence: Synthetic oligonucleotide
tacttcttttacagcttttctacagtacaccccttccc

SEQ ID NO: 322485 - DNA, 37 bp, Artificial Sequence
  Description of Artificial Sequence: Synthetic oligonucleotide
acttcttttacagcttttctacagtacaccccttccc

SEQ ID NO: 322486 - DNA, 36 bp, Artificial Sequence
  Description of Artificial Sequence: Synthetic oligonucleotide
cttcttttacagcttttctacagtacaccccttccc

SEQ ID NO: 322487 - DNA, 37 bp, Artificial Sequence
  Description of Artificial Sequence: Synthetic oligonucleotide
ttcttttacagcttttctacagtacaccccttcccag

SEQ ID NO: 322488 - DNA, 36 bp, Artificial Sequence
  Description of Artificial Sequence: Synthetic oligonucleotide
tcttttacagcttttctacagtacaccccttcccag

SEQ ID NO: 322489 - DNA, 35 bp, Artificial Sequence
  Description of Artificial Sequence: Synthetic oligonucleotide
cttttacagcttttctacagtacaccccttcccag

SEQ ID NO: 322490 - DNA, 36 bp, Artificial Sequence
  Description of Artificial Sequence: Synthetic oligonucleotide
ttttacagcttttctacagtacaccccttcccagac

SEQ ID NO: 322491 - DNA, 35 bp, Artificial Sequence
  Description of Artificial Sequence: Synthetic oligonucleotide
tttacagcttttctacagtacaccccttcccagac

SEQ ID NO: 322492 - DNA, 34 bp, Artificial Sequence
  Description of Artificial Sequence: Synthetic oligonucleotide
ttacagcttttctacagtacaccccttcccagac

SEQ ID NO: 322493 - DNA, 33 bp, Artificial Sequence
  Description of Artificial Sequence: Synthetic oligonucleotide
tacagcttttctacagtacaccccttcccagac

SEQ ID NO: 322494 - DNA, 32 bp, Artificial Sequence
  Description of Artificial Sequence: Synthetic oligonucleotide
acagcttttctacagtacaccccttcccagac

SEQ ID NO: 322495 - DNA, 31 bp, Artificial Sequence
  Description of Artificial Sequence: Synthetic oligonucleotide
cagcttttctacagtacaccccttcccagac

SEQ ID NO: 322496 - DNA, 31 bp, Artificial Sequence
  Description of Artificial Sequence: Synthetic oligonucleotide
agcttttctacagtacaccccttcccagacg

SEQ ID NO: 322497 - DNA, 30 bp, Artificial Sequence
  Description of Artificial Sequence: Synthetic oligonucleotide
gcttttctacagtacaccccttcccagacg

SEQ ID NO: 322498 - DNA, 32 bp, Artificial Sequence
  Description of Artificial Sequence: Synthetic oligonucleotide
cttttctacagtacaccccttcccagacgtag

SEQ ID NO: 322499 - DNA, 33 bp, Artificial Sequence
  Description of Artificial Sequence: Synthetic oligonucleotide
ttttctacagtacaccccttcccagacgtagac

SEQ ID NO: 322500 - DNA, 32 bp, Artificial Sequence
  Description of Artificial Sequence: Synthetic oligonucleotide
tttctacagtacaccccttcccagacgtagac

SEQ ID NO: 322501 - DNA, 31 bp, Artificial Sequence
  Description of Artificial Sequence: Synthetic oligonucleotide
ttctacagtacaccccttcccagacgtagac

SEQ ID NO: 322502 - DNA, 30 bp, Artificial Sequence
  Description of Artificial Sequence: Synthetic oligonucleotide
tctacagtacaccccttcccagacgtagac

SEQ ID NO: 322503 - DNA, 29 bp, Artificial Sequence
  Description of Artificial Sequence: Synthetic oligonucleotide
ctacagtacaccccttcccagacgtagac

SEQ ID NO: 322504 - DNA, 30 bp, Artificial Sequence
  Description of Artificial Sequence: Synthetic oligonucleotide
tacagtacaccccttcccagacgtagacag

SEQ ID NO: 322505 - DNA, 29 bp, Artificial Sequence
  Description of Artificial Sequence: Synthetic oligonucleotide
acagtacaccccttcccagacgtagacag

SEQ ID NO: 322506 - DNA, 28 bp, Artificial Sequence
  Description of Artificial Sequence: Synthetic oligonucleotide
cagtacaccccttcccagacgtagacag

SEQ ID NO: 322507 - DNA, 29 bp, Artificial Sequence
  Description of Artificial Sequence: Synthetic oligonucleotide
agtacaccccttcccagacgtagacagtc

SEQ ID NO: 322508 - DNA, 28 bp, Artificial Sequence
  Description of Artificial Sequence: Synthetic oligonucleotide
gtacaccccttcccagacgtagacagtc

SEQ ID NO: 322509 - DNA, 28 bp, Artificial Sequence
  Description of Artificial Sequence: Synthetic oligonucleotide
tacaccccttcccagacgtagacagtcc

SEQ ID NO: 322510 - DNA, 27 bp, Artificial Sequence
  Description of Artificial Sequence: Synthetic oligonucleotide
acaccccttcccagacgtagacagtcc

SEQ ID NO: 322511 - DNA, 26 bp, Artificial Sequence
  Description of Artificial Sequence: Synthetic oligonucleotide
caccccttcccagacgtagacagtcc

SEQ ID NO: 322512 - DNA, 27 bp, Artificial Sequence
  Description of Artificial Sequence: Synthetic oligonucleotide
accccttcccagacgtagacagtccgt

SEQ ID NO: 322513 - DNA, 26 bp, Artificial Sequence
  Description of Artificial Sequence: Synthetic oligonucleotide
ccccttcccagacgtagacagtccgt

SEQ ID NO: 322514 - DNA, 26 bp, Artificial Sequence
  Description of Artificial Sequence: Synthetic oligonucleotide
cccttcccagacgtagacagtccgtg

SEQ ID NO: 322515 - DNA, 27 bp, Artificial Sequence
  Description of Artificial Sequence: Synthetic oligonucleotide
ccttcccagacgtagacagtccgtgga

SEQ ID NO: 322516 - DNA, 28 bp, Artificial Sequence
  Description of Artificial Sequence: Synthetic oligonucleotide
cttcccagacgtagacagtccgtggatc

SEQ ID NO: 322517 - DNA, 29 bp, Artificial Sequence
  Description of Artificial Sequence: Synthetic oligonucleotide
ttcccagacgtagacagtccgtggatcac

SEQ ID NO: 322518 - DNA, 28 bp, Artificial Sequence
  Description of Artificial Sequence: Synthetic oligonucleotide
tcccagacgtagacagtccgtggatcac

SEQ ID NO: 322519 - DNA, 27 bp, Artificial Sequence
  Description of Artificial Sequence: Synthetic oligonucleotide
cccagacgtagacagtccgtggatcac

SEQ ID NO: 322520 - DNA, 27 bp, Artificial Sequence
  Description of Artificial Sequence: Synthetic oligonucleotide
ccagacgtagacagtccgtggatcacc

SEQ ID NO: 322521 - DNA, 27 bp, Artificial Sequence
  Description of Artificial Sequence: Synthetic oligonucleotide
cagacgtagacagtccgtggatcaccc

SEQ ID NO: 322522 - DNA, 28 bp, Artificial Sequence
  Description of Artificial Sequence: Synthetic oligonucleotide
agacgtagacagtccgtggatcacccac

SEQ ID NO: 322523 - DNA, 27 bp, Artificial Sequence
  Description of Artificial Sequence: Synthetic oligonucleotide
gacgtagacagtccgtggatcacccac

SEQ ID NO: 322524 - DNA, 28 bp, Artificial Sequence
  Description of Artificial Sequence: Synthetic oligonucleotide
acgtagacagtccgtggatcacccacag

SEQ ID NO: 322525 - DNA, 27 bp, Artificial Sequence
  Description of Artificial Sequence: Synthetic oligonucleotide
cgtagacagtccgtggatcacccacag

SEQ ID NO: 322526 - DNA, 27 bp, Artificial Sequence
  Description of Artificial Sequence: Synthetic oligonucleotide
gtagacagtccgtggatcacccacagc

SEQ ID NO: 322527 - DNA, 28 bp, Artificial Sequence
  Description of Artificial Sequence: Synthetic oligonucleotide
tagacagtccgtggatcacccacagcac

SEQ ID NO: 322528 - DNA, 27 bp, Artificial Sequence
  Description of Artificial Sequence: Synthetic oligonucleotide
agacagtccgtggatcacccacagcac

SEQ ID NO: 322529 - DNA, 27 bp, Artificial Sequence
  Description of Artificial Sequence: Synthetic oligonucleotide
gacagtccgtggatcacccacagcaca

SEQ ID NO: 322530 - DNA, 27 bp, Artificial Sequence
  Description of Artificial Sequence: Synthetic oligonucleotide
acagtccgtggatcacccacagcacag

SEQ ID NO: 322531 - DNA, 27 bp, Artificial Sequence
  Description of Artificial Sequence: Synthetic oligonucleotide
cagtccgtggatcacccacagcacagt

SEQ ID NO: 322532 - DNA, 27 bp, Artificial Sequence
  Description of Artificial Sequence: Synthetic oligonucleotide
agtccgtggatcacccacagcacagtc

SEQ ID NO: 322533 - DNA, 27 bp, Artificial Sequence
  Description of Artificial Sequence: Synthetic oligonucleotide
gtccgtggatcacccacagcacagtca

SEQ ID NO: 322534 - DNA, 27 bp, Artificial Sequence
  Description of Artificial Sequence: Synthetic oligonucleotide
tccgtggatcacccacagcacagtcag

SEQ ID NO: 322535 - DNA, 27 bp, Artificial Sequence
  Description of Artificial Sequence: Synthetic oligonucleotide
ccgtggatcacccacagcacagtcaga

SEQ ID NO: 322536 - DNA, 29 bp, Artificial Sequence
  Description of Artificial Sequence: Synthetic oligonucleotide
cgtggatcacccacagcacagtcagaatc

SEQ ID NO: 322537 - DNA, 29 bp, Artificial Sequence
  Description of Artificial Sequence: Synthetic oligonucleotide
gtggatcacccacagcacagtcagaatcc

SEQ ID NO: 322538 - DNA, 29 bp, Artificial Sequence
  Description of Artificial Sequence: Synthetic oligonucleotide
tggatcacccacagcacagtcagaatccc

SEQ ID NO: 322539 - DNA, 28 bp, Artificial Sequence
  Description of Artificial Sequence: Synthetic oligonucleotide
ggatcacccacagcacagtcagaatccc

SEQ ID NO: 322540 - DNA, 29 bp, Artificial Sequence
  Description of Artificial Sequence: Synthetic oligonucleotide
gatcacccacagcacagtcagaatcccag

SEQ ID NO: 322541 - DNA, 29 bp, Artificial Sequence
  Description of Artificial Sequence: Synthetic oligonucleotide
atcacccacagcacagtcagaatcccagc

SEQ ID NO: 322542 - DNA, 28 bp, Artificial Sequence
  Description of Artificial Sequence: Synthetic oligonucleotide
tcacccacagcacagtcagaatcccagc

SEQ ID NO: 322543 - DNA, 27 bp, Artificial Sequence
  Description of Artificial Sequence: Synthetic oligonucleotide
cacccacagcacagtcagaatcccagc

SEQ ID NO: 322544 - DNA, 29 bp, Artificial Sequence
  Description of Artificial Sequence: Synthetic oligonucleotide
acccacagcacagtcagaatcccagctac

SEQ ID NO: 322545 - DNA, 28 bp, Artificial Sequence
  Description of Artificial Sequence: Synthetic oligonucleotide
cccacagcacagtcagaatcccagctac

SEQ ID NO: 322546 - DNA, 28 bp, Artificial Sequence
  Description of Artificial Sequence: Synthetic oligonucleotide
ccacagcacagtcagaatcccagctacc

SEQ ID NO: 322547 - DNA, 29 bp, Artificial Sequence
  Description of Artificial Sequence: Synthetic oligonucleotide
cacagcacagtcagaatcccagctaccac

SEQ ID NO: 322548 - DNA, 32 bp, Artificial Sequence
  Description of Artificial Sequence: Synthetic oligonucleotide
acagcacagtcagaatcccagctaccactatg

SEQ ID NO: 322549 - DNA, 31 bp, Artificial Sequence
  Description of Artificial Sequence: Synthetic oligonucleotide
cagcacagtcagaatcccagctaccactatg

SEQ ID NO: 322550 - DNA, 33 bp, Artificial Sequence
  Description of Artificial Sequence: Synthetic oligonucleotide
agcacagtcagaatcccagctaccactatgatg

SEQ ID NO: 322551 - DNA, 32 bp, Artificial Sequence
  Description of Artificial Sequence: Synthetic oligonucleotide
gcacagtcagaatcccagctaccactatgatg

SEQ ID NO: 322552 - DNA, 33 bp, Artificial Sequence
  Description of Artificial Sequence: Synthetic oligonucleotide
cacagtcagaatcccagctaccactatgatgag

SEQ ID NO: 322553 - DNA, 33 bp, Artificial Sequence
  Description of Artificial Sequence: Synthetic oligonucleotide
acagtcagaatcccagctaccactatgatgagc

SEQ ID NO: 322554 - DNA, 32 bp, Artificial Sequence
  Description of Artificial Sequence: Synthetic oligonucleotide
cagtcagaatcccagctaccactatgatgagc

SEQ ID NO: 322555 - DNA, 33 bp, Artificial Sequence
  Description of Artificial Sequence: Synthetic oligonucleotide
agtcagaatcccagctaccactatgatgagcag

SEQ ID NO: 322556 - DNA, 32 bp, Artificial Sequence
  Description of Artificial Sequence: Synthetic oligonucleotide
gtcagaatcccagctaccactatgatgagcag

SEQ ID NO: 322557 - DNA, 34 bp, Artificial Sequence
  Description of Artificial Sequence: Synthetic oligonucleotide
tcagaatcccagctaccactatgatgagcagtag

SEQ ID NO: 322558 - DNA, 33 bp, Artificial Sequence
  Description of Artificial Sequence: Synthetic oligonucleotide
cagaatcccagctaccactatgatgagcagtag

SEQ ID NO: 322559 - DNA, 34 bp, Artificial Sequence
  Description of Artificial Sequence: Synthetic oligonucleotide
agaatcccagctaccactatgatgagcagtagtg

SEQ ID NO: 322560 - DNA, 33 bp, Artificial Sequence
  Description of Artificial Sequence: Synthetic oligonucleotide
gaatcccagctaccactatgatgagcagtagtg

SEQ ID NO: 322561 - DNA, 33 bp, Artificial Sequence
  Description of Artificial Sequence: Synthetic oligonucleotide
aatcccagctaccactatgatgagcagtagtgc

SEQ ID NO: 322562 - DNA, 32 bp, Artificial Sequence
  Description of Artificial Sequence: Synthetic oligonucleotide
atcccagctaccactatgatgagcagtagtgc

SEQ ID NO: 322563 - DNA, 31 bp, Artificial Sequence
  Description of Artificial Sequence: Synthetic oligonucleotide
tcccagctaccactatgatgagcagtagtgc

SEQ ID NO: 322564 - DNA, 30 bp, Artificial Sequence
  Description of Artificial Sequence: Synthetic oligonucleotide
cccagctaccactatgatgagcagtagtgc

SEQ ID NO: 322565 - DNA, 32 bp, Artificial Sequence
  Description of Artificial Sequence: Synthetic oligonucleotide
ccagctaccactatgatgagcagtagtgctac

SEQ ID NO: 322566 - DNA, 33 bp, Artificial Sequence
  Description of Artificial Sequence: Synthetic oligonucleotide
cagctaccactatgatgagcagtagtgctactg

SEQ ID NO: 322567 - DNA, 33 bp, Artificial Sequence
  Description of Artificial Sequence: Synthetic oligonucleotide
agctaccactatgatgagcagtagtgctactgc

SEQ ID NO: 322568 - DNA, 32 bp, Artificial Sequence
  Description of Artificial Sequence: Synthetic oligonucleotide
gctaccactatgatgagcagtagtgctactgc

SEQ ID NO: 322569 - DNA, 34 bp, Artificial Sequence
  Description of Artificial Sequence: Synthetic oligonucleotide
ctaccactatgatgagcagtagtgctactgcaac

SEQ ID NO: 322570 - DNA, 35 bp, Artificial Sequence
  Description of Artificial Sequence: Synthetic oligonucleotide
taccactatgatgagcagtagtgctactgcaactg

SEQ ID NO: 322571 - DNA, 34 bp, Artificial Sequence
  Description of Artificial Sequence: Synthetic oligonucleotide
accactatgatgagcagtagtgctactgcaactg

SEQ ID NO: 322572 - DNA, 33 bp, Artificial Sequence
  Description of Artificial Sequence: Synthetic oligonucleotide
ccactatgatgagcagtagtgctactgcaactg

SEQ ID NO: 322573 - DNA, 34 bp, Artificial Sequence
  Description of Artificial Sequence: Synthetic oligonucleotide
cactatgatgagcagtagtgctactgcaactgag

SEQ ID NO: 322574 - DNA, 35 bp, Artificial Sequence
  Description of Artificial Sequence: Synthetic oligonucleotide
actatgatgagcagtagtgctactgcaactgagtc

SEQ ID NO: 322575 - DNA, 34 bp, Artificial Sequence
  Description of Artificial Sequence: Synthetic oligonucleotide
ctatgatgagcagtagtgctactgcaactgagtc

SEQ ID NO: 322576 - DNA, 35 bp, Artificial Sequence
  Description of Artificial Sequence: Synthetic oligonucleotide
tatgatgagcagtagtgctactgcaactgagtcag

SEQ ID NO: 322577 - DNA, 34 bp, Artificial Sequence
  Description of Artificial Sequence: Synthetic oligonucleotide
atgatgagcagtagtgctactgcaactgagtcag

SEQ ID NO: 322578 - DNA, 33 bp, Artificial Sequence
  Description of Artificial Sequence: Synthetic oligonucleotide
tgatgagcagtagtgctactgcaactgagtcag

SEQ ID NO: 322579 - DNA, 32 bp, Artificial Sequence
  Description of Artificial Sequence: Synthetic oligonucleotide
gatgagcagtagtgctactgcaactgagtcag

SEQ ID NO: 322580 - DNA, 32 bp, Artificial Sequence
  Description of Artificial Sequence: Synthetic oligonucleotide
atgagcagtagtgctactgcaactgagtcagc

SEQ ID NO: 322581 - DNA, 31 bp, Artificial Sequence
  Description of Artificial Sequence: Synthetic oligonucleotide
tgagcagtagtgctactgcaactgagtcagc

SEQ ID NO: 322582 - DNA, 30 bp, Artificial Sequence
  Description of Artificial Sequence: Synthetic oligonucleotide
gagcagtagtgctactgcaactgagtcagc

SEQ ID NO: 322583 - DNA, 32 bp, Artificial Sequence
  Description of Artificial Sequence: Synthetic oligonucleotide
agcagtagtgctactgcaactgagtcagcaac

SEQ ID NO: 322584 - DNA, 31 bp, Artificial Sequence
  Description of Artificial Sequence: Synthetic oligonucleotide
gcagtagtgctactgcaactgagtcagcaac

SEQ ID NO: 322585 - DNA, 31 bp, Artificial Sequence
  Description of Artificial Sequence: Synthetic oligonucleotide
cagtagtgctactgcaactgagtcagcaacc

SEQ ID NO: 322586 - DNA, 33 bp, Artificial Sequence
  Description of Artificial Sequence: Synthetic oligonucleotide
agtagtgctactgcaactgagtcagcaaccatg

SEQ ID NO: 322587 - DNA, 32 bp, Artificial Sequence
  Description of Artificial Sequence: Synthetic oligonucleotide
gtagtgctactgcaactgagtcagcaaccatg

SEQ ID NO: 322588 - DNA, 33 bp, Artificial Sequence
  Description of Artificial Sequence: Synthetic oligonucleotide
tagtgctactgcaactgagtcagcaaccatgag

SEQ ID NO: 322589 - DNA, 32 bp, Artificial Sequence
  Description of Artificial Sequence: Synthetic oligonucleotide
agtgctactgcaactgagtcagcaaccatgag

SEQ ID NO: 322590 - DNA, 31 bp, Artificial Sequence
  Description of Artificial Sequence: Synthetic oligonucleotide
gtgctactgcaactgagtcagcaaccatgag

SEQ ID NO: 322591 - DNA, 31 bp, Artificial Sequence
  Description of Artificial Sequence: Synthetic oligonucleotide
tgctactgcaactgagtcagcaaccatgagg

SEQ ID NO: 322592 - DNA, 30 bp, Artificial Sequence
  Description of Artificial Sequence: Synthetic oligonucleotide
gctactgcaactgagtcagcaaccatgagg

SEQ ID NO: 322593 - DNA, 30 bp, Artificial Sequence
  Description of Artificial Sequence: Synthetic oligonucleotide
ctactgcaactgagtcagcaaccatgaggc

SEQ ID NO: 322594 - DNA, 32 bp, Artificial Sequence
  Description of Artificial Sequence: Synthetic oligonucleotide
tactgcaactgagtcagcaaccatgaggcaag

SEQ ID NO: 322595 - DNA, 31 bp, Artificial Sequence
  Description of Artificial Sequence: Synthetic oligonucleotide
actgcaactgagtcagcaaccatgaggcaag

SEQ ID NO: 322596 - DNA, 30 bp, Artificial Sequence
  Description of Artificial Sequence: Synthetic oligonucleotide
ctgcaactgagtcagcaaccatgaggcaag

SEQ ID NO: 322597 - DNA, 33 bp, Artificial Sequence
  Description of Artificial Sequence: Synthetic oligonucleotide
tgcaactgagtcagcaaccatgaggcaagatac

SEQ ID NO: 322598 - DNA, 32 bp, Artificial Sequence
  Description of Artificial Sequence: Synthetic oligonucleotide
gcaactgagtcagcaaccatgaggcaagatac

SEQ ID NO: 322599 - DNA, 32 bp, Artificial Sequence
  Description of Artificial Sequence: Synthetic oligonucleotide
caactgagtcagcaaccatgaggcaagatacc

SEQ ID NO: 322600 - DNA, 33 bp, Artificial Sequence
  Description of Artificial Sequence: Synthetic oligonucleotide
aactgagtcagcaaccatgaggcaagatacctg

SEQ ID NO: 322601 - DNA, 32 bp, Artificial Sequence
  Description of Artificial Sequence: Synthetic oligonucleotide
actgagtcagcaaccatgaggcaagatacctg

SEQ ID NO: 322602 - DNA, 31 bp, Artificial Sequence
  Description of Artificial Sequence: Synthetic oligonucleotide
ctgagtcagcaaccatgaggcaagatacctg

SEQ ID NO: 322603 - DNA, 31 bp, Artificial Sequence
  Description of Artificial Sequence: Synthetic oligonucleotide
tgagtcagcaaccatgaggcaagatacctgg

SEQ ID NO: 322604 - DNA, 30 bp, Artificial Sequence
  Description of Artificial Sequence: Synthetic oligonucleotide
gagtcagcaaccatgaggcaagatacctgg

SEQ ID NO: 322605 - DNA, 30 bp, Artificial Sequence
  Description of Artificial Sequence: Synthetic oligonucleotide
agtcagcaaccatgaggcaagatacctggg

SEQ ID NO: 322606 - DNA, 29 bp, Artificial Sequence
  Description of Artificial Sequence: Synthetic oligonucleotide
gtcagcaaccatgaggcaagatacctggg

SEQ ID NO: 322607 - DNA, 32 bp, Artificial Sequence
  Description of Artificial Sequence: Synthetic oligonucleotide
tcagcaaccatgaggcaagatacctgggatag

SEQ ID NO: 322608 - DNA, 31 bp, Artificial Sequence
  Description of Artificial Sequence: Synthetic oligonucleotide
cagcaaccatgaggcaagatacctgggatag

SEQ ID NO: 322609 - DNA, 31 bp, Artificial Sequence
  Description of Artificial Sequence: Synthetic oligonucleotide
agcaaccatgaggcaagatacctgggatagg

SEQ ID NO: 322610 - DNA, 30 bp, Artificial Sequence
  Description of Artificial Sequence: Synthetic oligonucleotide
gcaaccatgaggcaagatacctgggatagg

SEQ ID NO: 322611 - DNA, 34 bp, Artificial Sequence
  Description of Artificial Sequence: Synthetic oligonucleotide
caaccatgaggcaagatacctgggataggttttc

SEQ ID NO: 322612 - DNA, 36 bp, Artificial Sequence
  Description of Artificial Sequence: Synthetic oligonucleotide
aaccatgaggcaagatacctgggataggttttcatc

SEQ ID NO: 322613 - DNA, 35 bp, Artificial Sequence
  Description of Artificial Sequence: Synthetic oligonucleotide
accatgaggcaagatacctgggataggttttcatc

SEQ ID NO: 322614 - DNA, 34 bp, Artificial Sequence
  Description of Artificial Sequence: Synthetic oligonucleotide
ccatgaggcaagatacctgggataggttttcatc

SEQ ID NO: 322615 - DNA, 34 bp, Artificial Sequence
  Description of Artificial Sequence: Synthetic oligonucleotide
catgaggcaagatacctgggataggttttcatcg

SEQ ID NO: 322616 - DNA, 36 bp, Artificial Sequence
  Description of Artificial Sequence: Synthetic oligonucleotide
atgaggcaagatacctgggataggttttcatcgttg

SEQ ID NO: 322617 - DNA, 35 bp, Artificial Sequence
  Description of Artificial Sequence: Synthetic oligonucleotide
tgaggcaagatacctgggataggttttcatcgttg

SEQ ID NO: 322618 - DNA, 34 bp, Artificial Sequence
  Description of Artificial Sequence: Synthetic oligonucleotide
gaggcaagatacctgggataggttttcatcgttg

SEQ ID NO: 322619 - DNA, 37 bp, Artificial Sequence
  Description of Artificial Sequence: Synthetic oligonucleotide
aggcaagatacctgggataggttttcatcgttgtttc

SEQ ID NO: 322620 - DNA, 36 bp, Artificial Sequence
  Description of Artificial Sequence: Synthetic oligonucleotide
ggcaagatacctgggataggttttcatcgttgtttc

SEQ ID NO: 322621 - DNA, 38 bp, Artificial Sequence
  Description of Artificial Sequence: Synthetic oligonucleotide
gcaagatacctgggataggttttcatcgttgtttcttc

SEQ ID NO: 322622 - DNA, 38 bp, Artificial Sequence
  Description of Artificial Sequence: Synthetic oligonucleotide
caagatacctgggataggttttcatcgttgtttcttcc

SEQ ID NO: 322623 - DNA, 40 bp, Artificial Sequence
  Description of Artificial Sequence: Synthetic oligonucleotide
aagatacctgggataggttttcatcgttgtttcttccatc

SEQ ID NO: 322624 - DNA, 39 bp, Artificial Sequence
  Description of Artificial Sequence: Synthetic oligonucleotide
agatacctgggataggttttcatcgttgtttcttccatc

SEQ ID NO: 322625 - DNA, 38 bp, Artificial Sequence
  Description of Artificial Sequence: Synthetic oligonucleotide
gatacctgggataggttttcatcgttgtttcttccatc

SEQ ID NO: 322626 - DNA, 39 bp, Artificial Sequence
  Description of Artificial Sequence: Synthetic oligonucleotide
atacctgggataggttttcatcgttgtttcttccatcag

SEQ ID NO: 322627 - DNA, 38 bp, Artificial Sequence
  Description of Artificial Sequence: Synthetic oligonucleotide
tacctgggataggttttcatcgttgtttcttccatcag

SEQ ID NO: 322628 - DNA, 37 bp, Artificial Sequence
  Description of Artificial Sequence: Synthetic oligonucleotide
acctgggataggttttcatcgttgtttcttccatcag

SEQ ID NO: 322629 - DNA, 36 bp, Artificial Sequence
  Description of Artificial Sequence: Synthetic oligonucleotide
cctgggataggttttcatcgttgtttcttccatcag

SEQ ID NO: 322630 - DNA, 37 bp, Artificial Sequence
  Description of Artificial Sequence: Synthetic oligonucleotide
ctgggataggttttcatcgttgtttcttccatcagag

SEQ ID NO: 322631 - DNA, 38 bp, Artificial Sequence
  Description of Artificial Sequence: Synthetic oligonucleotide
tgggataggttttcatcgttgtttcttccatcagagac

SEQ ID NO: 322632 - DNA, 37 bp, Artificial Sequence
  Description of Artificial Sequence: Synthetic oligonucleotide
gggataggttttcatcgttgtttcttccatcagagac

SEQ ID NO: 322633 - DNA, 40 bp, Artificial Sequence
  Description of Artificial Sequence: Synthetic oligonucleotide
ggataggttttcatcgttgtttcttccatcagagacaaag

SEQ ID NO: 322634 - DNA, 43 bp, Artificial Sequence
  Description of Artificial Sequence: Synthetic oligonucleotide
gataggttttcatcgttgtttcttccatcagagacaaagaatc

SEQ ID NO: 322635 - DNA, 45 bp, Artificial Sequence
  Description of Artificial Sequence: Synthetic oligonucleotide
ataggttttcatcgttgtttcttccatcagagacaaagaatcttc

SEQ ID NO: 322636 - DNA, 44 bp, Artificial Sequence
  Description of Artificial Sequence: Synthetic oligonucleotide
taggttttcatcgttgtttcttccatcagagacaaagaatcttc

SEQ ID NO: 322637 - DNA, 43 bp, Artificial Sequence
  Description of Artificial Sequence: Synthetic oligonucleotide
aggttttcatcgttgtttcttccatcagagacaaagaatcttc

SEQ ID NO: 322638 - DNA, 42 bp, Artificial Sequence
  Description of Artificial Sequence: Synthetic oligonucleotide
ggttttcatcgttgtttcttccatcagagacaaagaatcttc

SEQ ID NO: 322639 - DNA, 44 bp, Artificial Sequence
  Description of Artificial Sequence: Synthetic oligonucleotide
gttttcatcgttgtttcttccatcagagacaaagaatcttcttc

SEQ ID NO: 322640 - DNA, 45 bp, Artificial Sequence
  Description of Artificial Sequence: Synthetic oligonucleotide
ttttcatcgttgtttcttccatcagagacaaagaatcttcttcac

SEQ ID NO: 322641 - DNA, 44 bp, Artificial Sequence
  Description of Artificial Sequence: Synthetic oligonucleotide
tttcatcgttgtttcttccatcagagacaaagaatcttcttcac

SEQ ID NO: 322642 - DNA, 43 bp, Artificial Sequence
  Description of Artificial Sequence: Synthetic oligonucleotide
ttcatcgttgtttcttccatcagagacaaagaatcttcttcac

SEQ ID NO: 322643 - DNA, 42 bp, Artificial Sequence
  Description of Artificial Sequence: Synthetic oligonucleotide
tcatcgttgtttcttccatcagagacaaagaatcttcttcac

SEQ ID NO: 322644 - DNA, 41 bp, Artificial Sequence
  Description of Artificial Sequence: Synthetic oligonucleotide
catcgttgtttcttccatcagagacaaagaatcttcttcac

SEQ ID NO: 322645 - DNA, 42 bp, Artificial Sequence
  Description of Artificial Sequence: Synthetic oligonucleotide
atcgttgtttcttccatcagagacaaagaatcttcttcacac

SEQ ID NO: 322646 - DNA, 41 bp, Artificial Sequence
  Description of Artificial Sequence: Synthetic oligonucleotide
tcgttgtttcttccatcagagacaaagaatcttcttcacac

SEQ ID NO: 322647 - DNA, 40 bp, Artificial Sequence
  Description of Artificial Sequence: Synthetic oligonucleotide
cgttgtttcttccatcagagacaaagaatcttcttcacac

SEQ ID NO: 322648 - DNA, 42 bp, Artificial Sequence
  Description of Artificial Sequence: Synthetic oligonucleotide
gttgtttcttccatcagagacaaagaatcttcttcacactac

SEQ ID NO: 322649 - DNA, 44 bp, Artificial Sequence
  Description of Artificial Sequence: Synthetic oligonucleotide
ttgtttcttccatcagagacaaagaatcttcttcacactacaac

SEQ ID NO: 322650 - DNA, 43 bp, Artificial Sequence
  Description of Artificial Sequence: Synthetic oligonucleotide
tgtttcttccatcagagacaaagaatcttcttcacactacaac

SEQ ID NO: 322651 - DNA, 42 bp, Artificial Sequence
  Description of Artificial Sequence: Synthetic oligonucleotide
gtttcttccatcagagacaaagaatcttcttcacactacaac

SEQ ID NO: 322652 - DNA, 43 bp, Artificial Sequence
  Description of Artificial Sequence: Synthetic oligonucleotide
tttcttccatcagagacaaagaatcttcttcacactacaacac

SEQ ID NO: 322653 - DNA, 42 bp, Artificial Sequence
  Description of Artificial Sequence: Synthetic oligonucleotide
ttcttccatcagagacaaagaatcttcttcacactacaacac

SEQ ID NO: 322654 - DNA, 41 bp, Artificial Sequence
  Description of Artificial Sequence: Synthetic oligonucleotide
tcttccatcagagacaaagaatcttcttcacactacaacac

SEQ ID NO: 322655 - DNA, 40 bp, Artificial Sequence
  Description of Artificial Sequence: Synthetic oligonucleotide
cttccatcagagacaaagaatcttcttcacactacaacac

SEQ ID NO: 322656 - DNA, 44 bp, Artificial Sequence
  Description of Artificial Sequence: Synthetic oligonucleotide
ttccatcagagacaaagaatcttcttcacactacaacacaattg

SEQ ID NO: 322657 - DNA, 43 bp, Artificial Sequence
  Description of Artificial Sequence: Synthetic oligonucleotide
tccatcagagacaaagaatcttcttcacactacaacacaattg

SEQ ID NO: 322658 - DNA, 42 bp, Artificial Sequence
  Description of Artificial Sequence: Synthetic oligonucleotide
ccatcagagacaaagaatcttcttcacactacaacacaattg

SEQ ID NO: 322659 - DNA, 42 bp, Artificial Sequence
  Description of Artificial Sequence: Synthetic oligonucleotide
catcagagacaaagaatcttcttcacactacaacacaattgg

SEQ ID NO: 322660 - DNA, 42 bp, Artificial Sequence
  Description of Artificial Sequence: Synthetic oligonucleotide
atcagagacaaagaatcttcttcacactacaacacaattggc

SEQ ID NO: 322661 - DNA, 41 bp, Artificial Sequence
  Description of Artificial Sequence: Synthetic oligonucleotide
tcagagacaaagaatcttcttcacactacaacacaattggc

SEQ ID NO: 322662 - DNA, 40 bp, Artificial Sequence
  Description of Artificial Sequence: Synthetic oligonucleotide
cagagacaaagaatcttcttcacactacaacacaattggc

SEQ ID NO: 322663 - DNA, 41 bp, Artificial Sequence
  Description of Artificial Sequence: Synthetic oligonucleotide
agagacaaagaatcttcttcacactacaacacaattggctg

SEQ ID NO: 322664 - DNA, 40 bp, Artificial Sequence
  Description of Artificial Sequence: Synthetic oligonucleotide
gagacaaagaatcttcttcacactacaacacaattggctg

SEQ ID NO: 322665 - DNA, 40 bp, Artificial Sequence
  Description of Artificial Sequence: Synthetic oligonucleotide
agacaaagaatcttcttcacactacaacacaattggctgg

SEQ ID NO: 322666 - DNA, 39 bp, Artificial Sequence
  Description of Artificial Sequence: Synthetic oligonucleotide
gacaaagaatcttcttcacactacaacacaattggctgg

SEQ ID NO: 322667 - DNA, 41 bp, Artificial Sequence
  Description of Artificial Sequence: Synthetic oligonucleotide
acaaagaatcttcttcacactacaacacaattggctggtag

SEQ ID NO: 322668 - DNA, 40 bp, Artificial Sequence
  Description of Artificial Sequence: Synthetic oligonucleotide
caaagaatcttcttcacactacaacacaattggctggtag

SEQ ID NO: 322669 - DNA, 40 bp, Artificial Sequence
  Description of Artificial Sequence: Synthetic oligonucleotide
aaagaatcttcttcacactacaacacaattggctggtagg

SEQ ID NO: 322670 - DNA, 39 bp, Artificial Sequence
  Description of Artificial Sequence: Synthetic oligonucleotide
aagaatcttcttcacactacaacacaattggctggtagg

SEQ ID NO: 322671 - DNA, 38 bp, Artificial Sequence
  Description of Artificial Sequence: Synthetic oligonucleotide
agaatcttcttcacactacaacacaattggctggtagg

SEQ ID NO: 322672 - DNA, 37 bp, Artificial Sequence
  Description of Artificial Sequence: Synthetic oligonucleotide
gaatcttcttcacactacaacacaattggctggtagg

SEQ ID NO: 322673 - DNA, 38 bp, Artificial Sequence
  Description of Artificial Sequence: Synthetic oligonucleotide
aatcttcttcacactacaacacaattggctggtaggtc

SEQ ID NO: 322674 - DNA, 37 bp, Artificial Sequence
  Description of Artificial Sequence: Synthetic oligonucleotide
atcttcttcacactacaacacaattggctggtaggtc

SEQ ID NO: 322675 - DNA, 36 bp, Artificial Sequence
  Description of Artificial Sequence: Synthetic oligonucleotide
tcttcttcacactacaacacaattggctggtaggtc

SEQ ID NO: 322676 - DNA, 35 bp, Artificial Sequence
  Description of Artificial Sequence: Synthetic oligonucleotide
cttcttcacactacaacacaattggctggtaggtc

SEQ ID NO: 322677 - DNA, 37 bp, Artificial Sequence
  Description of Artificial Sequence: Synthetic oligonucleotide
ttcttcacactacaacacaattggctggtaggtcttc

SEQ ID NO: 322678 - DNA, 36 bp, Artificial Sequence
  Description of Artificial Sequence: Synthetic oligonucleotide
tcttcacactacaacacaattggctggtaggtcttc

SEQ ID NO: 322679 - DNA, 35 bp, Artificial Sequence
  Description of Artificial Sequence: Synthetic oligonucleotide
cttcacactacaacacaattggctggtaggtcttc

SEQ ID NO: 322680 - DNA, 40 bp, Artificial Sequence
  Description of Artificial Sequence: Synthetic oligonucleotide
ttcacactacaacacaattggctggtaggtcttcaaaaac

SEQ ID NO: 322681 - DNA, 39 bp, Artificial Sequence
  Description of Artificial Sequence: Synthetic oligonucleotide
tcacactacaacacaattggctggtaggtcttcaaaaac

SEQ ID NO: 322682 - DNA, 38 bp, Artificial Sequence
  Description of Artificial Sequence: Synthetic oligonucleotide
cacactacaacacaattggctggtaggtcttcaaaaac

SEQ ID NO: 322683 - DNA, 38 bp, Artificial Sequence
  Description of Artificial Sequence: Synthetic oligonucleotide
acactacaacacaattggctggtaggtcttcaaaaacc

SEQ ID NO: 322684 - DNA, 37 bp, Artificial Sequence
  Description of Artificial Sequence: Synthetic oligonucleotide
cactacaacacaattggctggtaggtcttcaaaaacc

SEQ ID NO: 322685 - DNA, 39 bp, Artificial Sequence
  Description of Artificial Sequence: Synthetic oligonucleotide
actacaacacaattggctggtaggtcttcaaaaaccatc

SEQ ID NO: 322686 - DNA, 38 bp, Artificial Sequence
  Description of Artificial Sequence: Synthetic oligonucleotide
ctacaacacaattggctggtaggtcttcaaaaaccatc

SEQ ID NO: 322687 - DNA, 39 bp, Artificial Sequence
  Description of Artificial Sequence: Synthetic oligonucleotide
tacaacacaattggctggtaggtcttcaaaaaccatctc

SEQ ID NO: 322688 - DNA, 38 bp, Artificial Sequence
  Description of Artificial Sequence: Synthetic oligonucleotide
acaacacaattggctggtaggtcttcaaaaaccatctc

SEQ ID NO: 322689 - DNA, 37 bp, Artificial Sequence
  Description of Artificial Sequence: Synthetic oligonucleotide
caacacaattggctggtaggtcttcaaaaaccatctc

SEQ ID NO: 322690 - DNA, 38 bp, Artificial Sequence
  Description of Artificial Sequence: Synthetic oligonucleotide
aacacaattggctggtaggtcttcaaaaaccatctcac

SEQ ID NO: 322691 - DNA, 37 bp, Artificial Sequence
  Description of Artificial Sequence: Synthetic oligonucleotide
acacaattggctggtaggtcttcaaaaaccatctcac

SEQ ID NO: 322692 - DNA, 36 bp, Artificial Sequence
  Description of Artificial Sequence: Synthetic oligonucleotide
cacaattggctggtaggtcttcaaaaaccatctcac

SEQ ID NO: 322693 - DNA, 36 bp, Artificial Sequence
  Description of Artificial Sequence: Synthetic oligonucleotide
acaattggctggtaggtcttcaaaaaccatctcacc

SEQ ID NO: 322694 - DNA, 35 bp, Artificial Sequence
  Description of Artificial Sequence: Synthetic oligonucleotide
caattggctggtaggtcttcaaaaaccatctcacc

SEQ ID NO: 322695 - DNA, 36 bp, Artificial Sequence
  Description of Artificial Sequence: Synthetic oligonucleotide
aattggctggtaggtcttcaaaaaccatctcaccag

SEQ ID NO: 322696 - DNA, 35 bp, Artificial Sequence
  Description of Artificial Sequence: Synthetic oligonucleotide
attggctggtaggtcttcaaaaaccatctcaccag

SEQ ID NO: 322697 - DNA, 34 bp, Artificial Sequence
  Description of Artificial Sequence: Synthetic oligonucleotide
ttggctggtaggtcttcaaaaaccatctcaccag

SEQ ID NO: 322698 - DNA, 33 bp, Artificial Sequence
  Description of Artificial Sequence: Synthetic oligonucleotide
tggctggtaggtcttcaaaaaccatctcaccag

SEQ ID NO: 322699 - DNA, 32 bp, Artificial Sequence
  Description of Artificial Sequence: Synthetic oligonucleotide
ggctggtaggtcttcaaaaaccatctcaccag

SEQ ID NO: 322700 - DNA, 32 bp, Artificial Sequence
  Description of Artificial Sequence: Synthetic oligonucleotide
gctggtaggtcttcaaaaaccatctcaccagg

SEQ ID NO: 322701 - DNA, 32 bp, Artificial Sequence
  Description of Artificial Sequence: Synthetic oligonucleotide
ctggtaggtcttcaaaaaccatctcaccaggc

SEQ ID NO: 322702 - DNA, 33 bp, Artificial Sequence
  Description of Artificial Sequence: Synthetic oligonucleotide
tggtaggtcttcaaaaaccatctcaccaggctg

SEQ ID NO: 322703 - DNA, 32 bp, Artificial Sequence
  Description of Artificial Sequence: Synthetic oligonucleotide
ggtaggtcttcaaaaaccatctcaccaggctg

SEQ ID NO: 322704 - DNA, 32 bp, Artificial Sequence
  Description of Artificial Sequence: Synthetic oligonucleotide
gtaggtcttcaaaaaccatctcaccaggctgg

SEQ ID NO: 322705 - DNA, 32 bp, Artificial Sequence
  Description of Artificial Sequence: Synthetic oligonucleotide
taggtcttcaaaaaccatctcaccaggctggg

SEQ ID NO: 322706 - DNA, 31 bp, Artificial Sequence
  Description of Artificial Sequence: Synthetic oligonucleotide
aggtcttcaaaaaccatctcaccaggctggg

SEQ ID NO: 322707 - DNA, 30 bp, Artificial Sequence
  Description of Artificial Sequence: Synthetic oligonucleotide
ggtcttcaaaaaccatctcaccaggctggg

SEQ ID NO: 322708 - DNA, 31 bp, Artificial Sequence
  Description of Artificial Sequence: Synthetic oligonucleotide
gtcttcaaaaaccatctcaccaggctgggtg

SEQ ID NO: 322709 - DNA, 31 bp, Artificial Sequence
  Description of Artificial Sequence: Synthetic oligonucleotide
tcttcaaaaaccatctcaccaggctgggtgc

SEQ ID NO: 322710 - DNA, 30 bp, Artificial Sequence
  Description of Artificial Sequence: Synthetic oligonucleotide
cttcaaaaaccatctcaccaggctgggtgc

SEQ ID NO: 322711 - DNA, 30 bp, Artificial Sequence
  Description of Artificial Sequence: Synthetic oligonucleotide
ttcaaaaaccatctcaccaggctgggtgcc

SEQ ID NO: 322712 - DNA, 29 bp, Artificial Sequence
  Description of Artificial Sequence: Synthetic oligonucleotide
tcaaaaaccatctcaccaggctgggtgcc

SEQ ID NO: 322713 - DNA, 28 bp, Artificial Sequence
  Description of Artificial Sequence: Synthetic oligonucleotide
caaaaaccatctcaccaggctgggtgcc

SEQ ID NO: 322714 - DNA, 32 bp, Artificial Sequence
  Description of Artificial Sequence: Synthetic oligonucleotide
aaaaaccatctcaccaggctgggtgccaaatg

SEQ ID NO: 322715 - DNA, 31 bp, Artificial Sequence
  Description of Artificial Sequence: Synthetic oligonucleotide
aaaaccatctcaccaggctgggtgccaaatg

SEQ ID NO: 322716 - DNA, 30 bp, Artificial Sequence
  Description of Artificial Sequence: Synthetic oligonucleotide
aaaccatctcaccaggctgggtgccaaatg

SEQ ID NO: 322717 - DNA, 29 bp, Artificial Sequence
  Description of Artificial Sequence: Synthetic oligonucleotide
aaccatctcaccaggctgggtgccaaatg

SEQ ID NO: 322718 - DNA, 28 bp, Artificial Sequence
  Description of Artificial Sequence: Synthetic oligonucleotide
accatctcaccaggctgggtgccaaatg

SEQ ID NO: 322719 - DNA, 27 bp, Artificial Sequence
  Description of Artificial Sequence: Synthetic oligonucleotide
ccatctcaccaggctgggtgccaaatg

SEQ ID NO: 322720 - DNA, 29 bp, Artificial Sequence
  Description of Artificial Sequence: Synthetic oligonucleotide
catctcaccaggctgggtgccaaatgatg

SEQ ID NO: 322721 - DNA, 34 bp, Artificial Sequence
  Description of Artificial Sequence: Synthetic oligonucleotide
atctcaccaggctgggtgccaaatgatgaaaatg

SEQ ID NO: 322722 - DNA, 33 bp, Artificial Sequence
  Description of Artificial Sequence: Synthetic oligonucleotide
tctcaccaggctgggtgccaaatgatgaaaatg

SEQ ID NO: 322723 - DNA, 32 bp, Artificial Sequence
  Description of Artificial Sequence: Synthetic oligonucleotide
ctcaccaggctgggtgccaaatgatgaaaatg

SEQ ID NO: 322724 - DNA, 34 bp, Artificial Sequence
  Description of Artificial Sequence: Synthetic oligonucleotide
tcaccaggctgggtgccaaatgatgaaaatgaac

SEQ ID NO: 322725 - DNA, 33 bp, Artificial Sequence
  Description of Artificial Sequence: Synthetic oligonucleotide
caccaggctgggtgccaaatgatgaaaatgaac

SEQ ID NO: 322726 - DNA, 35 bp, Artificial Sequence
  Description of Artificial Sequence: Synthetic oligonucleotide
accaggctgggtgccaaatgatgaaaatgaacatg

SEQ ID NO: 322727 - DNA, 34 bp, Artificial Sequence
  Description of Artificial Sequence: Synthetic oligonucleotide
ccaggctgggtgccaaatgatgaaaatgaacatg

SEQ ID NO: 322728 - DNA, 37 bp, Artificial Sequence
  Description of Artificial Sequence: Synthetic oligonucleotide
caggctgggtgccaaatgatgaaaatgaacatgaaag

SEQ ID NO: 322729 - DNA, 38 bp, Artificial Sequence
  Description of Artificial Sequence: Synthetic oligonucleotide
aggctgggtgccaaatgatgaaaatgaacatgaaagag

SEQ ID NO: 322730 - DNA, 37 bp, Artificial Sequence
  Description of Artificial Sequence: Synthetic oligonucleotide
ggctgggtgccaaatgatgaaaatgaacatgaaagag

SEQ ID NO: 322731 - DNA, 38 bp, Artificial Sequence
  Description of Artificial Sequence: Synthetic oligonucleotide
gctgggtgccaaatgatgaaaatgaacatgaaagagtc

SEQ ID NO: 322732 - DNA, 39 bp, Artificial Sequence
  Description of Artificial Sequence: Synthetic oligonucleotide
ctgggtgccaaatgatgaaaatgaacatgaaagagtcag

SEQ ID NO: 322733 - DNA, 40 bp, Artificial Sequence
  Description of Artificial Sequence: Synthetic oligonucleotide
tgggtgccaaatgatgaaaatgaacatgaaagagtcagac

SEQ ID NO: 322734 - DNA, 39 bp, Artificial Sequence
  Description of Artificial Sequence: Synthetic oligonucleotide
gggtgccaaatgatgaaaatgaacatgaaagagtcagac

SEQ ID NO: 322735 - DNA, 40 bp, Artificial Sequence
  Description of Artificial Sequence: Synthetic oligonucleotide
ggtgccaaatgatgaaaatgaacatgaaagagtcagacac

SEQ ID NO: 322736 - DNA, 40 bp, Artificial Sequence
  Description of Artificial Sequence: Synthetic oligonucleotide
gtgccaaatgatgaaaatgaacatgaaagagtcagacacc

SEQ ID NO: 322737 - DNA, 41 bp, Artificial Sequence
  Description of Artificial Sequence: Synthetic oligonucleotide
tgccaaatgatgaaaatgaacatgaaagagtcagacacctg

SEQ ID NO: 322738 - DNA, 40 bp, Artificial Sequence
  Description of Artificial Sequence: Synthetic oligonucleotide
gccaaatgatgaaaatgaacatgaaagagtcagacacctg

SEQ ID NO: 322739 - DNA, 41 bp, Artificial Sequence
  Description of Artificial Sequence: Synthetic oligonucleotide
ccaaatgatgaaaatgaacatgaaagagtcagacacctgag

SEQ ID NO: 322740 - DNA, 46 bp, Artificial Sequence
  Description of Artificial Sequence: Synthetic oligonucleotide
caaatgatgaaaatgaacatgaaagagtcagacacctgagtttttc

SEQ ID NO: 322741 - DNA, 47 bp, Artificial Sequence
  Description of Artificial Sequence: Synthetic oligonucleotide
aaatgatgaaaatgaacatgaaagagtcagacacctgagtttttctc

SEQ ID NO: 322742 - DNA, 46 bp, Artificial Sequence
  Description of Artificial Sequence: Synthetic oligonucleotide
aatgatgaaaatgaacatgaaagagtcagacacctgagtttttctc

SEQ ID NO: 322743 - DNA, 45 bp, Artificial Sequence
  Description of Artificial Sequence: Synthetic oligonucleotide
atgatgaaaatgaacatgaaagagtcagacacctgagtttttctc

SEQ ID NO: 322744 - DNA, 44 bp, Artificial Sequence
  Description of Artificial Sequence: Synthetic oligonucleotide
tgatgaaaatgaacatgaaagagtcagacacctgagtttttctc

SEQ ID NO: 322745 - DNA, 43 bp, Artificial Sequence
  Description of Artificial Sequence: Synthetic oligonucleotide
gatgaaaatgaacatgaaagagtcagacacctgagtttttctc

SEQ ID NO: 322746 - DNA, 43 bp, Artificial Sequence
  Description of Artificial Sequence: Synthetic oligonucleotide
atgaaaatgaacatgaaagagtcagacacctgagtttttctcg

SEQ ID NO: 322747 - DNA, 42 bp, Artificial Sequence
  Description of Artificial Sequence: Synthetic oligonucleotide
tgaaaatgaacatgaaagagtcagacacctgagtttttctcg

SEQ ID NO: 322748 - DNA, 41 bp, Artificial Sequence
  Description of Artificial Sequence: Synthetic oligonucleotide
gaaaatgaacatgaaagagtcagacacctgagtttttctcg

SEQ ID NO: 322749 - DNA, 43 bp, Artificial Sequence
  Description of Artificial Sequence: Synthetic oligonucleotide
aaaatgaacatgaaagagtcagacacctgagtttttctcgatc

SEQ ID NO: 322750 - DNA, 42 bp, Artificial Sequence
  Description of Artificial Sequence: Synthetic oligonucleotide
aaatgaacatgaaagagtcagacacctgagtttttctcgatc

SEQ ID NO: 322751 - DNA, 41 bp, Artificial Sequence
  Description of Artificial Sequence: Synthetic oligonucleotide
aatgaacatgaaagagtcagacacctgagtttttctcgatc

SEQ ID NO: 322752 - DNA, 40 bp, Artificial Sequence
  Description of Artificial Sequence: Synthetic oligonucleotide
atgaacatgaaagagtcagacacctgagtttttctcgatc

SEQ ID NO: 322753 - DNA, 39 bp, Artificial Sequence
  Description of Artificial Sequence: Synthetic oligonucleotide
tgaacatgaaagagtcagacacctgagtttttctcgatc

SEQ ID NO: 322754 - DNA, 38 bp, Artificial Sequence
  Description of Artificial Sequence: Synthetic oligonucleotide
gaacatgaaagagtcagacacctgagtttttctcgatc

SEQ ID NO: 322755 - DNA, 39 bp, Artificial Sequence
  Description of Artificial Sequence: Synthetic oligonucleotide
aacatgaaagagtcagacacctgagtttttctcgatcag

SEQ ID NO: 322756 - DNA, 38 bp, Artificial Sequence
  Description of Artificial Sequence: Synthetic oligonucleotide
acatgaaagagtcagacacctgagtttttctcgatcag

SEQ ID NO: 322757 - DNA, 37 bp, Artificial Sequence
  Description of Artificial Sequence: Synthetic oligonucleotide
catgaaagagtcagacacctgagtttttctcgatcag

SEQ ID NO: 322758 - DNA, 37 bp, Artificial Sequence
  Description of Artificial Sequence: Synthetic oligonucleotide
atgaaagagtcagacacctgagtttttctcgatcagg

SEQ ID NO: 322759 - DNA, 36 bp, Artificial Sequence
  Description of Artificial Sequence: Synthetic oligonucleotide
tgaaagagtcagacacctgagtttttctcgatcagg

SEQ ID NO: 322760 - DNA, 35 bp, Artificial Sequence
  Description of Artificial Sequence: Synthetic oligonucleotide
gaaagagtcagacacctgagtttttctcgatcagg

SEQ ID NO: 322761 - DNA, 35 bp, Artificial Sequence
  Description of Artificial Sequence: Synthetic oligonucleotide
aaagagtcagacacctgagtttttctcgatcaggc

SEQ ID NO: 322762 - DNA, 34 bp, Artificial Sequence
  Description of Artificial Sequence: Synthetic oligonucleotide
aagagtcagacacctgagtttttctcgatcaggc

SEQ ID NO: 322763 - DNA, 33 bp, Artificial Sequence
  Description of Artificial Sequence: Synthetic oligonucleotide
agagtcagacacctgagtttttctcgatcaggc

SEQ ID NO: 322764 - DNA, 32 bp, Artificial Sequence
  Description of Artificial Sequence: Synthetic oligonucleotide
gagtcagacacctgagtttttctcgatcaggc

SEQ ID NO: 322765 - DNA, 35 bp, Artificial Sequence
  Description of Artificial Sequence: Synthetic oligonucleotide
agtcagacacctgagtttttctcgatcaggcaatg

SEQ ID NO: 322766 - DNA, 34 bp, Artificial Sequence
  Description of Artificial Sequence: Synthetic oligonucleotide
gtcagacacctgagtttttctcgatcaggcaatg

SEQ ID NO: 322767 - DNA, 36 bp, Artificial Sequence
  Description of Artificial Sequence: Synthetic oligonucleotide
tcagacacctgagtttttctcgatcaggcaatgatg

SEQ ID NO: 322768 - DNA, 35 bp, Artificial Sequence
  Description of Artificial Sequence: Synthetic oligonucleotide
cagacacctgagtttttctcgatcaggcaatgatg

SEQ ID NO: 322769 - DNA, 37 bp, Artificial Sequence
  Description of Artificial Sequence: Synthetic oligonucleotide
agacacctgagtttttctcgatcaggcaatgatgatg

SEQ ID NO: 322770 - DNA, 36 bp, Artificial Sequence
  Description of Artificial Sequence: Synthetic oligonucleotide
gacacctgagtttttctcgatcaggcaatgatgatg

SEQ ID NO: 322771 - DNA, 38 bp, Artificial Sequence
  Description of Artificial Sequence: Synthetic oligonucleotide
acacctgagtttttctcgatcaggcaatgatgatgaag

SEQ ID NO: 322772 - DNA, 37 bp, Artificial Sequence
  Description of Artificial Sequence: Synthetic oligonucleotide
cacctgagtttttctcgatcaggcaatgatgatgaag

SEQ ID NO: 322773 - DNA, 39 bp, Artificial Sequence
  Description of Artificial Sequence: Synthetic oligonucleotide
acctgagtttttctcgatcaggcaatgatgatgaagaag

SEQ ID NO: 322774 - DNA, 38 bp, Artificial Sequence
  Description of Artificial Sequence: Synthetic oligonucleotide
cctgagtttttctcgatcaggcaatgatgatgaagaag

SEQ ID NO: 322775 - DNA, 45 bp, Artificial Sequence
  Description of Artificial Sequence: Synthetic oligonucleotide
ctgagtttttctcgatcaggcaatgatgatgaagaagattttttc

SEQ ID NO: 322776 - DNA, 46 bp, Artificial Sequence
  Description of Artificial Sequence: Synthetic oligonucleotide
tgagtttttctcgatcaggcaatgatgatgaagaagattttttctc

SEQ ID NO: 322777 - DNA, 45 bp, Artificial Sequence
  Description of Artificial Sequence: Synthetic oligonucleotide
gagtttttctcgatcaggcaatgatgatgaagaagattttttctc

SEQ ID NO: 322778 - DNA, 45 bp, Artificial Sequence
  Description of Artificial Sequence: Synthetic oligonucleotide
agtttttctcgatcaggcaatgatgatgaagaagattttttctcc

SEQ ID NO: 322779 - DNA, 44 bp, Artificial Sequence
  Description of Artificial Sequence: Synthetic oligonucleotide
gtttttctcgatcaggcaatgatgatgaagaagattttttctcc

SEQ ID NO: 322780 - DNA, 45 bp, Artificial Sequence
  Description of Artificial Sequence: Synthetic oligonucleotide
tttttctcgatcaggcaatgatgatgaagaagattttttctccag

SEQ ID NO: 322781 - DNA, 44 bp, Artificial Sequence
  Description of Artificial Sequence: Synthetic oligonucleotide
ttttctcgatcaggcaatgatgatgaagaagattttttctccag

SEQ ID NO: 322782 - DNA, 43 bp, Artificial Sequence
  Description of Artificial Sequence: Synthetic oligonucleotide
tttctcgatcaggcaatgatgatgaagaagattttttctccag

SEQ ID NO: 322783 - DNA, 42 bp, Artificial Sequence
  Description of Artificial Sequence: Synthetic oligonucleotide
ttctcgatcaggcaatgatgatgaagaagattttttctccag

SEQ ID NO: 322784 - DNA, 41 bp, Artificial Sequence
  Description of Artificial Sequence: Synthetic oligonucleotide
tctcgatcaggcaatgatgatgaagaagattttttctccag

SEQ ID NO: 322785 - DNA, 40 bp, Artificial Sequence
  Description of Artificial Sequence: Synthetic oligonucleotide
ctcgatcaggcaatgatgatgaagaagattttttctccag

SEQ ID NO: 322786 - DNA, 40 bp, Artificial Sequence
  Description of Artificial Sequence: Synthetic oligonucleotide
tcgatcaggcaatgatgatgaagaagattttttctccagc

SEQ ID NO: 322787 - DNA, 39 bp, Artificial Sequence
  Description of Artificial Sequence: Synthetic oligonucleotide
cgatcaggcaatgatgatgaagaagattttttctccagc

SEQ ID NO: 322788 - DNA, 40 bp, Artificial Sequence
  Description of Artificial Sequence: Synthetic oligonucleotide
gatcaggcaatgatgatgaagaagattttttctccagcag

SEQ ID NO: 322789 - DNA, 40 bp, Artificial Sequence
  Description of Artificial Sequence: Synthetic oligonucleotide
atcaggcaatgatgatgaagaagattttttctccagcagc

SEQ ID NO: 322790 - DNA, 39 bp, Artificial Sequence
  Description of Artificial Sequence: Synthetic oligonucleotide
tcaggcaatgatgatgaagaagattttttctccagcagc

SEQ ID NO: 322791 - DNA, 38 bp, Artificial Sequence
  Description of Artificial Sequence: Synthetic oligonucleotide
caggcaatgatgatgaagaagattttttctccagcagc

SEQ ID NO: 322792 - DNA, 42 bp, Artificial Sequence
  Description of Artificial Sequence: Synthetic oligonucleotide
aggcaatgatgatgaagaagattttttctccagcagcatttc

SEQ ID NO: 322793 - DNA, 41 bp, Artificial Sequence
  Description of Artificial Sequence: Synthetic oligonucleotide
ggcaatgatgatgaagaagattttttctccagcagcatttc

SEQ ID NO: 322794 - DNA, 43 bp, Artificial Sequence
  Description of Artificial Sequence: Synthetic oligonucleotide
gcaatgatgatgaagaagattttttctccagcagcatttcaac

SEQ ID NO: 322795 - DNA, 43 bp, Artificial Sequence
  Description of Artificial Sequence: Synthetic oligonucleotide
caatgatgatgaagaagattttttctccagcagcatttcaacg

SEQ ID NO: 322796 - DNA, 44 bp, Artificial Sequence
  Description of Artificial Sequence: Synthetic oligonucleotide
aatgatgatgaagaagattttttctccagcagcatttcaacgac

SEQ ID NO: 322797 - DNA, 43 bp, Artificial Sequence
  Description of Artificial Sequence: Synthetic oligonucleotide
atgatgatgaagaagattttttctccagcagcatttcaacgac

SEQ ID NO: 322798 - DNA, 42 bp, Artificial Sequence
  Description of Artificial Sequence: Synthetic oligonucleotide
tgatgatgaagaagattttttctccagcagcatttcaacgac

SEQ ID NO: 322799 - DNA, 41 bp, Artificial Sequence
  Description of Artificial Sequence: Synthetic oligonucleotide
gatgatgaagaagattttttctccagcagcatttcaacgac

SEQ ID NO: 322800 - DNA, 42 bp, Artificial Sequence
  Description of Artificial Sequence: Synthetic oligonucleotide
atgatgaagaagattttttctccagcagcatttcaacgacac

SEQ ID NO: 322801 - DNA, 41 bp, Artificial Sequence
  Description of Artificial Sequence: Synthetic oligonucleotide
tgatgaagaagattttttctccagcagcatttcaacgacac

SEQ ID NO: 322802 - DNA, 40 bp, Artificial Sequence
  Description of Artificial Sequence: Synthetic oligonucleotide
gatgaagaagattttttctccagcagcatttcaacgacac

SEQ ID NO: 322803 - DNA, 40 bp, Artificial Sequence
  Description of Artificial Sequence: Synthetic oligonucleotide
atgaagaagattttttctccagcagcatttcaacgacacc

SEQ ID NO: 322804 - DNA, 39 bp, Artificial Sequence
  Description of Artificial Sequence: Synthetic oligonucleotide
tgaagaagattttttctccagcagcatttcaacgacacc

SEQ ID NO: 322805 - DNA, 38 bp, Artificial Sequence
  Description of Artificial Sequence: Synthetic oligonucleotide
gaagaagattttttctccagcagcatttcaacgacacc

SEQ ID NO: 322806 - DNA, 39 bp, Artificial Sequence
  Description of Artificial Sequence: Synthetic oligonucleotide
aagaagattttttctccagcagcatttcaacgacaccac

SEQ ID NO: 322807 - DNA, 38 bp, Artificial Sequence
  Description of Artificial Sequence: Synthetic oligonucleotide
agaagattttttctccagcagcatttcaacgacaccac

SEQ ID NO: 322808 - DNA, 37 bp, Artificial Sequence
  Description of Artificial Sequence: Synthetic oligonucleotide
gaagattttttctccagcagcatttcaacgacaccac

SEQ ID NO: 322809 - DNA, 37 bp, Artificial Sequence
  Description of Artificial Sequence: Synthetic oligonucleotide
aagattttttctccagcagcatttcaacgacaccacg

SEQ ID NO: 322810 - DNA, 36 bp, Artificial Sequence
  Description of Artificial Sequence: Synthetic oligonucleotide
agattttttctccagcagcatttcaacgacaccacg

SEQ ID NO: 322811 - DNA, 35 bp, Artificial Sequence
  Description of Artificial Sequence: Synthetic oligonucleotide
gattttttctccagcagcatttcaacgacaccacg

SEQ ID NO: 322812 - DNA, 35 bp, Artificial Sequence
  Description of Artificial Sequence: Synthetic oligonucleotide
attttttctccagcagcatttcaacgacaccacgg

SEQ ID NO: 322813 - DNA, 34 bp, Artificial Sequence
  Description of Artificial Sequence: Synthetic oligonucleotide
ttttttctccagcagcatttcaacgacaccacgg

SEQ ID NO: 322814 - DNA, 33 bp, Artificial Sequence
  Description of Artificial Sequence: Synthetic oligonucleotide
tttttctccagcagcatttcaacgacaccacgg

SEQ ID NO: 322815 - DNA, 32 bp, Artificial Sequence
  Description of Artificial Sequence: Synthetic oligonucleotide
ttttctccagcagcatttcaacgacaccacgg

SEQ ID NO: 322816 - DNA, 31 bp, Artificial Sequence
  Description of Artificial Sequence: Synthetic oligonucleotide
tttctccagcagcatttcaacgacaccacgg

SEQ ID NO: 322817 - DNA, 30 bp, Artificial Sequence
  Description of Artificial Sequence: Synthetic oligonucleotide
ttctccagcagcatttcaacgacaccacgg

SEQ ID NO: 322818 - DNA, 29 bp, Artificial Sequence
  Description of Artificial Sequence: Synthetic oligonucleotide
tctccagcagcatttcaacgacaccacgg

SEQ ID NO: 322819 - DNA, 28 bp, Artificial Sequence
  Description of Artificial Sequence: Synthetic oligonucleotide
ctccagcagcatttcaacgacaccacgg

SEQ ID NO: 322820 - DNA, 28 bp, Artificial Sequence
  Description of Artificial Sequence: Synthetic oligonucleotide
tccagcagcatttcaacgacaccacggc

SEQ ID NO: 322821 - DNA, 27 bp, Artificial Sequence
  Description of Artificial Sequence: Synthetic oligonucleotide
ccagcagcatttcaacgacaccacggc

SEQ ID NO: 322822 - DNA, 27 bp, Artificial Sequence
  Description of Artificial Sequence: Synthetic oligonucleotide
cagcagcatttcaacgacaccacggcc

SEQ ID NO: 322823 - DNA, 31 bp, Artificial Sequence
  Description of Artificial Sequence: Synthetic oligonucleotide
agcagcatttcaacgacaccacggccttttg

SEQ ID NO: 322824 - DNA, 30 bp, Artificial Sequence
  Description of Artificial Sequence: Synthetic oligonucleotide
gcagcatttcaacgacaccacggccttttg

SEQ ID NO: 322825 - DNA, 31 bp, Artificial Sequence
  Description of Artificial Sequence: Synthetic oligonucleotide
cagcatttcaacgacaccacggccttttgac

SEQ ID NO: 322826 - DNA, 31 bp, Artificial Sequence
  Description of Artificial Sequence: Synthetic oligonucleotide
agcatttcaacgacaccacggccttttgacc

SEQ ID NO: 322827 - DNA, 30 bp, Artificial Sequence
  Description of Artificial Sequence: Synthetic oligonucleotide
gcatttcaacgacaccacggccttttgacc

SEQ ID NO: 322828 - DNA, 31 bp, Artificial Sequence
  Description of Artificial Sequence: Synthetic oligonucleotide
catttcaacgacaccacggccttttgacctc

SEQ ID NO: 322829 - DNA, 32 bp, Artificial Sequence
  Description of Artificial Sequence: Synthetic oligonucleotide
atttcaacgacaccacggccttttgacctcac

SEQ ID NO: 322830 - DNA, 31 bp, Artificial Sequence
  Description of Artificial Sequence: Synthetic oligonucleotide
tttcaacgacaccacggccttttgacctcac

SEQ ID NO: 322831 - DNA, 30 bp, Artificial Sequence
  Description of Artificial Sequence: Synthetic oligonucleotide
ttcaacgacaccacggccttttgacctcac

SEQ ID NO: 322832 - DNA, 29 bp, Artificial Sequence
  Description of Artificial Sequence: Synthetic oligonucleotide
tcaacgacaccacggccttttgacctcac

SEQ ID NO: 322833 - DNA, 28 bp, Artificial Sequence
  Description of Artificial Sequence: Synthetic oligonucleotide
caacgacaccacggccttttgacctcac

SEQ ID NO: 322834 - DNA, 32 bp, Artificial Sequence
  Description of Artificial Sequence: Synthetic oligonucleotide
aacgacaccacggccttttgacctcacaaaac

SEQ ID NO: 322835 - DNA, 31 bp, Artificial Sequence
  Description of Artificial Sequence: Synthetic oligonucleotide
acgacaccacggccttttgacctcacaaaac

SEQ ID NO: 322836 - DNA, 30 bp, Artificial Sequence
  Description of Artificial Sequence: Synthetic oligonucleotide
cgacaccacggccttttgacctcacaaaac

SEQ ID NO: 322837 - DNA, 31 bp, Artificial Sequence
  Description of Artificial Sequence: Synthetic oligonucleotide
gacaccacggccttttgacctcacaaaacac

SEQ ID NO: 322838 - DNA, 33 bp, Artificial Sequence
  Description of Artificial Sequence: Synthetic oligonucleotide
acaccacggccttttgacctcacaaaacacaac

SEQ ID NO: 322839 - DNA, 32 bp, Artificial Sequence
  Description of Artificial Sequence: Synthetic oligonucleotide
caccacggccttttgacctcacaaaacacaac

SEQ ID NO: 322840 - DNA, 32 bp, Artificial Sequence
  Description of Artificial Sequence: Synthetic oligonucleotide
accacggccttttgacctcacaaaacacaacc

SEQ ID NO: 322841 - DNA, 31 bp, Artificial Sequence
  Description of Artificial Sequence: Synthetic oligonucleotide
ccacggccttttgacctcacaaaacacaacc

SEQ ID NO: 322842 - DNA, 32 bp, Artificial Sequence
  Description of Artificial Sequence: Synthetic oligonucleotide
cacggccttttgacctcacaaaacacaaccag

SEQ ID NO: 322843 - DNA, 32 bp, Artificial Sequence
  Description of Artificial Sequence: Synthetic oligonucleotide
acggccttttgacctcacaaaacacaaccagg

SEQ ID NO: 322844 - DNA, 31 bp, Artificial Sequence
  Description of Artificial Sequence: Synthetic oligonucleotide
cggccttttgacctcacaaaacacaaccagg

SEQ ID NO: 322845 - DNA, 32 bp, Artificial Sequence
  Description of Artificial Sequence: Synthetic oligonucleotide
ggccttttgacctcacaaaacacaaccaggac

SEQ ID NO: 322846 - DNA, 33 bp, Artificial Sequence
  Description of Artificial Sequence: Synthetic oligonucleotide
gccttttgacctcacaaaacacaaccaggacag

SEQ ID NO: 322847 - DNA, 33 bp, Artificial Sequence
  Description of Artificial Sequence: Synthetic oligonucleotide
ccttttgacctcacaaaacacaaccaggacagg

SEQ ID NO: 322848 - DNA, 34 bp, Artificial Sequence
  Description of Artificial Sequence: Synthetic oligonucleotide
cttttgacctcacaaaacacaaccaggacaggac

SEQ ID NO: 322849 - DNA, 34 bp, Artificial Sequence
  Description of Artificial Sequence: Synthetic oligonucleotide
ttttgacctcacaaaacacaaccaggacaggacc

SEQ ID NO: 322850 - DNA, 33 bp, Artificial Sequence
  Description of Artificial Sequence: Synthetic oligonucleotide
tttgacctcacaaaacacaaccaggacaggacc

SEQ ID NO: 322851 - DNA, 32 bp, Artificial Sequence
  Description of Artificial Sequence: Synthetic oligonucleotide
ttgacctcacaaaacacaaccaggacaggacc

SEQ ID NO: 322852 - DNA, 31 bp, Artificial Sequence
  Description of Artificial Sequence: Synthetic oligonucleotide
tgacctcacaaaacacaaccaggacaggacc

SEQ ID NO: 322853 - DNA, 30 bp, Artificial Sequence
  Description of Artificial Sequence: Synthetic oligonucleotide
gacctcacaaaacacaaccaggacaggacc

SEQ ID NO: 322854 - DNA, 30 bp, Artificial Sequence
  Description of Artificial Sequence: Synthetic oligonucleotide
acctcacaaaacacaaccaggacaggaccc

SEQ ID NO: 322855 - DNA, 29 bp, Artificial Sequence
  Description of Artificial Sequence: Synthetic oligonucleotide
cctcacaaaacacaaccaggacaggaccc

SEQ ID NO: 322856 - DNA, 30 bp, Artificial Sequence
  Description of Artificial Sequence: Synthetic oligonucleotide
ctcacaaaacacaaccaggacaggacccag

SEQ ID NO: 322857 - DNA, 31 bp, Artificial Sequence
  Description of Artificial Sequence: Synthetic oligonucleotide
tcacaaaacacaaccaggacaggacccagtc

SEQ ID NO: 322858 - DNA, 30 bp, Artificial Sequence
  Description of Artificial Sequence: Synthetic oligonucleotide
cacaaaacacaaccaggacaggacccagtc

SEQ ID NO: 322859 - DNA, 30 bp, Artificial Sequence
  Description of Artificial Sequence: Synthetic oligonucleotide
acaaaacacaaccaggacaggacccagtcg

SEQ ID NO: 322860 - DNA, 29 bp, Artificial Sequence
  Description of Artificial Sequence: Synthetic oligonucleotide
caaaacacaaccaggacaggacccagtcg

SEQ ID NO: 322861 - DNA, 31 bp, Artificial Sequence
  Description of Artificial Sequence: Synthetic oligonucleotide
aaaacacaaccaggacaggacccagtcgaac

SEQ ID NO: 322862 - DNA, 30 bp, Artificial Sequence
  Description of Artificial Sequence: Synthetic oligonucleotide
aaacacaaccaggacaggacccagtcgaac

SEQ ID NO: 322863 - DNA, 29 bp, Artificial Sequence
  Description of Artificial Sequence: Synthetic oligonucleotide
aacacaaccaggacaggacccagtcgaac

SEQ ID NO: 322864 - DNA, 28 bp, Artificial Sequence
  Description of Artificial Sequence: Synthetic oligonucleotide
acacaaccaggacaggacccagtcgaac

SEQ ID NO: 322865 - DNA, 27 bp, Artificial Sequence
  Description of Artificial Sequence: Synthetic oligonucleotide
cacaaccaggacaggacccagtcgaac

SEQ ID NO: 322866 - DNA, 27 bp, Artificial Sequence
  Description of Artificial Sequence: Synthetic oligonucleotide
acaaccaggacaggacccagtcgaacc

SEQ ID NO: 322867 - DNA, 26 bp, Artificial Sequence
  Description of Artificial Sequence: Synthetic oligonucleotide
caaccaggacaggacccagtcgaacc

SEQ ID NO: 322868 - DNA, 27 bp, Artificial Sequence
  Description of Artificial Sequence: Synthetic oligonucleotide
aaccaggacaggacccagtcgaaccca

SEQ ID NO: 322869 - DNA, 27 bp, Artificial Sequence
  Description of Artificial Sequence: Synthetic oligonucleotide
accaggacaggacccagtcgaacccaa

SEQ ID NO: 322870 - DNA, 26 bp, Artificial Sequence
  Description of Artificial Sequence: Synthetic oligonucleotide
ccaggacaggacccagtcgaacccaa

SEQ ID NO: 322871 - DNA, 26 bp, Artificial Sequence
  Description of Artificial Sequence: Synthetic oligonucleotide
caggacaggacccagtcgaacccaag

SEQ ID NO: 322872 - DNA, 26 bp, Artificial Sequence
  Description of Artificial Sequence: Synthetic oligonucleotide
aggacaggacccagtcgaacccaagg

SEQ ID NO: 322873 - DNA, 25 bp, Artificial Sequence
  Description of Artificial Sequence: Synthetic oligonucleotide
ggacaggacccagtcgaacccaagg

SEQ ID NO: 322874 - DNA, 27 bp, Artificial Sequence
  Description of Artificial Sequence: Synthetic oligonucleotide
gacaggacccagtcgaacccaaggcat

SEQ ID NO: 322875 - DNA, 28 bp, Artificial Sequence
  Description of Artificial Sequence: Synthetic oligonucleotide
acaggacccagtcgaacccaaggcattc

SEQ ID NO: 322876 - DNA, 27 bp, Artificial Sequence
  Description of Artificial Sequence: Synthetic oligonucleotide
caggacccagtcgaacccaaggcattc

SEQ ID NO: 322877 - DNA, 31 bp, Artificial Sequence
  Description of Artificial Sequence: Synthetic oligonucleotide
aggacccagtcgaacccaaggcattcaaatg

SEQ ID NO: 322878 - DNA, 30 bp, Artificial Sequence
  Description of Artificial Sequence: Synthetic oligonucleotide
ggacccagtcgaacccaaggcattcaaatg

SEQ ID NO: 322879 - DNA, 30 bp, Artificial Sequence
  Description of Artificial Sequence: Synthetic oligonucleotide
gacccagtcgaacccaaggcattcaaatgc

SEQ ID NO: 322880 - DNA, 30 bp, Artificial Sequence
  Description of Artificial Sequence: Synthetic oligonucleotide
acccagtcgaacccaaggcattcaaatgcg

SEQ ID NO: 322881 - DNA, 29 bp, Artificial Sequence
  Description of Artificial Sequence: Synthetic oligonucleotide
cccagtcgaacccaaggcattcaaatgcg

SEQ ID NO: 322882 - DNA, 29 bp, Artificial Sequence
  Description of Artificial Sequence: Synthetic oligonucleotide
ccagtcgaacccaaggcattcaaatgcgg

SEQ ID NO: 322883 - DNA, 31 bp, Artificial Sequence
  Description of Artificial Sequence: Synthetic oligonucleotide
cagtcgaacccaaggcattcaaatgcggaag

SEQ ID NO: 322884 - DNA, 32 bp, Artificial Sequence
  Description of Artificial Sequence: Synthetic oligonucleotide
agtcgaacccaaggcattcaaatgcggaagtg

SEQ ID NO: 322885 - DNA, 31 bp, Artificial Sequence
  Description of Artificial Sequence: Synthetic oligonucleotide
gtcgaacccaaggcattcaaatgcggaagtg

SEQ ID NO: 322886 - DNA, 31 bp, Artificial Sequence
  Description of Artificial Sequence: Synthetic oligonucleotide
tcgaacccaaggcattcaaatgcggaagtgc

SEQ ID NO: 322887 - DNA, 30 bp, Artificial Sequence
  Description of Artificial Sequence: Synthetic oligonucleotide
cgaacccaaggcattcaaatgcggaagtgc

SEQ ID NO: 322888 - DNA, 32 bp, Artificial Sequence
  Description of Artificial Sequence: Synthetic oligonucleotide
gaacccaaggcattcaaatgcggaagtgcaac

SEQ ID NO: 322889 - DNA, 34 bp, Artificial Sequence
  Description of Artificial Sequence: Synthetic oligonucleotide
aacccaaggcattcaaatgcggaagtgcaacttc

SEQ ID NO: 322890 - DNA, 33 bp, Artificial Sequence
  Description of Artificial Sequence: Synthetic oligonucleotide
acccaaggcattcaaatgcggaagtgcaacttc

SEQ ID NO: 322891 - DNA, 32 bp, Artificial Sequence
  Description of Artificial Sequence: Synthetic oligonucleotide
cccaaggcattcaaatgcggaagtgcaacttc

SEQ ID NO: 322892 - DNA, 33 bp, Artificial Sequence
  Description of Artificial Sequence: Synthetic oligonucleotide
ccaaggcattcaaatgcggaagtgcaacttcag

SEQ ID NO: 322893 - DNA, 34 bp, Artificial Sequence
  Description of Artificial Sequence: Synthetic oligonucleotide
caaggcattcaaatgcggaagtgcaacttcagac

SEQ ID NO: 322894 - DNA, 36 bp, Artificial Sequence
  Description of Artificial Sequence: Synthetic oligonucleotide
aaggcattcaaatgcggaagtgcaacttcagactac

SEQ ID NO: 322895 - DNA, 35 bp, Artificial Sequence
  Description of Artificial Sequence: Synthetic oligonucleotide
aggcattcaaatgcggaagtgcaacttcagactac

SEQ ID NO: 322896 - DNA, 34 bp, Artificial Sequence
  Description of Artificial Sequence: Synthetic oligonucleotide
ggcattcaaatgcggaagtgcaacttcagactac

SEQ ID NO: 322897 - DNA, 34 bp, Artificial Sequence
  Description of Artificial Sequence: Synthetic oligonucleotide
gcattcaaatgcggaagtgcaacttcagactacc

SEQ ID NO: 322898 - DNA, 35 bp, Artificial Sequence
  Description of Artificial Sequence: Synthetic oligonucleotide
cattcaaatgcggaagtgcaacttcagactaccac

SEQ ID NO: 322899 - DNA, 37 bp, Artificial Sequence
  Description of Artificial Sequence: Synthetic oligonucleotide
attcaaatgcggaagtgcaacttcagactaccacaag

SEQ ID NO: 322900 - DNA, 36 bp, Artificial Sequence
  Description of Artificial Sequence: Synthetic oligonucleotide
ttcaaatgcggaagtgcaacttcagactaccacaag

SEQ ID NO: 322901 - DNA, 35 bp, Artificial Sequence
  Description of Artificial Sequence: Synthetic oligonucleotide
tcaaatgcggaagtgcaacttcagactaccacaag

SEQ ID NO: 322902 - DNA, 34 bp, Artificial Sequence
  Description of Artificial Sequence: Synthetic oligonucleotide
caaatgcggaagtgcaacttcagactaccacaag

SEQ ID NO: 322903 - DNA, 34 bp, Artificial Sequence
  Description of Artificial Sequence: Synthetic oligonucleotide
aaatgcggaagtgcaacttcagactaccacaagg

SEQ ID NO: 322904 - DNA, 33 bp, Artificial Sequence
  Description of Artificial Sequence: Synthetic oligonucleotide
aatgcggaagtgcaacttcagactaccacaagg

SEQ ID NO: 322905 - DNA, 32 bp, Artificial Sequence
  Description of Artificial Sequence: Synthetic oligonucleotide
atgcggaagtgcaacttcagactaccacaagg

SEQ ID NO: 322906 - DNA, 31 bp, Artificial Sequence
  Description of Artificial Sequence: Synthetic oligonucleotide
tgcggaagtgcaacttcagactaccacaagg

SEQ ID NO: 322907 - DNA, 30 bp, Artificial Sequence
  Description of Artificial Sequence: Synthetic oligonucleotide
gcggaagtgcaacttcagactaccacaagg

SEQ ID NO: 322908 - DNA, 32 bp, Artificial Sequence
  Description of Artificial Sequence: Synthetic oligonucleotide
cggaagtgcaacttcagactaccacaaggttg

SEQ ID NO: 322909 - DNA, 33 bp, Artificial Sequence
  Description of Artificial Sequence: Synthetic oligonucleotide
ggaagtgcaacttcagactaccacaaggttgac

SEQ ID NO: 322910 - DNA, 34 bp, Artificial Sequence
  Description of Artificial Sequence: Synthetic oligonucleotide
gaagtgcaacttcagactaccacaaggttgactg

SEQ ID NO: 322911 - DNA, 36 bp, Artificial Sequence
  Description of Artificial Sequence: Synthetic oligonucleotide
aagtgcaacttcagactaccacaaggttgactgatg

SEQ ID NO: 322912 - DNA, 35 bp, Artificial Sequence
  Description of Artificial Sequence: Synthetic oligonucleotide
agtgcaacttcagactaccacaaggttgactgatg

SEQ ID NO: 322913 - DNA, 34 bp, Artificial Sequence
  Description of Artificial Sequence: Synthetic oligonucleotide
gtgcaacttcagactaccacaaggttgactgatg

SEQ ID NO: 322914 - DNA, 36 bp, Artificial Sequence
  Description of Artificial Sequence: Synthetic oligonucleotide
tgcaacttcagactaccacaaggttgactgatgaag

SEQ ID NO: 322915 - DNA, 35 bp, Artificial Sequence
  Description of Artificial Sequence: Synthetic oligonucleotide
gcaacttcagactaccacaaggttgactgatgaag

SEQ ID NO: 322916 - DNA, 36 bp, Artificial Sequence
  Description of Artificial Sequence: Synthetic oligonucleotide
caacttcagactaccacaaggttgactgatgaagac

SEQ ID NO: 322917 - DNA, 37 bp, Artificial Sequence
  Description of Artificial Sequence: Synthetic oligonucleotide
aacttcagactaccacaaggttgactgatgaagacag

SEQ ID NO: 322918 - DNA, 36 bp, Artificial Sequence
  Description of Artificial Sequence: Synthetic oligonucleotide
acttcagactaccacaaggttgactgatgaagacag

SEQ ID NO: 322919 - DNA, 35 bp, Artificial Sequence
  Description of Artificial Sequence: Synthetic oligonucleotide
cttcagactaccacaaggttgactgatgaagacag

SEQ ID NO: 322920 - DNA, 39 bp, Artificial Sequence
  Description of Artificial Sequence: Synthetic oligonucleotide
ttcagactaccacaaggttgactgatgaagacagaaaag

SEQ ID NO: 322921 - DNA, 38 bp, Artificial Sequence
  Description of Artificial Sequence: Synthetic oligonucleotide
tcagactaccacaaggttgactgatgaagacagaaaag

SEQ ID NO: 322922 - DNA, 37 bp, Artificial Sequence
  Description of Artificial Sequence: Synthetic oligonucleotide
cagactaccacaaggttgactgatgaagacagaaaag

SEQ ID NO: 322923 - DNA, 37 bp, Artificial Sequence
  Description of Artificial Sequence: Synthetic oligonucleotide
agactaccacaaggttgactgatgaagacagaaaagg

SEQ ID NO: 322924 - DNA, 36 bp, Artificial Sequence
  Description of Artificial Sequence: Synthetic oligonucleotide
gactaccacaaggttgactgatgaagacagaaaagg

SEQ ID NO: 322925 - DNA, 36 bp, Artificial Sequence
  Description of Artificial Sequence: Synthetic oligonucleotide
actaccacaaggttgactgatgaagacagaaaaggc

SEQ ID NO: 322926 - DNA, 35 bp, Artificial Sequence
  Description of Artificial Sequence: Synthetic oligonucleotide
ctaccacaaggttgactgatgaagacagaaaaggc

SEQ ID NO: 322927 - DNA, 36 bp, Artificial Sequence
  Description of Artificial Sequence: Synthetic oligonucleotide
taccacaaggttgactgatgaagacagaaaaggcac

SEQ ID NO: 322928 - DNA, 35 bp, Artificial Sequence
  Description of Artificial Sequence: Synthetic oligonucleotide
accacaaggttgactgatgaagacagaaaaggcac

SEQ ID NO: 322929 - DNA, 34 bp, Artificial Sequence
  Description of Artificial Sequence: Synthetic oligonucleotide
ccacaaggttgactgatgaagacagaaaaggcac

SEQ ID NO: 322930 - DNA, 34 bp, Artificial Sequence
  Description of Artificial Sequence: Synthetic oligonucleotide
cacaaggttgactgatgaagacagaaaaggcacc

SEQ ID NO: 322931 - DNA, 35 bp, Artificial Sequence
  Description of Artificial Sequence: Synthetic oligonucleotide
acaaggttgactgatgaagacagaaaaggcaccac

SEQ ID NO: 322932 - DNA, 34 bp, Artificial Sequence
  Description of Artificial Sequence: Synthetic oligonucleotide
caaggttgactgatgaagacagaaaaggcaccac

SEQ ID NO: 322933 - DNA, 35 bp, Artificial Sequence
  Description of Artificial Sequence: Synthetic oligonucleotide
aaggttgactgatgaagacagaaaaggcaccactc

SEQ ID NO: 322934 - DNA, 34 bp, Artificial Sequence
  Description of Artificial Sequence: Synthetic oligonucleotide
aggttgactgatgaagacagaaaaggcaccactc

SEQ ID NO: 322935 - DNA, 33 bp, Artificial Sequence
  Description of Artificial Sequence: Synthetic oligonucleotide
ggttgactgatgaagacagaaaaggcaccactc

SEQ ID NO: 322936 - DNA, 33 bp, Artificial Sequence
  Description of Artificial Sequence: Synthetic oligonucleotide
gttgactgatgaagacagaaaaggcaccactcc

SEQ ID NO: 322937 - DNA, 37 bp, Artificial Sequence
  Description of Artificial Sequence: Synthetic oligonucleotide
ttgactgatgaagacagaaaaggcaccactccttatg

SEQ ID NO: 322938 - DNA, 36 bp, Artificial Sequence
  Description of Artificial Sequence: Synthetic oligonucleotide
tgactgatgaagacagaaaaggcaccactccttatg

SEQ ID NO: 322939 - DNA, 35 bp, Artificial Sequence
  Description of Artificial Sequence: Synthetic oligonucleotide
gactgatgaagacagaaaaggcaccactccttatg

SEQ ID NO: 322940 - DNA, 37 bp, Artificial Sequence
  Description of Artificial Sequence: Synthetic oligonucleotide
actgatgaagacagaaaaggcaccactccttatgaag

SEQ ID NO: 322941 - DNA, 36 bp, Artificial Sequence
  Description of Artificial Sequence: Synthetic oligonucleotide
ctgatgaagacagaaaaggcaccactccttatgaag

SEQ ID NO: 322942 - DNA, 36 bp, Artificial Sequence
  Description of Artificial Sequence: Synthetic oligonucleotide
tgatgaagacagaaaaggcaccactccttatgaagc

SEQ ID NO: 322943 - DNA, 35 bp, Artificial Sequence
  Description of Artificial Sequence: Synthetic oligonucleotide
gatgaagacagaaaaggcaccactccttatgaagc

SEQ ID NO: 322944 - DNA, 38 bp, Artificial Sequence
  Description of Artificial Sequence: Synthetic oligonucleotide
atgaagacagaaaaggcaccactccttatgaagcaaac

SEQ ID NO: 322945 - DNA, 37 bp, Artificial Sequence
  Description of Artificial Sequence: Synthetic oligonucleotide
tgaagacagaaaaggcaccactccttatgaagcaaac

SEQ ID NO: 322946 - DNA, 36 bp, Artificial Sequence
  Description of Artificial Sequence: Synthetic oligonucleotide
gaagacagaaaaggcaccactccttatgaagcaaac

SEQ ID NO: 322947 - DNA, 37 bp, Artificial Sequence
  Description of Artificial Sequence: Synthetic oligonucleotide
aagacagaaaaggcaccactccttatgaagcaaactg

SEQ ID NO: 322948 - DNA, 36 bp, Artificial Sequence
  Description of Artificial Sequence: Synthetic oligonucleotide
agacagaaaaggcaccactccttatgaagcaaactg

SEQ ID NO: 322949 - DNA, 35 bp, Artificial Sequence
  Description of Artificial Sequence: Synthetic oligonucleotide
gacagaaaaggcaccactccttatgaagcaaactg

SEQ ID NO: 322950 - DNA, 35 bp, Artificial Sequence
  Description of Artificial Sequence: Synthetic oligonucleotide
acagaaaaggcaccactccttatgaagcaaactgg

SEQ ID NO: 322951 - DNA, 34 bp, Artificial Sequence
  Description of Artificial Sequence: Synthetic oligonucleotide
cagaaaaggcaccactccttatgaagcaaactgg

SEQ ID NO: 322952 - DNA, 36 bp, Artificial Sequence
  Description of Artificial Sequence: Synthetic oligonucleotide
agaaaaggcaccactccttatgaagcaaactggaag

SEQ ID NO: 322953 - DNA, 35 bp, Artificial Sequence
  Description of Artificial Sequence: Synthetic oligonucleotide
gaaaaggcaccactccttatgaagcaaactggaag

SEQ ID NO: 322954 - DNA, 35 bp, Artificial Sequence
  Description of Artificial Sequence: Synthetic oligonucleotide
aaaaggcaccactccttatgaagcaaactggaagc

SEQ ID NO: 322955 - DNA, 34 bp, Artificial Sequence
  Description of Artificial Sequence: Synthetic oligonucleotide
aaaggcaccactccttatgaagcaaactggaagc

SEQ ID NO: 322956 - DNA, 33 bp, Artificial Sequence
  Description of Artificial Sequence: Synthetic oligonucleotide
aaggcaccactccttatgaagcaaactggaagc

SEQ ID NO: 322957 - DNA, 32 bp, Artificial Sequence
  Description of Artificial Sequence: Synthetic oligonucleotide
aggcaccactccttatgaagcaaactggaagc

SEQ ID NO: 322958 - DNA, 31 bp, Artificial Sequence
  Description of Artificial Sequence: Synthetic oligonucleotide
ggcaccactccttatgaagcaaactggaagc

SEQ ID NO: 322959 - DNA, 31 bp, Artificial Sequence
  Description of Artificial Sequence: Synthetic oligonucleotide
gcaccactccttatgaagcaaactggaagcc

SEQ ID NO: 322960 - DNA, 32 bp, Artificial Sequence
  Description of Artificial Sequence: Synthetic oligonucleotide
caccactccttatgaagcaaactggaagccag

SEQ ID NO: 322961 - DNA, 34 bp, Artificial Sequence
  Description of Artificial Sequence: Synthetic oligonucleotide
accactccttatgaagcaaactggaagccagaag

SEQ ID NO: 322962 - DNA, 33 bp, Artificial Sequence
  Description of Artificial Sequence: Synthetic oligonucleotide
ccactccttatgaagcaaactggaagccagaag

SEQ ID NO: 322963 - DNA, 33 bp, Artificial Sequence
  Description of Artificial Sequence: Synthetic oligonucleotide
cactccttatgaagcaaactggaagccagaagc

SEQ ID NO: 322964 - DNA, 34 bp, Artificial Sequence
  Description of Artificial Sequence: Synthetic oligonucleotide
actccttatgaagcaaactggaagccagaagcag

SEQ ID NO: 322965 - DNA, 33 bp, Artificial Sequence
  Description of Artificial Sequence: Synthetic oligonucleotide
ctccttatgaagcaaactggaagccagaagcag

SEQ ID NO: 322966 - DNA, 34 bp, Artificial Sequence
  Description of Artificial Sequence: Synthetic oligonucleotide
tccttatgaagcaaactggaagccagaagcagac

SEQ ID NO: 322967 - DNA, 33 bp, Artificial Sequence
  Description of Artificial Sequence: Synthetic oligonucleotide
ccttatgaagcaaactggaagccagaagcagac

SEQ ID NO: 322968 - DNA, 33 bp, Artificial Sequence
  Description of Artificial Sequence: Synthetic oligonucleotide
cttatgaagcaaactggaagccagaagcagacc

SEQ ID NO: 322969 - DNA, 33 bp, Artificial Sequence
  Description of Artificial Sequence: Synthetic oligonucleotide
ttatgaagcaaactggaagccagaagcagaccc

SEQ ID NO: 322970 - DNA, 32 bp, Artificial Sequence
  Description of Artificial Sequence: Synthetic oligonucleotide
tatgaagcaaactggaagccagaagcagaccc

SEQ ID NO: 322971 - DNA, 31 bp, Artificial Sequence
  Description of Artificial Sequence: Synthetic oligonucleotide
atgaagcaaactggaagccagaagcagaccc

SEQ ID NO: 322972 - DNA, 30 bp, Artificial Sequence
  Description of Artificial Sequence: Synthetic oligonucleotide
tgaagcaaactggaagccagaagcagaccc

SEQ ID NO: 322973 - DNA, 29 bp, Artificial Sequence
  Description of Artificial Sequence: Synthetic oligonucleotide
gaagcaaactggaagccagaagcagaccc

SEQ ID NO: 322974 - DNA, 30 bp, Artificial Sequence
  Description of Artificial Sequence: Synthetic oligonucleotide
aagcaaactggaagccagaagcagaccctc

SEQ ID NO: 322975 - DNA, 29 bp, Artificial Sequence
  Description of Artificial Sequence: Synthetic oligonucleotide
agcaaactggaagccagaagcagaccctc

SEQ ID NO: 322976 - DNA, 28 bp, Artificial Sequence
  Description of Artificial Sequence: Synthetic oligonucleotide
gcaaactggaagccagaagcagaccctc

SEQ ID NO: 322977 - DNA, 28 bp, Artificial Sequence
  Description of Artificial Sequence: Synthetic oligonucleotide
caaactggaagccagaagcagaccctcc

SEQ ID NO: 322978 - DNA, 28 bp, Artificial Sequence
  Description of Artificial Sequence: Synthetic oligonucleotide
aaactggaagccagaagcagaccctccc

SEQ ID NO: 322979 - DNA, 27 bp, Artificial Sequence
  Description of Artificial Sequence: Synthetic oligonucleotide
aactggaagccagaagcagaccctccc

SEQ ID NO: 322980 - DNA, 26 bp, Artificial Sequence
  Description of Artificial Sequence: Synthetic oligonucleotide
actggaagccagaagcagaccctccc

SEQ ID NO: 322981 - DNA, 25 bp, Artificial Sequence
  Description of Artificial Sequence: Synthetic oligonucleotide
ctggaagccagaagcagaccctccc

SEQ ID NO: 322982 - DNA, 26 bp, Artificial Sequence
  Description of Artificial Sequence: Synthetic oligonucleotide
tggaagccagaagcagaccctcccca

SEQ ID NO: 322983 - DNA, 25 bp, Artificial Sequence
  Description of Artificial Sequence: Synthetic oligonucleotide
ggaagccagaagcagaccctcccca

SEQ ID NO: 322984 - DNA, 27 bp, Artificial Sequence
  Description of Artificial Sequence: Synthetic oligonucleotide
gaagccagaagcagaccctccccacat

SEQ ID NO: 322985 - DNA, 28 bp, Artificial Sequence
  Description of Artificial Sequence: Synthetic oligonucleotide
aagccagaagcagaccctccccacattc

SEQ ID NO: 322986 - DNA, 27 bp, Artificial Sequence
  Description of Artificial Sequence: Synthetic oligonucleotide
agccagaagcagaccctccccacattc

SEQ ID NO: 322987 - DNA, 27 bp, Artificial Sequence
  Description of Artificial Sequence: Synthetic oligonucleotide
gccagaagcagaccctccccacattca

SEQ ID NO: 322988 - DNA, 27 bp, Artificial Sequence
  Description of Artificial Sequence: Synthetic oligonucleotide
ccagaagcagaccctccccacattcac

SEQ ID NO: 322989 - DNA, 27 bp, Artificial Sequence
  Description of Artificial Sequence: Synthetic oligonucleotide
cagaagcagaccctccccacattcacc

SEQ ID NO: 322990 - DNA, 29 bp, Artificial Sequence
  Description of Artificial Sequence: Synthetic oligonucleotide
agaagcagaccctccccacattcaccaag

SEQ ID NO: 322991 - DNA, 28 bp, Artificial Sequence
  Description of Artificial Sequence: Synthetic oligonucleotide
gaagcagaccctccccacattcaccaag

SEQ ID NO: 322992 - DNA, 29 bp, Artificial Sequence
  Description of Artificial Sequence: Synthetic oligonucleotide
aagcagaccctccccacattcaccaagag

SEQ ID NO: 322993 - DNA, 28 bp, Artificial Sequence
  Description of Artificial Sequence: Synthetic oligonucleotide
agcagaccctccccacattcaccaagag

SEQ ID NO: 322994 - DNA, 27 bp, Artificial Sequence
  Description of Artificial Sequence: Synthetic oligonucleotide
gcagaccctccccacattcaccaagag

SEQ ID NO: 322995 - DNA, 27 bp, Artificial Sequence
  Description of Artificial Sequence: Synthetic oligonucleotide
cagaccctccccacattcaccaagagc

SEQ ID NO: 322996 - DNA, 29 bp, Artificial Sequence
  Description of Artificial Sequence: Synthetic oligonucleotide
agaccctccccacattcaccaagagcatc

SEQ ID NO: 322997 - DNA, 28 bp, Artificial Sequence
  Description of Artificial Sequence: Synthetic oligonucleotide
gaccctccccacattcaccaagagcatc

SEQ ID NO: 322998 - DNA, 30 bp, Artificial Sequence
  Description of Artificial Sequence: Synthetic oligonucleotide
accctccccacattcaccaagagcatcatc

SEQ ID NO: 322999 - DNA, 29 bp, Artificial Sequence
  Description of Artificial Sequence: Synthetic oligonucleotide
ccctccccacattcaccaagagcatcatc

SEQ ID NO: 323000 - DNA, 30 bp, Artificial Sequence
  Description of Artificial Sequence: Synthetic oligonucleotide
cctccccacattcaccaagagcatcatcag

SEQ ID NO: 323001 - DNA, 30 bp, Artificial Sequence
  Description of Artificial Sequence: Synthetic oligonucleotide
ctccccacattcaccaagagcatcatcagg

SEQ ID NO: 323002 - DNA, 32 bp, Artificial Sequence
  Description of Artificial Sequence: Synthetic oligonucleotide
tccccacattcaccaagagcatcatcaggaag

SEQ ID NO: 323003 - DNA, 31 bp, Artificial Sequence
  Description of Artificial Sequence: Synthetic oligonucleotide
ccccacattcaccaagagcatcatcaggaag

SEQ ID NO: 323004 - DNA, 33 bp, Artificial Sequence
  Description of Artificial Sequence: Synthetic oligonucleotide
cccacattcaccaagagcatcatcaggaagaag

SEQ ID NO: 323005 - DNA, 34 bp, Artificial Sequence
  Description of Artificial Sequence: Synthetic oligonucleotide
ccacattcaccaagagcatcatcaggaagaagtg

SEQ ID NO: 323006 - DNA, 35 bp, Artificial Sequence
  Description of Artificial Sequence: Synthetic oligonucleotide
cacattcaccaagagcatcatcaggaagaagtgac

SEQ ID NO: 323007 - DNA, 35 bp, Artificial Sequence
  Description of Artificial Sequence: Synthetic oligonucleotide
acattcaccaagagcatcatcaggaagaagtgacc

SEQ ID NO: 323008 - DNA, 34 bp, Artificial Sequence
  Description of Artificial Sequence: Synthetic oligonucleotide
cattcaccaagagcatcatcaggaagaagtgacc

SEQ ID NO: 323009 - DNA, 34 bp, Artificial Sequence
  Description of Artificial Sequence: Synthetic oligonucleotide
attcaccaagagcatcatcaggaagaagtgaccc

SEQ ID NO: 323010 - DNA, 33 bp, Artificial Sequence
  Description of Artificial Sequence: Synthetic oligonucleotide
ttcaccaagagcatcatcaggaagaagtgaccc

SEQ ID NO: 323011 - DNA, 32 bp, Artificial Sequence
  Description of Artificial Sequence: Synthetic oligonucleotide
tcaccaagagcatcatcaggaagaagtgaccc

SEQ ID NO: 323012 - DNA, 31 bp, Artificial Sequence
  Description of Artificial Sequence: Synthetic oligonucleotide
caccaagagcatcatcaggaagaagtgaccc

SEQ ID NO: 323013 - DNA, 31 bp, Artificial Sequence
  Description of Artificial Sequence: Synthetic oligonucleotide
accaagagcatcatcaggaagaagtgacccc

SEQ ID NO: 323014 - DNA, 30 bp, Artificial Sequence
  Description of Artificial Sequence: Synthetic oligonucleotide
ccaagagcatcatcaggaagaagtgacccc

SEQ ID NO: 323015 - DNA, 31 bp, Artificial Sequence
  Description of Artificial Sequence: Synthetic oligonucleotide
caagagcatcatcaggaagaagtgaccccac

SEQ ID NO: 323016 - DNA, 34 bp, Artificial Sequence
  Description of Artificial Sequence: Synthetic oligonucleotide
aagagcatcatcaggaagaagtgaccccacaatc

SEQ ID NO: 323017 - DNA, 33 bp, Artificial Sequence
  Description of Artificial Sequence: Synthetic oligonucleotide
agagcatcatcaggaagaagtgaccccacaatc

SEQ ID NO: 323018 - DNA, 32 bp, Artificial Sequence
  Description of Artificial Sequence: Synthetic oligonucleotide
gagcatcatcaggaagaagtgaccccacaatc

SEQ ID NO: 323019 - DNA, 34 bp, Artificial Sequence
  Description of Artificial Sequence: Synthetic oligonucleotide
agcatcatcaggaagaagtgaccccacaatctac

SEQ ID NO: 323020 - DNA, 33 bp, Artificial Sequence
  Description of Artificial Sequence: Synthetic oligonucleotide
gcatcatcaggaagaagtgaccccacaatctac

SEQ ID NO: 323021 - DNA, 35 bp, Artificial Sequence
  Description of Artificial Sequence: Synthetic oligonucleotide
catcatcaggaagaagtgaccccacaatctacaag

SEQ ID NO: 323022 - DNA, 35 bp, Artificial Sequence
  Description of Artificial Sequence: Synthetic oligonucleotide
atcatcaggaagaagtgaccccacaatctacaagc

SEQ ID NO: 323023 - DNA, 34 bp, Artificial Sequence
  Description of Artificial Sequence: Synthetic oligonucleotide
tcatcaggaagaagtgaccccacaatctacaagc

SEQ ID NO: 323024 - DNA, 33 bp, Artificial Sequence
  Description of Artificial Sequence: Synthetic oligonucleotide
catcaggaagaagtgaccccacaatctacaagc

SEQ ID NO: 323025 - DNA, 34 bp, Artificial Sequence
  Description of Artificial Sequence: Synthetic oligonucleotide
atcaggaagaagtgaccccacaatctacaagctc

SEQ ID NO: 323026 - DNA, 33 bp, Artificial Sequence
  Description of Artificial Sequence: Synthetic oligonucleotide
tcaggaagaagtgaccccacaatctacaagctc

SEQ ID NO: 323027 - DNA, 32 bp, Artificial Sequence
  Description of Artificial Sequence: Synthetic oligonucleotide
caggaagaagtgaccccacaatctacaagctc

SEQ ID NO: 323028 - DNA, 35 bp, Artificial Sequence
  Description of Artificial Sequence: Synthetic oligonucleotide
aggaagaagtgaccccacaatctacaagctcaatc

SEQ ID NO: 323029 - DNA, 34 bp, Artificial Sequence
  Description of Artificial Sequence: Synthetic oligonucleotide
ggaagaagtgaccccacaatctacaagctcaatc

SEQ ID NO: 323030 - DNA, 34 bp, Artificial Sequence
  Description of Artificial Sequence: Synthetic oligonucleotide
gaagaagtgaccccacaatctacaagctcaatcc

SEQ ID NO: 323031 - DNA, 35 bp, Artificial Sequence
  Description of Artificial Sequence: Synthetic oligonucleotide
aagaagtgaccccacaatctacaagctcaatccag

SEQ ID NO: 323032 - DNA, 34 bp, Artificial Sequence
  Description of Artificial Sequence: Synthetic oligonucleotide
agaagtgaccccacaatctacaagctcaatccag

SEQ ID NO: 323033 - DNA, 33 bp, Artificial Sequence
  Description of Artificial Sequence: Synthetic oligonucleotide
gaagtgaccccacaatctacaagctcaatccag

SEQ ID NO: 323034 - DNA, 33 bp, Artificial Sequence
  Description of Artificial Sequence: Synthetic oligonucleotide
aagtgaccccacaatctacaagctcaatccagg

SEQ ID NO: 323035 - DNA, 32 bp, Artificial Sequence
  Description of Artificial Sequence: Synthetic oligonucleotide
agtgaccccacaatctacaagctcaatccagg

SEQ ID NO: 323036 - DNA, 31 bp, Artificial Sequence
  Description of Artificial Sequence: Synthetic oligonucleotide
gtgaccccacaatctacaagctcaatccagg

SEQ ID NO: 323037 - DNA, 31 bp, Artificial Sequence
  Description of Artificial Sequence: Synthetic oligonucleotide
tgaccccacaatctacaagctcaatccaggg

SEQ ID NO: 323038 - DNA, 30 bp, Artificial Sequence
  Description of Artificial Sequence: Synthetic oligonucleotide
gaccccacaatctacaagctcaatccaggg

SEQ ID NO: 323039 - DNA, 32 bp, Artificial Sequence
  Description of Artificial Sequence: Synthetic oligonucleotide
accccacaatctacaagctcaatccagggaac

SEQ ID NO: 323040 - DNA, 31 bp, Artificial Sequence
  Description of Artificial Sequence: Synthetic oligonucleotide
ccccacaatctacaagctcaatccagggaac

SEQ ID NO: 323041 - DNA, 32 bp, Artificial Sequence
  Description of Artificial Sequence: Synthetic oligonucleotide
cccacaatctacaagctcaatccagggaactc

SEQ ID NO: 323042 - DNA, 32 bp, Artificial Sequence
  Description of Artificial Sequence: Synthetic oligonucleotide
ccacaatctacaagctcaatccagggaactcc

SEQ ID NO: 323043 - DNA, 34 bp, Artificial Sequence
  Description of Artificial Sequence: Synthetic oligonucleotide
cacaatctacaagctcaatccagggaactcctag

SEQ ID NO: 323044 - DNA, 36 bp, Artificial Sequence
  Description of Artificial Sequence: Synthetic oligonucleotide
acaatctacaagctcaatccagggaactcctagaag

SEQ ID NO: 323045 - DNA, 35 bp, Artificial Sequence
  Description of Artificial Sequence: Synthetic oligonucleotide
caatctacaagctcaatccagggaactcctagaag

SEQ ID NO: 323046 - DNA, 37 bp, Artificial Sequence
  Description of Artificial Sequence: Synthetic oligonucleotide
aatctacaagctcaatccagggaactcctagaagtac

SEQ ID NO: 323047 - DNA, 36 bp, Artificial Sequence
  Description of Artificial Sequence: Synthetic oligonucleotide
atctacaagctcaatccagggaactcctagaagtac

SEQ ID NO: 323048 - DNA, 35 bp, Artificial Sequence
  Description of Artificial Sequence: Synthetic oligonucleotide
tctacaagctcaatccagggaactcctagaagtac

SEQ ID NO: 323049 - DNA, 34 bp, Artificial Sequence
  Description of Artificial Sequence: Synthetic oligonucleotide
ctacaagctcaatccagggaactcctagaagtac

SEQ ID NO: 323050 - DNA, 36 bp, Artificial Sequence
  Description of Artificial Sequence: Synthetic oligonucleotide
tacaagctcaatccagggaactcctagaagtacaac

SEQ ID NO: 323051 - DNA, 35 bp, Artificial Sequence
  Description of Artificial Sequence: Synthetic oligonucleotide
acaagctcaatccagggaactcctagaagtacaac

SEQ ID NO: 323052 - DNA, 34 bp, Artificial Sequence
  Description of Artificial Sequence: Synthetic oligonucleotide
caagctcaatccagggaactcctagaagtacaac

SEQ ID NO: 323053 - DNA, 34 bp, Artificial Sequence
  Description of Artificial Sequence: Synthetic oligonucleotide
aagctcaatccagggaactcctagaagtacaacg

SEQ ID NO: 323054 - DNA, 33 bp, Artificial Sequence
  Description of Artificial Sequence: Synthetic oligonucleotide
agctcaatccagggaactcctagaagtacaacg

SEQ ID NO: 323055 - DNA, 32 bp, Artificial Sequence
  Description of Artificial Sequence: Synthetic oligonucleotide
gctcaatccagggaactcctagaagtacaacg

SEQ ID NO: 323056 - DNA, 32 bp, Artificial Sequence
  Description of Artificial Sequence: Synthetic oligonucleotide
ctcaatccagggaactcctagaagtacaacgc

SEQ ID NO: 323057 - DNA, 34 bp, Artificial Sequence
  Description of Artificial Sequence: Synthetic oligonucleotide
tcaatccagggaactcctagaagtacaacgcaag

SEQ ID NO: 323058 - DNA, 33 bp, Artificial Sequence
  Description of Artificial Sequence: Synthetic oligonucleotide
caatccagggaactcctagaagtacaacgcaag

SEQ ID NO: 323059 - DNA, 36 bp, Artificial Sequence
  Description of Artificial Sequence: Synthetic oligonucleotide
aatccagggaactcctagaagtacaacgcaagaaac

SEQ ID NO: 323060 - DNA, 35 bp, Artificial Sequence
  Description of Artificial Sequence: Synthetic oligonucleotide
atccagggaactcctagaagtacaacgcaagaaac

SEQ ID NO: 323061 - DNA, 34 bp, Artificial Sequence
  Description of Artificial Sequence: Synthetic oligonucleotide
tccagggaactcctagaagtacaacgcaagaaac

SEQ ID NO: 323062 - DNA, 33 bp, Artificial Sequence
  Description of Artificial Sequence: Synthetic oligonucleotide
ccagggaactcctagaagtacaacgcaagaaac

SEQ ID NO: 323063 - DNA, 34 bp, Artificial Sequence
  Description of Artificial Sequence: Synthetic oligonucleotide
cagggaactcctagaagtacaacgcaagaaacag

SEQ ID NO: 323064 - DNA, 34 bp, Artificial Sequence
  Description of Artificial Sequence: Synthetic oligonucleotide
agggaactcctagaagtacaacgcaagaaacagg

SEQ ID NO: 323065 - DNA, 33 bp, Artificial Sequence
  Description of Artificial Sequence: Synthetic oligonucleotide
gggaactcctagaagtacaacgcaagaaacagg

SEQ ID NO: 323066 - DNA, 35 bp, Artificial Sequence
  Description of Artificial Sequence: Synthetic oligonucleotide
ggaactcctagaagtacaacgcaagaaacaggtac

SEQ ID NO: 323067 - DNA, 35 bp, Artificial Sequence
  Description of Artificial Sequence: Synthetic oligonucleotide
gaactcctagaagtacaacgcaagaaacaggtacc

SEQ ID NO: 323068 - DNA, 35 bp, Artificial Sequence
  Description of Artificial Sequence: Synthetic oligonucleotide
aactcctagaagtacaacgcaagaaacaggtaccc

SEQ ID NO: 323069 - DNA, 34 bp, Artificial Sequence
  Description of Artificial Sequence: Synthetic oligonucleotide
actcctagaagtacaacgcaagaaacaggtaccc

SEQ ID NO: 323070 - DNA, 33 bp, Artificial Sequence
  Description of Artificial Sequence: Synthetic oligonucleotide
ctcctagaagtacaacgcaagaaacaggtaccc

SEQ ID NO: 323071 - DNA, 34 bp, Artificial Sequence
  Description of Artificial Sequence: Synthetic oligonucleotide
tcctagaagtacaacgcaagaaacaggtacccag

SEQ ID NO: 323072 - DNA, 33 bp, Artificial Sequence
  Description of Artificial Sequence: Synthetic oligonucleotide
cctagaagtacaacgcaagaaacaggtacccag

SEQ ID NO: 323073 - DNA, 35 bp, Artificial Sequence
  Description of Artificial Sequence: Synthetic oligonucleotide
ctagaagtacaacgcaagaaacaggtacccagaac

SEQ ID NO: 323074 - DNA, 35 bp, Artificial Sequence
  Description of Artificial Sequence: Synthetic oligonucleotide
tagaagtacaacgcaagaaacaggtacccagaacg

SEQ ID NO: 323075 - DNA, 34 bp, Artificial Sequence
  Description of Artificial Sequence: Synthetic oligonucleotide
agaagtacaacgcaagaaacaggtacccagaacg

SEQ ID NO: 323076 - DNA, 33 bp, Artificial Sequence
  Description of Artificial Sequence: Synthetic oligonucleotide
gaagtacaacgcaagaaacaggtacccagaacg

SEQ ID NO: 323077 - DNA, 35 bp, Artificial Sequence
  Description of Artificial Sequence: Synthetic oligonucleotide
aagtacaacgcaagaaacaggtacccagaacgaac

SEQ ID NO: 323078 - DNA, 34 bp, Artificial Sequence
  Description of Artificial Sequence: Synthetic oligonucleotide
agtacaacgcaagaaacaggtacccagaacgaac

SEQ ID NO: 323079 - DNA, 33 bp, Artificial Sequence
  Description of Artificial Sequence: Synthetic oligonucleotide
gtacaacgcaagaaacaggtacccagaacgaac

SEQ ID NO: 323080 - DNA, 34 bp, Artificial Sequence
  Description of Artificial Sequence: Synthetic oligonucleotide
tacaacgcaagaaacaggtacccagaacgaacag

SEQ ID NO: 323081 - DNA, 33 bp, Artificial Sequence
  Description of Artificial Sequence: Synthetic oligonucleotide
acaacgcaagaaacaggtacccagaacgaacag

SEQ ID NO: 323082 - DNA, 32 bp, Artificial Sequence
  Description of Artificial Sequence: Synthetic oligonucleotide
caacgcaagaaacaggtacccagaacgaacag

SEQ ID NO: 323083 - DNA, 33 bp, Artificial Sequence
  Description of Artificial Sequence: Synthetic oligonucleotide
aacgcaagaaacaggtacccagaacgaacagtg

SEQ ID NO: 323084 - DNA, 32 bp, Artificial Sequence
  Description of Artificial Sequence: Synthetic oligonucleotide
acgcaagaaacaggtacccagaacgaacagtg

SEQ ID NO: 323085 - DNA, 31 bp, Artificial Sequence
  Description of Artificial Sequence: Synthetic oligonucleotide
cgcaagaaacaggtacccagaacgaacagtg

SEQ ID NO: 323086 - DNA, 31 bp, Artificial Sequence
  Description of Artificial Sequence: Synthetic oligonucleotide
gcaagaaacaggtacccagaacgaacagtgg

SEQ ID NO: 323087 - DNA, 34 bp, Artificial Sequence
  Description of Artificial Sequence: Synthetic oligonucleotide
caagaaacaggtacccagaacgaacagtggattg

SEQ ID NO: 323088 - DNA, 34 bp, Artificial Sequence
  Description of Artificial Sequence: Synthetic oligonucleotide
aagaaacaggtacccagaacgaacagtggattgg

SEQ ID NO: 323089 - DNA, 33 bp, Artificial Sequence
  Description of Artificial Sequence: Synthetic oligonucleotide
agaaacaggtacccagaacgaacagtggattgg

SEQ ID NO: 323090 - DNA, 32 bp, Artificial Sequence
  Description of Artificial Sequence: Synthetic oligonucleotide
gaaacaggtacccagaacgaacagtggattgg

SEQ ID NO: 323091 - DNA, 32 bp, Artificial Sequence
  Description of Artificial Sequence: Synthetic oligonucleotide
aaacaggtacccagaacgaacagtggattggc

SEQ ID NO: 323092 - DNA, 31 bp, Artificial Sequence
  Description of Artificial Sequence: Synthetic oligonucleotide
aacaggtacccagaacgaacagtggattggc

SEQ ID NO: 323093 - DNA, 30 bp, Artificial Sequence
  Description of Artificial Sequence: Synthetic oligonucleotide
acaggtacccagaacgaacagtggattggc

SEQ ID NO: 323094 - DNA, 29 bp, Artificial Sequence
  Description of Artificial Sequence: Synthetic oligonucleotide
caggtacccagaacgaacagtggattggc

SEQ ID NO: 323095 - DNA, 31 bp, Artificial Sequence
  Description of Artificial Sequence: Synthetic oligonucleotide
aggtacccagaacgaacagtggattggcaac

SEQ ID NO: 323096 - DNA, 30 bp, Artificial Sequence
  Description of Artificial Sequence: Synthetic oligonucleotide
ggtacccagaacgaacagtggattggcaac

SEQ ID NO: 323097 - DNA, 31 bp, Artificial Sequence
  Description of Artificial Sequence: Synthetic oligonucleotide
gtacccagaacgaacagtggattggcaacac

SEQ ID NO: 323098 - DNA, 33 bp, Artificial Sequence
  Description of Artificial Sequence: Synthetic oligonucleotide
tacccagaacgaacagtggattggcaacacatg

SEQ ID NO: 323099 - DNA, 32 bp, Artificial Sequence
  Description of Artificial Sequence: Synthetic oligonucleotide
acccagaacgaacagtggattggcaacacatg

SEQ ID NO: 323100 - DNA, 31 bp, Artificial Sequence
  Description of Artificial Sequence: Synthetic oligonucleotide
cccagaacgaacagtggattggcaacacatg

SEQ ID NO: 323101 - DNA, 31 bp, Artificial Sequence
  Description of Artificial Sequence: Synthetic oligonucleotide
ccagaacgaacagtggattggcaacacatgg

SEQ ID NO: 323102 - DNA, 31 bp, Artificial Sequence
  Description of Artificial Sequence: Synthetic oligonucleotide
cagaacgaacagtggattggcaacacatggc

SEQ ID NO: 323103 - DNA, 33 bp, Artificial Sequence
  Description of Artificial Sequence: Synthetic oligonucleotide
agaacgaacagtggattggcaacacatggcatg

SEQ ID NO: 323104 - DNA, 32 bp, Artificial Sequence
  Description of Artificial Sequence: Synthetic oligonucleotide
gaacgaacagtggattggcaacacatggcatg

SEQ ID NO: 323105 - DNA, 33 bp, Artificial Sequence
  Description of Artificial Sequence: Synthetic oligonucleotide
aacgaacagtggattggcaacacatggcatgac

SEQ ID NO: 323106 - DNA, 32 bp, Artificial Sequence
  Description of Artificial Sequence: Synthetic oligonucleotide
acgaacagtggattggcaacacatggcatgac

SEQ ID NO: 323107 - DNA, 31 bp, Artificial Sequence
  Description of Artificial Sequence: Synthetic oligonucleotide
cgaacagtggattggcaacacatggcatgac

SEQ ID NO: 323108 - DNA, 31 bp, Artificial Sequence
  Description of Artificial Sequence: Synthetic oligonucleotide
gaacagtggattggcaacacatggcatgacg

SEQ ID NO: 323109 - DNA, 31 bp, Artificial Sequence
  Description of Artificial Sequence: Synthetic oligonucleotide
aacagtggattggcaacacatggcatgacgg

SEQ ID NO: 323110 - DNA, 30 bp, Artificial Sequence
  Description of Artificial Sequence: Synthetic oligonucleotide
acagtggattggcaacacatggcatgacgg

SEQ ID NO: 323111 - DNA, 29 bp, Artificial Sequence
  Description of Artificial Sequence: Synthetic oligonucleotide
cagtggattggcaacacatggcatgacgg

SEQ ID NO: 323112 - DNA, 33 bp, Artificial Sequence
  Description of Artificial Sequence: Synthetic oligonucleotide
agtggattggcaacacatggcatgacggatatc

SEQ ID NO: 323113 - DNA, 32 bp, Artificial Sequence
  Description of Artificial Sequence: Synthetic oligonucleotide
gtggattggcaacacatggcatgacggatatc

SEQ ID NO: 323114 - DNA, 32 bp, Artificial Sequence
  Description of Artificial Sequence: Synthetic oligonucleotide
tggattggcaacacatggcatgacggatatcg

SEQ ID NO: 323115 - DNA, 31 bp, Artificial Sequence
  Description of Artificial Sequence: Synthetic oligonucleotide
ggattggcaacacatggcatgacggatatcg

SEQ ID NO: 323116 - DNA, 31 bp, Artificial Sequence
  Description of Artificial Sequence: Synthetic oligonucleotide
gattggcaacacatggcatgacggatatcgc

SEQ ID NO: 323117 - DNA, 31 bp, Artificial Sequence
  Description of Artificial Sequence: Synthetic oligonucleotide
attggcaacacatggcatgacggatatcgcg

SEQ ID NO: 323118 - DNA, 30 bp, Artificial Sequence
  Description of Artificial Sequence: Synthetic oligonucleotide
ttggcaacacatggcatgacggatatcgcg

SEQ ID NO: 323119 - DNA, 29 bp, Artificial Sequence
  Description of Artificial Sequence: Synthetic oligonucleotide
tggcaacacatggcatgacggatatcgcg

SEQ ID NO: 323120 - DNA, 28 bp, Artificial Sequence
  Description of Artificial Sequence: Synthetic oligonucleotide
ggcaacacatggcatgacggatatcgcg

SEQ ID NO: 323121 - DNA, 31 bp, Artificial Sequence
  Description of Artificial Sequence: Synthetic oligonucleotide
gcaacacatggcatgacggatatcgcgaaac

SEQ ID NO: 323122 - DNA, 32 bp, Artificial Sequence
  Description of Artificial Sequence: Synthetic oligonucleotide
caacacatggcatgacggatatcgcgaaacac

SEQ ID NO: 323123 - DNA, 32 bp, Artificial Sequence
  Description of Artificial Sequence: Synthetic oligonucleotide
aacacatggcatgacggatatcgcgaaacacc

SEQ ID NO: 323124 - DNA, 31 bp, Artificial Sequence
  Description of Artificial Sequence: Synthetic oligonucleotide
acacatggcatgacggatatcgcgaaacacc

SEQ ID NO: 323125 - DNA, 30 bp, Artificial Sequence
  Description of Artificial Sequence: Synthetic oligonucleotide
cacatggcatgacggatatcgcgaaacacc

SEQ ID NO: 323126 - DNA, 30 bp, Artificial Sequence
  Description of Artificial Sequence: Synthetic oligonucleotide
acatggcatgacggatatcgcgaaacaccc

SEQ ID NO: 323127 - DNA, 29 bp, Artificial Sequence
  Description of Artificial Sequence: Synthetic oligonucleotide
catggcatgacggatatcgcgaaacaccc

SEQ ID NO: 323128 - DNA, 32 bp, Artificial Sequence
  Description of Artificial Sequence: Synthetic oligonucleotide
atggcatgacggatatcgcgaaacacccatag

SEQ ID NO: 323129 - DNA, 31 bp, Artificial Sequence
  Description of Artificial Sequence: Synthetic oligonucleotide
tggcatgacggatatcgcgaaacacccatag

SEQ ID NO: 323130 - DNA, 30 bp, Artificial Sequence
  Description of Artificial Sequence: Synthetic oligonucleotide
ggcatgacggatatcgcgaaacacccatag

SEQ ID NO: 323131 - DNA, 32 bp, Artificial Sequence
  Description of Artificial Sequence: Synthetic oligonucleotide
gcatgacggatatcgcgaaacacccatagaag

SEQ ID NO: 323132 - DNA, 33 bp, Artificial Sequence
  Description of Artificial Sequence: Synthetic oligonucleotide
catgacggatatcgcgaaacacccatagaagac

SEQ ID NO: 323133 - DNA, 34 bp, Artificial Sequence
  Description of Artificial Sequence: Synthetic oligonucleotide
atgacggatatcgcgaaacacccatagaagactc

SEQ ID NO: 323134 - DNA, 33 bp, Artificial Sequence
  Description of Artificial Sequence: Synthetic oligonucleotide
tgacggatatcgcgaaacacccatagaagactc

SEQ ID NO: 323135 - DNA, 32 bp, Artificial Sequence
  Description of Artificial Sequence: Synthetic oligonucleotide
gacggatatcgcgaaacacccatagaagactc

SEQ ID NO: 323136 - DNA, 32 bp, Artificial Sequence
  Description of Artificial Sequence: Synthetic oligonucleotide
acggatatcgcgaaacacccatagaagactcg

SEQ ID NO: 323137 - DNA, 31 bp, Artificial Sequence
  Description of Artificial Sequence: Synthetic oligonucleotide
cggatatcgcgaaacacccatagaagactcg

SEQ ID NO: 323138 - DNA, 31 bp, Artificial Sequence
  Description of Artificial Sequence: Synthetic oligonucleotide
ggatatcgcgaaacacccatagaagactcgc

SEQ ID NO: 323139 - DNA, 34 bp, Artificial Sequence
  Description of Artificial Sequence: Synthetic oligonucleotide
gatatcgcgaaacacccatagaagactcgcattc

SEQ ID NO: 323140 - DNA, 34 bp, Artificial Sequence
  Description of Artificial Sequence: Synthetic oligonucleotide
atatcgcgaaacacccatagaagactcgcattcg

SEQ ID NO: 323141 - DNA, 33 bp, Artificial Sequence
  Description of Artificial Sequence: Synthetic oligonucleotide
tatcgcgaaacacccatagaagactcgcattcg

SEQ ID NO: 323142 - DNA, 32 bp, Artificial Sequence
  Description of Artificial Sequence: Synthetic oligonucleotide
atcgcgaaacacccatagaagactcgcattcg

SEQ ID NO: 323143 - DNA, 31 bp, Artificial Sequence
  Description of Artificial Sequence: Synthetic oligonucleotide
tcgcgaaacacccatagaagactcgcattcg

SEQ ID NO: 323144 - DNA, 30 bp, Artificial Sequence
  Description of Artificial Sequence: Synthetic oligonucleotide
cgcgaaacacccatagaagactcgcattcg

SEQ ID NO: 323145 - DNA, 31 bp, Artificial Sequence
  Description of Artificial Sequence: Synthetic oligonucleotide
gcgaaacacccatagaagactcgcattcgac

SEQ ID NO: 323146 - DNA, 33 bp, Artificial Sequence
  Description of Artificial Sequence: Synthetic oligonucleotide
cgaaacacccatagaagactcgcattcgacatc

SEQ ID NO: 323147 - DNA, 34 bp, Artificial Sequence
  Description of Artificial Sequence: Synthetic oligonucleotide
gaaacacccatagaagactcgcattcgacatcag

SEQ ID NO: 323148 - DNA, 34 bp, Artificial Sequence
  Description of Artificial Sequence: Synthetic oligonucleotide
aaacacccatagaagactcgcattcgacatcagg

SEQ ID NO: 323149 - DNA, 33 bp, Artificial Sequence
  Description of Artificial Sequence: Synthetic oligonucleotide
aacacccatagaagactcgcattcgacatcagg

SEQ ID NO: 323150 - DNA, 32 bp, Artificial Sequence
  Description of Artificial Sequence: Synthetic oligonucleotide
acacccatagaagactcgcattcgacatcagg

SEQ ID NO: 323151 - DNA, 31 bp, Artificial Sequence
  Description of Artificial Sequence: Synthetic oligonucleotide
cacccatagaagactcgcattcgacatcagg

SEQ ID NO: 323152 - DNA, 31 bp, Artificial Sequence
  Description of Artificial Sequence: Synthetic oligonucleotide
acccatagaagactcgcattcgacatcaggg

SEQ ID NO: 323153 - DNA, 30 bp, Artificial Sequence
  Description of Artificial Sequence: Synthetic oligonucleotide
cccatagaagactcgcattcgacatcaggg

SEQ ID NO: 323154 - DNA, 31 bp, Artificial Sequence
  Description of Artificial Sequence: Synthetic oligonucleotide
ccatagaagactcgcattcgacatcagggac

SEQ ID NO: 323155 - DNA, 32 bp, Artificial Sequence
  Description of Artificial Sequence: Synthetic oligonucleotide
catagaagactcgcattcgacatcagggacag

SEQ ID NO: 323156 - DNA, 32 bp, Artificial Sequence
  Description of Artificial Sequence: Synthetic oligonucleotide
atagaagactcgcattcgacatcagggacagg

SEQ ID NO: 323157 - DNA, 31 bp, Artificial Sequence
  Description of Artificial Sequence: Synthetic oligonucleotide
tagaagactcgcattcgacatcagggacagg

SEQ ID NO: 323158 - DNA, 30 bp, Artificial Sequence
  Description of Artificial Sequence: Synthetic oligonucleotide
agaagactcgcattcgacatcagggacagg

SEQ ID NO: 323159 - DNA, 29 bp, Artificial Sequence
  Description of Artificial Sequence: Synthetic oligonucleotide
gaagactcgcattcgacatcagggacagg

SEQ ID NO: 323160 - DNA, 30 bp, Artificial Sequence
  Description of Artificial Sequence: Synthetic oligonucleotide
aagactcgcattcgacatcagggacaggtg

SEQ ID NO: 323161 - DNA, 29 bp, Artificial Sequence
  Description of Artificial Sequence: Synthetic oligonucleotide
agactcgcattcgacatcagggacaggtg

SEQ ID NO: 323162 - DNA, 28 bp, Artificial Sequence
  Description of Artificial Sequence: Synthetic oligonucleotide
gactcgcattcgacatcagggacaggtg

SEQ ID NO: 323163 - DNA, 28 bp, Artificial Sequence
  Description of Artificial Sequence: Synthetic oligonucleotide
actcgcattcgacatcagggacaggtgc

SEQ ID NO: 323164 - DNA, 27 bp, Artificial Sequence
  Description of Artificial Sequence: Synthetic oligonucleotide
ctcgcattcgacatcagggacaggtgc

SEQ ID NO: 323165 - DNA, 28 bp, Artificial Sequence
  Description of Artificial Sequence: Synthetic oligonucleotide
tcgcattcgacatcagggacaggtgcag

SEQ ID NO: 323166 - DNA, 27 bp, Artificial Sequence
  Description of Artificial Sequence: Synthetic oligonucleotide
cgcattcgacatcagggacaggtgcag

SEQ ID NO: 323167 - DNA, 27 bp, Artificial Sequence
  Description of Artificial Sequence: Synthetic oligonucleotide
gcattcgacatcagggacaggtgcagc

SEQ ID NO: 323168 - DNA, 27 bp, Artificial Sequence
  Description of Artificial Sequence: Synthetic oligonucleotide
cattcgacatcagggacaggtgcagcc

SEQ ID NO: 323169 - DNA, 28 bp, Artificial Sequence
  Description of Artificial Sequence: Synthetic oligonucleotide
attcgacatcagggacaggtgcagcctc

SEQ ID NO: 323170 - DNA, 27 bp, Artificial Sequence
  Description of Artificial Sequence: Synthetic oligonucleotide
ttcgacatcagggacaggtgcagcctc

SEQ ID NO: 323171 - DNA, 27 bp, Artificial Sequence
  Description of Artificial Sequence: Synthetic oligonucleotide
tcgacatcagggacaggtgcagcctct

SEQ ID NO: 323172 - DNA, 26 bp, Artificial Sequence
  Description of Artificial Sequence: Synthetic oligonucleotide
cgacatcagggacaggtgcagcctct

SEQ ID NO: 323173 - DNA, 26 bp, Artificial Sequence
  Description of Artificial Sequence: Synthetic oligonucleotide
gacatcagggacaggtgcagcctctg

SEQ ID NO: 323174 - DNA, 27 bp, Artificial Sequence
  Description of Artificial Sequence: Synthetic oligonucleotide
acatcagggacaggtgcagcctctgct

SEQ ID NO: 323175 - DNA, 26 bp, Artificial Sequence
  Description of Artificial Sequence: Synthetic oligonucleotide
catcagggacaggtgcagcctctgct

SEQ ID NO: 323176 - DNA, 27 bp, Artificial Sequence
  Description of Artificial Sequence: Synthetic oligonucleotide
atcagggacaggtgcagcctctgctca

SEQ ID NO: 323177 - DNA, 27 bp, Artificial Sequence
  Description of Artificial Sequence: Synthetic oligonucleotide
tcagggacaggtgcagcctctgctcat

SEQ ID NO: 323178 - DNA, 27 bp, Artificial Sequence
  Description of Artificial Sequence: Synthetic oligonucleotide
cagggacaggtgcagcctctgctcata

SEQ ID NO: 323179 - DNA, 27 bp, Artificial Sequence
  Description of Artificial Sequence: Synthetic oligonucleotide
agggacaggtgcagcctctgctcatac

SEQ ID NO: 323180 - DNA, 26 bp, Artificial Sequence
  Description of Artificial Sequence: Synthetic oligonucleotide
gggacaggtgcagcctctgctcatac

SEQ ID NO: 323181 - DNA, 27 bp, Artificial Sequence
  Description of Artificial Sequence: Synthetic oligonucleotide
ggacaggtgcagcctctgctcatacct

SEQ ID NO: 323182 - DNA, 27 bp, Artificial Sequence
  Description of Artificial Sequence: Synthetic oligonucleotide
gacaggtgcagcctctgctcatacctg

SEQ ID NO: 323183 - DNA, 27 bp, Artificial Sequence
  Description of Artificial Sequence: Synthetic oligonucleotide
acaggtgcagcctctgctcatacctgc

SEQ ID NO: 323184 - DNA, 26 bp, Artificial Sequence
  Description of Artificial Sequence: Synthetic oligonucleotide
caggtgcagcctctgctcatacctgc

SEQ ID NO: 323185 - DNA, 27 bp, Artificial Sequence
  Description of Artificial Sequence: Synthetic oligonucleotide
aggtgcagcctctgctcatacctgcca

SEQ ID NO: 323186 - DNA, 27 bp, Artificial Sequence
  Description of Artificial Sequence: Synthetic oligonucleotide
ggtgcagcctctgctcatacctgccat

SEQ ID NO: 323187 - DNA, 27 bp, Artificial Sequence
  Description of Artificial Sequence: Synthetic oligonucleotide
gtgcagcctctgctcatacctgccatc

SEQ ID NO: 323188 - DNA, 27 bp, Artificial Sequence
  Description of Artificial Sequence: Synthetic oligonucleotide
tgcagcctctgctcatacctgccatcc

SEQ ID NO: 323189 - DNA, 27 bp, Artificial Sequence
  Description of Artificial Sequence: Synthetic oligonucleotide
gcagcctctgctcatacctgccatcca

SEQ ID NO: 323190 - DNA, 29 bp, Artificial Sequence
  Description of Artificial Sequence: Synthetic oligonucleotide
cagcctctgctcatacctgccatccaaag

SEQ ID NO: 323191 - DNA, 29 bp, Artificial Sequence
  Description of Artificial Sequence: Synthetic oligonucleotide
agcctctgctcatacctgccatccaaagc

SEQ ID NO: 323192 - DNA, 28 bp, Artificial Sequence
  Description of Artificial Sequence: Synthetic oligonucleotide
gcctctgctcatacctgccatccaaagc

SEQ ID NO: 323193 - DNA, 30 bp, Artificial Sequence
  Description of Artificial Sequence: Synthetic oligonucleotide
cctctgctcatacctgccatccaaagcaag

SEQ ID NO: 323194 - DNA, 30 bp, Artificial Sequence
  Description of Artificial Sequence: Synthetic oligonucleotide
ctctgctcatacctgccatccaaagcaagg

SEQ ID NO: 323195 - DNA, 32 bp, Artificial Sequence
  Description of Artificial Sequence: Synthetic oligonucleotide
tctgctcatacctgccatccaaagcaaggaag

SEQ ID NO: 323196 - DNA, 31 bp, Artificial Sequence
  Description of Artificial Sequence: Synthetic oligonucleotide
ctgctcatacctgccatccaaagcaaggaag

SEQ ID NO: 323197 - DNA, 31 bp, Artificial Sequence
  Description of Artificial Sequence: Synthetic oligonucleotide
tgctcatacctgccatccaaagcaaggaagc

SEQ ID NO: 323198 - DNA, 30 bp, Artificial Sequence
  Description of Artificial Sequence: Synthetic oligonucleotide
gctcatacctgccatccaaagcaaggaagc

SEQ ID NO: 323199 - DNA, 31 bp, Artificial Sequence
  Description of Artificial Sequence: Synthetic oligonucleotide
ctcatacctgccatccaaagcaaggaagcac

SEQ ID NO: 323200 - DNA, 33 bp, Artificial Sequence
  Description of Artificial Sequence: Synthetic oligonucleotide
tcatacctgccatccaaagcaaggaagcacaac

SEQ ID NO: 323201 - DNA, 32 bp, Artificial Sequence
  Description of Artificial Sequence: Synthetic oligonucleotide
catacctgccatccaaagcaaggaagcacaac

SEQ ID NO: 323202 - DNA, 33 bp, Artificial Sequence
  Description of Artificial Sequence: Synthetic oligonucleotide
atacctgccatccaaagcaaggaagcacaacac

SEQ ID NO: 323203 - DNA, 32 bp, Artificial Sequence
  Description of Artificial Sequence: Synthetic oligonucleotide
tacctgccatccaaagcaaggaagcacaacac

SEQ ID NO: 323204 - DNA, 31 bp, Artificial Sequence
  Description of Artificial Sequence: Synthetic oligonucleotide
acctgccatccaaagcaaggaagcacaacac

SEQ ID NO: 323205 - DNA, 30 bp, Artificial Sequence
  Description of Artificial Sequence: Synthetic oligonucleotide
cctgccatccaaagcaaggaagcacaacac

SEQ ID NO: 323206 - DNA, 30 bp, Artificial Sequence
  Description of Artificial Sequence: Synthetic oligonucleotide
ctgccatccaaagcaaggaagcacaacacc

SEQ ID NO: 323207 - DNA, 32 bp, Artificial Sequence
  Description of Artificial Sequence: Synthetic oligonucleotide
tgccatccaaagcaaggaagcacaacaccatg

SEQ ID NO: 323208 - DNA, 31 bp, Artificial Sequence
  Description of Artificial Sequence: Synthetic oligonucleotide
gccatccaaagcaaggaagcacaacaccatg

SEQ ID NO: 323209 - DNA, 31 bp, Artificial Sequence
  Description of Artificial Sequence: Synthetic oligonucleotide
ccatccaaagcaaggaagcacaacaccatgc

SEQ ID NO: 323210 - DNA, 31 bp, Artificial Sequence
  Description of Artificial Sequence: Synthetic oligonucleotide
catccaaagcaaggaagcacaacaccatgcc

SEQ ID NO: 323211 - DNA, 31 bp, Artificial Sequence
  Description of Artificial Sequence: Synthetic oligonucleotide
atccaaagcaaggaagcacaacaccatgccc

SEQ ID NO: 323212 - DNA, 30 bp, Artificial Sequence
  Description of Artificial Sequence: Synthetic oligonucleotide
tccaaagcaaggaagcacaacaccatgccc

SEQ ID NO: 323213 - DNA, 29 bp, Artificial Sequence
  Description of Artificial Sequence: Synthetic oligonucleotide
ccaaagcaaggaagcacaacaccatgccc

SEQ ID NO: 323214 - DNA, 30 bp, Artificial Sequence
  Description of Artificial Sequence: Synthetic oligonucleotide
caaagcaaggaagcacaacaccatgcccag

SEQ ID NO: 323215 - DNA, 31 bp, Artificial Sequence
  Description of Artificial Sequence: Synthetic oligonucleotide
aaagcaaggaagcacaacaccatgcccagag

SEQ ID NO: 323216 - DNA, 30 bp, Artificial Sequence
  Description of Artificial Sequence: Synthetic oligonucleotide
aagcaaggaagcacaacaccatgcccagag

SEQ ID NO: 323217 - DNA, 29 bp, Artificial Sequence
  Description of Artificial Sequence: Synthetic oligonucleotide
agcaaggaagcacaacaccatgcccagag

SEQ ID NO: 323218 - DNA, 28 bp, Artificial Sequence
  Description of Artificial Sequence: Synthetic oligonucleotide
gcaaggaagcacaacaccatgcccagag

SEQ ID NO: 323219 - DNA, 28 bp, Artificial Sequence
  Description of Artificial Sequence: Synthetic oligonucleotide
caaggaagcacaacaccatgcccagagg

SEQ ID NO: 323220 - DNA, 29 bp, Artificial Sequence
  Description of Artificial Sequence: Synthetic oligonucleotide
aaggaagcacaacaccatgcccagaggtc

SEQ ID NO: 323221 - DNA, 28 bp, Artificial Sequence
  Description of Artificial Sequence: Synthetic oligonucleotide
aggaagcacaacaccatgcccagaggtc

SEQ ID NO: 323222 - DNA, 27 bp, Artificial Sequence
  Description of Artificial Sequence: Synthetic oligonucleotide
ggaagcacaacaccatgcccagaggtc

SEQ ID NO: 323223 - DNA, 28 bp, Artificial Sequence
  Description of Artificial Sequence: Synthetic oligonucleotide
gaagcacaacaccatgcccagaggtcag

SEQ ID NO: 323224 - DNA, 30 bp, Artificial Sequence
  Description of Artificial Sequence: Synthetic oligonucleotide
aagcacaacaccatgcccagaggtcagttc

SEQ ID NO: 323225 - DNA, 29 bp, Artificial Sequence
  Description of Artificial Sequence: Synthetic oligonucleotide
agcacaacaccatgcccagaggtcagttc

SEQ ID NO: 323226 - DNA, 28 bp, Artificial Sequence
  Description of Artificial Sequence: Synthetic oligonucleotide
gcacaacaccatgcccagaggtcagttc

SEQ ID NO: 323227 - DNA, 28 bp, Artificial Sequence
  Description of Artificial Sequence: Synthetic oligonucleotide
cacaacaccatgcccagaggtcagttcc

SEQ ID NO: 323228 - DNA, 29 bp, Artificial Sequence
  Description of Artificial Sequence: Synthetic oligonucleotide
acaacaccatgcccagaggtcagttcctg

SEQ ID NO: 323229 - DNA, 28 bp, Artificial Sequence
  Description of Artificial Sequence: Synthetic oligonucleotide
caacaccatgcccagaggtcagttcctg

SEQ ID NO: 323230 - DNA, 28 bp, Artificial Sequence
  Description of Artificial Sequence: Synthetic oligonucleotide
aacaccatgcccagaggtcagttcctgc

SEQ ID NO: 323231 - DNA, 27 bp, Artificial Sequence
  Description of Artificial Sequence: Synthetic oligonucleotide
acaccatgcccagaggtcagttcctgc

SEQ ID NO: 323232 - DNA, 27 bp, Artificial Sequence
  Description of Artificial Sequence: Synthetic oligonucleotide
caccatgcccagaggtcagttcctgca

SEQ ID NO: 323233 - DNA, 27 bp, Artificial Sequence
  Description of Artificial Sequence: Synthetic oligonucleotide
accatgcccagaggtcagttcctgcac

SEQ ID NO: 323234 - DNA, 27 bp, Artificial Sequence
  Description of Artificial Sequence: Synthetic oligonucleotide
ccatgcccagaggtcagttcctgcact

SEQ ID NO: 323235 - DNA, 27 bp, Artificial Sequence
  Description of Artificial Sequence: Synthetic oligonucleotide
catgcccagaggtcagttcctgcactg

SEQ ID NO: 323236 - DNA, 31 bp, Artificial Sequence
  Description of Artificial Sequence: Synthetic oligonucleotide
atgcccagaggtcagttcctgcactgatttc

SEQ ID NO: 323237 - DNA, 30 bp, Artificial Sequence
  Description of Artificial Sequence: Synthetic oligonucleotide
tgcccagaggtcagttcctgcactgatttc

SEQ ID NO: 323238 - DNA, 29 bp, Artificial Sequence
  Description of Artificial Sequence: Synthetic oligonucleotide
gcccagaggtcagttcctgcactgatttc

SEQ ID NO: 323239 - DNA, 31 bp, Artificial Sequence
  Description of Artificial Sequence: Synthetic oligonucleotide
cccagaggtcagttcctgcactgatttcatc

SEQ ID NO: 323240 - DNA, 33 bp, Artificial Sequence
  Description of Artificial Sequence: Synthetic oligonucleotide
ccagaggtcagttcctgcactgatttcatcaac

SEQ ID NO: 323241 - DNA, 33 bp, Artificial Sequence
  Description of Artificial Sequence: Synthetic oligonucleotide
cagaggtcagttcctgcactgatttcatcaacc

SEQ ID NO: 323242 - DNA, 33 bp, Artificial Sequence
  Description of Artificial Sequence: Synthetic oligonucleotide
agaggtcagttcctgcactgatttcatcaaccc

SEQ ID NO: 323243 - DNA, 32 bp, Artificial Sequence
  Description of Artificial Sequence: Synthetic oligonucleotide
gaggtcagttcctgcactgatttcatcaaccc

SEQ ID NO: 323244 - DNA, 35 bp, Artificial Sequence
  Description of Artificial Sequence: Synthetic oligonucleotide
aggtcagttcctgcactgatttcatcaacccaaac

SEQ ID NO: 323245 - DNA, 34 bp, Artificial Sequence
  Description of Artificial Sequence: Synthetic oligonucleotide
ggtcagttcctgcactgatttcatcaacccaaac

SEQ ID NO: 323246 - DNA, 35 bp, Artificial Sequence
  Description of Artificial Sequence: Synthetic oligonucleotide
gtcagttcctgcactgatttcatcaacccaaactc

SEQ ID NO: 323247 - DNA, 36 bp, Artificial Sequence
  Description of Artificial Sequence: Synthetic oligonucleotide
tcagttcctgcactgatttcatcaacccaaactcac

SEQ ID NO: 323248 - DNA, 35 bp, Artificial Sequence
  Description of Artificial Sequence: Synthetic oligonucleotide
cagttcctgcactgatttcatcaacccaaactcac

SEQ ID NO: 323249 - DNA, 36 bp, Artificial Sequence
  Description of Artificial Sequence: Synthetic oligonucleotide
agttcctgcactgatttcatcaacccaaactcacac

SEQ ID NO: 323250 - DNA, 35 bp, Artificial Sequence
  Description of Artificial Sequence: Synthetic oligonucleotide
gttcctgcactgatttcatcaacccaaactcacac

SEQ ID NO: 323251 - DNA, 35 bp, Artificial Sequence
  Description of Artificial Sequence: Synthetic oligonucleotide
ttcctgcactgatttcatcaacccaaactcacacc

SEQ ID NO: 323252 - DNA, 34 bp, Artificial Sequence
  Description of Artificial Sequence: Synthetic oligonucleotide
tcctgcactgatttcatcaacccaaactcacacc

SEQ ID NO: 323253 - DNA, 33 bp, Artificial Sequence
  Description of Artificial Sequence: Synthetic oligonucleotide
cctgcactgatttcatcaacccaaactcacacc

SEQ ID NO: 323254 - DNA, 33 bp, Artificial Sequence
  Description of Artificial Sequence: Synthetic oligonucleotide
ctgcactgatttcatcaacccaaactcacaccc

SEQ ID NO: 323255 - DNA, 33 bp, Artificial Sequence
  Description of Artificial Sequence: Synthetic oligonucleotide
tgcactgatttcatcaacccaaactcacacccg

SEQ ID NO: 323256 - DNA, 32 bp, Artificial Sequence
  Description of Artificial Sequence: Synthetic oligonucleotide
gcactgatttcatcaacccaaactcacacccg

SEQ ID NO: 323257 - DNA, 34 bp, Artificial Sequence
  Description of Artificial Sequence: Synthetic oligonucleotide
cactgatttcatcaacccaaactcacacccgatg

SEQ ID NO: 323258 - DNA, 34 bp, Artificial Sequence
  Description of Artificial Sequence: Synthetic oligonucleotide
actgatttcatcaacccaaactcacacccgatgg

SEQ ID NO: 323259 - DNA, 33 bp, Artificial Sequence
  Description of Artificial Sequence: Synthetic oligonucleotide
ctgatttcatcaacccaaactcacacccgatgg

SEQ ID NO: 323260 - DNA, 33 bp, Artificial Sequence
  Description of Artificial Sequence: Synthetic oligonucleotide
tgatttcatcaacccaaactcacacccgatggg

SEQ ID NO: 323261 - DNA, 32 bp, Artificial Sequence
  Description of Artificial Sequence: Synthetic oligonucleotide
gatttcatcaacccaaactcacacccgatggg

SEQ ID NO: 323262 - DNA, 33 bp, Artificial Sequence
  Description of Artificial Sequence: Synthetic oligonucleotide
atttcatcaacccaaactcacacccgatgggac

SEQ ID NO: 323263 - DNA, 32 bp, Artificial Sequence
  Description of Artificial Sequence: Synthetic oligonucleotide
tttcatcaacccaaactcacacccgatgggac

SEQ ID NO: 323264 - DNA, 31 bp, Artificial Sequence
  Description of Artificial Sequence: Synthetic oligonucleotide
ttcatcaacccaaactcacacccgatgggac

SEQ ID NO: 323265 - DNA, 30 bp, Artificial Sequence
  Description of Artificial Sequence: Synthetic oligonucleotide
tcatcaacccaaactcacacccgatgggac

SEQ ID NO: 323266 - DNA, 29 bp, Artificial Sequence
  Description of Artificial Sequence: Synthetic oligonucleotide
catcaacccaaactcacacccgatgggac

SEQ ID NO: 323267 - DNA, 29 bp, Artificial Sequence
  Description of Artificial Sequence: Synthetic oligonucleotide
atcaacccaaactcacacccgatgggacg

SEQ ID NO: 323268 - DNA, 28 bp, Artificial Sequence
  Description of Artificial Sequence: Synthetic oligonucleotide
tcaacccaaactcacacccgatgggacg

SEQ ID NO: 323269 - DNA, 27 bp, Artificial Sequence
  Description of Artificial Sequence: Synthetic oligonucleotide
caacccaaactcacacccgatgggacg

SEQ ID NO: 323270 - DNA, 28 bp, Artificial Sequence
  Description of Artificial Sequence: Synthetic oligonucleotide
aacccaaactcacacccgatgggacgac

SEQ ID NO: 323271 - DNA, 27 bp, Artificial Sequence
  Description of Artificial Sequence: Synthetic oligonucleotide
acccaaactcacacccgatgggacgac

SEQ ID NO: 323272 - DNA, 26 bp, Artificial Sequence
  Description of Artificial Sequence: Synthetic oligonucleotide
cccaaactcacacccgatgggacgac

SEQ ID NO: 323273 - DNA, 27 bp, Artificial Sequence
  Description of Artificial Sequence: Synthetic oligonucleotide
ccaaactcacacccgatgggacgacgt

SEQ ID NO: 323274 - DNA, 27 bp, Artificial Sequence
  Description of Artificial Sequence: Synthetic oligonucleotide
caaactcacacccgatgggacgacgtc

SEQ ID NO: 323275 - DNA, 29 bp, Artificial Sequence
  Description of Artificial Sequence: Synthetic oligonucleotide
aaactcacacccgatgggacgacgtcatc

SEQ ID NO: 323276 - DNA, 28 bp, Artificial Sequence
  Description of Artificial Sequence: Synthetic oligonucleotide
aactcacacccgatgggacgacgtcatc

SEQ ID NO: 323277 - DNA, 27 bp, Artificial Sequence
  Description of Artificial Sequence: Synthetic oligonucleotide
actcacacccgatgggacgacgtcatc

SEQ ID NO: 323278 - DNA, 27 bp, Artificial Sequence
  Description of Artificial Sequence: Synthetic oligonucleotide
ctcacacccgatgggacgacgtcatca

SEQ ID NO: 323279 - DNA, 28 bp, Artificial Sequence
  Description of Artificial Sequence: Synthetic oligonucleotide
tcacacccgatgggacgacgtcatcaag

SEQ ID NO: 323280 - DNA, 27 bp, Artificial Sequence
  Description of Artificial Sequence: Synthetic oligonucleotide
cacacccgatgggacgacgtcatcaag

SEQ ID NO: 323281 - DNA, 27 bp, Artificial Sequence
  Description of Artificial Sequence: Synthetic oligonucleotide
acacccgatgggacgacgtcatcaagg

SEQ ID NO: 323282 - DNA, 27 bp, Artificial Sequence
  Description of Artificial Sequence: Synthetic oligonucleotide
cacccgatgggacgacgtcatcaagga

SEQ ID NO: 323283 - DNA, 27 bp, Artificial Sequence
  Description of Artificial Sequence: Synthetic oligonucleotide
acccgatgggacgacgtcatcaaggag

SEQ ID NO: 323284 - DNA, 26 bp, Artificial Sequence
  Description of Artificial Sequence: Synthetic oligonucleotide
cccgatgggacgacgtcatcaaggag

SEQ ID NO: 323285 - DNA, 27 bp, Artificial Sequence
  Description of Artificial Sequence: Synthetic oligonucleotide
ccgatgggacgacgtcatcaaggagga

SEQ ID NO: 323286 - DNA, 28 bp, Artificial Sequence
  Description of Artificial Sequence: Synthetic oligonucleotide
cgatgggacgacgtcatcaaggaggaag

SEQ ID NO: 323287 - DNA, 30 bp, Artificial Sequence
  Description of Artificial Sequence: Synthetic oligonucleotide
gatgggacgacgtcatcaaggaggaagaag

SEQ ID NO: 323288 - DNA, 30 bp, Artificial Sequence
  Description of Artificial Sequence: Synthetic oligonucleotide
atgggacgacgtcatcaaggaggaagaagc

SEQ ID NO: 323289 - DNA, 29 bp, Artificial Sequence
  Description of Artificial Sequence: Synthetic oligonucleotide
tgggacgacgtcatcaaggaggaagaagc

SEQ ID NO: 323290 - DNA, 28 bp, Artificial Sequence
  Description of Artificial Sequence: Synthetic oligonucleotide
gggacgacgtcatcaaggaggaagaagc

SEQ ID NO: 323291 - DNA, 30 bp, Artificial Sequence
  Description of Artificial Sequence: Synthetic oligonucleotide
ggacgacgtcatcaaggaggaagaagcatg

SEQ ID NO: 323292 - DNA, 30 bp, Artificial Sequence
  Description of Artificial Sequence: Synthetic oligonucleotide
gacgacgtcatcaaggaggaagaagcatgg

SEQ ID NO: 323293 - DNA, 34 bp, Artificial Sequence
  Description of Artificial Sequence: Synthetic oligonucleotide
acgacgtcatcaaggaggaagaagcatggatatg

SEQ ID NO: 323294 - DNA, 33 bp, Artificial Sequence
  Description of Artificial Sequence: Synthetic oligonucleotide
cgacgtcatcaaggaggaagaagcatggatatg

SEQ ID NO: 323295 - DNA, 33 bp, Artificial Sequence
  Description of Artificial Sequence: Synthetic oligonucleotide
gacgtcatcaaggaggaagaagcatggatatgc

SEQ ID NO: 323296 - DNA, 34 bp, Artificial Sequence
  Description of Artificial Sequence: Synthetic oligonucleotide
acgtcatcaaggaggaagaagcatggatatgcac

SEQ ID NO: 323297 - DNA, 33 bp, Artificial Sequence
  Description of Artificial Sequence: Synthetic oligonucleotide
cgtcatcaaggaggaagaagcatggatatgcac

SEQ ID NO: 323298 - DNA, 34 bp, Artificial Sequence
  Description of Artificial Sequence: Synthetic oligonucleotide
gtcatcaaggaggaagaagcatggatatgcactc

SEQ ID NO: 323299 - DNA, 34 bp, Artificial Sequence
  Description of Artificial Sequence: Synthetic oligonucleotide
tcatcaaggaggaagaagcatggatatgcactcc

SEQ ID NO: 323300 - DNA, 33 bp, Artificial Sequence
  Description of Artificial Sequence: Synthetic oligonucleotide
catcaaggaggaagaagcatggatatgcactcc

SEQ ID NO: 323301 - DNA, 34 bp, Artificial Sequence
  Description of Artificial Sequence: Synthetic oligonucleotide
atcaaggaggaagaagcatggatatgcactccag

SEQ ID NO: 323302 - DNA, 33 bp, Artificial Sequence
  Description of Artificial Sequence: Synthetic oligonucleotide
tcaaggaggaagaagcatggatatgcactccag

SEQ ID NO: 323303 - DNA, 32 bp, Artificial Sequence
  Description of Artificial Sequence: Synthetic oligonucleotide
caaggaggaagaagcatggatatgcactccag

SEQ ID NO: 323304 - DNA, 33 bp, Artificial Sequence
  Description of Artificial Sequence: Synthetic oligonucleotide
aaggaggaagaagcatggatatgcactccagtc

SEQ ID NO: 323305 - DNA, 32 bp, Artificial Sequence
  Description of Artificial Sequence: Synthetic oligonucleotide
aggaggaagaagcatggatatgcactccagtc

SEQ ID NO: 323306 - DNA, 31 bp, Artificial Sequence
  Description of Artificial Sequence: Synthetic oligonucleotide
ggaggaagaagcatggatatgcactccagtc

SEQ ID NO: 323307 - DNA, 34 bp, Artificial Sequence
  Description of Artificial Sequence: Synthetic oligonucleotide
gaggaagaagcatggatatgcactccagtcttag

SEQ ID NO: 323308 - DNA, 39 bp, Artificial Sequence
  Description of Artificial Sequence: Synthetic oligonucleotide
aggaagaagcatggatatgcactccagtcttagtataac

SEQ ID NO: 323309 - DNA, 38 bp, Artificial Sequence
  Description of Artificial Sequence: Synthetic oligonucleotide
ggaagaagcatggatatgcactccagtcttagtataac

SEQ ID NO: 323310 - DNA, 38 bp, Artificial Sequence
  Description of Artificial Sequence: Synthetic oligonucleotide
gaagaagcatggatatgcactccagtcttagtataacc

SEQ ID NO: 323311 - DNA, 38 bp, Artificial Sequence
  Description of Artificial Sequence: Synthetic oligonucleotide
aagaagcatggatatgcactccagtcttagtataaccc

SEQ ID NO: 323312 - DNA, 37 bp, Artificial Sequence
  Description of Artificial Sequence: Synthetic oligonucleotide
agaagcatggatatgcactccagtcttagtataaccc

SEQ ID NO: 323313 - DNA, 36 bp, Artificial Sequence
  Description of Artificial Sequence: Synthetic oligonucleotide
gaagcatggatatgcactccagtcttagtataaccc

SEQ ID NO: 323314 - DNA, 38 bp, Artificial Sequence
  Description of Artificial Sequence: Synthetic oligonucleotide
aagcatggatatgcactccagtcttagtataacccttc

SEQ ID NO: 323315 - DNA, 37 bp, Artificial Sequence
  Description of Artificial Sequence: Synthetic oligonucleotide
agcatggatatgcactccagtcttagtataacccttc

SEQ ID NO: 323316 - DNA, 36 bp, Artificial Sequence
  Description of Artificial Sequence: Synthetic oligonucleotide
gcatggatatgcactccagtcttagtataacccttc

SEQ ID NO: 323317 - DNA, 37 bp, Artificial Sequence
  Description of Artificial Sequence: Synthetic oligonucleotide
catggatatgcactccagtcttagtataacccttcag

SEQ ID NO: 323318 - DNA, 37 bp, Artificial Sequence
  Description of Artificial Sequence: Synthetic oligonucleotide
atggatatgcactccagtcttagtataacccttcagc

SEQ ID NO: 323319 - DNA, 36 bp, Artificial Sequence
  Description of Artificial Sequence: Synthetic oligonucleotide
tggatatgcactccagtcttagtataacccttcagc

SEQ ID NO: 323320 - DNA, 35 bp, Artificial Sequence
  Description of Artificial Sequence: Synthetic oligonucleotide
ggatatgcactccagtcttagtataacccttcagc

SEQ ID NO: 323321 - DNA, 35 bp, Artificial Sequence
  Description of Artificial Sequence: Synthetic oligonucleotide
gatatgcactccagtcttagtataacccttcagcc

SEQ ID NO: 323322 - DNA, 37 bp, Artificial Sequence
  Description of Artificial Sequence: Synthetic oligonucleotide
atatgcactccagtcttagtataacccttcagccttc

SEQ ID NO: 323323 - DNA, 36 bp, Artificial Sequence
  Description of Artificial Sequence: Synthetic oligonucleotide
tatgcactccagtcttagtataacccttcagccttc

SEQ ID NO: 323324 - DNA, 35 bp, Artificial Sequence
  Description of Artificial Sequence: Synthetic oligonucleotide
atgcactccagtcttagtataacccttcagccttc

SEQ ID NO: 323325 - DNA, 34 bp, Artificial Sequence
  Description of Artificial Sequence: Synthetic oligonucleotide
tgcactccagtcttagtataacccttcagccttc

SEQ ID NO: 323326 - DNA, 33 bp, Artificial Sequence
  Description of Artificial Sequence: Synthetic oligonucleotide
gcactccagtcttagtataacccttcagccttc

SEQ ID NO: 323327 - DNA, 34 bp, Artificial Sequence
  Description of Artificial Sequence: Synthetic oligonucleotide
cactccagtcttagtataacccttcagccttctg

SEQ ID NO: 323328 - DNA, 34 bp, Artificial Sequence
  Description of Artificial Sequence: Synthetic oligonucleotide
actccagtcttagtataacccttcagccttctgc

SEQ ID NO: 323329 - DNA, 33 bp, Artificial Sequence
  Description of Artificial Sequence: Synthetic oligonucleotide
ctccagtcttagtataacccttcagccttctgc

SEQ ID NO: 323330 - DNA, 37 bp, Artificial Sequence
  Description of Artificial Sequence: Synthetic oligonucleotide
tccagtcttagtataacccttcagccttctgcaaatc

SEQ ID NO: 323331 - DNA, 36 bp, Artificial Sequence
  Description of Artificial Sequence: Synthetic oligonucleotide
ccagtcttagtataacccttcagccttctgcaaatc

SEQ ID NO: 323332 - DNA, 36 bp, Artificial Sequence
  Description of Artificial Sequence: Synthetic oligonucleotide
cagtcttagtataacccttcagccttctgcaaatcg

SEQ ID NO: 323333 - DNA, 39 bp, Artificial Sequence
  Description of Artificial Sequence: Synthetic oligonucleotide
agtcttagtataacccttcagccttctgcaaatcgaaac

SEQ ID NO: 323334 - DNA, 38 bp, Artificial Sequence
  Description of Artificial Sequence: Synthetic oligonucleotide
gtcttagtataacccttcagccttctgcaaatcgaaac

SEQ ID NO: 323335 - DNA, 39 bp, Artificial Sequence
  Description of Artificial Sequence: Synthetic oligonucleotide
tcttagtataacccttcagccttctgcaaatcgaaacac

SEQ ID NO: 323336 - DNA, 38 bp, Artificial Sequence
  Description of Artificial Sequence: Synthetic oligonucleotide
cttagtataacccttcagccttctgcaaatcgaaacac

SEQ ID NO: 323337 - DNA, 39 bp, Artificial Sequence
  Description of Artificial Sequence: Synthetic oligonucleotide
ttagtataacccttcagccttctgcaaatcgaaacacag

SEQ ID NO: 323338 - DNA, 38 bp, Artificial Sequence
  Description of Artificial Sequence: Synthetic oligonucleotide
tagtataacccttcagccttctgcaaatcgaaacacag

SEQ ID NO: 323339 - DNA, 37 bp, Artificial Sequence
  Description of Artificial Sequence: Synthetic oligonucleotide
agtataacccttcagccttctgcaaatcgaaacacag

SEQ ID NO: 323340 - DNA, 36 bp, Artificial Sequence
  Description of Artificial Sequence: Synthetic oligonucleotide
gtataacccttcagccttctgcaaatcgaaacacag

SEQ ID NO: 323341 - DNA, 36 bp, Artificial Sequence
  Description of Artificial Sequence: Synthetic oligonucleotide
tataacccttcagccttctgcaaatcgaaacacagg

SEQ ID NO: 323342 - DNA, 35 bp, Artificial Sequence
  Description of Artificial Sequence: Synthetic oligonucleotide
ataacccttcagccttctgcaaatcgaaacacagg

SEQ ID NO: 323343 - DNA, 34 bp, Artificial Sequence
  Description of Artificial Sequence: Synthetic oligonucleotide
taacccttcagccttctgcaaatcgaaacacagg

SEQ ID NO: 323344 - DNA, 33 bp, Artificial Sequence
  Description of Artificial Sequence: Synthetic oligonucleotide
aacccttcagccttctgcaaatcgaaacacagg

SEQ ID NO: 323345 - DNA, 32 bp, Artificial Sequence
  Description of Artificial Sequence: Synthetic oligonucleotide
acccttcagccttctgcaaatcgaaacacagg

SEQ ID NO: 323346 - DNA, 31 bp, Artificial Sequence
  Description of Artificial Sequence: Synthetic oligonucleotide
cccttcagccttctgcaaatcgaaacacagg

SEQ ID NO: 323347 - DNA, 34 bp, Artificial Sequence
  Description of Artificial Sequence: Synthetic oligonucleotide
ccttcagccttctgcaaatcgaaacacaggattg

SEQ ID NO: 323348 - DNA, 34 bp, Artificial Sequence
  Description of Artificial Sequence: Synthetic oligonucleotide
cttcagccttctgcaaatcgaaacacaggattgg

SEQ ID NO: 323349 - DNA, 35 bp, Artificial Sequence
  Description of Artificial Sequence: Synthetic oligonucleotide
ttcagccttctgcaaatcgaaacacaggattggtg

SEQ ID NO: 323350 - DNA, 34 bp, Artificial Sequence
  Description of Artificial Sequence: Synthetic oligonucleotide
tcagccttctgcaaatcgaaacacaggattggtg

SEQ ID NO: 323351 - DNA, 33 bp, Artificial Sequence
  Description of Artificial Sequence: Synthetic oligonucleotide
cagccttctgcaaatcgaaacacaggattggtg

SEQ ID NO: 323352 - DNA, 33 bp, Artificial Sequence
  Description of Artificial Sequence: Synthetic oligonucleotide
agccttctgcaaatcgaaacacaggattggtgg

SEQ ID NO: 323353 - DNA, 32 bp, Artificial Sequence
  Description of Artificial Sequence: Synthetic oligonucleotide
gccttctgcaaatcgaaacacaggattggtgg

SEQ ID NO: 323354 - DNA, 34 bp, Artificial Sequence
  Description of Artificial Sequence: Synthetic oligonucleotide
ccttctgcaaatcgaaacacaggattggtggaac

SEQ ID NO: 323355 - DNA, 38 bp, Artificial Sequence
  Description of Artificial Sequence: Synthetic oligonucleotide
cttctgcaaatcgaaacacaggattggtggaacatttg

SEQ ID NO: 323356 - DNA, 38 bp, Artificial Sequence
  Description of Artificial Sequence: Synthetic oligonucleotide
ttctgcaaatcgaaacacaggattggtggaacatttgg

SEQ ID NO: 323357 - DNA, 37 bp, Artificial Sequence
  Description of Artificial Sequence: Synthetic oligonucleotide
tctgcaaatcgaaacacaggattggtggaacatttgg

SEQ ID NO: 323358 - DNA, 36 bp, Artificial Sequence
  Description of Artificial Sequence: Synthetic oligonucleotide
ctgcaaatcgaaacacaggattggtggaacatttgg

SEQ ID NO: 323359 - DNA, 37 bp, Artificial Sequence
  Description of Artificial Sequence: Synthetic oligonucleotide
tgcaaatcgaaacacaggattggtggaacatttggac

SEQ ID NO: 323360 - DNA, 36 bp, Artificial Sequence
  Description of Artificial Sequence: Synthetic oligonucleotide
gcaaatcgaaacacaggattggtggaacatttggac

SEQ ID NO: 323361 - DNA, 37 bp, Artificial Sequence
  Description of Artificial Sequence: Synthetic oligonucleotide
caaatcgaaacacaggattggtggaacatttggacac

SEQ ID NO: 323362 - DNA, 37 bp, Artificial Sequence
  Description of Artificial Sequence: Synthetic oligonucleotide
aaatcgaaacacaggattggtggaacatttggacacg

SEQ ID NO: 323363 - DNA, 36 bp, Artificial Sequence
  Description of Artificial Sequence: Synthetic oligonucleotide
aatcgaaacacaggattggtggaacatttggacacg

SEQ ID NO: 323364 - DNA, 35 bp, Artificial Sequence
  Description of Artificial Sequence: Synthetic oligonucleotide
atcgaaacacaggattggtggaacatttggacacg

SEQ ID NO: 323365 - DNA, 34 bp, Artificial Sequence
  Description of Artificial Sequence: Synthetic oligonucleotide
tcgaaacacaggattggtggaacatttggacacg

SEQ ID NO: 323366 - DNA, 33 bp, Artificial Sequence
  Description of Artificial Sequence: Synthetic oligonucleotide
cgaaacacaggattggtggaacatttggacacg

SEQ ID NO: 323367 - DNA, 34 bp, Artificial Sequence
  Description of Artificial Sequence: Synthetic oligonucleotide
gaaacacaggattggtggaacatttggacacgac

SEQ ID NO: 323368 - DNA, 35 bp, Artificial Sequence
  Description of Artificial Sequence: Synthetic oligonucleotide
aaacacaggattggtggaacatttggacacgacag

SEQ ID NO: 323369 - DNA, 34 bp, Artificial Sequence
  Description of Artificial Sequence: Synthetic oligonucleotide
aacacaggattggtggaacatttggacacgacag

SEQ ID NO: 323370 - DNA, 33 bp, Artificial Sequence
  Description of Artificial Sequence: Synthetic oligonucleotide
acacaggattggtggaacatttggacacgacag

SEQ ID NO: 323371 - DNA, 32 bp, Artificial Sequence
  Description of Artificial Sequence: Synthetic oligonucleotide
cacaggattggtggaacatttggacacgacag

SEQ ID NO: 323372 - DNA, 32 bp, Artificial Sequence
  Description of Artificial Sequence: Synthetic oligonucleotide
acaggattggtggaacatttggacacgacagg

SEQ ID NO: 323373 - DNA, 31 bp, Artificial Sequence
  Description of Artificial Sequence: Synthetic oligonucleotide
caggattggtggaacatttggacacgacagg

SEQ ID NO: 323374 - DNA, 32 bp, Artificial Sequence
  Description of Artificial Sequence: Synthetic oligonucleotide
aggattggtggaacatttggacacgacaggac

SEQ ID NO: 323375 - DNA, 31 bp, Artificial Sequence
  Description of Artificial Sequence: Synthetic oligonucleotide
ggattggtggaacatttggacacgacaggac

SEQ ID NO: 323376 - DNA, 31 bp, Artificial Sequence
  Description of Artificial Sequence: Synthetic oligonucleotide
gattggtggaacatttggacacgacaggacc

SEQ ID NO: 323377 - DNA, 32 bp, Artificial Sequence
  Description of Artificial Sequence: Synthetic oligonucleotide
attggtggaacatttggacacgacaggaccac

SEQ ID NO: 323378 - DNA, 31 bp, Artificial Sequence
  Description of Artificial Sequence: Synthetic oligonucleotide
ttggtggaacatttggacacgacaggaccac

SEQ ID NO: 323379 - DNA, 30 bp, Artificial Sequence
  Description of Artificial Sequence: Synthetic oligonucleotide
tggtggaacatttggacacgacaggaccac

SEQ ID NO: 323380 - DNA, 29 bp, Artificial Sequence
  Description of Artificial Sequence: Synthetic oligonucleotide
ggtggaacatttggacacgacaggaccac

SEQ ID NO: 323381 - DNA, 32 bp, Artificial Sequence
  Description of Artificial Sequence: Synthetic oligonucleotide
gtggaacatttggacacgacaggaccactttc

SEQ ID NO: 323382 - DNA, 35 bp, Artificial Sequence
  Description of Artificial Sequence: Synthetic oligonucleotide
tggaacatttggacacgacaggaccactttcaatg

SEQ ID NO: 323383 - DNA, 34 bp, Artificial Sequence
  Description of Artificial Sequence: Synthetic oligonucleotide
ggaacatttggacacgacaggaccactttcaatg

SEQ ID NO: 323384 - DNA, 35 bp, Artificial Sequence
  Description of Artificial Sequence: Synthetic oligonucleotide
gaacatttggacacgacaggaccactttcaatgtc

SEQ ID NO: 323385 - DNA, 37 bp, Artificial Sequence
  Description of Artificial Sequence: Synthetic oligonucleotide
aacatttggacacgacaggaccactttcaatgtcaac

SEQ ID NO: 323386 - DNA, 36 bp, Artificial Sequence
  Description of Artificial Sequence: Synthetic oligonucleotide
acatttggacacgacaggaccactttcaatgtcaac

SEQ ID NO: 323387 - DNA, 35 bp, Artificial Sequence
  Description of Artificial Sequence: Synthetic oligonucleotide
catttggacacgacaggaccactttcaatgtcaac

SEQ ID NO: 323388 - DNA, 35 bp, Artificial Sequence
  Description of Artificial Sequence: Synthetic oligonucleotide
atttggacacgacaggaccactttcaatgtcaacg

SEQ ID NO: 323389 - DNA, 34 bp, Artificial Sequence
  Description of Artificial Sequence: Synthetic oligonucleotide
tttggacacgacaggaccactttcaatgtcaacg

SEQ ID NO: 323390 - DNA, 33 bp, Artificial Sequence
  Description of Artificial Sequence: Synthetic oligonucleotide
ttggacacgacaggaccactttcaatgtcaacg

SEQ ID NO: 323391 - DNA, 32 bp, Artificial Sequence
  Description of Artificial Sequence: Synthetic oligonucleotide
tggacacgacaggaccactttcaatgtcaacg

SEQ ID NO: 323392 - DNA, 31 bp, Artificial Sequence
  Description of Artificial Sequence: Synthetic oligonucleotide
ggacacgacaggaccactttcaatgtcaacg

SEQ ID NO: 323393 - DNA, 31 bp, Artificial Sequence
  Description of Artificial Sequence: Synthetic oligonucleotide
gacacgacaggaccactttcaatgtcaacgc

SEQ ID NO: 323394 - DNA, 32 bp, Artificial Sequence
  Description of Artificial Sequence: Synthetic oligonucleotide
acacgacaggaccactttcaatgtcaacgcag

SEQ ID NO: 323395 - DNA, 31 bp, Artificial Sequence
  Description of Artificial Sequence: Synthetic oligonucleotide
cacgacaggaccactttcaatgtcaacgcag

SEQ ID NO: 323396 - DNA, 31 bp, Artificial Sequence
  Description of Artificial Sequence: Synthetic oligonucleotide
acgacaggaccactttcaatgtcaacgcagc

SEQ ID NO: 323397 - DNA, 30 bp, Artificial Sequence
  Description of Artificial Sequence: Synthetic oligonucleotide
cgacaggaccactttcaatgtcaacgcagc

SEQ ID NO: 323398 - DNA, 31 bp, Artificial Sequence
  Description of Artificial Sequence: Synthetic oligonucleotide
gacaggaccactttcaatgtcaacgcagctg

SEQ ID NO: 323399 - DNA, 32 bp, Artificial Sequence
  Description of Artificial Sequence: Synthetic oligonucleotide
acaggaccactttcaatgtcaacgcagctgag

SEQ ID NO: 323400 - DNA, 31 bp, Artificial Sequence
  Description of Artificial Sequence: Synthetic oligonucleotide
caggaccactttcaatgtcaacgcagctgag

SEQ ID NO: 323401 - DNA, 36 bp, Artificial Sequence
  Description of Artificial Sequence: Synthetic oligonucleotide
aggaccactttcaatgtcaacgcagctgagtaattc

SEQ ID NO: 323402 - DNA, 35 bp, Artificial Sequence
  Description of Artificial Sequence: Synthetic oligonucleotide
ggaccactttcaatgtcaacgcagctgagtaattc

SEQ ID NO: 323403 - DNA, 36 bp, Artificial Sequence
  Description of Artificial Sequence: Synthetic oligonucleotide
gaccactttcaatgtcaacgcagctgagtaattcac

SEQ ID NO: 323404 - DNA, 37 bp, Artificial Sequence
  Description of Artificial Sequence: Synthetic oligonucleotide
accactttcaatgtcaacgcagctgagtaattcacag

SEQ ID NO: 323405 - DNA, 36 bp, Artificial Sequence
  Description of Artificial Sequence: Synthetic oligonucleotide
ccactttcaatgtcaacgcagctgagtaattcacag

SEQ ID NO: 323406 - DNA, 37 bp, Artificial Sequence
  Description of Artificial Sequence: Synthetic oligonucleotide
cactttcaatgtcaacgcagctgagtaattcacagag

SEQ ID NO: 323407 - DNA, 37 bp, Artificial Sequence
  Description of Artificial Sequence: Synthetic oligonucleotide
actttcaatgtcaacgcagctgagtaattcacagagc

SEQ ID NO: 323408 - DNA, 36 bp, Artificial Sequence
  Description of Artificial Sequence: Synthetic oligonucleotide
ctttcaatgtcaacgcagctgagtaattcacagagc

SEQ ID NO: 323409 - DNA, 38 bp, Artificial Sequence
  Description of Artificial Sequence: Synthetic oligonucleotide
tttcaatgtcaacgcagctgagtaattcacagagcttc

SEQ ID NO: 323410 - DNA, 37 bp, Artificial Sequence
  Description of Artificial Sequence: Synthetic oligonucleotide
ttcaatgtcaacgcagctgagtaattcacagagcttc

SEQ ID NO: 323411 - DNA, 36 bp, Artificial Sequence
  Description of Artificial Sequence: Synthetic oligonucleotide
tcaatgtcaacgcagctgagtaattcacagagcttc

SEQ ID NO: 323412 - DNA, 35 bp, Artificial Sequence
  Description of Artificial Sequence: Synthetic oligonucleotide
caatgtcaacgcagctgagtaattcacagagcttc

SEQ ID NO: 323413 - DNA, 36 bp, Artificial Sequence
  Description of Artificial Sequence: Synthetic oligonucleotide
aatgtcaacgcagctgagtaattcacagagcttcac

SEQ ID NO: 323414 - DNA, 35 bp, Artificial Sequence
  Description of Artificial Sequence: Synthetic oligonucleotide
atgtcaacgcagctgagtaattcacagagcttcac

SEQ ID NO: 323415 - DNA, 34 bp, Artificial Sequence
  Description of Artificial Sequence: Synthetic oligonucleotide
tgtcaacgcagctgagtaattcacagagcttcac

SEQ ID NO: 323416 - DNA, 33 bp, Artificial Sequence
  Description of Artificial Sequence: Synthetic oligonucleotide
gtcaacgcagctgagtaattcacagagcttcac

SEQ ID NO: 323417 - DNA, 35 bp, Artificial Sequence
  Description of Artificial Sequence: Synthetic oligonucleotide
tcaacgcagctgagtaattcacagagcttcactac

SEQ ID NO: 323418 - DNA, 34 bp, Artificial Sequence
  Description of Artificial Sequence: Synthetic oligonucleotide
caacgcagctgagtaattcacagagcttcactac

SEQ ID NO: 323419 - DNA, 36 bp, Artificial Sequence
  Description of Artificial Sequence: Synthetic oligonucleotide
aacgcagctgagtaattcacagagcttcactacatc

SEQ ID NO: 323420 - DNA, 35 bp, Artificial Sequence
  Description of Artificial Sequence: Synthetic oligonucleotide
acgcagctgagtaattcacagagcttcactacatc

SEQ ID NO: 323421 - DNA, 34 bp, Artificial Sequence
  Description of Artificial Sequence: Synthetic oligonucleotide
cgcagctgagtaattcacagagcttcactacatc

SEQ ID NO: 323422 - DNA, 35 bp, Artificial Sequence
  Description of Artificial Sequence: Synthetic oligonucleotide
gcagctgagtaattcacagagcttcactacatcac

SEQ ID NO: 323423 - DNA, 37 bp, Artificial Sequence
  Description of Artificial Sequence: Synthetic oligonucleotide
cagctgagtaattcacagagcttcactacatcacttg

SEQ ID NO: 323424 - DNA, 39 bp, Artificial Sequence
  Description of Artificial Sequence: Synthetic oligonucleotide
agctgagtaattcacagagcttcactacatcacttgaag

SEQ ID NO: 323425 - DNA, 38 bp, Artificial Sequence
  Description of Artificial Sequence: Synthetic oligonucleotide
gctgagtaattcacagagcttcactacatcacttgaag

SEQ ID NO: 323426 - DNA, 38 bp, Artificial Sequence
  Description of Artificial Sequence: Synthetic oligonucleotide
ctgagtaattcacagagcttcactacatcacttgaagg

SEQ ID NO: 323427 - DNA, 38 bp, Artificial Sequence
  Description of Artificial Sequence: Synthetic oligonucleotide
tgagtaattcacagagcttcactacatcacttgaaggc

SEQ ID NO: 323428 - DNA, 37 bp, Artificial Sequence
  Description of Artificial Sequence: Synthetic oligonucleotide
gagtaattcacagagcttcactacatcacttgaaggc

SEQ ID NO: 323429 - DNA, 39 bp, Artificial Sequence
  Description of Artificial Sequence: Synthetic oligonucleotide
agtaattcacagagcttcactacatcacttgaaggcttc

SEQ ID NO: 323430 - DNA, 38 bp, Artificial Sequence
  Description of Artificial Sequence: Synthetic oligonucleotide
gtaattcacagagcttcactacatcacttgaaggcttc

SEQ ID NO: 323431 - DNA, 38 bp, Artificial Sequence
  Description of Artificial Sequence: Synthetic oligonucleotide
taattcacagagcttcactacatcacttgaaggcttcg

SEQ ID NO: 323432 - DNA, 37 bp, Artificial Sequence
  Description of Artificial Sequence: Synthetic oligonucleotide
aattcacagagcttcactacatcacttgaaggcttcg

SEQ ID NO: 323433 - DNA, 36 bp, Artificial Sequence
  Description of Artificial Sequence: Synthetic oligonucleotide
attcacagagcttcactacatcacttgaaggcttcg

SEQ ID NO: 323434 - DNA, 35 bp, Artificial Sequence
  Description of Artificial Sequence: Synthetic oligonucleotide
ttcacagagcttcactacatcacttgaaggcttcg

SEQ ID NO: 323435 - DNA, 34 bp, Artificial Sequence
  Description of Artificial Sequence: Synthetic oligonucleotide
tcacagagcttcactacatcacttgaaggcttcg

SEQ ID NO: 323436 - DNA, 33 bp, Artificial Sequence
  Description of Artificial Sequence: Synthetic oligonucleotide
cacagagcttcactacatcacttgaaggcttcg

SEQ ID NO: 323437 - DNA, 35 bp, Artificial Sequence
  Description of Artificial Sequence: Synthetic oligonucleotide
acagagcttcactacatcacttgaaggcttcgaag

SEQ ID NO: 323438 - DNA, 34 bp, Artificial Sequence
  Description of Artificial Sequence: Synthetic oligonucleotide
cagagcttcactacatcacttgaaggcttcgaag

SEQ ID NO: 323439 - DNA, 36 bp, Artificial Sequence
  Description of Artificial Sequence: Synthetic oligonucleotide
agagcttcactacatcacttgaaggcttcgaagaag

SEQ ID NO: 323440 - DNA, 35 bp, Artificial Sequence
  Description of Artificial Sequence: Synthetic oligonucleotide
gagcttcactacatcacttgaaggcttcgaagaag

SEQ ID NO: 323441 - DNA, 40 bp, Artificial Sequence
  Description of Artificial Sequence: Synthetic oligonucleotide
agcttcactacatcacttgaaggcttcgaagaagattaag

SEQ ID NO: 323442 - DNA, 39 bp, Artificial Sequence
  Description of Artificial Sequence: Synthetic oligonucleotide
gcttcactacatcacttgaaggcttcgaagaagattaag

SEQ ID NO: 323443 - DNA, 40 bp, Artificial Sequence
  Description of Artificial Sequence: Synthetic oligonucleotide
cttcactacatcacttgaaggcttcgaagaagattaagac

SEQ ID NO: 323444 - DNA, 40 bp, Artificial Sequence
  Description of Artificial Sequence: Synthetic oligonucleotide
ttcactacatcacttgaaggcttcgaagaagattaagacc

SEQ ID NO: 323445 - DNA, 39 bp, Artificial Sequence
  Description of Artificial Sequence: Synthetic oligonucleotide
tcactacatcacttgaaggcttcgaagaagattaagacc

SEQ ID NO: 323446 - DNA, 38 bp, Artificial Sequence
  Description of Artificial Sequence: Synthetic oligonucleotide
cactacatcacttgaaggcttcgaagaagattaagacc

SEQ ID NO: 323447 - DNA, 40 bp, Artificial Sequence
  Description of Artificial Sequence: Synthetic oligonucleotide
actacatcacttgaaggcttcgaagaagattaagaccatc

SEQ ID NO: 323448 - DNA, 39 bp, Artificial Sequence
  Description of Artificial Sequence: Synthetic oligonucleotide
ctacatcacttgaaggcttcgaagaagattaagaccatc

SEQ ID NO: 323449 - DNA, 39 bp, Artificial Sequence
  Description of Artificial Sequence: Synthetic oligonucleotide
tacatcacttgaaggcttcgaagaagattaagaccatcg

SEQ ID NO: 323450 - DNA, 38 bp, Artificial Sequence
  Description of Artificial Sequence: Synthetic oligonucleotide
acatcacttgaaggcttcgaagaagattaagaccatcg

SEQ ID NO: 323451 - DNA, 37 bp, Artificial Sequence
  Description of Artificial Sequence: Synthetic oligonucleotide
catcacttgaaggcttcgaagaagattaagaccatcg

SEQ ID NO: 323452 - DNA, 39 bp, Artificial Sequence
  Description of Artificial Sequence: Synthetic oligonucleotide
atcacttgaaggcttcgaagaagattaagaccatcgaac

SEQ ID NO: 323453 - DNA, 38 bp, Artificial Sequence
  Description of Artificial Sequence: Synthetic oligonucleotide
tcacttgaaggcttcgaagaagattaagaccatcgaac

SEQ ID NO: 323454 - DNA, 37 bp, Artificial Sequence
  Description of Artificial Sequence: Synthetic oligonucleotide
cacttgaaggcttcgaagaagattaagaccatcgaac

SEQ ID NO: 323455 - DNA, 39 bp, Artificial Sequence
  Description of Artificial Sequence: Synthetic oligonucleotide
acttgaaggcttcgaagaagattaagaccatcgaacaac

SEQ ID NO: 323456 - DNA, 38 bp, Artificial Sequence
  Description of Artificial Sequence: Synthetic oligonucleotide
cttgaaggcttcgaagaagattaagaccatcgaacaac

SEQ ID NO: 323457 - DNA, 40 bp, Artificial Sequence
  Description of Artificial Sequence: Synthetic oligonucleotide
ttgaaggcttcgaagaagattaagaccatcgaacaacttc

SEQ ID NO: 323458 - DNA, 39 bp, Artificial Sequence
  Description of Artificial Sequence: Synthetic oligonucleotide
tgaaggcttcgaagaagattaagaccatcgaacaacttc

SEQ ID NO: 323459 - DNA, 38 bp, Artificial Sequence
  Description of Artificial Sequence: Synthetic oligonucleotide
gaaggcttcgaagaagattaagaccatcgaacaacttc

SEQ ID NO: 323460 - DNA, 40 bp, Artificial Sequence
  Description of Artificial Sequence: Synthetic oligonucleotide
aaggcttcgaagaagattaagaccatcgaacaacttcaac

SEQ ID NO: 323461 - DNA, 39 bp, Artificial Sequence
  Description of Artificial Sequence: Synthetic oligonucleotide
aggcttcgaagaagattaagaccatcgaacaacttcaac

SEQ ID NO: 323462 - DNA, 38 bp, Artificial Sequence
  Description of Artificial Sequence: Synthetic oligonucleotide
ggcttcgaagaagattaagaccatcgaacaacttcaac

SEQ ID NO: 323463 - DNA, 39 bp, Artificial Sequence
  Description of Artificial Sequence: Synthetic oligonucleotide
gcttcgaagaagattaagaccatcgaacaacttcaactc

SEQ ID NO: 323464 - DNA, 40 bp, Artificial Sequence
  Description of Artificial Sequence: Synthetic oligonucleotide
cttcgaagaagattaagaccatcgaacaacttcaactctg

SEQ ID NO: 323465 - DNA, 41 bp, Artificial Sequence
  Description of Artificial Sequence: Synthetic oligonucleotide
ttcgaagaagattaagaccatcgaacaacttcaactctgac

SEQ ID NO: 323466 - DNA, 40 bp, Artificial Sequence
  Description of Artificial Sequence: Synthetic oligonucleotide
tcgaagaagattaagaccatcgaacaacttcaactctgac

SEQ ID NO: 323467 - DNA, 39 bp, Artificial Sequence
  Description of Artificial Sequence: Synthetic oligonucleotide
cgaagaagattaagaccatcgaacaacttcaactctgac

SEQ ID NO: 323468 - DNA, 41 bp, Artificial Sequence
  Description of Artificial Sequence: Synthetic oligonucleotide
gaagaagattaagaccatcgaacaacttcaactctgacaac

SEQ ID NO: 323469 - DNA, 43 bp, Artificial Sequence
  Description of Artificial Sequence: Synthetic oligonucleotide
aagaagattaagaccatcgaacaacttcaactctgacaacaag

SEQ ID NO: 323470 - DNA, 42 bp, Artificial Sequence
  Description of Artificial Sequence: Synthetic oligonucleotide
agaagattaagaccatcgaacaacttcaactctgacaacaag

SEQ ID NO: 323471 - DNA, 41 bp, Artificial Sequence
  Description of Artificial Sequence: Synthetic oligonucleotide
gaagattaagaccatcgaacaacttcaactctgacaacaag

SEQ ID NO: 323472 - DNA, 41 bp, Artificial Sequence
  Description of Artificial Sequence: Synthetic oligonucleotide
aagattaagaccatcgaacaacttcaactctgacaacaagc

SEQ ID NO: 323473 - DNA, 40 bp, Artificial Sequence
  Description of Artificial Sequence: Synthetic oligonucleotide
agattaagaccatcgaacaacttcaactctgacaacaagc

SEQ ID NO: 323474 - DNA, 39 bp, Artificial Sequence
  Description of Artificial Sequence: Synthetic oligonucleotide
gattaagaccatcgaacaacttcaactctgacaacaagc

SEQ ID NO: 323475 - DNA, 43 bp, Artificial Sequence
  Description of Artificial Sequence: Synthetic oligonucleotide
attaagaccatcgaacaacttcaactctgacaacaagcaatac

SEQ ID NO: 323476 - DNA, 42 bp, Artificial Sequence
  Description of Artificial Sequence: Synthetic oligonucleotide
ttaagaccatcgaacaacttcaactctgacaacaagcaatac

SEQ ID NO: 323477 - DNA, 41 bp, Artificial Sequence
  Description of Artificial Sequence: Synthetic oligonucleotide
taagaccatcgaacaacttcaactctgacaacaagcaatac

SEQ ID NO: 323478 - DNA, 40 bp, Artificial Sequence
  Description of Artificial Sequence: Synthetic oligonucleotide
aagaccatcgaacaacttcaactctgacaacaagcaatac

SEQ ID NO: 323479 - DNA, 39 bp, Artificial Sequence
  Description of Artificial Sequence: Synthetic oligonucleotide
agaccatcgaacaacttcaactctgacaacaagcaatac

SEQ ID NO: 323480 - DNA, 38 bp, Artificial Sequence
  Description of Artificial Sequence: Synthetic oligonucleotide
gaccatcgaacaacttcaactctgacaacaagcaatac

SEQ ID NO: 323481 - DNA, 38 bp, Artificial Sequence
  Description of Artificial Sequence: Synthetic oligonucleotide
accatcgaacaacttcaactctgacaacaagcaatacg

SEQ ID NO: 323482 - DNA, 37 bp, Artificial Sequence
  Description of Artificial Sequence: Synthetic oligonucleotide
ccatcgaacaacttcaactctgacaacaagcaatacg

SEQ ID NO: 323483 - DNA, 40 bp, Artificial Sequence
  Description of Artificial Sequence: Synthetic oligonucleotide
catcgaacaacttcaactctgacaacaagcaatacgaatg

SEQ ID NO: 323484 - DNA, 42 bp, Artificial Sequence
  Description of Artificial Sequence: Synthetic oligonucleotide
atcgaacaacttcaactctgacaacaagcaatacgaatgatg

SEQ ID NO: 323485 - DNA, 41 bp, Artificial Sequence
  Description of Artificial Sequence: Synthetic oligonucleotide
tcgaacaacttcaactctgacaacaagcaatacgaatgatg

SEQ ID NO: 323486 - DNA, 40 bp, Artificial Sequence
  Description of Artificial Sequence: Synthetic oligonucleotide
cgaacaacttcaactctgacaacaagcaatacgaatgatg

SEQ ID NO: 323487 - DNA, 41 bp, Artificial Sequence
  Description of Artificial Sequence: Synthetic oligonucleotide
gaacaacttcaactctgacaacaagcaatacgaatgatgtg

SEQ ID NO: 323488 - DNA, 42 bp, Artificial Sequence
  Description of Artificial Sequence: Synthetic oligonucleotide
aacaacttcaactctgacaacaagcaatacgaatgatgtgac

SEQ ID NO: 323489 - DNA, 41 bp, Artificial Sequence
  Description of Artificial Sequence: Synthetic oligonucleotide
acaacttcaactctgacaacaagcaatacgaatgatgtgac

SEQ ID NO: 323490 - DNA, 40 bp, Artificial Sequence
  Description of Artificial Sequence: Synthetic oligonucleotide
caacttcaactctgacaacaagcaatacgaatgatgtgac

SEQ ID NO: 323491 - DNA, 41 bp, Artificial Sequence
  Description of Artificial Sequence: Synthetic oligonucleotide
aacttcaactctgacaacaagcaatacgaatgatgtgacag

SEQ ID NO: 323492 - DNA, 40 bp, Artificial Sequence
  Description of Artificial Sequence: Synthetic oligonucleotide
acttcaactctgacaacaagcaatacgaatgatgtgacag

SEQ ID NO: 323493 - DNA, 39 bp, Artificial Sequence
  Description of Artificial Sequence: Synthetic oligonucleotide
cttcaactctgacaacaagcaatacgaatgatgtgacag

SEQ ID NO: 323494 - DNA, 39 bp, Artificial Sequence
  Description of Artificial Sequence: Synthetic oligonucleotide
ttcaactctgacaacaagcaatacgaatgatgtgacagg

SEQ ID NO: 323495 - DNA, 38 bp, Artificial Sequence
  Description of Artificial Sequence: Synthetic oligonucleotide
tcaactctgacaacaagcaatacgaatgatgtgacagg

SEQ ID NO: 323496 - DNA, 37 bp, Artificial Sequence
  Description of Artificial Sequence: Synthetic oligonucleotide
caactctgacaacaagcaatacgaatgatgtgacagg

SEQ ID NO: 323497 - DNA, 38 bp, Artificial Sequence
  Description of Artificial Sequence: Synthetic oligonucleotide
aactctgacaacaagcaatacgaatgatgtgacaggtg

SEQ ID NO: 323498 - DNA, 37 bp, Artificial Sequence
  Description of Artificial Sequence: Synthetic oligonucleotide
actctgacaacaagcaatacgaatgatgtgacaggtg

SEQ ID NO: 323499 - DNA, 36 bp, Artificial Sequence
  Description of Artificial Sequence: Synthetic oligonucleotide
ctctgacaacaagcaatacgaatgatgtgacaggtg

SEQ ID NO: 323500 - DNA, 36 bp, Artificial Sequence
  Description of Artificial Sequence: Synthetic oligonucleotide
tctgacaacaagcaatacgaatgatgtgacaggtgg

SEQ ID NO: 323501 - DNA, 35 bp, Artificial Sequence
  Description of Artificial Sequence: Synthetic oligonucleotide
ctgacaacaagcaatacgaatgatgtgacaggtgg

SEQ ID NO: 323502 - DNA, 37 bp, Artificial Sequence
  Description of Artificial Sequence: Synthetic oligonucleotide
tgacaacaagcaatacgaatgatgtgacaggtggatg

SEQ ID NO: 323503 - DNA, 36 bp, Artificial Sequence
  Description of Artificial Sequence: Synthetic oligonucleotide
gacaacaagcaatacgaatgatgtgacaggtggatg

SEQ ID NO: 323504 - DNA, 38 bp, Artificial Sequence
  Description of Artificial Sequence: Synthetic oligonucleotide
acaacaagcaatacgaatgatgtgacaggtggatgaag

SEQ ID NO: 323505 - DNA, 37 bp, Artificial Sequence
  Description of Artificial Sequence: Synthetic oligonucleotide
caacaagcaatacgaatgatgtgacaggtggatgaag

SEQ ID NO: 323506 - DNA, 38 bp, Artificial Sequence
  Description of Artificial Sequence: Synthetic oligonucleotide
aacaagcaatacgaatgatgtgacaggtggatgaagag

SEQ ID NO: 323507 - DNA, 37 bp, Artificial Sequence
  Description of Artificial Sequence: Synthetic oligonucleotide
acaagcaatacgaatgatgtgacaggtggatgaagag

SEQ ID NO: 323508 - DNA, 36 bp, Artificial Sequence
  Description of Artificial Sequence: Synthetic oligonucleotide
caagcaatacgaatgatgtgacaggtggatgaagag

SEQ ID NO: 323509 - DNA, 37 bp, Artificial Sequence
  Description of Artificial Sequence: Synthetic oligonucleotide
aagcaatacgaatgatgtgacaggtggatgaagagac

SEQ ID NO: 323510 - DNA, 36 bp, Artificial Sequence
  Description of Artificial Sequence: Synthetic oligonucleotide
agcaatacgaatgatgtgacaggtggatgaagagac

SEQ ID NO: 323511 - DNA, 35 bp, Artificial Sequence
  Description of Artificial Sequence: Synthetic oligonucleotide
gcaatacgaatgatgtgacaggtggatgaagagac

SEQ ID NO: 323512 - DNA, 35 bp, Artificial Sequence
  Description of Artificial Sequence: Synthetic oligonucleotide
caatacgaatgatgtgacaggtggatgaagagacc

SEQ ID NO: 323513 - DNA, 35 bp, Artificial Sequence
  Description of Artificial Sequence: Synthetic oligonucleotide
aatacgaatgatgtgacaggtggatgaagagaccg

SEQ ID NO: 323514 - DNA, 34 bp, Artificial Sequence
  Description of Artificial Sequence: Synthetic oligonucleotide
atacgaatgatgtgacaggtggatgaagagaccg

SEQ ID NO: 323515 - DNA, 33 bp, Artificial Sequence
  Description of Artificial Sequence: Synthetic oligonucleotide
tacgaatgatgtgacaggtggatgaagagaccg

SEQ ID NO: 323516 - DNA, 32 bp, Artificial Sequence
  Description of Artificial Sequence: Synthetic oligonucleotide
acgaatgatgtgacaggtggatgaagagaccg

SEQ ID NO: 323517 - DNA, 31 bp, Artificial Sequence
  Description of Artificial Sequence: Synthetic oligonucleotide
cgaatgatgtgacaggtggatgaagagaccg

SEQ ID NO: 323518 - DNA, 35 bp, Artificial Sequence
  Description of Artificial Sequence: Synthetic oligonucleotide
gaatgatgtgacaggtggatgaagagaccgaaatc

SEQ ID NO: 323519 - DNA, 38 bp, Artificial Sequence
  Description of Artificial Sequence: Synthetic oligonucleotide
aatgatgtgacaggtggatgaagagaccgaaatcattc

SEQ ID NO: 323520 - DNA, 37 bp, Artificial Sequence
  Description of Artificial Sequence: Synthetic oligonucleotide
atgatgtgacaggtggatgaagagaccgaaatcattc

SEQ ID NO: 323521 - DNA, 36 bp, Artificial Sequence
  Description of Artificial Sequence: Synthetic oligonucleotide
tgatgtgacaggtggatgaagagaccgaaatcattc

SEQ ID NO: 323522 - DNA, 35 bp, Artificial Sequence
  Description of Artificial Sequence: Synthetic oligonucleotide
gatgtgacaggtggatgaagagaccgaaatcattc

SEQ ID NO: 323523 - DNA, 36 bp, Artificial Sequence
  Description of Artificial Sequence: Synthetic oligonucleotide
atgtgacaggtggatgaagagaccgaaatcattcag

SEQ ID NO: 323524 - DNA, 35 bp, Artificial Sequence
  Description of Artificial Sequence: Synthetic oligonucleotide
tgtgacaggtggatgaagagaccgaaatcattcag

SEQ ID NO: 323525 - DNA, 34 bp, Artificial Sequence
  Description of Artificial Sequence: Synthetic oligonucleotide
gtgacaggtggatgaagagaccgaaatcattcag

SEQ ID NO: 323526 - DNA, 36 bp, Artificial Sequence
  Description of Artificial Sequence: Synthetic oligonucleotide
tgacaggtggatgaagagaccgaaatcattcagaag

SEQ ID NO: 323527 - DNA, 35 bp, Artificial Sequence
  Description of Artificial Sequence: Synthetic oligonucleotide
gacaggtggatgaagagaccgaaatcattcagaag

SEQ ID NO: 323528 - DNA, 35 bp, Artificial Sequence
  Description of Artificial Sequence: Synthetic oligonucleotide
acaggtggatgaagagaccgaaatcattcagaagg

SEQ ID NO: 323529 - DNA, 34 bp, Artificial Sequence
  Description of Artificial Sequence: Synthetic oligonucleotide
caggtggatgaagagaccgaaatcattcagaagg

SEQ ID NO: 323530 - DNA, 34 bp, Artificial Sequence
  Description of Artificial Sequence: Synthetic oligonucleotide
aggtggatgaagagaccgaaatcattcagaaggc

SEQ ID NO: 323531 - DNA, 33 bp, Artificial Sequence
  Description of Artificial Sequence: Synthetic oligonucleotide
ggtggatgaagagaccgaaatcattcagaaggc

SEQ ID NO: 323532 - DNA, 34 bp, Artificial Sequence
  Description of Artificial Sequence: Synthetic oligonucleotide
gtggatgaagagaccgaaatcattcagaaggctc

SEQ ID NO: 323533 - DNA, 36 bp, Artificial Sequence
  Description of Artificial Sequence: Synthetic oligonucleotide
tggatgaagagaccgaaatcattcagaaggctcatc

SEQ ID NO: 323534 - DNA, 35 bp, Artificial Sequence
  Description of Artificial Sequence: Synthetic oligonucleotide
ggatgaagagaccgaaatcattcagaaggctcatc

SEQ ID NO: 323535 - DNA, 37 bp, Artificial Sequence
  Description of Artificial Sequence: Synthetic oligonucleotide
gatgaagagaccgaaatcattcagaaggctcatctac

SEQ ID NO: 323536 - DNA, 41 bp, Artificial Sequence
  Description of Artificial Sequence: Synthetic oligonucleotide
atgaagagaccgaaatcattcagaaggctcatctactttac

SEQ ID NO: 323537 - DNA, 40 bp, Artificial Sequence
  Description of Artificial Sequence: Synthetic oligonucleotide
tgaagagaccgaaatcattcagaaggctcatctactttac

SEQ ID NO: 323538 - DNA, 39 bp, Artificial Sequence
  Description of Artificial Sequence: Synthetic oligonucleotide
gaagagaccgaaatcattcagaaggctcatctactttac

SEQ ID NO: 323539 - DNA, 40 bp, Artificial Sequence
  Description of Artificial Sequence: Synthetic oligonucleotide
aagagaccgaaatcattcagaaggctcatctactttacag

SEQ ID NO: 323540 - DNA, 39 bp, Artificial Sequence
  Description of Artificial Sequence: Synthetic oligonucleotide
agagaccgaaatcattcagaaggctcatctactttacag

SEQ ID NO: 323541 - DNA, 38 bp, Artificial Sequence
  Description of Artificial Sequence: Synthetic oligonucleotide
gagaccgaaatcattcagaaggctcatctactttacag

SEQ ID NO: 323542 - DNA, 38 bp, Artificial Sequence
  Description of Artificial Sequence: Synthetic oligonucleotide
agaccgaaatcattcagaaggctcatctactttacagg

SEQ ID NO: 323543 - DNA, 37 bp, Artificial Sequence
  Description of Artificial Sequence: Synthetic oligonucleotide
gaccgaaatcattcagaaggctcatctactttacagg

SEQ ID NO: 323544 - DNA, 39 bp, Artificial Sequence
  Description of Artificial Sequence: Synthetic oligonucleotide
accgaaatcattcagaaggctcatctactttacaggaag

SEQ ID NO: 323545 - DNA, 38 bp, Artificial Sequence
  Description of Artificial Sequence: Synthetic oligonucleotide
ccgaaatcattcagaaggctcatctactttacaggaag

SEQ ID NO: 323546 - DNA, 38 bp, Artificial Sequence
  Description of Artificial Sequence: Synthetic oligonucleotide
cgaaatcattcagaaggctcatctactttacaggaagg

SEQ ID NO: 323547 - DNA, 43 bp, Artificial Sequence
  Description of Artificial Sequence: Synthetic oligonucleotide
gaaatcattcagaaggctcatctactttacaggaaggttaaac

SEQ ID NO: 323548 - DNA, 43 bp, Artificial Sequence
  Description of Artificial Sequence: Synthetic oligonucleotide
aaatcattcagaaggctcatctactttacaggaaggttaaacc

SEQ ID NO: 323549 - DNA, 42 bp, Artificial Sequence
  Description of Artificial Sequence: Synthetic oligonucleotide
aatcattcagaaggctcatctactttacaggaaggttaaacc

SEQ ID NO: 323550 - DNA, 41 bp, Artificial Sequence
  Description of Artificial Sequence: Synthetic oligonucleotide
atcattcagaaggctcatctactttacaggaaggttaaacc

SEQ ID NO: 323551 - DNA, 40 bp, Artificial Sequence
  Description of Artificial Sequence: Synthetic oligonucleotide
tcattcagaaggctcatctactttacaggaaggttaaacc

SEQ ID NO: 323552 - DNA, 39 bp, Artificial Sequence
  Description of Artificial Sequence: Synthetic oligonucleotide
cattcagaaggctcatctactttacaggaaggttaaacc

SEQ ID NO: 323553 - DNA, 40 bp, Artificial Sequence
  Description of Artificial Sequence: Synthetic oligonucleotide
attcagaaggctcatctactttacaggaaggttaaacctc

SEQ ID NO: 323554 - DNA, 39 bp, Artificial Sequence
  Description of Artificial Sequence: Synthetic oligonucleotide
ttcagaaggctcatctactttacaggaaggttaaacctc

SEQ ID NO: 323555 - DNA, 38 bp, Artificial Sequence
  Description of Artificial Sequence: Synthetic oligonucleotide
tcagaaggctcatctactttacaggaaggttaaacctc

SEQ ID NO: 323556 - DNA, 37 bp, Artificial Sequence
  Description of Artificial Sequence: Synthetic oligonucleotide
cagaaggctcatctactttacaggaaggttaaacctc

SEQ ID NO: 323557 - DNA, 38 bp, Artificial Sequence
  Description of Artificial Sequence: Synthetic oligonucleotide
agaaggctcatctactttacaggaaggttaaacctctc

SEQ ID NO: 323558 - DNA, 37 bp, Artificial Sequence
  Description of Artificial Sequence: Synthetic oligonucleotide
gaaggctcatctactttacaggaaggttaaacctctc

SEQ ID NO: 323559 - DNA, 41 bp, Artificial Sequence
  Description of Artificial Sequence: Synthetic oligonucleotide
aaggctcatctactttacaggaaggttaaacctctcataac

SEQ ID NO: 323560 - DNA, 40 bp, Artificial Sequence
  Description of Artificial Sequence: Synthetic oligonucleotide
aggctcatctactttacaggaaggttaaacctctcataac

SEQ ID NO: 323561 - DNA, 39 bp, Artificial Sequence
  Description of Artificial Sequence: Synthetic oligonucleotide
ggctcatctactttacaggaaggttaaacctctcataac

SEQ ID NO: 323562 - DNA, 39 bp, Artificial Sequence
  Description of Artificial Sequence: Synthetic oligonucleotide
gctcatctactttacaggaaggttaaacctctcataacc

SEQ ID NO: 323563 - DNA, 39 bp, Artificial Sequence
  Description of Artificial Sequence: Synthetic oligonucleotide
ctcatctactttacaggaaggttaaacctctcataaccc

SEQ ID NO: 323564 - DNA, 40 bp, Artificial Sequence
  Description of Artificial Sequence: Synthetic oligonucleotide
tcatctactttacaggaaggttaaacctctcataacccac

SEQ ID NO: 323565 - DNA, 39 bp, Artificial Sequence
  Description of Artificial Sequence: Synthetic oligonucleotide
catctactttacaggaaggttaaacctctcataacccac

SEQ ID NO: 323566 - DNA, 40 bp, Artificial Sequence
  Description of Artificial Sequence: Synthetic oligonucleotide
atctactttacaggaaggttaaacctctcataacccacac

SEQ ID NO: 323567 - DNA, 39 bp, Artificial Sequence
  Description of Artificial Sequence: Synthetic oligonucleotide
tctactttacaggaaggttaaacctctcataacccacac

SEQ ID NO: 323568 - DNA, 38 bp, Artificial Sequence
  Description of Artificial Sequence: Synthetic oligonucleotide
ctactttacaggaaggttaaacctctcataacccacac

SEQ ID NO: 323569 - DNA, 39 bp, Artificial Sequence
  Description of Artificial Sequence: Synthetic oligonucleotide
tactttacaggaaggttaaacctctcataacccacacag

SEQ ID NO: 323570 - DNA, 38 bp, Artificial Sequence
  Description of Artificial Sequence: Synthetic oligonucleotide
actttacaggaaggttaaacctctcataacccacacag

SEQ ID NO: 323571 - DNA, 37 bp, Artificial Sequence
  Description of Artificial Sequence: Synthetic oligonucleotide
ctttacaggaaggttaaacctctcataacccacacag

SEQ ID NO: 323572 - DNA, 37 bp, Artificial Sequence
  Description of Artificial Sequence: Synthetic oligonucleotide
tttacaggaaggttaaacctctcataacccacacagg

SEQ ID NO: 323573 - DNA, 36 bp, Artificial Sequence
  Description of Artificial Sequence: Synthetic oligonucleotide
ttacaggaaggttaaacctctcataacccacacagg

SEQ ID NO: 323574 - DNA, 35 bp, Artificial Sequence
  Description of Artificial Sequence: Synthetic oligonucleotide
tacaggaaggttaaacctctcataacccacacagg

SEQ ID NO: 323575 - DNA, 34 bp, Artificial Sequence
  Description of Artificial Sequence: Synthetic oligonucleotide
acaggaaggttaaacctctcataacccacacagg

SEQ ID NO: 323576 - DNA, 33 bp, Artificial Sequence
  Description of Artificial Sequence: Synthetic oligonucleotide
caggaaggttaaacctctcataacccacacagg

SEQ ID NO: 323577 - DNA, 35 bp, Artificial Sequence
  Description of Artificial Sequence: Synthetic oligonucleotide
aggaaggttaaacctctcataacccacacaggaag

SEQ ID NO: 323578 - DNA, 34 bp, Artificial Sequence
  Description of Artificial Sequence: Synthetic oligonucleotide
ggaaggttaaacctctcataacccacacaggaag

SEQ ID NO: 323579 - DNA, 34 bp, Artificial Sequence
  Description of Artificial Sequence: Synthetic oligonucleotide
gaaggttaaacctctcataacccacacaggaagg

SEQ ID NO: 323580 - DNA, 37 bp, Artificial Sequence
  Description of Artificial Sequence: Synthetic oligonucleotide
aaggttaaacctctcataacccacacaggaaggaaag

SEQ ID NO: 323581 - DNA, 36 bp, Artificial Sequence
  Description of Artificial Sequence: Synthetic oligonucleotide
aggttaaacctctcataacccacacaggaaggaaag

SEQ ID NO: 323582 - DNA, 35 bp, Artificial Sequence
  Description of Artificial Sequence: Synthetic oligonucleotide
ggttaaacctctcataacccacacaggaaggaaag

SEQ ID NO: 323583 - DNA, 35 bp, Artificial Sequence
  Description of Artificial Sequence: Synthetic oligonucleotide
gttaaacctctcataacccacacaggaaggaaagg

SEQ ID NO: 323584 - DNA, 36 bp, Artificial Sequence
  Description of Artificial Sequence: Synthetic oligonucleotide
ttaaacctctcataacccacacaggaaggaaaggag

SEQ ID NO: 323585 - DNA, 35 bp, Artificial Sequence
  Description of Artificial Sequence: Synthetic oligonucleotide
taaacctctcataacccacacaggaaggaaaggag

SEQ ID NO: 323586 - DNA, 34 bp, Artificial Sequence
  Description of Artificial Sequence: Synthetic oligonucleotide
aaacctctcataacccacacaggaaggaaaggag

SEQ ID NO: 323587 - DNA, 33 bp, Artificial Sequence
  Description of Artificial Sequence: Synthetic oligonucleotide
aacctctcataacccacacaggaaggaaaggag

SEQ ID NO: 323588 - DNA, 32 bp, Artificial Sequence
  Description of Artificial Sequence: Synthetic oligonucleotide
acctctcataacccacacaggaaggaaaggag

SEQ ID NO: 323589 - DNA, 31 bp, Artificial Sequence
  Description of Artificial Sequence: Synthetic oligonucleotide
cctctcataacccacacaggaaggaaaggag

SEQ ID NO: 323590 - DNA, 31 bp, Artificial Sequence
  Description of Artificial Sequence: Synthetic oligonucleotide
ctctcataacccacacaggaaggaaaggagg

SEQ ID NO: 323591 - DNA, 32 bp, Artificial Sequence
  Description of Artificial Sequence: Synthetic oligonucleotide
tctcataacccacacaggaaggaaaggaggac

SEQ ID NO: 323592 - DNA, 31 bp, Artificial Sequence
  Description of Artificial Sequence: Synthetic oligonucleotide
ctcataacccacacaggaaggaaaggaggac

SEQ ID NO: 323593 - DNA, 31 bp, Artificial Sequence
  Description of Artificial Sequence: Synthetic oligonucleotide
tcataacccacacaggaaggaaaggaggacc

SEQ ID NO: 323594 - DNA, 30 bp, Artificial Sequence
  Description of Artificial Sequence: Synthetic oligonucleotide
cataacccacacaggaaggaaaggaggacc

SEQ ID NO: 323595 - DNA, 32 bp, Artificial Sequence
  Description of Artificial Sequence: Synthetic oligonucleotide
ataacccacacaggaaggaaaggaggaccttc

SEQ ID NO: 323596 - DNA, 31 bp, Artificial Sequence
  Description of Artificial Sequence: Synthetic oligonucleotide
taacccacacaggaaggaaaggaggaccttc

SEQ ID NO: 323597 - DNA, 30 bp, Artificial Sequence
  Description of Artificial Sequence: Synthetic oligonucleotide
aacccacacaggaaggaaaggaggaccttc

SEQ ID NO: 323598 - DNA, 29 bp, Artificial Sequence
  Description of Artificial Sequence: Synthetic oligonucleotide
acccacacaggaaggaaaggaggaccttc

SEQ ID NO: 323599 - DNA, 28 bp, Artificial Sequence
  Description of Artificial Sequence: Synthetic oligonucleotide
cccacacaggaaggaaaggaggaccttc

SEQ ID NO: 323600 - DNA, 30 bp, Artificial Sequence
  Description of Artificial Sequence: Synthetic oligonucleotide
ccacacaggaaggaaaggaggaccttcttc

SEQ ID NO: 323601 - DNA, 30 bp, Artificial Sequence
  Description of Artificial Sequence: Synthetic oligonucleotide
cacacaggaaggaaaggaggaccttcttcc

SEQ ID NO: 323602 - DNA, 30 bp, Artificial Sequence
  Description of Artificial Sequence: Synthetic oligonucleotide
acacaggaaggaaaggaggaccttcttccc

SEQ ID NO: 323603 - DNA, 29 bp, Artificial Sequence
  Description of Artificial Sequence: Synthetic oligonucleotide
cacaggaaggaaaggaggaccttcttccc

SEQ ID NO: 323604 - DNA, 30 bp, Artificial Sequence
  Description of Artificial Sequence: Synthetic oligonucleotide
acaggaaggaaaggaggaccttcttcccag

SEQ ID NO: 323605 - DNA, 29 bp, Artificial Sequence
  Description of Artificial Sequence: Synthetic oligonucleotide
caggaaggaaaggaggaccttcttcccag

SEQ ID NO: 323606 - DNA, 30 bp, Artificial Sequence
  Description of Artificial Sequence: Synthetic oligonucleotide
aggaaggaaaggaggaccttcttcccagtg

SEQ ID NO: 323607 - DNA, 29 bp, Artificial Sequence
  Description of Artificial Sequence: Synthetic oligonucleotide
ggaaggaaaggaggaccttcttcccagtg

SEQ ID NO: 323608 - DNA, 30 bp, Artificial Sequence
  Description of Artificial Sequence: Synthetic oligonucleotide
gaaggaaaggaggaccttcttcccagtgag

SEQ ID NO: 323609 - DNA, 30 bp, Artificial Sequence
  Description of Artificial Sequence: Synthetic oligonucleotide
aaggaaaggaggaccttcttcccagtgagc

SEQ ID NO: 323610 - DNA, 29 bp, Artificial Sequence
  Description of Artificial Sequence: Synthetic oligonucleotide
aggaaaggaggaccttcttcccagtgagc

SEQ ID NO: 323611 - DNA, 28 bp, Artificial Sequence
  Description of Artificial Sequence: Synthetic oligonucleotide
ggaaaggaggaccttcttcccagtgagc

SEQ ID NO: 323612 - DNA, 29 bp, Artificial Sequence
  Description of Artificial Sequence: Synthetic oligonucleotide
gaaaggaggaccttcttcccagtgagctc

SEQ ID NO: 323613 - DNA, 30 bp, Artificial Sequence
  Description of Artificial Sequence: Synthetic oligonucleotide
aaaggaggaccttcttcccagtgagctcag

SEQ ID NO: 323614 - DNA, 29 bp, Artificial Sequence
  Description of Artificial Sequence: Synthetic oligonucleotide
aaggaggaccttcttcccagtgagctcag

SEQ ID NO: 323615 - DNA, 28 bp, Artificial Sequence
  Description of Artificial Sequence: Synthetic oligonucleotide
aggaggaccttcttcccagtgagctcag

SEQ ID NO: 323616 - DNA, 27 bp, Artificial Sequence
  Description of Artificial Sequence: Synthetic oligonucleotide
ggaggaccttcttcccagtgagctcag

SEQ ID NO: 323617 - DNA, 27 bp, Artificial Sequence
  Description of Artificial Sequence: Synthetic oligonucleotide
gaggaccttcttcccagtgagctcagc

SEQ ID NO: 323618 - DNA, 30 bp, Artificial Sequence
  Description of Artificial Sequence: Synthetic oligonucleotide
aggaccttcttcccagtgagctcagctaac

SEQ ID NO: 323619 - DNA, 29 bp, Artificial Sequence
  Description of Artificial Sequence: Synthetic oligonucleotide
ggaccttcttcccagtgagctcagctaac

SEQ ID NO: 323620 - DNA, 30 bp, Artificial Sequence
  Description of Artificial Sequence: Synthetic oligonucleotide
gaccttcttcccagtgagctcagctaacac

SEQ ID NO: 323621 - DNA, 31 bp, Artificial Sequence
  Description of Artificial Sequence: Synthetic oligonucleotide
accttcttcccagtgagctcagctaacactg

SEQ ID NO: 323622 - DNA, 30 bp, Artificial Sequence
  Description of Artificial Sequence: Synthetic oligonucleotide
ccttcttcccagtgagctcagctaacactg

SEQ ID NO: 323623 - DNA, 30 bp, Artificial Sequence
  Description of Artificial Sequence: Synthetic oligonucleotide
cttcttcccagtgagctcagctaacactgg

SEQ ID NO: 323624 - DNA, 30 bp, Artificial Sequence
  Description of Artificial Sequence: Synthetic oligonucleotide
ttcttcccagtgagctcagctaacactggg

SEQ ID NO: 323625 - DNA, 29 bp, Artificial Sequence
  Description of Artificial Sequence: Synthetic oligonucleotide
tcttcccagtgagctcagctaacactggg

SEQ ID NO: 323626 - DNA, 28 bp, Artificial Sequence
  Description of Artificial Sequence: Synthetic oligonucleotide
cttcccagtgagctcagctaacactggg

SEQ ID NO: 323627 - DNA, 29 bp, Artificial Sequence
  Description of Artificial Sequence: Synthetic oligonucleotide
ttcccagtgagctcagctaacactgggtc

SEQ ID NO: 323628 - DNA, 28 bp, Artificial Sequence
  Description of Artificial Sequence: Synthetic oligonucleotide
tcccagtgagctcagctaacactgggtc

SEQ ID NO: 323629 - DNA, 27 bp, Artificial Sequence
  Description of Artificial Sequence: Synthetic oligonucleotide
cccagtgagctcagctaacactgggtc

SEQ ID NO: 323630 - DNA, 27 bp, Artificial Sequence
  Description of Artificial Sequence: Synthetic oligonucleotide
ccagtgagctcagctaacactgggtcc

SEQ ID NO: 323631 - DNA, 30 bp, Artificial Sequence
  Description of Artificial Sequence: Synthetic oligonucleotide
cagtgagctcagctaacactgggtccattg

SEQ ID NO: 323632 - DNA, 30 bp, Artificial Sequence
  Description of Artificial Sequence: Synthetic oligonucleotide
agtgagctcagctaacactgggtccattgg

SEQ ID NO: 323633 - DNA, 29 bp, Artificial Sequence
  Description of Artificial Sequence: Synthetic oligonucleotide
gtgagctcagctaacactgggtccattgg

SEQ ID NO: 323634 - DNA, 30 bp, Artificial Sequence
  Description of Artificial Sequence: Synthetic oligonucleotide
tgagctcagctaacactgggtccattggag

SEQ ID NO: 323635 - DNA, 29 bp, Artificial Sequence
  Description of Artificial Sequence: Synthetic oligonucleotide
gagctcagctaacactgggtccattggag

SEQ ID NO: 323636 - DNA, 32 bp, Artificial Sequence
  Description of Artificial Sequence: Synthetic oligonucleotide
agctcagctaacactgggtccattggagttag

SEQ ID NO: 323637 - DNA, 31 bp, Artificial Sequence
  Description of Artificial Sequence: Synthetic oligonucleotide
gctcagctaacactgggtccattggagttag

SEQ ID NO: 323638 - DNA, 32 bp, Artificial Sequence
  Description of Artificial Sequence: Synthetic oligonucleotide
ctcagctaacactgggtccattggagttagtg

SEQ ID NO: 323639 - DNA, 32 bp, Artificial Sequence
  Description of Artificial Sequence: Synthetic oligonucleotide
tcagctaacactgggtccattggagttagtgc

SEQ ID NO: 323640 - DNA, 31 bp, Artificial Sequence
  Description of Artificial Sequence: Synthetic oligonucleotide
cagctaacactgggtccattggagttagtgc

SEQ ID NO: 323641 - DNA, 32 bp, Artificial Sequence
  Description of Artificial Sequence: Synthetic oligonucleotide
agctaacactgggtccattggagttagtgcag

SEQ ID NO: 323642 - DNA, 31 bp, Artificial Sequence
  Description of Artificial Sequence: Synthetic oligonucleotide
gctaacactgggtccattggagttagtgcag

SEQ ID NO: 323643 - DNA, 34 bp, Artificial Sequence
  Description of Artificial Sequence: Synthetic oligonucleotide
ctaacactgggtccattggagttagtgcagttac

SEQ ID NO: 323644 - DNA, 35 bp, Artificial Sequence
  Description of Artificial Sequence: Synthetic oligonucleotide
taacactgggtccattggagttagtgcagttacag

SEQ ID NO: 323645 - DNA, 34 bp, Artificial Sequence
  Description of Artificial Sequence: Synthetic oligonucleotide
aacactgggtccattggagttagtgcagttacag

SEQ ID NO: 323646 - DNA, 33 bp, Artificial Sequence
  Description of Artificial Sequence: Synthetic oligonucleotide
acactgggtccattggagttagtgcagttacag

SEQ ID NO: 323647 - DNA, 32 bp, Artificial Sequence
  Description of Artificial Sequence: Synthetic oligonucleotide
cactgggtccattggagttagtgcagttacag

SEQ ID NO: 323648 - DNA, 34 bp, Artificial Sequence
  Description of Artificial Sequence: Synthetic oligonucleotide
actgggtccattggagttagtgcagttacagttg

SEQ ID NO: 323649 - DNA, 33 bp, Artificial Sequence
  Description of Artificial Sequence: Synthetic oligonucleotide
ctgggtccattggagttagtgcagttacagttg

SEQ ID NO: 323650 - DNA, 33 bp, Artificial Sequence
  Description of Artificial Sequence: Synthetic oligonucleotide
tgggtccattggagttagtgcagttacagttgg

SEQ ID NO: 323651 - DNA, 32 bp, Artificial Sequence
  Description of Artificial Sequence: Synthetic oligonucleotide
gggtccattggagttagtgcagttacagttgg

SEQ ID NO: 323652 - DNA, 33 bp, Artificial Sequence
  Description of Artificial Sequence: Synthetic oligonucleotide
ggtccattggagttagtgcagttacagttggag

SEQ ID NO: 323653 - DNA, 36 bp, Artificial Sequence
  Description of Artificial Sequence: Synthetic oligonucleotide
gtccattggagttagtgcagttacagttggagatac

SEQ ID NO: 323654 - DNA, 36 bp, Artificial Sequence
  Description of Artificial Sequence: Synthetic oligonucleotide
tccattggagttagtgcagttacagttggagatacc

SEQ ID NO: 323655 - DNA, 35 bp, Artificial Sequence
  Description of Artificial Sequence: Synthetic oligonucleotide
ccattggagttagtgcagttacagttggagatacc

SEQ ID NO: 323656 - DNA, 37 bp, Artificial Sequence
  Description of Artificial Sequence: Synthetic oligonucleotide
cattggagttagtgcagttacagttggagataccaac

SEQ ID NO: 323657 - DNA, 38 bp, Artificial Sequence
  Description of Artificial Sequence: Synthetic oligonucleotide
attggagttagtgcagttacagttggagataccaactc

SEQ ID NO: 323658 - DNA, 37 bp, Artificial Sequence
  Description of Artificial Sequence: Synthetic oligonucleotide
ttggagttagtgcagttacagttggagataccaactc

SEQ ID NO: 323659 - DNA, 36 bp, Artificial Sequence
  Description of Artificial Sequence: Synthetic oligonucleotide
tggagttagtgcagttacagttggagataccaactc

SEQ ID NO: 323660 - DNA, 35 bp, Artificial Sequence
  Description of Artificial Sequence: Synthetic oligonucleotide
ggagttagtgcagttacagttggagataccaactc

SEQ ID NO: 323661 - DNA, 39 bp, Artificial Sequence
  Description of Artificial Sequence: Synthetic oligonucleotide
gagttagtgcagttacagttggagataccaactctattg

SEQ ID NO: 323662 - DNA, 40 bp, Artificial Sequence
  Description of Artificial Sequence: Synthetic oligonucleotide
agttagtgcagttacagttggagataccaactctattgtc

SEQ ID NO: 323663 - DNA, 39 bp, Artificial Sequence
  Description of Artificial Sequence: Synthetic oligonucleotide
gttagtgcagttacagttggagataccaactctattgtc

SEQ ID NO: 323664 - DNA, 42 bp, Artificial Sequence
  Description of Artificial Sequence: Synthetic oligonucleotide
ttagtgcagttacagttggagataccaactctattgtcaatc

SEQ ID NO: 323665 - DNA, 41 bp, Artificial Sequence
  Description of Artificial Sequence: Synthetic oligonucleotide
tagtgcagttacagttggagataccaactctattgtcaatc

SEQ ID NO: 323666 - DNA, 40 bp, Artificial Sequence
  Description of Artificial Sequence: Synthetic oligonucleotide
agtgcagttacagttggagataccaactctattgtcaatc

SEQ ID NO: 323667 - DNA, 39 bp, Artificial Sequence
  Description of Artificial Sequence: Synthetic oligonucleotide
gtgcagttacagttggagataccaactctattgtcaatc

SEQ ID NO: 323668 - DNA, 39 bp, Artificial Sequence
  Description of Artificial Sequence: Synthetic oligonucleotide
tgcagttacagttggagataccaactctattgtcaatcg

SEQ ID NO: 323669 - DNA, 38 bp, Artificial Sequence
  Description of Artificial Sequence: Synthetic oligonucleotide
gcagttacagttggagataccaactctattgtcaatcg

SEQ ID NO: 323670 - DNA, 40 bp, Artificial Sequence
  Description of Artificial Sequence: Synthetic oligonucleotide
cagttacagttggagataccaactctattgtcaatcgatc

SEQ ID NO: 323671 - DNA, 40 bp, Artificial Sequence
  Description of Artificial Sequence: Synthetic oligonucleotide
agttacagttggagataccaactctattgtcaatcgatcc

SEQ ID NO: 323672 - DNA, 39 bp, Artificial Sequence
  Description of Artificial Sequence: Synthetic oligonucleotide
gttacagttggagataccaactctattgtcaatcgatcc

SEQ ID NO: 323673 - DNA, 43 bp, Artificial Sequence
  Description of Artificial Sequence: Synthetic oligonucleotide
ttacagttggagataccaactctattgtcaatcgatccttatc

SEQ ID NO: 323674 - DNA, 42 bp, Artificial Sequence
  Description of Artificial Sequence: Synthetic oligonucleotide
tacagttggagataccaactctattgtcaatcgatccttatc

SEQ ID NO: 323675 - DNA, 41 bp, Artificial Sequence
  Description of Artificial Sequence: Synthetic oligonucleotide
acagttggagataccaactctattgtcaatcgatccttatc

SEQ ID NO: 323676 - DNA, 40 bp, Artificial Sequence
  Description of Artificial Sequence: Synthetic oligonucleotide
cagttggagataccaactctattgtcaatcgatccttatc

SEQ ID NO: 323677 - DNA, 41 bp, Artificial Sequence
  Description of Artificial Sequence: Synthetic oligonucleotide
agttggagataccaactctattgtcaatcgatccttatcac

SEQ ID NO: 323678 - DNA, 40 bp, Artificial Sequence
  Description of Artificial Sequence: Synthetic oligonucleotide
gttggagataccaactctattgtcaatcgatccttatcac

SEQ ID NO: 323679 - DNA, 40 bp, Artificial Sequence
  Description of Artificial Sequence: Synthetic oligonucleotide
ttggagataccaactctattgtcaatcgatccttatcacg

SEQ ID NO: 323680 - DNA, 39 bp, Artificial Sequence
  Description of Artificial Sequence: Synthetic oligonucleotide
tggagataccaactctattgtcaatcgatccttatcacg

SEQ ID NO: 323681 - DNA, 38 bp, Artificial Sequence
  Description of Artificial Sequence: Synthetic oligonucleotide
ggagataccaactctattgtcaatcgatccttatcacg

SEQ ID NO: 323682 - DNA, 39 bp, Artificial Sequence
  Description of Artificial Sequence: Synthetic oligonucleotide
gagataccaactctattgtcaatcgatccttatcacgag

SEQ ID NO: 323683 - DNA, 40 bp, Artificial Sequence
  Description of Artificial Sequence: Synthetic oligonucleotide
agataccaactctattgtcaatcgatccttatcacgagac

SEQ ID NO: 323684 - DNA, 39 bp, Artificial Sequence
  Description of Artificial Sequence: Synthetic oligonucleotide
gataccaactctattgtcaatcgatccttatcacgagac

SEQ ID NO: 323685 - DNA, 39 bp, Artificial Sequence
  Description of Artificial Sequence: Synthetic oligonucleotide
ataccaactctattgtcaatcgatccttatcacgagacc

SEQ ID NO: 323686 - DNA, 38 bp, Artificial Sequence
  Description of Artificial Sequence: Synthetic oligonucleotide
taccaactctattgtcaatcgatccttatcacgagacc

SEQ ID NO: 323687 - DNA, 37 bp, Artificial Sequence
  Description of Artificial Sequence: Synthetic oligonucleotide
accaactctattgtcaatcgatccttatcacgagacc

SEQ ID NO: 323688 - DNA, 36 bp, Artificial Sequence
  Description of Artificial Sequence: Synthetic oligonucleotide
ccaactctattgtcaatcgatccttatcacgagacc

SEQ ID NO: 323689 - DNA, 38 bp, Artificial Sequence
  Description of Artificial Sequence: Synthetic oligonucleotide
caactctattgtcaatcgatccttatcacgagaccaag

SEQ ID NO: 323690 - DNA, 39 bp, Artificial Sequence
  Description of Artificial Sequence: Synthetic oligonucleotide
aactctattgtcaatcgatccttatcacgagaccaagtc

SEQ ID NO: 323691 - DNA, 38 bp, Artificial Sequence
  Description of Artificial Sequence: Synthetic oligonucleotide
actctattgtcaatcgatccttatcacgagaccaagtc

SEQ ID NO: 323692 - DNA, 37 bp, Artificial Sequence
  Description of Artificial Sequence: Synthetic oligonucleotide
ctctattgtcaatcgatccttatcacgagaccaagtc

SEQ ID NO: 323693 - DNA, 38 bp, Artificial Sequence
  Description of Artificial Sequence: Synthetic oligonucleotide
tctattgtcaatcgatccttatcacgagaccaagtcac

SEQ ID NO: 323694 - DNA, 37 bp, Artificial Sequence
  Description of Artificial Sequence: Synthetic oligonucleotide
ctattgtcaatcgatccttatcacgagaccaagtcac

SEQ ID NO: 323695 - DNA, 40 bp, Artificial Sequence
  Description of Artificial Sequence: Synthetic oligonucleotide
tattgtcaatcgatccttatcacgagaccaagtcacattc

SEQ ID NO: 323696 - DNA, 39 bp, Artificial Sequence
  Description of Artificial Sequence: Synthetic oligonucleotide
attgtcaatcgatccttatcacgagaccaagtcacattc

SEQ ID NO: 323697 - DNA, 38 bp, Artificial Sequence
  Description of Artificial Sequence: Synthetic oligonucleotide
ttgtcaatcgatccttatcacgagaccaagtcacattc

SEQ ID NO: 323698 - DNA, 37 bp, Artificial Sequence
  Description of Artificial Sequence: Synthetic oligonucleotide
tgtcaatcgatccttatcacgagaccaagtcacattc

SEQ ID NO: 323699 - DNA, 36 bp, Artificial Sequence
  Description of Artificial Sequence: Synthetic oligonucleotide
gtcaatcgatccttatcacgagaccaagtcacattc

SEQ ID NO: 323700 - DNA, 36 bp, Artificial Sequence
  Description of Artificial Sequence: Synthetic oligonucleotide
tcaatcgatccttatcacgagaccaagtcacattcc

SEQ ID NO: 323701 - DNA, 35 bp, Artificial Sequence
  Description of Artificial Sequence: Synthetic oligonucleotide
caatcgatccttatcacgagaccaagtcacattcc

SEQ ID NO: 323702 - DNA, 36 bp, Artificial Sequence
  Description of Artificial Sequence: Synthetic oligonucleotide
aatcgatccttatcacgagaccaagtcacattccag

SEQ ID NO: 323703 - DNA, 35 bp, Artificial Sequence
  Description of Artificial Sequence: Synthetic oligonucleotide
atcgatccttatcacgagaccaagtcacattccag

SEQ ID NO: 323704 - DNA, 34 bp, Artificial Sequence
  Description of Artificial Sequence: Synthetic oligonucleotide
tcgatccttatcacgagaccaagtcacattccag

SEQ ID NO: 323705 - DNA, 33 bp, Artificial Sequence
  Description of Artificial Sequence: Synthetic oligonucleotide
cgatccttatcacgagaccaagtcacattccag

SEQ ID NO: 323706 - DNA, 33 bp, Artificial Sequence
  Description of Artificial Sequence: Synthetic oligonucleotide
gatccttatcacgagaccaagtcacattccagc

SEQ ID NO: 323707 - DNA, 33 bp, Artificial Sequence
  Description of Artificial Sequence: Synthetic oligonucleotide
atccttatcacgagaccaagtcacattccagcc

SEQ ID NO: 323708 - DNA, 32 bp, Artificial Sequence
  Description of Artificial Sequence: Synthetic oligonucleotide
tccttatcacgagaccaagtcacattccagcc

SEQ ID NO: 323709 - DNA, 31 bp, Artificial Sequence
  Description of Artificial Sequence: Synthetic oligonucleotide
ccttatcacgagaccaagtcacattccagcc

SEQ ID NO: 323710 - DNA, 31 bp, Artificial Sequence
  Description of Artificial Sequence: Synthetic oligonucleotide
cttatcacgagaccaagtcacattccagccc

SEQ ID NO: 323711 - DNA, 32 bp, Artificial Sequence
  Description of Artificial Sequence: Synthetic oligonucleotide
ttatcacgagaccaagtcacattccagcccag

SEQ ID NO: 323712 - DNA, 31 bp, Artificial Sequence
  Description of Artificial Sequence: Synthetic oligonucleotide
tatcacgagaccaagtcacattccagcccag

SEQ ID NO: 323713 - DNA, 30 bp, Artificial Sequence
  Description of Artificial Sequence: Synthetic oligonucleotide
atcacgagaccaagtcacattccagcccag

SEQ ID NO: 323714 - DNA, 29 bp, Artificial Sequence
  Description of Artificial Sequence: Synthetic oligonucleotide
tcacgagaccaagtcacattccagcccag

SEQ ID NO: 323715 - DNA, 28 bp, Artificial Sequence
  Description of Artificial Sequence: Synthetic oligonucleotide
cacgagaccaagtcacattccagcccag

SEQ ID NO: 323716 - DNA, 29 bp, Artificial Sequence
  Description of Artificial Sequence: Synthetic oligonucleotide
acgagaccaagtcacattccagcccagtg

SEQ ID NO: 323717 - DNA, 28 bp, Artificial Sequence
  Description of Artificial Sequence: Synthetic oligonucleotide
cgagaccaagtcacattccagcccagtg

SEQ ID NO: 323718 - DNA, 28 bp, Artificial Sequence
  Description of Artificial Sequence: Synthetic oligonucleotide
gagaccaagtcacattccagcccagtgg

SEQ ID NO: 323719 - DNA, 28 bp, Artificial Sequence
  Description of Artificial Sequence: Synthetic oligonucleotide
agaccaagtcacattccagcccagtggg

SEQ ID NO: 323720 - DNA, 27 bp, Artificial Sequence
  Description of Artificial Sequence: Synthetic oligonucleotide
gaccaagtcacattccagcccagtggg

SEQ ID NO: 323721 - DNA, 27 bp, Artificial Sequence
  Description of Artificial Sequence: Synthetic oligonucleotide
accaagtcacattccagcccagtgggc

SEQ ID NO: 323722 - DNA, 26 bp, Artificial Sequence
  Description of Artificial Sequence: Synthetic oligonucleotide
ccaagtcacattccagcccagtgggc

SEQ ID NO: 323723 - DNA, 26 bp, Artificial Sequence
  Description of Artificial Sequence: Synthetic oligonucleotide
caagtcacattccagcccagtgggcg

SEQ ID NO: 323724 - DNA, 27 bp, Artificial Sequence
  Description of Artificial Sequence: Synthetic oligonucleotide
aagtcacattccagcccagtgggcggt

SEQ ID NO: 323725 - DNA, 26 bp, Artificial Sequence
  Description of Artificial Sequence: Synthetic oligonucleotide
agtcacattccagcccagtgggcggt

SEQ ID NO: 323726 - DNA, 25 bp, Artificial Sequence
  Description of Artificial Sequence: Synthetic oligonucleotide
gtcacattccagcccagtgggcggt

SEQ ID NO: 323727 - DNA, 25 bp, Artificial Sequence
  Description of Artificial Sequence: Synthetic oligonucleotide
tcacattccagcccagtgggcggtc

SEQ ID NO: 323728 - DNA, 24 bp, Artificial Sequence
  Description of Artificial Sequence: Synthetic oligonucleotide
cacattccagcccagtgggcggtc

SEQ ID NO: 323729 - DNA, 24 bp, Artificial Sequence
  Description of Artificial Sequence: Synthetic oligonucleotide
acattccagcccagtgggcggtcc

SEQ ID NO: 323730 - DNA, 23 bp, Artificial Sequence
  Description of Artificial Sequence: Synthetic oligonucleotide
cattccagcccagtgggcggtcc

SEQ ID NO: 323731 - DNA, 26 bp, Artificial Sequence
  Description of Artificial Sequence: Synthetic oligonucleotide
attccagcccagtgggcggtcccata

SEQ ID NO: 323732 - DNA, 25 bp, Artificial Sequence
  Description of Artificial Sequence: Synthetic oligonucleotide
ttccagcccagtgggcggtcccata

SEQ ID NO: 323733 - DNA, 24 bp, Artificial Sequence
  Description of Artificial Sequence: Synthetic oligonucleotide
tccagcccagtgggcggtcccata

SEQ ID NO: 323734 - DNA, 23 bp, Artificial Sequence
  Description of Artificial Sequence: Synthetic oligonucleotide
ccagcccagtgggcggtcccata

SEQ ID NO: 323735 - DNA, 23 bp, Artificial Sequence
  Description of Artificial Sequence: Synthetic oligonucleotide
cagcccagtgggcggtcccatag

SEQ ID NO: 323736 - DNA, 24 bp, Artificial Sequence
  Description of Artificial Sequence: Synthetic oligonucleotide
agcccagtgggcggtcccatagca

SEQ ID NO: 323737 - DNA, 23 bp, Artificial Sequence
  Description of Artificial Sequence: Synthetic oligonucleotide
gcccagtgggcggtcccatagca

SEQ ID NO: 323738 - DNA, 24 bp, Artificial Sequence
  Description of Artificial Sequence: Synthetic oligonucleotide
cccagtgggcggtcccatagcact

SEQ ID NO: 323739 - DNA, 26 bp, Artificial Sequence
  Description of Artificial Sequence: Synthetic oligonucleotide
ccagtgggcggtcccatagcactcat

SEQ ID NO: 323740 - DNA, 26 bp, Artificial Sequence
  Description of Artificial Sequence: Synthetic oligonucleotide
cagtgggcggtcccatagcactcatg

SEQ ID NO: 323741 - DNA, 27 bp, Artificial Sequence
  Description of Artificial Sequence: Synthetic oligonucleotide
agtgggcggtcccatagcactcatggt

SEQ ID NO: 323742 - DNA, 27 bp, Artificial Sequence
  Description of Artificial Sequence: Synthetic oligonucleotide
gtgggcggtcccatagcactcatggtt

SEQ ID NO: 323743 - DNA, 27 bp, Artificial Sequence
  Description of Artificial Sequence: Synthetic oligonucleotide
tgggcggtcccatagcactcatggttc

SEQ ID NO: 323744 - DNA, 27 bp, Artificial Sequence
  Description of Artificial Sequence: Synthetic oligonucleotide
gggcggtcccatagcactcatggttct

SEQ ID NO: 323745 - DNA, 27 bp, Artificial Sequence
  Description of Artificial Sequence: Synthetic oligonucleotide
ggcggtcccatagcactcatggttctg

SEQ ID NO: 323746 - DNA, 30 bp, Artificial Sequence
  Description of Artificial Sequence: Synthetic oligonucleotide
gcggtcccatagcactcatggttctgaatc

SEQ ID NO: 323747 - DNA, 31 bp, Artificial Sequence
  Description of Artificial Sequence: Synthetic oligonucleotide
cggtcccatagcactcatggttctgaatcac

SEQ ID NO: 323748 - DNA, 33 bp, Artificial Sequence
  Description of Artificial Sequence: Synthetic oligonucleotide
ggtcccatagcactcatggttctgaatcacatg

SEQ ID NO: 323749 - DNA, 33 bp, Artificial Sequence
  Description of Artificial Sequence: Synthetic oligonucleotide
gtcccatagcactcatggttctgaatcacatgg

SEQ ID NO: 323750 - DNA, 34 bp, Artificial Sequence
  Description of Artificial Sequence: Synthetic oligonucleotide
tcccatagcactcatggttctgaatcacatggac

SEQ ID NO: 323751 - DNA, 33 bp, Artificial Sequence
  Description of Artificial Sequence: Synthetic oligonucleotide
cccatagcactcatggttctgaatcacatggac

SEQ ID NO: 323752 - DNA, 34 bp, Artificial Sequence
  Description of Artificial Sequence: Synthetic oligonucleotide
ccatagcactcatggttctgaatcacatggacac

SEQ ID NO: 323753 - DNA, 35 bp, Artificial Sequence
  Description of Artificial Sequence: Synthetic oligonucleotide
catagcactcatggttctgaatcacatggacactg

SEQ ID NO: 323754 - DNA, 36 bp, Artificial Sequence
  Description of Artificial Sequence: Synthetic oligonucleotide
atagcactcatggttctgaatcacatggacactgac

SEQ ID NO: 323755 - DNA, 35 bp, Artificial Sequence
  Description of Artificial Sequence: Synthetic oligonucleotide
tagcactcatggttctgaatcacatggacactgac

SEQ ID NO: 323756 - DNA, 34 bp, Artificial Sequence
  Description of Artificial Sequence: Synthetic oligonucleotide
agcactcatggttctgaatcacatggacactgac

SEQ ID NO: 323757 - DNA, 33 bp, Artificial Sequence
  Description of Artificial Sequence: Synthetic oligonucleotide
gcactcatggttctgaatcacatggacactgac

SEQ ID NO: 323758 - DNA, 35 bp, Artificial Sequence
  Description of Artificial Sequence: Synthetic oligonucleotide
cactcatggttctgaatcacatggacactgacatg

SEQ ID NO: 323759 - DNA, 35 bp, Artificial Sequence
  Description of Artificial Sequence: Synthetic oligonucleotide
actcatggttctgaatcacatggacactgacatgg

SEQ ID NO: 323760 - DNA, 34 bp, Artificial Sequence
  Description of Artificial Sequence: Synthetic oligonucleotide
ctcatggttctgaatcacatggacactgacatgg

SEQ ID NO: 323761 - DNA, 34 bp, Artificial Sequence
  Description of Artificial Sequence: Synthetic oligonucleotide
tcatggttctgaatcacatggacactgacatggg

SEQ ID NO: 323762 - DNA, 33 bp, Artificial Sequence
  Description of Artificial Sequence: Synthetic oligonucleotide
catggttctgaatcacatggacactgacatggg

SEQ ID NO: 323763 - DNA, 34 bp, Artificial Sequence
  Description of Artificial Sequence: Synthetic oligonucleotide
atggttctgaatcacatggacactgacatgggag

SEQ ID NO: 323764 - DNA, 33 bp, Artificial Sequence
  Description of Artificial Sequence: Synthetic oligonucleotide
tggttctgaatcacatggacactgacatgggag

SEQ ID NO: 323765 - DNA, 32 bp, Artificial Sequence
  Description of Artificial Sequence: Synthetic oligonucleotide
ggttctgaatcacatggacactgacatgggag

SEQ ID NO: 323766 - DNA, 33 bp, Artificial Sequence
  Description of Artificial Sequence: Synthetic oligonucleotide
gttctgaatcacatggacactgacatgggagac

SEQ ID NO: 323767 - DNA, 35 bp, Artificial Sequence
  Description of Artificial Sequence: Synthetic oligonucleotide
ttctgaatcacatggacactgacatgggagacaag

SEQ ID NO: 323768 - DNA, 34 bp, Artificial Sequence
  Description of Artificial Sequence: Synthetic oligonucleotide
tctgaatcacatggacactgacatgggagacaag

SEQ ID NO: 323769 - DNA, 33 bp, Artificial Sequence
  Description of Artificial Sequence: Synthetic oligonucleotide
ctgaatcacatggacactgacatgggagacaag

SEQ ID NO: 323770 - DNA, 35 bp, Artificial Sequence
  Description of Artificial Sequence: Synthetic oligonucleotide
tgaatcacatggacactgacatgggagacaagaag

SEQ ID NO: 323771 - DNA, 34 bp, Artificial Sequence
  Description of Artificial Sequence: Synthetic oligonucleotide
gaatcacatggacactgacatgggagacaagaag

SEQ ID NO: 323772 - DNA, 34 bp, Artificial Sequence
  Description of Artificial Sequence: Synthetic oligonucleotide
aatcacatggacactgacatgggagacaagaagg

SEQ ID NO: 323773 - DNA, 33 bp, Artificial Sequence
  Description of Artificial Sequence: Synthetic oligonucleotide
atcacatggacactgacatgggagacaagaagg

SEQ ID NO: 323774 - DNA, 32 bp, Artificial Sequence
  Description of Artificial Sequence: Synthetic oligonucleotide
tcacatggacactgacatgggagacaagaagg

SEQ ID NO: 323775 - DNA, 31 bp, Artificial Sequence
  Description of Artificial Sequence: Synthetic oligonucleotide
cacatggacactgacatgggagacaagaagg

SEQ ID NO: 323776 - DNA, 32 bp, Artificial Sequence
  Description of Artificial Sequence: Synthetic oligonucleotide
acatggacactgacatgggagacaagaaggtc

SEQ ID NO: 323777 - DNA, 31 bp, Artificial Sequence
  Description of Artificial Sequence: Synthetic oligonucleotide
catggacactgacatgggagacaagaaggtc

SEQ ID NO: 323778 - DNA, 31 bp, Artificial Sequence
  Description of Artificial Sequence: Synthetic oligonucleotide
atggacactgacatgggagacaagaaggtcg

SEQ ID NO: 323779 - DNA, 30 bp, Artificial Sequence
  Description of Artificial Sequence: Synthetic oligonucleotide
tggacactgacatgggagacaagaaggtcg

SEQ ID NO: 323780 - DNA, 29 bp, Artificial Sequence
  Description of Artificial Sequence: Synthetic oligonucleotide
ggacactgacatgggagacaagaaggtcg

SEQ ID NO: 323781 - DNA, 30 bp, Artificial Sequence
  Description of Artificial Sequence: Synthetic oligonucleotide
gacactgacatgggagacaagaaggtcgag

SEQ ID NO: 323782 - DNA, 30 bp, Artificial Sequence
  Description of Artificial Sequence: Synthetic oligonucleotide
acactgacatgggagacaagaaggtcgagc

SEQ ID NO: 323783 - DNA, 29 bp, Artificial Sequence
  Description of Artificial Sequence: Synthetic oligonucleotide
cactgacatgggagacaagaaggtcgagc

SEQ ID NO: 323784 - DNA, 32 bp, Artificial Sequence
  Description of Artificial Sequence: Synthetic oligonucleotide
actgacatgggagacaagaaggtcgagcaaac

SEQ ID NO: 323785 - DNA, 31 bp, Artificial Sequence
  Description of Artificial Sequence: Synthetic oligonucleotide
ctgacatgggagacaagaaggtcgagcaaac

SEQ ID NO: 323786 - DNA, 32 bp, Artificial Sequence
  Description of Artificial Sequence: Synthetic oligonucleotide
tgacatgggagacaagaaggtcgagcaaacag

SEQ ID NO: 323787 - DNA, 31 bp, Artificial Sequence
  Description of Artificial Sequence: Synthetic oligonucleotide
gacatgggagacaagaaggtcgagcaaacag

SEQ ID NO: 323788 - DNA, 33 bp, Artificial Sequence
  Description of Artificial Sequence: Synthetic oligonucleotide
acatgggagacaagaaggtcgagcaaacagaac

SEQ ID NO: 323789 - DNA, 32 bp, Artificial Sequence
  Description of Artificial Sequence: Synthetic oligonucleotide
catgggagacaagaaggtcgagcaaacagaac

SEQ ID NO: 323790 - DNA, 32 bp, Artificial Sequence
  Description of Artificial Sequence: Synthetic oligonucleotide
atgggagacaagaaggtcgagcaaacagaacc

SEQ ID NO: 323791 - DNA, 31 bp, Artificial Sequence
  Description of Artificial Sequence: Synthetic oligonucleotide
tgggagacaagaaggtcgagcaaacagaacc

SEQ ID NO: 323792 - DNA, 30 bp, Artificial Sequence
  Description of Artificial Sequence: Synthetic oligonucleotide
gggagacaagaaggtcgagcaaacagaacc

SEQ ID NO: 323793 - DNA, 31 bp, Artificial Sequence
  Description of Artificial Sequence: Synthetic oligonucleotide
ggagacaagaaggtcgagcaaacagaacctc

SEQ ID NO: 323794 - DNA, 32 bp, Artificial Sequence
  Description of Artificial Sequence: Synthetic oligonucleotide
gagacaagaaggtcgagcaaacagaacctctg

SEQ ID NO: 323795 - DNA, 32 bp, Artificial Sequence
  Description of Artificial Sequence: Synthetic oligonucleotide
agacaagaaggtcgagcaaacagaacctctgg

SEQ ID NO: 323796 - DNA, 31 bp, Artificial Sequence
  Description of Artificial Sequence: Synthetic oligonucleotide
gacaagaaggtcgagcaaacagaacctctgg

SEQ ID NO: 323797 - DNA, 32 bp, Artificial Sequence
  Description of Artificial Sequence: Synthetic oligonucleotide
acaagaaggtcgagcaaacagaacctctggac

SEQ ID NO: 323798 - DNA, 31 bp, Artificial Sequence
  Description of Artificial Sequence: Synthetic oligonucleotide
caagaaggtcgagcaaacagaacctctggac

SEQ ID NO: 323799 - DNA, 31 bp, Artificial Sequence
  Description of Artificial Sequence: Synthetic oligonucleotide
aagaaggtcgagcaaacagaacctctggacc

SEQ ID NO: 323800 - DNA, 30 bp, Artificial Sequence
  Description of Artificial Sequence: Synthetic oligonucleotide
agaaggtcgagcaaacagaacctctggacc

SEQ ID NO: 323801 - DNA, 29 bp, Artificial Sequence
  Description of Artificial Sequence: Synthetic oligonucleotide
gaaggtcgagcaaacagaacctctggacc

SEQ ID NO: 323802 - DNA, 34 bp, Artificial Sequence
  Description of Artificial Sequence: Synthetic oligonucleotide
aaggtcgagcaaacagaacctctggacctataag

SEQ ID NO: 323803 - DNA, 33 bp, Artificial Sequence
  Description of Artificial Sequence: Synthetic oligonucleotide
aggtcgagcaaacagaacctctggacctataag

SEQ ID NO: 323804 - DNA, 32 bp, Artificial Sequence
  Description of Artificial Sequence: Synthetic oligonucleotide
ggtcgagcaaacagaacctctggacctataag

SEQ ID NO: 323805 - DNA, 32 bp, Artificial Sequence
  Description of Artificial Sequence: Synthetic oligonucleotide
gtcgagcaaacagaacctctggacctataagg

SEQ ID NO: 323806 - DNA, 33 bp, Artificial Sequence
  Description of Artificial Sequence: Synthetic oligonucleotide
tcgagcaaacagaacctctggacctataaggtc

SEQ ID NO: 323807 - DNA, 32 bp, Artificial Sequence
  Description of Artificial Sequence: Synthetic oligonucleotide
cgagcaaacagaacctctggacctataaggtc

SEQ ID NO: 323808 - DNA, 33 bp, Artificial Sequence
  Description of Artificial Sequence: Synthetic oligonucleotide
gagcaaacagaacctctggacctataaggtcac

SEQ ID NO: 323809 - DNA, 33 bp, Artificial Sequence
  Description of Artificial Sequence: Synthetic oligonucleotide
agcaaacagaacctctggacctataaggtcacc

SEQ ID NO: 323810 - DNA, 32 bp, Artificial Sequence
  Description of Artificial Sequence: Synthetic oligonucleotide
gcaaacagaacctctggacctataaggtcacc

SEQ ID NO: 323811 - DNA, 32 bp, Artificial Sequence
  Description of Artificial Sequence: Synthetic oligonucleotide
caaacagaacctctggacctataaggtcaccc

SEQ ID NO: 323812 - DNA, 32 bp, Artificial Sequence
  Description of Artificial Sequence: Synthetic oligonucleotide
aaacagaacctctggacctataaggtcacccc

SEQ ID NO: 323813 - DNA, 31 bp, Artificial Sequence
  Description of Artificial Sequence: Synthetic oligonucleotide
aacagaacctctggacctataaggtcacccc

SEQ ID NO: 323814 - DNA, 30 bp, Artificial Sequence
  Description of Artificial Sequence: Synthetic oligonucleotide
acagaacctctggacctataaggtcacccc

SEQ ID NO: 323815 - DNA, 29 bp, Artificial Sequence
  Description of Artificial Sequence: Synthetic oligonucleotide
cagaacctctggacctataaggtcacccc

SEQ ID NO: 323816 - DNA, 34 bp, Artificial Sequence
  Description of Artificial Sequence: Synthetic oligonucleotide
agaacctctggacctataaggtcaccccaaaatc

SEQ ID NO: 323817 - DNA, 33 bp, Artificial Sequence
  Description of Artificial Sequence: Synthetic oligonucleotide
gaacctctggacctataaggtcaccccaaaatc

SEQ ID NO: 323818 - DNA, 33 bp, Artificial Sequence
  Description of Artificial Sequence: Synthetic oligonucleotide
aacctctggacctataaggtcaccccaaaatcc

SEQ ID NO: 323819 - DNA, 32 bp, Artificial Sequence
  Description of Artificial Sequence: Synthetic oligonucleotide
acctctggacctataaggtcaccccaaaatcc

SEQ ID NO: 323820 - DNA, 31 bp, Artificial Sequence
  Description of Artificial Sequence: Synthetic oligonucleotide
cctctggacctataaggtcaccccaaaatcc

SEQ ID NO: 323821 - DNA, 32 bp, Artificial Sequence
  Description of Artificial Sequence: Synthetic oligonucleotide
ctctggacctataaggtcaccccaaaatccag

SEQ ID NO: 323822 - DNA, 35 bp, Artificial Sequence
  Description of Artificial Sequence: Synthetic oligonucleotide
tctggacctataaggtcaccccaaaatccagaatg

SEQ ID NO: 323823 - DNA, 34 bp, Artificial Sequence
  Description of Artificial Sequence: Synthetic oligonucleotide
ctggacctataaggtcaccccaaaatccagaatg

SEQ ID NO: 323824 - DNA, 34 bp, Artificial Sequence
  Description of Artificial Sequence: Synthetic oligonucleotide
tggacctataaggtcaccccaaaatccagaatgc

SEQ ID NO: 323825 - DNA, 33 bp, Artificial Sequence
  Description of Artificial Sequence: Synthetic oligonucleotide
ggacctataaggtcaccccaaaatccagaatgc

SEQ ID NO: 323826 - DNA, 33 bp, Artificial Sequence
  Description of Artificial Sequence: Synthetic oligonucleotide
gacctataaggtcaccccaaaatccagaatgcc

SEQ ID NO: 323827 - DNA, 34 bp, Artificial Sequence
  Description of Artificial Sequence: Synthetic oligonucleotide
acctataaggtcaccccaaaatccagaatgcctg

SEQ ID NO: 323828 - DNA, 33 bp, Artificial Sequence
  Description of Artificial Sequence: Synthetic oligonucleotide
cctataaggtcaccccaaaatccagaatgcctg

SEQ ID NO: 323829 - DNA, 35 bp, Artificial Sequence
  Description of Artificial Sequence: Synthetic oligonucleotide
ctataaggtcaccccaaaatccagaatgcctgatc

SEQ ID NO: 323830 - DNA, 37 bp, Artificial Sequence
  Description of Artificial Sequence: Synthetic oligonucleotide
tataaggtcaccccaaaatccagaatgcctgatcatc

SEQ ID NO: 323831 - DNA, 36 bp, Artificial Sequence
  Description of Artificial Sequence: Synthetic oligonucleotide
ataaggtcaccccaaaatccagaatgcctgatcatc

SEQ ID NO: 323832 - DNA, 35 bp, Artificial Sequence
  Description of Artificial Sequence: Synthetic oligonucleotide
taaggtcaccccaaaatccagaatgcctgatcatc

SEQ ID NO: 323833 - DNA, 34 bp, Artificial Sequence
  Description of Artificial Sequence: Synthetic oligonucleotide
aaggtcaccccaaaatccagaatgcctgatcatc

SEQ ID NO: 323834 - DNA, 33 bp, Artificial Sequence
  Description of Artificial Sequence: Synthetic oligonucleotide
aggtcaccccaaaatccagaatgcctgatcatc

SEQ ID NO: 323835 - DNA, 32 bp, Artificial Sequence
  Description of Artificial Sequence: Synthetic oligonucleotide
ggtcaccccaaaatccagaatgcctgatcatc

SEQ ID NO: 323836 - DNA, 34 bp, Artificial Sequence
  Description of Artificial Sequence: Synthetic oligonucleotide
gtcaccccaaaatccagaatgcctgatcatcatg

SEQ ID NO: 323837 - DNA, 34 bp, Artificial Sequence
  Description of Artificial Sequence: Synthetic oligonucleotide
tcaccccaaaatccagaatgcctgatcatcatgg

SEQ ID NO: 323838 - DNA, 33 bp, Artificial Sequence
  Description of Artificial Sequence: Synthetic oligonucleotide
caccccaaaatccagaatgcctgatcatcatgg

SEQ ID NO: 323839 - DNA, 33 bp, Artificial Sequence
  Description of Artificial Sequence: Synthetic oligonucleotide
accccaaaatccagaatgcctgatcatcatggc

SEQ ID NO: 323840 - DNA, 32 bp, Artificial Sequence
  Description of Artificial Sequence: Synthetic oligonucleotide
ccccaaaatccagaatgcctgatcatcatggc

SEQ ID NO: 323841 - DNA, 34 bp, Artificial Sequence
  Description of Artificial Sequence: Synthetic oligonucleotide
cccaaaatccagaatgcctgatcatcatggcatc

SEQ ID NO: 323842 - DNA, 34 bp, Artificial Sequence
  Description of Artificial Sequence: Synthetic oligonucleotide
ccaaaatccagaatgcctgatcatcatggcatcc

SEQ ID NO: 323843 - DNA, 34 bp, Artificial Sequence
  Description of Artificial Sequence: Synthetic oligonucleotide
caaaatccagaatgcctgatcatcatggcatccc

SEQ ID NO: 323844 - DNA, 35 bp, Artificial Sequence
  Description of Artificial Sequence: Synthetic oligonucleotide
aaaatccagaatgcctgatcatcatggcatcccac

SEQ ID NO: 323845 - DNA, 34 bp, Artificial Sequence
  Description of Artificial Sequence: Synthetic oligonucleotide
aaatccagaatgcctgatcatcatggcatcccac

SEQ ID NO: 323846 - DNA, 33 bp, Artificial Sequence
  Description of Artificial Sequence: Synthetic oligonucleotide
aatccagaatgcctgatcatcatggcatcccac

SEQ ID NO: 323847 - DNA, 32 bp, Artificial Sequence
  Description of Artificial Sequence: Synthetic oligonucleotide
atccagaatgcctgatcatcatggcatcccac

SEQ ID NO: 323848 - DNA, 31 bp, Artificial Sequence
  Description of Artificial Sequence: Synthetic oligonucleotide
tccagaatgcctgatcatcatggcatcccac

SEQ ID NO: 323849 - DNA, 30 bp, Artificial Sequence
  Description of Artificial Sequence: Synthetic oligonucleotide
ccagaatgcctgatcatcatggcatcccac

SEQ ID NO: 323850 - DNA, 32 bp, Artificial Sequence
  Description of Artificial Sequence: Synthetic oligonucleotide
cagaatgcctgatcatcatggcatcccacttg

SEQ ID NO: 323851 - DNA, 32 bp, Artificial Sequence
  Description of Artificial Sequence: Synthetic oligonucleotide
agaatgcctgatcatcatggcatcccacttgg

SEQ ID NO: 323852 - DNA, 31 bp, Artificial Sequence
  Description of Artificial Sequence: Synthetic oligonucleotide
gaatgcctgatcatcatggcatcccacttgg

SEQ ID NO: 323853 - DNA, 31 bp, Artificial Sequence
  Description of Artificial Sequence: Synthetic oligonucleotide
aatgcctgatcatcatggcatcccacttggc

SEQ ID NO: 323854 - DNA, 30 bp, Artificial Sequence
  Description of Artificial Sequence: Synthetic oligonucleotide
atgcctgatcatcatggcatcccacttggc

SEQ ID NO: 323855 - DNA, 29 bp, Artificial Sequence
  Description of Artificial Sequence: Synthetic oligonucleotide
tgcctgatcatcatggcatcccacttggc

SEQ ID NO: 323856 - DNA, 28 bp, Artificial Sequence
  Description of Artificial Sequence: Synthetic oligonucleotide
gcctgatcatcatggcatcccacttggc

SEQ ID NO: 323857 - DNA, 28 bp, Artificial Sequence
  Description of Artificial Sequence: Synthetic oligonucleotide
cctgatcatcatggcatcccacttggcc

SEQ ID NO: 323858 - DNA, 30 bp, Artificial Sequence
  Description of Artificial Sequence: Synthetic oligonucleotide
ctgatcatcatggcatcccacttggccttc

SEQ ID NO: 323859 - DNA, 30 bp, Artificial Sequence
  Description of Artificial Sequence: Synthetic oligonucleotide
tgatcatcatggcatcccacttggccttcg

SEQ ID NO: 323860 - DNA, 29 bp, Artificial Sequence
  Description of Artificial Sequence: Synthetic oligonucleotide
gatcatcatggcatcccacttggccttcg

SEQ ID NO: 323861 - DNA, 29 bp, Artificial Sequence
  Description of Artificial Sequence: Synthetic oligonucleotide
atcatcatggcatcccacttggccttcgc

SEQ ID NO: 323862 - DNA, 28 bp, Artificial Sequence
  Description of Artificial Sequence: Synthetic oligonucleotide
tcatcatggcatcccacttggccttcgc

SEQ ID NO: 323863 - DNA, 27 bp, Artificial Sequence
  Description of Artificial Sequence: Synthetic oligonucleotide
catcatggcatcccacttggccttcgc

SEQ ID NO: 323864 - DNA, 30 bp, Artificial Sequence
  Description of Artificial Sequence: Synthetic oligonucleotide
atcatggcatcccacttggccttcgctttg

SEQ ID NO: 323865 - DNA, 29 bp, Artificial Sequence
  Description of Artificial Sequence: Synthetic oligonucleotide
tcatggcatcccacttggccttcgctttg

SEQ ID NO: 323866 - DNA, 28 bp, Artificial Sequence
  Description of Artificial Sequence: Synthetic oligonucleotide
catggcatcccacttggccttcgctttg

SEQ ID NO: 323867 - DNA, 31 bp, Artificial Sequence
  Description of Artificial Sequence: Synthetic oligonucleotide
atggcatcccacttggccttcgctttgattg

SEQ ID NO: 323868 - DNA, 30 bp, Artificial Sequence
  Description of Artificial Sequence: Synthetic oligonucleotide
tggcatcccacttggccttcgctttgattg

SEQ ID NO: 323869 - DNA, 29 bp, Artificial Sequence
  Description of Artificial Sequence: Synthetic oligonucleotide
ggcatcccacttggccttcgctttgattg

SEQ ID NO: 323870 - DNA, 31 bp, Artificial Sequence
  Description of Artificial Sequence: Synthetic oligonucleotide
gcatcccacttggccttcgctttgattgttg

SEQ ID NO: 323871 - DNA, 31 bp, Artificial Sequence
  Description of Artificial Sequence: Synthetic oligonucleotide
catcccacttggccttcgctttgattgttgc

SEQ ID NO: 323872 - DNA, 32 bp, Artificial Sequence
  Description of Artificial Sequence: Synthetic oligonucleotide
atcccacttggccttcgctttgattgttgcag

SEQ ID NO: 323873 - DNA, 31 bp, Artificial Sequence
  Description of Artificial Sequence: Synthetic oligonucleotide
tcccacttggccttcgctttgattgttgcag

SEQ ID NO: 323874 - DNA, 30 bp, Artificial Sequence
  Description of Artificial Sequence: Synthetic oligonucleotide
cccacttggccttcgctttgattgttgcag

SEQ ID NO: 323875 - DNA, 33 bp, Artificial Sequence
  Description of Artificial Sequence: Synthetic oligonucleotide
ccacttggccttcgctttgattgttgcagtttc

SEQ ID NO: 323876 - DNA, 33 bp, Artificial Sequence
  Description of Artificial Sequence: Synthetic oligonucleotide
cacttggccttcgctttgattgttgcagtttcc

SEQ ID NO: 323877 - DNA, 36 bp, Artificial Sequence
  Description of Artificial Sequence: Synthetic oligonucleotide
acttggccttcgctttgattgttgcagtttccattg

SEQ ID NO: 323878 - DNA, 35 bp, Artificial Sequence
  Description of Artificial Sequence: Synthetic oligonucleotide
cttggccttcgctttgattgttgcagtttccattg

SEQ ID NO: 323879 - DNA, 35 bp, Artificial Sequence
  Description of Artificial Sequence: Synthetic oligonucleotide
ttggccttcgctttgattgttgcagtttccattgc

SEQ ID NO: 323880 - DNA, 34 bp, Artificial Sequence
  Description of Artificial Sequence: Synthetic oligonucleotide
tggccttcgctttgattgttgcagtttccattgc

SEQ ID NO: 323881 - DNA, 33 bp, Artificial Sequence
  Description of Artificial Sequence: Synthetic oligonucleotide
ggccttcgctttgattgttgcagtttccattgc

SEQ ID NO: 323882 - DNA, 34 bp, Artificial Sequence
  Description of Artificial Sequence: Synthetic oligonucleotide
gccttcgctttgattgttgcagtttccattgcag

SEQ ID NO: 323883 - DNA, 35 bp, Artificial Sequence
  Description of Artificial Sequence: Synthetic oligonucleotide
ccttcgctttgattgttgcagtttccattgcagtg

SEQ ID NO: 323884 - DNA, 37 bp, Artificial Sequence
  Description of Artificial Sequence: Synthetic oligonucleotide
cttcgctttgattgttgcagtttccattgcagtgaac

SEQ ID NO: 323885 - DNA, 38 bp, Artificial Sequence
  Description of Artificial Sequence: Synthetic oligonucleotide
ttcgctttgattgttgcagtttccattgcagtgaacag

SEQ ID NO: 323886 - DNA, 37 bp, Artificial Sequence
  Description of Artificial Sequence: Synthetic oligonucleotide
tcgctttgattgttgcagtttccattgcagtgaacag

SEQ ID NO: 323887 - DNA, 36 bp, Artificial Sequence
  Description of Artificial Sequence: Synthetic oligonucleotide
cgctttgattgttgcagtttccattgcagtgaacag

SEQ ID NO: 323888 - DNA, 37 bp, Artificial Sequence
  Description of Artificial Sequence: Synthetic oligonucleotide
gctttgattgttgcagtttccattgcagtgaacagtc

SEQ ID NO: 323889 - DNA, 37 bp, Artificial Sequence
  Description of Artificial Sequence: Synthetic oligonucleotide
ctttgattgttgcagtttccattgcagtgaacagtcg

SEQ ID NO: 323890 - DNA, 39 bp, Artificial Sequence
  Description of Artificial Sequence: Synthetic oligonucleotide
tttgattgttgcagtttccattgcagtgaacagtcgatg

SEQ ID NO: 323891 - DNA, 38 bp, Artificial Sequence
  Description of Artificial Sequence: Synthetic oligonucleotide
ttgattgttgcagtttccattgcagtgaacagtcgatg

SEQ ID NO: 323892 - DNA, 37 bp, Artificial Sequence
  Description of Artificial Sequence: Synthetic oligonucleotide
tgattgttgcagtttccattgcagtgaacagtcgatg

SEQ ID NO: 323893 - DNA, 36 bp, Artificial Sequence
  Description of Artificial Sequence: Synthetic oligonucleotide
gattgttgcagtttccattgcagtgaacagtcgatg

SEQ ID NO: 323894 - DNA, 38 bp, Artificial Sequence
  Description of Artificial Sequence: Synthetic oligonucleotide
attgttgcagtttccattgcagtgaacagtcgatgaag

SEQ ID NO: 323895 - DNA, 37 bp, Artificial Sequence
  Description of Artificial Sequence: Synthetic oligonucleotide
ttgttgcagtttccattgcagtgaacagtcgatgaag

SEQ ID NO: 323896 - DNA, 36 bp, Artificial Sequence
  Description of Artificial Sequence: Synthetic oligonucleotide
tgttgcagtttccattgcagtgaacagtcgatgaag

SEQ ID NO: 323897 - DNA, 35 bp, Artificial Sequence
  Description of Artificial Sequence: Synthetic oligonucleotide
gttgcagtttccattgcagtgaacagtcgatgaag

SEQ ID NO: 323898 - DNA, 35 bp, Artificial Sequence
  Description of Artificial Sequence: Synthetic oligonucleotide
ttgcagtttccattgcagtgaacagtcgatgaagg

SEQ ID NO: 323899 - DNA, 34 bp, Artificial Sequence
  Description of Artificial Sequence: Synthetic oligonucleotide
tgcagtttccattgcagtgaacagtcgatgaagg

SEQ ID NO: 323900 - DNA, 33 bp, Artificial Sequence
  Description of Artificial Sequence: Synthetic oligonucleotide
gcagtttccattgcagtgaacagtcgatgaagg

SEQ ID NO: 323901 - DNA, 34 bp, Artificial Sequence
  Description of Artificial Sequence: Synthetic oligonucleotide
cagtttccattgcagtgaacagtcgatgaaggtg

SEQ ID NO: 323902 - DNA, 35 bp, Artificial Sequence
  Description of Artificial Sequence: Synthetic oligonucleotide
agtttccattgcagtgaacagtcgatgaaggtgtg

SEQ ID NO: 323903 - DNA, 34 bp, Artificial Sequence
  Description of Artificial Sequence: Synthetic oligonucleotide
gtttccattgcagtgaacagtcgatgaaggtgtg

SEQ ID NO: 323904 - DNA, 34 bp, Artificial Sequence
  Description of Artificial Sequence: Synthetic oligonucleotide
tttccattgcagtgaacagtcgatgaaggtgtgc

SEQ ID NO: 323905 - DNA, 33 bp, Artificial Sequence
  Description of Artificial Sequence: Synthetic oligonucleotide
ttccattgcagtgaacagtcgatgaaggtgtgc

SEQ ID NO: 323906 - DNA, 32 bp, Artificial Sequence
  Description of Artificial Sequence: Synthetic oligonucleotide
tccattgcagtgaacagtcgatgaaggtgtgc

SEQ ID NO: 323907 - DNA, 31 bp, Artificial Sequence
  Description of Artificial Sequence: Synthetic oligonucleotide
ccattgcagtgaacagtcgatgaaggtgtgc

SEQ ID NO: 323908 - DNA, 31 bp, Artificial Sequence
  Description of Artificial Sequence: Synthetic oligonucleotide
cattgcagtgaacagtcgatgaaggtgtgcg

SEQ ID NO: 323909 - DNA, 31 bp, Artificial Sequence
  Description of Artificial Sequence: Synthetic oligonucleotide
attgcagtgaacagtcgatgaaggtgtgcgc

SEQ ID NO: 323910 - DNA, 30 bp, Artificial Sequence
  Description of Artificial Sequence: Synthetic oligonucleotide
ttgcagtgaacagtcgatgaaggtgtgcgc

SEQ ID NO: 323911 - DNA, 29 bp, Artificial Sequence
  Description of Artificial Sequence: Synthetic oligonucleotide
tgcagtgaacagtcgatgaaggtgtgcgc

SEQ ID NO: 323912 - DNA, 28 bp, Artificial Sequence
  Description of Artificial Sequence: Synthetic oligonucleotide
gcagtgaacagtcgatgaaggtgtgcgc

SEQ ID NO: 323913 - DNA, 29 bp, Artificial Sequence
  Description of Artificial Sequence: Synthetic oligonucleotide
cagtgaacagtcgatgaaggtgtgcgcag

SEQ ID NO: 323914 - DNA, 31 bp, Artificial Sequence
  Description of Artificial Sequence: Synthetic oligonucleotide
agtgaacagtcgatgaaggtgtgcgcagaag

SEQ ID NO: 323915 - DNA, 30 bp, Artificial Sequence
  Description of Artificial Sequence: Synthetic oligonucleotide
gtgaacagtcgatgaaggtgtgcgcagaag

SEQ ID NO: 323916 - DNA, 35 bp, Artificial Sequence
  Description of Artificial Sequence: Synthetic oligonucleotide
tgaacagtcgatgaaggtgtgcgcagaagaataag

SEQ ID NO: 323917 - DNA, 34 bp, Artificial Sequence
  Description of Artificial Sequence: Synthetic oligonucleotide
gaacagtcgatgaaggtgtgcgcagaagaataag

SEQ ID NO: 323918 - DNA, 34 bp, Artificial Sequence
  Description of Artificial Sequence: Synthetic oligonucleotide
aacagtcgatgaaggtgtgcgcagaagaataagc

SEQ ID NO: 323919 - DNA, 33 bp, Artificial Sequence
  Description of Artificial Sequence: Synthetic oligonucleotide
acagtcgatgaaggtgtgcgcagaagaataagc

SEQ ID NO: 323920 - DNA, 32 bp, Artificial Sequence
  Description of Artificial Sequence: Synthetic oligonucleotide
cagtcgatgaaggtgtgcgcagaagaataagc

SEQ ID NO: 323921 - DNA, 34 bp, Artificial Sequence
  Description of Artificial Sequence: Synthetic oligonucleotide
agtcgatgaaggtgtgcgcagaagaataagctag

SEQ ID NO: 323922 - DNA, 33 bp, Artificial Sequence
  Description of Artificial Sequence: Synthetic oligonucleotide
gtcgatgaaggtgtgcgcagaagaataagctag

SEQ ID NO: 323923 - DNA, 34 bp, Artificial Sequence
  Description of Artificial Sequence: Synthetic oligonucleotide
tcgatgaaggtgtgcgcagaagaataagctagtg

SEQ ID NO: 323924 - DNA, 33 bp, Artificial Sequence
  Description of Artificial Sequence: Synthetic oligonucleotide
cgatgaaggtgtgcgcagaagaataagctagtg

SEQ ID NO: 323925 - DNA, 35 bp, Artificial Sequence
  Description of Artificial Sequence: Synthetic oligonucleotide
gatgaaggtgtgcgcagaagaataagctagtgttc

SEQ ID NO: 323926 - DNA, 37 bp, Artificial Sequence
  Description of Artificial Sequence: Synthetic oligonucleotide
atgaaggtgtgcgcagaagaataagctagtgttcaac

SEQ ID NO: 323927 - DNA, 36 bp, Artificial Sequence
  Description of Artificial Sequence: Synthetic oligonucleotide
tgaaggtgtgcgcagaagaataagctagtgttcaac

SEQ ID NO: 323928 - DNA, 35 bp, Artificial Sequence
  Description of Artificial Sequence: Synthetic oligonucleotide
gaaggtgtgcgcagaagaataagctagtgttcaac

SEQ ID NO: 323929 - DNA, 36 bp, Artificial Sequence
  Description of Artificial Sequence: Synthetic oligonucleotide
aaggtgtgcgcagaagaataagctagtgttcaacag

SEQ ID NO: 323930 - DNA, 35 bp, Artificial Sequence
  Description of Artificial Sequence: Synthetic oligonucleotide
aggtgtgcgcagaagaataagctagtgttcaacag

SEQ ID NO: 323931 - DNA, 34 bp, Artificial Sequence
  Description of Artificial Sequence: Synthetic oligonucleotide
ggtgtgcgcagaagaataagctagtgttcaacag

SEQ ID NO: 323932 - DNA, 35 bp, Artificial Sequence
  Description of Artificial Sequence: Synthetic oligonucleotide
gtgtgcgcagaagaataagctagtgttcaacagtg

SEQ ID NO: 323933 - DNA, 35 bp, Artificial Sequence
  Description of Artificial Sequence: Synthetic oligonucleotide
tgtgcgcagaagaataagctagtgttcaacagtgc

SEQ ID NO: 323934 - DNA, 34 bp, Artificial Sequence
  Description of Artificial Sequence: Synthetic oligonucleotide
gtgcgcagaagaataagctagtgttcaacagtgc

SEQ ID NO: 323935 - DNA, 34 bp, Artificial Sequence
  Description of Artificial Sequence: Synthetic oligonucleotide
tgcgcagaagaataagctagtgttcaacagtgcc

SEQ ID NO: 323936 - DNA, 33 bp, Artificial Sequence
  Description of Artificial Sequence: Synthetic oligonucleotide
gcgcagaagaataagctagtgttcaacagtgcc

SEQ ID NO: 323937 - DNA, 36 bp, Artificial Sequence
  Description of Artificial Sequence: Synthetic oligonucleotide
cgcagaagaataagctagtgttcaacagtgccaatg

SEQ ID NO: 323938 - DNA, 36 bp, Artificial Sequence
  Description of Artificial Sequence: Synthetic oligonucleotide
gcagaagaataagctagtgttcaacagtgccaatgg

SEQ ID NO: 323939 - DNA, 37 bp, Artificial Sequence
  Description of Artificial Sequence: Synthetic oligonucleotide
cagaagaataagctagtgttcaacagtgccaatggag

SEQ ID NO: 323940 - DNA, 37 bp, Artificial Sequence
  Description of Artificial Sequence: Synthetic oligonucleotide
agaagaataagctagtgttcaacagtgccaatggagc

SEQ ID NO: 323941 - DNA, 36 bp, Artificial Sequence
  Description of Artificial Sequence: Synthetic oligonucleotide
gaagaataagctagtgttcaacagtgccaatggagc

SEQ ID NO: 323942 - DNA, 37 bp, Artificial Sequence
  Description of Artificial Sequence: Synthetic oligonucleotide
aagaataagctagtgttcaacagtgccaatggagcag

SEQ ID NO: 323943 - DNA, 36 bp, Artificial Sequence
  Description of Artificial Sequence: Synthetic oligonucleotide
agaataagctagtgttcaacagtgccaatggagcag

SEQ ID NO: 323944 - DNA, 35 bp, Artificial Sequence
  Description of Artificial Sequence: Synthetic oligonucleotide
gaataagctagtgttcaacagtgccaatggagcag

SEQ ID NO: 323945 - DNA, 36 bp, Artificial Sequence
  Description of Artificial Sequence: Synthetic oligonucleotide
aataagctagtgttcaacagtgccaatggagcagtg

SEQ ID NO: 323946 - DNA, 35 bp, Artificial Sequence
  Description of Artificial Sequence: Synthetic oligonucleotide
ataagctagtgttcaacagtgccaatggagcagtg

SEQ ID NO: 323947 - DNA, 34 bp, Artificial Sequence
  Description of Artificial Sequence: Synthetic oligonucleotide
taagctagtgttcaacagtgccaatggagcagtg

SEQ ID NO: 323948 - DNA, 33 bp, Artificial Sequence
  Description of Artificial Sequence: Synthetic oligonucleotide
aagctagtgttcaacagtgccaatggagcagtg

SEQ ID NO: 323949 - DNA, 32 bp, Artificial Sequence
  Description of Artificial Sequence: Synthetic oligonucleotide
agctagtgttcaacagtgccaatggagcagtg

SEQ ID NO: 323950 - DNA, 31 bp, Artificial Sequence
  Description of Artificial Sequence: Synthetic oligonucleotide
gctagtgttcaacagtgccaatggagcagtg

SEQ ID NO: 323951 - DNA, 31 bp, Artificial Sequence
  Description of Artificial Sequence: Synthetic oligonucleotide
ctagtgttcaacagtgccaatggagcagtgg

SEQ ID NO: 323952 - DNA, 32 bp, Artificial Sequence
  Description of Artificial Sequence: Synthetic oligonucleotide
tagtgttcaacagtgccaatggagcagtggag

SEQ ID NO: 323953 - DNA, 31 bp, Artificial Sequence
  Description of Artificial Sequence: Synthetic oligonucleotide
agtgttcaacagtgccaatggagcagtggag

SEQ ID NO: 323954 - DNA, 30 bp, Artificial Sequence
  Description of Artificial Sequence: Synthetic oligonucleotide
gtgttcaacagtgccaatggagcagtggag

SEQ ID NO: 323955 - DNA, 30 bp, Artificial Sequence
  Description of Artificial Sequence: Synthetic oligonucleotide
tgttcaacagtgccaatggagcagtggagg

SEQ ID NO: 323956 - DNA, 29 bp, Artificial Sequence
  Description of Artificial Sequence: Synthetic oligonucleotide
gttcaacagtgccaatggagcagtggagg

SEQ ID NO: 323957 - DNA, 30 bp, Artificial Sequence
  Description of Artificial Sequence: Synthetic oligonucleotide
ttcaacagtgccaatggagcagtggaggac

SEQ ID NO: 323958 - DNA, 29 bp, Artificial Sequence
  Description of Artificial Sequence: Synthetic oligonucleotide
tcaacagtgccaatggagcagtggaggac

SEQ ID NO: 323959 - DNA, 28 bp, Artificial Sequence
  Description of Artificial Sequence: Synthetic oligonucleotide
caacagtgccaatggagcagtggaggac

SEQ ID NO: 323960 - DNA, 29 bp, Artificial Sequence
  Description of Artificial Sequence: Synthetic oligonucleotide
aacagtgccaatggagcagtggaggactg

SEQ ID NO: 323961 - DNA, 28 bp, Artificial Sequence
  Description of Artificial Sequence: Synthetic oligonucleotide
acagtgccaatggagcagtggaggactg

SEQ ID NO: 323962 - DNA, 27 bp, Artificial Sequence
  Description of Artificial Sequence: Synthetic oligonucleotide
cagtgccaatggagcagtggaggactg

SEQ ID NO: 323963 - DNA, 30 bp, Artificial Sequence
  Description of Artificial Sequence: Synthetic oligonucleotide
agtgccaatggagcagtggaggactgaaag

SEQ ID NO: 323964 - DNA, 29 bp, Artificial Sequence
  Description of Artificial Sequence: Synthetic oligonucleotide
gtgccaatggagcagtggaggactgaaag

SEQ ID NO: 323965 - DNA, 29 bp, Artificial Sequence
  Description of Artificial Sequence: Synthetic oligonucleotide
tgccaatggagcagtggaggactgaaagc

SEQ ID NO: 323966 - DNA, 28 bp, Artificial Sequence
  Description of Artificial Sequence: Synthetic oligonucleotide
gccaatggagcagtggaggactgaaagc

SEQ ID NO: 323967 - DNA, 28 bp, Artificial Sequence
  Description of Artificial Sequence: Synthetic oligonucleotide
ccaatggagcagtggaggactgaaagcc

SEQ ID NO: 323968 - DNA, 30 bp, Artificial Sequence
  Description of Artificial Sequence: Synthetic oligonucleotide
caatggagcagtggaggactgaaagccaac

SEQ ID NO: 323969 - DNA, 31 bp, Artificial Sequence
  Description of Artificial Sequence: Synthetic oligonucleotide
aatggagcagtggaggactgaaagccaactg

SEQ ID NO: 323970 - DNA, 30 bp, Artificial Sequence
  Description of Artificial Sequence: Synthetic oligonucleotide
atggagcagtggaggactgaaagccaactg

SEQ ID NO: 323971 - DNA, 29 bp, Artificial Sequence
  Description of Artificial Sequence: Synthetic oligonucleotide
tggagcagtggaggactgaaagccaactg

SEQ ID NO: 323972 - DNA, 28 bp, Artificial Sequence
  Description of Artificial Sequence: Synthetic oligonucleotide
ggagcagtggaggactgaaagccaactg

SEQ ID NO: 323973 - DNA, 28 bp, Artificial Sequence
  Description of Artificial Sequence: Synthetic oligonucleotide
gagcagtggaggactgaaagccaactgg

SEQ ID NO: 323974 - DNA, 29 bp, Artificial Sequence
  Description of Artificial Sequence: Synthetic oligonucleotide
agcagtggaggactgaaagccaactggac

SEQ ID NO: 323975 - DNA, 28 bp, Artificial Sequence
  Description of Artificial Sequence: Synthetic oligonucleotide
gcagtggaggactgaaagccaactggac

SEQ ID NO: 323976 - DNA, 29 bp, Artificial Sequence
  Description of Artificial Sequence: Synthetic oligonucleotide
cagtggaggactgaaagccaactggactc

SEQ ID NO: 323977 - DNA, 31 bp, Artificial Sequence
  Description of Artificial Sequence: Synthetic oligonucleotide
agtggaggactgaaagccaactggactcaag

SEQ ID NO: 323978 - DNA, 30 bp, Artificial Sequence
  Description of Artificial Sequence: Synthetic oligonucleotide
gtggaggactgaaagccaactggactcaag

SEQ ID NO: 323979 - DNA, 30 bp, Artificial Sequence
  Description of Artificial Sequence: Synthetic oligonucleotide
tggaggactgaaagccaactggactcaagg

SEQ ID NO: 323980 - DNA, 29 bp, Artificial Sequence
  Description of Artificial Sequence: Synthetic oligonucleotide
ggaggactgaaagccaactggactcaagg

SEQ ID NO: 323981 - DNA, 29 bp, Artificial Sequence
  Description of Artificial Sequence: Synthetic oligonucleotide
gaggactgaaagccaactggactcaaggg

SEQ ID NO: 323982 - DNA, 30 bp, Artificial Sequence
  Description of Artificial Sequence: Synthetic oligonucleotide
aggactgaaagccaactggactcaagggag

SEQ ID NO: 323983 - DNA, 29 bp, Artificial Sequence
  Description of Artificial Sequence: Synthetic oligonucleotide
ggactgaaagccaactggactcaagggag

SEQ ID NO: 323984 - DNA, 30 bp, Artificial Sequence
  Description of Artificial Sequence: Synthetic oligonucleotide
gactgaaagccaactggactcaagggagag

SEQ ID NO: 323985 - DNA, 30 bp, Artificial Sequence
  Description of Artificial Sequence: Synthetic oligonucleotide
actgaaagccaactggactcaagggagagg

SEQ ID NO: 323986 - DNA, 29 bp, Artificial Sequence
  Description of Artificial Sequence: Synthetic oligonucleotide
ctgaaagccaactggactcaagggagagg

SEQ ID NO: 323987 - DNA, 29 bp, Artificial Sequence
  Description of Artificial Sequence: Synthetic oligonucleotide
tgaaagccaactggactcaagggagaggc

SEQ ID NO: 323988 - DNA, 28 bp, Artificial Sequence
  Description of Artificial Sequence: Synthetic oligonucleotide
gaaagccaactggactcaagggagaggc

SEQ ID NO: 323989 - DNA, 28 bp, Artificial Sequence
  Description of Artificial Sequence: Synthetic oligonucleotide
aaagccaactggactcaagggagaggcc

SEQ ID NO: 323990 - DNA, 27 bp, Artificial Sequence
  Description of Artificial Sequence: Synthetic oligonucleotide
aagccaactggactcaagggagaggcc

SEQ ID NO: 323991 - DNA, 27 bp, Artificial Sequence
  Description of Artificial Sequence: Synthetic oligonucleotide
agccaactggactcaagggagaggcct

SEQ ID NO: 323992 - DNA, 26 bp, Artificial Sequence
  Description of Artificial Sequence: Synthetic oligonucleotide
gccaactggactcaagggagaggcct

SEQ ID NO: 323993 - DNA, 26 bp, Artificial Sequence
  Description of Artificial Sequence: Synthetic oligonucleotide
ccaactggactcaagggagaggcctg

SEQ ID NO: 323994 - DNA, 27 bp, Artificial Sequence
  Description of Artificial Sequence: Synthetic oligonucleotide
caactggactcaagggagaggcctgca

SEQ ID NO: 323995 - DNA, 28 bp, Artificial Sequence
  Description of Artificial Sequence: Synthetic oligonucleotide
aactggactcaagggagaggcctgcaag

SEQ ID NO: 323996 - DNA, 27 bp, Artificial Sequence
  Description of Artificial Sequence: Synthetic oligonucleotide
actggactcaagggagaggcctgcaag

SEQ ID NO: 323997 - DNA, 27 bp, Artificial Sequence
  Description of Artificial Sequence: Synthetic oligonucleotide
ctggactcaagggagaggcctgcaagt

SEQ ID NO: 323998 - DNA, 27 bp, Artificial Sequence
  Description of Artificial Sequence: Synthetic oligonucleotide
tggactcaagggagaggcctgcaagtc

SEQ ID NO: 323999 - DNA, 27 bp, Artificial Sequence
  Description of Artificial Sequence: Synthetic oligonucleotide
ggactcaagggagaggcctgcaagtct

SEQ ID NO: 324000 - DNA, 27 bp, Artificial Sequence
  Description of Artificial Sequence: Synthetic oligonucleotide
gactcaagggagaggcctgcaagtctc

SEQ ID NO: 324001 - DNA, 28 bp, Artificial Sequence
  Description of Artificial Sequence: Synthetic oligonucleotide
actcaagggagaggcctgcaagtctctg

SEQ ID NO: 324002 - DNA, 27 bp, Artificial Sequence
  Description of Artificial Sequence: Synthetic oligonucleotide
ctcaagggagaggcctgcaagtctctg

SEQ ID NO: 324003 - DNA, 27 bp, Artificial Sequence
  Description of Artificial Sequence: Synthetic oligonucleotide
tcaagggagaggcctgcaagtctctgg

SEQ ID NO: 324004 - DNA, 27 bp, Artificial Sequence
  Description of Artificial Sequence: Synthetic oligonucleotide
caagggagaggcctgcaagtctctgga

SEQ ID NO: 324005 - DNA, 30 bp, Artificial Sequence
  Description of Artificial Sequence: Synthetic oligonucleotide
aagggagaggcctgcaagtctctggaaatg

SEQ ID NO: 324006 - DNA, 29 bp, Artificial Sequence
  Description of Artificial Sequence: Synthetic oligonucleotide
agggagaggcctgcaagtctctggaaatg

SEQ ID NO: 324007 - DNA, 28 bp, Artificial Sequence
  Description of Artificial Sequence: Synthetic oligonucleotide
gggagaggcctgcaagtctctggaaatg

SEQ ID NO: 324008 - DNA, 28 bp, Artificial Sequence
  Description of Artificial Sequence: Synthetic oligonucleotide
ggagaggcctgcaagtctctggaaatgg

SEQ ID NO: 324009 - DNA, 29 bp, Artificial Sequence
  Description of Artificial Sequence: Synthetic oligonucleotide
gagaggcctgcaagtctctggaaatggtc

SEQ ID NO: 324010 - DNA, 29 bp, Artificial Sequence
  Description of Artificial Sequence: Synthetic oligonucleotide
agaggcctgcaagtctctggaaatggtcc

SEQ ID NO: 324011 - DNA, 28 bp, Artificial Sequence
  Description of Artificial Sequence: Synthetic oligonucleotide
gaggcctgcaagtctctggaaatggtcc

SEQ ID NO: 324012 - DNA, 32 bp, Artificial Sequence
  Description of Artificial Sequence: Synthetic oligonucleotide
aggcctgcaagtctctggaaatggtccatttg

SEQ ID NO: 324013 - DNA, 31 bp, Artificial Sequence
  Description of Artificial Sequence: Synthetic oligonucleotide
ggcctgcaagtctctggaaatggtccatttg

SEQ ID NO: 324014 - DNA, 31 bp, Artificial Sequence
  Description of Artificial Sequence: Synthetic oligonucleotide
gcctgcaagtctctggaaatggtccatttgg

SEQ ID NO: 324015 - DNA, 32 bp, Artificial Sequence
  Description of Artificial Sequence: Synthetic oligonucleotide
cctgcaagtctctggaaatggtccatttggtg

SEQ ID NO: 324016 - DNA, 34 bp, Artificial Sequence
  Description of Artificial Sequence: Synthetic oligonucleotide
ctgcaagtctctggaaatggtccatttggtgtac

SEQ ID NO: 324017 - DNA, 36 bp, Artificial Sequence
  Description of Artificial Sequence: Synthetic oligonucleotide
tgcaagtctctggaaatggtccatttggtgtacaag

SEQ ID NO: 324018 - DNA, 35 bp, Artificial Sequence
  Description of Artificial Sequence: Synthetic oligonucleotide
gcaagtctctggaaatggtccatttggtgtacaag

SEQ ID NO: 324019 - DNA, 35 bp, Artificial Sequence
  Description of Artificial Sequence: Synthetic oligonucleotide
caagtctctggaaatggtccatttggtgtacaagg

SEQ ID NO: 324020 - DNA, 36 bp, Artificial Sequence
  Description of Artificial Sequence: Synthetic oligonucleotide
aagtctctggaaatggtccatttggtgtacaaggag

SEQ ID NO: 324021 - DNA, 35 bp, Artificial Sequence
  Description of Artificial Sequence: Synthetic oligonucleotide
agtctctggaaatggtccatttggtgtacaaggag

SEQ ID NO: 324022 - DNA, 34 bp, Artificial Sequence
  Description of Artificial Sequence: Synthetic oligonucleotide
gtctctggaaatggtccatttggtgtacaaggag

SEQ ID NO: 324023 - DNA, 35 bp, Artificial Sequence
  Description of Artificial Sequence: Synthetic oligonucleotide
tctctggaaatggtccatttggtgtacaaggagtg

SEQ ID NO: 324024 - DNA, 34 bp, Artificial Sequence
  Description of Artificial Sequence: Synthetic oligonucleotide
ctctggaaatggtccatttggtgtacaaggagtg

SEQ ID NO: 324025 - DNA, 34 bp, Artificial Sequence
  Description of Artificial Sequence: Synthetic oligonucleotide
tctggaaatggtccatttggtgtacaaggagtgg

SEQ ID NO: 324026 - DNA, 33 bp, Artificial Sequence
  Description of Artificial Sequence: Synthetic oligonucleotide
ctggaaatggtccatttggtgtacaaggagtgg

SEQ ID NO: 324027 - DNA, 34 bp, Artificial Sequence
  Description of Artificial Sequence: Synthetic oligonucleotide
tggaaatggtccatttggtgtacaaggagtggtc

SEQ ID NO: 324028 - DNA, 33 bp, Artificial Sequence
  Description of Artificial Sequence: Synthetic oligonucleotide
ggaaatggtccatttggtgtacaaggagtggtc

SEQ ID NO: 324029 - DNA, 34 bp, Artificial Sequence
  Description of Artificial Sequence: Synthetic oligonucleotide
gaaatggtccatttggtgtacaaggagtggtcag

SEQ ID NO: 324030 - DNA, 37 bp, Artificial Sequence
  Description of Artificial Sequence: Synthetic oligonucleotide
aaatggtccatttggtgtacaaggagtggtcagaaac

SEQ ID NO: 324031 - DNA, 36 bp, Artificial Sequence
  Description of Artificial Sequence: Synthetic oligonucleotide
aatggtccatttggtgtacaaggagtggtcagaaac

SEQ ID NO: 324032 - DNA, 35 bp, Artificial Sequence
  Description of Artificial Sequence: Synthetic oligonucleotide
atggtccatttggtgtacaaggagtggtcagaaac

SEQ ID NO: 324033 - DNA, 34 bp, Artificial Sequence
  Description of Artificial Sequence: Synthetic oligonucleotide
tggtccatttggtgtacaaggagtggtcagaaac

SEQ ID NO: 324034 - DNA, 33 bp, Artificial Sequence
  Description of Artificial Sequence: Synthetic oligonucleotide
ggtccatttggtgtacaaggagtggtcagaaac

SEQ ID NO: 324035 - DNA, 34 bp, Artificial Sequence
  Description of Artificial Sequence: Synthetic oligonucleotide
gtccatttggtgtacaaggagtggtcagaaacac

SEQ ID NO: 324036 - DNA, 34 bp, Artificial Sequence
  Description of Artificial Sequence: Synthetic oligonucleotide
tccatttggtgtacaaggagtggtcagaaacacc

SEQ ID NO: 324037 - DNA, 33 bp, Artificial Sequence
  Description of Artificial Sequence: Synthetic oligonucleotide
ccatttggtgtacaaggagtggtcagaaacacc

SEQ ID NO: 324038 - DNA, 34 bp, Artificial Sequence
  Description of Artificial Sequence: Synthetic oligonucleotide
catttggtgtacaaggagtggtcagaaacaccag

SEQ ID NO: 324039 - DNA, 35 bp, Artificial Sequence
  Description of Artificial Sequence: Synthetic oligonucleotide
atttggtgtacaaggagtggtcagaaacaccagac

SEQ ID NO: 324040 - DNA, 34 bp, Artificial Sequence
  Description of Artificial Sequence: Synthetic oligonucleotide
tttggtgtacaaggagtggtcagaaacaccagac

SEQ ID NO: 324041 - DNA, 33 bp, Artificial Sequence
  Description of Artificial Sequence: Synthetic oligonucleotide
ttggtgtacaaggagtggtcagaaacaccagac

SEQ ID NO: 324042 - DNA, 32 bp, Artificial Sequence
  Description of Artificial Sequence: Synthetic oligonucleotide
tggtgtacaaggagtggtcagaaacaccagac

SEQ ID NO: 324043 - DNA, 31 bp, Artificial Sequence
  Description of Artificial Sequence: Synthetic oligonucleotide
ggtgtacaaggagtggtcagaaacaccagac

SEQ ID NO: 324044 - DNA, 31 bp, Artificial Sequence
  Description of Artificial Sequence: Synthetic oligonucleotide
gtgtacaaggagtggtcagaaacaccagacc

SEQ ID NO: 324045 - DNA, 32 bp, Artificial Sequence
  Description of Artificial Sequence: Synthetic oligonucleotide
tgtacaaggagtggtcagaaacaccagaccag

SEQ ID NO: 324046 - DNA, 31 bp, Artificial Sequence
  Description of Artificial Sequence: Synthetic oligonucleotide
gtacaaggagtggtcagaaacaccagaccag

SEQ ID NO: 324047 - DNA, 36 bp, Artificial Sequence
  Description of Artificial Sequence: Synthetic oligonucleotide
tacaaggagtggtcagaaacaccagaccagattatg

SEQ ID NO: 324048 - DNA, 35 bp, Artificial Sequence
  Description of Artificial Sequence: Synthetic oligonucleotide
acaaggagtggtcagaaacaccagaccagattatg

SEQ ID NO: 324049 - DNA, 34 bp, Artificial Sequence
  Description of Artificial Sequence: Synthetic oligonucleotide
caaggagtggtcagaaacaccagaccagattatg

SEQ ID NO: 324050 - DNA, 35 bp, Artificial Sequence
  Description of Artificial Sequence: Synthetic oligonucleotide
aaggagtggtcagaaacaccagaccagattatgac

SEQ ID NO: 324051 - DNA, 34 bp, Artificial Sequence
  Description of Artificial Sequence: Synthetic oligonucleotide
aggagtggtcagaaacaccagaccagattatgac

SEQ ID NO: 324052 - DNA, 33 bp, Artificial Sequence
  Description of Artificial Sequence: Synthetic oligonucleotide
ggagtggtcagaaacaccagaccagattatgac

SEQ ID NO: 324053 - DNA, 34 bp, Artificial Sequence
  Description of Artificial Sequence: Synthetic oligonucleotide
gagtggtcagaaacaccagaccagattatgacag

SEQ ID NO: 324054 - DNA, 34 bp, Artificial Sequence
  Description of Artificial Sequence: Synthetic oligonucleotide
agtggtcagaaacaccagaccagattatgacagg

SEQ ID NO: 324055 - DNA, 33 bp, Artificial Sequence
  Description of Artificial Sequence: Synthetic oligonucleotide
gtggtcagaaacaccagaccagattatgacagg

SEQ ID NO: 324056 - DNA, 34 bp, Artificial Sequence
  Description of Artificial Sequence: Synthetic oligonucleotide
tggtcagaaacaccagaccagattatgacaggtg

SEQ ID NO: 324057 - DNA, 33 bp, Artificial Sequence
  Description of Artificial Sequence: Synthetic oligonucleotide
ggtcagaaacaccagaccagattatgacaggtg

SEQ ID NO: 324058 - DNA, 35 bp, Artificial Sequence
  Description of Artificial Sequence: Synthetic oligonucleotide
gtcagaaacaccagaccagattatgacaggtgatg

SEQ ID NO: 324059 - DNA, 36 bp, Artificial Sequence
  Description of Artificial Sequence: Synthetic oligonucleotide
tcagaaacaccagaccagattatgacaggtgatgag

SEQ ID NO: 324060 - DNA, 35 bp, Artificial Sequence
  Description of Artificial Sequence: Synthetic oligonucleotide
cagaaacaccagaccagattatgacaggtgatgag

SEQ ID NO: 324061 - DNA, 36 bp, Artificial Sequence
  Description of Artificial Sequence: Synthetic oligonucleotide
agaaacaccagaccagattatgacaggtgatgagac

SEQ ID NO: 324062 - DNA, 35 bp, Artificial Sequence
  Description of Artificial Sequence: Synthetic oligonucleotide
gaaacaccagaccagattatgacaggtgatgagac

SEQ ID NO: 324063 - DNA, 37 bp, Artificial Sequence
  Description of Artificial Sequence: Synthetic oligonucleotide
aaacaccagaccagattatgacaggtgatgagactag

SEQ ID NO: 324064 - DNA, 36 bp, Artificial Sequence
  Description of Artificial Sequence: Synthetic oligonucleotide
aacaccagaccagattatgacaggtgatgagactag

SEQ ID NO: 324065 - DNA, 35 bp, Artificial Sequence
  Description of Artificial Sequence: Synthetic oligonucleotide
acaccagaccagattatgacaggtgatgagactag

SEQ ID NO: 324066 - DNA, 34 bp, Artificial Sequence
  Description of Artificial Sequence: Synthetic oligonucleotide
caccagaccagattatgacaggtgatgagactag

SEQ ID NO: 324067 - DNA, 34 bp, Artificial Sequence
  Description of Artificial Sequence: Synthetic oligonucleotide
accagaccagattatgacaggtgatgagactagg

SEQ ID NO: 324068 - DNA, 33 bp, Artificial Sequence
  Description of Artificial Sequence: Synthetic oligonucleotide
ccagaccagattatgacaggtgatgagactagg

SEQ ID NO: 324069 - DNA, 35 bp, Artificial Sequence
  Description of Artificial Sequence: Synthetic oligonucleotide
cagaccagattatgacaggtgatgagactaggaac

SEQ ID NO: 324070 - DNA, 35 bp, Artificial Sequence
  Description of Artificial Sequence: Synthetic oligonucleotide
agaccagattatgacaggtgatgagactaggaacc

SEQ ID NO: 324071 - DNA, 34 bp, Artificial Sequence
  Description of Artificial Sequence: Synthetic oligonucleotide
gaccagattatgacaggtgatgagactaggaacc

SEQ ID NO: 324072 - DNA, 35 bp, Artificial Sequence
  Description of Artificial Sequence: Synthetic oligonucleotide
accagattatgacaggtgatgagactaggaacctg

SEQ ID NO: 324073 - DNA, 34 bp, Artificial Sequence
  Description of Artificial Sequence: Synthetic oligonucleotide
ccagattatgacaggtgatgagactaggaacctg

SEQ ID NO: 324074 - DNA, 34 bp, Artificial Sequence
  Description of Artificial Sequence: Synthetic oligonucleotide
cagattatgacaggtgatgagactaggaacctgg

SEQ ID NO: 324075 - DNA, 35 bp, Artificial Sequence
  Description of Artificial Sequence: Synthetic oligonucleotide
agattatgacaggtgatgagactaggaacctggag

SEQ ID NO: 324076 - DNA, 34 bp, Artificial Sequence
  Description of Artificial Sequence: Synthetic oligonucleotide
gattatgacaggtgatgagactaggaacctggag

SEQ ID NO: 324077 - DNA, 37 bp, Artificial Sequence
  Description of Artificial Sequence: Synthetic oligonucleotide
attatgacaggtgatgagactaggaacctggagaatg

SEQ ID NO: 324078 - DNA, 36 bp, Artificial Sequence
  Description of Artificial Sequence: Synthetic oligonucleotide
ttatgacaggtgatgagactaggaacctggagaatg

SEQ ID NO: 324079 - DNA, 35 bp, Artificial Sequence
  Description of Artificial Sequence: Synthetic oligonucleotide
tatgacaggtgatgagactaggaacctggagaatg

SEQ ID NO: 324080 - DNA, 34 bp, Artificial Sequence
  Description of Artificial Sequence: Synthetic oligonucleotide
atgacaggtgatgagactaggaacctggagaatg

SEQ ID NO: 324081 - DNA, 33 bp, Artificial Sequence
  Description of Artificial Sequence: Synthetic oligonucleotide
tgacaggtgatgagactaggaacctggagaatg

SEQ ID NO: 324082 - DNA, 32 bp, Artificial Sequence
  Description of Artificial Sequence: Synthetic oligonucleotide
gacaggtgatgagactaggaacctggagaatg

SEQ ID NO: 324083 - DNA, 33 bp, Artificial Sequence
  Description of Artificial Sequence: Synthetic oligonucleotide
acaggtgatgagactaggaacctggagaatgtg

SEQ ID NO: 324084 - DNA, 32 bp, Artificial Sequence
  Description of Artificial Sequence: Synthetic oligonucleotide
caggtgatgagactaggaacctggagaatgtg

SEQ ID NO: 324085 - DNA, 32 bp, Artificial Sequence
  Description of Artificial Sequence: Synthetic oligonucleotide
aggtgatgagactaggaacctggagaatgtgg

SEQ ID NO: 324086 - DNA, 31 bp, Artificial Sequence
  Description of Artificial Sequence: Synthetic oligonucleotide
ggtgatgagactaggaacctggagaatgtgg

SEQ ID NO: 324087 - DNA, 32 bp, Artificial Sequence
  Description of Artificial Sequence: Synthetic oligonucleotide
gtgatgagactaggaacctggagaatgtggtc

SEQ ID NO: 324088 - DNA, 34 bp, Artificial Sequence
  Description of Artificial Sequence: Synthetic oligonucleotide
tgatgagactaggaacctggagaatgtggtcatg

SEQ ID NO: 324089 - DNA, 33 bp, Artificial Sequence
  Description of Artificial Sequence: Synthetic oligonucleotide
gatgagactaggaacctggagaatgtggtcatg

SEQ ID NO: 324090 - DNA, 35 bp, Artificial Sequence
  Description of Artificial Sequence: Synthetic oligonucleotide
atgagactaggaacctggagaatgtggtcatgaag

SEQ ID NO: 324091 - DNA, 34 bp, Artificial Sequence
  Description of Artificial Sequence: Synthetic oligonucleotide
tgagactaggaacctggagaatgtggtcatgaag

SEQ ID NO: 324092 - DNA, 33 bp, Artificial Sequence
  Description of Artificial Sequence: Synthetic oligonucleotide
gagactaggaacctggagaatgtggtcatgaag

SEQ ID NO: 324093 - DNA, 36 bp, Artificial Sequence
  Description of Artificial Sequence: Synthetic oligonucleotide
agactaggaacctggagaatgtggtcatgaagatag

SEQ ID NO: 324094 - DNA, 35 bp, Artificial Sequence
  Description of Artificial Sequence: Synthetic oligonucleotide
gactaggaacctggagaatgtggtcatgaagatag

SEQ ID NO: 324095 - DNA, 35 bp, Artificial Sequence
  Description of Artificial Sequence: Synthetic oligonucleotide
actaggaacctggagaatgtggtcatgaagatagg

SEQ ID NO: 324096 - DNA, 34 bp, Artificial Sequence
  Description of Artificial Sequence: Synthetic oligonucleotide
ctaggaacctggagaatgtggtcatgaagatagg

SEQ ID NO: 324097 - DNA, 34 bp, Artificial Sequence
  Description of Artificial Sequence: Synthetic oligonucleotide
taggaacctggagaatgtggtcatgaagataggg

SEQ ID NO: 324098 - DNA, 33 bp, Artificial Sequence
  Description of Artificial Sequence: Synthetic oligonucleotide
aggaacctggagaatgtggtcatgaagataggg

SEQ ID NO: 324099 - DNA, 32 bp, Artificial Sequence
  Description of Artificial Sequence: Synthetic oligonucleotide
ggaacctggagaatgtggtcatgaagataggg

SEQ ID NO: 324100 - DNA, 32 bp, Artificial Sequence
  Description of Artificial Sequence: Synthetic oligonucleotide
gaacctggagaatgtggtcatgaagatagggg

SEQ ID NO: 324101 - DNA, 33 bp, Artificial Sequence
  Description of Artificial Sequence: Synthetic oligonucleotide
aacctggagaatgtggtcatgaagataggggtg

SEQ ID NO: 324102 - DNA, 32 bp, Artificial Sequence
  Description of Artificial Sequence: Synthetic oligonucleotide
acctggagaatgtggtcatgaagataggggtg

SEQ ID NO: 324103 - DNA, 31 bp, Artificial Sequence
  Description of Artificial Sequence: Synthetic oligonucleotide
cctggagaatgtggtcatgaagataggggtg

SEQ ID NO: 324104 - DNA, 30 bp, Artificial Sequence
  Description of Artificial Sequence: Synthetic oligonucleotide
atggaggactgccccactaaggttagagtc

SEQ ID NO: 324105 - DNA, 29 bp, Artificial Sequence
  Description of Artificial Sequence: Synthetic oligonucleotide
tggaggactgccccactaaggttagagtc

SEQ ID NO: 324106 - DNA, 28 bp, Artificial Sequence
  Description of Artificial Sequence: Synthetic oligonucleotide
ggaggactgccccactaaggttagagtc

SEQ ID NO: 324107 - DNA, 28 bp, Artificial Sequence
  Description of Artificial Sequence: Synthetic oligonucleotide
gaggactgccccactaaggttagagtcg

SEQ ID NO: 324108 - DNA, 29 bp, Artificial Sequence
  Description of Artificial Sequence: Synthetic oligonucleotide
aggactgccccactaaggttagagtcgac

SEQ ID NO: 324109 - DNA, 28 bp, Artificial Sequence
  Description of Artificial Sequence: Synthetic oligonucleotide
ggactgccccactaaggttagagtcgac

SEQ ID NO: 324110 - DNA, 29 bp, Artificial Sequence
  Description of Artificial Sequence: Synthetic oligonucleotide
gactgccccactaaggttagagtcgacag

SEQ ID NO: 324111 - DNA, 29 bp, Artificial Sequence
  Description of Artificial Sequence: Synthetic oligonucleotide
actgccccactaaggttagagtcgacagc

SEQ ID NO: 324112 - DNA, 28 bp, Artificial Sequence
  Description of Artificial Sequence: Synthetic oligonucleotide
ctgccccactaaggttagagtcgacagc

SEQ ID NO: 324113 - DNA, 28 bp, Artificial Sequence
  Description of Artificial Sequence: Synthetic oligonucleotide
tgccccactaaggttagagtcgacagcc

SEQ ID NO: 324114 - DNA, 27 bp, Artificial Sequence
  Description of Artificial Sequence: Synthetic oligonucleotide
gccccactaaggttagagtcgacagcc

SEQ ID NO: 324115 - DNA, 27 bp, Artificial Sequence
  Description of Artificial Sequence: Synthetic oligonucleotide
ccccactaaggttagagtcgacagccc

SEQ ID NO: 324116 - DNA, 27 bp, Artificial Sequence
  Description of Artificial Sequence: Synthetic oligonucleotide
cccactaaggttagagtcgacagcccc

SEQ ID NO: 324117 - DNA, 28 bp, Artificial Sequence
  Description of Artificial Sequence: Synthetic oligonucleotide
ccactaaggttagagtcgacagcccctc

SEQ ID NO: 324118 - DNA, 31 bp, Artificial Sequence
  Description of Artificial Sequence: Synthetic oligonucleotide
cactaaggttagagtcgacagcccctctatg

SEQ ID NO: 324119 - DNA, 31 bp, Artificial Sequence
  Description of Artificial Sequence: Synthetic oligonucleotide
actaaggttagagtcgacagcccctctatgg

SEQ ID NO: 324120 - DNA, 30 bp, Artificial Sequence
  Description of Artificial Sequence: Synthetic oligonucleotide
ctaaggttagagtcgacagcccctctatgg

SEQ ID NO: 324121 - DNA, 33 bp, Artificial Sequence
  Description of Artificial Sequence: Synthetic oligonucleotide
taaggttagagtcgacagcccctctatggttac

SEQ ID NO: 324122 - DNA, 32 bp, Artificial Sequence
  Description of Artificial Sequence: Synthetic oligonucleotide
aaggttagagtcgacagcccctctatggttac

SEQ ID NO: 324123 - DNA, 31 bp, Artificial Sequence
  Description of Artificial Sequence: Synthetic oligonucleotide
aggttagagtcgacagcccctctatggttac

SEQ ID NO: 324124 - DNA, 30 bp, Artificial Sequence
  Description of Artificial Sequence: Synthetic oligonucleotide
ggttagagtcgacagcccctctatggttac

SEQ ID NO: 324125 - DNA, 30 bp, Artificial Sequence
  Description of Artificial Sequence: Synthetic oligonucleotide
gttagagtcgacagcccctctatggttacg

SEQ ID NO: 324126 - DNA, 30 bp, Artificial Sequence
  Description of Artificial Sequence: Synthetic oligonucleotide
ttagagtcgacagcccctctatggttacgg

SEQ ID NO: 324127 - DNA, 29 bp, Artificial Sequence
  Description of Artificial Sequence: Synthetic oligonucleotide
tagagtcgacagcccctctatggttacgg

SEQ ID NO: 324128 - DNA, 28 bp, Artificial Sequence
  Description of Artificial Sequence: Synthetic oligonucleotide
agagtcgacagcccctctatggttacgg

SEQ ID NO: 324129 - DNA, 27 bp, Artificial Sequence
  Description of Artificial Sequence: Synthetic oligonucleotide
gagtcgacagcccctctatggttacgg

SEQ ID NO: 324130 - DNA, 27 bp, Artificial Sequence
  Description of Artificial Sequence: Synthetic oligonucleotide
agtcgacagcccctctatggttacggg

SEQ ID NO: 324131 - DNA, 27 bp, Artificial Sequence
  Description of Artificial Sequence: Synthetic oligonucleotide
gtcgacagcccctctatggttacgggt

SEQ ID NO: 324132 - DNA, 27 bp, Artificial Sequence
  Description of Artificial Sequence: Synthetic oligonucleotide
tcgacagcccctctatggttacgggtg

SEQ ID NO: 324133 - DNA, 27 bp, Artificial Sequence
  Description of Artificial Sequence: Synthetic oligonucleotide
cgacagcccctctatggttacgggtga

SEQ ID NO: 324134 - DNA, 30 bp, Artificial Sequence
  Description of Artificial Sequence: Synthetic oligonucleotide
gacagcccctctatggttacgggtgaaaag

SEQ ID NO: 324135 - DNA, 30 bp, Artificial Sequence
  Description of Artificial Sequence: Synthetic oligonucleotide
acagcccctctatggttacgggtgaaaagc

SEQ ID NO: 324136 - DNA, 29 bp, Artificial Sequence
  Description of Artificial Sequence: Synthetic oligonucleotide
cagcccctctatggttacgggtgaaaagc

SEQ ID NO: 324137 - DNA, 30 bp, Artificial Sequence
  Description of Artificial Sequence: Synthetic oligonucleotide
agcccctctatggttacgggtgaaaagcag

SEQ ID NO: 324138 - DNA, 29 bp, Artificial Sequence
  Description of Artificial Sequence: Synthetic oligonucleotide
gcccctctatggttacgggtgaaaagcag

SEQ ID NO: 324139 - DNA, 29 bp, Artificial Sequence
  Description of Artificial Sequence: Synthetic oligonucleotide
cccctctatggttacgggtgaaaagcagg

SEQ ID NO: 324140 - DNA, 32 bp, Artificial Sequence
  Description of Artificial Sequence: Synthetic oligonucleotide
ccctctatggttacgggtgaaaagcaggtttc

SEQ ID NO: 324141 - DNA, 32 bp, Artificial Sequence
  Description of Artificial Sequence: Synthetic oligonucleotide
cctctatggttacgggtgaaaagcaggtttcg

SEQ ID NO: 324142 - DNA, 32 bp, Artificial Sequence
  Description of Artificial Sequence: Synthetic oligonucleotide
ctctatggttacgggtgaaaagcaggtttcgg

SEQ ID NO: 324143 - DNA, 32 bp, Artificial Sequence
  Description of Artificial Sequence: Synthetic oligonucleotide
tctatggttacgggtgaaaagcaggtttcggc

SEQ ID NO: 324144 - DNA, 31 bp, Artificial Sequence
  Description of Artificial Sequence: Synthetic oligonucleotide
ctatggttacgggtgaaaagcaggtttcggc

SEQ ID NO: 324145 - DNA, 33 bp, Artificial Sequence
  Description of Artificial Sequence: Synthetic oligonucleotide
tatggttacgggtgaaaagcaggtttcggcatg

SEQ ID NO: 324146 - DNA, 32 bp, Artificial Sequence
  Description of Artificial Sequence: Synthetic oligonucleotide
atggttacgggtgaaaagcaggtttcggcatg

SEQ ID NO: 324147 - DNA, 31 bp, Artificial Sequence
  Description of Artificial Sequence: Synthetic oligonucleotide
tggttacgggtgaaaagcaggtttcggcatg

SEQ ID NO: 324148 - DNA, 30 bp, Artificial Sequence
  Description of Artificial Sequence: Synthetic oligonucleotide
ggttacgggtgaaaagcaggtttcggcatg

SEQ ID NO: 324149 - DNA, 31 bp, Artificial Sequence
  Description of Artificial Sequence: Synthetic oligonucleotide
gttacgggtgaaaagcaggtttcggcatgtc

SEQ ID NO: 324150 - DNA, 33 bp, Artificial Sequence
  Description of Artificial Sequence: Synthetic oligonucleotide
ttacgggtgaaaagcaggtttcggcatgtcaag

SEQ ID NO: 324151 - DNA, 32 bp, Artificial Sequence
  Description of Artificial Sequence: Synthetic oligonucleotide
tacgggtgaaaagcaggtttcggcatgtcaag

SEQ ID NO: 324152 - DNA, 31 bp, Artificial Sequence
  Description of Artificial Sequence: Synthetic oligonucleotide
acgggtgaaaagcaggtttcggcatgtcaag

SEQ ID NO: 324153 - DNA, 30 bp, Artificial Sequence
  Description of Artificial Sequence: Synthetic oligonucleotide
cgggtgaaaagcaggtttcggcatgtcaag

SEQ ID NO: 324154 - DNA, 30 bp, Artificial Sequence
  Description of Artificial Sequence: Synthetic oligonucleotide
gggtgaaaagcaggtttcggcatgtcaagc

SEQ ID NO: 324155 - DNA, 30 bp, Artificial Sequence
  Description of Artificial Sequence: Synthetic oligonucleotide
ggtgaaaagcaggtttcggcatgtcaagcg

SEQ ID NO: 324156 - DNA, 31 bp, Artificial Sequence
  Description of Artificial Sequence: Synthetic oligonucleotide
gtgaaaagcaggtttcggcatgtcaagcgag

SEQ ID NO: 324157 - DNA, 33 bp, Artificial Sequence
  Description of Artificial Sequence: Synthetic oligonucleotide
tgaaaagcaggtttcggcatgtcaagcgagaag

SEQ ID NO: 324158 - DNA, 32 bp, Artificial Sequence
  Description of Artificial Sequence: Synthetic oligonucleotide
gaaaagcaggtttcggcatgtcaagcgagaag

SEQ ID NO: 324159 - DNA, 32 bp, Artificial Sequence
  Description of Artificial Sequence: Synthetic oligonucleotide
aaaagcaggtttcggcatgtcaagcgagaagg

SEQ ID NO: 324160 - DNA, 31 bp, Artificial Sequence
  Description of Artificial Sequence: Synthetic oligonucleotide
aaagcaggtttcggcatgtcaagcgagaagg

SEQ ID NO: 324161 - DNA, 30 bp, Artificial Sequence
  Description of Artificial Sequence: Synthetic oligonucleotide
aagcaggtttcggcatgtcaagcgagaagg

SEQ ID NO: 324162 - DNA, 29 bp, Artificial Sequence
  Description of Artificial Sequence: Synthetic oligonucleotide
agcaggtttcggcatgtcaagcgagaagg

SEQ ID NO: 324163 - DNA, 28 bp, Artificial Sequence
  Description of Artificial Sequence: Synthetic oligonucleotide
gcaggtttcggcatgtcaagcgagaagg

SEQ ID NO: 324164 - DNA, 29 bp, Artificial Sequence
  Description of Artificial Sequence: Synthetic oligonucleotide
caggtttcggcatgtcaagcgagaaggtg

SEQ ID NO: 324165 - DNA, 29 bp, Artificial Sequence
  Description of Artificial Sequence: Synthetic oligonucleotide
aggtttcggcatgtcaagcgagaaggtgg

SEQ ID NO: 324166 - DNA, 28 bp, Artificial Sequence
  Description of Artificial Sequence: Synthetic oligonucleotide
ggtttcggcatgtcaagcgagaaggtgg

SEQ ID NO: 324167 - DNA, 30 bp, Artificial Sequence
  Description of Artificial Sequence: Synthetic oligonucleotide
gtttcggcatgtcaagcgagaaggtggttc

SEQ ID NO: 324168 - DNA, 30 bp, Artificial Sequence
  Description of Artificial Sequence: Synthetic oligonucleotide
tttcggcatgtcaagcgagaaggtggttcc

SEQ ID NO: 324169 - DNA, 29 bp, Artificial Sequence
  Description of Artificial Sequence: Synthetic oligonucleotide
ttcggcatgtcaagcgagaaggtggttcc

SEQ ID NO: 324170 - DNA, 28 bp, Artificial Sequence
  Description of Artificial Sequence: Synthetic oligonucleotide
tcggcatgtcaagcgagaaggtggttcc

SEQ ID NO: 324171 - DNA, 27 bp, Artificial Sequence
  Description of Artificial Sequence: Synthetic oligonucleotide
cggcatgtcaagcgagaaggtggttcc

SEQ ID NO: 324172 - DNA, 27 bp, Artificial Sequence
  Description of Artificial Sequence: Synthetic oligonucleotide
ggcatgtcaagcgagaaggtggttccc

SEQ ID NO: 324173 - DNA, 27 bp, Artificial Sequence
  Description of Artificial Sequence: Synthetic oligonucleotide
gcatgtcaagcgagaaggtggttcccc

SEQ ID NO: 324174 - DNA, 30 bp, Artificial Sequence
  Description of Artificial Sequence: Synthetic oligonucleotide
catgtcaagcgagaaggtggttccccaaac

SEQ ID NO: 324175 - DNA, 30 bp, Artificial Sequence
  Description of Artificial Sequence: Synthetic oligonucleotide
atgtcaagcgagaaggtggttccccaaacc

SEQ ID NO: 324176 - DNA, 29 bp, Artificial Sequence
  Description of Artificial Sequence: Synthetic oligonucleotide
tgtcaagcgagaaggtggttccccaaacc

SEQ ID NO: 324177 - DNA, 28 bp, Artificial Sequence
  Description of Artificial Sequence: Synthetic oligonucleotide
gtcaagcgagaaggtggttccccaaacc

SEQ ID NO: 324178 - DNA, 29 bp, Artificial Sequence
  Description of Artificial Sequence: Synthetic oligonucleotide
tcaagcgagaaggtggttccccaaacctc

SEQ ID NO: 324179 - DNA, 28 bp, Artificial Sequence
  Description of Artificial Sequence: Synthetic oligonucleotide
caagcgagaaggtggttccccaaacctc

SEQ ID NO: 324180 - DNA, 30 bp, Artificial Sequence
  Description of Artificial Sequence: Synthetic oligonucleotide
aagcgagaaggtggttccccaaacctcttg

SEQ ID NO: 324181 - DNA, 29 bp, Artificial Sequence
  Description of Artificial Sequence: Synthetic oligonucleotide
agcgagaaggtggttccccaaacctcttg

SEQ ID NO: 324182 - DNA, 28 bp, Artificial Sequence
  Description of Artificial Sequence: Synthetic oligonucleotide
gcgagaaggtggttccccaaacctcttg

SEQ ID NO: 324183 - DNA, 28 bp, Artificial Sequence
  Description of Artificial Sequence: Synthetic oligonucleotide
cgagaaggtggttccccaaacctcttgg

SEQ ID NO: 324184 - DNA, 28 bp, Artificial Sequence
  Description of Artificial Sequence: Synthetic oligonucleotide
gagaaggtggttccccaaacctcttggc

SEQ ID NO: 324185 - DNA, 31 bp, Artificial Sequence
  Description of Artificial Sequence: Synthetic oligonucleotide
agaaggtggttccccaaacctcttggctttg

SEQ ID NO: 324186 - DNA, 30 bp, Artificial Sequence
  Description of Artificial Sequence: Synthetic oligonucleotide
gaaggtggttccccaaacctcttggctttg

SEQ ID NO: 324187 - DNA, 31 bp, Artificial Sequence
  Description of Artificial Sequence: Synthetic oligonucleotide
aaggtggttccccaaacctcttggctttgtc

SEQ ID NO: 324188 - DNA, 30 bp, Artificial Sequence
  Description of Artificial Sequence: Synthetic oligonucleotide
aggtggttccccaaacctcttggctttgtc

SEQ ID NO: 324189 - DNA, 29 bp, Artificial Sequence
  Description of Artificial Sequence: Synthetic oligonucleotide
ggtggttccccaaacctcttggctttgtc

SEQ ID NO: 324190 - DNA, 30 bp, Artificial Sequence
  Description of Artificial Sequence: Synthetic oligonucleotide
gtggttccccaaacctcttggctttgtcac

SEQ ID NO: 324191 - DNA, 30 bp, Artificial Sequence
  Description of Artificial Sequence: Synthetic oligonucleotide
tggttccccaaacctcttggctttgtcacc

SEQ ID NO: 324192 - DNA, 29 bp, Artificial Sequence
  Description of Artificial Sequence: Synthetic oligonucleotide
ggttccccaaacctcttggctttgtcacc

SEQ ID NO: 324193 - DNA, 29 bp, Artificial Sequence
  Description of Artificial Sequence: Synthetic oligonucleotide
gttccccaaacctcttggctttgtcaccg

SEQ ID NO: 324194 - DNA, 29 bp, Artificial Sequence
  Description of Artificial Sequence: Synthetic oligonucleotide
ttccccaaacctcttggctttgtcaccgg

SEQ ID NO: 324195 - DNA, 28 bp, Artificial Sequence
  Description of Artificial Sequence: Synthetic oligonucleotide
tccccaaacctcttggctttgtcaccgg

SEQ ID NO: 324196 - DNA, 27 bp, Artificial Sequence
  Description of Artificial Sequence: Synthetic oligonucleotide
ccccaaacctcttggctttgtcaccgg

SEQ ID NO: 324197 - DNA, 28 bp, Artificial Sequence
  Description of Artificial Sequence: Synthetic oligonucleotide
cccaaacctcttggctttgtcaccggag

SEQ ID NO: 324198 - DNA, 29 bp, Artificial Sequence
  Description of Artificial Sequence: Synthetic oligonucleotide
ccaaacctcttggctttgtcaccggagac

SEQ ID NO: 324199 - DNA, 31 bp, Artificial Sequence
  Description of Artificial Sequence: Synthetic oligonucleotide
caaacctcttggctttgtcaccggagacatg

SEQ ID NO: 324200 - DNA, 34 bp, Artificial Sequence
  Description of Artificial Sequence: Synthetic oligonucleotide
aaacctcttggctttgtcaccggagacatgaaac

SEQ ID NO: 324201 - DNA, 33 bp, Artificial Sequence
  Description of Artificial Sequence: Synthetic oligonucleotide
aacctcttggctttgtcaccggagacatgaaac

SEQ ID NO: 324202 - DNA, 32 bp, Artificial Sequence
  Description of Artificial Sequence: Synthetic oligonucleotide
acctcttggctttgtcaccggagacatgaaac

SEQ ID NO: 324203 - DNA, 31 bp, Artificial Sequence
  Description of Artificial Sequence: Synthetic oligonucleotide
cctcttggctttgtcaccggagacatgaaac

SEQ ID NO: 324204 - DNA, 33 bp, Artificial Sequence
  Description of Artificial Sequence: Synthetic oligonucleotide
ctcttggctttgtcaccggagacatgaaacaac

SEQ ID NO: 324205 - DNA, 35 bp, Artificial Sequence
  Description of Artificial Sequence: Synthetic oligonucleotide
tcttggctttgtcaccggagacatgaaacaacttg

SEQ ID NO: 324206 - DNA, 34 bp, Artificial Sequence
  Description of Artificial Sequence: Synthetic oligonucleotide
cttggctttgtcaccggagacatgaaacaacttg

SEQ ID NO: 324207 - DNA, 34 bp, Artificial Sequence
  Description of Artificial Sequence: Synthetic oligonucleotide
ttggctttgtcaccggagacatgaaacaacttgc

SEQ ID NO: 324208 - DNA, 33 bp, Artificial Sequence
  Description of Artificial Sequence: Synthetic oligonucleotide
tggctttgtcaccggagacatgaaacaacttgc

SEQ ID NO: 324209 - DNA, 32 bp, Artificial Sequence
  Description of Artificial Sequence: Synthetic oligonucleotide
ggctttgtcaccggagacatgaaacaacttgc

SEQ ID NO: 324210 - DNA, 32 bp, Artificial Sequence
  Description of Artificial Sequence: Synthetic oligonucleotide
gctttgtcaccggagacatgaaacaacttgcc

SEQ ID NO: 324211 - DNA, 34 bp, Artificial Sequence
  Description of Artificial Sequence: Synthetic oligonucleotide
ctttgtcaccggagacatgaaacaacttgccatc

SEQ ID NO: 324212 - DNA, 34 bp, Artificial Sequence
  Description of Artificial Sequence: Synthetic oligonucleotide
tttgtcaccggagacatgaaacaacttgccatcc

SEQ ID NO: 324213 - DNA, 33 bp, Artificial Sequence
  Description of Artificial Sequence: Synthetic oligonucleotide
ttgtcaccggagacatgaaacaacttgccatcc

SEQ ID NO: 324214 - DNA, 32 bp, Artificial Sequence
  Description of Artificial Sequence: Synthetic oligonucleotide
tgtcaccggagacatgaaacaacttgccatcc

SEQ ID NO: 324215 - DNA, 31 bp, Artificial Sequence
  Description of Artificial Sequence: Synthetic oligonucleotide
gtcaccggagacatgaaacaacttgccatcc

SEQ ID NO: 324216 - DNA, 32 bp, Artificial Sequence
  Description of Artificial Sequence: Synthetic oligonucleotide
tcaccggagacatgaaacaacttgccatccag

SEQ ID NO: 324217 - DNA, 31 bp, Artificial Sequence
  Description of Artificial Sequence: Synthetic oligonucleotide
caccggagacatgaaacaacttgccatccag

SEQ ID NO: 324218 - DNA, 31 bp, Artificial Sequence
  Description of Artificial Sequence: Synthetic oligonucleotide
accggagacatgaaacaacttgccatccagc

SEQ ID NO: 324219 - DNA, 30 bp, Artificial Sequence
  Description of Artificial Sequence: Synthetic oligonucleotide
ccggagacatgaaacaacttgccatccagc

SEQ ID NO: 324220 - DNA, 35 bp, Artificial Sequence
  Description of Artificial Sequence: Synthetic oligonucleotide
cggagacatgaaacaacttgccatccagcttaatg

SEQ ID NO: 324221 - DNA, 36 bp, Artificial Sequence
  Description of Artificial Sequence: Synthetic oligonucleotide
ggagacatgaaacaacttgccatccagcttaatgac

SEQ ID NO: 324222 - DNA, 39 bp, Artificial Sequence
  Description of Artificial Sequence: Synthetic oligonucleotide
gagacatgaaacaacttgccatccagcttaatgacaaac

SEQ ID NO: 324223 - DNA, 39 bp, Artificial Sequence
  Description of Artificial Sequence: Synthetic oligonucleotide
agacatgaaacaacttgccatccagcttaatgacaaacc

SEQ ID NO: 324224 - DNA, 38 bp, Artificial Sequence
  Description of Artificial Sequence: Synthetic oligonucleotide
gacatgaaacaacttgccatccagcttaatgacaaacc

SEQ ID NO: 324225 - DNA, 38 bp, Artificial Sequence
  Description of Artificial Sequence: Synthetic oligonucleotide
acatgaaacaacttgccatccagcttaatgacaaaccc

SEQ ID NO: 324226 - DNA, 37 bp, Artificial Sequence
  Description of Artificial Sequence: Synthetic oligonucleotide
catgaaacaacttgccatccagcttaatgacaaaccc

SEQ ID NO: 324227 - DNA, 37 bp, Artificial Sequence
  Description of Artificial Sequence: Synthetic oligonucleotide
atgaaacaacttgccatccagcttaatgacaaacccc

SEQ ID NO: 324228 - DNA, 36 bp, Artificial Sequence
  Description of Artificial Sequence: Synthetic oligonucleotide
tgaaacaacttgccatccagcttaatgacaaacccc

SEQ ID NO: 324229 - DNA, 35 bp, Artificial Sequence
  Description of Artificial Sequence: Synthetic oligonucleotide
gaaacaacttgccatccagcttaatgacaaacccc

SEQ ID NO: 324230 - DNA, 36 bp, Artificial Sequence
  Description of Artificial Sequence: Synthetic oligonucleotide
aaacaacttgccatccagcttaatgacaaacccctg

SEQ ID NO: 324231 - DNA, 35 bp, Artificial Sequence
  Description of Artificial Sequence: Synthetic oligonucleotide
aacaacttgccatccagcttaatgacaaacccctg

SEQ ID NO: 324232 - DNA, 34 bp, Artificial Sequence
  Description of Artificial Sequence: Synthetic oligonucleotide
acaacttgccatccagcttaatgacaaacccctg

SEQ ID NO: 324233 - DNA, 33 bp, Artificial Sequence
  Description of Artificial Sequence: Synthetic oligonucleotide
caacttgccatccagcttaatgacaaacccctg

SEQ ID NO: 324234 - DNA, 33 bp, Artificial Sequence
  Description of Artificial Sequence: Synthetic oligonucleotide
aacttgccatccagcttaatgacaaacccctgg

SEQ ID NO: 324235 - DNA, 32 bp, Artificial Sequence
  Description of Artificial Sequence: Synthetic oligonucleotide
acttgccatccagcttaatgacaaacccctgg

SEQ ID NO: 324236 - DNA, 31 bp, Artificial Sequence
  Description of Artificial Sequence: Synthetic oligonucleotide
cttgccatccagcttaatgacaaacccctgg

SEQ ID NO: 324237 - DNA, 32 bp, Artificial Sequence
  Description of Artificial Sequence: Synthetic oligonucleotide
ttgccatccagcttaatgacaaacccctggtg

SEQ ID NO: 324238 - DNA, 31 bp, Artificial Sequence
  Description of Artificial Sequence: Synthetic oligonucleotide
tgccatccagcttaatgacaaacccctggtg

SEQ ID NO: 324239 - DNA, 30 bp, Artificial Sequence
  Description of Artificial Sequence: Synthetic oligonucleotide
gccatccagcttaatgacaaacccctggtg

SEQ ID NO: 324240 - DNA, 30 bp, Artificial Sequence
  Description of Artificial Sequence: Synthetic oligonucleotide
ccatccagcttaatgacaaacccctggtgc

SEQ ID NO: 324241 - DNA, 31 bp, Artificial Sequence
  Description of Artificial Sequence: Synthetic oligonucleotide
catccagcttaatgacaaacccctggtgctc

SEQ ID NO: 324242 - DNA, 31 bp, Artificial Sequence
  Description of Artificial Sequence: Synthetic oligonucleotide
atccagcttaatgacaaacccctggtgctcc

SEQ ID NO: 324243 - DNA, 30 bp, Artificial Sequence
  Description of Artificial Sequence: Synthetic oligonucleotide
tccagcttaatgacaaacccctggtgctcc

SEQ ID NO: 324244 - DNA, 29 bp, Artificial Sequence
  Description of Artificial Sequence: Synthetic oligonucleotide
ccagcttaatgacaaacccctggtgctcc

SEQ ID NO: 324245 - DNA, 30 bp, Artificial Sequence
  Description of Artificial Sequence: Synthetic oligonucleotide
cagcttaatgacaaacccctggtgctcctg

SEQ ID NO: 324246 - DNA, 32 bp, Artificial Sequence
  Description of Artificial Sequence: Synthetic oligonucleotide
agcttaatgacaaacccctggtgctcctgttc

SEQ ID NO: 324247 - DNA, 31 bp, Artificial Sequence
  Description of Artificial Sequence: Synthetic oligonucleotide
gcttaatgacaaacccctggtgctcctgttc

SEQ ID NO: 324248 - DNA, 34 bp, Artificial Sequence
  Description of Artificial Sequence: Synthetic oligonucleotide
cttaatgacaaacccctggtgctcctgttcattg

SEQ ID NO: 324249 - DNA, 35 bp, Artificial Sequence
  Description of Artificial Sequence: Synthetic oligonucleotide
ttaatgacaaacccctggtgctcctgttcattgag

SEQ ID NO: 324250 - DNA, 34 bp, Artificial Sequence
  Description of Artificial Sequence: Synthetic oligonucleotide
taatgacaaacccctggtgctcctgttcattgag

SEQ ID NO: 324251 - DNA, 33 bp, Artificial Sequence
  Description of Artificial Sequence: Synthetic oligonucleotide
aatgacaaacccctggtgctcctgttcattgag

SEQ ID NO: 324252 - DNA, 32 bp, Artificial Sequence
  Description of Artificial Sequence: Synthetic oligonucleotide
atgacaaacccctggtgctcctgttcattgag

SEQ ID NO: 324253 - DNA, 31 bp, Artificial Sequence
  Description of Artificial Sequence: Synthetic oligonucleotide
tgacaaacccctggtgctcctgttcattgag

SEQ ID NO: 324254 - DNA, 30 bp, Artificial Sequence
  Description of Artificial Sequence: Synthetic oligonucleotide
gacaaacccctggtgctcctgttcattgag

SEQ ID NO: 324255 - DNA, 31 bp, Artificial Sequence
  Description of Artificial Sequence: Synthetic oligonucleotide
acaaacccctggtgctcctgttcattgagtg

SEQ ID NO: 324256 - DNA, 30 bp, Artificial Sequence
  Description of Artificial Sequence: Synthetic oligonucleotide
caaacccctggtgctcctgttcattgagtg

SEQ ID NO: 324257 - DNA, 30 bp, Artificial Sequence
  Description of Artificial Sequence: Synthetic oligonucleotide
aaacccctggtgctcctgttcattgagtgg

SEQ ID NO: 324258 - DNA, 29 bp, Artificial Sequence
  Description of Artificial Sequence: Synthetic oligonucleotide
aacccctggtgctcctgttcattgagtgg

SEQ ID NO: 324259 - DNA, 28 bp, Artificial Sequence
  Description of Artificial Sequence: Synthetic oligonucleotide
acccctggtgctcctgttcattgagtgg

SEQ ID NO: 324260 - DNA, 27 bp, Artificial Sequence
  Description of Artificial Sequence: Synthetic oligonucleotide
cccctggtgctcctgttcattgagtgg

SEQ ID NO: 324261 - DNA, 30 bp, Artificial Sequence
  Description of Artificial Sequence: Synthetic oligonucleotide
ccctggtgctcctgttcattgagtggattc

SEQ ID NO: 324262 - DNA, 31 bp, Artificial Sequence
  Description of Artificial Sequence: Synthetic oligonucleotide
cctggtgctcctgttcattgagtggattctc

SEQ ID NO: 324263 - DNA, 31 bp, Artificial Sequence
  Description of Artificial Sequence: Synthetic oligonucleotide
ctggtgctcctgttcattgagtggattctcg

SEQ ID NO: 324264 - DNA, 31 bp, Artificial Sequence
  Description of Artificial Sequence: Synthetic oligonucleotide
tggtgctcctgttcattgagtggattctcgg

SEQ ID NO: 324265 - DNA, 30 bp, Artificial Sequence
  Description of Artificial Sequence: Synthetic oligonucleotide
ggtgctcctgttcattgagtggattctcgg

SEQ ID NO: 324266 - DNA, 30 bp, Artificial Sequence
  Description of Artificial Sequence: Synthetic oligonucleotide
gtgctcctgttcattgagtggattctcggg

SEQ ID NO: 324267 - DNA, 30 bp, Artificial Sequence
  Description of Artificial Sequence: Synthetic oligonucleotide
tgctcctgttcattgagtggattctcgggg

SEQ ID NO: 324268 - DNA, 29 bp, Artificial Sequence
  Description of Artificial Sequence: Synthetic oligonucleotide
gctcctgttcattgagtggattctcgggg

SEQ ID NO: 324269 - DNA, 29 bp, Artificial Sequence
  Description of Artificial Sequence: Synthetic oligonucleotide
ctcctgttcattgagtggattctcggggg

SEQ ID NO: 324270 - DNA, 29 bp, Artificial Sequence
  Description of Artificial Sequence: Synthetic oligonucleotide
tcctgttcattgagtggattctcgggggc

SEQ ID NO: 324271 - DNA, 28 bp, Artificial Sequence
  Description of Artificial Sequence: Synthetic oligonucleotide
cctgttcattgagtggattctcgggggc

SEQ ID NO: 324272 - DNA, 32 bp, Artificial Sequence
  Description of Artificial Sequence: Synthetic oligonucleotide
ctgttcattgagtggattctcgggggcatatg

SEQ ID NO: 324273 - DNA, 32 bp, Artificial Sequence
  Description of Artificial Sequence: Synthetic oligonucleotide
tgttcattgagtggattctcgggggcatatgc

SEQ ID NO: 324274 - DNA, 31 bp, Artificial Sequence
  Description of Artificial Sequence: Synthetic oligonucleotide
gttcattgagtggattctcgggggcatatgc

SEQ ID NO: 324275 - DNA, 31 bp, Artificial Sequence
  Description of Artificial Sequence: Synthetic oligonucleotide
ttcattgagtggattctcgggggcatatgcc

SEQ ID NO: 324276 - DNA, 30 bp, Artificial Sequence
  Description of Artificial Sequence: Synthetic oligonucleotide
tcattgagtggattctcgggggcatatgcc

SEQ ID NO: 324277 - DNA, 29 bp, Artificial Sequence
  Description of Artificial Sequence: Synthetic oligonucleotide
cattgagtggattctcgggggcatatgcc

SEQ ID NO: 324278 - DNA, 31 bp, Artificial Sequence
  Description of Artificial Sequence: Synthetic oligonucleotide
attgagtggattctcgggggcatatgccaag

SEQ ID NO: 324279 - DNA, 30 bp, Artificial Sequence
  Description of Artificial Sequence: Synthetic oligonucleotide
ttgagtggattctcgggggcatatgccaag

SEQ ID NO: 324280 - DNA, 29 bp, Artificial Sequence
  Description of Artificial Sequence: Synthetic oligonucleotide
tgagtggattctcgggggcatatgccaag

SEQ ID NO: 324281 - DNA, 28 bp, Artificial Sequence
  Description of Artificial Sequence: Synthetic oligonucleotide
gagtggattctcgggggcatatgccaag

SEQ ID NO: 324282 - DNA, 29 bp, Artificial Sequence
  Description of Artificial Sequence: Synthetic oligonucleotide
agtggattctcgggggcatatgccaagtg

SEQ ID NO: 324283 - DNA, 28 bp, Artificial Sequence
  Description of Artificial Sequence: Synthetic oligonucleotide
gtggattctcgggggcatatgccaagtg

SEQ ID NO: 324284 - DNA, 28 bp, Artificial Sequence
  Description of Artificial Sequence: Synthetic oligonucleotide
tggattctcgggggcatatgccaagtgg

SEQ ID NO: 324285 - DNA, 27 bp, Artificial Sequence
  Description of Artificial Sequence: Synthetic oligonucleotide
ggattctcgggggcatatgccaagtgg

SEQ ID NO: 324286 - DNA, 28 bp, Artificial Sequence
  Description of Artificial Sequence: Synthetic oligonucleotide
gattctcgggggcatatgccaagtggtc

SEQ ID NO: 324287 - DNA, 30 bp, Artificial Sequence
  Description of Artificial Sequence: Synthetic oligonucleotide
attctcgggggcatatgccaagtggtcttc

SEQ ID NO: 324288 - DNA, 29 bp, Artificial Sequence
  Description of Artificial Sequence: Synthetic oligonucleotide
ttctcgggggcatatgccaagtggtcttc

SEQ ID NO: 324289 - DNA, 28 bp, Artificial Sequence
  Description of Artificial Sequence: Synthetic oligonucleotide
tctcgggggcatatgccaagtggtcttc

SEQ ID NO: 324290 - DNA, 27 bp, Artificial Sequence
  Description of Artificial Sequence: Synthetic oligonucleotide
ctcgggggcatatgccaagtggtcttc

SEQ ID NO: 324291 - DNA, 27 bp, Artificial Sequence
  Description of Artificial Sequence: Synthetic oligonucleotide
tcgggggcatatgccaagtggtcttcg

SEQ ID NO: 324292 - DNA, 27 bp, Artificial Sequence
  Description of Artificial Sequence: Synthetic oligonucleotide
cgggggcatatgccaagtggtcttcgt

SEQ ID NO: 324293 - DNA, 27 bp, Artificial Sequence
  Description of Artificial Sequence: Synthetic oligonucleotide
gggggcatatgccaagtggtcttcgtc

SEQ ID NO: 324294 - DNA, 29 bp, Artificial Sequence
  Description of Artificial Sequence: Synthetic oligonucleotide
ggggcatatgccaagtggtcttcgtcaac

SEQ ID NO: 324295 - DNA, 31 bp, Artificial Sequence
  Description of Artificial Sequence: Synthetic oligonucleotide
gggcatatgccaagtggtcttcgtcaactac

SEQ ID NO: 324296 - DNA, 31 bp, Artificial Sequence
  Description of Artificial Sequence: Synthetic oligonucleotide
ggcatatgccaagtggtcttcgtcaactacc

SEQ ID NO: 324297 - DNA, 31 bp, Artificial Sequence
  Description of Artificial Sequence: Synthetic oligonucleotide
gcatatgccaagtggtcttcgtcaactaccc

SEQ ID NO: 324298 - DNA, 31 bp, Artificial Sequence
  Description of Artificial Sequence: Synthetic oligonucleotide
catatgccaagtggtcttcgtcaactacccc

SEQ ID NO: 324299 - DNA, 31 bp, Artificial Sequence
  Description of Artificial Sequence: Synthetic oligonucleotide
atatgccaagtggtcttcgtcaactaccccg

SEQ ID NO: 324300 - DNA, 30 bp, Artificial Sequence
  Description of Artificial Sequence: Synthetic oligonucleotide
tatgccaagtggtcttcgtcaactaccccg

SEQ ID NO: 324301 - DNA, 29 bp, Artificial Sequence
  Description of Artificial Sequence: Synthetic oligonucleotide
atgccaagtggtcttcgtcaactaccccg

SEQ ID NO: 324302 - DNA, 28 bp, Artificial Sequence
  Description of Artificial Sequence: Synthetic oligonucleotide
tgccaagtggtcttcgtcaactaccccg

SEQ ID NO: 324303 - DNA, 27 bp, Artificial Sequence
  Description of Artificial Sequence: Synthetic oligonucleotide
gccaagtggtcttcgtcaactaccccg

SEQ ID NO: 324304 - DNA, 28 bp, Artificial Sequence
  Description of Artificial Sequence: Synthetic oligonucleotide
ccaagtggtcttcgtcaactaccccgtc

SEQ ID NO: 324305 - DNA, 29 bp, Artificial Sequence
  Description of Artificial Sequence: Synthetic oligonucleotide
caagtggtcttcgtcaactaccccgtcac

SEQ ID NO: 324306 - DNA, 30 bp, Artificial Sequence
  Description of Artificial Sequence: Synthetic oligonucleotide
aagtggtcttcgtcaactaccccgtcactg

SEQ ID NO: 324307 - DNA, 29 bp, Artificial Sequence
  Description of Artificial Sequence: Synthetic oligonucleotide
agtggtcttcgtcaactaccccgtcactg

SEQ ID NO: 324308 - DNA, 28 bp, Artificial Sequence
  Description of Artificial Sequence: Synthetic oligonucleotide
gtggtcttcgtcaactaccccgtcactg

SEQ ID NO: 324309 - DNA, 28 bp, Artificial Sequence
  Description of Artificial Sequence: Synthetic oligonucleotide
tggtcttcgtcaactaccccgtcactgg

SEQ ID NO: 324310 - DNA, 27 bp, Artificial Sequence
  Description of Artificial Sequence: Synthetic oligonucleotide
ggtcttcgtcaactaccccgtcactgg

SEQ ID NO: 324311 - DNA, 30 bp, Artificial Sequence
  Description of Artificial Sequence: Synthetic oligonucleotide
gtcttcgtcaactaccccgtcactggaatc

SEQ ID NO: 324312 - DNA, 30 bp, Artificial Sequence
  Description of Artificial Sequence: Synthetic oligonucleotide
tcttcgtcaactaccccgtcactggaatcc

SEQ ID NO: 324313 - DNA, 29 bp, Artificial Sequence
  Description of Artificial Sequence: Synthetic oligonucleotide
cttcgtcaactaccccgtcactggaatcc

SEQ ID NO: 324314 - DNA, 30 bp, Artificial Sequence
  Description of Artificial Sequence: Synthetic oligonucleotide
ttcgtcaactaccccgtcactggaatcctc

SEQ ID NO: 324315 - DNA, 29 bp, Artificial Sequence
  Description of Artificial Sequence: Synthetic oligonucleotide
tcgtcaactaccccgtcactggaatcctc

SEQ ID NO: 324316 - DNA, 28 bp, Artificial Sequence
  Description of Artificial Sequence: Synthetic oligonucleotide
cgtcaactaccccgtcactggaatcctc

SEQ ID NO: 324317 - DNA, 31 bp, Artificial Sequence
  Description of Artificial Sequence: Synthetic oligonucleotide
gtcaactaccccgtcactggaatcctcattc

SEQ ID NO: 324318 - DNA, 32 bp, Artificial Sequence
  Description of Artificial Sequence: Synthetic oligonucleotide
tcaactaccccgtcactggaatcctcattctg

SEQ ID NO: 324319 - DNA, 31 bp, Artificial Sequence
  Description of Artificial Sequence: Synthetic oligonucleotide
caactaccccgtcactggaatcctcattctg

SEQ ID NO: 324320 - DNA, 31 bp, Artificial Sequence
  Description of Artificial Sequence: Synthetic oligonucleotide
aactaccccgtcactggaatcctcattctgg

SEQ ID NO: 324321 - DNA, 30 bp, Artificial Sequence
  Description of Artificial Sequence: Synthetic oligonucleotide
actaccccgtcactggaatcctcattctgg

SEQ ID NO: 324322 - DNA, 29 bp, Artificial Sequence
  Description of Artificial Sequence: Synthetic oligonucleotide
ctaccccgtcactggaatcctcattctgg

SEQ ID NO: 324323 - DNA, 31 bp, Artificial Sequence
  Description of Artificial Sequence: Synthetic oligonucleotide
taccccgtcactggaatcctcattctggtac

SEQ ID NO: 324324 - DNA, 30 bp, Artificial Sequence
  Description of Artificial Sequence: Synthetic oligonucleotide
accccgtcactggaatcctcattctggtac

SEQ ID NO: 324325 - DNA, 29 bp, Artificial Sequence
  Description of Artificial Sequence: Synthetic oligonucleotide
ccccgtcactggaatcctcattctggtac

SEQ ID NO: 324326 - DNA, 29 bp, Artificial Sequence
  Description of Artificial Sequence: Synthetic oligonucleotide
cccgtcactggaatcctcattctggtacg

SEQ ID NO: 324327 - DNA, 30 bp, Artificial Sequence
  Description of Artificial Sequence: Synthetic oligonucleotide
ccgtcactggaatcctcattctggtacgac

SEQ ID NO: 324328 - DNA, 32 bp, Artificial Sequence
  Description of Artificial Sequence: Synthetic oligonucleotide
cgtcactggaatcctcattctggtacgacttc

SEQ ID NO: 324329 - DNA, 34 bp, Artificial Sequence
  Description of Artificial Sequence: Synthetic oligonucleotide
gtcactggaatcctcattctggtacgacttcttg

SEQ ID NO: 324330 - DNA, 36 bp, Artificial Sequence
  Description of Artificial Sequence: Synthetic oligonucleotide
tcactggaatcctcattctggtacgacttcttgatc

SEQ ID NO: 324331 - DNA, 35 bp, Artificial Sequence
  Description of Artificial Sequence: Synthetic oligonucleotide
cactggaatcctcattctggtacgacttcttgatc

SEQ ID NO: 324332 - DNA, 36 bp, Artificial Sequence
  Description of Artificial Sequence: Synthetic oligonucleotide
actggaatcctcattctggtacgacttcttgatcag

SEQ ID NO: 324333 - DNA, 35 bp, Artificial Sequence
  Description of Artificial Sequence: Synthetic oligonucleotide
ctggaatcctcattctggtacgacttcttgatcag

SEQ ID NO: 324334 - DNA, 37 bp, Artificial Sequence
  Description of Artificial Sequence: Synthetic oligonucleotide
tggaatcctcattctggtacgacttcttgatcagaac

SEQ ID NO: 324335 - DNA, 36 bp, Artificial Sequence
  Description of Artificial Sequence: Synthetic oligonucleotide
ggaatcctcattctggtacgacttcttgatcagaac

SEQ ID NO: 324336 - DNA, 36 bp, Artificial Sequence
  Description of Artificial Sequence: Synthetic oligonucleotide
gaatcctcattctggtacgacttcttgatcagaacc

SEQ ID NO: 324337 - DNA, 36 bp, Artificial Sequence
  Description of Artificial Sequence: Synthetic oligonucleotide
aatcctcattctggtacgacttcttgatcagaaccc

SEQ ID NO: 324338 - DNA, 35 bp, Artificial Sequence
  Description of Artificial Sequence: Synthetic oligonucleotide
atcctcattctggtacgacttcttgatcagaaccc

SEQ ID NO: 324339 - DNA, 34 bp, Artificial Sequence
  Description of Artificial Sequence: Synthetic oligonucleotide
tcctcattctggtacgacttcttgatcagaaccc

SEQ ID NO: 324340 - DNA, 33 bp, Artificial Sequence
  Description of Artificial Sequence: Synthetic oligonucleotide
cctcattctggtacgacttcttgatcagaaccc

SEQ ID NO: 324341 - DNA, 33 bp, Artificial Sequence
  Description of Artificial Sequence: Synthetic oligonucleotide
ctcattctggtacgacttcttgatcagaacccg

SEQ ID NO: 324342 - DNA, 34 bp, Artificial Sequence
  Description of Artificial Sequence: Synthetic oligonucleotide
tcattctggtacgacttcttgatcagaacccgtg

SEQ ID NO: 324343 - DNA, 33 bp, Artificial Sequence
  Description of Artificial Sequence: Synthetic oligonucleotide
cattctggtacgacttcttgatcagaacccgtg

SEQ ID NO: 324344 - DNA, 33 bp, Artificial Sequence
  Description of Artificial Sequence: Synthetic oligonucleotide
attctggtacgacttcttgatcagaacccgtgg

SEQ ID NO: 324345 - DNA, 32 bp, Artificial Sequence
  Description of Artificial Sequence: Synthetic oligonucleotide
ttctggtacgacttcttgatcagaacccgtgg

SEQ ID NO: 324346 - DNA, 31 bp, Artificial Sequence
  Description of Artificial Sequence: Synthetic oligonucleotide
tctggtacgacttcttgatcagaacccgtgg

SEQ ID NO: 324347 - DNA, 30 bp, Artificial Sequence
  Description of Artificial Sequence: Synthetic oligonucleotide
ctggtacgacttcttgatcagaacccgtgg

SEQ ID NO: 324348 - DNA, 31 bp, Artificial Sequence
  Description of Artificial Sequence: Synthetic oligonucleotide
tggtacgacttcttgatcagaacccgtggtg

SEQ ID NO: 324349 - DNA, 30 bp, Artificial Sequence
  Description of Artificial Sequence: Synthetic oligonucleotide
ggtacgacttcttgatcagaacccgtggtg

SEQ ID NO: 324350 - DNA, 30 bp, Artificial Sequence
  Description of Artificial Sequence: Synthetic oligonucleotide
gtacgacttcttgatcagaacccgtggtgg

SEQ ID NO: 324351 - DNA, 30 bp, Artificial Sequence
  Description of Artificial Sequence: Synthetic oligonucleotide
tacgacttcttgatcagaacccgtggtggg

SEQ ID NO: 324352 - DNA, 29 bp, Artificial Sequence
  Description of Artificial Sequence: Synthetic oligonucleotide
acgacttcttgatcagaacccgtggtggg

SEQ ID NO: 324353 - DNA, 28 bp, Artificial Sequence
  Description of Artificial Sequence: Synthetic oligonucleotide
cgacttcttgatcagaacccgtggtggg

SEQ ID NO: 324354 - DNA, 28 bp, Artificial Sequence
  Description of Artificial Sequence: Synthetic oligonucleotide
gacttcttgatcagaacccgtggtgggc

SEQ ID NO: 324355 - DNA, 29 bp, Artificial Sequence
  Description of Artificial Sequence: Synthetic oligonucleotide
acttcttgatcagaacccgtggtgggctg

SEQ ID NO: 324356 - DNA, 28 bp, Artificial Sequence
  Description of Artificial Sequence: Synthetic oligonucleotide
cttcttgatcagaacccgtggtgggctg

SEQ ID NO: 324357 - DNA, 29 bp, Artificial Sequence
  Description of Artificial Sequence: Synthetic oligonucleotide
ttcttgatcagaacccgtggtgggctgtc

SEQ ID NO: 324358 - DNA, 28 bp, Artificial Sequence
  Description of Artificial Sequence: Synthetic oligonucleotide
tcttgatcagaacccgtggtgggctgtc

SEQ ID NO: 324359 - DNA, 27 bp, Artificial Sequence
  Description of Artificial Sequence: Synthetic oligonucleotide
cttgatcagaacccgtggtgggctgtc

SEQ ID NO: 324360 - DNA, 28 bp, Artificial Sequence
  Description of Artificial Sequence: Synthetic oligonucleotide
ttgatcagaacccgtggtgggctgtcac

SEQ ID NO: 324361 - DNA, 27 bp, Artificial Sequence
  Description of Artificial Sequence: Synthetic oligonucleotide
tgatcagaacccgtggtgggctgtcac

SEQ ID NO: 324362 - DNA, 27 bp, Artificial Sequence
  Description of Artificial Sequence: Synthetic oligonucleotide
gatcagaacccgtggtgggctgtcact

SEQ ID NO: 324363 - DNA, 27 bp, Artificial Sequence
  Description of Artificial Sequence: Synthetic oligonucleotide
atcagaacccgtggtgggctgtcactg

SEQ ID NO: 324364 - DNA, 26 bp, Artificial Sequence
  Description of Artificial Sequence: Synthetic oligonucleotide
tcagaacccgtggtgggctgtcactg

SEQ ID NO: 324365 - DNA, 25 bp, Artificial Sequence
  Description of Artificial Sequence: Synthetic oligonucleotide
cagaacccgtggtgggctgtcactg

SEQ ID NO: 324366 - DNA, 25 bp, Artificial Sequence
  Description of Artificial Sequence: Synthetic oligonucleotide
agaacccgtggtgggctgtcactgg

SEQ ID NO: 324367 - DNA, 24 bp, Artificial Sequence
  Description of Artificial Sequence: Synthetic oligonucleotide
gaacccgtggtgggctgtcactgg

SEQ ID NO: 324368 - DNA, 25 bp, Artificial Sequence
  Description of Artificial Sequence: Synthetic oligonucleotide
aacccgtggtgggctgtcactggct

SEQ ID NO: 324369 - DNA, 24 bp, Artificial Sequence
  Description of Artificial Sequence: Synthetic oligonucleotide
acccgtggtgggctgtcactggct

SEQ ID NO: 324370 - DNA, 23 bp, Artificial Sequence
  Description of Artificial Sequence: Synthetic oligonucleotide
cccgtggtgggctgtcactggct

SEQ ID NO: 324371 - DNA, 23 bp, Artificial Sequence
  Description of Artificial Sequence: Synthetic oligonucleotide
ccgtggtgggctgtcactggctc

SEQ ID NO: 324372 - DNA, 23 bp, Artificial Sequence
  Description of Artificial Sequence: Synthetic oligonucleotide
cgtggtgggctgtcactggctcg

SEQ ID NO: 324373 - DNA, 24 bp, Artificial Sequence
  Description of Artificial Sequence: Synthetic oligonucleotide
gtggtgggctgtcactggctcgct

SEQ ID NO: 324374 - DNA, 24 bp, Artificial Sequence
  Description of Artificial Sequence: Synthetic oligonucleotide
tggtgggctgtcactggctcgctg

SEQ ID NO: 324375 - DNA, 23 bp, Artificial Sequence
  Description of Artificial Sequence: Synthetic oligonucleotide
ggtgggctgtcactggctcgctg

SEQ ID NO: 324376 - DNA, 23 bp, Artificial Sequence
  Description of Artificial Sequence: Synthetic oligonucleotide
gtgggctgtcactggctcgctgg

SEQ ID NO: 324377 - DNA, 25 bp, Artificial Sequence
  Description of Artificial Sequence: Synthetic oligonucleotide
tgggctgtcactggctcgctgggaa

SEQ ID NO: 324378 - DNA, 24 bp, Artificial Sequence
  Description of Artificial Sequence: Synthetic oligonucleotide
gggctgtcactggctcgctgggaa

SEQ ID NO: 324379 - DNA, 25 bp, Artificial Sequence
  Description of Artificial Sequence: Synthetic oligonucleotide
ggctgtcactggctcgctgggaact

SEQ ID NO: 324380 - DNA, 26 bp, Artificial Sequence
  Description of Artificial Sequence: Synthetic oligonucleotide
gctgtcactggctcgctgggaactgt

SEQ ID NO: 324381 - DNA, 26 bp, Artificial Sequence
  Description of Artificial Sequence: Synthetic oligonucleotide
ctgtcactggctcgctgggaactgtg

SEQ ID NO: 324382 - DNA, 27 bp, Artificial Sequence
  Description of Artificial Sequence: Synthetic oligonucleotide
tgtcactggctcgctgggaactgtggt

SEQ ID NO: 324383 - DNA, 26 bp, Artificial Sequence
  Description of Artificial Sequence: Synthetic oligonucleotide
gtcactggctcgctgggaactgtggt

SEQ ID NO: 324384 - DNA, 27 bp, Artificial Sequence
  Description of Artificial Sequence: Synthetic oligonucleotide
tcactggctcgctgggaactgtggtct

SEQ ID NO: 324385 - DNA, 26 bp, Artificial Sequence
  Description of Artificial Sequence: Synthetic oligonucleotide
cactggctcgctgggaactgtggtct

SEQ ID NO: 324386 - DNA, 26 bp, Artificial Sequence
  Description of Artificial Sequence: Synthetic oligonucleotide
actggctcgctgggaactgtggtctc

SEQ ID NO: 324387 - DNA, 25 bp, Artificial Sequence
  Description of Artificial Sequence: Synthetic oligonucleotide
ctggctcgctgggaactgtggtctc

SEQ ID NO: 324388 - DNA, 26 bp, Artificial Sequence
  Description of Artificial Sequence: Synthetic oligonucleotide
tggctcgctgggaactgtggtctcct

SEQ ID NO: 324389 - DNA, 25 bp, Artificial Sequence
  Description of Artificial Sequence: Synthetic oligonucleotide
ggctcgctgggaactgtggtctcct

SEQ ID NO: 324390 - DNA, 26 bp, Artificial Sequence
  Description of Artificial Sequence: Synthetic oligonucleotide
gctcgctgggaactgtggtctcctct

SEQ ID NO: 324391 - DNA, 27 bp, Artificial Sequence
  Description of Artificial Sequence: Synthetic oligonucleotide
ctcgctgggaactgtggtctcctctct

SEQ ID NO: 324392 - DNA, 27 bp, Artificial Sequence
  Description of Artificial Sequence: Synthetic oligonucleotide
tcgctgggaactgtggtctcctctctg

SEQ ID NO: 324393 - DNA, 27 bp, Artificial Sequence
  Description of Artificial Sequence: Synthetic oligonucleotide
cgctgggaactgtggtctcctctctga

SEQ ID NO: 324394 - DNA, 28 bp, Artificial Sequence
  Description of Artificial Sequence: Synthetic oligonucleotide
gctgggaactgtggtctcctctctgatg

SEQ ID NO: 324395 - DNA, 28 bp, Artificial Sequence
  Description of Artificial Sequence: Synthetic oligonucleotide
ctgggaactgtggtctcctctctgatgg

SEQ ID NO: 324396 - DNA, 28 bp, Artificial Sequence
  Description of Artificial Sequence: Synthetic oligonucleotide
tgggaactgtggtctcctctctgatggg

SEQ ID NO: 324397 - DNA, 27 bp, Artificial Sequence
  Description of Artificial Sequence: Synthetic oligonucleotide
gggaactgtggtctcctctctgatggg

SEQ ID NO: 324398 - DNA, 27 bp, Artificial Sequence
  Description of Artificial Sequence: Synthetic oligonucleotide
ggaactgtggtctcctctctgatgggc

SEQ ID NO: 324399 - DNA, 27 bp, Artificial Sequence
  Description of Artificial Sequence: Synthetic oligonucleotide
gaactgtggtctcctctctgatgggcc

SEQ ID NO: 324400 - DNA, 28 bp, Artificial Sequence
  Description of Artificial Sequence: Synthetic oligonucleotide
aactgtggtctcctctctgatgggcctc

SEQ ID NO: 324401 - DNA, 27 bp, Artificial Sequence
  Description of Artificial Sequence: Synthetic oligonucleotide
actgtggtctcctctctgatgggcctc

SEQ ID NO: 324402 - DNA, 27 bp, Artificial Sequence
  Description of Artificial Sequence: Synthetic oligonucleotide
ctgtggtctcctctctgatgggcctct

SEQ ID NO: 324403 - DNA, 28 bp, Artificial Sequence
  Description of Artificial Sequence: Synthetic oligonucleotide
tgtggtctcctctctgatgggcctcttg

SEQ ID NO: 324404 - DNA, 27 bp, Artificial Sequence
  Description of Artificial Sequence: Synthetic oligonucleotide
gtggtctcctctctgatgggcctcttg

SEQ ID NO: 324405 - DNA, 27 bp, Artificial Sequence
  Description of Artificial Sequence: Synthetic oligonucleotide
tggtctcctctctgatgggcctcttgc

SEQ ID NO: 324406 - DNA, 27 bp, Artificial Sequence
  Description of Artificial Sequence: Synthetic oligonucleotide
ggtctcctctctgatgggcctcttgct

SEQ ID NO: 324407 - DNA, 27 bp, Artificial Sequence
  Description of Artificial Sequence: Synthetic oligonucleotide
gtctcctctctgatgggcctcttgctg

SEQ ID NO: 324408 - DNA, 28 bp, Artificial Sequence
  Description of Artificial Sequence: Synthetic oligonucleotide
tctcctctctgatgggcctcttgctgag

SEQ ID NO: 324409 - DNA, 27 bp, Artificial Sequence
  Description of Artificial Sequence: Synthetic oligonucleotide
ctcctctctgatgggcctcttgctgag

SEQ ID NO: 324410 - DNA, 27 bp, Artificial Sequence
  Description of Artificial Sequence: Synthetic oligonucleotide
tcctctctgatgggcctcttgctgagc

SEQ ID NO: 324411 - DNA, 26 bp, Artificial Sequence
  Description of Artificial Sequence: Synthetic oligonucleotide
cctctctgatgggcctcttgctgagc

SEQ ID NO: 324412 - DNA, 27 bp, Artificial Sequence
  Description of Artificial Sequence: Synthetic oligonucleotide
ctctctgatgggcctcttgctgagcca

SEQ ID NO: 324413 - DNA, 27 bp, Artificial Sequence
  Description of Artificial Sequence: Synthetic oligonucleotide
tctctgatgggcctcttgctgagccag

SEQ ID NO: 324414 - DNA, 26 bp, Artificial Sequence
  Description of Artificial Sequence: Synthetic oligonucleotide
ctctgatgggcctcttgctgagccag

SEQ ID NO: 324415 - DNA, 27 bp, Artificial Sequence
  Description of Artificial Sequence: Synthetic oligonucleotide
tctgatgggcctcttgctgagccagga

SEQ ID NO: 324416 - DNA, 26 bp, Artificial Sequence
  Description of Artificial Sequence: Synthetic oligonucleotide
ctgatgggcctcttgctgagccagga

SEQ ID NO: 324417 - DNA, 27 bp, Artificial Sequence
  Description of Artificial Sequence: Synthetic oligonucleotide
tgatgggcctcttgctgagccaggact

SEQ ID NO: 324418 - DNA, 26 bp, Artificial Sequence
  Description of Artificial Sequence: Synthetic oligonucleotide
gatgggcctcttgctgagccaggact

SEQ ID NO: 324419 - DNA, 26 bp, Artificial Sequence
  Description of Artificial Sequence: Synthetic oligonucleotide
atgggcctcttgctgagccaggactg

SEQ ID NO: 324420 - DNA, 25 bp, Artificial Sequence
  Description of Artificial Sequence: Synthetic oligonucleotide
tgggcctcttgctgagccaggactg

SEQ ID NO: 324421 - DNA, 24 bp, Artificial Sequence
  Description of Artificial Sequence: Synthetic oligonucleotide
gggcctcttgctgagccaggactg

SEQ ID NO: 324422 - DNA, 25 bp, Artificial Sequence
  Description of Artificial Sequence: Synthetic oligonucleotide
ggcctcttgctgagccaggactggt

SEQ ID NO: 324423 - DNA, 27 bp, Artificial Sequence
  Description of Artificial Sequence: Synthetic oligonucleotide
gcctcttgctgagccaggactggtcat

SEQ ID NO: 324424 - DNA, 32 bp, Artificial Sequence
  Description of Artificial Sequence: Synthetic oligonucleotide
cctcttgctgagccaggactggtcattaaaag

SEQ ID NO: 324425 - DNA, 32 bp, Artificial Sequence
  Description of Artificial Sequence: Synthetic oligonucleotide
ctcttgctgagccaggactggtcattaaaagc

SEQ ID NO: 324426 - DNA, 34 bp, Artificial Sequence
  Description of Artificial Sequence: Synthetic oligonucleotide
tcttgctgagccaggactggtcattaaaagcatc

SEQ ID NO: 324427 - DNA, 33 bp, Artificial Sequence
  Description of Artificial Sequence: Synthetic oligonucleotide
cttgctgagccaggactggtcattaaaagcatc

SEQ ID NO: 324428 - DNA, 34 bp, Artificial Sequence
  Description of Artificial Sequence: Synthetic oligonucleotide
ttgctgagccaggactggtcattaaaagcatctg

SEQ ID NO: 324429 - DNA, 33 bp, Artificial Sequence
  Description of Artificial Sequence: Synthetic oligonucleotide
tgctgagccaggactggtcattaaaagcatctg

SEQ ID NO: 324430 - DNA, 32 bp, Artificial Sequence
  Description of Artificial Sequence: Synthetic oligonucleotide
gctgagccaggactggtcattaaaagcatctg

SEQ ID NO: 324431 - DNA, 32 bp, Artificial Sequence
  Description of Artificial Sequence: Synthetic oligonucleotide
ctgagccaggactggtcattaaaagcatctgg

SEQ ID NO: 324432 - DNA, 32 bp, Artificial Sequence
  Description of Artificial Sequence: Synthetic oligonucleotide
tgagccaggactggtcattaaaagcatctggc

SEQ ID NO: 324433 - DNA, 31 bp, Artificial Sequence
  Description of Artificial Sequence: Synthetic oligonucleotide
gagccaggactggtcattaaaagcatctggc

SEQ ID NO: 324434 - DNA, 31 bp, Artificial Sequence
  Description of Artificial Sequence: Synthetic oligonucleotide
agccaggactggtcattaaaagcatctggcc

SEQ ID NO: 324435 - DNA, 30 bp, Artificial Sequence
  Description of Artificial Sequence: Synthetic oligonucleotide
gccaggactggtcattaaaagcatctggcc

SEQ ID NO: 324436 - DNA, 31 bp, Artificial Sequence
  Description of Artificial Sequence: Synthetic oligonucleotide
ccaggactggtcattaaaagcatctggcctc

SEQ ID NO: 324437 - DNA, 34 bp, Artificial Sequence
  Description of Artificial Sequence: Synthetic oligonucleotide
caggactggtcattaaaagcatctggcctctatg

SEQ ID NO: 324438 - DNA, 34 bp, Artificial Sequence
  Description of Artificial Sequence: Synthetic oligonucleotide
aggactggtcattaaaagcatctggcctctatgg

SEQ ID NO: 324439 - DNA, 33 bp, Artificial Sequence
  Description of Artificial Sequence: Synthetic oligonucleotide
ggactggtcattaaaagcatctggcctctatgg

SEQ ID NO: 324440 - DNA, 33 bp, Artificial Sequence
  Description of Artificial Sequence: Synthetic oligonucleotide
gactggtcattaaaagcatctggcctctatggc

SEQ ID NO: 324441 - DNA, 35 bp, Artificial Sequence
  Description of Artificial Sequence: Synthetic oligonucleotide
actggtcattaaaagcatctggcctctatggcaac

SEQ ID NO: 324442 - DNA, 34 bp, Artificial Sequence
  Description of Artificial Sequence: Synthetic oligonucleotide
ctggtcattaaaagcatctggcctctatggcaac

SEQ ID NO: 324443 - DNA, 37 bp, Artificial Sequence
  Description of Artificial Sequence: Synthetic oligonucleotide
tggtcattaaaagcatctggcctctatggcaacaatg

SEQ ID NO: 324444 - DNA, 36 bp, Artificial Sequence
  Description of Artificial Sequence: Synthetic oligonucleotide
ggtcattaaaagcatctggcctctatggcaacaatg

SEQ ID NO: 324445 - DNA, 36 bp, Artificial Sequence
  Description of Artificial Sequence: Synthetic oligonucleotide
gtcattaaaagcatctggcctctatggcaacaatgc

SEQ ID NO: 324446 - DNA, 36 bp, Artificial Sequence
  Description of Artificial Sequence: Synthetic oligonucleotide
tcattaaaagcatctggcctctatggcaacaatgcc

SEQ ID NO: 324447 - DNA, 35 bp, Artificial Sequence
  Description of Artificial Sequence: Synthetic oligonucleotide
cattaaaagcatctggcctctatggcaacaatgcc

SEQ ID NO: 324448 - DNA, 36 bp, Artificial Sequence
  Description of Artificial Sequence: Synthetic oligonucleotide
attaaaagcatctggcctctatggcaacaatgccag

SEQ ID NO: 324449 - DNA, 35 bp, Artificial Sequence
  Description of Artificial Sequence: Synthetic oligonucleotide
ttaaaagcatctggcctctatggcaacaatgccag

SEQ ID NO: 324450 - DNA, 34 bp, Artificial Sequence
  Description of Artificial Sequence: Synthetic oligonucleotide
taaaagcatctggcctctatggcaacaatgccag

SEQ ID NO: 324451 - DNA, 33 bp, Artificial Sequence
  Description of Artificial Sequence: Synthetic oligonucleotide
aaaagcatctggcctctatggcaacaatgccag

SEQ ID NO: 324452 - DNA, 32 bp, Artificial Sequence
  Description of Artificial Sequence: Synthetic oligonucleotide
aaagcatctggcctctatggcaacaatgccag

SEQ ID NO: 324453 - DNA, 31 bp, Artificial Sequence
  Description of Artificial Sequence: Synthetic oligonucleotide
aagcatctggcctctatggcaacaatgccag

SEQ ID NO: 324454 - DNA, 30 bp, Artificial Sequence
  Description of Artificial Sequence: Synthetic oligonucleotide
agcatctggcctctatggcaacaatgccag

SEQ ID NO: 324455 - DNA, 29 bp, Artificial Sequence
  Description of Artificial Sequence: Synthetic oligonucleotide
gcatctggcctctatggcaacaatgccag

SEQ ID NO: 324456 - DNA, 29 bp, Artificial Sequence
  Description of Artificial Sequence: Synthetic oligonucleotide
catctggcctctatggcaacaatgccagc

SEQ ID NO: 324457 - DNA, 29 bp, Artificial Sequence
  Description of Artificial Sequence: Synthetic oligonucleotide
atctggcctctatggcaacaatgccagcc

SEQ ID NO: 324458 - DNA, 28 bp, Artificial Sequence
  Description of Artificial Sequence: Synthetic oligonucleotide
tctggcctctatggcaacaatgccagcc

SEQ ID NO: 324459 - DNA, 27 bp, Artificial Sequence
  Description of Artificial Sequence: Synthetic oligonucleotide
ctggcctctatggcaacaatgccagcc

SEQ ID NO: 324460 - DNA, 28 bp, Artificial Sequence
  Description of Artificial Sequence: Synthetic oligonucleotide
tggcctctatggcaacaatgccagcctg

SEQ ID NO: 324461 - DNA, 27 bp, Artificial Sequence
  Description of Artificial Sequence: Synthetic oligonucleotide
ggcctctatggcaacaatgccagcctg

SEQ ID NO: 324462 - DNA, 27 bp, Artificial Sequence
  Description of Artificial Sequence: Synthetic oligonucleotide
gcctctatggcaacaatgccagcctgg

SEQ ID NO: 324463 - DNA, 28 bp, Artificial Sequence
  Description of Artificial Sequence: Synthetic oligonucleotide
cctctatggcaacaatgccagcctggtg

SEQ ID NO: 324464 - DNA, 28 bp, Artificial Sequence
  Description of Artificial Sequence: Synthetic oligonucleotide
ctctatggcaacaatgccagcctggtgg

SEQ ID NO: 324465 - DNA, 28 bp, Artificial Sequence
  Description of Artificial Sequence: Synthetic oligonucleotide
tctatggcaacaatgccagcctggtggg

SEQ ID NO: 324466 - DNA, 27 bp, Artificial Sequence
  Description of Artificial Sequence: Synthetic oligonucleotide
ctatggcaacaatgccagcctggtggg

SEQ ID NO: 324467 - DNA, 28 bp, Artificial Sequence
  Description of Artificial Sequence: Synthetic oligonucleotide
tatggcaacaatgccagcctggtgggtg

SEQ ID NO: 324468 - DNA, 27 bp, Artificial Sequence
  Description of Artificial Sequence: Synthetic oligonucleotide
atggcaacaatgccagcctggtgggtg

SEQ ID NO: 324469 - DNA, 27 bp, Artificial Sequence
  Description of Artificial Sequence: Synthetic oligonucleotide
tggcaacaatgccagcctggtgggtgt

SEQ ID NO: 324470 - DNA, 27 bp, Artificial Sequence
  Description of Artificial Sequence: Synthetic oligonucleotide
ggcaacaatgccagcctggtgggtgta

SEQ ID NO: 324471 - DNA, 27 bp, Artificial Sequence
  Description of Artificial Sequence: Synthetic oligonucleotide
gcaacaatgccagcctggtgggtgtac

SEQ ID NO: 324472 - DNA, 28 bp, Artificial Sequence
  Description of Artificial Sequence: Synthetic oligonucleotide
caacaatgccagcctggtgggtgtactc

SEQ ID NO: 324473 - DNA, 30 bp, Artificial Sequence
  Description of Artificial Sequence: Synthetic oligonucleotide
aacaatgccagcctggtgggtgtactcatg

SEQ ID NO: 324474 - DNA, 29 bp, Artificial Sequence
  Description of Artificial Sequence: Synthetic oligonucleotide
acaatgccagcctggtgggtgtactcatg

SEQ ID NO: 324475 - DNA, 28 bp, Artificial Sequence
  Description of Artificial Sequence: Synthetic oligonucleotide
caatgccagcctggtgggtgtactcatg

SEQ ID NO: 324476 - DNA, 28 bp, Artificial Sequence
  Description of Artificial Sequence: Synthetic oligonucleotide
aatgccagcctggtgggtgtactcatgc

SEQ ID NO: 324477 - DNA, 27 bp, Artificial Sequence
  Description of Artificial Sequence: Synthetic oligonucleotide
atgccagcctggtgggtgtactcatgc

SEQ ID NO: 324478 - DNA, 26 bp, Artificial Sequence
  Description of Artificial Sequence: Synthetic oligonucleotide
tgccagcctggtgggtgtactcatgc

SEQ ID NO: 324479 - DNA, 25 bp, Artificial Sequence
  Description of Artificial Sequence: Synthetic oligonucleotide
gccagcctggtgggtgtactcatgc

SEQ ID NO: 324480 - DNA, 26 bp, Artificial Sequence
  Description of Artificial Sequence: Synthetic oligonucleotide
ccagcctggtgggtgtactcatgcct

SEQ ID NO: 324481 - DNA, 27 bp, Artificial Sequence
  Description of Artificial Sequence: Synthetic oligonucleotide
cagcctggtgggtgtactcatgcctgt

SEQ ID NO: 324482 - DNA, 27 bp, Artificial Sequence
  Description of Artificial Sequence: Synthetic oligonucleotide
agcctggtgggtgtactcatgcctgtc

SEQ ID NO: 324483 - DNA, 27 bp, Artificial Sequence
  Description of Artificial Sequence: Synthetic oligonucleotide
gcctggtgggtgtactcatgcctgtct

SEQ ID NO: 324484 - DNA, 30 bp, Artificial Sequence
  Description of Artificial Sequence: Synthetic oligonucleotide
cctggtgggtgtactcatgcctgtcttttg

SEQ ID NO: 324485 - DNA, 30 bp, Artificial Sequence
  Description of Artificial Sequence: Synthetic oligonucleotide
ctggtgggtgtactcatgcctgtcttttgg

SEQ ID NO: 324486 - DNA, 30 bp, Artificial Sequence
  Description of Artificial Sequence: Synthetic oligonucleotide
tggtgggtgtactcatgcctgtcttttggg

SEQ ID NO: 324487 - DNA, 29 bp, Artificial Sequence
  Description of Artificial Sequence: Synthetic oligonucleotide
ggtgggtgtactcatgcctgtcttttggg

SEQ ID NO: 324488 - DNA, 30 bp, Artificial Sequence
  Description of Artificial Sequence: Synthetic oligonucleotide
gtgggtgtactcatgcctgtcttttgggac

SEQ ID NO: 324489 - DNA, 32 bp, Artificial Sequence
  Description of Artificial Sequence: Synthetic oligonucleotide
tgggtgtactcatgcctgtcttttgggacaag

SEQ ID NO: 324490 - DNA, 31 bp, Artificial Sequence
  Description of Artificial Sequence: Synthetic oligonucleotide
gggtgtactcatgcctgtcttttgggacaag

SEQ ID NO: 324491 - DNA, 31 bp, Artificial Sequence
  Description of Artificial Sequence: Synthetic oligonucleotide
ggtgtactcatgcctgtcttttgggacaagg

SEQ ID NO: 324492 - DNA, 31 bp, Artificial Sequence
  Description of Artificial Sequence: Synthetic oligonucleotide
gtgtactcatgcctgtcttttgggacaaggg

SEQ ID NO: 324493 - DNA, 32 bp, Artificial Sequence
  Description of Artificial Sequence: Synthetic oligonucleotide
tgtactcatgcctgtcttttgggacaagggtg

SEQ ID NO: 324494 - DNA, 31 bp, Artificial Sequence
  Description of Artificial Sequence: Synthetic oligonucleotide
gtactcatgcctgtcttttgggacaagggtg

SEQ ID NO: 324495 - DNA, 32 bp, Artificial Sequence
  Description of Artificial Sequence: Synthetic oligonucleotide
tactcatgcctgtcttttgggacaagggtgac

SEQ ID NO: 324496 - DNA, 31 bp, Artificial Sequence
  Description of Artificial Sequence: Synthetic oligonucleotide
actcatgcctgtcttttgggacaagggtgac

SEQ ID NO: 324497 - DNA, 30 bp, Artificial Sequence
  Description of Artificial Sequence: Synthetic oligonucleotide
ctcatgcctgtcttttgggacaagggtgac

SEQ ID NO: 324498 - DNA, 35 bp, Artificial Sequence
  Description of Artificial Sequence: Synthetic oligonucleotide
tcatgcctgtcttttgggacaagggtgactatttc

SEQ ID NO: 324499 - DNA, 34 bp, Artificial Sequence
  Description of Artificial Sequence: Synthetic oligonucleotide
catgcctgtcttttgggacaagggtgactatttc

SEQ ID NO: 324500 - DNA, 35 bp, Artificial Sequence
  Description of Artificial Sequence: Synthetic oligonucleotide
atgcctgtcttttgggacaagggtgactatttcag

SEQ ID NO: 324501 - DNA, 34 bp, Artificial Sequence
  Description of Artificial Sequence: Synthetic oligonucleotide
tgcctgtcttttgggacaagggtgactatttcag

SEQ ID NO: 324502 - DNA, 33 bp, Artificial Sequence
  Description of Artificial Sequence: Synthetic oligonucleotide
gcctgtcttttgggacaagggtgactatttcag

SEQ ID NO: 324503 - DNA, 33 bp, Artificial Sequence
  Description of Artificial Sequence: Synthetic oligonucleotide
cctgtcttttgggacaagggtgactatttcagg

SEQ ID NO: 324504 - DNA, 34 bp, Artificial Sequence
  Description of Artificial Sequence: Synthetic oligonucleotide
ctgtcttttgggacaagggtgactatttcaggtg

SEQ ID NO: 324505 - DNA, 34 bp, Artificial Sequence
  Description of Artificial Sequence: Synthetic oligonucleotide
tgtcttttgggacaagggtgactatttcaggtgg

SEQ ID NO: 324506 - DNA, 33 bp, Artificial Sequence
  Description of Artificial Sequence: Synthetic oligonucleotide
gtcttttgggacaagggtgactatttcaggtgg

SEQ ID NO: 324507 - DNA, 33 bp, Artificial Sequence
  Description of Artificial Sequence: Synthetic oligonucleotide
tcttttgggacaagggtgactatttcaggtggc

SEQ ID NO: 324508 - DNA, 32 bp, Artificial Sequence
  Description of Artificial Sequence: Synthetic oligonucleotide
cttttgggacaagggtgactatttcaggtggc

SEQ ID NO: 324509 - DNA, 33 bp, Artificial Sequence
  Description of Artificial Sequence: Synthetic oligonucleotide
ttttgggacaagggtgactatttcaggtggctg

SEQ ID NO: 324510 - DNA, 32 bp, Artificial Sequence
  Description of Artificial Sequence: Synthetic oligonucleotide
tttgggacaagggtgactatttcaggtggctg

SEQ ID NO: 324511 - DNA, 31 bp, Artificial Sequence
  Description of Artificial Sequence: Synthetic oligonucleotide
ttgggacaagggtgactatttcaggtggctg

SEQ ID NO: 324512 - DNA, 30 bp, Artificial Sequence
  Description of Artificial Sequence: Synthetic oligonucleotide
tgggacaagggtgactatttcaggtggctg

SEQ ID NO: 324513 - DNA, 29 bp, Artificial Sequence
  Description of Artificial Sequence: Synthetic oligonucleotide
gggacaagggtgactatttcaggtggctg

SEQ ID NO: 324514 - DNA, 32 bp, Artificial Sequence
  Description of Artificial Sequence: Synthetic oligonucleotide
ggacaagggtgactatttcaggtggctgtaac

SEQ ID NO: 324515 - DNA, 33 bp, Artificial Sequence
  Description of Artificial Sequence: Synthetic oligonucleotide
gacaagggtgactatttcaggtggctgtaactc

SEQ ID NO: 324516 - DNA, 33 bp, Artificial Sequence
  Description of Artificial Sequence: Synthetic oligonucleotide
acaagggtgactatttcaggtggctgtaactcc

SEQ ID NO: 324517 - DNA, 32 bp, Artificial Sequence
  Description of Artificial Sequence: Synthetic oligonucleotide
caagggtgactatttcaggtggctgtaactcc

SEQ ID NO: 324518 - DNA, 32 bp, Artificial Sequence
  Description of Artificial Sequence: Synthetic oligonucleotide
aagggtgactatttcaggtggctgtaactccc

SEQ ID NO: 324519 - DNA, 31 bp, Artificial Sequence
  Description of Artificial Sequence: Synthetic oligonucleotide
agggtgactatttcaggtggctgtaactccc

SEQ ID NO: 324520 - DNA, 30 bp, Artificial Sequence
  Description of Artificial Sequence: Synthetic oligonucleotide
gggtgactatttcaggtggctgtaactccc

SEQ ID NO: 324521 - DNA, 31 bp, Artificial Sequence
  Description of Artificial Sequence: Synthetic oligonucleotide
ggtgactatttcaggtggctgtaactccctg

SEQ ID NO: 324522 - DNA, 34 bp, Artificial Sequence
  Description of Artificial Sequence: Synthetic oligonucleotide
gtgactatttcaggtggctgtaactccctgtttg

SEQ ID NO: 324523 - DNA, 35 bp, Artificial Sequence
  Description of Artificial Sequence: Synthetic oligonucleotide
tgactatttcaggtggctgtaactccctgtttgtg

SEQ ID NO: 324524 - DNA, 34 bp, Artificial Sequence
  Description of Artificial Sequence: Synthetic oligonucleotide
gactatttcaggtggctgtaactccctgtttgtg

SEQ ID NO: 324525 - DNA, 34 bp, Artificial Sequence
  Description of Artificial Sequence: Synthetic oligonucleotide
actatttcaggtggctgtaactccctgtttgtgc

SEQ ID NO: 324526 - DNA, 33 bp, Artificial Sequence
  Description of Artificial Sequence: Synthetic oligonucleotide
ctatttcaggtggctgtaactccctgtttgtgc

SEQ ID NO: 324527 - DNA, 36 bp, Artificial Sequence
  Description of Artificial Sequence: Synthetic oligonucleotide
tatttcaggtggctgtaactccctgtttgtgctatg

SEQ ID NO: 324528 - DNA, 35 bp, Artificial Sequence
  Description of Artificial Sequence: Synthetic oligonucleotide
atttcaggtggctgtaactccctgtttgtgctatg

SEQ ID NO: 324529 - DNA, 34 bp, Artificial Sequence
  Description of Artificial Sequence: Synthetic oligonucleotide
tttcaggtggctgtaactccctgtttgtgctatg

SEQ ID NO: 324530 - DNA, 33 bp, Artificial Sequence
  Description of Artificial Sequence: Synthetic oligonucleotide
ttcaggtggctgtaactccctgtttgtgctatg

SEQ ID NO: 324531 - DNA, 32 bp, Artificial Sequence
  Description of Artificial Sequence: Synthetic oligonucleotide
tcaggtggctgtaactccctgtttgtgctatg

SEQ ID NO: 324532 - DNA, 31 bp, Artificial Sequence
  Description of Artificial Sequence: Synthetic oligonucleotide
caggtggctgtaactccctgtttgtgctatg

SEQ ID NO: 324533 - DNA, 32 bp, Artificial Sequence
  Description of Artificial Sequence: Synthetic oligonucleotide
aggtggctgtaactccctgtttgtgctatgac

SEQ ID NO: 324534 - DNA, 31 bp, Artificial Sequence
  Description of Artificial Sequence: Synthetic oligonucleotide
ggtggctgtaactccctgtttgtgctatgac

SEQ ID NO: 324535 - DNA, 31 bp, Artificial Sequence
  Description of Artificial Sequence: Synthetic oligonucleotide
gtggctgtaactccctgtttgtgctatgacc

SEQ ID NO: 324536 - DNA, 33 bp, Artificial Sequence
  Description of Artificial Sequence: Synthetic oligonucleotide
tggctgtaactccctgtttgtgctatgaccatg

SEQ ID NO: 324537 - DNA, 32 bp, Artificial Sequence
  Description of Artificial Sequence: Synthetic oligonucleotide
ggctgtaactccctgtttgtgctatgaccatg

SEQ ID NO: 324538 - DNA, 33 bp, Artificial Sequence
  Description of Artificial Sequence: Synthetic oligonucleotide
gctgtaactccctgtttgtgctatgaccatgac

SEQ ID NO: 324539 - DNA, 35 bp, Artificial Sequence
  Description of Artificial Sequence: Synthetic oligonucleotide
ctgtaactccctgtttgtgctatgaccatgacttc

SEQ ID NO: 324540 - DNA, 35 bp, Artificial Sequence
  Description of Artificial Sequence: Synthetic oligonucleotide
tgtaactccctgtttgtgctatgaccatgacttcc

SEQ ID NO: 324541 - DNA, 34 bp, Artificial Sequence
  Description of Artificial Sequence: Synthetic oligonucleotide
gtaactccctgtttgtgctatgaccatgacttcc

SEQ ID NO: 324542 - DNA, 34 bp, Artificial Sequence
  Description of Artificial Sequence: Synthetic oligonucleotide
taactccctgtttgtgctatgaccatgacttccc

SEQ ID NO: 324543 - DNA, 33 bp, Artificial Sequence
  Description of Artificial Sequence: Synthetic oligonucleotide
aactccctgtttgtgctatgaccatgacttccc

SEQ ID NO: 324544 - DNA, 32 bp, Artificial Sequence
  Description of Artificial Sequence: Synthetic oligonucleotide
actccctgtttgtgctatgaccatgacttccc

SEQ ID NO: 324545 - DNA, 31 bp, Artificial Sequence
  Description of Artificial Sequence: Synthetic oligonucleotide
ctccctgtttgtgctatgaccatgacttccc

SEQ ID NO: 324546 - DNA, 31 bp, Artificial Sequence
  Description of Artificial Sequence: Synthetic oligonucleotide
tccctgtttgtgctatgaccatgacttcccc

SEQ ID NO: 324547 - DNA, 30 bp, Artificial Sequence
  Description of Artificial Sequence: Synthetic oligonucleotide
ccctgtttgtgctatgaccatgacttcccc

SEQ ID NO: 324548 - DNA, 36 bp, Artificial Sequence
  Description of Artificial Sequence: Synthetic oligonucleotide
cctgtttgtgctatgaccatgacttccccaattttg

SEQ ID NO: 324549 - DNA, 37 bp, Artificial Sequence
  Description of Artificial Sequence: Synthetic oligonucleotide
ctgtttgtgctatgaccatgacttccccaattttgtc

SEQ ID NO: 324550 - DNA, 39 bp, Artificial Sequence
  Description of Artificial Sequence: Synthetic oligonucleotide
tgtttgtgctatgaccatgacttccccaattttgtcaag

SEQ ID NO: 324551 - DNA, 38 bp, Artificial Sequence
  Description of Artificial Sequence: Synthetic oligonucleotide
gtttgtgctatgaccatgacttccccaattttgtcaag

SEQ ID NO: 324552 - DNA, 39 bp, Artificial Sequence
  Description of Artificial Sequence: Synthetic oligonucleotide
tttgtgctatgaccatgacttccccaattttgtcaagtg

SEQ ID NO: 324553 - DNA, 38 bp, Artificial Sequence
  Description of Artificial Sequence: Synthetic oligonucleotide
ttgtgctatgaccatgacttccccaattttgtcaagtg

SEQ ID NO: 324554 - DNA, 37 bp, Artificial Sequence
  Description of Artificial Sequence: Synthetic oligonucleotide
tgtgctatgaccatgacttccccaattttgtcaagtg

SEQ ID NO: 324555 - DNA, 36 bp, Artificial Sequence
  Description of Artificial Sequence: Synthetic oligonucleotide
gtgctatgaccatgacttccccaattttgtcaagtg

SEQ ID NO: 324556 - DNA, 36 bp, Artificial Sequence
  Description of Artificial Sequence: Synthetic oligonucleotide
tgctatgaccatgacttccccaattttgtcaagtgc

SEQ ID NO: 324557 - DNA, 35 bp, Artificial Sequence
  Description of Artificial Sequence: Synthetic oligonucleotide
gctatgaccatgacttccccaattttgtcaagtgc

SEQ ID NO: 324558 - DNA, 38 bp, Artificial Sequence
  Description of Artificial Sequence: Synthetic oligonucleotide
ctatgaccatgacttccccaattttgtcaagtgcaatg

SEQ ID NO: 324559 - DNA, 42 bp, Artificial Sequence
  Description of Artificial Sequence: Synthetic oligonucleotide
tatgaccatgacttccccaattttgtcaagtgcaatgaattc

SEQ ID NO: 324560 - DNA, 41 bp, Artificial Sequence
  Description of Artificial Sequence: Synthetic oligonucleotide
atgaccatgacttccccaattttgtcaagtgcaatgaattc

SEQ ID NO: 324561 - DNA, 40 bp, Artificial Sequence
  Description of Artificial Sequence: Synthetic oligonucleotide
tgaccatgacttccccaattttgtcaagtgcaatgaattc

SEQ ID NO: 324562 - DNA, 39 bp, Artificial Sequence
  Description of Artificial Sequence: Synthetic oligonucleotide
gaccatgacttccccaattttgtcaagtgcaatgaattc

SEQ ID NO: 324563 - DNA, 39 bp, Artificial Sequence
  Description of Artificial Sequence: Synthetic oligonucleotide
accatgacttccccaattttgtcaagtgcaatgaattcc

SEQ ID NO: 324564 - DNA, 38 bp, Artificial Sequence
  Description of Artificial Sequence: Synthetic oligonucleotide
ccatgacttccccaattttgtcaagtgcaatgaattcc

SEQ ID NO: 324565 - DNA, 40 bp, Artificial Sequence
  Description of Artificial Sequence: Synthetic oligonucleotide
catgacttccccaattttgtcaagtgcaatgaattccaag

SEQ ID NO: 324566 - DNA, 40 bp, Artificial Sequence
  Description of Artificial Sequence: Synthetic oligonucleotide
atgacttccccaattttgtcaagtgcaatgaattccaagc

SEQ ID NO: 324567 - DNA, 39 bp, Artificial Sequence
  Description of Artificial Sequence: Synthetic oligonucleotide
tgacttccccaattttgtcaagtgcaatgaattccaagc

SEQ ID NO: 324568 - DNA, 38 bp, Artificial Sequence
  Description of Artificial Sequence: Synthetic oligonucleotide
gacttccccaattttgtcaagtgcaatgaattccaagc

SEQ ID NO: 324569 - DNA, 39 bp, Artificial Sequence
  Description of Artificial Sequence: Synthetic oligonucleotide
acttccccaattttgtcaagtgcaatgaattccaagctc

SEQ ID NO: 324570 - DNA, 38 bp, Artificial Sequence
  Description of Artificial Sequence: Synthetic oligonucleotide
cttccccaattttgtcaagtgcaatgaattccaagctc

SEQ ID NO: 324571 - DNA, 39 bp, Artificial Sequence
  Description of Artificial Sequence: Synthetic oligonucleotide
ttccccaattttgtcaagtgcaatgaattccaagctcag

SEQ ID NO: 324572 - DNA, 38 bp, Artificial Sequence
  Description of Artificial Sequence: Synthetic oligonucleotide
tccccaattttgtcaagtgcaatgaattccaagctcag

SEQ ID NO: 324573 - DNA, 37 bp, Artificial Sequence
  Description of Artificial Sequence: Synthetic oligonucleotide
ccccaattttgtcaagtgcaatgaattccaagctcag

SEQ ID NO: 324574 - DNA, 37 bp, Artificial Sequence
  Description of Artificial Sequence: Synthetic oligonucleotide
cccaattttgtcaagtgcaatgaattccaagctcagc

SEQ ID NO: 324575 - DNA, 41 bp, Artificial Sequence
  Description of Artificial Sequence: Synthetic oligonucleotide
ccaattttgtcaagtgcaatgaattccaagctcagcaattg

SEQ ID NO: 324576 - DNA, 41 bp, Artificial Sequence
  Description of Artificial Sequence: Synthetic oligonucleotide
caattttgtcaagtgcaatgaattccaagctcagcaattgg

SEQ ID NO: 324577 - DNA, 41 bp, Artificial Sequence
  Description of Artificial Sequence: Synthetic oligonucleotide
aattttgtcaagtgcaatgaattccaagctcagcaattggg

SEQ ID NO: 324578 - DNA, 40 bp, Artificial Sequence
  Description of Artificial Sequence: Synthetic oligonucleotide
attttgtcaagtgcaatgaattccaagctcagcaattggg

SEQ ID NO: 324579 - DNA, 39 bp, Artificial Sequence
  Description of Artificial Sequence: Synthetic oligonucleotide
ttttgtcaagtgcaatgaattccaagctcagcaattggg

SEQ ID NO: 324580 - DNA, 38 bp, Artificial Sequence
  Description of Artificial Sequence: Synthetic oligonucleotide
tttgtcaagtgcaatgaattccaagctcagcaattggg

SEQ ID NO: 324581 - DNA, 37 bp, Artificial Sequence
  Description of Artificial Sequence: Synthetic oligonucleotide
ttgtcaagtgcaatgaattccaagctcagcaattggg

SEQ ID NO: 324582 - DNA, 36 bp, Artificial Sequence
  Description of Artificial Sequence: Synthetic oligonucleotide
tgtcaagtgcaatgaattccaagctcagcaattggg

SEQ ID NO: 324583 - DNA, 35 bp, Artificial Sequence
  Description of Artificial Sequence: Synthetic oligonucleotide
gtcaagtgcaatgaattccaagctcagcaattggg

SEQ ID NO: 324584 - DNA, 36 bp, Artificial Sequence
  Description of Artificial Sequence: Synthetic oligonucleotide
tcaagtgcaatgaattccaagctcagcaattgggac

SEQ ID NO: 324585 - DNA, 35 bp, Artificial Sequence
  Description of Artificial Sequence: Synthetic oligonucleotide
caagtgcaatgaattccaagctcagcaattgggac

SEQ ID NO: 324586 - DNA, 35 bp, Artificial Sequence
  Description of Artificial Sequence: Synthetic oligonucleotide
aagtgcaatgaattccaagctcagcaattgggacc

SEQ ID NO: 324587 - DNA, 34 bp, Artificial Sequence
  Description of Artificial Sequence: Synthetic oligonucleotide
agtgcaatgaattccaagctcagcaattgggacc

SEQ ID NO: 324588 - DNA, 33 bp, Artificial Sequence
  Description of Artificial Sequence: Synthetic oligonucleotide
gtgcaatgaattccaagctcagcaattgggacc

SEQ ID NO: 324589 - DNA, 34 bp, Artificial Sequence
  Description of Artificial Sequence: Synthetic oligonucleotide
tgcaatgaattccaagctcagcaattgggacctc

SEQ ID NO: 324590 - DNA, 33 bp, Artificial Sequence
  Description of Artificial Sequence: Synthetic oligonucleotide
gcaatgaattccaagctcagcaattgggacctc

SEQ ID NO: 324591 - DNA, 33 bp, Artificial Sequence
  Description of Artificial Sequence: Synthetic oligonucleotide
caatgaattccaagctcagcaattgggacctcg

SEQ ID NO: 324592 - DNA, 33 bp, Artificial Sequence
  Description of Artificial Sequence: Synthetic oligonucleotide
aatgaattccaagctcagcaattgggacctcgc

SEQ ID NO: 324593 - DNA, 32 bp, Artificial Sequence
  Description of Artificial Sequence: Synthetic oligonucleotide
atgaattccaagctcagcaattgggacctcgc

SEQ ID NO: 324594 - DNA, 31 bp, Artificial Sequence
  Description of Artificial Sequence: Synthetic oligonucleotide
tgaattccaagctcagcaattgggacctcgc

SEQ ID NO: 324595 - DNA, 30 bp, Artificial Sequence
  Description of Artificial Sequence: Synthetic oligonucleotide
gaattccaagctcagcaattgggacctcgc

SEQ ID NO: 324596 - DNA, 30 bp, Artificial Sequence
  Description of Artificial Sequence: Synthetic oligonucleotide
aattccaagctcagcaattgggacctcgcc

SEQ ID NO: 324597 - DNA, 29 bp, Artificial Sequence
  Description of Artificial Sequence: Synthetic oligonucleotide
attccaagctcagcaattgggacctcgcc

SEQ ID NO: 324598 - DNA, 28 bp, Artificial Sequence
  Description of Artificial Sequence: Synthetic oligonucleotide
ttccaagctcagcaattgggacctcgcc

SEQ ID NO: 324599 - DNA, 27 bp, Artificial Sequence
  Description of Artificial Sequence: Synthetic oligonucleotide
tccaagctcagcaattgggacctcgcc

SEQ ID NO: 324600 - DNA, 26 bp, Artificial Sequence
  Description of Artificial Sequence: Synthetic oligonucleotide
ccaagctcagcaattgggacctcgcc

SEQ ID NO: 324601 - DNA, 27 bp, Artificial Sequence
  Description of Artificial Sequence: Synthetic oligonucleotide
caagctcagcaattgggacctcgccgt

SEQ ID NO: 324602 - DNA, 27 bp, Artificial Sequence
  Description of Artificial Sequence: Synthetic oligonucleotide
aagctcagcaattgggacctcgccgtc

SEQ ID NO: 324603 - DNA, 27 bp, Artificial Sequence
  Description of Artificial Sequence: Synthetic oligonucleotide
agctcagcaattgggacctcgccgtct

SEQ ID NO: 324604 - DNA, 27 bp, Artificial Sequence
  Description of Artificial Sequence: Synthetic oligonucleotide
gctcagcaattgggacctcgccgtctt

SEQ ID NO: 324605 - DNA, 27 bp, Artificial Sequence
  Description of Artificial Sequence: Synthetic oligonucleotide
ctcagcaattgggacctcgccgtcttc

SEQ ID NO: 324606 - DNA, 28 bp, Artificial Sequence
  Description of Artificial Sequence: Synthetic oligonucleotide
tcagcaattgggacctcgccgtcttcag

SEQ ID NO: 324607 - DNA, 27 bp, Artificial Sequence
  Description of Artificial Sequence: Synthetic oligonucleotide
cagcaattgggacctcgccgtcttcag

SEQ ID NO: 324608 - DNA, 27 bp, Artificial Sequence
  Description of Artificial Sequence: Synthetic oligonucleotide
agcaattgggacctcgccgtcttcagc

SEQ ID NO: 324609 - DNA, 26 bp, Artificial Sequence
  Description of Artificial Sequence: Synthetic oligonucleotide
gcaattgggacctcgccgtcttcagc

SEQ ID NO: 324610 - DNA, 27 bp, Artificial Sequence
  Description of Artificial Sequence: Synthetic oligonucleotide
caattgggacctcgccgtcttcagcct

SEQ ID NO: 324611 - DNA, 27 bp, Artificial Sequence
  Description of Artificial Sequence: Synthetic oligonucleotide
aattgggacctcgccgtcttcagcctc

SEQ ID NO: 324612 - DNA, 26 bp, Artificial Sequence
  Description of Artificial Sequence: Synthetic oligonucleotide
attgggacctcgccgtcttcagcctc

SEQ ID NO: 324613 - DNA, 25 bp, Artificial Sequence
  Description of Artificial Sequence: Synthetic oligonucleotide
ttgggacctcgccgtcttcagcctc

SEQ ID NO: 324614 - DNA, 24 bp, Artificial Sequence
  Description of Artificial Sequence: Synthetic oligonucleotide
tgggacctcgccgtcttcagcctc

SEQ ID NO: 324615 - DNA, 23 bp, Artificial Sequence
  Description of Artificial Sequence: Synthetic oligonucleotide
gggacctcgccgtcttcagcctc

SEQ ID NO: 324616 - DNA, 23 bp, Artificial Sequence
  Description of Artificial Sequence: Synthetic oligonucleotide
ggacctcgccgtcttcagcctcc

SEQ ID NO: 324617 - DNA, 26 bp, Artificial Sequence
  Description of Artificial Sequence: Synthetic oligonucleotide
gacctcgccgtcttcagcctcccttt

SEQ ID NO: 324618 - DNA, 27 bp, Artificial Sequence
  Description of Artificial Sequence: Synthetic oligonucleotide
acctcgccgtcttcagcctccctttga

SEQ ID NO: 324619 - DNA, 27 bp, Artificial Sequence
  Description of Artificial Sequence: Synthetic oligonucleotide
cctcgccgtcttcagcctccctttgaa

SEQ ID NO: 324620 - DNA, 27 bp, Artificial Sequence
  Description of Artificial Sequence: Synthetic oligonucleotide
ctcgccgtcttcagcctccctttgaac

SEQ ID NO: 324621 - DNA, 29 bp, Artificial Sequence
  Description of Artificial Sequence: Synthetic oligonucleotide
tcgccgtcttcagcctccctttgaacatg

SEQ ID NO: 324622 - DNA, 28 bp, Artificial Sequence
  Description of Artificial Sequence: Synthetic oligonucleotide
cgccgtcttcagcctccctttgaacatg

SEQ ID NO: 324623 - DNA, 28 bp, Artificial Sequence
  Description of Artificial Sequence: Synthetic oligonucleotide
gccgtcttcagcctccctttgaacatgg

SEQ ID NO: 324624 - DNA, 28 bp, Artificial Sequence
  Description of Artificial Sequence: Synthetic oligonucleotide
ccgtcttcagcctccctttgaacatggc

SEQ ID NO: 324625 - DNA, 28 bp, Artificial Sequence
  Description of Artificial Sequence: Synthetic oligonucleotide
cgtcttcagcctccctttgaacatggcg

SEQ ID NO: 324626 - DNA, 30 bp, Artificial Sequence
  Description of Artificial Sequence: Synthetic oligonucleotide
gtcttcagcctccctttgaacatggcgatg

SEQ ID NO: 324627 - DNA, 31 bp, Artificial Sequence
  Description of Artificial Sequence: Synthetic oligonucleotide
tcttcagcctccctttgaacatggcgatgtc

SEQ ID NO: 324628 - DNA, 30 bp, Artificial Sequence
  Description of Artificial Sequence: Synthetic oligonucleotide
cttcagcctccctttgaacatggcgatgtc

SEQ ID NO: 324629 - DNA, 33 bp, Artificial Sequence
  Description of Artificial Sequence: Synthetic oligonucleotide
ttcagcctccctttgaacatggcgatgtcaatg

SEQ ID NO: 324630 - DNA, 32 bp, Artificial Sequence
  Description of Artificial Sequence: Synthetic oligonucleotide
tcagcctccctttgaacatggcgatgtcaatg

SEQ ID NO: 324631 - DNA, 31 bp, Artificial Sequence
  Description of Artificial Sequence: Synthetic oligonucleotide
cagcctccctttgaacatggcgatgtcaatg

SEQ ID NO: 324632 - DNA, 33 bp, Artificial Sequence
  Description of Artificial Sequence: Synthetic oligonucleotide
agcctccctttgaacatggcgatgtcaatgttc

SEQ ID NO: 324633 - DNA, 32 bp, Artificial Sequence
  Description of Artificial Sequence: Synthetic oligonucleotide
gcctccctttgaacatggcgatgtcaatgttc

SEQ ID NO: 324634 - DNA, 32 bp, Artificial Sequence
  Description of Artificial Sequence: Synthetic oligonucleotide
cctccctttgaacatggcgatgtcaatgttcc

SEQ ID NO: 324635 - DNA, 35 bp, Artificial Sequence
  Description of Artificial Sequence: Synthetic oligonucleotide
ctccctttgaacatggcgatgtcaatgttcctttc

SEQ ID NO: 324636 - DNA, 36 bp, Artificial Sequence
  Description of Artificial Sequence: Synthetic oligonucleotide
tccctttgaacatggcgatgtcaatgttcctttcag

SEQ ID NO: 324637 - DNA, 35 bp, Artificial Sequence
  Description of Artificial Sequence: Synthetic oligonucleotide
ccctttgaacatggcgatgtcaatgttcctttcag

SEQ ID NO: 324638 - DNA, 35 bp, Artificial Sequence
  Description of Artificial Sequence: Synthetic oligonucleotide
cctttgaacatggcgatgtcaatgttcctttcagc

SEQ ID NO: 324639 - DNA, 35 bp, Artificial Sequence
  Description of Artificial Sequence: Synthetic oligonucleotide
ctttgaacatggcgatgtcaatgttcctttcagcg

SEQ ID NO: 324640 - DNA, 36 bp, Artificial Sequence
  Description of Artificial Sequence: Synthetic oligonucleotide
tttgaacatggcgatgtcaatgttcctttcagcgac

SEQ ID NO: 324641 - DNA, 35 bp, Artificial Sequence
  Description of Artificial Sequence: Synthetic oligonucleotide
ttgaacatggcgatgtcaatgttcctttcagcgac

SEQ ID NO: 324642 - DNA, 34 bp, Artificial Sequence
  Description of Artificial Sequence: Synthetic oligonucleotide
tgaacatggcgatgtcaatgttcctttcagcgac

SEQ ID NO: 324643 - DNA, 33 bp, Artificial Sequence
  Description of Artificial Sequence: Synthetic oligonucleotide
gaacatggcgatgtcaatgttcctttcagcgac

SEQ ID NO: 324644 - DNA, 34 bp, Artificial Sequence
  Description of Artificial Sequence: Synthetic oligonucleotide
aacatggcgatgtcaatgttcctttcagcgacag

SEQ ID NO: 324645 - DNA, 33 bp, Artificial Sequence
  Description of Artificial Sequence: Synthetic oligonucleotide
acatggcgatgtcaatgttcctttcagcgacag

SEQ ID NO: 324646 - DNA, 32 bp, Artificial Sequence
  Description of Artificial Sequence: Synthetic oligonucleotide
catggcgatgtcaatgttcctttcagcgacag

SEQ ID NO: 324647 - DNA, 32 bp, Artificial Sequence
  Description of Artificial Sequence: Synthetic oligonucleotide
atggcgatgtcaatgttcctttcagcgacagg

SEQ ID NO: 324648 - DNA, 31 bp, Artificial Sequence
  Description of Artificial Sequence: Synthetic oligonucleotide
tggcgatgtcaatgttcctttcagcgacagg

SEQ ID NO: 324649 - DNA, 30 bp, Artificial Sequence
  Description of Artificial Sequence: Synthetic oligonucleotide
ggcgatgtcaatgttcctttcagcgacagg

SEQ ID NO: 324650 - DNA, 31 bp, Artificial Sequence
  Description of Artificial Sequence: Synthetic oligonucleotide
gcgatgtcaatgttcctttcagcgacaggac

SEQ ID NO: 324651 - DNA, 35 bp, Artificial Sequence
  Description of Artificial Sequence: Synthetic oligonucleotide
cgatgtcaatgttcctttcagcgacaggacataac

SEQ ID NO: 324652 - DNA, 38 bp, Artificial Sequence
  Description of Artificial Sequence: Synthetic oligonucleotide
gatgtcaatgttcctttcagcgacaggacataacaatc

SEQ ID NO: 324653 - DNA, 38 bp, Artificial Sequence
  Description of Artificial Sequence: Synthetic oligonucleotide
atgtcaatgttcctttcagcgacaggacataacaatcc

SEQ ID NO: 324654 - DNA, 37 bp, Artificial Sequence
  Description of Artificial Sequence: Synthetic oligonucleotide
tgtcaatgttcctttcagcgacaggacataacaatcc

SEQ ID NO: 324655 - DNA, 36 bp, Artificial Sequence
  Description of Artificial Sequence: Synthetic oligonucleotide
gtcaatgttcctttcagcgacaggacataacaatcc

SEQ ID NO: 324656 - DNA, 39 bp, Artificial Sequence
  Description of Artificial Sequence: Synthetic oligonucleotide
tcaatgttcctttcagcgacaggacataacaatccatac

SEQ ID NO: 324657 - DNA, 38 bp, Artificial Sequence
  Description of Artificial Sequence: Synthetic oligonucleotide
caatgttcctttcagcgacaggacataacaatccatac

SEQ ID NO: 324658 - DNA, 41 bp, Artificial Sequence
  Description of Artificial Sequence: Synthetic oligonucleotide
aatgttcctttcagcgacaggacataacaatccatactttc

SEQ ID NO: 324659 - DNA, 40 bp, Artificial Sequence
  Description of Artificial Sequence: Synthetic oligonucleotide
atgttcctttcagcgacaggacataacaatccatactttc

SEQ ID NO: 324660 - DNA, 39 bp, Artificial Sequence
  Description of Artificial Sequence: Synthetic oligonucleotide
tgttcctttcagcgacaggacataacaatccatactttc

SEQ ID NO: 324661 - DNA, 38 bp, Artificial Sequence
  Description of Artificial Sequence: Synthetic oligonucleotide
gttcctttcagcgacaggacataacaatccatactttc

SEQ ID NO: 324662 - DNA, 38 bp, Artificial Sequence
  Description of Artificial Sequence: Synthetic oligonucleotide
ttcctttcagcgacaggacataacaatccatactttcc

SEQ ID NO: 324663 - DNA, 37 bp, Artificial Sequence
  Description of Artificial Sequence: Synthetic oligonucleotide
tcctttcagcgacaggacataacaatccatactttcc

SEQ ID NO: 324664 - DNA, 36 bp, Artificial Sequence
  Description of Artificial Sequence: Synthetic oligonucleotide
cctttcagcgacaggacataacaatccatactttcc

SEQ ID NO: 324665 - DNA, 37 bp, Artificial Sequence
  Description of Artificial Sequence: Synthetic oligonucleotide
ctttcagcgacaggacataacaatccatactttccag

SEQ ID NO: 324666 - DNA, 37 bp, Artificial Sequence
  Description of Artificial Sequence: Synthetic oligonucleotide
tttcagcgacaggacataacaatccatactttccagc

SEQ ID NO: 324667 - DNA, 36 bp, Artificial Sequence
  Description of Artificial Sequence: Synthetic oligonucleotide
ttcagcgacaggacataacaatccatactttccagc

SEQ ID NO: 324668 - DNA, 35 bp, Artificial Sequence
  Description of Artificial Sequence: Synthetic oligonucleotide
tcagcgacaggacataacaatccatactttccagc

SEQ ID NO: 324669 - DNA, 34 bp, Artificial Sequence
  Description of Artificial Sequence: Synthetic oligonucleotide
cagcgacaggacataacaatccatactttccagc

SEQ ID NO: 324670 - DNA, 34 bp, Artificial Sequence
  Description of Artificial Sequence: Synthetic oligonucleotide
agcgacaggacataacaatccatactttccagcg

SEQ ID NO: 324671 - DNA, 33 bp, Artificial Sequence
  Description of Artificial Sequence: Synthetic oligonucleotide
gcgacaggacataacaatccatactttccagcg

SEQ ID NO: 324672 - DNA, 36 bp, Artificial Sequence
  Description of Artificial Sequence: Synthetic oligonucleotide
cgacaggacataacaatccatactttccagcgaaac

SEQ ID NO: 324673 - DNA, 37 bp, Artificial Sequence
  Description of Artificial Sequence: Synthetic oligonucleotide
gacaggacataacaatccatactttccagcgaaactg

SEQ ID NO: 324674 - DNA, 37 bp, Artificial Sequence
  Description of Artificial Sequence: Synthetic oligonucleotide
acaggacataacaatccatactttccagcgaaactgg

SEQ ID NO: 324675 - DNA, 36 bp, Artificial Sequence
  Description of Artificial Sequence: Synthetic oligonucleotide
caggacataacaatccatactttccagcgaaactgg

SEQ ID NO: 324676 - DNA, 37 bp, Artificial Sequence
  Description of Artificial Sequence: Synthetic oligonucleotide
aggacataacaatccatactttccagcgaaactggtc

SEQ ID NO: 324677 - DNA, 36 bp, Artificial Sequence
  Description of Artificial Sequence: Synthetic oligonucleotide
ggacataacaatccatactttccagcgaaactggtc

SEQ ID NO: 324678 - DNA, 39 bp, Artificial Sequence
  Description of Artificial Sequence: Synthetic oligonucleotide
gacataacaatccatactttccagcgaaactggtcttac

SEQ ID NO: 324679 - DNA, 39 bp, Artificial Sequence
  Description of Artificial Sequence: Synthetic oligonucleotide
acataacaatccatactttccagcgaaactggtcttacc

SEQ ID NO: 324680 - DNA, 38 bp, Artificial Sequence
  Description of Artificial Sequence: Synthetic oligonucleotide
cataacaatccatactttccagcgaaactggtcttacc

SEQ ID NO: 324681 - DNA, 43 bp, Artificial Sequence
  Description of Artificial Sequence: Synthetic oligonucleotide
ataacaatccatactttccagcgaaactggtcttacctataag

SEQ ID NO: 324682 - DNA, 42 bp, Artificial Sequence
  Description of Artificial Sequence: Synthetic oligonucleotide
taacaatccatactttccagcgaaactggtcttacctataag

SEQ ID NO: 324683 - DNA, 41 bp, Artificial Sequence
  Description of Artificial Sequence: Synthetic oligonucleotide
aacaatccatactttccagcgaaactggtcttacctataag

SEQ ID NO: 324684 - DNA, 40 bp, Artificial Sequence
  Description of Artificial Sequence: Synthetic oligonucleotide
acaatccatactttccagcgaaactggtcttacctataag

SEQ ID NO: 324685 - DNA, 39 bp, Artificial Sequence
  Description of Artificial Sequence: Synthetic oligonucleotide
caatccatactttccagcgaaactggtcttacctataag

SEQ ID NO: 324686 - DNA, 41 bp, Artificial Sequence
  Description of Artificial Sequence: Synthetic oligonucleotide
aatccatactttccagcgaaactggtcttacctataagtac

SEQ ID NO: 324687 - DNA, 40 bp, Artificial Sequence
  Description of Artificial Sequence: Synthetic oligonucleotide
atccatactttccagcgaaactggtcttacctataagtac

SEQ ID NO: 324688 - DNA, 39 bp, Artificial Sequence
  Description of Artificial Sequence: Synthetic oligonucleotide
tccatactttccagcgaaactggtcttacctataagtac

SEQ ID NO: 324689 - DNA, 38 bp, Artificial Sequence
  Description of Artificial Sequence: Synthetic oligonucleotide
ccatactttccagcgaaactggtcttacctataagtac

SEQ ID NO: 324690 - DNA, 39 bp, Artificial Sequence
  Description of Artificial Sequence: Synthetic oligonucleotide
catactttccagcgaaactggtcttacctataagtacag

SEQ ID NO: 324691 - DNA, 39 bp, Artificial Sequence
  Description of Artificial Sequence: Synthetic oligonucleotide
atactttccagcgaaactggtcttacctataagtacagc

SEQ ID NO: 324692 - DNA, 38 bp, Artificial Sequence
  Description of Artificial Sequence: Synthetic oligonucleotide
tactttccagcgaaactggtcttacctataagtacagc

SEQ ID NO: 324693 - DNA, 37 bp, Artificial Sequence
  Description of Artificial Sequence: Synthetic oligonucleotide
actttccagcgaaactggtcttacctataagtacagc

SEQ ID NO: 324694 - DNA, 36 bp, Artificial Sequence
  Description of Artificial Sequence: Synthetic oligonucleotide
ctttccagcgaaactggtcttacctataagtacagc

SEQ ID NO: 324695 - DNA, 37 bp, Artificial Sequence
  Description of Artificial Sequence: Synthetic oligonucleotide
tttccagcgaaactggtcttacctataagtacagctc

SEQ ID NO: 324696 - DNA, 36 bp, Artificial Sequence
  Description of Artificial Sequence: Synthetic oligonucleotide
ttccagcgaaactggtcttacctataagtacagctc

SEQ ID NO: 324697 - DNA, 35 bp, Artificial Sequence
  Description of Artificial Sequence: Synthetic oligonucleotide
tccagcgaaactggtcttacctataagtacagctc

SEQ ID NO: 324698 - DNA, 34 bp, Artificial Sequence
  Description of Artificial Sequence: Synthetic oligonucleotide
ccagcgaaactggtcttacctataagtacagctc

SEQ ID NO: 324699 - DNA, 34 bp, Artificial Sequence
  Description of Artificial Sequence: Synthetic oligonucleotide
cagcgaaactggtcttacctataagtacagctcc

SEQ ID NO: 324700 - DNA, 40 bp, Artificial Sequence
  Description of Artificial Sequence: Synthetic oligonucleotide
agcgaaactggtcttacctataagtacagctcctaatatc

SEQ ID NO: 324701 - DNA, 39 bp, Artificial Sequence
  Description of Artificial Sequence: Synthetic oligonucleotide
gcgaaactggtcttacctataagtacagctcctaatatc

SEQ ID NO: 324702 - DNA, 40 bp, Artificial Sequence
  Description of Artificial Sequence: Synthetic oligonucleotide
cgaaactggtcttacctataagtacagctcctaatatctc

SEQ ID NO: 324703 - DNA, 40 bp, Artificial Sequence
  Description of Artificial Sequence: Synthetic oligonucleotide
gaaactggtcttacctataagtacagctcctaatatctcc

SEQ ID NO: 324704 - DNA, 41 bp, Artificial Sequence
  Description of Artificial Sequence: Synthetic oligonucleotide
aaactggtcttacctataagtacagctcctaatatctccag

SEQ ID NO: 324705 - DNA, 40 bp, Artificial Sequence
  Description of Artificial Sequence: Synthetic oligonucleotide
aactggtcttacctataagtacagctcctaatatctccag

SEQ ID NO: 324706 - DNA, 39 bp, Artificial Sequence
  Description of Artificial Sequence: Synthetic oligonucleotide
actggtcttacctataagtacagctcctaatatctccag

SEQ ID NO: 324707 - DNA, 38 bp, Artificial Sequence
  Description of Artificial Sequence: Synthetic oligonucleotide
ctggtcttacctataagtacagctcctaatatctccag

SEQ ID NO: 324708 - DNA, 38 bp, Artificial Sequence
  Description of Artificial Sequence: Synthetic oligonucleotide
tggtcttacctataagtacagctcctaatatctccagg

SEQ ID NO: 324709 - DNA, 37 bp, Artificial Sequence
  Description of Artificial Sequence: Synthetic oligonucleotide
ggtcttacctataagtacagctcctaatatctccagg

SEQ ID NO: 324710 - DNA, 38 bp, Artificial Sequence
  Description of Artificial Sequence: Synthetic oligonucleotide
gtcttacctataagtacagctcctaatatctccaggtc

SEQ ID NO: 324711 - DNA, 39 bp, Artificial Sequence
  Description of Artificial Sequence: Synthetic oligonucleotide
tcttacctataagtacagctcctaatatctccaggtctg

SEQ ID NO: 324712 - DNA, 38 bp, Artificial Sequence
  Description of Artificial Sequence: Synthetic oligonucleotide
cttacctataagtacagctcctaatatctccaggtctg

SEQ ID NO: 324713 - DNA, 39 bp, Artificial Sequence
  Description of Artificial Sequence: Synthetic oligonucleotide
ttacctataagtacagctcctaatatctccaggtctgac

SEQ ID NO: 324714 - DNA, 38 bp, Artificial Sequence
  Description of Artificial Sequence: Synthetic oligonucleotide
tacctataagtacagctcctaatatctccaggtctgac

SEQ ID NO: 324715 - DNA, 37 bp, Artificial Sequence
  Description of Artificial Sequence: Synthetic oligonucleotide
acctataagtacagctcctaatatctccaggtctgac

SEQ ID NO: 324716 - DNA, 36 bp, Artificial Sequence
  Description of Artificial Sequence: Synthetic oligonucleotide
cctataagtacagctcctaatatctccaggtctgac

SEQ ID NO: 324717 - DNA, 36 bp, Artificial Sequence
  Description of Artificial Sequence: Synthetic oligonucleotide
ctataagtacagctcctaatatctccaggtctgacc

SEQ ID NO: 324718 - DNA, 37 bp, Artificial Sequence
  Description of Artificial Sequence: Synthetic oligonucleotide
tataagtacagctcctaatatctccaggtctgaccac

SEQ ID NO: 324719 - DNA, 36 bp, Artificial Sequence
  Description of Artificial Sequence: Synthetic oligonucleotide
ataagtacagctcctaatatctccaggtctgaccac

SEQ ID NO: 324720 - DNA, 35 bp, Artificial Sequence
  Description of Artificial Sequence: Synthetic oligonucleotide
taagtacagctcctaatatctccaggtctgaccac

SEQ ID NO: 324721 - DNA, 34 bp, Artificial Sequence
  Description of Artificial Sequence: Synthetic oligonucleotide
aagtacagctcctaatatctccaggtctgaccac

SEQ ID NO: 324722 - DNA, 33 bp, Artificial Sequence
  Description of Artificial Sequence: Synthetic oligonucleotide
agtacagctcctaatatctccaggtctgaccac

SEQ ID NO: 324723 - DNA, 32 bp, Artificial Sequence
  Description of Artificial Sequence: Synthetic oligonucleotide
gtacagctcctaatatctccaggtctgaccac

SEQ ID NO: 324724 - DNA, 33 bp, Artificial Sequence
  Description of Artificial Sequence: Synthetic oligonucleotide
tacagctcctaatatctccaggtctgaccacag

SEQ ID NO: 324725 - DNA, 32 bp, Artificial Sequence
  Description of Artificial Sequence: Synthetic oligonucleotide
acagctcctaatatctccaggtctgaccacag

SEQ ID NO: 324726 - DNA, 31 bp, Artificial Sequence
  Description of Artificial Sequence: Synthetic oligonucleotide
cagctcctaatatctccaggtctgaccacag

SEQ ID NO: 324727 - DNA, 32 bp, Artificial Sequence
  Description of Artificial Sequence: Synthetic oligonucleotide
agctcctaatatctccaggtctgaccacagtg

SEQ ID NO: 324728 - DNA, 31 bp, Artificial Sequence
  Description of Artificial Sequence: Synthetic oligonucleotide
gctcctaatatctccaggtctgaccacagtg

SEQ ID NO: 324729 - DNA, 31 bp, Artificial Sequence
  Description of Artificial Sequence: Synthetic oligonucleotide
ctcctaatatctccaggtctgaccacagtgc

SEQ ID NO: 324730 - DNA, 31 bp, Artificial Sequence
  Description of Artificial Sequence: Synthetic oligonucleotide
tcctaatatctccaggtctgaccacagtgcc

SEQ ID NO: 324731 - DNA, 30 bp, Artificial Sequence
  Description of Artificial Sequence: Synthetic oligonucleotide
cctaatatctccaggtctgaccacagtgcc

SEQ ID NO: 324732 - DNA, 30 bp, Artificial Sequence
  Description of Artificial Sequence: Synthetic oligonucleotide
ctaatatctccaggtctgaccacagtgccc

SEQ ID NO: 324733 - DNA, 31 bp, Artificial Sequence
  Description of Artificial Sequence: Synthetic oligonucleotide
taatatctccaggtctgaccacagtgccctc

SEQ ID NO: 324734 - DNA, 30 bp, Artificial Sequence
  Description of Artificial Sequence: Synthetic oligonucleotide
aatatctccaggtctgaccacagtgccctc

SEQ ID NO: 324735 - DNA, 29 bp, Artificial Sequence
  Description of Artificial Sequence: Synthetic oligonucleotide
atatctccaggtctgaccacagtgccctc

SEQ ID NO: 324736 - DNA, 28 bp, Artificial Sequence
  Description of Artificial Sequence: Synthetic oligonucleotide
tatctccaggtctgaccacagtgccctc

SEQ ID NO: 324737 - DNA, 27 bp, Artificial Sequence
  Description of Artificial Sequence: Synthetic oligonucleotide
atctccaggtctgaccacagtgccctc

SEQ ID NO: 324738 - DNA, 26 bp, Artificial Sequence
  Description of Artificial Sequence: Synthetic oligonucleotide
tctccaggtctgaccacagtgccctc

SEQ ID NO: 324739 - DNA, 25 bp, Artificial Sequence
  Description of Artificial Sequence: Synthetic oligonucleotide
ctccaggtctgaccacagtgccctc

SEQ ID NO: 324740 - DNA, 26 bp, Artificial Sequence
  Description of Artificial Sequence: Synthetic oligonucleotide
tccaggtctgaccacagtgccctcga

SEQ ID NO: 324741 - DNA, 25 bp, Artificial Sequence
  Description of Artificial Sequence: Synthetic oligonucleotide
ccaggtctgaccacagtgccctcga

SEQ ID NO: 324742 - DNA, 27 bp, Artificial Sequence
  Description of Artificial Sequence: Synthetic oligonucleotide
caggtctgaccacagtgccctcgagtt

SEQ ID NO: 324743 - DNA, 27 bp, Artificial Sequence
  Description of Artificial Sequence: Synthetic oligonucleotide
aggtctgaccacagtgccctcgagttg

SEQ ID NO: 324744 - DNA, 27 bp, Artificial Sequence
  Description of Artificial Sequence: Synthetic oligonucleotide
ggtctgaccacagtgccctcgagttgt

SEQ ID NO: 324745 - DNA, 28 bp, Artificial Sequence
  Description of Artificial Sequence: Synthetic oligonucleotide
gtctgaccacagtgccctcgagttgttg

SEQ ID NO: 324746 - DNA, 32 bp, Artificial Sequence
  Description of Artificial Sequence: Synthetic oligonucleotide
tctgaccacagtgccctcgagttgttgtaatc

SEQ ID NO: 324747 - DNA, 31 bp, Artificial Sequence
  Description of Artificial Sequence: Synthetic oligonucleotide
ctgaccacagtgccctcgagttgttgtaatc

SEQ ID NO: 324748 - DNA, 35 bp, Artificial Sequence
  Description of Artificial Sequence: Synthetic oligonucleotide
tgaccacagtgccctcgagttgttgtaatctatac

SEQ ID NO: 324749 - DNA, 34 bp, Artificial Sequence
  Description of Artificial Sequence: Synthetic oligonucleotide
gaccacagtgccctcgagttgttgtaatctatac

SEQ ID NO: 324750 - DNA, 34 bp, Artificial Sequence
  Description of Artificial Sequence: Synthetic oligonucleotide
accacagtgccctcgagttgttgtaatctatacg

SEQ ID NO: 324751 - DNA, 33 bp, Artificial Sequence
  Description of Artificial Sequence: Synthetic oligonucleotide
ccacagtgccctcgagttgttgtaatctatacg

SEQ ID NO: 324752 - DNA, 34 bp, Artificial Sequence
  Description of Artificial Sequence: Synthetic oligonucleotide
cacagtgccctcgagttgttgtaatctatacgag

SEQ ID NO: 324753 - DNA, 35 bp, Artificial Sequence
  Description of Artificial Sequence: Synthetic oligonucleotide
acagtgccctcgagttgttgtaatctatacgagtg

SEQ ID NO: 324754 - DNA, 34 bp, Artificial Sequence
  Description of Artificial Sequence: Synthetic oligonucleotide
cagtgccctcgagttgttgtaatctatacgagtg

SEQ ID NO: 324755 - DNA, 34 bp, Artificial Sequence
  Description of Artificial Sequence: Synthetic oligonucleotide
agtgccctcgagttgttgtaatctatacgagtgg

SEQ ID NO: 324756 - DNA, 33 bp, Artificial Sequence
  Description of Artificial Sequence: Synthetic oligonucleotide
gtgccctcgagttgttgtaatctatacgagtgg

SEQ ID NO: 324757 - DNA, 33 bp, Artificial Sequence
  Description of Artificial Sequence: Synthetic oligonucleotide
tgccctcgagttgttgtaatctatacgagtggg

SEQ ID NO: 324758 - DNA, 32 bp, Artificial Sequence
  Description of Artificial Sequence: Synthetic oligonucleotide
gccctcgagttgttgtaatctatacgagtggg

SEQ ID NO: 324759 - DNA, 33 bp, Artificial Sequence
  Description of Artificial Sequence: Synthetic oligonucleotide
ccctcgagttgttgtaatctatacgagtgggag

SEQ ID NO: 324760 - DNA, 35 bp, Artificial Sequence
  Description of Artificial Sequence: Synthetic oligonucleotide
cctcgagttgttgtaatctatacgagtgggagtag

SEQ ID NO: 324761 - DNA, 35 bp, Artificial Sequence
  Description of Artificial Sequence: Synthetic oligonucleotide
ctcgagttgttgtaatctatacgagtgggagtagg

SEQ ID NO: 324762 - DNA, 36 bp, Artificial Sequence
  Description of Artificial Sequence: Synthetic oligonucleotide
tcgagttgttgtaatctatacgagtgggagtaggtc

SEQ ID NO: 324763 - DNA, 35 bp, Artificial Sequence
  Description of Artificial Sequence: Synthetic oligonucleotide
cgagttgttgtaatctatacgagtgggagtaggtc

SEQ ID NO: 324764 - DNA, 36 bp, Artificial Sequence
  Description of Artificial Sequence: Synthetic oligonucleotide
gagttgttgtaatctatacgagtgggagtaggtcag

SEQ ID NO: 324765 - DNA, 38 bp, Artificial Sequence
  Description of Artificial Sequence: Synthetic oligonucleotide
agttgttgtaatctatacgagtgggagtaggtcagatc

SEQ ID NO: 324766 - DNA, 37 bp, Artificial Sequence
  Description of Artificial Sequence: Synthetic oligonucleotide
gttgttgtaatctatacgagtgggagtaggtcagatc

SEQ ID NO: 324767 - DNA, 40 bp, Artificial Sequence
  Description of Artificial Sequence: Synthetic oligonucleotide
ttgttgtaatctatacgagtgggagtaggtcagatcaatg

SEQ ID NO: 324768 - DNA, 39 bp, Artificial Sequence
  Description of Artificial Sequence: Synthetic oligonucleotide
tgttgtaatctatacgagtgggagtaggtcagatcaatg

SEQ ID NO: 324769 - DNA, 38 bp, Artificial Sequence
  Description of Artificial Sequence: Synthetic oligonucleotide
gttgtaatctatacgagtgggagtaggtcagatcaatg

SEQ ID NO: 324770 - DNA, 38 bp, Artificial Sequence
  Description of Artificial Sequence: Synthetic oligonucleotide
ttgtaatctatacgagtgggagtaggtcagatcaatgg

SEQ ID NO: 324771 - DNA, 37 bp, Artificial Sequence
  Description of Artificial Sequence: Synthetic oligonucleotide
tgtaatctatacgagtgggagtaggtcagatcaatgg

SEQ ID NO: 324772 - DNA, 36 bp, Artificial Sequence
  Description of Artificial Sequence: Synthetic oligonucleotide
gtaatctatacgagtgggagtaggtcagatcaatgg

SEQ ID NO: 324773 - DNA, 36 bp, Artificial Sequence
  Description of Artificial Sequence: Synthetic oligonucleotide
taatctatacgagtgggagtaggtcagatcaatggc

SEQ ID NO: 324774 - DNA, 35 bp, Artificial Sequence
  Description of Artificial Sequence: Synthetic oligonucleotide
aatctatacgagtgggagtaggtcagatcaatggc

SEQ ID NO: 324775 - DNA, 34 bp, Artificial Sequence
  Description of Artificial Sequence: Synthetic oligonucleotide
atctatacgagtgggagtaggtcagatcaatggc

SEQ ID NO: 324776 - DNA, 33 bp, Artificial Sequence
  Description of Artificial Sequence: Synthetic oligonucleotide
tctatacgagtgggagtaggtcagatcaatggc

SEQ ID NO: 324777 - DNA, 32 bp, Artificial Sequence
  Description of Artificial Sequence: Synthetic oligonucleotide
ctatacgagtgggagtaggtcagatcaatggc

SEQ ID NO: 324778 - DNA, 33 bp, Artificial Sequence
  Description of Artificial Sequence: Synthetic oligonucleotide
tatacgagtgggagtaggtcagatcaatggctg

SEQ ID NO: 324779 - DNA, 32 bp, Artificial Sequence
  Description of Artificial Sequence: Synthetic oligonucleotide
atacgagtgggagtaggtcagatcaatggctg

SEQ ID NO: 324780 - DNA, 31 bp, Artificial Sequence
  Description of Artificial Sequence: Synthetic oligonucleotide
tacgagtgggagtaggtcagatcaatggctg

SEQ ID NO: 324781 - DNA, 30 bp, Artificial Sequence
  Description of Artificial Sequence: Synthetic oligonucleotide
acgagtgggagtaggtcagatcaatggctg

SEQ ID NO: 324782 - DNA, 29 bp, Artificial Sequence
  Description of Artificial Sequence: Synthetic oligonucleotide
cgagtgggagtaggtcagatcaatggctg

SEQ ID NO: 324783 - DNA, 30 bp, Artificial Sequence
  Description of Artificial Sequence: Synthetic oligonucleotide
gagtgggagtaggtcagatcaatggctgtg

SEQ ID NO: 324784 - DNA, 35 bp, Artificial Sequence
  Description of Artificial Sequence: Synthetic oligonucleotide
agtgggagtaggtcagatcaatggctgtgttaatc

SEQ ID NO: 324785 - DNA, 34 bp, Artificial Sequence
  Description of Artificial Sequence: Synthetic oligonucleotide
gtgggagtaggtcagatcaatggctgtgttaatc

SEQ ID NO: 324786 - DNA, 34 bp, Artificial Sequence
  Description of Artificial Sequence: Synthetic oligonucleotide
tgggagtaggtcagatcaatggctgtgttaatcc

SEQ ID NO: 324787 - DNA, 33 bp, Artificial Sequence
  Description of Artificial Sequence: Synthetic oligonucleotide
gggagtaggtcagatcaatggctgtgttaatcc

SEQ ID NO: 324788 - DNA, 35 bp, Artificial Sequence
  Description of Artificial Sequence: Synthetic oligonucleotide
ggagtaggtcagatcaatggctgtgttaatccatg

SEQ ID NO: 324789 - DNA, 35 bp, Artificial Sequence
  Description of Artificial Sequence: Synthetic oligonucleotide
gagtaggtcagatcaatggctgtgttaatccatgc

SEQ ID NO: 324790 - DNA, 36 bp, Artificial Sequence
  Description of Artificial Sequence: Synthetic oligonucleotide
agtaggtcagatcaatggctgtgttaatccatgcac

SEQ ID NO: 324791 - DNA, 35 bp, Artificial Sequence
  Description of Artificial Sequence: Synthetic oligonucleotide
gtaggtcagatcaatggctgtgttaatccatgcac

SEQ ID NO: 324792 - DNA, 36 bp, Artificial Sequence
  Description of Artificial Sequence: Synthetic oligonucleotide
taggtcagatcaatggctgtgttaatccatgcacag

SEQ ID NO: 324793 - DNA, 35 bp, Artificial Sequence
  Description of Artificial Sequence: Synthetic oligonucleotide
aggtcagatcaatggctgtgttaatccatgcacag

SEQ ID NO: 324794 - DNA, 34 bp, Artificial Sequence
  Description of Artificial Sequence: Synthetic oligonucleotide
ggtcagatcaatggctgtgttaatccatgcacag

SEQ ID NO: 324795 - DNA, 34 bp, Artificial Sequence
  Description of Artificial Sequence: Synthetic oligonucleotide
gtcagatcaatggctgtgttaatccatgcacagg

SEQ ID NO: 324796 - DNA, 34 bp, Artificial Sequence
  Description of Artificial Sequence: Synthetic oligonucleotide
tcagatcaatggctgtgttaatccatgcacaggg

SEQ ID NO: 324797 - DNA, 33 bp, Artificial Sequence
  Description of Artificial Sequence: Synthetic oligonucleotide
cagatcaatggctgtgttaatccatgcacaggg

SEQ ID NO: 324798 - DNA, 33 bp, Artificial Sequence
  Description of Artificial Sequence: Synthetic oligonucleotide
agatcaatggctgtgttaatccatgcacagggg

SEQ ID NO: 324799 - DNA, 32 bp, Artificial Sequence
  Description of Artificial Sequence: Synthetic oligonucleotide
gatcaatggctgtgttaatccatgcacagggg

SEQ ID NO: 324800 - DNA, 32 bp, Artificial Sequence
  Description of Artificial Sequence: Synthetic oligonucleotide
atcaatggctgtgttaatccatgcacaggggg

SEQ ID NO: 324801 - DNA, 31 bp, Artificial Sequence
  Description of Artificial Sequence: Synthetic oligonucleotide
tcaatggctgtgttaatccatgcacaggggg

SEQ ID NO: 324802 - DNA, 30 bp, Artificial Sequence
  Description of Artificial Sequence: Synthetic oligonucleotide
caatggctgtgttaatccatgcacaggggg

SEQ ID NO: 324803 - DNA, 30 bp, Artificial Sequence
  Description of Artificial Sequence: Synthetic oligonucleotide
aatggctgtgttaatccatgcacagggggc

SEQ ID NO: 324804 - DNA, 29 bp, Artificial Sequence
  Description of Artificial Sequence: Synthetic oligonucleotide
atggctgtgttaatccatgcacagggggc

SEQ ID NO: 324805 - DNA, 28 bp, Artificial Sequence
  Description of Artificial Sequence: Synthetic oligonucleotide
tggctgtgttaatccatgcacagggggc

SEQ ID NO: 324806 - DNA, 27 bp, Artificial Sequence
  Description of Artificial Sequence: Synthetic oligonucleotide
ggctgtgttaatccatgcacagggggc

SEQ ID NO: 324807 - DNA, 32 bp, Artificial Sequence
  Description of Artificial Sequence: Synthetic oligonucleotide
gctgtgttaatccatgcacagggggctttttc

SEQ ID NO: 324808 - DNA, 32 bp, Artificial Sequence
  Description of Artificial Sequence: Synthetic oligonucleotide
ctgtgttaatccatgcacagggggctttttcc

SEQ ID NO: 324809 - DNA, 33 bp, Artificial Sequence
  Description of Artificial Sequence: Synthetic oligonucleotide
tgtgttaatccatgcacagggggctttttcctg

SEQ ID NO: 324810 - DNA, 32 bp, Artificial Sequence
  Description of Artificial Sequence: Synthetic oligonucleotide
gtgttaatccatgcacagggggctttttcctg

SEQ ID NO: 324811 - DNA, 32 bp, Artificial Sequence
  Description of Artificial Sequence: Synthetic oligonucleotide
tgttaatccatgcacagggggctttttcctgg

SEQ ID NO: 324812 - DNA, 31 bp, Artificial Sequence
  Description of Artificial Sequence: Synthetic oligonucleotide
gttaatccatgcacagggggctttttcctgg

SEQ ID NO: 324813 - DNA, 31 bp, Artificial Sequence
  Description of Artificial Sequence: Synthetic oligonucleotide
ttaatccatgcacagggggctttttcctggc

SEQ ID NO: 324814 - DNA, 30 bp, Artificial Sequence
  Description of Artificial Sequence: Synthetic oligonucleotide
taatccatgcacagggggctttttcctggc

SEQ ID NO: 324815 - DNA, 29 bp, Artificial Sequence
  Description of Artificial Sequence: Synthetic oligonucleotide
aatccatgcacagggggctttttcctggc

SEQ ID NO: 324816 - DNA, 28 bp, Artificial Sequence
  Description of Artificial Sequence: Synthetic oligonucleotide
atccatgcacagggggctttttcctggc

SEQ ID NO: 324817 - DNA, 27 bp, Artificial Sequence
  Description of Artificial Sequence: Synthetic oligonucleotide
tccatgcacagggggctttttcctggc

SEQ ID NO: 324818 - DNA, 27 bp, Artificial Sequence
  Description of Artificial Sequence: Synthetic oligonucleotide
ccatgcacagggggctttttcctggca

SEQ ID NO: 324819 - DNA, 27 bp, Artificial Sequence
  Description of Artificial Sequence: Synthetic oligonucleotide
catgcacagggggctttttcctggcag

SEQ ID NO: 324820 - DNA, 27 bp, Artificial Sequence
  Description of Artificial Sequence: Synthetic oligonucleotide
atgcacagggggctttttcctggcagc

SEQ ID NO: 324821 - DNA, 26 bp, Artificial Sequence
  Description of Artificial Sequence: Synthetic oligonucleotide
tgcacagggggctttttcctggcagc

SEQ ID NO: 324822 - DNA, 25 bp, Artificial Sequence
  Description of Artificial Sequence: Synthetic oligonucleotide
gcacagggggctttttcctggcagc

SEQ ID NO: 324823 - DNA, 27 bp, Artificial Sequence
  Description of Artificial Sequence: Synthetic oligonucleotide
cacagggggctttttcctggcagccat

SEQ ID NO: 324824 - DNA, 27 bp, Artificial Sequence
  Description of Artificial Sequence: Synthetic oligonucleotide
acagggggctttttcctggcagccatc

SEQ ID NO: 324825 - DNA, 26 bp, Artificial Sequence
  Description of Artificial Sequence: Synthetic oligonucleotide
cagggggctttttcctggcagccatc

SEQ ID NO: 324826 - DNA, 27 bp, Artificial Sequence
  Description of Artificial Sequence: Synthetic oligonucleotide
agggggctttttcctggcagccatcct

SEQ ID NO: 324827 - DNA, 27 bp, Artificial Sequence
  Description of Artificial Sequence: Synthetic oligonucleotide
gggggctttttcctggcagccatcctt

SEQ ID NO: 324828 - DNA, 27 bp, Artificial Sequence
  Description of Artificial Sequence: Synthetic oligonucleotide
ggggctttttcctggcagccatccttc

SEQ ID NO: 324829 - DNA, 28 bp, Artificial Sequence
  Description of Artificial Sequence: Synthetic oligonucleotide
gggctttttcctggcagccatccttctc

SEQ ID NO: 324830 - DNA, 29 bp, Artificial Sequence
  Description of Artificial Sequence: Synthetic oligonucleotide
ggctttttcctggcagccatccttctctc

SEQ ID NO: 324831 - DNA, 29 bp, Artificial Sequence
  Description of Artificial Sequence: Synthetic oligonucleotide
gctttttcctggcagccatccttctctcc

SEQ ID NO: 324832 - DNA, 30 bp, Artificial Sequence
  Description of Artificial Sequence: Synthetic oligonucleotide
ctttttcctggcagccatccttctctcctc

SEQ ID NO: 324833 - DNA, 30 bp, Artificial Sequence
  Description of Artificial Sequence: Synthetic oligonucleotide
tttttcctggcagccatccttctctcctcc

SEQ ID NO: 324834 - DNA, 29 bp, Artificial Sequence
  Description of Artificial Sequence: Synthetic oligonucleotide
ttttcctggcagccatccttctctcctcc

SEQ ID NO: 324835 - DNA, 28 bp, Artificial Sequence
  Description of Artificial Sequence: Synthetic oligonucleotide
tttcctggcagccatccttctctcctcc

SEQ ID NO: 324836 - DNA, 27 bp, Artificial Sequence
  Description of Artificial Sequence: Synthetic oligonucleotide
ttcctggcagccatccttctctcctcc

SEQ ID NO: 324837 - DNA, 26 bp, Artificial Sequence
  Description of Artificial Sequence: Synthetic oligonucleotide
tcctggcagccatccttctctcctcc

SEQ ID NO: 324838 - DNA, 25 bp, Artificial Sequence
  Description of Artificial Sequence: Synthetic oligonucleotide
cctggcagccatccttctctcctcc

SEQ ID NO: 324839 - DNA, 25 bp, Artificial Sequence
  Description of Artificial Sequence: Synthetic oligonucleotide
ctggcagccatccttctctcctccg

SEQ ID NO: 324840 - DNA, 26 bp, Artificial Sequence
  Description of Artificial Sequence: Synthetic oligonucleotide
tggcagccatccttctctcctccgca

SEQ ID NO: 324841 - DNA, 25 bp, Artificial Sequence
  Description of Artificial Sequence: Synthetic oligonucleotide
ggcagccatccttctctcctccgca

SEQ ID NO: 324842 - DNA, 26 bp, Artificial Sequence
  Description of Artificial Sequence: Synthetic oligonucleotide
gcagccatccttctctcctccgcact

SEQ ID NO: 324843 - DNA, 27 bp, Artificial Sequence
  Description of Artificial Sequence: Synthetic oligonucleotide
cagccatccttctctcctccgcactca

SEQ ID NO: 324844 - DNA, 28 bp, Artificial Sequence
  Description of Artificial Sequence: Synthetic oligonucleotide
agccatccttctctcctccgcactcatg

SEQ ID NO: 324845 - DNA, 27 bp, Artificial Sequence
  Description of Artificial Sequence: Synthetic oligonucleotide
gccatccttctctcctccgcactcatg

SEQ ID NO: 324846 - DNA, 28 bp, Artificial Sequence
  Description of Artificial Sequence: Synthetic oligonucleotide
ccatccttctctcctccgcactcatgtc

SEQ ID NO: 324847 - DNA, 28 bp, Artificial Sequence
  Description of Artificial Sequence: Synthetic oligonucleotide
catccttctctcctccgcactcatgtcc

SEQ ID NO: 324848 - DNA, 28 bp, Artificial Sequence
  Description of Artificial Sequence: Synthetic oligonucleotide
atccttctctcctccgcactcatgtccc

SEQ ID NO: 324849 - DNA, 27 bp, Artificial Sequence
  Description of Artificial Sequence: Synthetic oligonucleotide
tccttctctcctccgcactcatgtccc

SEQ ID NO: 324850 - DNA, 27 bp, Artificial Sequence
  Description of Artificial Sequence: Synthetic oligonucleotide
ccttctctcctccgcactcatgtccct

SEQ ID NO: 324851 - DNA, 27 bp, Artificial Sequence
  Description of Artificial Sequence: Synthetic oligonucleotide
cttctctcctccgcactcatgtccctg

SEQ ID NO: 324852 - DNA, 27 bp, Artificial Sequence
  Description of Artificial Sequence: Synthetic oligonucleotide
ttctctcctccgcactcatgtccctgc

SEQ ID NO: 324853 - DNA, 27 bp, Artificial Sequence
  Description of Artificial Sequence: Synthetic oligonucleotide
tctctcctccgcactcatgtccctgca

SEQ ID NO: 324854 - DNA, 27 bp, Artificial Sequence
  Description of Artificial Sequence: Synthetic oligonucleotide
ctctcctccgcactcatgtccctgcat

SEQ ID NO: 324855 - DNA, 27 bp, Artificial Sequence
  Description of Artificial Sequence: Synthetic oligonucleotide
tctcctccgcactcatgtccctgcatg

SEQ ID NO: 324856 - DNA, 26 bp, Artificial Sequence
  Description of Artificial Sequence: Synthetic oligonucleotide
ctcctccgcactcatgtccctgcatg

SEQ ID NO: 324857 - DNA, 27 bp, Artificial Sequence
  Description of Artificial Sequence: Synthetic oligonucleotide
tcctccgcactcatgtccctgcatgca

SEQ ID NO: 324858 - DNA, 26 bp, Artificial Sequence
  Description of Artificial Sequence: Synthetic oligonucleotide
cctccgcactcatgtccctgcatgca

SEQ ID NO: 324859 - DNA, 26 bp, Artificial Sequence
  Description of Artificial Sequence: Synthetic oligonucleotide
ctccgcactcatgtccctgcatgcag

SEQ ID NO: 324860 - DNA, 26 bp, Artificial Sequence
  Description of Artificial Sequence: Synthetic oligonucleotide
tccgcactcatgtccctgcatgcagc

SEQ ID NO: 324861 - DNA, 25 bp, Artificial Sequence
  Description of Artificial Sequence: Synthetic oligonucleotide
ccgcactcatgtccctgcatgcagc

SEQ ID NO: 324862 - DNA, 27 bp, Artificial Sequence
  Description of Artificial Sequence: Synthetic oligonucleotide
cgcactcatgtccctgcatgcagccat

SEQ ID NO: 324863 - DNA, 28 bp, Artificial Sequence
  Description of Artificial Sequence: Synthetic oligonucleotide
gcactcatgtccctgcatgcagccatag

SEQ ID NO: 324864 - DNA, 28 bp, Artificial Sequence
  Description of Artificial Sequence: Synthetic oligonucleotide
cactcatgtccctgcatgcagccatagg

SEQ ID NO: 324865 - DNA, 30 bp, Artificial Sequence
  Description of Artificial Sequence: Synthetic oligonucleotide
actcatgtccctgcatgcagccataggaac

SEQ ID NO: 324866 - DNA, 29 bp, Artificial Sequence
  Description of Artificial Sequence: Synthetic oligonucleotide
ctcatgtccctgcatgcagccataggaac

SEQ ID NO: 324867 - DNA, 32 bp, Artificial Sequence
  Description of Artificial Sequence: Synthetic oligonucleotide
tcatgtccctgcatgcagccataggaacattg

SEQ ID NO: 324868 - DNA, 31 bp, Artificial Sequence
  Description of Artificial Sequence: Synthetic oligonucleotide
catgtccctgcatgcagccataggaacattg

SEQ ID NO: 324869 - DNA, 31 bp, Artificial Sequence
  Description of Artificial Sequence: Synthetic oligonucleotide
atgtccctgcatgcagccataggaacattgc

SEQ ID NO: 324870 - DNA, 30 bp, Artificial Sequence
  Description of Artificial Sequence: Synthetic oligonucleotide
tgtccctgcatgcagccataggaacattgc

SEQ ID NO: 324871 - DNA, 29 bp, Artificial Sequence
  Description of Artificial Sequence: Synthetic oligonucleotide
gtccctgcatgcagccataggaacattgc

SEQ ID NO: 324872 - DNA, 30 bp, Artificial Sequence
  Description of Artificial Sequence: Synthetic oligonucleotide
tccctgcatgcagccataggaacattgctg

SEQ ID NO: 324873 - DNA, 29 bp, Artificial Sequence
  Description of Artificial Sequence: Synthetic oligonucleotide
ccctgcatgcagccataggaacattgctg

SEQ ID NO: 324874 - DNA, 29 bp, Artificial Sequence
  Description of Artificial Sequence: Synthetic oligonucleotide
cctgcatgcagccataggaacattgctgg

SEQ ID NO: 324875 - DNA, 29 bp, Artificial Sequence
  Description of Artificial Sequence: Synthetic oligonucleotide
ctgcatgcagccataggaacattgctggc

SEQ ID NO: 324876 - DNA, 29 bp, Artificial Sequence
  Description of Artificial Sequence: Synthetic oligonucleotide
tgcatgcagccataggaacattgctggcc

SEQ ID NO: 324877 - DNA, 28 bp, Artificial Sequence
  Description of Artificial Sequence: Synthetic oligonucleotide
gcatgcagccataggaacattgctggcc

SEQ ID NO: 324878 - DNA, 31 bp, Artificial Sequence
  Description of Artificial Sequence: Synthetic oligonucleotide
catgcagccataggaacattgctggccatag

SEQ ID NO: 324879 - DNA, 31 bp, Artificial Sequence
  Description of Artificial Sequence: Synthetic oligonucleotide
atgcagccataggaacattgctggccatagc

SEQ ID NO: 324880 - DNA, 30 bp, Artificial Sequence
  Description of Artificial Sequence: Synthetic oligonucleotide
tgcagccataggaacattgctggccatagc

SEQ ID NO: 324881 - DNA, 29 bp, Artificial Sequence
  Description of Artificial Sequence: Synthetic oligonucleotide
gcagccataggaacattgctggccatagc

SEQ ID NO: 324882 - DNA, 30 bp, Artificial Sequence
  Description of Artificial Sequence: Synthetic oligonucleotide
cagccataggaacattgctggccatagcag

SEQ ID NO: 324883 - DNA, 30 bp, Artificial Sequence
  Description of Artificial Sequence: Synthetic oligonucleotide
agccataggaacattgctggccatagcagc

SEQ ID NO: 324884 - DNA, 29 bp, Artificial Sequence
  Description of Artificial Sequence: Synthetic oligonucleotide
gccataggaacattgctggccatagcagc

SEQ ID NO: 324885 - DNA, 29 bp, Artificial Sequence
  Description of Artificial Sequence: Synthetic oligonucleotide
ccataggaacattgctggccatagcagcc

SEQ ID NO: 324886 - DNA, 29 bp, Artificial Sequence
  Description of Artificial Sequence: Synthetic oligonucleotide
cataggaacattgctggccatagcagccg

SEQ ID NO: 324887 - DNA, 29 bp, Artificial Sequence
  Description of Artificial Sequence: Synthetic oligonucleotide
ataggaacattgctggccatagcagccgg

SEQ ID NO: 324888 - DNA, 28 bp, Artificial Sequence
  Description of Artificial Sequence: Synthetic oligonucleotide
taggaacattgctggccatagcagccgg

SEQ ID NO: 324889 - DNA, 27 bp, Artificial Sequence
  Description of Artificial Sequence: Synthetic oligonucleotide
aggaacattgctggccatagcagccgg

SEQ ID NO: 324890 - DNA, 27 bp, Artificial Sequence
  Description of Artificial Sequence: Synthetic oligonucleotide
ggaacattgctggccatagcagccgga

SEQ ID NO: 324891 - DNA, 27 bp, Artificial Sequence
  Description of Artificial Sequence: Synthetic oligonucleotide
gaacattgctggccatagcagccggac

SEQ ID NO: 324892 - DNA, 28 bp, Artificial Sequence
  Description of Artificial Sequence: Synthetic oligonucleotide
aacattgctggccatagcagccggactc

SEQ ID NO: 324893 - DNA, 27 bp, Artificial Sequence
  Description of Artificial Sequence: Synthetic oligonucleotide
acattgctggccatagcagccggactc

SEQ ID NO: 324894 - DNA, 27 bp, Artificial Sequence
  Description of Artificial Sequence: Synthetic oligonucleotide
cattgctggccatagcagccggactca

SEQ ID NO: 324895 - DNA, 27 bp, Artificial Sequence
  Description of Artificial Sequence: Synthetic oligonucleotide
attgctggccatagcagccggactcag

SEQ ID NO: 324896 - DNA, 27 bp, Artificial Sequence
  Description of Artificial Sequence: Synthetic oligonucleotide
ttgctggccatagcagccggactcagt

SEQ ID NO: 324897 - DNA, 26 bp, Artificial Sequence
  Description of Artificial Sequence: Synthetic oligonucleotide
tgctggccatagcagccggactcagt

SEQ ID NO: 324898 - DNA, 25 bp, Artificial Sequence
  Description of Artificial Sequence: Synthetic oligonucleotide
gctggccatagcagccggactcagt

SEQ ID NO: 324899 - DNA, 27 bp, Artificial Sequence
  Description of Artificial Sequence: Synthetic oligonucleotide
ctggccatagcagccggactcagtgtt

SEQ ID NO: 324900 - DNA, 28 bp, Artificial Sequence
  Description of Artificial Sequence: Synthetic oligonucleotide
tggccatagcagccggactcagtgtttc

SEQ ID NO: 324901 - DNA, 27 bp, Artificial Sequence
  Description of Artificial Sequence: Synthetic oligonucleotide
ggccatagcagccggactcagtgtttc

SEQ ID NO: 324902 - DNA, 28 bp, Artificial Sequence
  Description of Artificial Sequence: Synthetic oligonucleotide
gccatagcagccggactcagtgtttcag

SEQ ID NO: 324903 - DNA, 28 bp, Artificial Sequence
  Description of Artificial Sequence: Synthetic oligonucleotide
ccatagcagccggactcagtgtttcagc

SEQ ID NO: 324904 - DNA, 28 bp, Artificial Sequence
  Description of Artificial Sequence: Synthetic oligonucleotide
catagcagccggactcagtgtttcagcc

SEQ ID NO: 324905 - DNA, 28 bp, Artificial Sequence
  Description of Artificial Sequence: Synthetic oligonucleotide
atagcagccggactcagtgtttcagccc

SEQ ID NO: 324906 - DNA, 27 bp, Artificial Sequence
  Description of Artificial Sequence: Synthetic oligonucleotide
tagcagccggactcagtgtttcagccc

SEQ ID NO: 324907 - DNA, 26 bp, Artificial Sequence
  Description of Artificial Sequence: Synthetic oligonucleotide
agcagccggactcagtgtttcagccc

SEQ ID NO: 324908 - DNA, 25 bp, Artificial Sequence
  Description of Artificial Sequence: Synthetic oligonucleotide
gcagccggactcagtgtttcagccc

SEQ ID NO: 324909 - DNA, 27 bp, Artificial Sequence
  Description of Artificial Sequence: Synthetic oligonucleotide
cagccggactcagtgtttcagcccgat

SEQ ID NO: 324910 - DNA, 29 bp, Artificial Sequence
  Description of Artificial Sequence: Synthetic oligonucleotide
agccggactcagtgtttcagcccgatttg

SEQ ID NO: 324911 - DNA, 28 bp, Artificial Sequence
  Description of Artificial Sequence: Synthetic oligonucleotide
gccggactcagtgtttcagcccgatttg

SEQ ID NO: 324912 - DNA, 29 bp, Artificial Sequence
  Description of Artificial Sequence: Synthetic oligonucleotide
ccggactcagtgtttcagcccgatttgag

SEQ ID NO: 324913 - DNA, 29 bp, Artificial Sequence
  Description of Artificial Sequence: Synthetic oligonucleotide
cggactcagtgtttcagcccgatttgagg

SEQ ID NO: 324914 - DNA, 30 bp, Artificial Sequence
  Description of Artificial Sequence: Synthetic oligonucleotide
ggactcagtgtttcagcccgatttgaggag

SEQ ID NO: 324915 - DNA, 32 bp, Artificial Sequence
  Description of Artificial Sequence: Synthetic oligonucleotide
gactcagtgtttcagcccgatttgaggagatc

SEQ ID NO: 324916 - DNA, 34 bp, Artificial Sequence
  Description of Artificial Sequence: Synthetic oligonucleotide
actcagtgtttcagcccgatttgaggagatctac

SEQ ID NO: 324917 - DNA, 33 bp, Artificial Sequence
  Description of Artificial Sequence: Synthetic oligonucleotide
ctcagtgtttcagcccgatttgaggagatctac

SEQ ID NO: 324918 - DNA, 36 bp, Artificial Sequence
  Description of Artificial Sequence: Synthetic oligonucleotide
tcagtgtttcagcccgatttgaggagatctactttc

SEQ ID NO: 324919 - DNA, 35 bp, Artificial Sequence
  Description of Artificial Sequence: Synthetic oligonucleotide
cagtgtttcagcccgatttgaggagatctactttc

SEQ ID NO: 324920 - DNA, 35 bp, Artificial Sequence
  Description of Artificial Sequence: Synthetic oligonucleotide
agtgtttcagcccgatttgaggagatctactttcg

SEQ ID NO: 324921 - DNA, 34 bp, Artificial Sequence
  Description of Artificial Sequence: Synthetic oligonucleotide
gtgtttcagcccgatttgaggagatctactttcg

SEQ ID NO: 324922 - DNA, 35 bp, Artificial Sequence
  Description of Artificial Sequence: Synthetic oligonucleotide
tgtttcagcccgatttgaggagatctactttcgac

SEQ ID NO: 324923 - DNA, 34 bp, Artificial Sequence
  Description of Artificial Sequence: Synthetic oligonucleotide
gtttcagcccgatttgaggagatctactttcgac

SEQ ID NO: 324924 - DNA, 35 bp, Artificial Sequence
  Description of Artificial Sequence: Synthetic oligonucleotide
tttcagcccgatttgaggagatctactttcgactc

SEQ ID NO: 324925 - DNA, 34 bp, Artificial Sequence
  Description of Artificial Sequence: Synthetic oligonucleotide
ttcagcccgatttgaggagatctactttcgactc

SEQ ID NO: 324926 - DNA, 33 bp, Artificial Sequence
  Description of Artificial Sequence: Synthetic oligonucleotide
tcagcccgatttgaggagatctactttcgactc

SEQ ID NO: 324927 - DNA, 32 bp, Artificial Sequence
  Description of Artificial Sequence: Synthetic oligonucleotide
cagcccgatttgaggagatctactttcgactc

SEQ ID NO: 324928 - DNA, 33 bp, Artificial Sequence
  Description of Artificial Sequence: Synthetic oligonucleotide
agcccgatttgaggagatctactttcgactctg

SEQ ID NO: 324929 - DNA, 32 bp, Artificial Sequence
  Description of Artificial Sequence: Synthetic oligonucleotide
gcccgatttgaggagatctactttcgactctg

SEQ ID NO: 324930 - DNA, 32 bp, Artificial Sequence
  Description of Artificial Sequence: Synthetic oligonucleotide
cccgatttgaggagatctactttcgactctgg

SEQ ID NO: 324931 - DNA, 32 bp, Artificial Sequence
  Description of Artificial Sequence: Synthetic oligonucleotide
ccgatttgaggagatctactttcgactctggg

SEQ ID NO: 324932 - DNA, 32 bp, Artificial Sequence
  Description of Artificial Sequence: Synthetic oligonucleotide
cgatttgaggagatctactttcgactctgggc

SEQ ID NO: 324933 - DNA, 35 bp, Artificial Sequence
  Description of Artificial Sequence: Synthetic oligonucleotide
gatttgaggagatctactttcgactctgggctttc

SEQ ID NO: 324934 - DNA, 37 bp, Artificial Sequence
  Description of Artificial Sequence: Synthetic oligonucleotide
atttgaggagatctactttcgactctgggctttcaac

SEQ ID NO: 324935 - DNA, 36 bp, Artificial Sequence
  Description of Artificial Sequence: Synthetic oligonucleotide
tttgaggagatctactttcgactctgggctttcaac

SEQ ID NO: 324936 - DNA, 35 bp, Artificial Sequence
  Description of Artificial Sequence: Synthetic oligonucleotide
ttgaggagatctactttcgactctgggctttcaac

SEQ ID NO: 324937 - DNA, 34 bp, Artificial Sequence
  Description of Artificial Sequence: Synthetic oligonucleotide
tgaggagatctactttcgactctgggctttcaac

SEQ ID NO: 324938 - DNA, 33 bp, Artificial Sequence
  Description of Artificial Sequence: Synthetic oligonucleotide
gaggagatctactttcgactctgggctttcaac

SEQ ID NO: 324939 - DNA, 34 bp, Artificial Sequence
  Description of Artificial Sequence: Synthetic oligonucleotide
aggagatctactttcgactctgggctttcaacag

SEQ ID NO: 324940 - DNA, 33 bp, Artificial Sequence
  Description of Artificial Sequence: Synthetic oligonucleotide
ggagatctactttcgactctgggctttcaacag

SEQ ID NO: 324941 - DNA, 33 bp, Artificial Sequence
  Description of Artificial Sequence: Synthetic oligonucleotide
gagatctactttcgactctgggctttcaacagg

SEQ ID NO: 324942 - DNA, 34 bp, Artificial Sequence
  Description of Artificial Sequence: Synthetic oligonucleotide
agatctactttcgactctgggctttcaacaggtc

SEQ ID NO: 324943 - DNA, 33 bp, Artificial Sequence
  Description of Artificial Sequence: Synthetic oligonucleotide
gatctactttcgactctgggctttcaacaggtc

SEQ ID NO: 324944 - DNA, 34 bp, Artificial Sequence
  Description of Artificial Sequence: Synthetic oligonucleotide
atctactttcgactctgggctttcaacaggtctc

SEQ ID NO: 324945 - DNA, 33 bp, Artificial Sequence
  Description of Artificial Sequence: Synthetic oligonucleotide
tctactttcgactctgggctttcaacaggtctc

SEQ ID NO: 324946 - DNA, 32 bp, Artificial Sequence
  Description of Artificial Sequence: Synthetic oligonucleotide
ctactttcgactctgggctttcaacaggtctc

SEQ ID NO: 324947 - DNA, 33 bp, Artificial Sequence
  Description of Artificial Sequence: Synthetic oligonucleotide
tactttcgactctgggctttcaacaggtctctg

SEQ ID NO: 324948 - DNA, 32 bp, Artificial Sequence
  Description of Artificial Sequence: Synthetic oligonucleotide
actttcgactctgggctttcaacaggtctctg

SEQ ID NO: 324949 - DNA, 31 bp, Artificial Sequence
  Description of Artificial Sequence: Synthetic oligonucleotide
ctttcgactctgggctttcaacaggtctctg

SEQ ID NO: 324950 - DNA, 31 bp, Artificial Sequence
  Description of Artificial Sequence: Synthetic oligonucleotide
tttcgactctgggctttcaacaggtctctgg

SEQ ID NO: 324951 - DNA, 30 bp, Artificial Sequence
  Description of Artificial Sequence: Synthetic oligonucleotide
ttcgactctgggctttcaacaggtctctgg

SEQ ID NO: 324952 - DNA, 29 bp, Artificial Sequence
  Description of Artificial Sequence: Synthetic oligonucleotide
tcgactctgggctttcaacaggtctctgg

SEQ ID NO: 324953 - DNA, 28 bp, Artificial Sequence
  Description of Artificial Sequence: Synthetic oligonucleotide
cgactctgggctttcaacaggtctctgg

SEQ ID NO: 324954 - DNA, 28 bp, Artificial Sequence
  Description of Artificial Sequence: Synthetic oligonucleotide
gactctgggctttcaacaggtctctggc

SEQ ID NO: 324955 - DNA, 28 bp, Artificial Sequence
  Description of Artificial Sequence: Synthetic oligonucleotide
actctgggctttcaacaggtctctggcc

SEQ ID NO: 324956 - DNA, 27 bp, Artificial Sequence
  Description of Artificial Sequence: Synthetic oligonucleotide
ctctgggctttcaacaggtctctggcc

SEQ ID NO: 324957 - DNA, 28 bp, Artificial Sequence
  Description of Artificial Sequence: Synthetic oligonucleotide
tctgggctttcaacaggtctctggccag

SEQ ID NO: 324958 - DNA, 27 bp, Artificial Sequence
  Description of Artificial Sequence: Synthetic oligonucleotide
ctgggctttcaacaggtctctggccag

SEQ ID NO: 324959 - DNA, 27 bp, Artificial Sequence
  Description of Artificial Sequence: Synthetic oligonucleotide
tgggctttcaacaggtctctggccagc

SEQ ID NO: 324960 - DNA, 27 bp, Artificial Sequence
  Description of Artificial Sequence: Synthetic oligonucleotide
gggctttcaacaggtctctggccagca

SEQ ID NO: 324961 - DNA, 29 bp, Artificial Sequence
  Description of Artificial Sequence: Synthetic oligonucleotide
ggctttcaacaggtctctggccagcattg

SEQ ID NO: 324962 - DNA, 29 bp, Artificial Sequence
  Description of Artificial Sequence: Synthetic oligonucleotide
gctttcaacaggtctctggccagcattgc

SEQ ID NO: 324963 - DNA, 32 bp, Artificial Sequence
  Description of Artificial Sequence: Synthetic oligonucleotide
ctttcaacaggtctctggccagcattgcaaag

SEQ ID NO: 324964 - DNA, 32 bp, Artificial Sequence
  Description of Artificial Sequence: Synthetic oligonucleotide
tttcaacaggtctctggccagcattgcaaagg

SEQ ID NO: 324965 - DNA, 31 bp, Artificial Sequence
  Description of Artificial Sequence: Synthetic oligonucleotide
ttcaacaggtctctggccagcattgcaaagg

SEQ ID NO: 324966 - DNA, 30 bp, Artificial Sequence
  Description of Artificial Sequence: Synthetic oligonucleotide
tcaacaggtctctggccagcattgcaaagg

SEQ ID NO: 324967 - DNA, 29 bp, Artificial Sequence
  Description of Artificial Sequence: Synthetic oligonucleotide
caacaggtctctggccagcattgcaaagg

SEQ ID NO: 324968 - DNA, 29 bp, Artificial Sequence
  Description of Artificial Sequence: Synthetic oligonucleotide
aacaggtctctggccagcattgcaaaggg

SEQ ID NO: 324969 - DNA, 28 bp, Artificial Sequence
  Description of Artificial Sequence: Synthetic oligonucleotide
acaggtctctggccagcattgcaaaggg

SEQ ID NO: 324970 - DNA, 27 bp, Artificial Sequence
  Description of Artificial Sequence: Synthetic oligonucleotide
caggtctctggccagcattgcaaaggg

SEQ ID NO: 324971 - DNA, 28 bp, Artificial Sequence
  Description of Artificial Sequence: Synthetic oligonucleotide
aggtctctggccagcattgcaaagggag

SEQ ID NO: 324972 - DNA, 27 bp, Artificial Sequence
  Description of Artificial Sequence: Synthetic oligonucleotide
ggtctctggccagcattgcaaagggag

SEQ ID NO: 324973 - DNA, 27 bp, Artificial Sequence
  Description of Artificial Sequence: Synthetic oligonucleotide
gtctctggccagcattgcaaagggagg

SEQ ID NO: 324974 - DNA, 30 bp, Artificial Sequence
  Description of Artificial Sequence: Synthetic oligonucleotide
tctctggccagcattgcaaagggaggaatc

SEQ ID NO: 324975 - DNA, 29 bp, Artificial Sequence
  Description of Artificial Sequence: Synthetic oligonucleotide
ctctggccagcattgcaaagggaggaatc

SEQ ID NO: 324976 - DNA, 31 bp, Artificial Sequence
  Description of Artificial Sequence: Synthetic oligonucleotide
tctggccagcattgcaaagggaggaatcttc

SEQ ID NO: 324977 - DNA, 30 bp, Artificial Sequence
  Description of Artificial Sequence: Synthetic oligonucleotide
ctggccagcattgcaaagggaggaatcttc

SEQ ID NO: 324978 - DNA, 32 bp, Artificial Sequence
  Description of Artificial Sequence: Synthetic oligonucleotide
tggccagcattgcaaagggaggaatcttcatg

SEQ ID NO: 324979 - DNA, 31 bp, Artificial Sequence
  Description of Artificial Sequence: Synthetic oligonucleotide
ggccagcattgcaaagggaggaatcttcatg

SEQ ID NO: 324980 - DNA, 31 bp, Artificial Sequence
  Description of Artificial Sequence: Synthetic oligonucleotide
gccagcattgcaaagggaggaatcttcatgg

SEQ ID NO: 324981 - DNA, 31 bp, Artificial Sequence
  Description of Artificial Sequence: Synthetic oligonucleotide
ccagcattgcaaagggaggaatcttcatggc

SEQ ID NO: 324982 - DNA, 31 bp, Artificial Sequence
  Description of Artificial Sequence: Synthetic oligonucleotide
cagcattgcaaagggaggaatcttcatggcg

SEQ ID NO: 324983 - DNA, 31 bp, Artificial Sequence
  Description of Artificial Sequence: Synthetic oligonucleotide
agcattgcaaagggaggaatcttcatggcgg

SEQ ID NO: 324984 - DNA, 30 bp, Artificial Sequence
  Description of Artificial Sequence: Synthetic oligonucleotide
gcattgcaaagggaggaatcttcatggcgg

SEQ ID NO: 324985 - DNA, 31 bp, Artificial Sequence
  Description of Artificial Sequence: Synthetic oligonucleotide
cattgcaaagggaggaatcttcatggcggtc

SEQ ID NO: 324986 - DNA, 32 bp, Artificial Sequence
  Description of Artificial Sequence: Synthetic oligonucleotide
attgcaaagggaggaatcttcatggcggtcac

SEQ ID NO: 324987 - DNA, 31 bp, Artificial Sequence
  Description of Artificial Sequence: Synthetic oligonucleotide
ttgcaaagggaggaatcttcatggcggtcac

SEQ ID NO: 324988 - DNA, 30 bp, Artificial Sequence
  Description of Artificial Sequence: Synthetic oligonucleotide
tgcaaagggaggaatcttcatggcggtcac

SEQ ID NO: 324989 - DNA, 29 bp, Artificial Sequence
  Description of Artificial Sequence: Synthetic oligonucleotide
gcaaagggaggaatcttcatggcggtcac

SEQ ID NO: 324990 - DNA, 29 bp, Artificial Sequence
  Description of Artificial Sequence: Synthetic oligonucleotide
caaagggaggaatcttcatggcggtcacc

SEQ ID NO: 324991 - DNA, 30 bp, Artificial Sequence
  Description of Artificial Sequence: Synthetic oligonucleotide
aaagggaggaatcttcatggcggtcacctg

SEQ ID NO: 324992 - DNA, 29 bp, Artificial Sequence
  Description of Artificial Sequence: Synthetic oligonucleotide
aagggaggaatcttcatggcggtcacctg

SEQ ID NO: 324993 - DNA, 28 bp, Artificial Sequence
  Description of Artificial Sequence: Synthetic oligonucleotide
agggaggaatcttcatggcggtcacctg

SEQ ID NO: 324994 - DNA, 27 bp, Artificial Sequence
  Description of Artificial Sequence: Synthetic oligonucleotide
gggaggaatcttcatggcggtcacctg

SEQ ID NO: 324995 - DNA, 27 bp, Artificial Sequence
  Description of Artificial Sequence: Synthetic oligonucleotide
ggaggaatcttcatggcggtcacctgg

SEQ ID NO: 324996 - DNA, 27 bp, Artificial Sequence
  Description of Artificial Sequence: Synthetic oligonucleotide
gaggaatcttcatggcggtcacctggc

SEQ ID NO: 324997 - DNA, 30 bp, Artificial Sequence
  Description of Artificial Sequence: Synthetic oligonucleotide
aggaatcttcatggcggtcacctggctaac

SEQ ID NO: 324998 - DNA, 29 bp, Artificial Sequence
  Description of Artificial Sequence: Synthetic oligonucleotide
ggaatcttcatggcggtcacctggctaac

SEQ ID NO: 324999 - DNA, 29 bp, Artificial Sequence
  Description of Artificial Sequence: Synthetic oligonucleotide
gaatcttcatggcggtcacctggctaacc

SEQ ID NO: 325000 - DNA, 29 bp, Artificial Sequence
  Description of Artificial Sequence: Synthetic oligonucleotide
aatcttcatggcggtcacctggctaaccc

SEQ ID NO: 325001 - DNA, 28 bp, Artificial Sequence
  Description of Artificial Sequence: Synthetic oligonucleotide
atcttcatggcggtcacctggctaaccc

SEQ ID NO: 325002 - DNA, 27 bp, Artificial Sequence
  Description of Artificial Sequence: Synthetic oligonucleotide
tcttcatggcggtcacctggctaaccc

SEQ ID NO: 325003 - DNA, 27 bp, Artificial Sequence
  Description of Artificial Sequence: Synthetic oligonucleotide
cttcatggcggtcacctggctaaccca

SEQ ID NO: 325004 - DNA, 27 bp, Artificial Sequence
  Description of Artificial Sequence: Synthetic oligonucleotide
ttcatggcggtcacctggctaacccac

SEQ ID NO: 325005 - DNA, 26 bp, Artificial Sequence
  Description of Artificial Sequence: Synthetic oligonucleotide
tcatggcggtcacctggctaacccac

SEQ ID NO: 325006 - DNA, 25 bp, Artificial Sequence
  Description of Artificial Sequence: Synthetic oligonucleotide
catggcggtcacctggctaacccac

SEQ ID NO: 325007 - DNA, 26 bp, Artificial Sequence
  Description of Artificial Sequence: Synthetic oligonucleotide
atggcggtcacctggctaacccacct

SEQ ID NO: 325008 - DNA, 25 bp, Artificial Sequence
  Description of Artificial Sequence: Synthetic oligonucleotide
tggcggtcacctggctaacccacct

SEQ ID NO: 325009 - DNA, 24 bp, Artificial Sequence
  Description of Artificial Sequence: Synthetic oligonucleotide
ggcggtcacctggctaacccacct

SEQ ID NO: 325010 - DNA, 24 bp, Artificial Sequence
  Description of Artificial Sequence: Synthetic oligonucleotide
gcggtcacctggctaacccacctg

SEQ ID NO: 325011 - DNA, 25 bp, Artificial Sequence
  Description of Artificial Sequence: Synthetic oligonucleotide
cggtcacctggctaacccacctgct

SEQ ID NO: 325012 - DNA, 25 bp, Artificial Sequence
  Description of Artificial Sequence: Synthetic oligonucleotide
ggtcacctggctaacccacctgctg

SEQ ID NO: 325013 - DNA, 25 bp, Artificial Sequence
  Description of Artificial Sequence: Synthetic oligonucleotide
gtcacctggctaacccacctgctgg

SEQ ID NO: 325014 - DNA, 26 bp, Artificial Sequence
  Description of Artificial Sequence: Synthetic oligonucleotide
tcacctggctaacccacctgctggct

SEQ ID NO: 325015 - DNA, 25 bp, Artificial Sequence
  Description of Artificial Sequence: Synthetic oligonucleotide
cacctggctaacccacctgctggct

SEQ ID NO: 325016 - DNA, 27 bp, Artificial Sequence
  Description of Artificial Sequence: Synthetic oligonucleotide
acctggctaacccacctgctggctctt

SEQ ID NO: 325017 - DNA, 26 bp, Artificial Sequence
  Description of Artificial Sequence: Synthetic oligonucleotide
cctggctaacccacctgctggctctt

SEQ ID NO: 325018 - DNA, 26 bp, Artificial Sequence
  Description of Artificial Sequence: Synthetic oligonucleotide
ctggctaacccacctgctggctcttc

SEQ ID NO: 325019 - DNA, 26 bp, Artificial Sequence
  Description of Artificial Sequence: Synthetic oligonucleotide
tggctaacccacctgctggctcttcg

SEQ ID NO: 325020 - DNA, 25 bp, Artificial Sequence
  Description of Artificial Sequence: Synthetic oligonucleotide
ggctaacccacctgctggctcttcg

SEQ ID NO: 325021 - DNA, 26 bp, Artificial Sequence
  Description of Artificial Sequence: Synthetic oligonucleotide
gctaacccacctgctggctcttcgct

SEQ ID NO: 325022 - DNA, 27 bp, Artificial Sequence
  Description of Artificial Sequence: Synthetic oligonucleotide
ctaacccacctgctggctcttcgctgt

SEQ ID NO: 325023 - DNA, 27 bp, Artificial Sequence
  Description of Artificial Sequence: Synthetic oligonucleotide
taacccacctgctggctcttcgctgtg

SEQ ID NO: 325024 - DNA, 26 bp, Artificial Sequence
  Description of Artificial Sequence: Synthetic oligonucleotide
aacccacctgctggctcttcgctgtg

SEQ ID NO: 325025 - DNA, 25 bp, Artificial Sequence
  Description of Artificial Sequence: Synthetic oligonucleotide
acccacctgctggctcttcgctgtg

SEQ ID NO: 325026 - DNA, 24 bp, Artificial Sequence
  Description of Artificial Sequence: Synthetic oligonucleotide
cccacctgctggctcttcgctgtg

SEQ ID NO: 325027 - DNA, 24 bp, Artificial Sequence
  Description of Artificial Sequence: Synthetic oligonucleotide
ccacctgctggctcttcgctgtgc

SEQ ID NO: 325028 - DNA, 24 bp, Artificial Sequence
  Description of Artificial Sequence: Synthetic oligonucleotide
cacctgctggctcttcgctgtgcc

SEQ ID NO: 325029 - DNA, 25 bp, Artificial Sequence
  Description of Artificial Sequence: Synthetic oligonucleotide
acctgctggctcttcgctgtgccca

SEQ ID NO: 325030 - DNA, 24 bp, Artificial Sequence
  Description of Artificial Sequence: Synthetic oligonucleotide
cctgctggctcttcgctgtgccca

SEQ ID NO: 325031 - DNA, 26 bp, Artificial Sequence
  Description of Artificial Sequence: Synthetic oligonucleotide
ctgctggctcttcgctgtgcccagtt

SEQ ID NO: 325032 - DNA, 27 bp, Artificial Sequence
  Description of Artificial Sequence: Synthetic oligonucleotide
tgctggctcttcgctgtgcccagttca

SEQ ID NO: 325033 - DNA, 26 bp, Artificial Sequence
  Description of Artificial Sequence: Synthetic oligonucleotide
gctggctcttcgctgtgcccagttca

SEQ ID NO: 325034 - DNA, 26 bp, Artificial Sequence
  Description of Artificial Sequence: Synthetic oligonucleotide
ctggctcttcgctgtgcccagttcac

SEQ ID NO: 325035 - DNA, 26 bp, Artificial Sequence
  Description of Artificial Sequence: Synthetic oligonucleotide
tggctcttcgctgtgcccagttcacg

SEQ ID NO: 325036 - DNA, 25 bp, Artificial Sequence
  Description of Artificial Sequence: Synthetic oligonucleotide
ggctcttcgctgtgcccagttcacg

SEQ ID NO: 325037 - DNA, 25 bp, Artificial Sequence
  Description of Artificial Sequence: Synthetic oligonucleotide
gctcttcgctgtgcccagttcacgg

SEQ ID NO: 325038 - DNA, 25 bp, Artificial Sequence
  Description of Artificial Sequence: Synthetic oligonucleotide
ctcttcgctgtgcccagttcacggc

SEQ ID NO: 325039 - DNA, 27 bp, Artificial Sequence
  Description of Artificial Sequence: Synthetic oligonucleotide
tcttcgctgtgcccagttcacggcgta

SEQ ID NO: 325040 - DNA, 27 bp, Artificial Sequence
  Description of Artificial Sequence: Synthetic oligonucleotide
cttcgctgtgcccagttcacggcgtat

SEQ ID NO: 325041 - DNA, 27 bp, Artificial Sequence
  Description of Artificial Sequence: Synthetic oligonucleotide
ttcgctgtgcccagttcacggcgtatc

SEQ ID NO: 325042 - DNA, 27 bp, Artificial Sequence
  Description of Artificial Sequence: Synthetic oligonucleotide
tcgctgtgcccagttcacggcgtatct

SEQ ID NO: 325043 - DNA, 27 bp, Artificial Sequence
  Description of Artificial Sequence: Synthetic oligonucleotide
cgctgtgcccagttcacggcgtatctt

SEQ ID NO: 325044 - DNA, 27 bp, Artificial Sequence
  Description of Artificial Sequence: Synthetic oligonucleotide
gctgtgcccagttcacggcgtatcttg

SEQ ID NO: 325045 - DNA, 27 bp, Artificial Sequence
  Description of Artificial Sequence: Synthetic oligonucleotide
ctgtgcccagttcacggcgtatcttgg

SEQ ID NO: 325046 - DNA, 28 bp, Artificial Sequence
  Description of Artificial Sequence: Synthetic oligonucleotide
tgtgcccagttcacggcgtatcttggac

SEQ ID NO: 325047 - DNA, 27 bp, Artificial Sequence
  Description of Artificial Sequence: Synthetic oligonucleotide
gtgcccagttcacggcgtatcttggac

SEQ ID NO: 325048 - DNA, 28 bp, Artificial Sequence
  Description of Artificial Sequence: Synthetic oligonucleotide
tgcccagttcacggcgtatcttggactc

SEQ ID NO: 325049 - DNA, 27 bp, Artificial Sequence
  Description of Artificial Sequence: Synthetic oligonucleotide
gcccagttcacggcgtatcttggactc

SEQ ID NO: 325050 - DNA, 27 bp, Artificial Sequence
  Description of Artificial Sequence: Synthetic oligonucleotide
cccagttcacggcgtatcttggactcg

SEQ ID NO: 325051 - DNA, 27 bp, Artificial Sequence
  Description of Artificial Sequence: Synthetic oligonucleotide
ccagttcacggcgtatcttggactcgg

SEQ ID NO: 325052 - DNA, 27 bp, Artificial Sequence
  Description of Artificial Sequence: Synthetic oligonucleotide
cagttcacggcgtatcttggactcggc

SEQ ID NO: 325053 - DNA, 29 bp, Artificial Sequence
  Description of Artificial Sequence: Synthetic oligonucleotide
agttcacggcgtatcttggactcggcatg

SEQ ID NO: 325054 - DNA, 28 bp, Artificial Sequence
  Description of Artificial Sequence: Synthetic oligonucleotide
gttcacggcgtatcttggactcggcatg

SEQ ID NO: 325055 - DNA, 28 bp, Artificial Sequence
  Description of Artificial Sequence: Synthetic oligonucleotide
ttcacggcgtatcttggactcggcatgg

SEQ ID NO: 325056 - DNA, 27 bp, Artificial Sequence
  Description of Artificial Sequence: Synthetic oligonucleotide
tcacggcgtatcttggactcggcatgg

SEQ ID NO: 325057 - DNA, 26 bp, Artificial Sequence
  Description of Artificial Sequence: Synthetic oligonucleotide
cacggcgtatcttggactcggcatgg

SEQ ID NO: 325058 - DNA, 27 bp, Artificial Sequence
  Description of Artificial Sequence: Synthetic oligonucleotide
acggcgtatcttggactcggcatggga

SEQ ID NO: 325059 - DNA, 27 bp, Artificial Sequence
  Description of Artificial Sequence: Synthetic oligonucleotide
cggcgtatcttggactcggcatgggaa

SEQ ID NO: 325060 - DNA, 28 bp, Artificial Sequence
  Description of Artificial Sequence: Synthetic oligonucleotide
ggcgtatcttggactcggcatgggaaac

SEQ ID NO: 325061 - DNA, 33 bp, Artificial Sequence
  Description of Artificial Sequence: Synthetic oligonucleotide
gcgtatcttggactcggcatgggaaactttatc

SEQ ID NO: 325062 - DNA, 33 bp, Artificial Sequence
  Description of Artificial Sequence: Synthetic oligonucleotide
cgtatcttggactcggcatgggaaactttatcg

SEQ ID NO: 325063 - DNA, 33 bp, Artificial Sequence
  Description of Artificial Sequence: Synthetic oligonucleotide
gtatcttggactcggcatgggaaactttatcgc

SEQ ID NO: 325064 - DNA, 34 bp, Artificial Sequence
  Description of Artificial Sequence: Synthetic oligonucleotide
tatcttggactcggcatgggaaactttatcgctg

SEQ ID NO: 325065 - DNA, 33 bp, Artificial Sequence
  Description of Artificial Sequence: Synthetic oligonucleotide
atcttggactcggcatgggaaactttatcgctg

SEQ ID NO: 325066 - DNA, 32 bp, Artificial Sequence
  Description of Artificial Sequence: Synthetic oligonucleotide
tcttggactcggcatgggaaactttatcgctg

SEQ ID NO: 325067 - DNA, 31 bp, Artificial Sequence
  Description of Artificial Sequence: Synthetic oligonucleotide
cttggactcggcatgggaaactttatcgctg

SEQ ID NO: 325068 - DNA, 32 bp, Artificial Sequence
  Description of Artificial Sequence: Synthetic oligonucleotide
ttggactcggcatgggaaactttatcgctgag

SEQ ID NO: 325069 - DNA, 31 bp, Artificial Sequence
  Description of Artificial Sequence: Synthetic oligonucleotide
tggactcggcatgggaaactttatcgctgag

SEQ ID NO: 325070 - DNA, 30 bp, Artificial Sequence
  Description of Artificial Sequence: Synthetic oligonucleotide
ggactcggcatgggaaactttatcgctgag

SEQ ID NO: 325071 - DNA, 30 bp, Artificial Sequence
  Description of Artificial Sequence: Synthetic oligonucleotide
gactcggcatgggaaactttatcgctgagg

SEQ ID NO: 325072 - DNA, 32 bp, Artificial Sequence
  Description of Artificial Sequence: Synthetic oligonucleotide
actcggcatgggaaactttatcgctgaggttc

SEQ ID NO: 325073 - DNA, 31 bp, Artificial Sequence
  Description of Artificial Sequence: Synthetic oligonucleotide
ctcggcatgggaaactttatcgctgaggttc

SEQ ID NO: 325074 - DNA, 31 bp, Artificial Sequence
  Description of Artificial Sequence: Synthetic oligonucleotide
tcggcatgggaaactttatcgctgaggttcg

SEQ ID NO: 325075 - DNA, 30 bp, Artificial Sequence
  Description of Artificial Sequence: Synthetic oligonucleotide
cggcatgggaaactttatcgctgaggttcg

SEQ ID NO: 325076 - DNA, 33 bp, Artificial Sequence
  Description of Artificial Sequence: Synthetic oligonucleotide
ggcatgggaaactttatcgctgaggttcgattg

SEQ ID NO: 325077 - DNA, 33 bp, Artificial Sequence
  Description of Artificial Sequence: Synthetic oligonucleotide
gcatgggaaactttatcgctgaggttcgattgc

SEQ ID NO: 325078 - DNA, 33 bp, Artificial Sequence
  Description of Artificial Sequence: Synthetic oligonucleotide
catgggaaactttatcgctgaggttcgattgcc

SEQ ID NO: 325079 - DNA, 34 bp, Artificial Sequence
  Description of Artificial Sequence: Synthetic oligonucleotide
atgggaaactttatcgctgaggttcgattgccag

SEQ ID NO: 325080 - DNA, 33 bp, Artificial Sequence
  Description of Artificial Sequence: Synthetic oligonucleotide
tgggaaactttatcgctgaggttcgattgccag

SEQ ID NO: 325081 - DNA, 32 bp, Artificial Sequence
  Description of Artificial Sequence: Synthetic oligonucleotide
gggaaactttatcgctgaggttcgattgccag

SEQ ID NO: 325082 - DNA, 32 bp, Artificial Sequence
  Description of Artificial Sequence: Synthetic oligonucleotide
ggaaactttatcgctgaggttcgattgccagg

SEQ ID NO: 325083 - DNA, 34 bp, Artificial Sequence
  Description of Artificial Sequence: Synthetic oligonucleotide
gaaactttatcgctgaggttcgattgccaggttg

SEQ ID NO: 325084 - DNA, 36 bp, Artificial Sequence
  Description of Artificial Sequence: Synthetic oligonucleotide
aaactttatcgctgaggttcgattgccaggttgtac

SEQ ID NO: 325085 - DNA, 35 bp, Artificial Sequence
  Description of Artificial Sequence: Synthetic oligonucleotide
aactttatcgctgaggttcgattgccaggttgtac

SEQ ID NO: 325086 - DNA, 34 bp, Artificial Sequence
  Description of Artificial Sequence: Synthetic oligonucleotide
actttatcgctgaggttcgattgccaggttgtac

SEQ ID NO: 325087 - DNA, 33 bp, Artificial Sequence
  Description of Artificial Sequence: Synthetic oligonucleotide
ctttatcgctgaggttcgattgccaggttgtac

SEQ ID NO: 325088 - DNA, 33 bp, Artificial Sequence
  Description of Artificial Sequence: Synthetic oligonucleotide
tttatcgctgaggttcgattgccaggttgtacc

SEQ ID NO: 325089 - DNA, 32 bp, Artificial Sequence
  Description of Artificial Sequence: Synthetic oligonucleotide
ttatcgctgaggttcgattgccaggttgtacc

SEQ ID NO: 325090 - DNA, 31 bp, Artificial Sequence
  Description of Artificial Sequence: Synthetic oligonucleotide
tatcgctgaggttcgattgccaggttgtacc

SEQ ID NO: 325091 - DNA, 30 bp, Artificial Sequence
  Description of Artificial Sequence: Synthetic oligonucleotide
atcgctgaggttcgattgccaggttgtacc

SEQ ID NO: 325092 - DNA, 29 bp, Artificial Sequence
  Description of Artificial Sequence: Synthetic oligonucleotide
tcgctgaggttcgattgccaggttgtacc

SEQ ID NO: 325093 - DNA, 28 bp, Artificial Sequence
  Description of Artificial Sequence: Synthetic oligonucleotide
cgctgaggttcgattgccaggttgtacc

SEQ ID NO: 325094 - DNA, 29 bp, Artificial Sequence
  Description of Artificial Sequence: Synthetic oligonucleotide
gctgaggttcgattgccaggttgtacctg

SEQ ID NO: 325095 - DNA, 29 bp, Artificial Sequence
  Description of Artificial Sequence: Synthetic oligonucleotide
ctgaggttcgattgccaggttgtacctgc

SEQ ID NO: 325096 - DNA, 29 bp, Artificial Sequence
  Description of Artificial Sequence: Synthetic oligonucleotide
tgaggttcgattgccaggttgtacctgcc

SEQ ID NO: 325097 - DNA, 28 bp, Artificial Sequence
  Description of Artificial Sequence: Synthetic oligonucleotide
gaggttcgattgccaggttgtacctgcc

SEQ ID NO: 325098 - DNA, 28 bp, Artificial Sequence
  Description of Artificial Sequence: Synthetic oligonucleotide
aggttcgattgccaggttgtacctgccc

SEQ ID NO: 325099 - DNA, 27 bp, Artificial Sequence
  Description of Artificial Sequence: Synthetic oligonucleotide
ggttcgattgccaggttgtacctgccc

SEQ ID NO: 325100 - DNA, 27 bp, Artificial Sequence
  Description of Artificial Sequence: Synthetic oligonucleotide
gttcgattgccaggttgtacctgcccc

SEQ ID NO: 325101 - DNA, 29 bp, Artificial Sequence
  Description of Artificial Sequence: Synthetic oligonucleotide
ttcgattgccaggttgtacctgccccttc

SEQ ID NO: 325102 - DNA, 28 bp, Artificial Sequence
  Description of Artificial Sequence: Synthetic oligonucleotide
tcgattgccaggttgtacctgccccttc

SEQ ID NO: 325103 - DNA, 27 bp, Artificial Sequence
  Description of Artificial Sequence: Synthetic oligonucleotide
cgattgccaggttgtacctgccccttc

SEQ ID NO: 325104 - DNA, 28 bp, Artificial Sequence
  Description of Artificial Sequence: Synthetic oligonucleotide
gattgccaggttgtacctgccccttctg

SEQ ID NO: 325105 - DNA, 31 bp, Artificial Sequence
  Description of Artificial Sequence: Synthetic oligonucleotide
attgccaggttgtacctgccccttctgtatg

SEQ ID NO: 325106 - DNA, 30 bp, Artificial Sequence
  Description of Artificial Sequence: Synthetic oligonucleotide
ttgccaggttgtacctgccccttctgtatg

SEQ ID NO: 325107 - DNA, 29 bp, Artificial Sequence
  Description of Artificial Sequence: Synthetic oligonucleotide
tgccaggttgtacctgccccttctgtatg

SEQ ID NO: 325108 - DNA, 28 bp, Artificial Sequence
  Description of Artificial Sequence: Synthetic oligonucleotide
gccaggttgtacctgccccttctgtatg

SEQ ID NO: 325109 - DNA, 28 bp, Artificial Sequence
  Description of Artificial Sequence: Synthetic oligonucleotide
ccaggttgtacctgccccttctgtatgg

SEQ ID NO: 325110 - DNA, 28 bp, Artificial Sequence
  Description of Artificial Sequence: Synthetic oligonucleotide
caggttgtacctgccccttctgtatggc

SEQ ID NO: 325111 - DNA, 28 bp, Artificial Sequence
  Description of Artificial Sequence: Synthetic oligonucleotide
aggttgtacctgccccttctgtatggcc

SEQ ID NO: 325112 - DNA, 27 bp, Artificial Sequence
  Description of Artificial Sequence: Synthetic oligonucleotide
ggttgtacctgccccttctgtatggcc

SEQ ID NO: 325113 - DNA, 28 bp, Artificial Sequence
  Description of Artificial Sequence: Synthetic oligonucleotide
gttgtacctgccccttctgtatggccac

SEQ ID NO: 325114 - DNA, 28 bp, Artificial Sequence
  Description of Artificial Sequence: Synthetic oligonucleotide
ttgtacctgccccttctgtatggccacg

SEQ ID NO: 325115 - DNA, 27 bp, Artificial Sequence
  Description of Artificial Sequence: Synthetic oligonucleotide
tgtacctgccccttctgtatggccacg

SEQ ID NO: 325116 - DNA, 26 bp, Artificial Sequence
  Description of Artificial Sequence: Synthetic oligonucleotide
gtacctgccccttctgtatggccacg

SEQ ID NO: 325117 - DNA, 27 bp, Artificial Sequence
  Description of Artificial Sequence: Synthetic oligonucleotide
tacctgccccttctgtatggccacgca

SEQ ID NO: 325118 - DNA, 27 bp, Artificial Sequence
  Description of Artificial Sequence: Synthetic oligonucleotide
acctgccccttctgtatggccacgcaa

SEQ ID NO: 325119 - DNA, 27 bp, Artificial Sequence
  Description of Artificial Sequence: Synthetic oligonucleotide
cctgccccttctgtatggccacgcaat

SEQ ID NO: 325120 - DNA, 28 bp, Artificial Sequence
  Description of Artificial Sequence: Synthetic oligonucleotide
ctgccccttctgtatggccacgcaattg

SEQ ID NO: 325121 - DNA, 30 bp, Artificial Sequence
  Description of Artificial Sequence: Synthetic oligonucleotide
tgccccttctgtatggccacgcaattgttc

SEQ ID NO: 325122 - DNA, 29 bp, Artificial Sequence
  Description of Artificial Sequence: Synthetic oligonucleotide
gccccttctgtatggccacgcaattgttc

SEQ ID NO: 325123 - DNA, 29 bp, Artificial Sequence
  Description of Artificial Sequence: Synthetic oligonucleotide
ccccttctgtatggccacgcaattgttcc

SEQ ID NO: 325124 - DNA, 30 bp, Artificial Sequence
  Description of Artificial Sequence: Synthetic oligonucleotide
cccttctgtatggccacgcaattgttcctg

SEQ ID NO: 325125 - DNA, 32 bp, Artificial Sequence
  Description of Artificial Sequence: Synthetic oligonucleotide
ccttctgtatggccacgcaattgttcctgatc

SEQ ID NO: 325126 - DNA, 34 bp, Artificial Sequence
  Description of Artificial Sequence: Synthetic oligonucleotide
cttctgtatggccacgcaattgttcctgatcatg

SEQ ID NO: 325127 - DNA, 35 bp, Artificial Sequence
  Description of Artificial Sequence: Synthetic oligonucleotide
ttctgtatggccacgcaattgttcctgatcatgac

SEQ ID NO: 325128 - DNA, 34 bp, Artificial Sequence
  Description of Artificial Sequence: Synthetic oligonucleotide
tctgtatggccacgcaattgttcctgatcatgac

SEQ ID NO: 325129 - DNA, 33 bp, Artificial Sequence
  Description of Artificial Sequence: Synthetic oligonucleotide
ctgtatggccacgcaattgttcctgatcatgac

SEQ ID NO: 325130 - DNA, 33 bp, Artificial Sequence
  Description of Artificial Sequence: Synthetic oligonucleotide
tgtatggccacgcaattgttcctgatcatgacc

SEQ ID NO: 325131 - DNA, 32 bp, Artificial Sequence
  Description of Artificial Sequence: Synthetic oligonucleotide
gtatggccacgcaattgttcctgatcatgacc

SEQ ID NO: 325132 - DNA, 33 bp, Artificial Sequence
  Description of Artificial Sequence: Synthetic oligonucleotide
tatggccacgcaattgttcctgatcatgacctc

SEQ ID NO: 325133 - DNA, 32 bp, Artificial Sequence
  Description of Artificial Sequence: Synthetic oligonucleotide
atggccacgcaattgttcctgatcatgacctc

SEQ ID NO: 325134 - DNA, 31 bp, Artificial Sequence
  Description of Artificial Sequence: Synthetic oligonucleotide
tggccacgcaattgttcctgatcatgacctc

SEQ ID NO: 325135 - DNA, 30 bp, Artificial Sequence
  Description of Artificial Sequence: Synthetic oligonucleotide
ggccacgcaattgttcctgatcatgacctc

SEQ ID NO: 325136 - DNA, 38 bp, Artificial Sequence
  Description of Artificial Sequence: Synthetic oligonucleotide
gccacgcaattgttcctgatcatgacctcaaaaaattg

SEQ ID NO: 325137 - DNA, 38 bp, Artificial Sequence
  Description of Artificial Sequence: Synthetic oligonucleotide
ccacgcaattgttcctgatcatgacctcaaaaaattgc

SEQ ID NO: 325138 - DNA, 40 bp, Artificial Sequence
  Description of Artificial Sequence: Synthetic oligonucleotide
cacgcaattgttcctgatcatgacctcaaaaaattgcaac

SEQ ID NO: 325139 - DNA, 42 bp, Artificial Sequence
  Description of Artificial Sequence: Synthetic oligonucleotide
acgcaattgttcctgatcatgacctcaaaaaattgcaacatc

SEQ ID NO: 325140 - DNA, 41 bp, Artificial Sequence
  Description of Artificial Sequence: Synthetic oligonucleotide
cgcaattgttcctgatcatgacctcaaaaaattgcaacatc

SEQ ID NO: 325141 - DNA, 43 bp, Artificial Sequence
  Description of Artificial Sequence: Synthetic oligonucleotide
gcaattgttcctgatcatgacctcaaaaaattgcaacatctag

SEQ ID NO: 325142 - DNA, 45 bp, Artificial Sequence
  Description of Artificial Sequence: Synthetic oligonucleotide
caattgttcctgatcatgacctcaaaaaattgcaacatctagaag

SEQ ID NO: 325143 - DNA, 47 bp, Artificial Sequence
  Description of Artificial Sequence: Synthetic oligonucleotide
aattgttcctgatcatgacctcaaaaaattgcaacatctagaagatg

SEQ ID NO: 325144 - DNA, 46 bp, Artificial Sequence
  Description of Artificial Sequence: Synthetic oligonucleotide
attgttcctgatcatgacctcaaaaaattgcaacatctagaagatg

SEQ ID NO: 325145 - DNA, 45 bp, Artificial Sequence
  Description of Artificial Sequence: Synthetic oligonucleotide
ttgttcctgatcatgacctcaaaaaattgcaacatctagaagatg

SEQ ID NO: 325146 - DNA, 44 bp, Artificial Sequence
  Description of Artificial Sequence: Synthetic oligonucleotide
tgttcctgatcatgacctcaaaaaattgcaacatctagaagatg

SEQ ID NO: 325147 - DNA, 43 bp, Artificial Sequence
  Description of Artificial Sequence: Synthetic oligonucleotide
gttcctgatcatgacctcaaaaaattgcaacatctagaagatg

SEQ ID NO: 325148 - DNA, 43 bp, Artificial Sequence
  Description of Artificial Sequence: Synthetic oligonucleotide
ttcctgatcatgacctcaaaaaattgcaacatctagaagatgc

SEQ ID NO: 325149 - DNA, 42 bp, Artificial Sequence
  Description of Artificial Sequence: Synthetic oligonucleotide
tcctgatcatgacctcaaaaaattgcaacatctagaagatgc

SEQ ID NO: 325150 - DNA, 41 bp, Artificial Sequence
  Description of Artificial Sequence: Synthetic oligonucleotide
cctgatcatgacctcaaaaaattgcaacatctagaagatgc

SEQ ID NO: 325151 - DNA, 41 bp, Artificial Sequence
  Description of Artificial Sequence: Synthetic oligonucleotide
ctgatcatgacctcaaaaaattgcaacatctagaagatgcc

SEQ ID NO: 325152 - DNA, 41 bp, Artificial Sequence
  Description of Artificial Sequence: Synthetic oligonucleotide
tgatcatgacctcaaaaaattgcaacatctagaagatgccc

SEQ ID NO: 325153 - DNA, 40 bp, Artificial Sequence
  Description of Artificial Sequence: Synthetic oligonucleotide
gatcatgacctcaaaaaattgcaacatctagaagatgccc

SEQ ID NO: 325154 - DNA, 40 bp, Artificial Sequence
  Description of Artificial Sequence: Synthetic oligonucleotide
atcatgacctcaaaaaattgcaacatctagaagatgcccg

SEQ ID NO: 325155 - DNA, 39 bp, Artificial Sequence
  Description of Artificial Sequence: Synthetic oligonucleotide
tcatgacctcaaaaaattgcaacatctagaagatgcccg

SEQ ID NO: 325156 - DNA, 38 bp, Artificial Sequence
  Description of Artificial Sequence: Synthetic oligonucleotide
catgacctcaaaaaattgcaacatctagaagatgcccg

SEQ ID NO: 325157 - DNA, 39 bp, Artificial Sequence
  Description of Artificial Sequence: Synthetic oligonucleotide
atgacctcaaaaaattgcaacatctagaagatgcccgtc

SEQ ID NO: 325158 - DNA, 38 bp, Artificial Sequence
  Description of Artificial Sequence: Synthetic oligonucleotide
tgacctcaaaaaattgcaacatctagaagatgcccgtc

SEQ ID NO: 325159 - DNA, 37 bp, Artificial Sequence
  Description of Artificial Sequence: Synthetic oligonucleotide
gacctcaaaaaattgcaacatctagaagatgcccgtc

SEQ ID NO: 325160 - DNA, 38 bp, Artificial Sequence
  Description of Artificial Sequence: Synthetic oligonucleotide
acctcaaaaaattgcaacatctagaagatgcccgtcag

SEQ ID NO: 325161 - DNA, 37 bp, Artificial Sequence
  Description of Artificial Sequence: Synthetic oligonucleotide
cctcaaaaaattgcaacatctagaagatgcccgtcag

SEQ ID NO: 325162 - DNA, 41 bp, Artificial Sequence
  Description of Artificial Sequence: Synthetic oligonucleotide
ctcaaaaaattgcaacatctagaagatgcccgtcagtaaag

SEQ ID NO: 325163 - DNA, 44 bp, Artificial Sequence
  Description of Artificial Sequence: Synthetic oligonucleotide
tcaaaaaattgcaacatctagaagatgcccgtcagtaaagatac

SEQ ID NO: 325164 - DNA, 43 bp, Artificial Sequence
  Description of Artificial Sequence: Synthetic oligonucleotide
caaaaaattgcaacatctagaagatgcccgtcagtaaagatac

SEQ ID NO: 325165 - DNA, 47 bp, Artificial Sequence
  Description of Artificial Sequence: Synthetic oligonucleotide
aaaaaattgcaacatctagaagatgcccgtcagtaaagatacttatc

SEQ ID NO: 325166 - DNA, 46 bp, Artificial Sequence
  Description of Artificial Sequence: Synthetic oligonucleotide
aaaaattgcaacatctagaagatgcccgtcagtaaagatacttatc

SEQ ID NO: 325167 - DNA, 45 bp, Artificial Sequence
  Description of Artificial Sequence: Synthetic oligonucleotide
aaaattgcaacatctagaagatgcccgtcagtaaagatacttatc

SEQ ID NO: 325168 - DNA, 44 bp, Artificial Sequence
  Description of Artificial Sequence: Synthetic oligonucleotide
aaattgcaacatctagaagatgcccgtcagtaaagatacttatc

SEQ ID NO: 325169 - DNA, 43 bp, Artificial Sequence
  Description of Artificial Sequence: Synthetic oligonucleotide
aattgcaacatctagaagatgcccgtcagtaaagatacttatc

SEQ ID NO: 325170 - DNA, 42 bp, Artificial Sequence
  Description of Artificial Sequence: Synthetic oligonucleotide
attgcaacatctagaagatgcccgtcagtaaagatacttatc

SEQ ID NO: 325171 - DNA, 41 bp, Artificial Sequence
  Description of Artificial Sequence: Synthetic oligonucleotide
ttgcaacatctagaagatgcccgtcagtaaagatacttatc

SEQ ID NO: 325172 - DNA, 40 bp, Artificial Sequence
  Description of Artificial Sequence: Synthetic oligonucleotide
tgcaacatctagaagatgcccgtcagtaaagatacttatc

SEQ ID NO: 325173 - DNA, 39 bp, Artificial Sequence
  Description of Artificial Sequence: Synthetic oligonucleotide
gcaacatctagaagatgcccgtcagtaaagatacttatc

SEQ ID NO: 325174 - DNA, 39 bp, Artificial Sequence
  Description of Artificial Sequence: Synthetic oligonucleotide
caacatctagaagatgcccgtcagtaaagatacttatcc

SEQ ID NO: 325175 - DNA, 40 bp, Artificial Sequence
  Description of Artificial Sequence: Synthetic oligonucleotide
aacatctagaagatgcccgtcagtaaagatacttatccag

SEQ ID NO: 325176 - DNA, 39 bp, Artificial Sequence
  Description of Artificial Sequence: Synthetic oligonucleotide
acatctagaagatgcccgtcagtaaagatacttatccag

SEQ ID NO: 325177 - DNA, 38 bp, Artificial Sequence
  Description of Artificial Sequence: Synthetic oligonucleotide
catctagaagatgcccgtcagtaaagatacttatccag

SEQ ID NO: 325178 - DNA, 40 bp, Artificial Sequence
  Description of Artificial Sequence: Synthetic oligonucleotide
atctagaagatgcccgtcagtaaagatacttatccagaag

SEQ ID NO: 325179 - DNA, 39 bp, Artificial Sequence
  Description of Artificial Sequence: Synthetic oligonucleotide
tctagaagatgcccgtcagtaaagatacttatccagaag

SEQ ID NO: 325180 - DNA, 38 bp, Artificial Sequence
  Description of Artificial Sequence: Synthetic oligonucleotide
ctagaagatgcccgtcagtaaagatacttatccagaag

SEQ ID NO: 325181 - DNA, 42 bp, Artificial Sequence
  Description of Artificial Sequence: Synthetic oligonucleotide
tagaagatgcccgtcagtaaagatacttatccagaagaaaac

SEQ ID NO: 325182 - DNA, 41 bp, Artificial Sequence
  Description of Artificial Sequence: Synthetic oligonucleotide
agaagatgcccgtcagtaaagatacttatccagaagaaaac

SEQ ID NO: 325183 - DNA, 40 bp, Artificial Sequence
  Description of Artificial Sequence: Synthetic oligonucleotide
gaagatgcccgtcagtaaagatacttatccagaagaaaac

SEQ ID NO: 325184 - DNA, 40 bp, Artificial Sequence
  Description of Artificial Sequence: Synthetic oligonucleotide
aagatgcccgtcagtaaagatacttatccagaagaaaacg

SEQ ID NO: 325185 - DNA, 39 bp, Artificial Sequence
  Description of Artificial Sequence: Synthetic oligonucleotide
agatgcccgtcagtaaagatacttatccagaagaaaacg

SEQ ID NO: 325186 - DNA, 38 bp, Artificial Sequence
  Description of Artificial Sequence: Synthetic oligonucleotide
gatgcccgtcagtaaagatacttatccagaagaaaacg

SEQ ID NO: 325187 - DNA, 38 bp, Artificial Sequence
  Description of Artificial Sequence: Synthetic oligonucleotide
atgcccgtcagtaaagatacttatccagaagaaaacgg

SEQ ID NO: 325188 - DNA, 37 bp, Artificial Sequence
  Description of Artificial Sequence: Synthetic oligonucleotide
tgcccgtcagtaaagatacttatccagaagaaaacgg

SEQ ID NO: 325189 - DNA, 36 bp, Artificial Sequence
  Description of Artificial Sequence: Synthetic oligonucleotide
gcccgtcagtaaagatacttatccagaagaaaacgg

SEQ ID NO: 325190 - DNA, 36 bp, Artificial Sequence
  Description of Artificial Sequence: Synthetic oligonucleotide
cccgtcagtaaagatacttatccagaagaaaacggc

SEQ ID NO: 325191 - DNA, 38 bp, Artificial Sequence
  Description of Artificial Sequence: Synthetic oligonucleotide
ccgtcagtaaagatacttatccagaagaaaacggcatc

SEQ ID NO: 325192 - DNA, 40 bp, Artificial Sequence
  Description of Artificial Sequence: Synthetic oligonucleotide
cgtcagtaaagatacttatccagaagaaaacggcatcttc

SEQ ID NO: 325193 - DNA, 42 bp, Artificial Sequence
  Description of Artificial Sequence: Synthetic oligonucleotide
gtcagtaaagatacttatccagaagaaaacggcatcttcttc

SEQ ID NO: 325194 - DNA, 42 bp, Artificial Sequence
  Description of Artificial Sequence: Synthetic oligonucleotide
tcagtaaagatacttatccagaagaaaacggcatcttcttcc

SEQ ID NO: 325195 - DNA, 41 bp, Artificial Sequence
  Description of Artificial Sequence: Synthetic oligonucleotide
cagtaaagatacttatccagaagaaaacggcatcttcttcc

SEQ ID NO: 325196 - DNA, 42 bp, Artificial Sequence
  Description of Artificial Sequence: Synthetic oligonucleotide
agtaaagatacttatccagaagaaaacggcatcttcttcctg

SEQ ID NO: 325197 - DNA, 41 bp, Artificial Sequence
  Description of Artificial Sequence: Synthetic oligonucleotide
gtaaagatacttatccagaagaaaacggcatcttcttcctg

SEQ ID NO: 325198 - DNA, 41 bp, Artificial Sequence
  Description of Artificial Sequence: Synthetic oligonucleotide
taaagatacttatccagaagaaaacggcatcttcttcctgc

SEQ ID NO: 325199 - DNA, 40 bp, Artificial Sequence
  Description of Artificial Sequence: Synthetic oligonucleotide
aaagatacttatccagaagaaaacggcatcttcttcctgc

SEQ ID NO: 325200 - DNA, 39 bp, Artificial Sequence
  Description of Artificial Sequence: Synthetic oligonucleotide
aagatacttatccagaagaaaacggcatcttcttcctgc

SEQ ID NO: 325201 - DNA, 38 bp, Artificial Sequence
  Description of Artificial Sequence: Synthetic oligonucleotide
agatacttatccagaagaaaacggcatcttcttcctgc

SEQ ID NO: 325202 - DNA, 37 bp, Artificial Sequence
  Description of Artificial Sequence: Synthetic oligonucleotide
gatacttatccagaagaaaacggcatcttcttcctgc

SEQ ID NO: 325203 - DNA, 39 bp, Artificial Sequence
  Description of Artificial Sequence: Synthetic oligonucleotide
atacttatccagaagaaaacggcatcttcttcctgcaag

SEQ ID NO: 325204 - DNA, 38 bp, Artificial Sequence
  Description of Artificial Sequence: Synthetic oligonucleotide
tacttatccagaagaaaacggcatcttcttcctgcaag

SEQ ID NO: 325205 - DNA, 37 bp, Artificial Sequence
  Description of Artificial Sequence: Synthetic oligonucleotide
acttatccagaagaaaacggcatcttcttcctgcaag

SEQ ID NO: 325206 - DNA, 36 bp, Artificial Sequence
  Description of Artificial Sequence: Synthetic oligonucleotide
cttatccagaagaaaacggcatcttcttcctgcaag

SEQ ID NO: 325207 - DNA, 36 bp, Artificial Sequence
  Description of Artificial Sequence: Synthetic oligonucleotide
ttatccagaagaaaacggcatcttcttcctgcaagc

SEQ ID NO: 325208 - DNA, 35 bp, Artificial Sequence
  Description of Artificial Sequence: Synthetic oligonucleotide
tatccagaagaaaacggcatcttcttcctgcaagc

SEQ ID NO: 325209 - DNA, 34 bp, Artificial Sequence
  Description of Artificial Sequence: Synthetic oligonucleotide
atccagaagaaaacggcatcttcttcctgcaagc

SEQ ID NO: 325210 - DNA, 33 bp, Artificial Sequence
  Description of Artificial Sequence: Synthetic oligonucleotide
tccagaagaaaacggcatcttcttcctgcaagc

SEQ ID NO: 325211 - DNA, 32 bp, Artificial Sequence
  Description of Artificial Sequence: Synthetic oligonucleotide
ccagaagaaaacggcatcttcttcctgcaagc

SEQ ID NO: 325212 - DNA, 32 bp, Artificial Sequence
  Description of Artificial Sequence: Synthetic oligonucleotide
cagaagaaaacggcatcttcttcctgcaagcg

SEQ ID NO: 325213 - DNA, 34 bp, Artificial Sequence
  Description of Artificial Sequence: Synthetic oligonucleotide
agaagaaaacggcatcttcttcctgcaagcgaag

SEQ ID NO: 325214 - DNA, 33 bp, Artificial Sequence
  Description of Artificial Sequence: Synthetic oligonucleotide
gaagaaaacggcatcttcttcctgcaagcgaag

SEQ ID NO: 325215 - DNA, 37 bp, Artificial Sequence
  Description of Artificial Sequence: Synthetic oligonucleotide
aagaaaacggcatcttcttcctgcaagcgaagaaaag

SEQ ID NO: 325216 - DNA, 36 bp, Artificial Sequence
  Description of Artificial Sequence: Synthetic oligonucleotide
agaaaacggcatcttcttcctgcaagcgaagaaaag

SEQ ID NO: 325217 - DNA, 35 bp, Artificial Sequence
  Description of Artificial Sequence: Synthetic oligonucleotide
gaaaacggcatcttcttcctgcaagcgaagaaaag

SEQ ID NO: 325218 - DNA, 38 bp, Artificial Sequence
  Description of Artificial Sequence: Synthetic oligonucleotide
aaaacggcatcttcttcctgcaagcgaagaaaagattg

SEQ ID NO: 325219 - DNA, 37 bp, Artificial Sequence
  Description of Artificial Sequence: Synthetic oligonucleotide
aaacggcatcttcttcctgcaagcgaagaaaagattg

SEQ ID NO: 325220 - DNA, 36 bp, Artificial Sequence
  Description of Artificial Sequence: Synthetic oligonucleotide
aacggcatcttcttcctgcaagcgaagaaaagattg

SEQ ID NO: 325221 - DNA, 35 bp, Artificial Sequence
  Description of Artificial Sequence: Synthetic oligonucleotide
acggcatcttcttcctgcaagcgaagaaaagattg

SEQ ID NO: 325222 - DNA, 34 bp, Artificial Sequence
  Description of Artificial Sequence: Synthetic oligonucleotide
cggcatcttcttcctgcaagcgaagaaaagattg

SEQ ID NO: 325223 - DNA, 34 bp, Artificial Sequence
  Description of Artificial Sequence: Synthetic oligonucleotide
ggcatcttcttcctgcaagcgaagaaaagattgg

SEQ ID NO: 325224 - DNA, 35 bp, Artificial Sequence
  Description of Artificial Sequence: Synthetic oligonucleotide
gcatcttcttcctgcaagcgaagaaaagattggtg

SEQ ID NO: 325225 - DNA, 35 bp, Artificial Sequence
  Description of Artificial Sequence: Synthetic oligonucleotide
catcttcttcctgcaagcgaagaaaagattggtgg

SEQ ID NO: 325226 - DNA, 38 bp, Artificial Sequence
  Description of Artificial Sequence: Synthetic oligonucleotide
atcttcttcctgcaagcgaagaaaagattggtggaaac

SEQ ID NO: 325227 - DNA, 37 bp, Artificial Sequence
  Description of Artificial Sequence: Synthetic oligonucleotide
tcttcttcctgcaagcgaagaaaagattggtggaaac

SEQ ID NO: 325228 - DNA, 36 bp, Artificial Sequence
  Description of Artificial Sequence: Synthetic oligonucleotide
cttcttcctgcaagcgaagaaaagattggtggaaac

SEQ ID NO: 325229 - DNA, 36 bp, Artificial Sequence
  Description of Artificial Sequence: Synthetic oligonucleotide
ttcttcctgcaagcgaagaaaagattggtggaaacc

SEQ ID NO: 325230 - DNA, 35 bp, Artificial Sequence
  Description of Artificial Sequence: Synthetic oligonucleotide
tcttcctgcaagcgaagaaaagattggtggaaacc

SEQ ID NO: 325231 - DNA, 34 bp, Artificial Sequence
  Description of Artificial Sequence: Synthetic oligonucleotide
cttcctgcaagcgaagaaaagattggtggaaacc

SEQ ID NO: 325232 - DNA, 34 bp, Artificial Sequence
  Description of Artificial Sequence: Synthetic oligonucleotide
ttcctgcaagcgaagaaaagattggtggaaaccc

SEQ ID NO: 325233 - DNA, 33 bp, Artificial Sequence
  Description of Artificial Sequence: Synthetic oligonucleotide
tcctgcaagcgaagaaaagattggtggaaaccc

SEQ ID NO: 325234 - DNA, 32 bp, Artificial Sequence
  Description of Artificial Sequence: Synthetic oligonucleotide
cctgcaagcgaagaaaagattggtggaaaccc

SEQ ID NO: 325235 - DNA, 32 bp, Artificial Sequence
  Description of Artificial Sequence: Synthetic oligonucleotide
ctgcaagcgaagaaaagattggtggaaacccc

SEQ ID NO: 325236 - DNA, 35 bp, Artificial Sequence
  Description of Artificial Sequence: Synthetic oligonucleotide
tgcaagcgaagaaaagattggtggaaacccctttg

SEQ ID NO: 325237 - DNA, 34 bp, Artificial Sequence
  Description of Artificial Sequence: Synthetic oligonucleotide
gcaagcgaagaaaagattggtggaaacccctttg

SEQ ID NO: 325238 - DNA, 35 bp, Artificial Sequence
  Description of Artificial Sequence: Synthetic oligonucleotide
caagcgaagaaaagattggtggaaacccctttgtg

SEQ ID NO: 325239 - DNA, 22 bp, Artificial Sequence
  Description of Artificial Sequence: Synthetic oligonucleotide
atgacgcctgctccgcccgcac

SEQ ID NO: 325240 - DNA, 21 bp, Artificial Sequence
  Description of Artificial Sequence: Synthetic oligonucleotide
tgacgcctgctccgcccgcac

SEQ ID NO: 325241 - DNA, 20 bp, Artificial Sequence
  Description of Artificial Sequence: Synthetic oligonucleotide
gacgcctgctccgcccgcac

SEQ ID NO: 325242 - DNA, 21 bp, Artificial Sequence
  Description of Artificial Sequence: Synthetic oligonucleotide
acgcctgctccgcccgcacgt

SEQ ID NO: 325243 - DNA, 20 bp, Artificial Sequence
  Description of Artificial Sequence: Synthetic oligonucleotide
cgcctgctccgcccgcacgt

SEQ ID NO: 325244 - DNA, 20 bp, Artificial Sequence
  Description of Artificial Sequence: Synthetic oligonucleotide
gcctgctccgcccgcacgtg

SEQ ID NO: 325245 - DNA, 20 bp, Artificial Sequence
  Description of Artificial Sequence: Synthetic oligonucleotide
cctgctccgcccgcacgtgc

SEQ ID NO: 325246 - DNA, 20 bp, Artificial Sequence
  Description of Artificial Sequence: Synthetic oligonucleotide
ctgctccgcccgcacgtgcc

SEQ ID NO: 325247 - DNA, 20 bp, Artificial Sequence
  Description of Artificial Sequence: Synthetic oligonucleotide
tgctccgcccgcacgtgccg

SEQ ID NO: 325248 - DNA, 20 bp, Artificial Sequence
  Description of Artificial Sequence: Synthetic oligonucleotide
gctccgcccgcacgtgccgt

SEQ ID NO: 325249 - DNA, 20 bp, Artificial Sequence
  Description of Artificial Sequence: Synthetic oligonucleotide
ctccgcccgcacgtgccgct

SEQ ID NO: 325250 - DNA, 20 bp, Artificial Sequence
  Description of Artificial Sequence: Synthetic oligonucleotide
tccgcccgcacgtgccgcgt

SEQ ID NO: 325251 - DNA, 20 bp, Artificial Sequence
  Description of Artificial Sequence: Synthetic oligonucleotide
ccgcccgcacgtgccgcgtt

SEQ ID NO: 325252 - DNA, 20 bp, Artificial Sequence
  Description of Artificial Sequence: Synthetic oligonucleotide
cgcccgcacgtgccgcgctt

SEQ ID NO: 325253 - DNA, 20 bp, Artificial Sequence
  Description of Artificial Sequence: Synthetic oligonucleotide
gcccgcacgtgccgcgcctt

SEQ ID NO: 325254 - DNA, 20 bp, Artificial Sequence
  Description of Artificial Sequence: Synthetic oligonucleotide
cccgcacgtgccgcgcccat

SEQ ID NO: 325255 - DNA, 20 bp, Artificial Sequence
  Description of Artificial Sequence: Synthetic oligonucleotide
ccgcacgtgccgcgcccagt

SEQ ID NO: 325256 - DNA, 20 bp, Artificial Sequence
  Description of Artificial Sequence: Synthetic oligonucleotide
cgcacgtgccgcgcccagct

SEQ ID NO: 325257 - DNA, 20 bp, Artificial Sequence
  Description of Artificial Sequence: Synthetic oligonucleotide
gcacgtgccgcgcccagcgt

SEQ ID NO: 325258 - DNA, 20 bp, Artificial Sequence
  Description of Artificial Sequence: Synthetic oligonucleotide
cacgtgccgcgcccagcgca

SEQ ID NO: 325259 - DNA, 20 bp, Artificial Sequence
  Description of Artificial Sequence: Synthetic oligonucleotide
acgtgccgcgcccagcgcag

SEQ ID NO: 325260 - DNA, 20 bp, Artificial Sequence
  Description of Artificial Sequence: Synthetic oligonucleotide
cgtgccgcgcccagcgcagt

SEQ ID NO: 325261 - DNA, 20 bp, Artificial Sequence
  Description of Artificial Sequence: Synthetic oligonucleotide
gtgccgcgcccagcgcagct

SEQ ID NO: 325262 - DNA, 20 bp, Artificial Sequence
  Description of Artificial Sequence: Synthetic oligonucleotide
tgccgcgcccagcgcagcgt

SEQ ID NO: 325263 - DNA, 20 bp, Artificial Sequence
  Description of Artificial Sequence: Synthetic oligonucleotide
gccgcgcccagcgcagcgtt

SEQ ID NO: 325264 - DNA, 20 bp, Artificial Sequence
  Description of Artificial Sequence: Synthetic oligonucleotide
ccgcgcccagcgcagcgctt

SEQ ID NO: 325265 - DNA, 20 bp, Artificial Sequence
  Description of Artificial Sequence: Synthetic oligonucleotide
cgcgcccagcgcagcgcgtt

SEQ ID NO: 325266 - DNA, 20 bp, Artificial Sequence
  Description of Artificial Sequence: Synthetic oligonucleotide
gcgcccagcgcagcgcgctt

SEQ ID NO: 325267 - DNA, 20 bp, Artificial Sequence
  Description of Artificial Sequence: Synthetic oligonucleotide
cgcccagcgcagcgcgcgtt

SEQ ID NO: 325268 - DNA, 20 bp, Artificial Sequence
  Description of Artificial Sequence: Synthetic oligonucleotide
gcccagcgcagcgcgcgctt

SEQ ID NO: 325269 - DNA, 20 bp, Artificial Sequence
  Description of Artificial Sequence: Synthetic oligonucleotide
cccagcgcagcgcgcgcctt

SEQ ID NO: 325270 - DNA, 20 bp, Artificial Sequence
  Description of Artificial Sequence: Synthetic oligonucleotide
ccagcgcagcgcgcgccctt

SEQ ID NO: 325271 - DNA, 20 bp, Artificial Sequence
  Description of Artificial Sequence: Synthetic oligonucleotide
cagcgcagcgcgcgcccctt

SEQ ID NO: 325272 - DNA, 20 bp, Artificial Sequence
  Description of Artificial Sequence: Synthetic oligonucleotide
agcgcagcgcgcgccccctt

SEQ ID NO: 325273 - DNA, 20 bp, Artificial Sequence
  Description of Artificial Sequence: Synthetic oligonucleotide
gcgcagcgcgcgcccccttt

SEQ ID NO: 325274 - DNA, 20 bp, Artificial Sequence
  Description of Artificial Sequence: Synthetic oligonucleotide
cgcagcgcgcgcccccgttt

SEQ ID NO: 325275 - DNA, 20 bp, Artificial Sequence
  Description of Artificial Sequence: Synthetic oligonucleotide
gcagcgcgcgcccccgtctt

SEQ ID NO: 325276 - DNA, 20 bp, Artificial Sequence
  Description of Artificial Sequence: Synthetic oligonucleotide
cagcgcgcgcccccgtcctt

SEQ ID NO: 325277 - DNA, 20 bp, Artificial Sequence
  Description of Artificial Sequence: Synthetic oligonucleotide
agcgcgcgcccccgtccctt

SEQ ID NO: 325278 - DNA, 20 bp, Artificial Sequence
  Description of Artificial Sequence: Synthetic oligonucleotide
gcgcgcgcccccgtcccttt

SEQ ID NO: 325279 - DNA, 20 bp, Artificial Sequence
  Description of Artificial Sequence: Synthetic oligonucleotide
cgcgcgcccccgtccctgtt

SEQ ID NO: 325280 - DNA, 20 bp, Artificial Sequence
  Description of Artificial Sequence: Synthetic oligonucleotide
gcgcgcccccgtccctggtt

SEQ ID NO: 325281 - DNA, 20 bp, Artificial Sequence
  Description of Artificial Sequence: Synthetic oligonucleotide
cgcgcccccgtccctgggtt

SEQ ID NO: 325282 - DNA, 20 bp, Artificial Sequence
  Description of Artificial Sequence: Synthetic oligonucleotide
gcgcccccgtccctgggctt

SEQ ID NO: 325283 - DNA, 20 bp, Artificial Sequence
  Description of Artificial Sequence: Synthetic oligonucleotide
cgcccccgtccctgggcctt

SEQ ID NO: 325284 - DNA, 20 bp, Artificial Sequence
  Description of Artificial Sequence: Synthetic oligonucleotide
gcccccgtccctgggccgtt

SEQ ID NO: 325285 - DNA, 20 bp, Artificial Sequence
  Description of Artificial Sequence: Synthetic oligonucleotide
cccccgtccctgggccgctt

SEQ ID NO: 325286 - DNA, 20 bp, Artificial Sequence
  Description of Artificial Sequence: Synthetic oligonucleotide
ccccgtccctgggccgcctt

SEQ ID NO: 325287 - DNA, 20 bp, Artificial Sequence
  Description of Artificial Sequence: Synthetic oligonucleotide
cccgtccctgggccgccgtt

SEQ ID NO: 325288 - DNA, 20 bp, Artificial Sequence
  Description of Artificial Sequence: Synthetic oligonucleotide
ccgtccctgggccgccggtt

SEQ ID NO: 325289 - DNA, 20 bp, Artificial Sequence
  Description of Artificial Sequence: Synthetic oligonucleotide
cgtccctgggccgccggctt

SEQ ID NO: 325290 - DNA, 20 bp, Artificial Sequence
  Description of Artificial Sequence: Synthetic oligonucleotide
gtccctgggccgccggctgt

SEQ ID NO: 325291 - DNA, 20 bp, Artificial Sequence
  Description of Artificial Sequence: Synthetic oligonucleotide
tccctgggccgccggctggt

SEQ ID NO: 325292 - DNA, 20 bp, Artificial Sequence
  Description of Artificial Sequence: Synthetic oligonucleotide
ccctgggccgccggctggtt

SEQ ID NO: 325293 - DNA, 20 bp, Artificial Sequence
  Description of Artificial Sequence: Synthetic oligonucleotide
cctgggccgccggctgggtt

SEQ ID NO: 325294 - DNA, 20 bp, Artificial Sequence
  Description of Artificial Sequence: Synthetic oligonucleotide
ctgggccgccggctgggttg

SEQ ID NO: 325295 - DNA, 20 bp, Artificial Sequence
  Description of Artificial Sequence: Synthetic oligonucleotide
tgggccgccggctgggttgg

SEQ ID NO: 325296 - DNA, 20 bp, Artificial Sequence
  Description of Artificial Sequence: Synthetic oligonucleotide
gggccgccggctgggttggt

SEQ ID NO: 325297 - DNA, 20 bp, Artificial Sequence
  Description of Artificial Sequence: Synthetic oligonucleotide
ggccgccggctgggttgggt

SEQ ID NO: 325298 - DNA, 20 bp, Artificial Sequence
  Description of Artificial Sequence: Synthetic oligonucleotide
gccgccggctgggttggggt

SEQ ID NO: 325299 - DNA, 21 bp, Artificial Sequence
  Description of Artificial Sequence: Synthetic oligonucleotide
ccgccggctgggttggggcat

SEQ ID NO: 325300 - DNA, 21 bp, Artificial Sequence
  Description of Artificial Sequence: Synthetic oligonucleotide
cgccggctgggttggggcatc

SEQ ID NO: 325301 - DNA, 21 bp, Artificial Sequence
  Description of Artificial Sequence: Synthetic oligonucleotide
gccggctgggttggggcatcc

SEQ ID NO: 325302 - DNA, 21 bp, Artificial Sequence
  Description of Artificial Sequence: Synthetic oligonucleotide
ccggctgggttggggcatccg

SEQ ID NO: 325303 - DNA, 22 bp, Artificial Sequence
  Description of Artificial Sequence: Synthetic oligonucleotide
cggctgggttggggcatccgct

SEQ ID NO: 325304 - DNA, 22 bp, Artificial Sequence
  Description of Artificial Sequence: Synthetic oligonucleotide
ggctgggttggggcatccgctg

SEQ ID NO: 325305 - DNA, 22 bp, Artificial Sequence
  Description of Artificial Sequence: Synthetic oligonucleotide
gctgggttggggcatccgctgc

SEQ ID NO: 325306 - DNA, 22 bp, Artificial Sequence
  Description of Artificial Sequence: Synthetic oligonucleotide
ctgggttggggcatccgctgcg

SEQ ID NO: 325307 - DNA, 22 bp, Artificial Sequence
  Description of Artificial Sequence: Synthetic oligonucleotide
tgggttggggcatccgctgcgc

SEQ ID NO: 325308 - DNA, 21 bp, Artificial Sequence
  Description of Artificial Sequence: Synthetic oligonucleotide
gggttggggcatccgctgcgc

SEQ ID NO: 325309 - DNA, 22 bp, Artificial Sequence
  Description of Artificial Sequence: Synthetic oligonucleotide
ggttggggcatccgctgcgcct

SEQ ID NO: 325310 - DNA, 22 bp, Artificial Sequence
  Description of Artificial Sequence: Synthetic oligonucleotide
gttggggcatccgctgcgcctg

SEQ ID NO: 325311 - DNA, 22 bp, Artificial Sequence
  Description of Artificial Sequence: Synthetic oligonucleotide
ttggggcatccgctgcgcctgc

SEQ ID NO: 325312 - DNA, 21 bp, Artificial Sequence
  Description of Artificial Sequence: Synthetic oligonucleotide
tggggcatccgctgcgcctgc

SEQ ID NO: 325313 - DNA, 20 bp, Artificial Sequence
  Description of Artificial Sequence: Synthetic oligonucleotide
ggggcatccgctgcgcctgc

SEQ ID NO: 325314 - DNA, 20 bp, Artificial Sequence
  Description of Artificial Sequence: Synthetic oligonucleotide
gggcatccgctgcgcctgcg

SEQ ID NO: 325315 - DNA, 20 bp, Artificial Sequence
  Description of Artificial Sequence: Synthetic oligonucleotide
ggcatccgctgcgcctgcgg

SEQ ID NO: 325316 - DNA, 21 bp, Artificial Sequence
  Description of Artificial Sequence: Synthetic oligonucleotide
gcatccgctgcgcctgcggct

SEQ ID NO: 325317 - DNA, 21 bp, Artificial Sequence
  Description of Artificial Sequence: Synthetic oligonucleotide
catccgctgcgcctgcggctg

SEQ ID NO: 325318 - DNA, 22 bp, Artificial Sequence
  Description of Artificial Sequence: Synthetic oligonucleotide
atccgctgcgcctgcggctggt

SEQ ID NO: 325319 - DNA, 21 bp, Artificial Sequence
  Description of Artificial Sequence: Synthetic oligonucleotide
tccgctgcgcctgcggctggt

SEQ ID NO: 325320 - DNA, 20 bp, Artificial Sequence
  Description of Artificial Sequence: Synthetic oligonucleotide
ccgctgcgcctgcggctggt

SEQ ID NO: 325321 - DNA, 20 bp, Artificial Sequence
  Description of Artificial Sequence: Synthetic oligonucleotide
cgctgcgcctgcggctggtg

SEQ ID NO: 325322 - DNA, 21 bp, Artificial Sequence
  Description of Artificial Sequence: Synthetic oligonucleotide
gctgcgcctgcggctggtgct

SEQ ID NO: 325323 - DNA, 21 bp, Artificial Sequence
  Description of Artificial Sequence: Synthetic oligonucleotide
ctgcgcctgcggctggtgctg

SEQ ID NO: 325324 - DNA, 22 bp, Artificial Sequence
  Description of Artificial Sequence: Synthetic oligonucleotide
tgcgcctgcggctggtgctgct

SEQ ID NO: 325325 - DNA, 21 bp, Artificial Sequence
  Description of Artificial Sequence: Synthetic oligonucleotide
gcgcctgcggctggtgctgct

SEQ ID NO: 325326 - DNA, 21 bp, Artificial Sequence
  Description of Artificial Sequence: Synthetic oligonucleotide
cgcctgcggctggtgctgctg

SEQ ID NO: 325327 - DNA, 22 bp, Artificial Sequence
  Description of Artificial Sequence: Synthetic oligonucleotide
gcctgcggctggtgctgctgca

SEQ ID NO: 325328 - DNA, 23 bp, Artificial Sequence
  Description of Artificial Sequence: Synthetic oligonucleotide
cctgcggctggtgctgctgcact

SEQ ID NO: 325329 - DNA, 23 bp, Artificial Sequence
  Description of Artificial Sequence: Synthetic oligonucleotide
ctgcggctggtgctgctgcactg

SEQ ID NO: 325330 - DNA, 23 bp, Artificial Sequence
  Description of Artificial Sequence: Synthetic oligonucleotide
tgcggctggtgctgctgcactgg

SEQ ID NO: 325331 - DNA, 22 bp, Artificial Sequence
  Description of Artificial Sequence: Synthetic oligonucleotide
gcggctggtgctgctgcactgg

SEQ ID NO: 325332 - DNA, 22 bp, Artificial Sequence
  Description of Artificial Sequence: Synthetic oligonucleotide
cggctggtgctgctgcactggg

SEQ ID NO: 325333 - DNA, 22 bp, Artificial Sequence
  Description of Artificial Sequence: Synthetic oligonucleotide
ggctggtgctgctgcactgggc

SEQ ID NO: 325334 - DNA, 22 bp, Artificial Sequence
  Description of Artificial Sequence: Synthetic oligonucleotide
gctggtgctgctgcactgggcg

SEQ ID NO: 325335 - DNA, 22 bp, Artificial Sequence
  Description of Artificial Sequence: Synthetic oligonucleotide
ctggtgctgctgcactgggcgg

SEQ ID NO: 325336 - DNA, 22 bp, Artificial Sequence
  Description of Artificial Sequence: Synthetic oligonucleotide
tggtgctgctgcactgggcggc

SEQ ID NO: 325337 - DNA, 21 bp, Artificial Sequence
  Description of Artificial Sequence: Synthetic oligonucleotide
ggtgctgctgcactgggcggc

SEQ ID NO: 325338 - DNA, 21 bp, Artificial Sequence
  Description of Artificial Sequence: Synthetic oligonucleotide
gtgctgctgcactgggcggcg

SEQ ID NO: 325339 - DNA, 21 bp, Artificial Sequence
  Description of Artificial Sequence: Synthetic oligonucleotide
tgctgctgcactgggcggcgg

SEQ ID NO: 325340 - DNA, 20 bp, Artificial Sequence
  Description of Artificial Sequence: Synthetic oligonucleotide
gctgctgcactgggcggcgg

SEQ ID NO: 325341 - DNA, 20 bp, Artificial Sequence
  Description of Artificial Sequence: Synthetic oligonucleotide
ctgctgcactgggcggcggc

SEQ ID NO: 325342 - DNA, 20 bp, Artificial Sequence
  Description of Artificial Sequence: Synthetic oligonucleotide
tgctgcactgggcggcggcc

SEQ ID NO: 325343 - DNA, 20 bp, Artificial Sequence
  Description of Artificial Sequence: Synthetic oligonucleotide
gctgcactgggcggcggcct

SEQ ID NO: 325344 - DNA, 20 bp, Artificial Sequence
  Description of Artificial Sequence: Synthetic oligonucleotide
ctgcactgggcggcggccgt

SEQ ID NO: 325345 - DNA, 20 bp, Artificial Sequence
  Description of Artificial Sequence: Synthetic oligonucleotide
tgcactgggcggcggccgct

SEQ ID NO: 325346 - DNA, 20 bp, Artificial Sequence
  Description of Artificial Sequence: Synthetic oligonucleotide
gcactgggcggcggccgctt

SEQ ID NO: 325347 - DNA, 20 bp, Artificial Sequence
  Description of Artificial Sequence: Synthetic oligonucleotide
cactgggcggcggccgcctt

SEQ ID NO: 325348 - DNA, 20 bp, Artificial Sequence
  Description of Artificial Sequence: Synthetic oligonucleotide
actgggcggcggccgcctct

SEQ ID NO: 325349 - DNA, 20 bp, Artificial Sequence
  Description of Artificial Sequence: Synthetic oligonucleotide
ctgggcggcggccgcctctt

SEQ ID NO: 325350 - DNA, 20 bp, Artificial Sequence
  Description of Artificial Sequence: Synthetic oligonucleotide
tgggcggcggccgcctcctt

SEQ ID NO: 325351 - DNA, 20 bp, Artificial Sequence
  Description of Artificial Sequence: Synthetic oligonucleotide
gggcggcggccgcctccttt

SEQ ID NO: 325352 - DNA, 20 bp, Artificial Sequence
  Description of Artificial Sequence: Synthetic oligonucleotide
ggcggcggccgcctcccttt

SEQ ID NO: 325353 - DNA, 20 bp, Artificial Sequence
  Description of Artificial Sequence: Synthetic oligonucleotide
gcggcggccgcctccccttt

SEQ ID NO: 325354 - DNA, 20 bp, Artificial Sequence
  Description of Artificial Sequence: Synthetic oligonucleotide
cggcggccgcctcccccttt

SEQ ID NO: 325355 - DNA, 20 bp, Artificial Sequence
  Description of Artificial Sequence: Synthetic oligonucleotide
ggcggccgcctccccccatt

SEQ ID NO: 325356 - DNA, 20 bp, Artificial Sequence
  Description of Artificial Sequence: Synthetic oligonucleotide
gcggccgcctccccccagtt

SEQ ID NO: 325357 - DNA, 20 bp, Artificial Sequence
  Description of Artificial Sequence: Synthetic oligonucleotide
cggccgcctccccccaggtt

SEQ ID NO: 325358 - DNA, 20 bp, Artificial Sequence
  Description of Artificial Sequence: Synthetic oligonucleotide
ggccgcctccccccagggtt

SEQ ID NO: 325359 - DNA, 20 bp, Artificial Sequence
  Description of Artificial Sequence: Synthetic oligonucleotide
gccgcctccccccagggctt

SEQ ID NO: 325360 - DNA, 20 bp, Artificial Sequence
  Description of Artificial Sequence: Synthetic oligonucleotide
ccgcctccccccagggcctt

SEQ ID NO: 325361 - DNA, 20 bp, Artificial Sequence
  Description of Artificial Sequence: Synthetic oligonucleotide
cgcctccccccagggcctct

SEQ ID NO: 325362 - DNA, 22 bp, Artificial Sequence
  Description of Artificial Sequence: Synthetic oligonucleotide
gcctccccccagggcctcctaa

SEQ ID NO: 325363 - DNA, 22 bp, Artificial Sequence
  Description of Artificial Sequence: Synthetic oligonucleotide
cctccccccagggcctcctaag

SEQ ID NO: 325364 - DNA, 23 bp, Artificial Sequence
  Description of Artificial Sequence: Synthetic oligonucleotide
ctccccccagggcctcctaagga

SEQ ID NO: 325365 - DNA, 23 bp, Artificial Sequence
  Description of Artificial Sequence: Synthetic oligonucleotide
tccccccagggcctcctaaggag

SEQ ID NO: 325366 - DNA, 22 bp, Artificial Sequence
  Description of Artificial Sequence: Synthetic oligonucleotide
ccccccagggcctcctaaggag

SEQ ID NO: 325367 - DNA, 22 bp, Artificial Sequence
  Description of Artificial Sequence: Synthetic oligonucleotide
cccccagggcctcctaaggagg

SEQ ID NO: 325368 - DNA, 22 bp, Artificial Sequence
  Description of Artificial Sequence: Synthetic oligonucleotide
ccccagggcctcctaaggaggg

SEQ ID NO: 325369 - DNA, 23 bp, Artificial Sequence
  Description of Artificial Sequence: Synthetic oligonucleotide
cccagggcctcctaaggagggga

SEQ ID NO: 325370 - DNA, 23 bp, Artificial Sequence
  Description of Artificial Sequence: Synthetic oligonucleotide
ccagggcctcctaaggaggggac

SEQ ID NO: 325371 - DNA, 23 bp, Artificial Sequence
  Description of Artificial Sequence: Synthetic oligonucleotide
cagggcctcctaaggaggggacc

SEQ ID NO: 325372 - DNA, 23 bp, Artificial Sequence
  Description of Artificial Sequence: Synthetic oligonucleotide
agggcctcctaaggaggggaccc

SEQ ID NO: 325373 - DNA, 22 bp, Artificial Sequence
  Description of Artificial Sequence: Synthetic oligonucleotide
gggcctcctaaggaggggaccc

SEQ ID NO: 325374 - DNA, 22 bp, Artificial Sequence
  Description of Artificial Sequence: Synthetic oligonucleotide
ggcctcctaaggaggggacccc

SEQ ID NO: 325375 - DNA, 22 bp, Artificial Sequence
  Description of Artificial Sequence: Synthetic oligonucleotide
gcctcctaaggaggggaccccg

SEQ ID NO: 325376 - DNA, 24 bp, Artificial Sequence
  Description of Artificial Sequence: Synthetic oligonucleotide
cctcctaaggaggggaccccgctt

SEQ ID NO: 325377 - DNA, 26 bp, Artificial Sequence
  Description of Artificial Sequence: Synthetic oligonucleotide
ctcctaaggaggggaccccgcttctt

SEQ ID NO: 325378 - DNA, 26 bp, Artificial Sequence
  Description of Artificial Sequence: Synthetic oligonucleotide
tcctaaggaggggaccccgcttcttc

SEQ ID NO: 325379 - DNA, 25 bp, Artificial Sequence
  Description of Artificial Sequence: Synthetic oligonucleotide
cctaaggaggggaccccgcttcttc

SEQ ID NO: 325380 - DNA, 25 bp, Artificial Sequence
  Description of Artificial Sequence: Synthetic oligonucleotide
ctaaggaggggaccccgcttcttcg

SEQ ID NO: 325381 - DNA, 25 bp, Artificial Sequence
  Description of Artificial Sequence: Synthetic oligonucleotide
taaggaggggaccccgcttcttcgc

SEQ ID NO: 325382 - DNA, 24 bp, Artificial Sequence
  Description of Artificial Sequence: Synthetic oligonucleotide
aaggaggggaccccgcttcttcgc

SEQ ID NO: 325383 - DNA, 23 bp, Artificial Sequence
  Description of Artificial Sequence: Synthetic oligonucleotide
aggaggggaccccgcttcttcgc

SEQ ID NO: 325384 - DNA, 22 bp, Artificial Sequence
  Description of Artificial Sequence: Synthetic oligonucleotide
ggaggggaccccgcttcttcgc

SEQ ID NO: 325385 - DNA, 22 bp, Artificial Sequence
  Description of Artificial Sequence: Synthetic oligonucleotide
gaggggaccccgcttcttcgcc

SEQ ID NO: 325386 - DNA, 23 bp, Artificial Sequence
  Description of Artificial Sequence: Synthetic oligonucleotide
aggggaccccgcttcttcgccga

SEQ ID NO: 325387 - DNA, 22 bp, Artificial Sequence
  Description of Artificial Sequence: Synthetic oligonucleotide
ggggaccccgcttcttcgccga

SEQ ID NO: 325388 - DNA, 23 bp, Artificial Sequence
  Description of Artificial Sequence: Synthetic oligonucleotide
gggaccccgcttcttcgccgact

SEQ ID NO: 325389 - DNA, 23 bp, Artificial Sequence
  Description of Artificial Sequence: Synthetic oligonucleotide
ggaccccgcttcttcgccgactg

SEQ ID NO: 325390 - DNA, 26 bp, Artificial Sequence
  Description of Artificial Sequence: Synthetic oligonucleotide
gaccccgcttcttcgccgactggaaa

SEQ ID NO: 325391 - DNA, 26 bp, Artificial Sequence
  Description of Artificial Sequence: Synthetic oligonucleotide
accccgcttcttcgccgactggaaag

SEQ ID NO: 325392 - DNA, 25 bp, Artificial Sequence
  Description of Artificial Sequence: Synthetic oligonucleotide
ccccgcttcttcgccgactggaaag

SEQ ID NO: 325393 - DNA, 25 bp, Artificial Sequence
  Description of Artificial Sequence: Synthetic oligonucleotide
cccgcttcttcgccgactggaaagg

SEQ ID NO: 325394 - DNA, 25 bp, Artificial Sequence
  Description of Artificial Sequence: Synthetic oligonucleotide
ccgcttcttcgccgactggaaaggg

SEQ ID NO: 325395 - DNA, 27 bp, Artificial Sequence
  Description of Artificial Sequence: Synthetic oligonucleotide
cgcttcttcgccgactggaaagggcat

SEQ ID NO: 325396 - DNA, 27 bp, Artificial Sequence
  Description of Artificial Sequence: Synthetic oligonucleotide
gcttcttcgccgactggaaagggcatg

SEQ ID NO: 325397 - DNA, 29 bp, Artificial Sequence
  Description of Artificial Sequence: Synthetic oligonucleotide
cttcttcgccgactggaaagggcatgtag

SEQ ID NO: 325398 - DNA, 29 bp, Artificial Sequence
  Description of Artificial Sequence: Synthetic oligonucleotide
ttcttcgccgactggaaagggcatgtagg

SEQ ID NO: 325399 - DNA, 28 bp, Artificial Sequence
  Description of Artificial Sequence: Synthetic oligonucleotide
tcttcgccgactggaaagggcatgtagg

SEQ ID NO: 325400 - DNA, 27 bp, Artificial Sequence
  Description of Artificial Sequence: Synthetic oligonucleotide
cttcgccgactggaaagggcatgtagg

SEQ ID NO: 325401 - DNA, 27 bp, Artificial Sequence
  Description of Artificial Sequence: Synthetic oligonucleotide
ttcgccgactggaaagggcatgtaggg

SEQ ID NO: 325402 - DNA, 26 bp, Artificial Sequence
  Description of Artificial Sequence: Synthetic oligonucleotide
tcgccgactggaaagggcatgtaggg

SEQ ID NO: 325403 - DNA, 25 bp, Artificial Sequence
  Description of Artificial Sequence: Synthetic oligonucleotide
cgccgactggaaagggcatgtaggg

SEQ ID NO: 325404 - DNA, 26 bp, Artificial Sequence
  Description of Artificial Sequence: Synthetic oligonucleotide
gccgactggaaagggcatgtagggga

SEQ ID NO: 325405 - DNA, 26 bp, Artificial Sequence
  Description of Artificial Sequence: Synthetic oligonucleotide
ccgactggaaagggcatgtaggggag

SEQ ID NO: 325406 - DNA, 27 bp, Artificial Sequence
  Description of Artificial Sequence: Synthetic oligonucleotide
cgactggaaagggcatgtaggggagga

SEQ ID NO: 325407 - DNA, 27 bp, Artificial Sequence
  Description of Artificial Sequence: Synthetic oligonucleotide
gactggaaagggcatgtaggggaggac

SEQ ID NO: 325408 - DNA, 27 bp, Artificial Sequence
  Description of Artificial Sequence: Synthetic oligonucleotide
actggaaagggcatgtaggggaggacc

SEQ ID NO: 325409 - DNA, 26 bp, Artificial Sequence
  Description of Artificial Sequence: Synthetic oligonucleotide
ctggaaagggcatgtaggggaggacc

SEQ ID NO: 325410 - DNA, 26 bp, Artificial Sequence
  Description of Artificial Sequence: Synthetic oligonucleotide
tggaaagggcatgtaggggaggaccg

SEQ ID NO: 325411 - DNA, 25 bp, Artificial Sequence
  Description of Artificial Sequence: Synthetic oligonucleotide
ggaaagggcatgtaggggaggaccg

SEQ ID NO: 325412 - DNA, 25 bp, Artificial Sequence
  Description of Artificial Sequence: Synthetic oligonucleotide
gaaagggcatgtaggggaggaccgg

SEQ ID NO: 325413 - DNA, 26 bp, Artificial Sequence
  Description of Artificial Sequence: Synthetic oligonucleotide
aaagggcatgtaggggaggaccggga

SEQ ID NO: 325414 - DNA, 25 bp, Artificial Sequence
  Description of Artificial Sequence: Synthetic oligonucleotide
aagggcatgtaggggaggaccggga

SEQ ID NO: 325415 - DNA, 24 bp, Artificial Sequence
  Description of Artificial Sequence: Synthetic oligonucleotide
agggcatgtaggggaggaccggga

SEQ ID NO: 325416 - DNA, 23 bp, Artificial Sequence
  Description of Artificial Sequence: Synthetic oligonucleotide
gggcatgtaggggaggaccggga

SEQ ID NO: 325417 - DNA, 23 bp, Artificial Sequence
  Description of Artificial Sequence: Synthetic oligonucleotide
ggcatgtaggggaggaccgggag

SEQ ID NO: 325418 - DNA, 24 bp, Artificial Sequence
  Description of Artificial Sequence: Synthetic oligonucleotide
gcatgtaggggaggaccgggagga

SEQ ID NO: 325419 - DNA, 27 bp, Artificial Sequence
  Description of Artificial Sequence: Synthetic oligonucleotide
catgtaggggaggaccgggaggacttt

SEQ ID NO: 325420 - DNA, 27 bp, Artificial Sequence
  Description of Artificial Sequence: Synthetic oligonucleotide
atgtaggggaggaccgggaggactttg

SEQ ID NO: 325421 - DNA, 26 bp, Artificial Sequence
  Description of Artificial Sequence: Synthetic oligonucleotide
tgtaggggaggaccgggaggactttg

SEQ ID NO: 325422 - DNA, 25 bp, Artificial Sequence
  Description of Artificial Sequence: Synthetic oligonucleotide
gtaggggaggaccgggaggactttg

SEQ ID NO: 325423 - DNA, 25 bp, Artificial Sequence
  Description of Artificial Sequence: Synthetic oligonucleotide
taggggaggaccgggaggactttgg

SEQ ID NO: 325424 - DNA, 24 bp, Artificial Sequence
  Description of Artificial Sequence: Synthetic oligonucleotide
aggggaggaccgggaggactttgg

SEQ ID NO: 325425 - DNA, 23 bp, Artificial Sequence
  Description of Artificial Sequence: Synthetic oligonucleotide
ggggaggaccgggaggactttgg

SEQ ID NO: 325426 - DNA, 23 bp, Artificial Sequence
  Description of Artificial Sequence: Synthetic oligonucleotide
gggaggaccgggaggactttggg

SEQ ID NO: 325427 - DNA, 24 bp, Artificial Sequence
  Description of Artificial Sequence: Synthetic oligonucleotide
ggaggaccgggaggactttgggca

SEQ ID NO: 325428 - DNA, 25 bp, Artificial Sequence
  Description of Artificial Sequence: Synthetic oligonucleotide
gaggaccgggaggactttgggcaga

SEQ ID NO: 325429 - DNA, 26 bp, Artificial Sequence
  Description of Artificial Sequence: Synthetic oligonucleotide
aggaccgggaggactttgggcagact

SEQ ID NO: 325430 - DNA, 25 bp, Artificial Sequence
  Description of Artificial Sequence: Synthetic oligonucleotide
ggaccgggaggactttgggcagact

SEQ ID NO: 325431 - DNA, 26 bp, Artificial Sequence
  Description of Artificial Sequence: Synthetic oligonucleotide
gaccgggaggactttgggcagactga

SEQ ID NO: 325432 - DNA, 26 bp, Artificial Sequence
  Description of Artificial Sequence: Synthetic oligonucleotide
accgggaggactttgggcagactgag

SEQ ID NO: 325433 - DNA, 25 bp, Artificial Sequence
  Description of Artificial Sequence: Synthetic oligonucleotide
ccgggaggactttgggcagactgag

SEQ ID NO: 325434 - DNA, 25 bp, Artificial Sequence
  Description of Artificial Sequence: Synthetic oligonucleotide
cgggaggactttgggcagactgagg

SEQ ID NO: 325435 - DNA, 25 bp, Artificial Sequence
  Description of Artificial Sequence: Synthetic oligonucleotide
gggaggactttgggcagactgaggc

SEQ ID NO: 325436 - DNA, 25 bp, Artificial Sequence
  Description of Artificial Sequence: Synthetic oligonucleotide
ggaggactttgggcagactgaggcg

SEQ ID NO: 325437 - DNA, 26 bp, Artificial Sequence
  Description of Artificial Sequence: Synthetic oligonucleotide
gaggactttgggcagactgaggcgca

SEQ ID NO: 325438 - DNA, 27 bp, Artificial Sequence
  Description of Artificial Sequence: Synthetic oligonucleotide
aggactttgggcagactgaggcgcaca

SEQ ID NO: 325439 - DNA, 26 bp, Artificial Sequence
  Description of Artificial Sequence: Synthetic oligonucleotide
ggactttgggcagactgaggcgcaca

SEQ ID NO: 325440 - DNA, 26 bp, Artificial Sequence
  Description of Artificial Sequence: Synthetic oligonucleotide
gactttgggcagactgaggcgcacac

SEQ ID NO: 325441 - DNA, 26 bp, Artificial Sequence
  Description of Artificial Sequence: Synthetic oligonucleotide
actttgggcagactgaggcgcacacg

SEQ ID NO: 325442 - DNA, 25 bp, Artificial Sequence
  Description of Artificial Sequence: Synthetic oligonucleotide
ctttgggcagactgaggcgcacacg

SEQ ID NO: 325443 - DNA, 26 bp, Artificial Sequence
  Description of Artificial Sequence: Synthetic oligonucleotide
tttgggcagactgaggcgcacacgga

SEQ ID NO: 325444 - DNA, 25 bp, Artificial Sequence
  Description of Artificial Sequence: Synthetic oligonucleotide
ttgggcagactgaggcgcacacgga

SEQ ID NO: 325445 - DNA, 24 bp, Artificial Sequence
  Description of Artificial Sequence: Synthetic oligonucleotide
tgggcagactgaggcgcacacgga

SEQ ID NO: 325446 - DNA, 23 bp, Artificial Sequence
  Description of Artificial Sequence: Synthetic oligonucleotide
gggcagactgaggcgcacacgga

SEQ ID NO: 325447 - DNA, 23 bp, Artificial Sequence
  Description of Artificial Sequence: Synthetic oligonucleotide
ggcagactgaggcgcacacggag

SEQ ID NO: 325448 - DNA, 27 bp, Artificial Sequence
  Description of Artificial Sequence: Synthetic oligonucleotide
gcagactgaggcgcacacggagctttt

SEQ ID NO: 325449 - DNA, 27 bp, Artificial Sequence
  Description of Artificial Sequence: Synthetic oligonucleotide
cagactgaggcgcacacggagcttttc

SEQ ID NO: 325450 - DNA, 27 bp, Artificial Sequence
  Description of Artificial Sequence: Synthetic oligonucleotide
agactgaggcgcacacggagcttttcc

SEQ ID NO: 325451 - DNA, 27 bp, Artificial Sequence
  Description of Artificial Sequence: Synthetic oligonucleotide
gactgaggcgcacacggagcttttcca

SEQ ID NO: 325452 - DNA, 27 bp, Artificial Sequence
  Description of Artificial Sequence: Synthetic oligonucleotide
actgaggcgcacacggagcttttccag

SEQ ID NO: 325453 - DNA, 26 bp, Artificial Sequence
  Description of Artificial Sequence: Synthetic oligonucleotide
ctgaggcgcacacggagcttttccag

SEQ ID NO: 325454 - DNA, 27 bp, Artificial Sequence
  Description of Artificial Sequence: Synthetic oligonucleotide
tgaggcgcacacggagcttttccagga

SEQ ID NO: 325455 - DNA, 26 bp, Artificial Sequence
  Description of Artificial Sequence: Synthetic oligonucleotide
gaggcgcacacggagcttttccagga

SEQ ID NO: 325456 - DNA, 26 bp, Artificial Sequence
  Description of Artificial Sequence: Synthetic oligonucleotide
aggcgcacacggagcttttccaggag

SEQ ID NO: 325457 - DNA, 25 bp, Artificial Sequence
  Description of Artificial Sequence: Synthetic oligonucleotide
ggcgcacacggagcttttccaggag

SEQ ID NO: 325458 - DNA, 25 bp, Artificial Sequence
  Description of Artificial Sequence: Synthetic oligonucleotide
gcgcacacggagcttttccaggagc

SEQ ID NO: 325459 - DNA, 26 bp, Artificial Sequence
  Description of Artificial Sequence: Synthetic oligonucleotide
cgcacacggagcttttccaggagcca

SEQ ID NO: 325460 - DNA, 26 bp, Artificial Sequence
  Description of Artificial Sequence: Synthetic oligonucleotide
gcacacggagcttttccaggagccag

SEQ ID NO: 325461 - DNA, 26 bp, Artificial Sequence
  Description of Artificial Sequence: Synthetic oligonucleotide
cacacggagcttttccaggagccagg

SEQ ID NO: 325462 - DNA, 27 bp, Artificial Sequence
  Description of Artificial Sequence: Synthetic oligonucleotide
acacggagcttttccaggagccaggct

SEQ ID NO: 325463 - DNA, 26 bp, Artificial Sequence
  Description of Artificial Sequence: Synthetic oligonucleotide
cacggagcttttccaggagccaggct

SEQ ID NO: 325464 - DNA, 26 bp, Artificial Sequence
  Description of Artificial Sequence: Synthetic oligonucleotide
acggagcttttccaggagccaggctg

SEQ ID NO: 325465 - DNA, 25 bp, Artificial Sequence
  Description of Artificial Sequence: Synthetic oligonucleotide
cggagcttttccaggagccaggctg

SEQ ID NO: 325466 - DNA, 26 bp, Artificial Sequence
  Description of Artificial Sequence: Synthetic oligonucleotide
ggagcttttccaggagccaggctgct

SEQ ID NO: 325467 - DNA, 26 bp, Artificial Sequence
  Description of Artificial Sequence: Synthetic oligonucleotide
gagcttttccaggagccaggctgctc

SEQ ID NO: 325468 - DNA, 27 bp, Artificial Sequence
  Description of Artificial Sequence: Synthetic oligonucleotide
agcttttccaggagccaggctgctcct

SEQ ID NO: 325469 - DNA, 26 bp, Artificial Sequence
  Description of Artificial Sequence: Synthetic oligonucleotide
gcttttccaggagccaggctgctcct

SEQ ID NO: 325470 - DNA, 27 bp, Artificial Sequence
  Description of Artificial Sequence: Synthetic oligonucleotide
cttttccaggagccaggctgctcctct

SEQ ID NO: 325471 - DNA, 27 bp, Artificial Sequence
  Description of Artificial Sequence: Synthetic oligonucleotide
ttttccaggagccaggctgctcctctg

SEQ ID NO: 325472 - DNA, 27 bp, Artificial Sequence
  Description of Artificial Sequence: Synthetic oligonucleotide
tttccaggagccaggctgctcctctga

SEQ ID NO: 325473 - DNA, 26 bp, Artificial Sequence
  Description of Artificial Sequence: Synthetic oligonucleotide
ttccaggagccaggctgctcctctga

SEQ ID NO: 325474 - DNA, 25 bp, Artificial Sequence
  Description of Artificial Sequence: Synthetic oligonucleotide
tccaggagccaggctgctcctctga

SEQ ID NO: 325475 - DNA, 24 bp, Artificial Sequence
  Description of Artificial Sequence: Synthetic oligonucleotide
ccaggagccaggctgctcctctga

SEQ ID NO: 325476 - DNA, 25 bp, Artificial Sequence
  Description of Artificial Sequence: Synthetic oligonucleotide
caggagccaggctgctcctctgagt

SEQ ID NO: 325477 - DNA, 25 bp, Artificial Sequence
  Description of Artificial Sequence: Synthetic oligonucleotide
aggagccaggctgctcctctgagtg

SEQ ID NO: 325478 - DNA, 24 bp, Artificial Sequence
  Description of Artificial Sequence: Synthetic oligonucleotide
ggagccaggctgctcctctgagtg

SEQ ID NO: 325479 - DNA, 24 bp, Artificial Sequence
  Description of Artificial Sequence: Synthetic oligonucleotide
gagccaggctgctcctctgagtgg

SEQ ID NO: 325480 - DNA, 25 bp, Artificial Sequence
  Description of Artificial Sequence: Synthetic oligonucleotide
agccaggctgctcctctgagtgggt

SEQ ID NO: 325481 - DNA, 24 bp, Artificial Sequence
  Description of Artificial Sequence: Synthetic oligonucleotide
gccaggctgctcctctgagtgggt

SEQ ID NO: 325482 - DNA, 24 bp, Artificial Sequence
  Description of Artificial Sequence: Synthetic oligonucleotide
ccaggctgctcctctgagtgggtg

SEQ ID NO: 325483 - DNA, 24 bp, Artificial Sequence
  Description of Artificial Sequence: Synthetic oligonucleotide
caggctgctcctctgagtgggtgg

SEQ ID NO: 325484 - DNA, 25 bp, Artificial Sequence
  Description of Artificial Sequence: Synthetic oligonucleotide
aggctgctcctctgagtgggtgggt

SEQ ID NO: 325485 - DNA, 24 bp, Artificial Sequence
  Description of Artificial Sequence: Synthetic oligonucleotide
ggctgctcctctgagtgggtgggt

SEQ ID NO: 325486 - DNA, 24 bp, Artificial Sequence
  Description of Artificial Sequence: Synthetic oligonucleotide
gctgctcctctgagtgggtgggtg

SEQ ID NO: 325487 - DNA, 25 bp, Artificial Sequence
  Description of Artificial Sequence: Synthetic oligonucleotide
ctgctcctctgagtgggtgggtgga

SEQ ID NO: 325488 - DNA, 25 bp, Artificial Sequence
  Description of Artificial Sequence: Synthetic oligonucleotide
tgctcctctgagtgggtgggtggac

SEQ ID NO: 325489 - DNA, 24 bp, Artificial Sequence
  Description of Artificial Sequence: Synthetic oligonucleotide
gctcctctgagtgggtgggtggac

SEQ ID NO: 325490 - DNA, 25 bp, Artificial Sequence
  Description of Artificial Sequence: Synthetic oligonucleotide
ctcctctgagtgggtgggtggacgt

SEQ ID NO: 325491 - DNA, 25 bp, Artificial Sequence
  Description of Artificial Sequence: Synthetic oligonucleotide
tcctctgagtgggtgggtggacgtg

SEQ ID NO: 325492 - DNA, 24 bp, Artificial Sequence
  Description of Artificial Sequence: Synthetic oligonucleotide
cctctgagtgggtgggtggacgtg

SEQ ID NO: 325493 - DNA, 24 bp, Artificial Sequence
  Description of Artificial Sequence: Synthetic oligonucleotide
ctctgagtgggtgggtggacgtgg

SEQ ID NO: 325494 - DNA, 26 bp, Artificial Sequence
  Description of Artificial Sequence: Synthetic oligonucleotide
tctgagtgggtgggtggacgtggcta

SEQ ID NO: 325495 - DNA, 25 bp, Artificial Sequence
  Description of Artificial Sequence: Synthetic oligonucleotide
ctgagtgggtgggtggacgtggcta

SEQ ID NO: 325496 - DNA, 25 bp, Artificial Sequence
  Description of Artificial Sequence: Synthetic oligonucleotide
tgagtgggtgggtggacgtggctag

SEQ ID NO: 325497 - DNA, 24 bp, Artificial Sequence
  Description of Artificial Sequence: Synthetic oligonucleotide
gagtgggtgggtggacgtggctag

SEQ ID NO: 325498 - DNA, 25 bp, Artificial Sequence
  Description of Artificial Sequence: Synthetic oligonucleotide
agtgggtgggtggacgtggctaggt

SEQ ID NO: 325499 - DNA, 24 bp, Artificial Sequence
  Description of Artificial Sequence: Synthetic oligonucleotide
gtgggtgggtggacgtggctaggt

SEQ ID NO: 325500 - DNA, 26 bp, Artificial Sequence
  Description of Artificial Sequence: Synthetic oligonucleotide
tgggtgggtggacgtggctaggtcta

SEQ ID NO: 325501 - DNA, 25 bp, Artificial Sequence
  Description of Artificial Sequence: Synthetic oligonucleotide
gggtgggtggacgtggctaggtcta

SEQ ID NO: 325502 - DNA, 25 bp, Artificial Sequence
  Description of Artificial Sequence: Synthetic oligonucleotide
ggtgggtggacgtggctaggtctac

SEQ ID NO: 325503 - DNA, 26 bp, Artificial Sequence
  Description of Artificial Sequence: Synthetic oligonucleotide
gtgggtggacgtggctaggtctacca

SEQ ID NO: 325504 - DNA, 27 bp, Artificial Sequence
  Description of Artificial Sequence: Synthetic oligonucleotide
tgggtggacgtggctaggtctaccact

SEQ ID NO: 325505 - DNA, 27 bp, Artificial Sequence
  Description of Artificial Sequence: Synthetic oligonucleotide
gggtggacgtggctaggtctaccactt

SEQ ID NO: 325506 - DNA, 28 bp, Artificial Sequence
  Description of Artificial Sequence: Synthetic oligonucleotide
ggtggacgtggctaggtctaccactttg

SEQ ID NO: 325507 - DNA, 29 bp, Artificial Sequence
  Description of Artificial Sequence: Synthetic oligonucleotide
gtggacgtggctaggtctaccactttgac

SEQ ID NO: 325508 - DNA, 31 bp, Artificial Sequence
  Description of Artificial Sequence: Synthetic oligonucleotide
tggacgtggctaggtctaccactttgacttg

SEQ ID NO: 325509 - DNA, 30 bp, Artificial Sequence
  Description of Artificial Sequence: Synthetic oligonucleotide
ggacgtggctaggtctaccactttgacttg

SEQ ID NO: 325510 - DNA, 30 bp, Artificial Sequence
  Description of Artificial Sequence: Synthetic oligonucleotide
gacgtggctaggtctaccactttgacttgc

SEQ ID NO: 325511 - DNA, 30 bp, Artificial Sequence
  Description of Artificial Sequence: Synthetic oligonucleotide
acgtggctaggtctaccactttgacttgcc

SEQ ID NO: 325512 - DNA, 29 bp, Artificial Sequence
  Description of Artificial Sequence: Synthetic oligonucleotide
cgtggctaggtctaccactttgacttgcc

SEQ ID NO: 325513 - DNA, 29 bp, Artificial Sequence
  Description of Artificial Sequence: Synthetic oligonucleotide
gtggctaggtctaccactttgacttgccc

SEQ ID NO: 325514 - DNA, 29 bp, Artificial Sequence
  Description of Artificial Sequence: Synthetic oligonucleotide
tggctaggtctaccactttgacttgcccg

SEQ ID NO: 325515 - DNA, 28 bp, Artificial Sequence
  Description of Artificial Sequence: Synthetic oligonucleotide
ggctaggtctaccactttgacttgcccg

SEQ ID NO: 325516 - DNA, 29 bp, Artificial Sequence
  Description of Artificial Sequence: Synthetic oligonucleotide
gctaggtctaccactttgacttgcccgag

SEQ ID NO: 325517 - DNA, 29 bp, Artificial Sequence
  Description of Artificial Sequence: Synthetic oligonucleotide
ctaggtctaccactttgacttgcccgagg

SEQ ID NO: 325518 - DNA, 29 bp, Artificial Sequence
  Description of Artificial Sequence: Synthetic oligonucleotide
taggtctaccactttgacttgcccgaggg

SEQ ID NO: 325519 - DNA, 28 bp, Artificial Sequence
  Description of Artificial Sequence: Synthetic oligonucleotide
aggtctaccactttgacttgcccgaggg

SEQ ID NO: 325520 - DNA, 27 bp, Artificial Sequence
  Description of Artificial Sequence: Synthetic oligonucleotide
ggtctaccactttgacttgcccgaggg

SEQ ID NO: 325521 - DNA, 27 bp, Artificial Sequence
  Description of Artificial Sequence: Synthetic oligonucleotide
gtctaccactttgacttgcccgagggc

SEQ ID NO: 325522 - DNA, 29 bp, Artificial Sequence
  Description of Artificial Sequence: Synthetic oligonucleotide
tctaccactttgacttgcccgagggctag

SEQ ID NO: 325523 - DNA, 28 bp, Artificial Sequence
  Description of Artificial Sequence: Synthetic oligonucleotide
ctaccactttgacttgcccgagggctag

SEQ ID NO: 325524 - DNA, 30 bp, Artificial Sequence
  Description of Artificial Sequence: Synthetic oligonucleotide
taccactttgacttgcccgagggctagaac

SEQ ID NO: 325525 - DNA, 29 bp, Artificial Sequence
  Description of Artificial Sequence: Synthetic oligonucleotide
accactttgacttgcccgagggctagaac

SEQ ID NO: 325526 - DNA, 28 bp, Artificial Sequence
  Description of Artificial Sequence: Synthetic oligonucleotide
ccactttgacttgcccgagggctagaac

SEQ ID NO: 325527 - DNA, 28 bp, Artificial Sequence
  Description of Artificial Sequence: Synthetic oligonucleotide
cactttgacttgcccgagggctagaacg

SEQ ID NO: 325528 - DNA, 28 bp, Artificial Sequence
  Description of Artificial Sequence: Synthetic oligonucleotide
actttgacttgcccgagggctagaacgc

SEQ ID NO: 325529 - DNA, 27 bp, Artificial Sequence
  Description of Artificial Sequence: Synthetic oligonucleotide
ctttgacttgcccgagggctagaacgc

SEQ ID NO: 325530 - DNA, 29 bp, Artificial Sequence
  Description of Artificial Sequence: Synthetic oligonucleotide
tttgacttgcccgagggctagaacgcatg

SEQ ID NO: 325531 - DNA, 28 bp, Artificial Sequence
  Description of Artificial Sequence: Synthetic oligonucleotide
ttgacttgcccgagggctagaacgcatg

SEQ ID NO: 325532 - DNA, 27 bp, Artificial Sequence
  Description of Artificial Sequence: Synthetic oligonucleotide
tgacttgcccgagggctagaacgcatg

SEQ ID NO: 325533 - DNA, 27 bp, Artificial Sequence
  Description of Artificial Sequence: Synthetic oligonucleotide
gacttgcccgagggctagaacgcatgt

SEQ ID NO: 325534 - DNA, 27 bp, Artificial Sequence
  Description of Artificial Sequence: Synthetic oligonucleotide
acttgcccgagggctagaacgcatgtg

SEQ ID NO: 325535 - DNA, 27 bp, Artificial Sequence
  Description of Artificial Sequence: Synthetic oligonucleotide
cttgcccgagggctagaacgcatgtgt

SEQ ID NO: 325536 - DNA, 27 bp, Artificial Sequence
  Description of Artificial Sequence: Synthetic oligonucleotide
ttgcccgagggctagaacgcatgtgtg

SEQ ID NO: 325537 - DNA, 26 bp, Artificial Sequence
  Description of Artificial Sequence: Synthetic oligonucleotide
tgcccgagggctagaacgcatgtgtg

SEQ ID NO: 325538 - DNA, 25 bp, Artificial Sequence
  Description of Artificial Sequence: Synthetic oligonucleotide
gcccgagggctagaacgcatgtgtg

SEQ ID NO: 325539 - DNA, 25 bp, Artificial Sequence
  Description of Artificial Sequence: Synthetic oligonucleotide
cccgagggctagaacgcatgtgtgc

SEQ ID NO: 325540 - DNA, 25 bp, Artificial Sequence
  Description of Artificial Sequence: Synthetic oligonucleotide
ccgagggctagaacgcatgtgtgcg

SEQ ID NO: 325541 - DNA, 26 bp, Artificial Sequence
  Description of Artificial Sequence: Synthetic oligonucleotide
cgagggctagaacgcatgtgtgcgca

SEQ ID NO: 325542 - DNA, 26 bp, Artificial Sequence
  Description of Artificial Sequence: Synthetic oligonucleotide
gagggctagaacgcatgtgtgcgcac

SEQ ID NO: 325543 - DNA, 26 bp, Artificial Sequence
  Description of Artificial Sequence: Synthetic oligonucleotide
agggctagaacgcatgtgtgcgcacc

SEQ ID NO: 325544 - DNA, 25 bp, Artificial Sequence
  Description of Artificial Sequence: Synthetic oligonucleotide
gggctagaacgcatgtgtgcgcacc

SEQ ID NO: 325545 - DNA, 26 bp, Artificial Sequence
  Description of Artificial Sequence: Synthetic oligonucleotide
ggctagaacgcatgtgtgcgcaccgt

SEQ ID NO: 325546 - DNA, 27 bp, Artificial Sequence
  Description of Artificial Sequence: Synthetic oligonucleotide
gctagaacgcatgtgtgcgcaccgtga

SEQ ID NO: 325547 - DNA, 31 bp, Artificial Sequence
  Description of Artificial Sequence: Synthetic oligonucleotide
ctagaacgcatgtgtgcgcaccgtgaatatc

SEQ ID NO: 325548 - DNA, 31 bp, Artificial Sequence
  Description of Artificial Sequence: Synthetic oligonucleotide
tagaacgcatgtgtgcgcaccgtgaatatcc

SEQ ID NO: 325549 - DNA, 30 bp, Artificial Sequence
  Description of Artificial Sequence: Synthetic oligonucleotide
agaacgcatgtgtgcgcaccgtgaatatcc

SEQ ID NO: 325550 - DNA, 29 bp, Artificial Sequence
  Description of Artificial Sequence: Synthetic oligonucleotide
gaacgcatgtgtgcgcaccgtgaatatcc

SEQ ID NO: 325551 - DNA, 29 bp, Artificial Sequence
  Description of Artificial Sequence: Synthetic oligonucleotide
aacgcatgtgtgcgcaccgtgaatatccg

SEQ ID NO: 325552 - DNA, 28 bp, Artificial Sequence
  Description of Artificial Sequence: Synthetic oligonucleotide
acgcatgtgtgcgcaccgtgaatatccg

SEQ ID NO: 325553 - DNA, 27 bp, Artificial Sequence
  Description of Artificial Sequence: Synthetic oligonucleotide
cgcatgtgtgcgcaccgtgaatatccg

SEQ ID NO: 325554 - DNA, 27 bp, Artificial Sequence
  Description of Artificial Sequence: Synthetic oligonucleotide
gcatgtgtgcgcaccgtgaatatccgc

SEQ ID NO: 325555 - DNA, 28 bp, Artificial Sequence
  Description of Artificial Sequence: Synthetic oligonucleotide
catgtgtgcgcaccgtgaatatccgctc

SEQ ID NO: 325556 - DNA, 28 bp, Artificial Sequence
  Description of Artificial Sequence: Synthetic oligonucleotide
atgtgtgcgcaccgtgaatatccgctcc

SEQ ID NO: 325557 - DNA, 27 bp, Artificial Sequence
  Description of Artificial Sequence: Synthetic oligonucleotide
tgtgtgcgcaccgtgaatatccgctcc

SEQ ID NO: 325558 - DNA, 27 bp, Artificial Sequence
  Description of Artificial Sequence: Synthetic oligonucleotide
gtgtgcgcaccgtgaatatccgctcca

SEQ ID NO: 325559 - DNA, 27 bp, Artificial Sequence
  Description of Artificial Sequence: Synthetic oligonucleotide
tgtgcgcaccgtgaatatccgctccac

SEQ ID NO: 325560 - DNA, 27 bp, Artificial Sequence
  Description of Artificial Sequence: Synthetic oligonucleotide
gtgcgcaccgtgaatatccgctccaca

SEQ ID NO: 325561 - DNA, 29 bp, Artificial Sequence
  Description of Artificial Sequence: Synthetic oligonucleotide
tgcgcaccgtgaatatccgctccacaatg

SEQ ID NO: 325562 - DNA, 28 bp, Artificial Sequence
  Description of Artificial Sequence: Synthetic oligonucleotide
gcgcaccgtgaatatccgctccacaatg

SEQ ID NO: 325563 - DNA, 28 bp, Artificial Sequence
  Description of Artificial Sequence: Synthetic oligonucleotide
cgcaccgtgaatatccgctccacaatgg

SEQ ID NO: 325564 - DNA, 28 bp, Artificial Sequence
  Description of Artificial Sequence: Synthetic oligonucleotide
gcaccgtgaatatccgctccacaatggg

SEQ ID NO: 325565 - DNA, 28 bp, Artificial Sequence
  Description of Artificial Sequence: Synthetic oligonucleotide
caccgtgaatatccgctccacaatgggg

SEQ ID NO: 325566 - DNA, 29 bp, Artificial Sequence
  Description of Artificial Sequence: Synthetic oligonucleotide
accgtgaatatccgctccacaatggggtc

SEQ ID NO: 325567 - DNA, 28 bp, Artificial Sequence
  Description of Artificial Sequence: Synthetic oligonucleotide
ccgtgaatatccgctccacaatggggtc

SEQ ID NO: 325568 - DNA, 28 bp, Artificial Sequence
  Description of Artificial Sequence: Synthetic oligonucleotide
cgtgaatatccgctccacaatggggtcc

SEQ ID NO: 325569 - DNA, 29 bp, Artificial Sequence
  Description of Artificial Sequence: Synthetic oligonucleotide
gtgaatatccgctccacaatggggtcctg

SEQ ID NO: 325570 - DNA, 30 bp, Artificial Sequence
  Description of Artificial Sequence: Synthetic oligonucleotide
tgaatatccgctccacaatggggtcctgac

SEQ ID NO: 325571 - DNA, 29 bp, Artificial Sequence
  Description of Artificial Sequence: Synthetic oligonucleotide
gaatatccgctccacaatggggtcctgac

SEQ ID NO: 325572 - DNA, 30 bp, Artificial Sequence
  Description of Artificial Sequence: Synthetic oligonucleotide
aatatccgctccacaatggggtcctgactg

SEQ ID NO: 325573 - DNA, 29 bp, Artificial Sequence
  Description of Artificial Sequence: Synthetic oligonucleotide
atatccgctccacaatggggtcctgactg

SEQ ID NO: 325574 - DNA, 28 bp, Artificial Sequence
  Description of Artificial Sequence: Synthetic oligonucleotide
tatccgctccacaatggggtcctgactg

SEQ ID NO: 325575 - DNA, 27 bp, Artificial Sequence
  Description of Artificial Sequence: Synthetic oligonucleotide
atccgctccacaatggggtcctgactg

SEQ ID NO: 325576 - DNA, 26 bp, Artificial Sequence
  Description of Artificial Sequence: Synthetic oligonucleotide
tccgctccacaatggggtcctgactg

SEQ ID NO: 325577 - DNA, 25 bp, Artificial Sequence
  Description of Artificial Sequence: Synthetic oligonucleotide
ccgctccacaatggggtcctgactg

SEQ ID NO: 325578 - DNA, 27 bp, Artificial Sequence
  Description of Artificial Sequence: Synthetic oligonucleotide
cgctccacaatggggtcctgactggat

SEQ ID NO: 325579 - DNA, 29 bp, Artificial Sequence
  Description of Artificial Sequence: Synthetic oligonucleotide
gctccacaatggggtcctgactggataag

SEQ ID NO: 325580 - DNA, 29 bp, Artificial Sequence
  Description of Artificial Sequence: Synthetic oligonucleotide
ctccacaatggggtcctgactggataagg

SEQ ID NO: 325581 - DNA, 29 bp, Artificial Sequence
  Description of Artificial Sequence: Synthetic oligonucleotide
tccacaatggggtcctgactggataaggg

SEQ ID NO: 325582 - DNA, 28 bp, Artificial Sequence
  Description of Artificial Sequence: Synthetic oligonucleotide
ccacaatggggtcctgactggataaggg

SEQ ID NO: 325583 - DNA, 28 bp, Artificial Sequence
  Description of Artificial Sequence: Synthetic oligonucleotide
cacaatggggtcctgactggataagggg

SEQ ID NO: 325584 - DNA, 28 bp, Artificial Sequence
  Description of Artificial Sequence: Synthetic oligonucleotide
acaatggggtcctgactggataaggggg

SEQ ID NO: 325585 - DNA, 27 bp, Artificial Sequence
  Description of Artificial Sequence: Synthetic oligonucleotide
caatggggtcctgactggataaggggg

SEQ ID NO: 325586 - DNA, 28 bp, Artificial Sequence
  Description of Artificial Sequence: Synthetic oligonucleotide
aatggggtcctgactggataagggggac

SEQ ID NO: 325587 - DNA, 27 bp, Artificial Sequence
  Description of Artificial Sequence: Synthetic oligonucleotide
atggggtcctgactggataagggggac

SEQ ID NO: 325588 - DNA, 27 bp, Artificial Sequence
  Description of Artificial Sequence: Synthetic oligonucleotide
tggggtcctgactggataagggggact

SEQ ID NO: 325589 - DNA, 26 bp, Artificial Sequence
  Description of Artificial Sequence: Synthetic oligonucleotide
ggggtcctgactggataagggggact

SEQ ID NO: 325590 - DNA, 26 bp, Artificial Sequence
  Description of Artificial Sequence: Synthetic oligonucleotide
gggtcctgactggataagggggactg

SEQ ID NO: 325591 - DNA, 26 bp, Artificial Sequence
  Description of Artificial Sequence: Synthetic oligonucleotide
ggtcctgactggataagggggactgc

SEQ ID NO: 325592 - DNA, 27 bp, Artificial Sequence
  Description of Artificial Sequence: Synthetic oligonucleotide
gtcctgactggataagggggactgcgt

SEQ ID NO: 325593 - DNA, 27 bp, Artificial Sequence
  Description of Artificial Sequence: Synthetic oligonucleotide
tcctgactggataagggggactgcgtg

SEQ ID NO: 325594 - DNA, 27 bp, Artificial Sequence
  Description of Artificial Sequence: Synthetic oligonucleotide
cctgactggataagggggactgcgtga

SEQ ID NO: 325595 - DNA, 28 bp, Artificial Sequence
  Description of Artificial Sequence: Synthetic oligonucleotide
ctgactggataagggggactgcgtgaac

SEQ ID NO: 325596 - DNA, 30 bp, Artificial Sequence
  Description of Artificial Sequence: Synthetic oligonucleotide
tgactggataagggggactgcgtgaactac

SEQ ID NO: 325597 - DNA, 29 bp, Artificial Sequence
  Description of Artificial Sequence: Synthetic oligonucleotide
gactggataagggggactgcgtgaactac

SEQ ID NO: 325598 - DNA, 31 bp, Artificial Sequence
  Description of Artificial Sequence: Synthetic oligonucleotide
actggataagggggactgcgtgaactacatg

SEQ ID NO: 325599 - DNA, 30 bp, Artificial Sequence
  Description of Artificial Sequence: Synthetic oligonucleotide
ctggataagggggactgcgtgaactacatg

SEQ ID NO: 325600 - DNA, 31 bp, Artificial Sequence
  Description of Artificial Sequence: Synthetic oligonucleotide
tggataagggggactgcgtgaactacatgac

SEQ ID NO: 325601 - DNA, 30 bp, Artificial Sequence
  Description of Artificial Sequence: Synthetic oligonucleotide
ggataagggggactgcgtgaactacatgac

SEQ ID NO: 325602 - DNA, 31 bp, Artificial Sequence
  Description of Artificial Sequence: Synthetic oligonucleotide
gataagggggactgcgtgaactacatgactc

SEQ ID NO: 325603 - DNA, 32 bp, Artificial Sequence
  Description of Artificial Sequence: Synthetic oligonucleotide
ataagggggactgcgtgaactacatgactctc

SEQ ID NO: 325604 - DNA, 31 bp, Artificial Sequence
  Description of Artificial Sequence: Synthetic oligonucleotide
taagggggactgcgtgaactacatgactctc

SEQ ID NO: 325605 - DNA, 30 bp, Artificial Sequence
  Description of Artificial Sequence: Synthetic oligonucleotide
aagggggactgcgtgaactacatgactctc

SEQ ID NO: 325606 - DNA, 29 bp, Artificial Sequence
  Description of Artificial Sequence: Synthetic oligonucleotide
agggggactgcgtgaactacatgactctc

SEQ ID NO: 325607 - DNA, 28 bp, Artificial Sequence
  Description of Artificial Sequence: Synthetic oligonucleotide
gggggactgcgtgaactacatgactctc

SEQ ID NO: 325608 - DNA, 28 bp, Artificial Sequence
  Description of Artificial Sequence: Synthetic oligonucleotide
ggggactgcgtgaactacatgactctcc

SEQ ID NO: 325609 - DNA, 29 bp, Artificial Sequence
  Description of Artificial Sequence: Synthetic oligonucleotide
gggactgcgtgaactacatgactctcctg

SEQ ID NO: 325610 - DNA, 29 bp, Artificial Sequence
  Description of Artificial Sequence: Synthetic oligonucleotide
ggactgcgtgaactacatgactctcctgc

SEQ ID NO: 325611 - DNA, 30 bp, Artificial Sequence
  Description of Artificial Sequence: Synthetic oligonucleotide
gactgcgtgaactacatgactctcctgcag

SEQ ID NO: 325612 - DNA, 31 bp, Artificial Sequence
  Description of Artificial Sequence: Synthetic oligonucleotide
actgcgtgaactacatgactctcctgcagag

SEQ ID NO: 325613 - DNA, 30 bp, Artificial Sequence
  Description of Artificial Sequence: Synthetic oligonucleotide
ctgcgtgaactacatgactctcctgcagag

SEQ ID NO: 325614 - DNA, 30 bp, Artificial Sequence
  Description of Artificial Sequence: Synthetic oligonucleotide
tgcgtgaactacatgactctcctgcagagg

SEQ ID NO: 325615 - DNA, 29 bp, Artificial Sequence
  Description of Artificial Sequence: Synthetic oligonucleotide
gcgtgaactacatgactctcctgcagagg

SEQ ID NO: 325616 - DNA, 29 bp, Artificial Sequence
  Description of Artificial Sequence: Synthetic oligonucleotide
cgtgaactacatgactctcctgcagaggc

SEQ ID NO: 325617 - DNA, 29 bp, Artificial Sequence
  Description of Artificial Sequence: Synthetic oligonucleotide
gtgaactacatgactctcctgcagaggcg

SEQ ID NO: 325618 - DNA, 29 bp, Artificial Sequence
  Description of Artificial Sequence: Synthetic oligonucleotide
tgaactacatgactctcctgcagaggcgg

SEQ ID NO: 325619 - DNA, 28 bp, Artificial Sequence
  Description of Artificial Sequence: Synthetic oligonucleotide
gaactacatgactctcctgcagaggcgg

SEQ ID NO: 325620 - DNA, 29 bp, Artificial Sequence
  Description of Artificial Sequence: Synthetic oligonucleotide
aactacatgactctcctgcagaggcggac

SEQ ID NO: 325621 - DNA, 28 bp, Artificial Sequence
  Description of Artificial Sequence: Synthetic oligonucleotide
actacatgactctcctgcagaggcggac

SEQ ID NO: 325622 - DNA, 27 bp, Artificial Sequence
  Description of Artificial Sequence: Synthetic oligonucleotide
ctacatgactctcctgcagaggcggac

SEQ ID NO: 325623 - DNA, 28 bp, Artificial Sequence
  Description of Artificial Sequence: Synthetic oligonucleotide
tacatgactctcctgcagaggcggactg

SEQ ID NO: 325624 - DNA, 27 bp, Artificial Sequence
  Description of Artificial Sequence: Synthetic oligonucleotide
acatgactctcctgcagaggcggactg

SEQ ID NO: 325625 - DNA, 27 bp, Artificial Sequence
  Description of Artificial Sequence: Synthetic oligonucleotide
catgactctcctgcagaggcggactga

SEQ ID NO: 325626 - DNA, 27 bp, Artificial Sequence
  Description of Artificial Sequence: Synthetic oligonucleotide
atgactctcctgcagaggcggactgag

SEQ ID NO: 325627 - DNA, 26 bp, Artificial Sequence
  Description of Artificial Sequence: Synthetic oligonucleotide
tgactctcctgcagaggcggactgag

SEQ ID NO: 325628 - DNA, 25 bp, Artificial Sequence
  Description of Artificial Sequence: Synthetic oligonucleotide
gactctcctgcagaggcggactgag

SEQ ID NO: 325629 - DNA, 25 bp, Artificial Sequence
  Description of Artificial Sequence: Synthetic oligonucleotide
actctcctgcagaggcggactgagg

SEQ ID NO: 325630 - DNA, 24 bp, Artificial Sequence
  Description of Artificial Sequence: Synthetic oligonucleotide
ctctcctgcagaggcggactgagg

SEQ ID NO: 325631 - DNA, 24 bp, Artificial Sequence
  Description of Artificial Sequence: Synthetic oligonucleotide
tctcctgcagaggcggactgaggg

SEQ ID NO: 325632 - DNA, 23 bp, Artificial Sequence
  Description of Artificial Sequence: Synthetic oligonucleotide
ctcctgcagaggcggactgaggg

SEQ ID NO: 325633 - DNA, 23 bp, Artificial Sequence
  Description of Artificial Sequence: Synthetic oligonucleotide
tcctgcagaggcggactgagggg

SEQ ID NO: 325634 - DNA, 22 bp, Artificial Sequence
  Description of Artificial Sequence: Synthetic oligonucleotide
cctgcagaggcggactgagggg

SEQ ID NO: 325635 - DNA, 23 bp, Artificial Sequence
  Description of Artificial Sequence: Synthetic oligonucleotide
ctgcagaggcggactgaggggct

SEQ ID NO: 325636 - DNA, 23 bp, Artificial Sequence
  Description of Artificial Sequence: Synthetic oligonucleotide
tgcagaggcggactgaggggctc

SEQ ID NO: 325637 - DNA, 22 bp, Artificial Sequence
  Description of Artificial Sequence: Synthetic oligonucleotide
gcagaggcggactgaggggctc

SEQ ID NO: 325638 - DNA, 23 bp, Artificial Sequence
  Description of Artificial Sequence: Synthetic oligonucleotide
cagaggcggactgaggggctcct

SEQ ID NO: 325639 - DNA, 23 bp, Artificial Sequence
  Description of Artificial Sequence: Synthetic oligonucleotide
agaggcggactgaggggctcctg

SEQ ID NO: 325640 - DNA, 22 bp, Artificial Sequence
  Description of Artificial Sequence: Synthetic oligonucleotide
gaggcggactgaggggctcctg

SEQ ID NO: 325641 - DNA, 22 bp, Artificial Sequence
  Description of Artificial Sequence: Synthetic oligonucleotide
aggcggactgaggggctcctgg

SEQ ID NO: 325642 - DNA, 21 bp, Artificial Sequence
  Description of Artificial Sequence: Synthetic oligonucleotide
ggcggactgaggggctcctgg

SEQ ID NO: 325643 - DNA, 21 bp, Artificial Sequence
  Description of Artificial Sequence: Synthetic oligonucleotide
gcggactgaggggctcctggc

SEQ ID NO: 325644 - DNA, 22 bp, Artificial Sequence
  Description of Artificial Sequence: Synthetic oligonucleotide
cggactgaggggctcctggcct

SEQ ID NO: 325645 - DNA, 23 bp, Artificial Sequence
  Description of Artificial Sequence: Synthetic oligonucleotide
ggactgaggggctcctggcctgt

SEQ ID NO: 325646 - DNA, 23 bp, Artificial Sequence
  Description of Artificial Sequence: Synthetic oligonucleotide
gactgaggggctcctggcctgtc

SEQ ID NO: 325647 - DNA, 23 bp, Artificial Sequence
  Description of Artificial Sequence: Synthetic oligonucleotide
actgaggggctcctggcctgtcg

SEQ ID NO: 325648 - DNA, 22 bp, Artificial Sequence
  Description of Artificial Sequence: Synthetic oligonucleotide
ctgaggggctcctggcctgtcg

SEQ ID NO: 325649 - DNA, 23 bp, Artificial Sequence
  Description of Artificial Sequence: Synthetic oligonucleotide
tgaggggctcctggcctgtcgca

SEQ ID NO: 325650 - DNA, 22 bp, Artificial Sequence
  Description of Artificial Sequence: Synthetic oligonucleotide
gaggggctcctggcctgtcgca

SEQ ID NO: 325651 - DNA, 22 bp, Artificial Sequence
  Description of Artificial Sequence: Synthetic oligonucleotide
aggggctcctggcctgtcgcac

SEQ ID NO: 325652 - DNA, 21 bp, Artificial Sequence
  Description of Artificial Sequence: Synthetic oligonucleotide
ggggctcctggcctgtcgcac

SEQ ID NO: 325653 - DNA, 23 bp, Artificial Sequence
  Description of Artificial Sequence: Synthetic oligonucleotide
gggctcctggcctgtcgcaccaa

SEQ ID NO: 325654 - DNA, 23 bp, Artificial Sequence
  Description of Artificial Sequence: Synthetic oligonucleotide
ggctcctggcctgtcgcaccaac

SEQ ID NO: 325655 - DNA, 23 bp, Artificial Sequence
  Description of Artificial Sequence: Synthetic oligonucleotide
gctcctggcctgtcgcaccaacg

SEQ ID NO: 325656 - DNA, 23 bp, Artificial Sequence
  Description of Artificial Sequence: Synthetic oligonucleotide
ctcctggcctgtcgcaccaacgg

SEQ ID NO: 325657 - DNA, 23 bp, Artificial Sequence
  Description of Artificial Sequence: Synthetic oligonucleotide
tcctggcctgtcgcaccaacggc

SEQ ID NO: 325658 - DNA, 22 bp, Artificial Sequence
  Description of Artificial Sequence: Synthetic oligonucleotide
cctggcctgtcgcaccaacggc

SEQ ID NO: 325659 - DNA, 22 bp, Artificial Sequence
  Description of Artificial Sequence: Synthetic oligonucleotide
ctggcctgtcgcaccaacggcc

SEQ ID NO: 325660 - DNA, 22 bp, Artificial Sequence
  Description of Artificial Sequence: Synthetic oligonucleotide
tggcctgtcgcaccaacggccg

SEQ ID NO: 325661 - DNA, 21 bp, Artificial Sequence
  Description of Artificial Sequence: Synthetic oligonucleotide
ggcctgtcgcaccaacggccg

SEQ ID NO: 325662 - DNA, 21 bp, Artificial Sequence
  Description of Artificial Sequence: Synthetic oligonucleotide
gcctgtcgcaccaacggccgg

SEQ ID NO: 325663 - DNA, 22 bp, Artificial Sequence
  Description of Artificial Sequence: Synthetic oligonucleotide
cctgtcgcaccaacggccggca

SEQ ID NO: 325664 - DNA, 22 bp, Artificial Sequence
  Description of Artificial Sequence: Synthetic oligonucleotide
ctgtcgcaccaacggccggcac

SEQ ID NO: 325665 - DNA, 22 bp, Artificial Sequence
  Description of Artificial Sequence: Synthetic oligonucleotide
tgtcgcaccaacggccggcacc

SEQ ID NO: 325666 - DNA, 21 bp, Artificial Sequence
  Description of Artificial Sequence: Synthetic oligonucleotide
gtcgcaccaacggccggcacc

SEQ ID NO: 325667 - DNA, 21 bp, Artificial Sequence
  Description of Artificial Sequence: Synthetic oligonucleotide
tcgcaccaacggccggcaccc

SEQ ID NO: 325668 - DNA, 20 bp, Artificial Sequence
  Description of Artificial Sequence: Synthetic oligonucleotide
cgcaccaacggccggcaccc

SEQ ID NO: 325669 - DNA, 21 bp, Artificial Sequence
  Description of Artificial Sequence: Synthetic oligonucleotide
gcaccaacggccggcacccga

SEQ ID NO: 325670 - DNA, 21 bp, Artificial Sequence
  Description of Artificial Sequence: Synthetic oligonucleotide
caccaacggccggcacccgag

SEQ ID NO: 325671 - DNA, 22 bp, Artificial Sequence
  Description of Artificial Sequence: Synthetic oligonucleotide
accaacggccggcacccgagct

SEQ ID NO: 325672 - DNA, 21 bp, Artificial Sequence
  Description of Artificial Sequence: Synthetic oligonucleotide
ccaacggccggcacccgagct

SEQ ID NO: 325673 - DNA, 21 bp, Artificial Sequence
  Description of Artificial Sequence: Synthetic oligonucleotide
caacggccggcacccgagctg

SEQ ID NO: 325674 - DNA, 22 bp, Artificial Sequence
  Description of Artificial Sequence: Synthetic oligonucleotide
aacggccggcacccgagctgct

SEQ ID NO: 325675 - DNA, 21 bp, Artificial Sequence
  Description of Artificial Sequence: Synthetic oligonucleotide
acggccggcacccgagctgct

SEQ ID NO: 325676 - DNA, 20 bp, Artificial Sequence
  Description of Artificial Sequence: Synthetic oligonucleotide
cggccggcacccgagctgct

SEQ ID NO: 325677 - DNA, 20 bp, Artificial Sequence
  Description of Artificial Sequence: Synthetic oligonucleotide
ggccggcacccgagctgctg

SEQ ID NO: 325678 - DNA, 22 bp, Artificial Sequence
  Description of Artificial Sequence: Synthetic oligonucleotide
gccggcacccgagctgctggta

SEQ ID NO: 325679 - DNA, 22 bp, Artificial Sequence
  Description of Artificial Sequence: Synthetic oligonucleotide
ccggcacccgagctgctggtac

SEQ ID NO: 325680 - DNA, 23 bp, Artificial Sequence
  Description of Artificial Sequence: Synthetic oligonucleotide
cggcacccgagctgctggtacct

SEQ ID NO: 325681 - DNA, 23 bp, Artificial Sequence
  Description of Artificial Sequence: Synthetic oligonucleotide
ggcacccgagctgctggtacctg

SEQ ID NO: 325682 - DNA, 24 bp, Artificial Sequence
  Description of Artificial Sequence: Synthetic oligonucleotide
gcacccgagctgctggtacctggt

SEQ ID NO: 325683 - DNA, 27 bp, Artificial Sequence
  Description of Artificial Sequence: Synthetic oligonucleotide
cacccgagctgctggtacctggtgatt

SEQ ID NO: 325684 - DNA, 27 bp, Artificial Sequence
  Description of Artificial Sequence: Synthetic oligonucleotide
acccgagctgctggtacctggtgattg

SEQ ID NO: 325685 - DNA, 26 bp, Artificial Sequence
  Description of Artificial Sequence: Synthetic oligonucleotide
cccgagctgctggtacctggtgattg

SEQ ID NO: 325686 - DNA, 26 bp, Artificial Sequence
  Description of Artificial Sequence: Synthetic oligonucleotide
ccgagctgctggtacctggtgattgg

SEQ ID NO: 325687 - DNA, 27 bp, Artificial Sequence
  Description of Artificial Sequence: Synthetic oligonucleotide
cgagctgctggtacctggtgattggca

SEQ ID NO: 325688 - DNA, 27 bp, Artificial Sequence
  Description of Artificial Sequence: Synthetic oligonucleotide
gagctgctggtacctggtgattggcac

SEQ ID NO: 325689 - DNA, 28 bp, Artificial Sequence
  Description of Artificial Sequence: Synthetic oligonucleotide
agctgctggtacctggtgattggcactg

SEQ ID NO: 325690 - DNA, 27 bp, Artificial Sequence
  Description of Artificial Sequence: Synthetic oligonucleotide
gctgctggtacctggtgattggcactg

SEQ ID NO: 325691 - DNA, 28 bp, Artificial Sequence
  Description of Artificial Sequence: Synthetic oligonucleotide
ctgctggtacctggtgattggcactgtc

SEQ ID NO: 325692 - DNA, 28 bp, Artificial Sequence
  Description of Artificial Sequence: Synthetic oligonucleotide
tgctggtacctggtgattggcactgtcg

SEQ ID NO: 325693 - DNA, 27 bp, Artificial Sequence
  Description of Artificial Sequence: Synthetic oligonucleotide
gctggtacctggtgattggcactgtcg

SEQ ID NO: 325694 - DNA, 28 bp, Artificial Sequence
  Description of Artificial Sequence: Synthetic oligonucleotide
ctggtacctggtgattggcactgtcgtg

SEQ ID NO: 325695 - DNA, 28 bp, Artificial Sequence
  Description of Artificial Sequence: Synthetic oligonucleotide
tggtacctggtgattggcactgtcgtgc

SEQ ID NO: 325696 - DNA, 27 bp, Artificial Sequence
  Description of Artificial Sequence: Synthetic oligonucleotide
ggtacctggtgattggcactgtcgtgc

SEQ ID NO: 325697 - DNA, 27 bp, Artificial Sequence
  Description of Artificial Sequence: Synthetic oligonucleotide
gtacctggtgattggcactgtcgtgcc

SEQ ID NO: 325698 - DNA, 28 bp, Artificial Sequence
  Description of Artificial Sequence: Synthetic oligonucleotide
tacctggtgattggcactgtcgtgccac

SEQ ID NO: 325699 - DNA, 27 bp, Artificial Sequence
  Description of Artificial Sequence: Synthetic oligonucleotide
acctggtgattggcactgtcgtgccac

SEQ ID NO: 325700 - DNA, 27 bp, Artificial Sequence
  Description of Artificial Sequence: Synthetic oligonucleotide
cctggtgattggcactgtcgtgccact

SEQ ID NO: 325701 - DNA, 28 bp, Artificial Sequence
  Description of Artificial Sequence: Synthetic oligonucleotide
ctggtgattggcactgtcgtgccacttc

SEQ ID NO: 325702 - DNA, 28 bp, Artificial Sequence
  Description of Artificial Sequence: Synthetic oligonucleotide
tggtgattggcactgtcgtgccacttcg

SEQ ID NO: 325703 - DNA, 27 bp, Artificial Sequence
  Description of Artificial Sequence: Synthetic oligonucleotide
ggtgattggcactgtcgtgccacttcg

SEQ ID NO: 325704 - DNA, 27 bp, Artificial Sequence
  Description of Artificial Sequence: Synthetic oligonucleotide
gtgattggcactgtcgtgccacttcgc

SEQ ID NO: 325705 - DNA, 27 bp, Artificial Sequence
  Description of Artificial Sequence: Synthetic oligonucleotide
tgattggcactgtcgtgccacttcgcg

SEQ ID NO: 325706 - DNA, 27 bp, Artificial Sequence
  Description of Artificial Sequence: Synthetic oligonucleotide
gattggcactgtcgtgccacttcgcga

SEQ ID NO: 325707 - DNA, 27 bp, Artificial Sequence
  Description of Artificial Sequence: Synthetic oligonucleotide
attggcactgtcgtgccacttcgcgag

SEQ ID NO: 325708 - DNA, 27 bp, Artificial Sequence
  Description of Artificial Sequence: Synthetic oligonucleotide
ttggcactgtcgtgccacttcgcgaga

SEQ ID NO: 325709 - DNA, 27 bp, Artificial Sequence
  Description of Artificial Sequence: Synthetic oligonucleotide
tggcactgtcgtgccacttcgcgagat

SEQ ID NO: 325710 - DNA, 26 bp, Artificial Sequence
  Description of Artificial Sequence: Synthetic oligonucleotide
ggcactgtcgtgccacttcgcgagat

SEQ ID NO: 325711 - DNA, 27 bp, Artificial Sequence
  Description of Artificial Sequence: Synthetic oligonucleotide
gcactgtcgtgccacttcgcgagatga

SEQ ID NO: 325712 - DNA, 27 bp, Artificial Sequence
  Description of Artificial Sequence: Synthetic oligonucleotide
cactgtcgtgccacttcgcgagatgac

SEQ ID NO: 325713 - DNA, 28 bp, Artificial Sequence
  Description of Artificial Sequence: Synthetic oligonucleotide
actgtcgtgccacttcgcgagatgacag

SEQ ID NO: 325714 - DNA, 27 bp, Artificial Sequence
  Description of Artificial Sequence: Synthetic oligonucleotide
ctgtcgtgccacttcgcgagatgacag

SEQ ID NO: 325715 - DNA, 27 bp, Artificial Sequence
  Description of Artificial Sequence: Synthetic oligonucleotide
tgtcgtgccacttcgcgagatgacagg

SEQ ID NO: 325716 - DNA, 26 bp, Artificial Sequence
  Description of Artificial Sequence: Synthetic oligonucleotide
gtcgtgccacttcgcgagatgacagg

SEQ ID NO: 325717 - DNA, 27 bp, Artificial Sequence
  Description of Artificial Sequence: Synthetic oligonucleotide
tcgtgccacttcgcgagatgacaggct

SEQ ID NO: 325718 - DNA, 27 bp, Artificial Sequence
  Description of Artificial Sequence: Synthetic oligonucleotide
cgtgccacttcgcgagatgacaggcta

SEQ ID NO: 325719 - DNA, 27 bp, Artificial Sequence
  Description of Artificial Sequence: Synthetic oligonucleotide
gtgccacttcgcgagatgacaggctac

SEQ ID NO: 325720 - DNA, 27 bp, Artificial Sequence
  Description of Artificial Sequence: Synthetic oligonucleotide
tgccacttcgcgagatgacaggctacg

SEQ ID NO: 325721 - DNA, 26 bp, Artificial Sequence
  Description of Artificial Sequence: Synthetic oligonucleotide
gccacttcgcgagatgacaggctacg

SEQ ID NO: 325722 - DNA, 26 bp, Artificial Sequence
  Description of Artificial Sequence: Synthetic oligonucleotide
ccacttcgcgagatgacaggctacgc

SEQ ID NO: 325723 - DNA, 26 bp, Artificial Sequence
  Description of Artificial Sequence: Synthetic oligonucleotide
cacttcgcgagatgacaggctacgcg

SEQ ID NO: 325724 - DNA, 26 bp, Artificial Sequence
  Description of Artificial Sequence: Synthetic oligonucleotide
acttcgcgagatgacaggctacgcgc

SEQ ID NO: 325725 - DNA, 25 bp, Artificial Sequence
  Description of Artificial Sequence: Synthetic oligonucleotide
cttcgcgagatgacaggctacgcgc

SEQ ID NO: 325726 - DNA, 25 bp, Artificial Sequence
  Description of Artificial Sequence: Synthetic oligonucleotide
ttcgcgagatgacaggctacgcgcc

SEQ ID NO: 325727 - DNA, 24 bp, Artificial Sequence
  Description of Artificial Sequence: Synthetic oligonucleotide
tcgcgagatgacaggctacgcgcc

SEQ ID NO: 325728 - DNA, 23 bp, Artificial Sequence
  Description of Artificial Sequence: Synthetic oligonucleotide
cgcgagatgacaggctacgcgcc

SEQ ID NO: 325729 - DNA, 25 bp, Artificial Sequence
  Description of Artificial Sequence: Synthetic oligonucleotide
gcgagatgacaggctacgcgccctt

SEQ ID NO: 325730 - DNA, 26 bp, Artificial Sequence
  Description of Artificial Sequence: Synthetic oligonucleotide
cgagatgacaggctacgcgcccttca

SEQ ID NO: 325731 - DNA, 26 bp, Artificial Sequence
  Description of Artificial Sequence: Synthetic oligonucleotide
gagatgacaggctacgcgcccttcag

SEQ ID NO: 325732 - DNA, 26 bp, Artificial Sequence
  Description of Artificial Sequence: Synthetic oligonucleotide
agatgacaggctacgcgcccttcagc

SEQ ID NO: 325733 - DNA, 25 bp, Artificial Sequence
  Description of Artificial Sequence: Synthetic oligonucleotide
gatgacaggctacgcgcccttcagc

SEQ ID NO: 325734 - DNA, 25 bp, Artificial Sequence
  Description of Artificial Sequence: Synthetic oligonucleotide
atgacaggctacgcgcccttcagcg

SEQ ID NO: 325735 - DNA, 24 bp, Artificial Sequence
  Description of Artificial Sequence: Synthetic oligonucleotide
tgacaggctacgcgcccttcagcg

SEQ ID NO: 325736 - DNA, 23 bp, Artificial Sequence
  Description of Artificial Sequence: Synthetic oligonucleotide
gacaggctacgcgcccttcagcg

SEQ ID NO: 325737 - DNA, 23 bp, Artificial Sequence
  Description of Artificial Sequence: Synthetic oligonucleotide
acaggctacgcgcccttcagcgc

SEQ ID NO: 325738 - DNA, 22 bp, Artificial Sequence
  Description of Artificial Sequence: Synthetic oligonucleotide
caggctacgcgcccttcagcgc

SEQ ID NO: 325739 - DNA, 22 bp, Artificial Sequence
  Description of Artificial Sequence: Synthetic oligonucleotide
aggctacgcgcccttcagcgcg

SEQ ID NO: 325740 - DNA, 21 bp, Artificial Sequence
  Description of Artificial Sequence: Synthetic oligonucleotide
ggctacgcgcccttcagcgcg

SEQ ID NO: 325741 - DNA, 22 bp, Artificial Sequence
  Description of Artificial Sequence: Synthetic oligonucleotide
gctacgcgcccttcagcgcgga

SEQ ID NO: 325742 - DNA, 22 bp, Artificial Sequence
  Description of Artificial Sequence: Synthetic oligonucleotide
ctacgcgcccttcagcgcggac

SEQ ID NO: 325743 - DNA, 23 bp, Artificial Sequence
  Description of Artificial Sequence: Synthetic oligonucleotide
tacgcgcccttcagcgcggacga

SEQ ID NO: 325744 - DNA, 22 bp, Artificial Sequence
  Description of Artificial Sequence: Synthetic oligonucleotide
acgcgcccttcagcgcggacga

SEQ ID NO: 325745 - DNA, 21 bp, Artificial Sequence
  Description of Artificial Sequence: Synthetic oligonucleotide
cgcgcccttcagcgcggacga

SEQ ID NO: 325746 - DNA, 23 bp, Artificial Sequence
  Description of Artificial Sequence: Synthetic oligonucleotide
gcgcccttcagcgcggacgagat

SEQ ID NO: 325747 - DNA, 24 bp, Artificial Sequence
  Description of Artificial Sequence: Synthetic oligonucleotide
cgcccttcagcgcggacgagatct

SEQ ID NO: 325748 - DNA, 24 bp, Artificial Sequence
  Description of Artificial Sequence: Synthetic oligonucleotide
gcccttcagcgcggacgagatctc

SEQ ID NO: 325749 - DNA, 24 bp, Artificial Sequence
  Description of Artificial Sequence: Synthetic oligonucleotide
cccttcagcgcggacgagatctcc

SEQ ID NO: 325750 - DNA, 25 bp, Artificial Sequence
  Description of Artificial Sequence: Synthetic oligonucleotide
ccttcagcgcggacgagatctccct

SEQ ID NO: 325751 - DNA, 25 bp, Artificial Sequence
  Description of Artificial Sequence: Synthetic oligonucleotide
cttcagcgcggacgagatctccctg

SEQ ID NO: 325752 - DNA, 27 bp, Artificial Sequence
  Description of Artificial Sequence: Synthetic oligonucleotide
ttcagcgcggacgagatctccctggta

SEQ ID NO: 325753 - DNA, 26 bp, Artificial Sequence
  Description of Artificial Sequence: Synthetic oligonucleotide
tcagcgcggacgagatctccctggta

SEQ ID NO: 325754 - DNA, 25 bp, Artificial Sequence
  Description of Artificial Sequence: Synthetic oligonucleotide
cagcgcggacgagatctccctggta

SEQ ID NO: 325755 - DNA, 26 bp, Artificial Sequence
  Description of Artificial Sequence: Synthetic oligonucleotide
agcgcggacgagatctccctggtact

SEQ ID NO: 325756 - DNA, 25 bp, Artificial Sequence
  Description of Artificial Sequence: Synthetic oligonucleotide
gcgcggacgagatctccctggtact

SEQ ID NO: 325757 - DNA, 27 bp, Artificial Sequence
  Description of Artificial Sequence: Synthetic oligonucleotide
cgcggacgagatctccctggtactgtt

SEQ ID NO: 325758 - DNA, 28 bp, Artificial Sequence
  Description of Artificial Sequence: Synthetic oligonucleotide
gcggacgagatctccctggtactgtttg

SEQ ID NO: 325759 - DNA, 30 bp, Artificial Sequence
  Description of Artificial Sequence: Synthetic oligonucleotide
cggacgagatctccctggtactgtttgaac

SEQ ID NO: 325760 - DNA, 30 bp, Artificial Sequence
  Description of Artificial Sequence: Synthetic oligonucleotide
ggacgagatctccctggtactgtttgaacg

SEQ ID NO: 325761 - DNA, 30 bp, Artificial Sequence
  Description of Artificial Sequence: Synthetic oligonucleotide
gacgagatctccctggtactgtttgaacgg

SEQ ID NO: 325762 - DNA, 30 bp, Artificial Sequence
  Description of Artificial Sequence: Synthetic oligonucleotide
acgagatctccctggtactgtttgaacggg

SEQ ID NO: 325763 - DNA, 29 bp, Artificial Sequence
  Description of Artificial Sequence: Synthetic oligonucleotide
cgagatctccctggtactgtttgaacggg

SEQ ID NO: 325764 - DNA, 30 bp, Artificial Sequence
  Description of Artificial Sequence: Synthetic oligonucleotide
gagatctccctggtactgtttgaacgggac

SEQ ID NO: 325765 - DNA, 30 bp, Artificial Sequence
  Description of Artificial Sequence: Synthetic oligonucleotide
agatctccctggtactgtttgaacgggacg

SEQ ID NO: 325766 - DNA, 29 bp, Artificial Sequence
  Description of Artificial Sequence: Synthetic oligonucleotide
gatctccctggtactgtttgaacgggacg

SEQ ID NO: 325767 - DNA, 30 bp, Artificial Sequence
  Description of Artificial Sequence: Synthetic oligonucleotide
atctccctggtactgtttgaacgggacgag

SEQ ID NO: 325768 - DNA, 29 bp, Artificial Sequence
  Description of Artificial Sequence: Synthetic oligonucleotide
tctccctggtactgtttgaacgggacgag

SEQ ID NO: 325769 - DNA, 28 bp, Artificial Sequence
  Description of Artificial Sequence: Synthetic oligonucleotide
ctccctggtactgtttgaacgggacgag

SEQ ID NO: 325770 - DNA, 28 bp, Artificial Sequence
  Description of Artificial Sequence: Synthetic oligonucleotide
tccctggtactgtttgaacgggacgagg

SEQ ID NO: 325771 - DNA, 27 bp, Artificial Sequence
  Description of Artificial Sequence: Synthetic oligonucleotide
ccctggtactgtttgaacgggacgagg

SEQ ID NO: 325772 - DNA, 28 bp, Artificial Sequence
  Description of Artificial Sequence: Synthetic oligonucleotide
cctggtactgtttgaacgggacgaggag

SEQ ID NO: 325773 - DNA, 32 bp, Artificial Sequence
  Description of Artificial Sequence: Synthetic oligonucleotide
ctggtactgtttgaacgggacgaggagtattc

SEQ ID NO: 325774 - DNA, 32 bp, Artificial Sequence
  Description of Artificial Sequence: Synthetic oligonucleotide
tggtactgtttgaacgggacgaggagtattcc

SEQ ID NO: 325775 - DNA, 31 bp, Artificial Sequence
  Description of Artificial Sequence: Synthetic oligonucleotide
ggtactgtttgaacgggacgaggagtattcc

SEQ ID NO: 325776 - DNA, 32 bp, Artificial Sequence
  Description of Artificial Sequence: Synthetic oligonucleotide
gtactgtttgaacgggacgaggagtattccac

SEQ ID NO: 325777 - DNA, 32 bp, Artificial Sequence
  Description of Artificial Sequence: Synthetic oligonucleotide
tactgtttgaacgggacgaggagtattccacg

SEQ ID NO: 325778 - DNA, 31 bp, Artificial Sequence
  Description of Artificial Sequence: Synthetic oligonucleotide
actgtttgaacgggacgaggagtattccacg

SEQ ID NO: 325779 - DNA, 30 bp, Artificial Sequence
  Description of Artificial Sequence: Synthetic oligonucleotide
ctgtttgaacgggacgaggagtattccacg

SEQ ID NO: 325780 - DNA, 32 bp, Artificial Sequence
  Description of Artificial Sequence: Synthetic oligonucleotide
tgtttgaacgggacgaggagtattccacgatc

SEQ ID NO: 325781 - DNA, 31 bp, Artificial Sequence
  Description of Artificial Sequence: Synthetic oligonucleotide
gtttgaacgggacgaggagtattccacgatc

SEQ ID NO: 325782 - DNA, 31 bp, Artificial Sequence
  Description of Artificial Sequence: Synthetic oligonucleotide
tttgaacgggacgaggagtattccacgatcc

SEQ ID NO: 325783 - DNA, 30 bp, Artificial Sequence
  Description of Artificial Sequence: Synthetic oligonucleotide
ttgaacgggacgaggagtattccacgatcc

SEQ ID NO: 325784 - DNA, 29 bp, Artificial Sequence
  Description of Artificial Sequence: Synthetic oligonucleotide
tgaacgggacgaggagtattccacgatcc

SEQ ID NO: 325785 - DNA, 28 bp, Artificial Sequence
  Description of Artificial Sequence: Synthetic oligonucleotide
gaacgggacgaggagtattccacgatcc

SEQ ID NO: 325786 - DNA, 28 bp, Artificial Sequence
  Description of Artificial Sequence: Synthetic oligonucleotide
aacgggacgaggagtattccacgatccg

SEQ ID NO: 325787 - DNA, 27 bp, Artificial Sequence
  Description of Artificial Sequence: Synthetic oligonucleotide
acgggacgaggagtattccacgatccg

SEQ ID NO: 325788 - DNA, 26 bp, Artificial Sequence
  Description of Artificial Sequence: Synthetic oligonucleotide
cgggacgaggagtattccacgatccg

SEQ ID NO: 325789 - DNA, 27 bp, Artificial Sequence
  Description of Artificial Sequence: Synthetic oligonucleotide
gggacgaggagtattccacgatccgga

SEQ ID NO: 325790 - DNA, 28 bp, Artificial Sequence
  Description of Artificial Sequence: Synthetic oligonucleotide
ggacgaggagtattccacgatccggaag

SEQ ID NO: 325791 - DNA, 28 bp, Artificial Sequence
  Description of Artificial Sequence: Synthetic oligonucleotide
gacgaggagtattccacgatccggaagg

SEQ ID NO: 325792 - DNA, 29 bp, Artificial Sequence
  Description of Artificial Sequence: Synthetic oligonucleotide
acgaggagtattccacgatccggaaggag

SEQ ID NO: 325793 - DNA, 28 bp, Artificial Sequence
  Description of Artificial Sequence: Synthetic oligonucleotide
cgaggagtattccacgatccggaaggag

SEQ ID NO: 325794 - DNA, 28 bp, Artificial Sequence
  Description of Artificial Sequence: Synthetic oligonucleotide
gaggagtattccacgatccggaaggagg

SEQ ID NO: 325795 - DNA, 32 bp, Artificial Sequence
  Description of Artificial Sequence: Synthetic oligonucleotide
aggagtattccacgatccggaaggaggaatac

SEQ ID NO: 325796 - DNA, 31 bp, Artificial Sequence
  Description of Artificial Sequence: Synthetic oligonucleotide
ggagtattccacgatccggaaggaggaatac

SEQ ID NO: 325797 - DNA, 34 bp, Artificial Sequence
  Description of Artificial Sequence: Synthetic oligonucleotide
gagtattccacgatccggaaggaggaatacattg

SEQ ID NO: 325798 - DNA, 34 bp, Artificial Sequence
  Description of Artificial Sequence: Synthetic oligonucleotide
agtattccacgatccggaaggaggaatacattgg

SEQ ID NO: 325799 - DNA, 33 bp, Artificial Sequence
  Description of Artificial Sequence: Synthetic oligonucleotide
gtattccacgatccggaaggaggaatacattgg

SEQ ID NO: 325800 - DNA, 33 bp, Artificial Sequence
  Description of Artificial Sequence: Synthetic oligonucleotide
tattccacgatccggaaggaggaatacattggg

SEQ ID NO: 325801 - DNA, 32 bp, Artificial Sequence
  Description of Artificial Sequence: Synthetic oligonucleotide
attccacgatccggaaggaggaatacattggg

SEQ ID NO: 325802 - DNA, 31 bp, Artificial Sequence
  Description of Artificial Sequence: Synthetic oligonucleotide
ttccacgatccggaaggaggaatacattggg

SEQ ID NO: 325803 - DNA, 30 bp, Artificial Sequence
  Description of Artificial Sequence: Synthetic oligonucleotide
tccacgatccggaaggaggaatacattggg

SEQ ID NO: 325804 - DNA, 29 bp, Artificial Sequence
  Description of Artificial Sequence: Synthetic oligonucleotide
ccacgatccggaaggaggaatacattggg

SEQ ID NO: 325805 - DNA, 31 bp, Artificial Sequence
  Description of Artificial Sequence: Synthetic oligonucleotide
cacgatccggaaggaggaatacattgggaag

SEQ ID NO: 325806 - DNA, 33 bp, Artificial Sequence
  Description of Artificial Sequence: Synthetic oligonucleotide
acgatccggaaggaggaatacattgggaagatg

SEQ ID NO: 325807 - DNA, 32 bp, Artificial Sequence
  Description of Artificial Sequence: Synthetic oligonucleotide
cgatccggaaggaggaatacattgggaagatg

SEQ ID NO: 325808 - DNA, 32 bp, Artificial Sequence
  Description of Artificial Sequence: Synthetic oligonucleotide
gatccggaaggaggaatacattgggaagatgc

SEQ ID NO: 325809 - DNA, 32 bp, Artificial Sequence
  Description of Artificial Sequence: Synthetic oligonucleotide
atccggaaggaggaatacattgggaagatgcc

SEQ ID NO: 325810 - DNA, 31 bp, Artificial Sequence
  Description of Artificial Sequence: Synthetic oligonucleotide
tccggaaggaggaatacattgggaagatgcc

SEQ ID NO: 325811 - DNA, 30 bp, Artificial Sequence
  Description of Artificial Sequence: Synthetic oligonucleotide
ccggaaggaggaatacattgggaagatgcc

SEQ ID NO: 325812 - DNA, 31 bp, Artificial Sequence
  Description of Artificial Sequence: Synthetic oligonucleotide
cggaaggaggaatacattgggaagatgcctc

SEQ ID NO: 325813 - DNA, 31 bp, Artificial Sequence
  Description of Artificial Sequence: Synthetic oligonucleotide
ggaaggaggaatacattgggaagatgcctcg

SEQ ID NO: 325814 - DNA, 31 bp, Artificial Sequence
  Description of Artificial Sequence: Synthetic oligonucleotide
gaaggaggaatacattgggaagatgcctcgg

SEQ ID NO: 325815 - DNA, 33 bp, Artificial Sequence
  Description of Artificial Sequence: Synthetic oligonucleotide
aaggaggaatacattgggaagatgcctcggttc

SEQ ID NO: 325816 - DNA, 32 bp, Artificial Sequence
  Description of Artificial Sequence: Synthetic oligonucleotide
aggaggaatacattgggaagatgcctcggttc

SEQ ID NO: 325817 - DNA, 31 bp, Artificial Sequence
  Description of Artificial Sequence: Synthetic oligonucleotide
ggaggaatacattgggaagatgcctcggttc

SEQ ID NO: 325818 - DNA, 31 bp, Artificial Sequence
  Description of Artificial Sequence: Synthetic oligonucleotide
gaggaatacattgggaagatgcctcggttcg

SEQ ID NO: 325819 - DNA, 31 bp, Artificial Sequence
  Description of Artificial Sequence: Synthetic oligonucleotide
aggaatacattgggaagatgcctcggttcgg

SEQ ID NO: 325820 - DNA, 30 bp, Artificial Sequence
  Description of Artificial Sequence: Synthetic oligonucleotide
ggaatacattgggaagatgcctcggttcgg

SEQ ID NO: 325821 - DNA, 30 bp, Artificial Sequence
  Description of Artificial Sequence: Synthetic oligonucleotide
gaatacattgggaagatgcctcggttcggc

SEQ ID NO: 325822 - DNA, 30 bp, Artificial Sequence
  Description of Artificial Sequence: Synthetic oligonucleotide
aatacattgggaagatgcctcggttcggcc

SEQ ID NO: 325823 - DNA, 29 bp, Artificial Sequence
  Description of Artificial Sequence: Synthetic oligonucleotide
atacattgggaagatgcctcggttcggcc

SEQ ID NO: 325824 - DNA, 28 bp, Artificial Sequence
  Description of Artificial Sequence: Synthetic oligonucleotide
tacattgggaagatgcctcggttcggcc

SEQ ID NO: 325825 - DNA, 27 bp, Artificial Sequence
  Description of Artificial Sequence: Synthetic oligonucleotide
acattgggaagatgcctcggttcggcc

SEQ ID NO: 325826 - DNA, 26 bp, Artificial Sequence
  Description of Artificial Sequence: Synthetic oligonucleotide
cattgggaagatgcctcggttcggcc

SEQ ID NO: 325827 - DNA, 26 bp, Artificial Sequence
  Description of Artificial Sequence: Synthetic oligonucleotide
attgggaagatgcctcggttcggccg

SEQ ID NO: 325828 - DNA, 25 bp, Artificial Sequence
  Description of Artificial Sequence: Synthetic oligonucleotide
ttgggaagatgcctcggttcggccg

SEQ ID NO: 325829 - DNA, 24 bp, Artificial Sequence
  Description of Artificial Sequence: Synthetic oligonucleotide
tgggaagatgcctcggttcggccg

SEQ ID NO: 325830 - DNA, 23 bp, Artificial Sequence
  Description of Artificial Sequence: Synthetic oligonucleotide
gggaagatgcctcggttcggccg

SEQ ID NO: 325831 - DNA, 25 bp, Artificial Sequence
  Description of Artificial Sequence: Synthetic oligonucleotide
ggaagatgcctcggttcggccgcat

SEQ ID NO: 325832 - DNA, 25 bp, Artificial Sequence
  Description of Artificial Sequence: Synthetic oligonucleotide
gaagatgcctcggttcggccgcatc

SEQ ID NO: 325833 - DNA, 25 bp, Artificial Sequence
  Description of Artificial Sequence: Synthetic oligonucleotide
aagatgcctcggttcggccgcatcc

SEQ ID NO: 325834 - DNA, 24 bp, Artificial Sequence
  Description of Artificial Sequence: Synthetic oligonucleotide
agatgcctcggttcggccgcatcc

SEQ ID NO: 325835 - DNA, 23 bp, Artificial Sequence
  Description of Artificial Sequence: Synthetic oligonucleotide
gatgcctcggttcggccgcatcc

SEQ ID NO: 325836 - DNA, 23 bp, Artificial Sequence
  Description of Artificial Sequence: Synthetic oligonucleotide
atgcctcggttcggccgcatccc

SEQ ID NO: 325837 - DNA, 22 bp, Artificial Sequence
  Description of Artificial Sequence: Synthetic oligonucleotide
tgcctcggttcggccgcatccc

SEQ ID NO: 325838 - DNA, 21 bp, Artificial Sequence
  Description of Artificial Sequence: Synthetic oligonucleotide
gcctcggttcggccgcatccc

SEQ ID NO: 325839 - DNA, 21 bp, Artificial Sequence
  Description of Artificial Sequence: Synthetic oligonucleotide
cctcggttcggccgcatcccg

SEQ ID NO: 325840 - DNA, 21 bp, Artificial Sequence
  Description of Artificial Sequence: Synthetic oligonucleotide
ctcggttcggccgcatcccgg

SEQ ID NO: 325841 - DNA, 21 bp, Artificial Sequence
  Description of Artificial Sequence: Synthetic oligonucleotide
tcggttcggccgcatcccggg

SEQ ID NO: 325842 - DNA, 20 bp, Artificial Sequence
  Description of Artificial Sequence: Synthetic oligonucleotide
cggttcggccgcatcccggg

SEQ ID NO: 325843 - DNA, 20 bp, Artificial Sequence
  Description of Artificial Sequence: Synthetic oligonucleotide
ggttcggccgcatcccgggc

SEQ ID NO: 325844 - DNA, 21 bp, Artificial Sequence
  Description of Artificial Sequence: Synthetic oligonucleotide
gttcggccgcatcccgggcga

SEQ ID NO: 325845 - DNA, 22 bp, Artificial Sequence
  Description of Artificial Sequence: Synthetic oligonucleotide
ttcggccgcatcccgggcgaga

SEQ ID NO: 325846 - DNA, 21 bp, Artificial Sequence
  Description of Artificial Sequence: Synthetic oligonucleotide
tcggccgcatcccgggcgaga

SEQ ID NO: 325847 - DNA, 20 bp, Artificial Sequence
  Description of Artificial Sequence: Synthetic oligonucleotide
cggccgcatcccgggcgaga

SEQ ID NO: 325848 - DNA, 21 bp, Artificial Sequence
  Description of Artificial Sequence: Synthetic oligonucleotide
ggccgcatcccgggcgagaga

SEQ ID NO: 325849 - DNA, 22 bp, Artificial Sequence
  Description of Artificial Sequence: Synthetic oligonucleotide
gccgcatcccgggcgagagaga

SEQ ID NO: 325850 - DNA, 22 bp, Artificial Sequence
  Description of Artificial Sequence: Synthetic oligonucleotide
ccgcatcccgggcgagagagag

SEQ ID NO: 325851 - DNA, 23 bp, Artificial Sequence
  Description of Artificial Sequence: Synthetic oligonucleotide
cgcatcccgggcgagagagagct

SEQ ID NO: 325852 - DNA, 25 bp, Artificial Sequence
  Description of Artificial Sequence: Synthetic oligonucleotide
gcatcccgggcgagagagagctgta

SEQ ID NO: 325853 - DNA, 26 bp, Artificial Sequence
  Description of Artificial Sequence: Synthetic oligonucleotide
catcccgggcgagagagagctgtact

SEQ ID NO: 325854 - DNA, 26 bp, Artificial Sequence
  Description of Artificial Sequence: Synthetic oligonucleotide
atcccgggcgagagagagctgtactc

SEQ ID NO: 325855 - DNA, 25 bp, Artificial Sequence
  Description of Artificial Sequence: Synthetic oligonucleotide
tcccgggcgagagagagctgtactc

SEQ ID NO: 325856 - DNA, 24 bp, Artificial Sequence
  Description of Artificial Sequence: Synthetic oligonucleotide
cccgggcgagagagagctgtactc

SEQ ID NO: 325857 - DNA, 25 bp, Artificial Sequence
  Description of Artificial Sequence: Synthetic oligonucleotide
ccgggcgagagagagctgtactcca

SEQ ID NO: 325858 - DNA, 26 bp, Artificial Sequence
  Description of Artificial Sequence: Synthetic oligonucleotide
cgggcgagagagagctgtactccagt

SEQ ID NO: 325859 - DNA, 27 bp, Artificial Sequence
  Description of Artificial Sequence: Synthetic oligonucleotide
gggcgagagagagctgtactccagtga

SEQ ID NO: 325860 - DNA, 29 bp, Artificial Sequence
  Description of Artificial Sequence: Synthetic oligonucleotide
ggcgagagagagctgtactccagtgatag

SEQ ID NO: 325861 - DNA, 30 bp, Artificial Sequence
  Description of Artificial Sequence: Synthetic oligonucleotide
gcgagagagagctgtactccagtgatagtg

SEQ ID NO: 325862 - DNA, 31 bp, Artificial Sequence
  Description of Artificial Sequence: Synthetic oligonucleotide
cgagagagagctgtactccagtgatagtgtc

SEQ ID NO: 325863 - DNA, 33 bp, Artificial Sequence
  Description of Artificial Sequence: Synthetic oligonucleotide
gagagagagctgtactccagtgatagtgtcatg

SEQ ID NO: 325864 - DNA, 33 bp, Artificial Sequence
  Description of Artificial Sequence: Synthetic oligonucleotide
agagagagctgtactccagtgatagtgtcatgc

SEQ ID NO: 325865 - DNA, 32 bp, Artificial Sequence
  Description of Artificial Sequence: Synthetic oligonucleotide
gagagagctgtactccagtgatagtgtcatgc

SEQ ID NO: 325866 - DNA, 33 bp, Artificial Sequence
  Description of Artificial Sequence: Synthetic oligonucleotide
agagagctgtactccagtgatagtgtcatgcac

SEQ ID NO: 325867 - DNA, 32 bp, Artificial Sequence
  Description of Artificial Sequence: Synthetic oligonucleotide
gagagctgtactccagtgatagtgtcatgcac

SEQ ID NO: 325868 - DNA, 34 bp, Artificial Sequence
  Description of Artificial Sequence: Synthetic oligonucleotide
agagctgtactccagtgatagtgtcatgcacaac

SEQ ID NO: 325869 - DNA, 33 bp, Artificial Sequence
  Description of Artificial Sequence: Synthetic oligonucleotide
gagctgtactccagtgatagtgtcatgcacaac

SEQ ID NO: 325870 - DNA, 33 bp, Artificial Sequence
  Description of Artificial Sequence: Synthetic oligonucleotide
agctgtactccagtgatagtgtcatgcacaacc

SEQ ID NO: 325871 - DNA, 32 bp, Artificial Sequence
  Description of Artificial Sequence: Synthetic oligonucleotide
gctgtactccagtgatagtgtcatgcacaacc

SEQ ID NO: 325872 - DNA, 32 bp, Artificial Sequence
  Description of Artificial Sequence: Synthetic oligonucleotide
ctgtactccagtgatagtgtcatgcacaaccc

SEQ ID NO: 325873 - DNA, 33 bp, Artificial Sequence
  Description of Artificial Sequence: Synthetic oligonucleotide
tgtactccagtgatagtgtcatgcacaacccac

SEQ ID NO: 325874 - DNA, 32 bp, Artificial Sequence
  Description of Artificial Sequence: Synthetic oligonucleotide
gtactccagtgatagtgtcatgcacaacccac

SEQ ID NO: 325875 - DNA, 33 bp, Artificial Sequence
  Description of Artificial Sequence: Synthetic oligonucleotide
tactccagtgatagtgtcatgcacaacccacag

SEQ ID NO: 325876 - DNA, 32 bp, Artificial Sequence
  Description of Artificial Sequence: Synthetic oligonucleotide
actccagtgatagtgtcatgcacaacccacag

SEQ ID NO: 325877 - DNA, 31 bp, Artificial Sequence
  Description of Artificial Sequence: Synthetic oligonucleotide
ctccagtgatagtgtcatgcacaacccacag

SEQ ID NO: 325878 - DNA, 33 bp, Artificial Sequence
  Description of Artificial Sequence: Synthetic oligonucleotide
tccagtgatagtgtcatgcacaacccacagatc

SEQ ID NO: 325879 - DNA, 32 bp, Artificial Sequence
  Description of Artificial Sequence: Synthetic oligonucleotide
ccagtgatagtgtcatgcacaacccacagatc

SEQ ID NO: 325880 - DNA, 34 bp, Artificial Sequence
  Description of Artificial Sequence: Synthetic oligonucleotide
cagtgatagtgtcatgcacaacccacagatcatc

SEQ ID NO: 325881 - DNA, 37 bp, Artificial Sequence
  Description of Artificial Sequence: Synthetic oligonucleotide
agtgatagtgtcatgcacaacccacagatcatcaaag

SEQ ID NO: 325882 - DNA, 36 bp, Artificial Sequence
  Description of Artificial Sequence: Synthetic oligonucleotide
gtgatagtgtcatgcacaacccacagatcatcaaag

SEQ ID NO: 325883 - DNA, 36 bp, Artificial Sequence
  Description of Artificial Sequence: Synthetic oligonucleotide
tgatagtgtcatgcacaacccacagatcatcaaagg

SEQ ID NO: 325884 - DNA, 35 bp, Artificial Sequence
  Description of Artificial Sequence: Synthetic oligonucleotide
gatagtgtcatgcacaacccacagatcatcaaagg

SEQ ID NO: 325885 - DNA, 35 bp, Artificial Sequence
  Description of Artificial Sequence: Synthetic oligonucleotide
atagtgtcatgcacaacccacagatcatcaaaggc

SEQ ID NO: 325886 - DNA, 34 bp, Artificial Sequence
  Description of Artificial Sequence: Synthetic oligonucleotide
tagtgtcatgcacaacccacagatcatcaaaggc

SEQ ID NO: 325887 - DNA, 33 bp, Artificial Sequence
  Description of Artificial Sequence: Synthetic oligonucleotide
agtgtcatgcacaacccacagatcatcaaaggc

SEQ ID NO: 325888 - DNA, 32 bp, Artificial Sequence
  Description of Artificial Sequence: Synthetic oligonucleotide
gtgtcatgcacaacccacagatcatcaaaggc

SEQ ID NO: 325889 - DNA, 33 bp, Artificial Sequence
  Description of Artificial Sequence: Synthetic oligonucleotide
tgtcatgcacaacccacagatcatcaaaggcac

SEQ ID NO: 325890 - DNA, 32 bp, Artificial Sequence
  Description of Artificial Sequence: Synthetic oligonucleotide
gtcatgcacaacccacagatcatcaaaggcac

SEQ ID NO: 325891 - DNA, 32 bp, Artificial Sequence
  Description of Artificial Sequence: Synthetic oligonucleotide
tcatgcacaacccacagatcatcaaaggcacc

SEQ ID NO: 325892 - DNA, 31 bp, Artificial Sequence
  Description of Artificial Sequence: Synthetic oligonucleotide
catgcacaacccacagatcatcaaaggcacc

SEQ ID NO: 325893 - DNA, 33 bp, Artificial Sequence
  Description of Artificial Sequence: Synthetic oligonucleotide
atgcacaacccacagatcatcaaaggcaccatc

SEQ ID NO: 325894 - DNA, 32 bp, Artificial Sequence
  Description of Artificial Sequence: Synthetic oligonucleotide
tgcacaacccacagatcatcaaaggcaccatc

SEQ ID NO: 325895 - DNA, 31 bp, Artificial Sequence
  Description of Artificial Sequence: Synthetic oligonucleotide
gcacaacccacagatcatcaaaggcaccatc

SEQ ID NO: 325896 - DNA, 31 bp, Artificial Sequence
  Description of Artificial Sequence: Synthetic oligonucleotide
cacaacccacagatcatcaaaggcaccatcg

SEQ ID NO: 325897 - DNA, 32 bp, Artificial Sequence
  Description of Artificial Sequence: Synthetic oligonucleotide
acaacccacagatcatcaaaggcaccatcgtc

SEQ ID NO: 325898 - DNA, 31 bp, Artificial Sequence
  Description of Artificial Sequence: Synthetic oligonucleotide
caacccacagatcatcaaaggcaccatcgtc

SEQ ID NO: 325899 - DNA, 31 bp, Artificial Sequence
  Description of Artificial Sequence: Synthetic oligonucleotide
aacccacagatcatcaaaggcaccatcgtcc

SEQ ID NO: 325900 - DNA, 30 bp, Artificial Sequence
  Description of Artificial Sequence: Synthetic oligonucleotide
acccacagatcatcaaaggcaccatcgtcc

SEQ ID NO: 325901 - DNA, 29 bp, Artificial Sequence
  Description of Artificial Sequence: Synthetic oligonucleotide
cccacagatcatcaaaggcaccatcgtcc

SEQ ID NO: 325902 - DNA, 30 bp, Artificial Sequence
  Description of Artificial Sequence: Synthetic oligonucleotide
ccacagatcatcaaaggcaccatcgtccac

SEQ ID NO: 325903 - DNA, 30 bp, Artificial Sequence
  Description of Artificial Sequence: Synthetic oligonucleotide
cacagatcatcaaaggcaccatcgtccacc

SEQ ID NO: 325904 - DNA, 32 bp, Artificial Sequence
  Description of Artificial Sequence: Synthetic oligonucleotide
acagatcatcaaaggcaccatcgtccaccaag

SEQ ID NO: 325905 - DNA, 31 bp, Artificial Sequence
  Description of Artificial Sequence: Synthetic oligonucleotide
cagatcatcaaaggcaccatcgtccaccaag

SEQ ID NO: 325906 - DNA, 32 bp, Artificial Sequence
  Description of Artificial Sequence: Synthetic oligonucleotide
agatcatcaaaggcaccatcgtccaccaagac

SEQ ID NO: 325907 - DNA, 31 bp, Artificial Sequence
  Description of Artificial Sequence: Synthetic oligonucleotide
gatcatcaaaggcaccatcgtccaccaagac

SEQ ID NO: 325908 - DNA, 31 bp, Artificial Sequence
  Description of Artificial Sequence: Synthetic oligonucleotide
atcatcaaaggcaccatcgtccaccaagacg

SEQ ID NO: 325909 - DNA, 30 bp, Artificial Sequence
  Description of Artificial Sequence: Synthetic oligonucleotide
tcatcaaaggcaccatcgtccaccaagacg

SEQ ID NO: 325910 - DNA, 29 bp, Artificial Sequence
  Description of Artificial Sequence: Synthetic oligonucleotide
catcaaaggcaccatcgtccaccaagacg

SEQ ID NO: 325911 - DNA, 30 bp, Artificial Sequence
  Description of Artificial Sequence: Synthetic oligonucleotide
atcaaaggcaccatcgtccaccaagacgag

SEQ ID NO: 325912 - DNA, 29 bp, Artificial Sequence
  Description of Artificial Sequence: Synthetic oligonucleotide
tcaaaggcaccatcgtccaccaagacgag

SEQ ID NO: 325913 - DNA, 28 bp, Artificial Sequence
  Description of Artificial Sequence: Synthetic oligonucleotide
caaaggcaccatcgtccaccaagacgag

SEQ ID NO: 325914 - DNA, 28 bp, Artificial Sequence
  Description of Artificial Sequence: Synthetic oligonucleotide
aaaggcaccatcgtccaccaagacgagg

SEQ ID NO: 325915 - DNA, 27 bp, Artificial Sequence
  Description of Artificial Sequence: Synthetic oligonucleotide
aaggcaccatcgtccaccaagacgagg

SEQ ID NO: 325916 - DNA, 26 bp, Artificial Sequence
  Description of Artificial Sequence: Synthetic oligonucleotide
aggcaccatcgtccaccaagacgagg

SEQ ID NO: 325917 - DNA, 25 bp, Artificial Sequence
  Description of Artificial Sequence: Synthetic oligonucleotide
ggcaccatcgtccaccaagacgagg

SEQ ID NO: 325918 - DNA, 27 bp, Artificial Sequence
  Description of Artificial Sequence: Synthetic oligonucleotide
gcaccatcgtccaccaagacgaggctt

SEQ ID NO: 325919 - DNA, 28 bp, Artificial Sequence
  Description of Artificial Sequence: Synthetic oligonucleotide
caccatcgtccaccaagacgaggcttac

SEQ ID NO: 325920 - DNA, 28 bp, Artificial Sequence
  Description of Artificial Sequence: Synthetic oligonucleotide
accatcgtccaccaagacgaggcttacg

SEQ ID NO: 325921 - DNA, 27 bp, Artificial Sequence
  Description of Artificial Sequence: Synthetic oligonucleotide
ccatcgtccaccaagacgaggcttacg

SEQ ID NO: 325922 - DNA, 29 bp, Artificial Sequence
  Description of Artificial Sequence: Synthetic oligonucleotide
catcgtccaccaagacgaggcttacgttg

SEQ ID NO: 325923 - DNA, 30 bp, Artificial Sequence
  Description of Artificial Sequence: Synthetic oligonucleotide
atcgtccaccaagacgaggcttacgttgac

SEQ ID NO: 325924 - DNA, 29 bp, Artificial Sequence
  Description of Artificial Sequence: Synthetic oligonucleotide
tcgtccaccaagacgaggcttacgttgac

SEQ ID NO: 325925 - DNA, 28 bp, Artificial Sequence
  Description of Artificial Sequence: Synthetic oligonucleotide
cgtccaccaagacgaggcttacgttgac

SEQ ID NO: 325926 - DNA, 30 bp, Artificial Sequence
  Description of Artificial Sequence: Synthetic oligonucleotide
gtccaccaagacgaggcttacgttgacaag

SEQ ID NO: 325927 - DNA, 32 bp, Artificial Sequence
  Description of Artificial Sequence: Synthetic oligonucleotide
tccaccaagacgaggcttacgttgacaagatg

SEQ ID NO: 325928 - DNA, 31 bp, Artificial Sequence
  Description of Artificial Sequence: Synthetic oligonucleotide
ccaccaagacgaggcttacgttgacaagatg

SEQ ID NO: 325929 - DNA, 33 bp, Artificial Sequence
  Description of Artificial Sequence: Synthetic oligonucleotide
caccaagacgaggcttacgttgacaagatgtac

SEQ ID NO: 325930 - DNA, 35 bp, Artificial Sequence
  Description of Artificial Sequence: Synthetic oligonucleotide
accaagacgaggcttacgttgacaagatgtactac

SEQ ID NO: 325931 - DNA, 34 bp, Artificial Sequence
  Description of Artificial Sequence: Synthetic oligonucleotide
ccaagacgaggcttacgttgacaagatgtactac

SEQ ID NO: 325932 - DNA, 36 bp, Artificial Sequence
  Description of Artificial Sequence: Synthetic oligonucleotide
caagacgaggcttacgttgacaagatgtactacttc

SEQ ID NO: 325933 - DNA, 38 bp, Artificial Sequence
  Description of Artificial Sequence: Synthetic oligonucleotide
aagacgaggcttacgttgacaagatgtactacttcatc

SEQ ID NO: 325934 - DNA, 37 bp, Artificial Sequence
  Description of Artificial Sequence: Synthetic oligonucleotide
agacgaggcttacgttgacaagatgtactacttcatc

SEQ ID NO: 325935 - DNA, 36 bp, Artificial Sequence
  Description of Artificial Sequence: Synthetic oligonucleotide
gacgaggcttacgttgacaagatgtactacttcatc

SEQ ID NO: 325936 - DNA, 36 bp, Artificial Sequence
  Description of Artificial Sequence: Synthetic oligonucleotide
acgaggcttacgttgacaagatgtactacttcatcc

SEQ ID NO: 325937 - DNA, 35 bp, Artificial Sequence
  Description of Artificial Sequence: Synthetic oligonucleotide
cgaggcttacgttgacaagatgtactacttcatcc

SEQ ID NO: 325938 - DNA, 35 bp, Artificial Sequence
  Description of Artificial Sequence: Synthetic oligonucleotide
gaggcttacgttgacaagatgtactacttcatccg

SEQ ID NO: 325939 - DNA, 36 bp, Artificial Sequence
  Description of Artificial Sequence: Synthetic oligonucleotide
aggcttacgttgacaagatgtactacttcatccgag

SEQ ID NO: 325940 - DNA, 35 bp, Artificial Sequence
  Description of Artificial Sequence: Synthetic oligonucleotide
ggcttacgttgacaagatgtactacttcatccgag

SEQ ID NO: 325941 - DNA, 36 bp, Artificial Sequence
  Description of Artificial Sequence: Synthetic oligonucleotide
gcttacgttgacaagatgtactacttcatccgagag

SEQ ID NO: 325942 - DNA, 36 bp, Artificial Sequence
  Description of Artificial Sequence: Synthetic oligonucleotide
cttacgttgacaagatgtactacttcatccgagagg

SEQ ID NO: 325943 - DNA, 37 bp, Artificial Sequence
  Description of Artificial Sequence: Synthetic oligonucleotide
ttacgttgacaagatgtactacttcatccgagaggtc

SEQ ID NO: 325944 - DNA, 36 bp, Artificial Sequence
  Description of Artificial Sequence: Synthetic oligonucleotide
tacgttgacaagatgtactacttcatccgagaggtc

SEQ ID NO: 325945 - DNA, 35 bp, Artificial Sequence
  Description of Artificial Sequence: Synthetic oligonucleotide
acgttgacaagatgtactacttcatccgagaggtc

SEQ ID NO: 325946 - DNA, 34 bp, Artificial Sequence
  Description of Artificial Sequence: Synthetic oligonucleotide
cgttgacaagatgtactacttcatccgagaggtc

SEQ ID NO: 325947 - DNA, 37 bp, Artificial Sequence
  Description of Artificial Sequence: Synthetic oligonucleotide
gttgacaagatgtactacttcatccgagaggtcaatc

SEQ ID NO: 325948 - DNA, 37 bp, Artificial Sequence
  Description of Artificial Sequence: Synthetic oligonucleotide
ttgacaagatgtactacttcatccgagaggtcaatcc

SEQ ID NO: 325949 - DNA, 36 bp, Artificial Sequence
  Description of Artificial Sequence: Synthetic oligonucleotide
tgacaagatgtactacttcatccgagaggtcaatcc

SEQ ID NO: 325950 - DNA, 35 bp, Artificial Sequence
  Description of Artificial Sequence: Synthetic oligonucleotide
gacaagatgtactacttcatccgagaggtcaatcc

SEQ ID NO: 325951 - DNA, 36 bp, Artificial Sequence
  Description of Artificial Sequence: Synthetic oligonucleotide
acaagatgtactacttcatccgagaggtcaatcctg

SEQ ID NO: 325952 - DNA, 35 bp, Artificial Sequence
  Description of Artificial Sequence: Synthetic oligonucleotide
caagatgtactacttcatccgagaggtcaatcctg

SEQ ID NO: 325953 - DNA, 36 bp, Artificial Sequence
  Description of Artificial Sequence: Synthetic oligonucleotide
aagatgtactacttcatccgagaggtcaatcctgag

SEQ ID NO: 325954 - DNA, 35 bp, Artificial Sequence
  Description of Artificial Sequence: Synthetic oligonucleotide
agatgtactacttcatccgagaggtcaatcctgag

SEQ ID NO: 325955 - DNA, 34 bp, Artificial Sequence
  Description of Artificial Sequence: Synthetic oligonucleotide
gatgtactacttcatccgagaggtcaatcctgag

SEQ ID NO: 325956 - DNA, 36 bp, Artificial Sequence
  Description of Artificial Sequence: Synthetic oligonucleotide
atgtactacttcatccgagaggtcaatcctgagaag

SEQ ID NO: 325957 - DNA, 35 bp, Artificial Sequence
  Description of Artificial Sequence: Synthetic oligonucleotide
tgtactacttcatccgagaggtcaatcctgagaag

SEQ ID NO: 325958 - DNA, 34 bp, Artificial Sequence
  Description of Artificial Sequence: Synthetic oligonucleotide
gtactacttcatccgagaggtcaatcctgagaag

SEQ ID NO: 325959 - DNA, 37 bp, Artificial Sequence
  Description of Artificial Sequence: Synthetic oligonucleotide
tactacttcatccgagaggtcaatcctgagaagaatc

SEQ ID NO: 325960 - DNA, 36 bp, Artificial Sequence
  Description of Artificial Sequence: Synthetic oligonucleotide
actacttcatccgagaggtcaatcctgagaagaatc

SEQ ID NO: 325961 - DNA, 35 bp, Artificial Sequence
  Description of Artificial Sequence: Synthetic oligonucleotide
ctacttcatccgagaggtcaatcctgagaagaatc

SEQ ID NO: 325962 - DNA, 35 bp, Artificial Sequence
  Description of Artificial Sequence: Synthetic oligonucleotide
tacttcatccgagaggtcaatcctgagaagaatcc

SEQ ID NO: 325963 - DNA, 34 bp, Artificial Sequence
  Description of Artificial Sequence: Synthetic oligonucleotide
acttcatccgagaggtcaatcctgagaagaatcc

SEQ ID NO: 325964 - DNA, 33 bp, Artificial Sequence
  Description of Artificial Sequence: Synthetic oligonucleotide
cttcatccgagaggtcaatcctgagaagaatcc

SEQ ID NO: 325965 - DNA, 34 bp, Artificial Sequence
  Description of Artificial Sequence: Synthetic oligonucleotide
ttcatccgagaggtcaatcctgagaagaatcctc

SEQ ID NO: 325966 - DNA, 33 bp, Artificial Sequence
  Description of Artificial Sequence: Synthetic oligonucleotide
tcatccgagaggtcaatcctgagaagaatcctc

SEQ ID NO: 325967 - DNA, 32 bp, Artificial Sequence
  Description of Artificial Sequence: Synthetic oligonucleotide
catccgagaggtcaatcctgagaagaatcctc

SEQ ID NO: 325968 - DNA, 33 bp, Artificial Sequence
  Description of Artificial Sequence: Synthetic oligonucleotide
atccgagaggtcaatcctgagaagaatcctcag

SEQ ID NO: 325969 - DNA, 32 bp, Artificial Sequence
  Description of Artificial Sequence: Synthetic oligonucleotide
tccgagaggtcaatcctgagaagaatcctcag

SEQ ID NO: 325970 - DNA, 31 bp, Artificial Sequence
  Description of Artificial Sequence: Synthetic oligonucleotide
ccgagaggtcaatcctgagaagaatcctcag

SEQ ID NO: 325971 - DNA, 31 bp, Artificial Sequence
  Description of Artificial Sequence: Synthetic oligonucleotide
cgagaggtcaatcctgagaagaatcctcagg

SEQ ID NO: 325972 - DNA, 31 bp, Artificial Sequence
  Description of Artificial Sequence: Synthetic oligonucleotide
gagaggtcaatcctgagaagaatcctcaggc

SEQ ID NO: 325973 - DNA, 32 bp, Artificial Sequence
  Description of Artificial Sequence: Synthetic oligonucleotide
agaggtcaatcctgagaagaatcctcaggctc

SEQ ID NO: 325974 - DNA, 31 bp, Artificial Sequence
  Description of Artificial Sequence: Synthetic oligonucleotide
gaggtcaatcctgagaagaatcctcaggctc

SEQ ID NO: 325975 - DNA, 31 bp, Artificial Sequence
  Description of Artificial Sequence: Synthetic oligonucleotide
aggtcaatcctgagaagaatcctcaggctcc

SEQ ID NO: 325976 - DNA, 30 bp, Artificial Sequence
  Description of Artificial Sequence: Synthetic oligonucleotide
ggtcaatcctgagaagaatcctcaggctcc

SEQ ID NO: 325977 - DNA, 31 bp, Artificial Sequence
  Description of Artificial Sequence: Synthetic oligonucleotide
gtcaatcctgagaagaatcctcaggctcctc

SEQ ID NO: 325978 - DNA, 32 bp, Artificial Sequence
  Description of Artificial Sequence: Synthetic oligonucleotide
tcaatcctgagaagaatcctcaggctcctcac

SEQ ID NO: 325979 - DNA, 31 bp, Artificial Sequence
  Description of Artificial Sequence: Synthetic oligonucleotide
caatcctgagaagaatcctcaggctcctcac

SEQ ID NO: 325980 - DNA, 34 bp, Artificial Sequence
  Description of Artificial Sequence: Synthetic oligonucleotide
aatcctgagaagaatcctcaggctcctcacaatg

SEQ ID NO: 325981 - DNA, 33 bp, Artificial Sequence
  Description of Artificial Sequence: Synthetic oligonucleotide
atcctgagaagaatcctcaggctcctcacaatg

SEQ ID NO: 325982 - DNA, 32 bp, Artificial Sequence
  Description of Artificial Sequence: Synthetic oligonucleotide
tcctgagaagaatcctcaggctcctcacaatg

SEQ ID NO: 325983 - DNA, 31 bp, Artificial Sequence
  Description of Artificial Sequence: Synthetic oligonucleotide
cctgagaagaatcctcaggctcctcacaatg

SEQ ID NO: 325984 - DNA, 32 bp, Artificial Sequence
  Description of Artificial Sequence: Synthetic oligonucleotide
ctgagaagaatcctcaggctcctcacaatgtg

SEQ ID NO: 325985 - DNA, 33 bp, Artificial Sequence
  Description of Artificial Sequence: Synthetic oligonucleotide
tgagaagaatcctcaggctcctcacaatgtgtc

SEQ ID NO: 325986 - DNA, 32 bp, Artificial Sequence
  Description of Artificial Sequence: Synthetic oligonucleotide
gagaagaatcctcaggctcctcacaatgtgtc

SEQ ID NO: 325987 - DNA, 32 bp, Artificial Sequence
  Description of Artificial Sequence: Synthetic oligonucleotide
agaagaatcctcaggctcctcacaatgtgtcg

SEQ ID NO: 325988 - DNA, 31 bp, Artificial Sequence
  Description of Artificial Sequence: Synthetic oligonucleotide
gaagaatcctcaggctcctcacaatgtgtcg

SEQ ID NO: 325989 - DNA, 31 bp, Artificial Sequence
  Description of Artificial Sequence: Synthetic oligonucleotide
aagaatcctcaggctcctcacaatgtgtcgc

SEQ ID NO: 325990 - DNA, 30 bp, Artificial Sequence
  Description of Artificial Sequence: Synthetic oligonucleotide
agaatcctcaggctcctcacaatgtgtcgc

SEQ ID NO: 325991 - DNA, 29 bp, Artificial Sequence
  Description of Artificial Sequence: Synthetic oligonucleotide
gaatcctcaggctcctcacaatgtgtcgc

SEQ ID NO: 325992 - DNA, 29 bp, Artificial Sequence
  Description of Artificial Sequence: Synthetic oligonucleotide
aatcctcaggctcctcacaatgtgtcgcg

SEQ ID NO: 325993 - DNA, 28 bp, Artificial Sequence
  Description of Artificial Sequence: Synthetic oligonucleotide
atcctcaggctcctcacaatgtgtcgcg

SEQ ID NO: 325994 - DNA, 27 bp, Artificial Sequence
  Description of Artificial Sequence: Synthetic oligonucleotide
tcctcaggctcctcacaatgtgtcgcg

SEQ ID NO: 325995 - DNA, 27 bp, Artificial Sequence
  Description of Artificial Sequence: Synthetic oligonucleotide
cctcaggctcctcacaatgtgtcgcgt

SEQ ID NO: 325996 - DNA, 27 bp, Artificial Sequence
  Description of Artificial Sequence: Synthetic oligonucleotide
ctcaggctcctcacaatgtgtcgcgtg

SEQ ID NO: 325997 - DNA, 28 bp, Artificial Sequence
  Description of Artificial Sequence: Synthetic oligonucleotide
tcaggctcctcacaatgtgtcgcgtgtg

SEQ ID NO: 325998 - DNA, 27 bp, Artificial Sequence
  Description of Artificial Sequence: Synthetic oligonucleotide
caggctcctcacaatgtgtcgcgtgtg

SEQ ID NO: 325999 - DNA, 27 bp, Artificial Sequence
  Description of Artificial Sequence: Synthetic oligonucleotide
aggctcctcacaatgtgtcgcgtgtgg

SEQ ID NO: 326000 - DNA, 26 bp, Artificial Sequence
  Description of Artificial Sequence: Synthetic oligonucleotide
ggctcctcacaatgtgtcgcgtgtgg

SEQ ID NO: 326001 - DNA, 26 bp, Artificial Sequence
  Description of Artificial Sequence: Synthetic oligonucleotide
gctcctcacaatgtgtcgcgtgtggc

SEQ ID NO: 326002 - DNA, 26 bp, Artificial Sequence
  Description of Artificial Sequence: Synthetic oligonucleotide
ctcctcacaatgtgtcgcgtgtggcc

SEQ ID NO: 326003 - DNA, 27 bp, Artificial Sequence
  Description of Artificial Sequence: Synthetic oligonucleotide
tcctcacaatgtgtcgcgtgtggccga

SEQ ID NO: 326004 - DNA, 26 bp, Artificial Sequence
  Description of Artificial Sequence: Synthetic oligonucleotide
cctcacaatgtgtcgcgtgtggccga

SEQ ID NO: 326005 - DNA, 27 bp, Artificial Sequence
  Description of Artificial Sequence: Synthetic oligonucleotide
ctcacaatgtgtcgcgtgtggccgagt

SEQ ID NO: 326006 - DNA, 28 bp, Artificial Sequence
  Description of Artificial Sequence: Synthetic oligonucleotide
tcacaatgtgtcgcgtgtggccgagttg

SEQ ID NO: 326007 - DNA, 27 bp, Artificial Sequence
  Description of Artificial Sequence: Synthetic oligonucleotide
cacaatgtgtcgcgtgtggccgagttg

SEQ ID NO: 326008 - DNA, 28 bp, Artificial Sequence
  Description of Artificial Sequence: Synthetic oligonucleotide
acaatgtgtcgcgtgtggccgagttgtg

SEQ ID NO: 326009 - DNA, 27 bp, Artificial Sequence
  Description of Artificial Sequence: Synthetic oligonucleotide
caatgtgtcgcgtgtggccgagttgtg

SEQ ID NO: 326010 - DNA, 27 bp, Artificial Sequence
  Description of Artificial Sequence: Synthetic oligonucleotide
aatgtgtcgcgtgtggccgagttgtgc

SEQ ID NO: 326011 - DNA, 27 bp, Artificial Sequence
  Description of Artificial Sequence: Synthetic oligonucleotide
atgtgtcgcgtgtggccgagttgtgca

SEQ ID NO: 326012 - DNA, 26 bp, Artificial Sequence
  Description of Artificial Sequence: Synthetic oligonucleotide
tgtgtcgcgtgtggccgagttgtgca

SEQ ID NO: 326013 - DNA, 25 bp, Artificial Sequence
  Description of Artificial Sequence: Synthetic oligonucleotide
gtgtcgcgtgtggccgagttgtgca

SEQ ID NO: 326014 - DNA, 25 bp, Artificial Sequence
  Description of Artificial Sequence: Synthetic oligonucleotide
tgtcgcgtgtggccgagttgtgcac

SEQ ID NO: 326015 - DNA, 24 bp, Artificial Sequence
  Description of Artificial Sequence: Synthetic oligonucleotide
gtcgcgtgtggccgagttgtgcac

SEQ ID NO: 326016 - DNA, 24 bp, Artificial Sequence
  Description of Artificial Sequence: Synthetic oligonucleotide
tcgcgtgtggccgagttgtgcacg

SEQ ID NO: 326017 - DNA, 23 bp, Artificial Sequence
  Description of Artificial Sequence: Synthetic oligonucleotide
cgcgtgtggccgagttgtgcacg

SEQ ID NO: 326018 - DNA, 23 bp, Artificial Sequence
  Description of Artificial Sequence: Synthetic oligonucleotide
gcgtgtggccgagttgtgcacgg

SEQ ID NO: 326019 - DNA, 23 bp, Artificial Sequence
  Description of Artificial Sequence: Synthetic oligonucleotide
cgtgtggccgagttgtgcacggg

SEQ ID NO: 326020 - DNA, 23 bp, Artificial Sequence
  Description of Artificial Sequence: Synthetic oligonucleotide
gtgtggccgagttgtgcacgggg

SEQ ID NO: 326021 - DNA, 24 bp, Artificial Sequence
  Description of Artificial Sequence: Synthetic oligonucleotide
tgtggccgagttgtgcacggggga

SEQ ID NO: 326022 - DNA, 23 bp, Artificial Sequence
  Description of Artificial Sequence: Synthetic oligonucleotide
gtggccgagttgtgcacggggga

SEQ ID NO: 326023 - DNA, 23 bp, Artificial Sequence
  Description of Artificial Sequence: Synthetic oligonucleotide
tggccgagttgtgcacgggggac

SEQ ID NO: 326024 - DNA, 22 bp, Artificial Sequence
  Description of Artificial Sequence: Synthetic oligonucleotide
ggccgagttgtgcacgggggac

SEQ ID NO: 326025 - DNA, 23 bp, Artificial Sequence
  Description of Artificial Sequence: Synthetic oligonucleotide
gccgagttgtgcacgggggacca

SEQ ID NO: 326026 - DNA, 23 bp, Artificial Sequence
  Description of Artificial Sequence: Synthetic oligonucleotide
ccgagttgtgcacgggggaccac

SEQ ID NO: 326027 - DNA, 23 bp, Artificial Sequence
  Description of Artificial Sequence: Synthetic oligonucleotide
cgagttgtgcacgggggaccacg

SEQ ID NO: 326028 - DNA, 24 bp, Artificial Sequence
  Description of Artificial Sequence: Synthetic oligonucleotide
gagttgtgcacgggggaccacggt

SEQ ID NO: 326029 - DNA, 24 bp, Artificial Sequence
  Description of Artificial Sequence: Synthetic oligonucleotide
agttgtgcacgggggaccacggtg

SEQ ID NO: 326030 - DNA, 23 bp, Artificial Sequence
  Description of Artificial Sequence: Synthetic oligonucleotide
gttgtgcacgggggaccacggtg

SEQ ID NO: 326031 - DNA, 23 bp, Artificial Sequence
  Description of Artificial Sequence: Synthetic oligonucleotide
ttgtgcacgggggaccacggtgg

SEQ ID NO: 326032 - DNA, 22 bp, Artificial Sequence
  Description of Artificial Sequence: Synthetic oligonucleotide
tgtgcacgggggaccacggtgg

SEQ ID NO: 326033 - DNA, 21 bp, Artificial Sequence
  Description of Artificial Sequence: Synthetic oligonucleotide
gtgcacgggggaccacggtgg

SEQ ID NO: 326034 - DNA, 21 bp, Artificial Sequence
  Description of Artificial Sequence: Synthetic oligonucleotide
tgcacgggggaccacggtggg

SEQ ID NO: 326035 - DNA, 20 bp, Artificial Sequence
  Description of Artificial Sequence: Synthetic oligonucleotide
gcacgggggaccacggtggg

SEQ ID NO: 326036 - DNA, 23 bp, Artificial Sequence
  Description of Artificial Sequence: Synthetic oligonucleotide
cacgggggaccacggtggggaat

SEQ ID NO: 326037 - DNA, 25 bp, Artificial Sequence
  Description of Artificial Sequence: Synthetic oligonucleotide
acgggggaccacggtggggaatgtt

SEQ ID NO: 326038 - DNA, 24 bp, Artificial Sequence
  Description of Artificial Sequence: Synthetic oligonucleotide
cgggggaccacggtggggaatgtt

SEQ ID NO: 326039 - DNA, 25 bp, Artificial Sequence
  Description of Artificial Sequence: Synthetic oligonucleotide
gggggaccacggtggggaatgttca

SEQ ID NO: 326040 - DNA, 26 bp, Artificial Sequence
  Description of Artificial Sequence: Synthetic oligonucleotide
ggggaccacggtggggaatgttcact

SEQ ID NO: 326041 - DNA, 27 bp, Artificial Sequence
  Description of Artificial Sequence: Synthetic oligonucleotide
gggaccacggtggggaatgttcactgt

SEQ ID NO: 326042 - DNA, 27 bp, Artificial Sequence
  Description of Artificial Sequence: Synthetic oligonucleotide
ggaccacggtggggaatgttcactgtg

SEQ ID NO: 326043 - DNA, 28 bp, Artificial Sequence
  Description of Artificial Sequence: Synthetic oligonucleotide
gaccacggtggggaatgttcactgtgag

SEQ ID NO: 326044 - DNA, 29 bp, Artificial Sequence
  Description of Artificial Sequence: Synthetic oligonucleotide
accacggtggggaatgttcactgtgagtc

SEQ ID NO: 326045 - DNA, 28 bp, Artificial Sequence
  Description of Artificial Sequence: Synthetic oligonucleotide
ccacggtggggaatgttcactgtgagtc

SEQ ID NO: 326046 - DNA, 29 bp, Artificial Sequence
  Description of Artificial Sequence: Synthetic oligonucleotide
cacggtggggaatgttcactgtgagtctc

SEQ ID NO: 326047 - DNA, 29 bp, Artificial Sequence
  Description of Artificial Sequence: Synthetic oligonucleotide
acggtggggaatgttcactgtgagtctcc

SEQ ID NO: 326048 - DNA, 28 bp, Artificial Sequence
  Description of Artificial Sequence: Synthetic oligonucleotide
cggtggggaatgttcactgtgagtctcc

SEQ ID NO: 326049 - DNA, 30 bp, Artificial Sequence
  Description of Artificial Sequence: Synthetic oligonucleotide
ggtggggaatgttcactgtgagtctccaac

SEQ ID NO: 326050 - DNA, 31 bp, Artificial Sequence
  Description of Artificial Sequence: Synthetic oligonucleotide
gtggggaatgttcactgtgagtctccaactg

SEQ ID NO: 326051 - DNA, 31 bp, Artificial Sequence
  Description of Artificial Sequence: Synthetic oligonucleotide
tggggaatgttcactgtgagtctccaactgg

SEQ ID NO: 326052 - DNA, 30 bp, Artificial Sequence
  Description of Artificial Sequence: Synthetic oligonucleotide
ggggaatgttcactgtgagtctccaactgg

SEQ ID NO: 326053 - DNA, 32 bp, Artificial Sequence
  Description of Artificial Sequence: Synthetic oligonucleotide
gggaatgttcactgtgagtctccaactggaac

SEQ ID NO: 326054 - DNA, 33 bp, Artificial Sequence
  Description of Artificial Sequence: Synthetic oligonucleotide
ggaatgttcactgtgagtctccaactggaacac

SEQ ID NO: 326055 - DNA, 37 bp, Artificial Sequence
  Description of Artificial Sequence: Synthetic oligonucleotide
gaatgttcactgtgagtctccaactggaacactattc

SEQ ID NO: 326056 - DNA, 38 bp, Artificial Sequence
  Description of Artificial Sequence: Synthetic oligonucleotide
aatgttcactgtgagtctccaactggaacactattctg

SEQ ID NO: 326057 - DNA, 37 bp, Artificial Sequence
  Description of Artificial Sequence: Synthetic oligonucleotide
atgttcactgtgagtctccaactggaacactattctg

SEQ ID NO: 326058 - DNA, 36 bp, Artificial Sequence
  Description of Artificial Sequence: Synthetic oligonucleotide
tgttcactgtgagtctccaactggaacactattctg

SEQ ID NO: 326059 - DNA, 35 bp, Artificial Sequence
  Description of Artificial Sequence: Synthetic oligonucleotide
gttcactgtgagtctccaactggaacactattctg

SEQ ID NO: 326060 - DNA, 38 bp, Artificial Sequence
  Description of Artificial Sequence: Synthetic oligonucleotide
ttcactgtgagtctccaactggaacactattctgaaag

SEQ ID NO: 326061 - DNA, 37 bp, Artificial Sequence
  Description of Artificial Sequence: Synthetic oligonucleotide
tcactgtgagtctccaactggaacactattctgaaag

SEQ ID NO: 326062 - DNA, 36 bp, Artificial Sequence
  Description of Artificial Sequence: Synthetic oligonucleotide
cactgtgagtctccaactggaacactattctgaaag

SEQ ID NO: 326063 - DNA, 36 bp, Artificial Sequence
  Description of Artificial Sequence: Synthetic oligonucleotide
actgtgagtctccaactggaacactattctgaaagg

SEQ ID NO: 326064 - DNA, 35 bp, Artificial Sequence
  Description of Artificial Sequence: Synthetic oligonucleotide
ctgtgagtctccaactggaacactattctgaaagg

SEQ ID NO: 326065 - DNA, 35 bp, Artificial Sequence
  Description of Artificial Sequence: Synthetic oligonucleotide
tgtgagtctccaactggaacactattctgaaaggc

SEQ ID NO: 326066 - DNA, 34 bp, Artificial Sequence
  Description of Artificial Sequence: Synthetic oligonucleotide
gtgagtctccaactggaacactattctgaaaggc

SEQ ID NO: 326067 - DNA, 36 bp, Artificial Sequence
  Description of Artificial Sequence: Synthetic oligonucleotide
tgagtctccaactggaacactattctgaaaggcatg

SEQ ID NO: 326068 - DNA, 35 bp, Artificial Sequence
  Description of Artificial Sequence: Synthetic oligonucleotide
gagtctccaactggaacactattctgaaaggcatg

SEQ ID NO: 326069 - DNA, 35 bp, Artificial Sequence
  Description of Artificial Sequence: Synthetic oligonucleotide
agtctccaactggaacactattctgaaaggcatgc

SEQ ID NO: 326070 - DNA, 34 bp, Artificial Sequence
  Description of Artificial Sequence: Synthetic oligonucleotide
gtctccaactggaacactattctgaaaggcatgc

SEQ ID NO: 326071 - DNA, 35 bp, Artificial Sequence
  Description of Artificial Sequence: Synthetic oligonucleotide
tctccaactggaacactattctgaaaggcatgctg

SEQ ID NO: 326072 - DNA, 34 bp, Artificial Sequence
  Description of Artificial Sequence: Synthetic oligonucleotide
ctccaactggaacactattctgaaaggcatgctg

SEQ ID NO: 326073 - DNA, 34 bp, Artificial Sequence
  Description of Artificial Sequence: Synthetic oligonucleotide
tccaactggaacactattctgaaaggcatgctgg

SEQ ID NO: 326074 - DNA, 33 bp, Artificial Sequence
  Description of Artificial Sequence: Synthetic oligonucleotide
ccaactggaacactattctgaaaggcatgctgg

SEQ ID NO: 326075 - DNA, 36 bp, Artificial Sequence
  Description of Artificial Sequence: Synthetic oligonucleotide
caactggaacactattctgaaaggcatgctggtttg

SEQ ID NO: 326076 - DNA, 36 bp, Artificial Sequence
  Description of Artificial Sequence: Synthetic oligonucleotide
aactggaacactattctgaaaggcatgctggtttgc

SEQ ID NO: 326077 - DNA, 35 bp, Artificial Sequence
  Description of Artificial Sequence: Synthetic oligonucleotide
actggaacactattctgaaaggcatgctggtttgc

SEQ ID NO: 326078 - DNA, 34 bp, Artificial Sequence
  Description of Artificial Sequence: Synthetic oligonucleotide
ctggaacactattctgaaaggcatgctggtttgc

SEQ ID NO: 326079 - DNA, 35 bp, Artificial Sequence
  Description of Artificial Sequence: Synthetic oligonucleotide
tggaacactattctgaaaggcatgctggtttgcag

SEQ ID NO: 326080 - DNA, 34 bp, Artificial Sequence
  Description of Artificial Sequence: Synthetic oligonucleotide
ggaacactattctgaaaggcatgctggtttgcag

SEQ ID NO: 326081 - DNA, 35 bp, Artificial Sequence
  Description of Artificial Sequence: Synthetic oligonucleotide
gaacactattctgaaaggcatgctggtttgcagtg

SEQ ID NO: 326082 - DNA, 37 bp, Artificial Sequence
  Description of Artificial Sequence: Synthetic oligonucleotide
aacactattctgaaaggcatgctggtttgcagtgatc

SEQ ID NO: 326083 - DNA, 36 bp, Artificial Sequence
  Description of Artificial Sequence: Synthetic oligonucleotide
acactattctgaaaggcatgctggtttgcagtgatc

SEQ ID NO: 326084 - DNA, 35 bp, Artificial Sequence
  Description of Artificial Sequence: Synthetic oligonucleotide
cactattctgaaaggcatgctggtttgcagtgatc

SEQ ID NO: 326085 - DNA, 35 bp, Artificial Sequence
  Description of Artificial Sequence: Synthetic oligonucleotide
actattctgaaaggcatgctggtttgcagtgatcc

SEQ ID NO: 326086 - DNA, 34 bp, Artificial Sequence
  Description of Artificial Sequence: Synthetic oligonucleotide
ctattctgaaaggcatgctggtttgcagtgatcc

SEQ ID NO: 326087 - DNA, 35 bp, Artificial Sequence
  Description of Artificial Sequence: Synthetic oligonucleotide
tattctgaaaggcatgctggtttgcagtgatcctg

SEQ ID NO: 326088 - DNA, 34 bp, Artificial Sequence
  Description of Artificial Sequence: Synthetic oligonucleotide
attctgaaaggcatgctggtttgcagtgatcctg

SEQ ID NO: 326089 - DNA, 33 bp, Artificial Sequence
  Description of Artificial Sequence: Synthetic oligonucleotide
ttctgaaaggcatgctggtttgcagtgatcctg

SEQ ID NO: 326090 - DNA, 32 bp, Artificial Sequence
  Description of Artificial Sequence: Synthetic oligonucleotide
tctgaaaggcatgctggtttgcagtgatcctg

SEQ ID NO: 326091 - DNA, 31 bp, Artificial Sequence
  Description of Artificial Sequence: Synthetic oligonucleotide
ctgaaaggcatgctggtttgcagtgatcctg

SEQ ID NO: 326092 - DNA, 31 bp, Artificial Sequence
  Description of Artificial Sequence: Synthetic oligonucleotide
tgaaaggcatgctggtttgcagtgatcctgc

SEQ ID NO: 326093 - DNA, 30 bp, Artificial Sequence
  Description of Artificial Sequence: Synthetic oligonucleotide
gaaaggcatgctggtttgcagtgatcctgc

SEQ ID NO: 326094 - DNA, 30 bp, Artificial Sequence
  Description of Artificial Sequence: Synthetic oligonucleotide
aaaggcatgctggtttgcagtgatcctgcc

SEQ ID NO: 326095 - DNA, 29 bp, Artificial Sequence
  Description of Artificial Sequence: Synthetic oligonucleotide
aaggcatgctggtttgcagtgatcctgcc

SEQ ID NO: 326096 - DNA, 28 bp, Artificial Sequence
  Description of Artificial Sequence: Synthetic oligonucleotide
aggcatgctggtttgcagtgatcctgcc

SEQ ID NO: 326097 - DNA, 27 bp, Artificial Sequence
  Description of Artificial Sequence: Synthetic oligonucleotide
ggcatgctggtttgcagtgatcctgcc

SEQ ID NO: 326098 - DNA, 28 bp, Artificial Sequence
  Description of Artificial Sequence: Synthetic oligonucleotide
gcatgctggtttgcagtgatcctgccac

SEQ ID NO: 326099 - DNA, 28 bp, Artificial Sequence
  Description of Artificial Sequence: Synthetic oligonucleotide
catgctggtttgcagtgatcctgccacc

SEQ ID NO: 326100 - DNA, 30 bp, Artificial Sequence
  Description of Artificial Sequence: Synthetic oligonucleotide
atgctggtttgcagtgatcctgccaccatc

SEQ ID NO: 326101 - DNA, 29 bp, Artificial Sequence
  Description of Artificial Sequence: Synthetic oligonucleotide
tgctggtttgcagtgatcctgccaccatc

SEQ ID NO: 326102 - DNA, 28 bp, Artificial Sequence
  Description of Artificial Sequence: Synthetic oligonucleotide
gctggtttgcagtgatcctgccaccatc

SEQ ID NO: 326103 - DNA, 30 bp, Artificial Sequence
  Description of Artificial Sequence: Synthetic oligonucleotide
ctggtttgcagtgatcctgccaccatcaag

SEQ ID NO: 326104 - DNA, 32 bp, Artificial Sequence
  Description of Artificial Sequence: Synthetic oligonucleotide
tggtttgcagtgatcctgccaccatcaagaac

SEQ ID NO: 326105 - DNA, 31 bp, Artificial Sequence
  Description of Artificial Sequence: Synthetic oligonucleotide
ggtttgcagtgatcctgccaccatcaagaac

SEQ ID NO: 326106 - DNA, 33 bp, Artificial Sequence
  Description of Artificial Sequence: Synthetic oligonucleotide
gtttgcagtgatcctgccaccatcaagaacttg

SEQ ID NO: 326107 - DNA, 35 bp, Artificial Sequence
  Description of Artificial Sequence: Synthetic oligonucleotide
tttgcagtgatcctgccaccatcaagaacttgaac

SEQ ID NO: 326108 - DNA, 34 bp, Artificial Sequence
  Description of Artificial Sequence: Synthetic oligonucleotide
ttgcagtgatcctgccaccatcaagaacttgaac

SEQ ID NO: 326109 - DNA, 33 bp, Artificial Sequence
  Description of Artificial Sequence: Synthetic oligonucleotide
tgcagtgatcctgccaccatcaagaacttgaac

SEQ ID NO: 326110 - DNA, 32 bp, Artificial Sequence
  Description of Artificial Sequence: Synthetic oligonucleotide
gcagtgatcctgccaccatcaagaacttgaac

SEQ ID NO: 326111 - DNA, 33 bp, Artificial Sequence
  Description of Artificial Sequence: Synthetic oligonucleotide
cagtgatcctgccaccatcaagaacttgaacag

SEQ ID NO: 326112 - DNA, 33 bp, Artificial Sequence
  Description of Artificial Sequence: Synthetic oligonucleotide
agtgatcctgccaccatcaagaacttgaacagg

SEQ ID NO: 326113 - DNA, 32 bp, Artificial Sequence
  Description of Artificial Sequence: Synthetic oligonucleotide
gtgatcctgccaccatcaagaacttgaacagg

SEQ ID NO: 326114 - DNA, 32 bp, Artificial Sequence
  Description of Artificial Sequence: Synthetic oligonucleotide
tgatcctgccaccatcaagaacttgaacaggc

SEQ ID NO: 326115 - DNA, 31 bp, Artificial Sequence
  Description of Artificial Sequence: Synthetic oligonucleotide
gatcctgccaccatcaagaacttgaacaggc

SEQ ID NO: 326116 - DNA, 32 bp, Artificial Sequence
  Description of Artificial Sequence: Synthetic oligonucleotide
atcctgccaccatcaagaacttgaacaggctg

SEQ ID NO: 326117 - DNA, 31 bp, Artificial Sequence
  Description of Artificial Sequence: Synthetic oligonucleotide
tcctgccaccatcaagaacttgaacaggctg

SEQ ID NO: 326118 - DNA, 30 bp, Artificial Sequence
  Description of Artificial Sequence: Synthetic oligonucleotide
cctgccaccatcaagaacttgaacaggctg

SEQ ID NO: 326119 - DNA, 30 bp, Artificial Sequence
  Description of Artificial Sequence: Synthetic oligonucleotide
ctgccaccatcaagaacttgaacaggctgg

SEQ ID NO: 326120 - DNA, 32 bp, Artificial Sequence
  Description of Artificial Sequence: Synthetic oligonucleotide
tgccaccatcaagaacttgaacaggctggaag

SEQ ID NO: 326121 - DNA, 31 bp, Artificial Sequence
  Description of Artificial Sequence: Synthetic oligonucleotide
gccaccatcaagaacttgaacaggctggaag

SEQ ID NO: 326122 - DNA, 32 bp, Artificial Sequence
  Description of Artificial Sequence: Synthetic oligonucleotide
ccaccatcaagaacttgaacaggctggaagac

SEQ ID NO: 326123 - DNA, 32 bp, Artificial Sequence
  Description of Artificial Sequence: Synthetic oligonucleotide
caccatcaagaacttgaacaggctggaagacg

SEQ ID NO: 326124 - DNA, 33 bp, Artificial Sequence
  Description of Artificial Sequence: Synthetic oligonucleotide
accatcaagaacttgaacaggctggaagacgtc

SEQ ID NO: 326125 - DNA, 32 bp, Artificial Sequence
  Description of Artificial Sequence: Synthetic oligonucleotide
ccatcaagaacttgaacaggctggaagacgtc

SEQ ID NO: 326126 - DNA, 34 bp, Artificial Sequence
  Description of Artificial Sequence: Synthetic oligonucleotide
catcaagaacttgaacaggctggaagacgtctac

SEQ ID NO: 326127 - DNA, 34 bp, Artificial Sequence
  Description of Artificial Sequence: Synthetic oligonucleotide
atcaagaacttgaacaggctggaagacgtctacc

SEQ ID NO: 326128 - DNA, 33 bp, Artificial Sequence
  Description of Artificial Sequence: Synthetic oligonucleotide
tcaagaacttgaacaggctggaagacgtctacc

SEQ ID NO: 326129 - DNA, 32 bp, Artificial Sequence
  Description of Artificial Sequence: Synthetic oligonucleotide
caagaacttgaacaggctggaagacgtctacc

SEQ ID NO: 326130 - DNA, 33 bp, Artificial Sequence
  Description of Artificial Sequence: Synthetic oligonucleotide
aagaacttgaacaggctggaagacgtctacctg

SEQ ID NO: 326131 - DNA, 32 bp, Artificial Sequence
  Description of Artificial Sequence: Synthetic oligonucleotide
agaacttgaacaggctggaagacgtctacctg

SEQ ID NO: 326132 - DNA, 31 bp, Artificial Sequence
  Description of Artificial Sequence: Synthetic oligonucleotide
gaacttgaacaggctggaagacgtctacctg

SEQ ID NO: 326133 - DNA, 31 bp, Artificial Sequence
  Description of Artificial Sequence: Synthetic oligonucleotide
aacttgaacaggctggaagacgtctacctgc

SEQ ID NO: 326134 - DNA, 30 bp, Artificial Sequence
  Description of Artificial Sequence: Synthetic oligonucleotide
acttgaacaggctggaagacgtctacctgc

SEQ ID NO: 326135 - DNA, 29 bp, Artificial Sequence
  Description of Artificial Sequence: Synthetic oligonucleotide
cttgaacaggctggaagacgtctacctgc

SEQ ID NO: 326136 - DNA, 30 bp, Artificial Sequence
  Description of Artificial Sequence: Synthetic oligonucleotide
ttgaacaggctggaagacgtctacctgctc

SEQ ID NO: 326137 - DNA, 29 bp, Artificial Sequence
  Description of Artificial Sequence: Synthetic oligonucleotide
tgaacaggctggaagacgtctacctgctc

SEQ ID NO: 326138 - DNA, 28 bp, Artificial Sequence
  Description of Artificial Sequence: Synthetic oligonucleotide
gaacaggctggaagacgtctacctgctc

SEQ ID NO: 326139 - DNA, 28 bp, Artificial Sequence
  Description of Artificial Sequence: Synthetic oligonucleotide
aacaggctggaagacgtctacctgctcc

SEQ ID NO: 326140 - DNA, 27 bp, Artificial Sequence
  Description of Artificial Sequence: Synthetic oligonucleotide
acaggctggaagacgtctacctgctcc

SEQ ID NO: 326141 - DNA, 26 bp, Artificial Sequence
  Description of Artificial Sequence: Synthetic oligonucleotide
caggctggaagacgtctacctgctcc

SEQ ID NO: 326142 - DNA, 27 bp, Artificial Sequence
  Description of Artificial Sequence: Synthetic oligonucleotide
aggctggaagacgtctacctgctccca

SEQ ID NO: 326143 - DNA, 26 bp, Artificial Sequence
  Description of Artificial Sequence: Synthetic oligonucleotide
ggctggaagacgtctacctgctccca

SEQ ID NO: 326144 - DNA, 27 bp, Artificial Sequence
  Description of Artificial Sequence: Synthetic oligonucleotide
gctggaagacgtctacctgctcccaga

SEQ ID NO: 326145 - DNA, 27 bp, Artificial Sequence
  Description of Artificial Sequence: Synthetic oligonucleotide
ctggaagacgtctacctgctcccagac

SEQ ID NO: 326146 - DNA, 27 bp, Artificial Sequence
  Description of Artificial Sequence: Synthetic oligonucleotide
tggaagacgtctacctgctcccagacc

SEQ ID NO: 326147 - DNA, 26 bp, Artificial Sequence
  Description of Artificial Sequence: Synthetic oligonucleotide
ggaagacgtctacctgctcccagacc

SEQ ID NO: 326148 - DNA, 26 bp, Artificial Sequence
  Description of Artificial Sequence: Synthetic oligonucleotide
gaagacgtctacctgctcccagaccc

SEQ ID NO: 326149 - DNA, 27 bp, Artificial Sequence
  Description of Artificial Sequence: Synthetic oligonucleotide
aagacgtctacctgctcccagacccca

SEQ ID NO: 326150 - DNA, 26 bp, Artificial Sequence
  Description of Artificial Sequence: Synthetic oligonucleotide
agacgtctacctgctcccagacccca

SEQ ID NO: 326151 - DNA, 25 bp, Artificial Sequence
  Description of Artificial Sequence: Synthetic oligonucleotide
gacgtctacctgctcccagacccca

SEQ ID NO: 326152 - DNA, 25 bp, Artificial Sequence
  Description of Artificial Sequence: Synthetic oligonucleotide
acgtctacctgctcccagaccccag

SEQ ID NO: 326153 - DNA, 24 bp, Artificial Sequence
  Description of Artificial Sequence: Synthetic oligonucleotide
cgtctacctgctcccagaccccag

SEQ ID NO: 326154 - DNA, 24 bp, Artificial Sequence
  Description of Artificial Sequence: Synthetic oligonucleotide
gtctacctgctcccagaccccagc

SEQ ID NO: 326155 - DNA, 24 bp, Artificial Sequence
  Description of Artificial Sequence: Synthetic oligonucleotide
tctacctgctcccagaccccagcc

SEQ ID NO: 326156 - DNA, 23 bp, Artificial Sequence
  Description of Artificial Sequence: Synthetic oligonucleotide
ctacctgctcccagaccccagcc

SEQ ID NO: 326157 - DNA, 23 bp, Artificial Sequence
  Description of Artificial Sequence: Synthetic oligonucleotide
tacctgctcccagaccccagccg

SEQ ID NO: 326158 - DNA, 22 bp, Artificial Sequence
  Description of Artificial Sequence: Synthetic oligonucleotide
acctgctcccagaccccagccg

SEQ ID NO: 326159 - DNA, 21 bp, Artificial Sequence
  Description of Artificial Sequence: Synthetic oligonucleotide
cctgctcccagaccccagccg

SEQ ID NO: 326160 - DNA, 21 bp, Artificial Sequence
  Description of Artificial Sequence: Synthetic oligonucleotide
ctgctcccagaccccagccgc

SEQ ID NO: 326161 - DNA, 22 bp, Artificial Sequence
  Description of Artificial Sequence: Synthetic oligonucleotide
tgctcccagaccccagccgcca

SEQ ID NO: 326162 - DNA, 21 bp, Artificial Sequence
  Description of Artificial Sequence: Synthetic oligonucleotide
gctcccagaccccagccgcca

SEQ ID NO: 326163 - DNA, 22 bp, Artificial Sequence
  Description of Artificial Sequence: Synthetic oligonucleotide
ctcccagaccccagccgccagt

SEQ ID NO: 326164 - DNA, 22 bp, Artificial Sequence
  Description of Artificial Sequence: Synthetic oligonucleotide
tcccagaccccagccgccagtg

SEQ ID NO: 326165 - DNA, 21 bp, Artificial Sequence
  Description of Artificial Sequence: Synthetic oligonucleotide
cccagaccccagccgccagtg

SEQ ID NO: 326166 - DNA, 22 bp, Artificial Sequence
  Description of Artificial Sequence: Synthetic oligonucleotide
ccagaccccagccgccagtgga

SEQ ID NO: 326167 - DNA, 22 bp, Artificial Sequence
  Description of Artificial Sequence: Synthetic oligonucleotide
cagaccccagccgccagtggac

SEQ ID NO: 326168 - DNA, 22 bp, Artificial Sequence
  Description of Artificial Sequence: Synthetic oligonucleotide
agaccccagccgccagtggacg

SEQ ID NO: 326169 - DNA, 21 bp, Artificial Sequence
  Description of Artificial Sequence: Synthetic oligonucleotide
gaccccagccgccagtggacg

SEQ ID NO: 326170 - DNA, 22 bp, Artificial Sequence
  Description of Artificial Sequence: Synthetic oligonucleotide
accccagccgccagtggacgga

SEQ ID NO: 326171 - DNA, 21 bp, Artificial Sequence
  Description of Artificial Sequence: Synthetic oligonucleotide
ccccagccgccagtggacgga

SEQ ID NO: 326172 - DNA, 22 bp, Artificial Sequence
  Description of Artificial Sequence: Synthetic oligonucleotide
cccagccgccagtggacggaca

SEQ ID NO: 326173 - DNA, 22 bp, Artificial Sequence
  Description of Artificial Sequence: Synthetic oligonucleotide
ccagccgccagtggacggacac

SEQ ID NO: 326174 - DNA, 23 bp, Artificial Sequence
  Description of Artificial Sequence: Synthetic oligonucleotide
cagccgccagtggacggacacca

SEQ ID NO: 326175 - DNA, 23 bp, Artificial Sequence
  Description of Artificial Sequence: Synthetic oligonucleotide
agccgccagtggacggacaccag

SEQ ID NO: 326176 - DNA, 22 bp, Artificial Sequence
  Description of Artificial Sequence: Synthetic oligonucleotide
gccgccagtggacggacaccag

SEQ ID NO: 326177 - DNA, 22 bp, Artificial Sequence
  Description of Artificial Sequence: Synthetic oligonucleotide
ccgccagtggacggacaccagc

SEQ ID NO: 326178 - DNA, 23 bp, Artificial Sequence
  Description of Artificial Sequence: Synthetic oligonucleotide
cgccagtggacggacaccagcgt

SEQ ID NO: 326179 - DNA, 26 bp, Artificial Sequence
  Description of Artificial Sequence: Synthetic oligonucleotide
gccagtggacggacaccagcgtctat

SEQ ID NO: 326180 - DNA, 26 bp, Artificial Sequence
  Description of Artificial Sequence: Synthetic oligonucleotide
ccagtggacggacaccagcgtctatg

SEQ ID NO: 326181 - DNA, 27 bp, Artificial Sequence
  Description of Artificial Sequence: Synthetic oligonucleotide
cagtggacggacaccagcgtctatggt

SEQ ID NO: 326182 - DNA, 27 bp, Artificial Sequence
  Description of Artificial Sequence: Synthetic oligonucleotide
agtggacggacaccagcgtctatggtc

SEQ ID NO: 326183 - DNA, 27 bp, Artificial Sequence
  Description of Artificial Sequence: Synthetic oligonucleotide
gtggacggacaccagcgtctatggtct

SEQ ID NO: 326184 - DNA, 30 bp, Artificial Sequence
  Description of Artificial Sequence: Synthetic oligonucleotide
tggacggacaccagcgtctatggtcttttc

SEQ ID NO: 326185 - DNA, 29 bp, Artificial Sequence
  Description of Artificial Sequence: Synthetic oligonucleotide
ggacggacaccagcgtctatggtcttttc

SEQ ID NO: 326186 - DNA, 30 bp, Artificial Sequence
  Description of Artificial Sequence: Synthetic oligonucleotide
gacggacaccagcgtctatggtcttttctc

SEQ ID NO: 326187 - DNA, 30 bp, Artificial Sequence
  Description of Artificial Sequence: Synthetic oligonucleotide
acggacaccagcgtctatggtcttttctcc

SEQ ID NO: 326188 - DNA, 29 bp, Artificial Sequence
  Description of Artificial Sequence: Synthetic oligonucleotide
cggacaccagcgtctatggtcttttctcc

SEQ ID NO: 326189 - DNA, 31 bp, Artificial Sequence
  Description of Artificial Sequence: Synthetic oligonucleotide
ggacaccagcgtctatggtcttttctccatc

SEQ ID NO: 326190 - DNA, 31 bp, Artificial Sequence
  Description of Artificial Sequence: Synthetic oligonucleotide
gacaccagcgtctatggtcttttctccatcc

SEQ ID NO: 326191 - DNA, 31 bp, Artificial Sequence
  Description of Artificial Sequence: Synthetic oligonucleotide
acaccagcgtctatggtcttttctccatccc

SEQ ID NO: 326192 - DNA, 30 bp, Artificial Sequence
  Description of Artificial Sequence: Synthetic oligonucleotide
caccagcgtctatggtcttttctccatccc

SEQ ID NO: 326193 - DNA, 30 bp, Artificial Sequence
  Description of Artificial Sequence: Synthetic oligonucleotide
accagcgtctatggtcttttctccatcccc

SEQ ID NO: 326194 - DNA, 29 bp, Artificial Sequence
  Description of Artificial Sequence: Synthetic oligonucleotide
ccagcgtctatggtcttttctccatcccc

SEQ ID NO: 326195 - DNA, 30 bp, Artificial Sequence
  Description of Artificial Sequence: Synthetic oligonucleotide
cagcgtctatggtcttttctccatcccctg

SEQ ID NO: 326196 - DNA, 30 bp, Artificial Sequence
  Description of Artificial Sequence: Synthetic oligonucleotide
agcgtctatggtcttttctccatcccctgg

SEQ ID NO: 326197 - DNA, 29 bp, Artificial Sequence
  Description of Artificial Sequence: Synthetic oligonucleotide
gcgtctatggtcttttctccatcccctgg

SEQ ID NO: 326198 - DNA, 31 bp, Artificial Sequence
  Description of Artificial Sequence: Synthetic oligonucleotide
cgtctatggtcttttctccatcccctggaag

SEQ ID NO: 326199 - DNA, 33 bp, Artificial Sequence
  Description of Artificial Sequence: Synthetic oligonucleotide
gtctatggtcttttctccatcccctggaagtac

SEQ ID NO: 326200 - DNA, 34 bp, Artificial Sequence
  Description of Artificial Sequence: Synthetic oligonucleotide
tctatggtcttttctccatcccctggaagtactc

SEQ ID NO: 326201 - DNA, 33 bp, Artificial Sequence
  Description of Artificial Sequence: Synthetic oligonucleotide
ctatggtcttttctccatcccctggaagtactc

SEQ ID NO: 326202 - DNA, 34 bp, Artificial Sequence
  Description of Artificial Sequence: Synthetic oligonucleotide
tatggtcttttctccatcccctggaagtactcag

SEQ ID NO: 326203 - DNA, 33 bp, Artificial Sequence
  Description of Artificial Sequence: Synthetic oligonucleotide
atggtcttttctccatcccctggaagtactcag

SEQ ID NO: 326204 - DNA, 32 bp, Artificial Sequence
  Description of Artificial Sequence: Synthetic oligonucleotide
tggtcttttctccatcccctggaagtactcag

SEQ ID NO: 326205 - DNA, 31 bp, Artificial Sequence
  Description of Artificial Sequence: Synthetic oligonucleotide
ggtcttttctccatcccctggaagtactcag

SEQ ID NO: 326206 - DNA, 31 bp, Artificial Sequence
  Description of Artificial Sequence: Synthetic oligonucleotide
gtcttttctccatcccctggaagtactcagc

SEQ ID NO: 326207 - DNA, 31 bp, Artificial Sequence
  Description of Artificial Sequence: Synthetic oligonucleotide
tcttttctccatcccctggaagtactcagcc

SEQ ID NO: 326208 - DNA, 30 bp, Artificial Sequence
  Description of Artificial Sequence: Synthetic oligonucleotide
cttttctccatcccctggaagtactcagcc

SEQ ID NO: 326209 - DNA, 30 bp, Artificial Sequence
  Description of Artificial Sequence: Synthetic oligonucleotide
ttttctccatcccctggaagtactcagccc

SEQ ID NO: 326210 - DNA, 29 bp, Artificial Sequence
  Description of Artificial Sequence: Synthetic oligonucleotide
tttctccatcccctggaagtactcagccc

SEQ ID NO: 326211 - DNA, 28 bp, Artificial Sequence
  Description of Artificial Sequence: Synthetic oligonucleotide
ttctccatcccctggaagtactcagccc

SEQ ID NO: 326212 - DNA, 27 bp, Artificial Sequence
  Description of Artificial Sequence: Synthetic oligonucleotide
tctccatcccctggaagtactcagccc

SEQ ID NO: 326213 - DNA, 27 bp, Artificial Sequence
  Description of Artificial Sequence: Synthetic oligonucleotide
ctccatcccctggaagtactcagccct

SEQ ID NO: 326214 - DNA, 27 bp, Artificial Sequence
  Description of Artificial Sequence: Synthetic oligonucleotide
tccatcccctggaagtactcagccctc

SEQ ID NO: 326215 - DNA, 27 bp, Artificial Sequence
  Description of Artificial Sequence: Synthetic oligonucleotide
ccatcccctggaagtactcagccctct

SEQ ID NO: 326216 - DNA, 27 bp, Artificial Sequence
  Description of Artificial Sequence: Synthetic oligonucleotide
catcccctggaagtactcagccctctg

SEQ ID NO: 326217 - DNA, 28 bp, Artificial Sequence
  Description of Artificial Sequence: Synthetic oligonucleotide
atcccctggaagtactcagccctctgtg

SEQ ID NO: 326218 - DNA, 27 bp, Artificial Sequence
  Description of Artificial Sequence: Synthetic oligonucleotide
tcccctggaagtactcagccctctgtg

SEQ ID NO: 326219 - DNA, 27 bp, Artificial Sequence
  Description of Artificial Sequence: Synthetic oligonucleotide
cccctggaagtactcagccctctgtgt

SEQ ID NO: 326220 - DNA, 27 bp, Artificial Sequence
  Description of Artificial Sequence: Synthetic oligonucleotide
ccctggaagtactcagccctctgtgtg

SEQ ID NO: 326221 - DNA, 31 bp, Artificial Sequence
  Description of Artificial Sequence: Synthetic oligonucleotide
cctggaagtactcagccctctgtgtgttttc

SEQ ID NO: 326222 - DNA, 31 bp, Artificial Sequence
  Description of Artificial Sequence: Synthetic oligonucleotide
ctggaagtactcagccctctgtgtgttttcc

SEQ ID NO: 326223 - DNA, 31 bp, Artificial Sequence
  Description of Artificial Sequence: Synthetic oligonucleotide
tggaagtactcagccctctgtgtgttttccc

SEQ ID NO: 326224 - DNA, 30 bp, Artificial Sequence
  Description of Artificial Sequence: Synthetic oligonucleotide
ggaagtactcagccctctgtgtgttttccc

SEQ ID NO: 326225 - DNA, 31 bp, Artificial Sequence
  Description of Artificial Sequence: Synthetic oligonucleotide
gaagtactcagccctctgtgtgttttccctc

SEQ ID NO: 326226 - DNA, 31 bp, Artificial Sequence
  Description of Artificial Sequence: Synthetic oligonucleotide
aagtactcagccctctgtgtgttttccctcg

SEQ ID NO: 326227 - DNA, 30 bp, Artificial Sequence
  Description of Artificial Sequence: Synthetic oligonucleotide
agtactcagccctctgtgtgttttccctcg

SEQ ID NO: 326228 - DNA, 29 bp, Artificial Sequence
  Description of Artificial Sequence: Synthetic oligonucleotide
gtactcagccctctgtgtgttttccctcg

SEQ ID NO: 326229 - DNA, 29 bp, Artificial Sequence
  Description of Artificial Sequence: Synthetic oligonucleotide
tactcagccctctgtgtgttttccctcgg

SEQ ID NO: 326230 - DNA, 28 bp, Artificial Sequence
  Description of Artificial Sequence: Synthetic oligonucleotide
actcagccctctgtgtgttttccctcgg

SEQ ID NO: 326231 - DNA, 27 bp, Artificial Sequence
  Description of Artificial Sequence: Synthetic oligonucleotide
ctcagccctctgtgtgttttccctcgg

SEQ ID NO: 326232 - DNA, 28 bp, Artificial Sequence
  Description of Artificial Sequence: Synthetic oligonucleotide
tcagccctctgtgtgttttccctcggag

SEQ ID NO: 326233 - DNA, 27 bp, Artificial Sequence
  Description of Artificial Sequence: Synthetic oligonucleotide
cagccctctgtgtgttttccctcggag

SEQ ID NO: 326234 - DNA, 28 bp, Artificial Sequence
  Description of Artificial Sequence: Synthetic oligonucleotide
agccctctgtgtgttttccctcggagac

SEQ ID NO: 326235 - DNA, 27 bp, Artificial Sequence
  Description of Artificial Sequence: Synthetic oligonucleotide
gccctctgtgtgttttccctcggagac

SEQ ID NO: 326236 - DNA, 30 bp, Artificial Sequence
  Description of Artificial Sequence: Synthetic oligonucleotide
ccctctgtgtgttttccctcggagacattg

SEQ ID NO: 326237 - DNA, 31 bp, Artificial Sequence
  Description of Artificial Sequence: Synthetic oligonucleotide
cctctgtgtgttttccctcggagacattgac

SEQ ID NO: 326238 - DNA, 33 bp, Artificial Sequence
  Description of Artificial Sequence: Synthetic oligonucleotide
ctctgtgtgttttccctcggagacattgactag

SEQ ID NO: 326239 - DNA, 33 bp, Artificial Sequence
  Description of Artificial Sequence: Synthetic oligonucleotide
tctgtgtgttttccctcggagacattgactagg

SEQ ID NO: 326240 - DNA, 32 bp, Artificial Sequence
  Description of Artificial Sequence: Synthetic oligonucleotide
ctgtgtgttttccctcggagacattgactagg

SEQ ID NO: 326241 - DNA, 33 bp, Artificial Sequence
  Description of Artificial Sequence: Synthetic oligonucleotide
tgtgtgttttccctcggagacattgactaggtc

SEQ ID NO: 326242 - DNA, 32 bp, Artificial Sequence
  Description of Artificial Sequence: Synthetic oligonucleotide
gtgtgttttccctcggagacattgactaggtc

SEQ ID NO: 326243 - DNA, 34 bp, Artificial Sequence
  Description of Artificial Sequence: Synthetic oligonucleotide
tgtgttttccctcggagacattgactaggtcttc

SEQ ID NO: 326244 - DNA, 33 bp, Artificial Sequence
  Description of Artificial Sequence: Synthetic oligonucleotide
gtgttttccctcggagacattgactaggtcttc

SEQ ID NO: 326245 - DNA, 33 bp, Artificial Sequence
  Description of Artificial Sequence: Synthetic oligonucleotide
tgttttccctcggagacattgactaggtcttcc

SEQ ID NO: 326246 - DNA, 32 bp, Artificial Sequence
  Description of Artificial Sequence: Synthetic oligonucleotide
gttttccctcggagacattgactaggtcttcc

SEQ ID NO: 326247 - DNA, 32 bp, Artificial Sequence
  Description of Artificial Sequence: Synthetic oligonucleotide
ttttccctcggagacattgactaggtcttccc

SEQ ID NO: 326248 - DNA, 31 bp, Artificial Sequence
  Description of Artificial Sequence: Synthetic oligonucleotide
tttccctcggagacattgactaggtcttccc

SEQ ID NO: 326249 - DNA, 30 bp, Artificial Sequence
  Description of Artificial Sequence: Synthetic oligonucleotide
ttccctcggagacattgactaggtcttccc

SEQ ID NO: 326250 - DNA, 29 bp, Artificial Sequence
  Description of Artificial Sequence: Synthetic oligonucleotide
tccctcggagacattgactaggtcttccc

SEQ ID NO: 326251 - DNA, 28 bp, Artificial Sequence
  Description of Artificial Sequence: Synthetic oligonucleotide
ccctcggagacattgactaggtcttccc

SEQ ID NO: 326252 - DNA, 30 bp, Artificial Sequence
  Description of Artificial Sequence: Synthetic oligonucleotide
cctcggagacattgactaggtcttccctac

SEQ ID NO: 326253 - DNA, 30 bp, Artificial Sequence
  Description of Artificial Sequence: Synthetic oligonucleotide
ctcggagacattgactaggtcttccctacc

SEQ ID NO: 326254 - DNA, 31 bp, Artificial Sequence
  Description of Artificial Sequence: Synthetic oligonucleotide
tcggagacattgactaggtcttccctacctc

SEQ ID NO: 326255 - DNA, 30 bp, Artificial Sequence
  Description of Artificial Sequence: Synthetic oligonucleotide
cggagacattgactaggtcttccctacctc

SEQ ID NO: 326256 - DNA, 30 bp, Artificial Sequence
  Description of Artificial Sequence: Synthetic oligonucleotide
ggagacattgactaggtcttccctacctcc

SEQ ID NO: 326257 - DNA, 31 bp, Artificial Sequence
  Description of Artificial Sequence: Synthetic oligonucleotide
gagacattgactaggtcttccctacctcctc

SEQ ID NO: 326258 - DNA, 32 bp, Artificial Sequence
  Description of Artificial Sequence: Synthetic oligonucleotide
agacattgactaggtcttccctacctcctctc

SEQ ID NO: 326259 - DNA, 31 bp, Artificial Sequence
  Description of Artificial Sequence: Synthetic oligonucleotide
gacattgactaggtcttccctacctcctctc

SEQ ID NO: 326260 - DNA, 32 bp, Artificial Sequence
  Description of Artificial Sequence: Synthetic oligonucleotide
acattgactaggtcttccctacctcctctctc

SEQ ID NO: 326261 - DNA, 31 bp, Artificial Sequence
  Description of Artificial Sequence: Synthetic oligonucleotide
cattgactaggtcttccctacctcctctctc

SEQ ID NO: 326262 - DNA, 33 bp, Artificial Sequence
  Description of Artificial Sequence: Synthetic oligonucleotide
attgactaggtcttccctacctcctctctcaag

SEQ ID NO: 326263 - DNA, 32 bp, Artificial Sequence
  Description of Artificial Sequence: Synthetic oligonucleotide
ttgactaggtcttccctacctcctctctcaag

SEQ ID NO: 326264 - DNA, 31 bp, Artificial Sequence
  Description of Artificial Sequence: Synthetic oligonucleotide
tgactaggtcttccctacctcctctctcaag

SEQ ID NO: 326265 - DNA, 30 bp, Artificial Sequence
  Description of Artificial Sequence: Synthetic oligonucleotide
gactaggtcttccctacctcctctctcaag

SEQ ID NO: 326266 - DNA, 30 bp, Artificial Sequence
  Description of Artificial Sequence: Synthetic oligonucleotide
actaggtcttccctacctcctctctcaagg

SEQ ID NO: 326267 - DNA, 29 bp, Artificial Sequence
  Description of Artificial Sequence: Synthetic oligonucleotide
ctaggtcttccctacctcctctctcaagg

SEQ ID NO: 326268 - DNA, 29 bp, Artificial Sequence
  Description of Artificial Sequence: Synthetic oligonucleotide
taggtcttccctacctcctctctcaaggg

SEQ ID NO: 326269 - DNA, 28 bp, Artificial Sequence
  Description of Artificial Sequence: Synthetic oligonucleotide
aggtcttccctacctcctctctcaaggg

SEQ ID NO: 326270 - DNA, 27 bp, Artificial Sequence
  Description of Artificial Sequence: Synthetic oligonucleotide
ggtcttccctacctcctctctcaaggg

SEQ ID NO: 326271 - DNA, 27 bp, Artificial Sequence
  Description of Artificial Sequence: Synthetic oligonucleotide
gtcttccctacctcctctctcaagggc

SEQ ID NO: 326272 - DNA, 29 bp, Artificial Sequence
  Description of Artificial Sequence: Synthetic oligonucleotide
tcttccctacctcctctctcaagggcaac

SEQ ID NO: 326273 - DNA, 28 bp, Artificial Sequence
  Description of Artificial Sequence: Synthetic oligonucleotide
cttccctacctcctctctcaagggcaac

SEQ ID NO: 326274 - DNA, 28 bp, Artificial Sequence
  Description of Artificial Sequence: Synthetic oligonucleotide
ttccctacctcctctctcaagggcaacc

SEQ ID NO: 326275 - DNA, 27 bp, Artificial Sequence
  Description of Artificial Sequence: Synthetic oligonucleotide
tccctacctcctctctcaagggcaacc

SEQ ID NO: 326276 - DNA, 27 bp, Artificial Sequence
  Description of Artificial Sequence: Synthetic oligonucleotide
ccctacctcctctctcaagggcaacca

SEQ ID NO: 326277 - DNA, 27 bp, Artificial Sequence
  Description of Artificial Sequence: Synthetic oligonucleotide
cctacctcctctctcaagggcaaccac

SEQ ID NO: 326278 - DNA, 28 bp, Artificial Sequence
  Description of Artificial Sequence: Synthetic oligonucleotide
ctacctcctctctcaagggcaaccactc

SEQ ID NO: 326279 - DNA, 30 bp, Artificial Sequence
  Description of Artificial Sequence: Synthetic oligonucleotide
tacctcctctctcaagggcaaccactcaac

SEQ ID NO: 326280 - DNA, 29 bp, Artificial Sequence
  Description of Artificial Sequence: Synthetic oligonucleotide
acctcctctctcaagggcaaccactcaac

SEQ ID NO: 326281 - DNA, 28 bp, Artificial Sequence
  Description of Artificial Sequence: Synthetic oligonucleotide
cctcctctctcaagggcaaccactcaac

SEQ ID NO: 326282 - DNA, 28 bp, Artificial Sequence
  Description of Artificial Sequence: Synthetic oligonucleotide
ctcctctctcaagggcaaccactcaacc

SEQ ID NO: 326283 - DNA, 28 bp, Artificial Sequence
  Description of Artificial Sequence: Synthetic oligonucleotide
tcctctctcaagggcaaccactcaaccc

SEQ ID NO: 326284 - DNA, 27 bp, Artificial Sequence
  Description of Artificial Sequence: Synthetic oligonucleotide
cctctctcaagggcaaccactcaaccc

SEQ ID NO: 326285 - DNA, 29 bp, Artificial Sequence
  Description of Artificial Sequence: Synthetic oligonucleotide
ctctctcaagggcaaccactcaacccttc

SEQ ID NO: 326286 - DNA, 29 bp, Artificial Sequence
  Description of Artificial Sequence: Synthetic oligonucleotide
tctctcaagggcaaccactcaacccttcc

SEQ ID NO: 326287 - DNA, 28 bp, Artificial Sequence
  Description of Artificial Sequence: Synthetic oligonucleotide
ctctcaagggcaaccactcaacccttcc

SEQ ID NO: 326288 - DNA, 28 bp, Artificial Sequence
  Description of Artificial Sequence: Synthetic oligonucleotide
tctcaagggcaaccactcaacccttccc

SEQ ID NO: 326289 - DNA, 27 bp, Artificial Sequence
  Description of Artificial Sequence: Synthetic oligonucleotide
ctcaagggcaaccactcaacccttccc

SEQ ID NO: 326290 - DNA, 29 bp, Artificial Sequence
  Description of Artificial Sequence: Synthetic oligonucleotide
tcaagggcaaccactcaacccttcccaag

SEQ ID NO: 326291 - DNA, 28 bp, Artificial Sequence
  Description of Artificial Sequence: Synthetic oligonucleotide
caagggcaaccactcaacccttcccaag

SEQ ID NO: 326292 - DNA, 28 bp, Artificial Sequence
  Description of Artificial Sequence: Synthetic oligonucleotide
aagggcaaccactcaacccttcccaagc

SEQ ID NO: 326293 - DNA, 27 bp, Artificial Sequence
  Description of Artificial Sequence: Synthetic oligonucleotide
agggcaaccactcaacccttcccaagc

SEQ ID NO: 326294 - DNA, 26 bp, Artificial Sequence
  Description of Artificial Sequence: Synthetic oligonucleotide
gggcaaccactcaacccttcccaagc

SEQ ID NO: 326295 - DNA, 26 bp, Artificial Sequence
  Description of Artificial Sequence: Synthetic oligonucleotide
ggcaaccactcaacccttcccaagcc

SEQ ID NO: 326296 - DNA, 26 bp, Artificial Sequence
  Description of Artificial Sequence: Synthetic oligonucleotide
gcaaccactcaacccttcccaagccg

SEQ ID NO: 326297 - DNA, 26 bp, Artificial Sequence
  Description of Artificial Sequence: Synthetic oligonucleotide
caaccactcaacccttcccaagccgc

SEQ ID NO: 326298 - DNA, 26 bp, Artificial Sequence
  Description of Artificial Sequence: Synthetic oligonucleotide
aaccactcaacccttcccaagccgcg

SEQ ID NO: 326299 - DNA, 25 bp, Artificial Sequence
  Description of Artificial Sequence: Synthetic oligonucleotide
accactcaacccttcccaagccgcg

SEQ ID NO: 326300 - DNA, 24 bp, Artificial Sequence
  Description of Artificial Sequence: Synthetic oligonucleotide
ccactcaacccttcccaagccgcg

SEQ ID NO: 326301 - DNA, 24 bp, Artificial Sequence
  Description of Artificial Sequence: Synthetic oligonucleotide
cactcaacccttcccaagccgcgg

SEQ ID NO: 326302 - DNA, 24 bp, Artificial Sequence
  Description of Artificial Sequence: Synthetic oligonucleotide
actcaacccttcccaagccgcggc

SEQ ID NO: 326303 - DNA, 23 bp, Artificial Sequence
  Description of Artificial Sequence: Synthetic oligonucleotide
ctcaacccttcccaagccgcggc

SEQ ID NO: 326304 - DNA, 24 bp, Artificial Sequence
  Description of Artificial Sequence: Synthetic oligonucleotide
tcaacccttcccaagccgcggcct

SEQ ID NO: 326305 - DNA, 23 bp, Artificial Sequence
  Description of Artificial Sequence: Synthetic oligonucleotide
caacccttcccaagccgcggcct

SEQ ID NO: 326306 - DNA, 23 bp, Artificial Sequence
  Description of Artificial Sequence: Synthetic oligonucleotide
aacccttcccaagccgcggcctc

SEQ ID NO: 326307 - DNA, 22 bp, Artificial Sequence
  Description of Artificial Sequence: Synthetic oligonucleotide
acccttcccaagccgcggcctc

SEQ ID NO: 326308 - DNA, 21 bp, Artificial Sequence
  Description of Artificial Sequence: Synthetic oligonucleotide
cccttcccaagccgcggcctc

SEQ ID NO: 326309 - DNA, 21 bp, Artificial Sequence
  Description of Artificial Sequence: Synthetic oligonucleotide
ccttcccaagccgcggcctcg

SEQ ID NO: 326310 - DNA, 23 bp, Artificial Sequence
  Description of Artificial Sequence: Synthetic oligonucleotide
cttcccaagccgcggcctcgcaa

SEQ ID NO: 326311 - DNA, 24 bp, Artificial Sequence
  Description of Artificial Sequence: Synthetic oligonucleotide
ttcccaagccgcggcctcgcaagt

SEQ ID NO: 326312 - DNA, 23 bp, Artificial Sequence
  Description of Artificial Sequence: Synthetic oligonucleotide
tcccaagccgcggcctcgcaagt

SEQ ID NO: 326313 - DNA, 22 bp, Artificial Sequence
  Description of Artificial Sequence: Synthetic oligonucleotide
cccaagccgcggcctcgcaagt

SEQ ID NO: 326314 - DNA, 22 bp, Artificial Sequence
  Description of Artificial Sequence: Synthetic oligonucleotide
ccaagccgcggcctcgcaagtg

SEQ ID NO: 326315 - DNA, 22 bp, Artificial Sequence
  Description of Artificial Sequence: Synthetic oligonucleotide
caagccgcggcctcgcaagtgc

SEQ ID NO: 326316 - DNA, 23 bp, Artificial Sequence
  Description of Artificial Sequence: Synthetic oligonucleotide
aagccgcggcctcgcaagtgcca

SEQ ID NO: 326317 - DNA, 22 bp, Artificial Sequence
  Description of Artificial Sequence: Synthetic oligonucleotide
agccgcggcctcgcaagtgcca

SEQ ID NO: 326318 - DNA, 21 bp, Artificial Sequence
  Description of Artificial Sequence: Synthetic oligonucleotide
gccgcggcctcgcaagtgcca

SEQ ID NO: 326319 - DNA, 21 bp, Artificial Sequence
  Description of Artificial Sequence: Synthetic oligonucleotide
ccgcggcctcgcaagtgccac

SEQ ID NO: 326320 - DNA, 21 bp, Artificial Sequence
  Description of Artificial Sequence: Synthetic oligonucleotide
cgcggcctcgcaagtgccacc

SEQ ID NO: 326321 - DNA, 22 bp, Artificial Sequence
  Description of Artificial Sequence: Synthetic oligonucleotide
gcggcctcgcaagtgccaccca

SEQ ID NO: 326322 - DNA, 23 bp, Artificial Sequence
  Description of Artificial Sequence: Synthetic oligonucleotide
cggcctcgcaagtgccacccaga

SEQ ID NO: 326323 - DNA, 23 bp, Artificial Sequence
  Description of Artificial Sequence: Synthetic oligonucleotide
ggcctcgcaagtgccacccagac

SEQ ID NO: 326324 - DNA, 24 bp, Artificial Sequence
  Description of Artificial Sequence: Synthetic oligonucleotide
gcctcgcaagtgccacccagacca

SEQ ID NO: 326325 - DNA, 24 bp, Artificial Sequence
  Description of Artificial Sequence: Synthetic oligonucleotide
cctcgcaagtgccacccagaccac

SEQ ID NO: 326326 - DNA, 25 bp, Artificial Sequence
  Description of Artificial Sequence: Synthetic oligonucleotide
ctcgcaagtgccacccagaccacca

SEQ ID NO: 326327 - DNA, 25 bp, Artificial Sequence
  Description of Artificial Sequence: Synthetic oligonucleotide
tcgcaagtgccacccagaccaccag

SEQ ID NO: 326328 - DNA, 24 bp, Artificial Sequence
  Description of Artificial Sequence: Synthetic oligonucleotide
cgcaagtgccacccagaccaccag

SEQ ID NO: 326329 - DNA, 24 bp, Artificial Sequence
  Description of Artificial Sequence: Synthetic oligonucleotide
gcaagtgccacccagaccaccagc

SEQ ID NO: 326330 - DNA, 24 bp, Artificial Sequence
  Description of Artificial Sequence: Synthetic oligonucleotide
caagtgccacccagaccaccagcc

SEQ ID NO: 326331 - DNA, 27 bp, Artificial Sequence
  Description of Artificial Sequence: Synthetic oligonucleotide
aagtgccacccagaccaccagccgata

SEQ ID NO: 326332 - DNA, 26 bp, Artificial Sequence
  Description of Artificial Sequence: Synthetic oligonucleotide
agtgccacccagaccaccagccgata

SEQ ID NO: 326333 - DNA, 25 bp, Artificial Sequence
  Description of Artificial Sequence: Synthetic oligonucleotide
gtgccacccagaccaccagccgata

SEQ ID NO: 326334 - DNA, 25 bp, Artificial Sequence
  Description of Artificial Sequence: Synthetic oligonucleotide
tgccacccagaccaccagccgatag

SEQ ID NO: 326335 - DNA, 24 bp, Artificial Sequence
  Description of Artificial Sequence: Synthetic oligonucleotide
gccacccagaccaccagccgatag

SEQ ID NO: 326336 - DNA, 24 bp, Artificial Sequence
  Description of Artificial Sequence: Synthetic oligonucleotide
ccacccagaccaccagccgatagc

SEQ ID NO: 326337 - DNA, 25 bp, Artificial Sequence
  Description of Artificial Sequence: Synthetic oligonucleotide
cacccagaccaccagccgatagcca

SEQ ID NO: 326338 - DNA, 26 bp, Artificial Sequence
  Description of Artificial Sequence: Synthetic oligonucleotide
acccagaccaccagccgatagccaca

SEQ ID NO: 326339 - DNA, 25 bp, Artificial Sequence
  Description of Artificial Sequence: Synthetic oligonucleotide
cccagaccaccagccgatagccaca

SEQ ID NO: 326340 - DNA, 26 bp, Artificial Sequence
  Description of Artificial Sequence: Synthetic oligonucleotide
ccagaccaccagccgatagccacaga

SEQ ID NO: 326341 - DNA, 27 bp, Artificial Sequence
  Description of Artificial Sequence: Synthetic oligonucleotide
cagaccaccagccgatagccacagaga

SEQ ID NO: 326342 - DNA, 27 bp, Artificial Sequence
  Description of Artificial Sequence: Synthetic oligonucleotide
agaccaccagccgatagccacagagag

SEQ ID NO: 326343 - DNA, 26 bp, Artificial Sequence
  Description of Artificial Sequence: Synthetic oligonucleotide
gaccaccagccgatagccacagagag

SEQ ID NO: 326344 - DNA, 27 bp, Artificial Sequence
  Description of Artificial Sequence: Synthetic oligonucleotide
accaccagccgatagccacagagagct

SEQ ID NO: 326345 - DNA, 27 bp, Artificial Sequence
  Description of Artificial Sequence: Synthetic oligonucleotide
ccaccagccgatagccacagagagctt

SEQ ID NO: 326346 - DNA, 27 bp, Artificial Sequence
  Description of Artificial Sequence: Synthetic oligonucleotide
caccagccgatagccacagagagcttc

SEQ ID NO: 326347 - DNA, 27 bp, Artificial Sequence
  Description of Artificial Sequence: Synthetic oligonucleotide
accagccgatagccacagagagcttcc

SEQ ID NO: 326348 - DNA, 27 bp, Artificial Sequence
  Description of Artificial Sequence: Synthetic oligonucleotide
ccagccgatagccacagagagcttcca

SEQ ID NO: 326349 - DNA, 27 bp, Artificial Sequence
  Description of Artificial Sequence: Synthetic oligonucleotide
cagccgatagccacagagagcttccag

SEQ ID NO: 326350 - DNA, 27 bp, Artificial Sequence
  Description of Artificial Sequence: Synthetic oligonucleotide
agccgatagccacagagagcttccagg

SEQ ID NO: 326351 - DNA, 27 bp, Artificial Sequence
  Description of Artificial Sequence: Synthetic oligonucleotide
gccgatagccacagagagcttccaggt

SEQ ID NO: 326352 - DNA, 27 bp, Artificial Sequence
  Description of Artificial Sequence: Synthetic oligonucleotide
ccgatagccacagagagcttccaggtc

SEQ ID NO: 326353 - DNA, 27 bp, Artificial Sequence
  Description of Artificial Sequence: Synthetic oligonucleotide
cgatagccacagagagcttccaggtcg

SEQ ID NO: 326354 - DNA, 27 bp, Artificial Sequence
  Description of Artificial Sequence: Synthetic oligonucleotide
gatagccacagagagcttccaggtcgc

SEQ ID NO: 326355 - DNA, 28 bp, Artificial Sequence
  Description of Artificial Sequence: Synthetic oligonucleotide
atagccacagagagcttccaggtcgctg

SEQ ID NO: 326356 - DNA, 27 bp, Artificial Sequence
  Description of Artificial Sequence: Synthetic oligonucleotide
tagccacagagagcttccaggtcgctg

SEQ ID NO: 326357 - DNA, 27 bp, Artificial Sequence
  Description of Artificial Sequence: Synthetic oligonucleotide
agccacagagagcttccaggtcgctga

SEQ ID NO: 326358 - DNA, 26 bp, Artificial Sequence
  Description of Artificial Sequence: Synthetic oligonucleotide
gccacagagagcttccaggtcgctga

SEQ ID NO: 326359 - DNA, 26 bp, Artificial Sequence
  Description of Artificial Sequence: Synthetic oligonucleotide
ccacagagagcttccaggtcgctgac

SEQ ID NO: 326360 - DNA, 26 bp, Artificial Sequence
  Description of Artificial Sequence: Synthetic oligonucleotide
cacagagagcttccaggtcgctgacc

SEQ ID NO: 326361 - DNA, 27 bp, Artificial Sequence
  Description of Artificial Sequence: Synthetic oligonucleotide
acagagagcttccaggtcgctgaccgt

SEQ ID NO: 326362 - DNA, 26 bp, Artificial Sequence
  Description of Artificial Sequence: Synthetic oligonucleotide
cagagagcttccaggtcgctgaccgt

SEQ ID NO: 326363 - DNA, 27 bp, Artificial Sequence
  Description of Artificial Sequence: Synthetic oligonucleotide
agagagcttccaggtcgctgaccgtga

SEQ ID NO: 326364 - DNA, 26 bp, Artificial Sequence
  Description of Artificial Sequence: Synthetic oligonucleotide
gagagcttccaggtcgctgaccgtga

SEQ ID NO: 326365 - DNA, 26 bp, Artificial Sequence
  Description of Artificial Sequence: Synthetic oligonucleotide
agagcttccaggtcgctgaccgtgac

SEQ ID NO: 326366 - DNA, 25 bp, Artificial Sequence
  Description of Artificial Sequence: Synthetic oligonucleotide
gagcttccaggtcgctgaccgtgac

SEQ ID NO: 326367 - DNA, 25 bp, Artificial Sequence
  Description of Artificial Sequence: Synthetic oligonucleotide
agcttccaggtcgctgaccgtgacc

SEQ ID NO: 326368 - DNA, 24 bp, Artificial Sequence
  Description of Artificial Sequence: Synthetic oligonucleotide
gcttccaggtcgctgaccgtgacc

SEQ ID NO: 326369 - DNA, 25 bp, Artificial Sequence
  Description of Artificial Sequence: Synthetic oligonucleotide
cttccaggtcgctgaccgtgaccca

SEQ ID NO: 326370 - DNA, 26 bp, Artificial Sequence
  Description of Artificial Sequence: Synthetic oligonucleotide
ttccaggtcgctgaccgtgacccaga

SEQ ID NO: 326371 - DNA, 25 bp, Artificial Sequence
  Description of Artificial Sequence: Synthetic oligonucleotide
tccaggtcgctgaccgtgacccaga

SEQ ID NO: 326372 - DNA, 24 bp, Artificial Sequence
  Description of Artificial Sequence: Synthetic oligonucleotide
ccaggtcgctgaccgtgacccaga

SEQ ID NO: 326373 - DNA, 24 bp, Artificial Sequence
  Description of Artificial Sequence: Synthetic oligonucleotide
caggtcgctgaccgtgacccagag

SEQ ID NO: 326374 - DNA, 25 bp, Artificial Sequence
  Description of Artificial Sequence: Synthetic oligonucleotide
aggtcgctgaccgtgacccagagga

SEQ ID NO: 326375 - DNA, 24 bp, Artificial Sequence
  Description of Artificial Sequence: Synthetic oligonucleotide
ggtcgctgaccgtgacccagagga

SEQ ID NO: 326376 - DNA, 24 bp, Artificial Sequence
  Description of Artificial Sequence: Synthetic oligonucleotide
gtcgctgaccgtgacccagaggag

SEQ ID NO: 326377 - DNA, 24 bp, Artificial Sequence
  Description of Artificial Sequence: Synthetic oligonucleotide
tcgctgaccgtgacccagaggagg

SEQ ID NO: 326378 - DNA, 23 bp, Artificial Sequence
  Description of Artificial Sequence: Synthetic oligonucleotide
cgctgaccgtgacccagaggagg

SEQ ID NO: 326379 - DNA, 23 bp, Artificial Sequence
  Description of Artificial Sequence: Synthetic oligonucleotide
gctgaccgtgacccagaggaggc

SEQ ID NO: 326380 - DNA, 23 bp, Artificial Sequence
  Description of Artificial Sequence: Synthetic oligonucleotide
ctgaccgtgacccagaggaggcg

SEQ ID NO: 326381 - DNA, 24 bp, Artificial Sequence
  Description of Artificial Sequence: Synthetic oligonucleotide
tgaccgtgacccagaggaggcgca

SEQ ID NO: 326382 - DNA, 23 bp, Artificial Sequence
  Description of Artificial Sequence: Synthetic oligonucleotide
gaccgtgacccagaggaggcgca

SEQ ID NO: 326383 - DNA, 24 bp, Artificial Sequence
  Description of Artificial Sequence: Synthetic oligonucleotide
accgtgacccagaggaggcgcaga

SEQ ID NO: 326384 - DNA, 23 bp, Artificial Sequence
  Description of Artificial Sequence: Synthetic oligonucleotide
ccgtgacccagaggaggcgcaga

SEQ ID NO: 326385 - DNA, 23 bp, Artificial Sequence
  Description of Artificial Sequence: Synthetic oligonucleotide
cgtgacccagaggaggcgcagag

SEQ ID NO: 326386 - DNA, 23 bp, Artificial Sequence
  Description of Artificial Sequence: Synthetic oligonucleotide
gtgacccagaggaggcgcagagc

SEQ ID NO: 326387 - DNA, 24 bp, Artificial Sequence
  Description of Artificial Sequence: Synthetic oligonucleotide
tgacccagaggaggcgcagagcgt

SEQ ID NO: 326388 - DNA, 23 bp, Artificial Sequence
  Description of Artificial Sequence: Synthetic oligonucleotide
gacccagaggaggcgcagagcgt

SEQ ID NO: 326389 - DNA, 23 bp, Artificial Sequence
  Description of Artificial Sequence: Synthetic oligonucleotide
acccagaggaggcgcagagcgtg

SEQ ID NO: 326390 - DNA, 22 bp, Artificial Sequence
  Description of Artificial Sequence: Synthetic oligonucleotide
cccagaggaggcgcagagcgtg

SEQ ID NO: 326391 - DNA, 23 bp, Artificial Sequence
  Description of Artificial Sequence: Synthetic oligonucleotide
ccagaggaggcgcagagcgtgga

SEQ ID NO: 326392 - DNA, 23 bp, Artificial Sequence
  Description of Artificial Sequence: Synthetic oligonucleotide
cagaggaggcgcagagcgtggag

SEQ ID NO: 326393 - DNA, 23 bp, Artificial Sequence
  Description of Artificial Sequence: Synthetic oligonucleotide
agaggaggcgcagagcgtggagc

SEQ ID NO: 326394 - DNA, 22 bp, Artificial Sequence
  Description of Artificial Sequence: Synthetic oligonucleotide
gaggaggcgcagagcgtggagc

SEQ ID NO: 326395 - DNA, 22 bp, Artificial Sequence
  Description of Artificial Sequence: Synthetic oligonucleotide
aggaggcgcagagcgtggagcc

SEQ ID NO: 326396 - DNA, 21 bp, Artificial Sequence
  Description of Artificial Sequence: Synthetic oligonucleotide
ggaggcgcagagcgtggagcc

SEQ ID NO: 326397 - DNA, 23 bp, Artificial Sequence
  Description of Artificial Sequence: Synthetic oligonucleotide
gaggcgcagagcgtggagccctt

SEQ ID NO: 326398 - DNA, 23 bp, Artificial Sequence
  Description of Artificial Sequence: Synthetic oligonucleotide
aggcgcagagcgtggagcccttg

SEQ ID NO: 326399 - DNA, 22 bp, Artificial Sequence
  Description of Artificial Sequence: Synthetic oligonucleotide
ggcgcagagcgtggagcccttg

SEQ ID NO: 326400 - DNA, 22 bp, Artificial Sequence
  Description of Artificial Sequence: Synthetic oligonucleotide
gcgcagagcgtggagcccttgg

SEQ ID NO: 326401 - DNA, 22 bp, Artificial Sequence
  Description of Artificial Sequence: Synthetic oligonucleotide
cgcagagcgtggagcccttggg

SEQ ID NO: 326402 - DNA, 22 bp, Artificial Sequence
  Description of Artificial Sequence: Synthetic oligonucleotide
gcagagcgtggagcccttgggg

SEQ ID NO: 326403 - DNA, 22 bp, Artificial Sequence
  Description of Artificial Sequence: Synthetic oligonucleotide
cagagcgtggagcccttggggc

SEQ ID NO: 326404 - DNA, 23 bp, Artificial Sequence
  Description of Artificial Sequence: Synthetic oligonucleotide
agagcgtggagcccttggggcct

SEQ ID NO: 326405 - DNA, 22 bp, Artificial Sequence
  Description of Artificial Sequence: Synthetic oligonucleotide
gagcgtggagcccttggggcct

SEQ ID NO: 326406 - DNA, 23 bp, Artificial Sequence
  Description of Artificial Sequence: Synthetic oligonucleotide
agcgtggagcccttggggcctca

SEQ ID NO: 326407 - DNA, 22 bp, Artificial Sequence
  Description of Artificial Sequence: Synthetic oligonucleotide
gcgtggagcccttggggcctca

SEQ ID NO: 326408 - DNA, 24 bp, Artificial Sequence
  Description of Artificial Sequence: Synthetic oligonucleotide
cgtggagcccttggggcctcagaa

SEQ ID NO: 326409 - DNA, 25 bp, Artificial Sequence
  Description of Artificial Sequence: Synthetic oligonucleotide
gtggagcccttggggcctcagaaga

SEQ ID NO: 326410 - DNA, 25 bp, Artificial Sequence
  Description of Artificial Sequence: Synthetic oligonucleotide
tggagcccttggggcctcagaagac

SEQ ID NO: 326411 - DNA, 24 bp, Artificial Sequence
  Description of Artificial Sequence: Synthetic oligonucleotide
ggagcccttggggcctcagaagac

SEQ ID NO: 326412 - DNA, 24 bp, Artificial Sequence
  Description of Artificial Sequence: Synthetic oligonucleotide
gagcccttggggcctcagaagacg

SEQ ID NO: 326413 - DNA, 24 bp, Artificial Sequence
  Description of Artificial Sequence: Synthetic oligonucleotide
agcccttggggcctcagaagacgc

SEQ ID NO: 326414 - DNA, 23 bp, Artificial Sequence
  Description of Artificial Sequence: Synthetic oligonucleotide
gcccttggggcctcagaagacgc

SEQ ID NO: 326415 - DNA, 26 bp, Artificial Sequence
  Description of Artificial Sequence: Synthetic oligonucleotide
cccttggggcctcagaagacgccttt

SEQ ID NO: 326416 - DNA, 27 bp, Artificial Sequence
  Description of Artificial Sequence: Synthetic oligonucleotide
ccttggggcctcagaagacgcctttgt

SEQ ID NO: 326417 - DNA, 28 bp, Artificial Sequence
  Description of Artificial Sequence: Synthetic oligonucleotide
cttggggcctcagaagacgcctttgttc

SEQ ID NO: 326418 - DNA, 28 bp, Artificial Sequence
  Description of Artificial Sequence: Synthetic oligonucleotide
ttggggcctcagaagacgcctttgttcc

SEQ ID NO: 326419 - DNA, 27 bp, Artificial Sequence
  Description of Artificial Sequence: Synthetic oligonucleotide
tggggcctcagaagacgcctttgttcc

SEQ ID NO: 326420 - DNA, 27 bp, Artificial Sequence
  Description of Artificial Sequence: Synthetic oligonucleotide
ggggcctcagaagacgcctttgttcca

SEQ ID NO: 326421 - DNA, 27 bp, Artificial Sequence
  Description of Artificial Sequence: Synthetic oligonucleotide
gggcctcagaagacgcctttgttccac

SEQ ID NO: 326422 - DNA, 28 bp, Artificial Sequence
  Description of Artificial Sequence: Synthetic oligonucleotide
ggcctcagaagacgcctttgttccacac

SEQ ID NO: 326423 - DNA, 34 bp, Artificial Sequence
  Description of Artificial Sequence: Synthetic oligonucleotide
gcctcagaagacgcctttgttccacactaaatac

SEQ ID NO: 326424 - DNA, 34 bp, Artificial Sequence
  Description of Artificial Sequence: Synthetic oligonucleotide
cctcagaagacgcctttgttccacactaaatacc

SEQ ID NO: 326425 - DNA, 35 bp, Artificial Sequence
  Description of Artificial Sequence: Synthetic oligonucleotide
ctcagaagacgcctttgttccacactaaatacctc

SEQ ID NO: 326426 - DNA, 37 bp, Artificial Sequence
  Description of Artificial Sequence: Synthetic oligonucleotide
tcagaagacgcctttgttccacactaaatacctctac

SEQ ID NO: 326427 - DNA, 36 bp, Artificial Sequence
  Description of Artificial Sequence: Synthetic oligonucleotide
cagaagacgcctttgttccacactaaatacctctac

SEQ ID NO: 326428 - DNA, 36 bp, Artificial Sequence
  Description of Artificial Sequence: Synthetic oligonucleotide
agaagacgcctttgttccacactaaatacctctacc

SEQ ID NO: 326429 - DNA, 35 bp, Artificial Sequence
  Description of Artificial Sequence: Synthetic oligonucleotide
gaagacgcctttgttccacactaaatacctctacc

SEQ ID NO: 326430 - DNA, 36 bp, Artificial Sequence
  Description of Artificial Sequence: Synthetic oligonucleotide
aagacgcctttgttccacactaaatacctctaccag

SEQ ID NO: 326431 - DNA, 35 bp, Artificial Sequence
  Description of Artificial Sequence: Synthetic oligonucleotide
agacgcctttgttccacactaaatacctctaccag

SEQ ID NO: 326432 - DNA, 34 bp, Artificial Sequence
  Description of Artificial Sequence: Synthetic oligonucleotide
gacgcctttgttccacactaaatacctctaccag

SEQ ID NO: 326433 - DNA, 37 bp, Artificial Sequence
  Description of Artificial Sequence: Synthetic oligonucleotide
acgcctttgttccacactaaatacctctaccagaatg

SEQ ID NO: 326434 - DNA, 36 bp, Artificial Sequence
  Description of Artificial Sequence: Synthetic oligonucleotide
cgcctttgttccacactaaatacctctaccagaatg

SEQ ID NO: 326435 - DNA, 37 bp, Artificial Sequence
  Description of Artificial Sequence: Synthetic oligonucleotide
gcctttgttccacactaaatacctctaccagaatgtg

SEQ ID NO: 326436 - DNA, 37 bp, Artificial Sequence
  Description of Artificial Sequence: Synthetic oligonucleotide
cctttgttccacactaaatacctctaccagaatgtgg

SEQ ID NO: 326437 - DNA, 37 bp, Artificial Sequence
  Description of Artificial Sequence: Synthetic oligonucleotide
ctttgttccacactaaatacctctaccagaatgtggc

SEQ ID NO: 326438 - DNA, 37 bp, Artificial Sequence
  Description of Artificial Sequence: Synthetic oligonucleotide
tttgttccacactaaatacctctaccagaatgtggcc

SEQ ID NO: 326439 - DNA, 36 bp, Artificial Sequence
  Description of Artificial Sequence: Synthetic oligonucleotide
ttgttccacactaaatacctctaccagaatgtggcc

SEQ ID NO: 326440 - DNA, 35 bp, Artificial Sequence
  Description of Artificial Sequence: Synthetic oligonucleotide
tgttccacactaaatacctctaccagaatgtggcc

SEQ ID NO: 326441 - DNA, 34 bp, Artificial Sequence
  Description of Artificial Sequence: Synthetic oligonucleotide
gttccacactaaatacctctaccagaatgtggcc

SEQ ID NO: 326442 - DNA, 34 bp, Artificial Sequence
  Description of Artificial Sequence: Synthetic oligonucleotide
ttccacactaaatacctctaccagaatgtggccg

SEQ ID NO: 326443 - DNA, 33 bp, Artificial Sequence
  Description of Artificial Sequence: Synthetic oligonucleotide
tccacactaaatacctctaccagaatgtggccg

SEQ ID NO: 326444 - DNA, 32 bp, Artificial Sequence
  Description of Artificial Sequence: Synthetic oligonucleotide
ccacactaaatacctctaccagaatgtggccg

SEQ ID NO: 326445 - DNA, 33 bp, Artificial Sequence
  Description of Artificial Sequence: Synthetic oligonucleotide
cacactaaatacctctaccagaatgtggccgtc

SEQ ID NO: 326446 - DNA, 33 bp, Artificial Sequence
  Description of Artificial Sequence: Synthetic oligonucleotide
acactaaatacctctaccagaatgtggccgtcg

SEQ ID NO: 326447 - DNA, 32 bp, Artificial Sequence
  Description of Artificial Sequence: Synthetic oligonucleotide
cactaaatacctctaccagaatgtggccgtcg

SEQ ID NO: 326448 - DNA, 33 bp, Artificial Sequence
  Description of Artificial Sequence: Synthetic oligonucleotide
actaaatacctctaccagaatgtggccgtcgac

SEQ ID NO: 326449 - DNA, 32 bp, Artificial Sequence
  Description of Artificial Sequence: Synthetic oligonucleotide
ctaaatacctctaccagaatgtggccgtcgac

SEQ ID NO: 326450 - DNA, 32 bp, Artificial Sequence
  Description of Artificial Sequence: Synthetic oligonucleotide
taaatacctctaccagaatgtggccgtcgacc

SEQ ID NO: 326451 - DNA, 31 bp, Artificial Sequence
  Description of Artificial Sequence: Synthetic oligonucleotide
aaatacctctaccagaatgtggccgtcgacc

SEQ ID NO: 326452 - DNA, 30 bp, Artificial Sequence
  Description of Artificial Sequence: Synthetic oligonucleotide
aatacctctaccagaatgtggccgtcgacc

SEQ ID NO: 326453 - DNA, 29 bp, Artificial Sequence
  Description of Artificial Sequence: Synthetic oligonucleotide
atacctctaccagaatgtggccgtcgacc

SEQ ID NO: 326454 - DNA, 28 bp, Artificial Sequence
  Description of Artificial Sequence: Synthetic oligonucleotide
tacctctaccagaatgtggccgtcgacc

SEQ ID NO: 326455 - DNA, 27 bp, Artificial Sequence
  Description of Artificial Sequence: Synthetic oligonucleotide
acctctaccagaatgtggccgtcgacc

SEQ ID NO: 326456 - DNA, 26 bp, Artificial Sequence
  Description of Artificial Sequence: Synthetic oligonucleotide
cctctaccagaatgtggccgtcgacc

SEQ ID NO: 326457 - DNA, 26 bp, Artificial Sequence
  Description of Artificial Sequence: Synthetic oligonucleotide
ctctaccagaatgtggccgtcgaccg

SEQ ID NO: 326458 - DNA, 27 bp, Artificial Sequence
  Description of Artificial Sequence: Synthetic oligonucleotide
tctaccagaatgtggccgtcgaccgca

SEQ ID NO: 326459 - DNA, 27 bp, Artificial Sequence
  Description of Artificial Sequence: Synthetic oligonucleotide
ctaccagaatgtggccgtcgaccgcat

SEQ ID NO: 326460 - DNA, 27 bp, Artificial Sequence
  Description of Artificial Sequence: Synthetic oligonucleotide
taccagaatgtggccgtcgaccgcatg

SEQ ID NO: 326461 - DNA, 26 bp, Artificial Sequence
  Description of Artificial Sequence: Synthetic oligonucleotide
accagaatgtggccgtcgaccgcatg

SEQ ID NO: 326462 - DNA, 25 bp, Artificial Sequence
  Description of Artificial Sequence: Synthetic oligonucleotide
ccagaatgtggccgtcgaccgcatg

SEQ ID NO: 326463 - DNA, 27 bp, Artificial Sequence
  Description of Artificial Sequence: Synthetic oligonucleotide
cagaatgtggccgtcgaccgcatgcta

SEQ ID NO: 326464 - DNA, 27 bp, Artificial Sequence
  Description of Artificial Sequence: Synthetic oligonucleotide
agaatgtggccgtcgaccgcatgctag

SEQ ID NO: 326465 - DNA, 26 bp, Artificial Sequence
  Description of Artificial Sequence: Synthetic oligonucleotide
gaatgtggccgtcgaccgcatgctag

SEQ ID NO: 326466 - DNA, 26 bp, Artificial Sequence
  Description of Artificial Sequence: Synthetic oligonucleotide
aatgtggccgtcgaccgcatgctagc

SEQ ID NO: 326467 - DNA, 25 bp, Artificial Sequence
  Description of Artificial Sequence: Synthetic oligonucleotide
atgtggccgtcgaccgcatgctagc

SEQ ID NO: 326468 - DNA, 24 bp, Artificial Sequence
  Description of Artificial Sequence: Synthetic oligonucleotide
tgtggccgtcgaccgcatgctagc

SEQ ID NO: 326469 - DNA, 23 bp, Artificial Sequence
  Description of Artificial Sequence: Synthetic oligonucleotide
gtggccgtcgaccgcatgctagc

SEQ ID NO: 326470 - DNA, 24 bp, Artificial Sequence
  Description of Artificial Sequence: Synthetic oligonucleotide
tggccgtcgaccgcatgctagcca

SEQ ID NO: 326471 - DNA, 23 bp, Artificial Sequence
  Description of Artificial Sequence: Synthetic oligonucleotide
ggccgtcgaccgcatgctagcca

SEQ ID NO: 326472 - DNA, 23 bp, Artificial Sequence
  Description of Artificial Sequence: Synthetic oligonucleotide
gccgtcgaccgcatgctagccag

SEQ ID NO: 326473 - DNA, 23 bp, Artificial Sequence
  Description of Artificial Sequence: Synthetic oligonucleotide
ccgtcgaccgcatgctagccagc

SEQ ID NO: 326474 - DNA, 24 bp, Artificial Sequence
  Description of Artificial Sequence: Synthetic oligonucleotide
cgtcgaccgcatgctagccagcca

SEQ ID NO: 326475 - DNA, 24 bp, Artificial Sequence
  Description of Artificial Sequence: Synthetic oligonucleotide
gtcgaccgcatgctagccagccag

SEQ ID NO: 326476 - DNA, 24 bp, Artificial Sequence
  Description of Artificial Sequence: Synthetic oligonucleotide
tcgaccgcatgctagccagccagg

SEQ ID NO: 326477 - DNA, 23 bp, Artificial Sequence
  Description of Artificial Sequence: Synthetic oligonucleotide
cgaccgcatgctagccagccagg

SEQ ID NO: 326478 - DNA, 23 bp, Artificial Sequence
  Description of Artificial Sequence: Synthetic oligonucleotide
gaccgcatgctagccagccaggg

SEQ ID NO: 326479 - DNA, 23 bp, Artificial Sequence
  Description of Artificial Sequence: Synthetic oligonucleotide
accgcatgctagccagccagggg

SEQ ID NO: 326480 - DNA, 22 bp, Artificial Sequence
  Description of Artificial Sequence: Synthetic oligonucleotide
ccgcatgctagccagccagggg

SEQ ID NO: 326481 - DNA, 23 bp, Artificial Sequence
  Description of Artificial Sequence: Synthetic oligonucleotide
cgcatgctagccagccaggggga

SEQ ID NO: 326482 - DNA, 24 bp, Artificial Sequence
  Description of Artificial Sequence: Synthetic oligonucleotide
gcatgctagccagccagggggaga

SEQ ID NO: 326483 - DNA, 24 bp, Artificial Sequence
  Description of Artificial Sequence: Synthetic oligonucleotide
catgctagccagccagggggagac

SEQ ID NO: 326484 - DNA, 27 bp, Artificial Sequence
  Description of Artificial Sequence: Synthetic oligonucleotide
atgctagccagccagggggagaccatt

SEQ ID NO: 326485 - DNA, 26 bp, Artificial Sequence
  Description of Artificial Sequence: Synthetic oligonucleotide
tgctagccagccagggggagaccatt

SEQ ID NO: 326486 - DNA, 25 bp, Artificial Sequence
  Description of Artificial Sequence: Synthetic oligonucleotide
gctagccagccagggggagaccatt

SEQ ID NO: 326487 - DNA, 27 bp, Artificial Sequence
  Description of Artificial Sequence: Synthetic oligonucleotide
ctagccagccagggggagaccattcat

SEQ ID NO: 326488 - DNA, 27 bp, Artificial Sequence
  Description of Artificial Sequence: Synthetic oligonucleotide
tagccagccagggggagaccattcatg

SEQ ID NO: 326489 - DNA, 27 bp, Artificial Sequence
  Description of Artificial Sequence: Synthetic oligonucleotide
agccagccagggggagaccattcatgt

SEQ ID NO: 326490 - DNA, 26 bp, Artificial Sequence
  Description of Artificial Sequence: Synthetic oligonucleotide
gccagccagggggagaccattcatgt

SEQ ID NO: 326491 - DNA, 26 bp, Artificial Sequence
  Description of Artificial Sequence: Synthetic oligonucleotide
ccagccagggggagaccattcatgtg

SEQ ID NO: 326492 - DNA, 27 bp, Artificial Sequence
  Description of Artificial Sequence: Synthetic oligonucleotide
cagccagggggagaccattcatgtgca

SEQ ID NO: 326493 - DNA, 30 bp, Artificial Sequence
  Description of Artificial Sequence: Synthetic oligonucleotide
agccagggggagaccattcatgtgcattac

SEQ ID NO: 326494 - DNA, 29 bp, Artificial Sequence
  Description of Artificial Sequence: Synthetic oligonucleotide
gccagggggagaccattcatgtgcattac

SEQ ID NO: 326495 - DNA, 29 bp, Artificial Sequence
  Description of Artificial Sequence: Synthetic oligonucleotide
ccagggggagaccattcatgtgcattacc

SEQ ID NO: 326496 - DNA, 32 bp, Artificial Sequence
  Description of Artificial Sequence: Synthetic oligonucleotide
cagggggagaccattcatgtgcattacctaac

SEQ ID NO: 326497 - DNA, 34 bp, Artificial Sequence
  Description of Artificial Sequence: Synthetic oligonucleotide
agggggagaccattcatgtgcattacctaacaac

SEQ ID NO: 326498 - DNA, 33 bp, Artificial Sequence
  Description of Artificial Sequence: Synthetic oligonucleotide
gggggagaccattcatgtgcattacctaacaac

SEQ ID NO: 326499 - DNA, 34 bp, Artificial Sequence
  Description of Artificial Sequence: Synthetic oligonucleotide
ggggagaccattcatgtgcattacctaacaacag

SEQ ID NO: 326500 - DNA, 35 bp, Artificial Sequence
  Description of Artificial Sequence: Synthetic oligonucleotide
gggagaccattcatgtgcattacctaacaacagac

SEQ ID NO: 326501 - DNA, 36 bp, Artificial Sequence
  Description of Artificial Sequence: Synthetic oligonucleotide
ggagaccattcatgtgcattacctaacaacagacag

SEQ ID NO: 326502 - DNA, 36 bp, Artificial Sequence
  Description of Artificial Sequence: Synthetic oligonucleotide
gagaccattcatgtgcattacctaacaacagacagg

SEQ ID NO: 326503 - DNA, 36 bp, Artificial Sequence
  Description of Artificial Sequence: Synthetic oligonucleotide
agaccattcatgtgcattacctaacaacagacaggc

SEQ ID NO: 326504 - DNA, 35 bp, Artificial Sequence
  Description of Artificial Sequence: Synthetic oligonucleotide
gaccattcatgtgcattacctaacaacagacaggc

SEQ ID NO: 326505 - DNA, 35 bp, Artificial Sequence
  Description of Artificial Sequence: Synthetic oligonucleotide
accattcatgtgcattacctaacaacagacaggcg

SEQ ID NO: 326506 - DNA, 34 bp, Artificial Sequence
  Description of Artificial Sequence: Synthetic oligonucleotide
ccattcatgtgcattacctaacaacagacaggcg

SEQ ID NO: 326507 - DNA, 34 bp, Artificial Sequence
  Description of Artificial Sequence: Synthetic oligonucleotide
cattcatgtgcattacctaacaacagacaggcgc

SEQ ID NO: 326508 - DNA, 35 bp, Artificial Sequence
  Description of Artificial Sequence: Synthetic oligonucleotide
attcatgtgcattacctaacaacagacaggcgcac

SEQ ID NO: 326509 - DNA, 34 bp, Artificial Sequence
  Description of Artificial Sequence: Synthetic oligonucleotide
ttcatgtgcattacctaacaacagacaggcgcac

SEQ ID NO: 326510 - DNA, 33 bp, Artificial Sequence
  Description of Artificial Sequence: Synthetic oligonucleotide
tcatgtgcattacctaacaacagacaggcgcac

SEQ ID NO: 326511 - DNA, 32 bp, Artificial Sequence
  Description of Artificial Sequence: Synthetic oligonucleotide
catgtgcattacctaacaacagacaggcgcac

SEQ ID NO: 326512 - DNA, 35 bp, Artificial Sequence
  Description of Artificial Sequence: Synthetic oligonucleotide
atgtgcattacctaacaacagacaggcgcactatc

SEQ ID NO: 326513 - DNA, 34 bp, Artificial Sequence
  Description of Artificial Sequence: Synthetic oligonucleotide
tgtgcattacctaacaacagacaggcgcactatc

SEQ ID NO: 326514 - DNA, 33 bp, Artificial Sequence
  Description of Artificial Sequence: Synthetic oligonucleotide
gtgcattacctaacaacagacaggcgcactatc

SEQ ID NO: 326515 - DNA, 33 bp, Artificial Sequence
  Description of Artificial Sequence: Synthetic oligonucleotide
tgcattacctaacaacagacaggcgcactatcc

SEQ ID NO: 326516 - DNA, 32 bp, Artificial Sequence
  Description of Artificial Sequence: Synthetic oligonucleotide
gcattacctaacaacagacaggcgcactatcc

SEQ ID NO: 326517 - DNA, 33 bp, Artificial Sequence
  Description of Artificial Sequence: Synthetic oligonucleotide
cattacctaacaacagacaggcgcactatcctc

SEQ ID NO: 326518 - DNA, 35 bp, Artificial Sequence
  Description of Artificial Sequence: Synthetic oligonucleotide
attacctaacaacagacaggcgcactatcctcaag

SEQ ID NO: 326519 - DNA, 34 bp, Artificial Sequence
  Description of Artificial Sequence: Synthetic oligonucleotide
ttacctaacaacagacaggcgcactatcctcaag

SEQ ID NO: 326520 - DNA, 33 bp, Artificial Sequence
  Description of Artificial Sequence: Synthetic oligonucleotide
tacctaacaacagacaggcgcactatcctcaag

SEQ ID NO: 326521 - DNA, 32 bp, Artificial Sequence
  Description of Artificial Sequence: Synthetic oligonucleotide
acctaacaacagacaggcgcactatcctcaag

SEQ ID NO: 326522 - DNA, 31 bp, Artificial Sequence
  Description of Artificial Sequence: Synthetic oligonucleotide
cctaacaacagacaggcgcactatcctcaag

SEQ ID NO: 326523 - DNA, 31 bp, Artificial Sequence
  Description of Artificial Sequence: Synthetic oligonucleotide
ctaacaacagacaggcgcactatcctcaagg

SEQ ID NO: 326524 - DNA, 32 bp, Artificial Sequence
  Description of Artificial Sequence: Synthetic oligonucleotide
taacaacagacaggcgcactatcctcaaggtg

SEQ ID NO: 326525 - DNA, 31 bp, Artificial Sequence
  Description of Artificial Sequence: Synthetic oligonucleotide
aacaacagacaggcgcactatcctcaaggtg

SEQ ID NO: 326526 - DNA, 30 bp, Artificial Sequence
  Description of Artificial Sequence: Synthetic oligonucleotide
acaacagacaggcgcactatcctcaaggtg

SEQ ID NO: 326527 - DNA, 29 bp, Artificial Sequence
  Description of Artificial Sequence: Synthetic oligonucleotide
caacagacaggcgcactatcctcaaggtg

SEQ ID NO: 326528 - DNA, 29 bp, Artificial Sequence
  Description of Artificial Sequence: Synthetic oligonucleotide
aacagacaggcgcactatcctcaaggtgg

SEQ ID NO: 326529 - DNA, 28 bp, Artificial Sequence
  Description of Artificial Sequence: Synthetic oligonucleotide
acagacaggcgcactatcctcaaggtgg

SEQ ID NO: 326530 - DNA, 27 bp, Artificial Sequence
  Description of Artificial Sequence: Synthetic oligonucleotide
cagacaggcgcactatcctcaaggtgg

SEQ ID NO: 326531 - DNA, 28 bp, Artificial Sequence
  Description of Artificial Sequence: Synthetic oligonucleotide
agacaggcgcactatcctcaaggtggtc

SEQ ID NO: 326532 - DNA, 27 bp, Artificial Sequence
  Description of Artificial Sequence: Synthetic oligonucleotide
gacaggcgcactatcctcaaggtggtc

SEQ ID NO: 326533 - DNA, 27 bp, Artificial Sequence
  Description of Artificial Sequence: Synthetic oligonucleotide
acaggcgcactatcctcaaggtggtcg

SEQ ID NO: 326534 - DNA, 27 bp, Artificial Sequence
  Description of Artificial Sequence: Synthetic oligonucleotide
caggcgcactatcctcaaggtggtcga

SEQ ID NO: 326535 - DNA, 28 bp, Artificial Sequence
  Description of Artificial Sequence: Synthetic oligonucleotide
aggcgcactatcctcaaggtggtcgaac

SEQ ID NO: 326536 - DNA, 27 bp, Artificial Sequence
  Description of Artificial Sequence: Synthetic oligonucleotide
ggcgcactatcctcaaggtggtcgaac

SEQ ID NO: 326537 - DNA, 27 bp, Artificial Sequence
  Description of Artificial Sequence: Synthetic oligonucleotide
gcgcactatcctcaaggtggtcgaacc

SEQ ID NO: 326538 - DNA, 27 bp, Artificial Sequence
  Description of Artificial Sequence: Synthetic oligonucleotide
cgcactatcctcaaggtggtcgaaccg

SEQ ID NO: 326539 - DNA, 27 bp, Artificial Sequence
  Description of Artificial Sequence: Synthetic oligonucleotide
gcactatcctcaaggtggtcgaaccgg

SEQ ID NO: 326540 - DNA, 27 bp, Artificial Sequence
  Description of Artificial Sequence: Synthetic oligonucleotide
cactatcctcaaggtggtcgaaccggg

SEQ ID NO: 326541 - DNA, 27 bp, Artificial Sequence
  Description of Artificial Sequence: Synthetic oligonucleotide
actatcctcaaggtggtcgaaccgggg

SEQ ID NO: 326542 - DNA, 26 bp, Artificial Sequence
  Description of Artificial Sequence: Synthetic oligonucleotide
ctatcctcaaggtggtcgaaccgggg

SEQ ID NO: 326543 - DNA, 27 bp, Artificial Sequence
  Description of Artificial Sequence: Synthetic oligonucleotide
tatcctcaaggtggtcgaaccggggca

SEQ ID NO: 326544 - DNA, 26 bp, Artificial Sequence
  Description of Artificial Sequence: Synthetic oligonucleotide
atcctcaaggtggtcgaaccggggca

SEQ ID NO: 326545 - DNA, 25 bp, Artificial Sequence
  Description of Artificial Sequence: Synthetic oligonucleotide
tcctcaaggtggtcgaaccggggca

SEQ ID NO: 326546 - DNA, 24 bp, Artificial Sequence
  Description of Artificial Sequence: Synthetic oligonucleotide
cctcaaggtggtcgaaccggggca

SEQ ID NO: 326547 - DNA, 24 bp, Artificial Sequence
  Description of Artificial Sequence: Synthetic oligonucleotide
ctcaaggtggtcgaaccggggcag

SEQ ID NO: 326548 - DNA, 25 bp, Artificial Sequence
  Description of Artificial Sequence: Synthetic oligonucleotide
tcaaggtggtcgaaccggggcagca

SEQ ID NO: 326549 - DNA, 24 bp, Artificial Sequence
  Description of Artificial Sequence: Synthetic oligonucleotide
caaggtggtcgaaccggggcagca

SEQ ID NO: 326550 - DNA, 24 bp, Artificial Sequence
  Description of Artificial Sequence: Synthetic oligonucleotide
aaggtggtcgaaccggggcagcag

SEQ ID NO: 326551 - DNA, 23 bp, Artificial Sequence
  Description of Artificial Sequence: Synthetic oligonucleotide
aggtggtcgaaccggggcagcag

SEQ ID NO: 326552 - DNA, 22 bp, Artificial Sequence
  Description of Artificial Sequence: Synthetic oligonucleotide
ggtggtcgaaccggggcagcag

SEQ ID NO: 326553 - DNA, 23 bp, Artificial Sequence
  Description of Artificial Sequence: Synthetic oligonucleotide
gtggtcgaaccggggcagcagga

SEQ ID NO: 326554 - DNA, 23 bp, Artificial Sequence
  Description of Artificial Sequence: Synthetic oligonucleotide
tggtcgaaccggggcagcaggag

SEQ ID NO: 326555 - DNA, 22 bp, Artificial Sequence
  Description of Artificial Sequence: Synthetic oligonucleotide
ggtcgaaccggggcagcaggag

SEQ ID NO: 326556 - DNA, 23 bp, Artificial Sequence
  Description of Artificial Sequence: Synthetic oligonucleotide
gtcgaaccggggcagcaggagct

SEQ ID NO: 326557 - DNA, 24 bp, Artificial Sequence
  Description of Artificial Sequence: Synthetic oligonucleotide
tcgaaccggggcagcaggagctca

SEQ ID NO: 326558 - DNA, 23 bp, Artificial Sequence
  Description of Artificial Sequence: Synthetic oligonucleotide
cgaaccggggcagcaggagctca

SEQ ID NO: 326559 - DNA, 23 bp, Artificial Sequence
  Description of Artificial Sequence: Synthetic oligonucleotide
gaaccggggcagcaggagctcag

SEQ ID NO: 326560 - DNA, 25 bp, Artificial Sequence
  Description of Artificial Sequence: Synthetic oligonucleotide
aaccggggcagcaggagctcagctt

SEQ ID NO: 326561 - DNA, 24 bp, Artificial Sequence
  Description of Artificial Sequence: Synthetic oligonucleotide
accggggcagcaggagctcagctt

SEQ ID NO: 326562 - DNA, 23 bp, Artificial Sequence
  Description of Artificial Sequence: Synthetic oligonucleotide
ccggggcagcaggagctcagctt

SEQ ID NO: 326563 - DNA, 23 bp, Artificial Sequence
  Description of Artificial Sequence: Synthetic oligonucleotide
cggggcagcaggagctcagcttc

SEQ ID NO: 326564 - DNA, 23 bp, Artificial Sequence
  Description of Artificial Sequence: Synthetic oligonucleotide
ggggcagcaggagctcagcttcg

SEQ ID NO: 326565 - DNA, 23 bp, Artificial Sequence
  Description of Artificial Sequence: Synthetic oligonucleotide
gggcagcaggagctcagcttcgc

SEQ ID NO: 326566 - DNA, 25 bp, Artificial Sequence
  Description of Artificial Sequence: Synthetic oligonucleotide
ggcagcaggagctcagcttcgcgtt

SEQ ID NO: 326567 - DNA, 27 bp, Artificial Sequence
  Description of Artificial Sequence: Synthetic oligonucleotide
gcagcaggagctcagcttcgcgttcaa

SEQ ID NO: 326568 - DNA, 27 bp, Artificial Sequence
  Description of Artificial Sequence: Synthetic oligonucleotide
cagcaggagctcagcttcgcgttcaac

SEQ ID NO: 326569 - DNA, 29 bp, Artificial Sequence
  Description of Artificial Sequence: Synthetic oligonucleotide
agcaggagctcagcttcgcgttcaacatc

SEQ ID NO: 326570 - DNA, 28 bp, Artificial Sequence
  Description of Artificial Sequence: Synthetic oligonucleotide
gcaggagctcagcttcgcgttcaacatc

SEQ ID NO: 326571 - DNA, 30 bp, Artificial Sequence
  Description of Artificial Sequence: Synthetic oligonucleotide
caggagctcagcttcgcgttcaacatcttg

SEQ ID NO: 326572 - DNA, 30 bp, Artificial Sequence
  Description of Artificial Sequence: Synthetic oligonucleotide
aggagctcagcttcgcgttcaacatcttgg

SEQ ID NO: 326573 - DNA, 29 bp, Artificial Sequence
  Description of Artificial Sequence: Synthetic oligonucleotide
ggagctcagcttcgcgttcaacatcttgg

SEQ ID NO: 326574 - DNA, 30 bp, Artificial Sequence
  Description of Artificial Sequence: Synthetic oligonucleotide
gagctcagcttcgcgttcaacatcttggag

SEQ ID NO: 326575 - DNA, 32 bp, Artificial Sequence
  Description of Artificial Sequence: Synthetic oligonucleotide
agctcagcttcgcgttcaacatcttggagatc

SEQ ID NO: 326576 - DNA, 31 bp, Artificial Sequence
  Description of Artificial Sequence: Synthetic oligonucleotide
gctcagcttcgcgttcaacatcttggagatc

SEQ ID NO: 326577 - DNA, 31 bp, Artificial Sequence
  Description of Artificial Sequence: Synthetic oligonucleotide
ctcagcttcgcgttcaacatcttggagatcc

SEQ ID NO: 326578 - DNA, 32 bp, Artificial Sequence
  Description of Artificial Sequence: Synthetic oligonucleotide
tcagcttcgcgttcaacatcttggagatcctg

SEQ ID NO: 326579 - DNA, 31 bp, Artificial Sequence
  Description of Artificial Sequence: Synthetic oligonucleotide
cagcttcgcgttcaacatcttggagatcctg

SEQ ID NO: 326580 - DNA, 31 bp, Artificial Sequence
  Description of Artificial Sequence: Synthetic oligonucleotide
agcttcgcgttcaacatcttggagatcctgc

SEQ ID NO: 326581 - DNA, 30 bp, Artificial Sequence
  Description of Artificial Sequence: Synthetic oligonucleotide
gcttcgcgttcaacatcttggagatcctgc

SEQ ID NO: 326582 - DNA, 30 bp, Artificial Sequence
  Description of Artificial Sequence: Synthetic oligonucleotide
cttcgcgttcaacatcttggagatcctgcc

SEQ ID NO: 326583 - DNA, 30 bp, Artificial Sequence
  Description of Artificial Sequence: Synthetic oligonucleotide
ttcgcgttcaacatcttggagatcctgccc

SEQ ID NO: 326584 - DNA, 29 bp, Artificial Sequence
  Description of Artificial Sequence: Synthetic oligonucleotide
tcgcgttcaacatcttggagatcctgccc

SEQ ID NO: 326585 - DNA, 28 bp, Artificial Sequence
  Description of Artificial Sequence: Synthetic oligonucleotide
cgcgttcaacatcttggagatcctgccc

SEQ ID NO: 326586 - DNA, 30 bp, Artificial Sequence
  Description of Artificial Sequence: Synthetic oligonucleotide
gcgttcaacatcttggagatcctgcccttc

SEQ ID NO: 326587 - DNA, 30 bp, Artificial Sequence
  Description of Artificial Sequence: Synthetic oligonucleotide
cgttcaacatcttggagatcctgcccttcc

SEQ ID NO: 326588 - DNA, 30 bp, Artificial Sequence
  Description of Artificial Sequence: Synthetic oligonucleotide
gttcaacatcttggagatcctgcccttccg

SEQ ID NO: 326589 - DNA, 30 bp, Artificial Sequence
  Description of Artificial Sequence: Synthetic oligonucleotide
ttcaacatcttggagatcctgcccttccgg

SEQ ID NO: 326590 - DNA, 29 bp, Artificial Sequence
  Description of Artificial Sequence: Synthetic oligonucleotide
tcaacatcttggagatcctgcccttccgg

SEQ ID NO: 326591 - DNA, 28 bp, Artificial Sequence
  Description of Artificial Sequence: Synthetic oligonucleotide
caacatcttggagatcctgcccttccgg

SEQ ID NO: 326592 - DNA, 28 bp, Artificial Sequence
  Description of Artificial Sequence: Synthetic oligonucleotide
aacatcttggagatcctgcccttccggc

SEQ ID NO: 326593 - DNA, 27 bp, Artificial Sequence
  Description of Artificial Sequence: Synthetic oligonucleotide
acatcttggagatcctgcccttccggc

SEQ ID NO: 326594 - DNA, 26 bp, Artificial Sequence
  Description of Artificial Sequence: Synthetic oligonucleotide
catcttggagatcctgcccttccggc

SEQ ID NO: 326595 - DNA, 26 bp, Artificial Sequence
  Description of Artificial Sequence: Synthetic oligonucleotide
atcttggagatcctgcccttccggcg

SEQ ID NO: 326596 - DNA, 25 bp, Artificial Sequence
  Description of Artificial Sequence: Synthetic oligonucleotide
tcttggagatcctgcccttccggcg

SEQ ID NO: 326597 - DNA, 24 bp, Artificial Sequence
  Description of Artificial Sequence: Synthetic oligonucleotide
cttggagatcctgcccttccggcg

SEQ ID NO: 326598 - DNA, 24 bp, Artificial Sequence
  Description of Artificial Sequence: Synthetic oligonucleotide
ttggagatcctgcccttccggcgc

SEQ ID NO: 326599 - DNA, 23 bp, Artificial Sequence
  Description of Artificial Sequence: Synthetic oligonucleotide
tggagatcctgcccttccggcgc

SEQ ID NO: 326600 - DNA, 22 bp, Artificial Sequence
  Description of Artificial Sequence: Synthetic oligonucleotide
ggagatcctgcccttccggcgc

SEQ ID NO: 326601 - DNA, 22 bp, Artificial Sequence
  Description of Artificial Sequence: Synthetic oligonucleotide
gagatcctgcccttccggcgcg

SEQ ID NO: 326602 - DNA, 22 bp, Artificial Sequence
  Description of Artificial Sequence: Synthetic oligonucleotide
agatcctgcccttccggcgcgc

SEQ ID NO: 326603 - DNA, 21 bp, Artificial Sequence
  Description of Artificial Sequence: Synthetic oligonucleotide
gatcctgcccttccggcgcgc

SEQ ID NO: 326604 - DNA, 21 bp, Artificial Sequence
  Description of Artificial Sequence: Synthetic oligonucleotide
atcctgcccttccggcgcgcg

SEQ ID NO: 326605 - DNA, 20 bp, Artificial Sequence
  Description of Artificial Sequence: Synthetic oligonucleotide
tcctgcccttccggcgcgcg

SEQ ID NO: 326606 - DNA, 20 bp, Artificial Sequence
  Description of Artificial Sequence: Synthetic oligonucleotide
cctgcccttccggcgcgcgt

SEQ ID NO: 326607 - DNA, 20 bp, Artificial Sequence
  Description of Artificial Sequence: Synthetic oligonucleotide
ctgcccttccggcgcgcggt

SEQ ID NO: 326608 - DNA, 20 bp, Artificial Sequence
  Description of Artificial Sequence: Synthetic oligonucleotide
tgcccttccggcgcgcggct

SEQ ID NO: 326609 - DNA, 20 bp, Artificial Sequence
  Description of Artificial Sequence: Synthetic oligonucleotide
gcccttccggcgcgcggctt

SEQ ID NO: 326610 - DNA, 20 bp, Artificial Sequence
  Description of Artificial Sequence: Synthetic oligonucleotide
cccttccggcgcgcggctct

SEQ ID NO: 326611 - DNA, 20 bp, Artificial Sequence
  Description of Artificial Sequence: Synthetic oligonucleotide
ccttccggcgcgcggctcct

SEQ ID NO: 326612 - DNA, 21 bp, Artificial Sequence
  Description of Artificial Sequence: Synthetic oligonucleotide
cttccggcgcgcggctcccat

SEQ ID NO: 326613 - DNA, 21 bp, Artificial Sequence
  Description of Artificial Sequence: Synthetic oligonucleotide
ttccggcgcgcggctcccatc

SEQ ID NO: 326614 - DNA, 20 bp, Artificial Sequence
  Description of Artificial Sequence: Synthetic oligonucleotide
tccggcgcgcggctcccatc

SEQ ID NO: 326615 - DNA, 20 bp, Artificial Sequence
  Description of Artificial Sequence: Synthetic oligonucleotide
ccggcgcgcggctcccatct

SEQ ID NO: 326616 - DNA, 20 bp, Artificial Sequence
  Description of Artificial Sequence: Synthetic oligonucleotide
cggcgcgcggctcccatcca

SEQ ID NO: 326617 - DNA, 21 bp, Artificial Sequence
  Description of Artificial Sequence: Synthetic oligonucleotide
ggcgcgcggctcccatccaga

SEQ ID NO: 326618 - DNA, 21 bp, Artificial Sequence
  Description of Artificial Sequence: Synthetic oligonucleotide
gcgcgcggctcccatccagag

SEQ ID NO: 326619 - DNA, 23 bp, Artificial Sequence
  Description of Artificial Sequence: Synthetic oligonucleotide
cgcgcggctcccatccagagcat

SEQ ID NO: 326620 - DNA, 24 bp, Artificial Sequence
  Description of Artificial Sequence: Synthetic oligonucleotide
gcgcggctcccatccagagcatgt

SEQ ID NO: 326621 - DNA, 24 bp, Artificial Sequence
  Description of Artificial Sequence: Synthetic oligonucleotide
cgcggctcccatccagagcatgtc

SEQ ID NO: 326622 - DNA, 24 bp, Artificial Sequence
  Description of Artificial Sequence: Synthetic oligonucleotide
gcggctcccatccagagcatgtcg

SEQ ID NO: 326623 - DNA, 25 bp, Artificial Sequence
  Description of Artificial Sequence: Synthetic oligonucleotide
cggctcccatccagagcatgtcgct

SEQ ID NO: 326624 - DNA, 25 bp, Artificial Sequence
  Description of Artificial Sequence: Synthetic oligonucleotide
ggctcccatccagagcatgtcgctc

SEQ ID NO: 326625 - DNA, 27 bp, Artificial Sequence
  Description of Artificial Sequence: Synthetic oligonucleotide
gctcccatccagagcatgtcgctcgat

SEQ ID NO: 326626 - DNA, 27 bp, Artificial Sequence
  Description of Artificial Sequence: Synthetic oligonucleotide
ctcccatccagagcatgtcgctcgatg

SEQ ID NO: 326627 - DNA, 27 bp, Artificial Sequence
  Description of Artificial Sequence: Synthetic oligonucleotide
tcccatccagagcatgtcgctcgatgc

SEQ ID NO: 326628 - DNA, 27 bp, Artificial Sequence
  Description of Artificial Sequence: Synthetic oligonucleotide
cccatccagagcatgtcgctcgatgct

SEQ ID NO: 326629 - DNA, 27 bp, Artificial Sequence
  Description of Artificial Sequence: Synthetic oligonucleotide
ccatccagagcatgtcgctcgatgctg

SEQ ID NO: 326630 - DNA, 28 bp, Artificial Sequence
  Description of Artificial Sequence: Synthetic oligonucleotide
catccagagcatgtcgctcgatgctgag

SEQ ID NO: 326631 - DNA, 28 bp, Artificial Sequence
  Description of Artificial Sequence: Synthetic oligonucleotide
atccagagcatgtcgctcgatgctgagg

SEQ ID NO: 326632 - DNA, 27 bp, Artificial Sequence
  Description of Artificial Sequence: Synthetic oligonucleotide
tccagagcatgtcgctcgatgctgagg

SEQ ID NO: 326633 - DNA, 26 bp, Artificial Sequence
  Description of Artificial Sequence: Synthetic oligonucleotide
ccagagcatgtcgctcgatgctgagg

SEQ ID NO: 326634 - DNA, 26 bp, Artificial Sequence
  Description of Artificial Sequence: Synthetic oligonucleotide
cagagcatgtcgctcgatgctgaggg

SEQ ID NO: 326635 - DNA, 27 bp, Artificial Sequence
  Description of Artificial Sequence: Synthetic oligonucleotide
agagcatgtcgctcgatgctgagggga

SEQ ID NO: 326636 - DNA, 26 bp, Artificial Sequence
  Description of Artificial Sequence: Synthetic oligonucleotide
gagcatgtcgctcgatgctgagggga

SEQ ID NO: 326637 - DNA, 26 bp, Artificial Sequence
  Description of Artificial Sequence: Synthetic oligonucleotide
agcatgtcgctcgatgctgaggggag

SEQ ID NO: 326638 - DNA, 25 bp, Artificial Sequence
  Description of Artificial Sequence: Synthetic oligonucleotide
gcatgtcgctcgatgctgaggggag

SEQ ID NO: 326639 - DNA, 27 bp, Artificial Sequence
  Description of Artificial Sequence: Synthetic oligonucleotide
catgtcgctcgatgctgaggggaggaa

SEQ ID NO: 326640 - DNA, 27 bp, Artificial Sequence
  Description of Artificial Sequence: Synthetic oligonucleotide
atgtcgctcgatgctgaggggaggaag

SEQ ID NO: 326641 - DNA, 26 bp, Artificial Sequence
  Description of Artificial Sequence: Synthetic oligonucleotide
tgtcgctcgatgctgaggggaggaag

SEQ ID NO: 326642 - DNA, 25 bp, Artificial Sequence
  Description of Artificial Sequence: Synthetic oligonucleotide
gtcgctcgatgctgaggggaggaag

SEQ ID NO: 326643 - DNA, 26 bp, Artificial Sequence
  Description of Artificial Sequence: Synthetic oligonucleotide
tcgctcgatgctgaggggaggaagca

SEQ ID NO: 326644 - DNA, 25 bp, Artificial Sequence
  Description of Artificial Sequence: Synthetic oligonucleotide
cgctcgatgctgaggggaggaagca

SEQ ID NO: 326645 - DNA, 27 bp, Artificial Sequence
  Description of Artificial Sequence: Synthetic oligonucleotide
gctcgatgctgaggggaggaagcagta

SEQ ID NO: 326646 - DNA, 28 bp, Artificial Sequence
  Description of Artificial Sequence: Synthetic oligonucleotide
ctcgatgctgaggggaggaagcagtatg

SEQ ID NO: 326647 - DNA, 29 bp, Artificial Sequence
  Description of Artificial Sequence: Synthetic oligonucleotide
tcgatgctgaggggaggaagcagtatgtg

SEQ ID NO: 326648 - DNA, 28 bp, Artificial Sequence
  Description of Artificial Sequence: Synthetic oligonucleotide
cgatgctgaggggaggaagcagtatgtg

SEQ ID NO: 326649 - DNA, 29 bp, Artificial Sequence
  Description of Artificial Sequence: Synthetic oligonucleotide
gatgctgaggggaggaagcagtatgtgag

SEQ ID NO: 326650 - DNA, 29 bp, Artificial Sequence
  Description of Artificial Sequence: Synthetic oligonucleotide
atgctgaggggaggaagcagtatgtgagg

SEQ ID NO: 326651 - DNA, 28 bp, Artificial Sequence
  Description of Artificial Sequence: Synthetic oligonucleotide
tgctgaggggaggaagcagtatgtgagg

SEQ ID NO: 326652 - DNA, 27 bp, Artificial Sequence
  Description of Artificial Sequence: Synthetic oligonucleotide
gctgaggggaggaagcagtatgtgagg

SEQ ID NO: 326653 - DNA, 28 bp, Artificial Sequence
  Description of Artificial Sequence: Synthetic oligonucleotide
ctgaggggaggaagcagtatgtgaggtc

SEQ ID NO: 326654 - DNA, 28 bp, Artificial Sequence
  Description of Artificial Sequence: Synthetic oligonucleotide
tgaggggaggaagcagtatgtgaggtcc

SEQ ID NO: 326655 - DNA, 27 bp, Artificial Sequence
  Description of Artificial Sequence: Synthetic oligonucleotide
gaggggaggaagcagtatgtgaggtcc

SEQ ID NO: 326656 - DNA, 27 bp, Artificial Sequence
  Description of Artificial Sequence: Synthetic oligonucleotide
aggggaggaagcagtatgtgaggtccc

SEQ ID NO: 326657 - DNA, 27 bp, Artificial Sequence
  Description of Artificial Sequence: Synthetic oligonucleotide
ggggaggaagcagtatgtgaggtccca

SEQ ID NO: 326658 - DNA, 27 bp, Artificial Sequence
  Description of Artificial Sequence: Synthetic oligonucleotide
gggaggaagcagtatgtgaggtcccag

SEQ ID NO: 326659 - DNA, 28 bp, Artificial Sequence
  Description of Artificial Sequence: Synthetic oligonucleotide
ggaggaagcagtatgtgaggtcccagtg

SEQ ID NO: 326660 - DNA, 28 bp, Artificial Sequence
  Description of Artificial Sequence: Synthetic oligonucleotide
gaggaagcagtatgtgaggtcccagtgg

SEQ ID NO: 326661 - DNA, 28 bp, Artificial Sequence
  Description of Artificial Sequence: Synthetic oligonucleotide
aggaagcagtatgtgaggtcccagtggc

SEQ ID NO: 326662 - DNA, 27 bp, Artificial Sequence
  Description of Artificial Sequence: Synthetic oligonucleotide
ggaagcagtatgtgaggtcccagtggc

SEQ ID NO: 326663 - DNA, 28 bp, Artificial Sequence
  Description of Artificial Sequence: Synthetic oligonucleotide
gaagcagtatgtgaggtcccagtggcag

SEQ ID NO: 326664 - DNA, 28 bp, Artificial Sequence
  Description of Artificial Sequence: Synthetic oligonucleotide
aagcagtatgtgaggtcccagtggcagg

SEQ ID NO: 326665 - DNA, 27 bp, Artificial Sequence
  Description of Artificial Sequence: Synthetic oligonucleotide
agcagtatgtgaggtcccagtggcagg

SEQ ID NO: 326666 - DNA, 27 bp, Artificial Sequence
  Description of Artificial Sequence: Synthetic oligonucleotide
gcagtatgtgaggtcccagtggcaggt

SEQ ID NO: 326667 - DNA, 27 bp, Artificial Sequence
  Description of Artificial Sequence: Synthetic oligonucleotide
cagtatgtgaggtcccagtggcaggtg

SEQ ID NO: 326668 - DNA, 28 bp, Artificial Sequence
  Description of Artificial Sequence: Synthetic oligonucleotide
agtatgtgaggtcccagtggcaggtgag

SEQ ID NO: 326669 - DNA, 27 bp, Artificial Sequence
  Description of Artificial Sequence: Synthetic oligonucleotide
gtatgtgaggtcccagtggcaggtgag

SEQ ID NO: 326670 - DNA, 27 bp, Artificial Sequence
  Description of Artificial Sequence: Synthetic oligonucleotide
tatgtgaggtcccagtggcaggtgagc

SEQ ID NO: 326671 - DNA, 26 bp, Artificial Sequence
  Description of Artificial Sequence: Synthetic oligonucleotide
atgtgaggtcccagtggcaggtgagc

SEQ ID NO: 326672 - DNA, 25 bp, Artificial Sequence
  Description of Artificial Sequence: Synthetic oligonucleotide
tgtgaggtcccagtggcaggtgagc

SEQ ID NO: 326673 - DNA, 24 bp, Artificial Sequence
  Description of Artificial Sequence: Synthetic oligonucleotide
gtgaggtcccagtggcaggtgagc

SEQ ID NO: 326674 - DNA, 25 bp, Artificial Sequence
  Description of Artificial Sequence: Synthetic oligonucleotide
tgaggtcccagtggcaggtgagcct

SEQ ID NO: 326675 - DNA, 24 bp, Artificial Sequence
  Description of Artificial Sequence: Synthetic oligonucleotide
gaggtcccagtggcaggtgagcct

SEQ ID NO: 326676 - DNA, 24 bp, Artificial Sequence
  Description of Artificial Sequence: Synthetic oligonucleotide
aggtcccagtggcaggtgagcctg

SEQ ID NO: 326677 - DNA, 23 bp, Artificial Sequence
  Description of Artificial Sequence: Synthetic oligonucleotide
ggtcccagtggcaggtgagcctg

SEQ ID NO: 326678 - DNA, 24 bp, Artificial Sequence
  Description of Artificial Sequence: Synthetic oligonucleotide
gtcccagtggcaggtgagcctggt

SEQ ID NO: 326679 - DNA, 24 bp, Artificial Sequence
  Description of Artificial Sequence: Synthetic oligonucleotide
tcccagtggcaggtgagcctggtg

SEQ ID NO: 326680 - DNA, 23 bp, Artificial Sequence
  Description of Artificial Sequence: Synthetic oligonucleotide
cccagtggcaggtgagcctggtg

SEQ ID NO: 326681 - DNA, 23 bp, Artificial Sequence
  Description of Artificial Sequence: Synthetic oligonucleotide
ccagtggcaggtgagcctggtgc

SEQ ID NO: 326682 - DNA, 23 bp, Artificial Sequence
  Description of Artificial Sequence: Synthetic oligonucleotide
cagtggcaggtgagcctggtgcc

SEQ ID NO: 326683 - DNA, 23 bp, Artificial Sequence
  Description of Artificial Sequence: Synthetic oligonucleotide
agtggcaggtgagcctggtgccc

SEQ ID NO: 326684 - DNA, 22 bp, Artificial Sequence
  Description of Artificial Sequence: Synthetic oligonucleotide
gtggcaggtgagcctggtgccc

SEQ ID NO: 326685 - DNA, 23 bp, Artificial Sequence
  Description of Artificial Sequence: Synthetic oligonucleotide
tggcaggtgagcctggtgcccct

SEQ ID NO: 326686 - DNA, 22 bp, Artificial Sequence
  Description of Artificial Sequence: Synthetic oligonucleotide
ggcaggtgagcctggtgcccct

SEQ ID NO: 326687 - DNA, 22 bp, Artificial Sequence
  Description of Artificial Sequence: Synthetic oligonucleotide
gcaggtgagcctggtgcccctc

SEQ ID NO: 326688 - DNA, 23 bp, Artificial Sequence
  Description of Artificial Sequence: Synthetic oligonucleotide
caggtgagcctggtgcccctcga

SEQ ID NO: 326689 - DNA, 23 bp, Artificial Sequence
  Description of Artificial Sequence: Synthetic oligonucleotide
aggtgagcctggtgcccctcgac

SEQ ID NO: 326690 - DNA, 22 bp, Artificial Sequence
  Description of Artificial Sequence: Synthetic oligonucleotide
ggtgagcctggtgcccctcgac

SEQ ID NO: 326691 - DNA, 23 bp, Artificial Sequence
  Description of Artificial Sequence: Synthetic oligonucleotide
gtgagcctggtgcccctcgacct

SEQ ID NO: 326692 - DNA, 24 bp, Artificial Sequence
  Description of Artificial Sequence: Synthetic oligonucleotide
tgagcctggtgcccctcgacctgt

SEQ ID NO: 326693 - DNA, 23 bp, Artificial Sequence
  Description of Artificial Sequence: Synthetic oligonucleotide
gagcctggtgcccctcgacctgt

SEQ ID NO: 326694 - DNA, 24 bp, Artificial Sequence
  Description of Artificial Sequence: Synthetic oligonucleotide
agcctggtgcccctcgacctgtgt

SEQ ID NO: 326695 - DNA, 23 bp, Artificial Sequence
  Description of Artificial Sequence: Synthetic oligonucleotide
gcctggtgcccctcgacctgtgt

SEQ ID NO: 326696 - DNA, 24 bp, Artificial Sequence
  Description of Artificial Sequence: Synthetic oligonucleotide
cctggtgcccctcgacctgtgtca

SEQ ID NO: 326697 - DNA, 24 bp, Artificial Sequence
  Description of Artificial Sequence: Synthetic oligonucleotide
ctggtgcccctcgacctgtgtcag

SEQ ID NO: 326698 - DNA, 25 bp, Artificial Sequence
  Description of Artificial Sequence: Synthetic oligonucleotide
tggtgcccctcgacctgtgtcaggt

SEQ ID NO: 326699 - DNA, 24 bp, Artificial Sequence
  Description of Artificial Sequence: Synthetic oligonucleotide
ggtgcccctcgacctgtgtcaggt

SEQ ID NO: 326700 - DNA, 27 bp, Artificial Sequence
  Description of Artificial Sequence: Synthetic oligonucleotide
gtgcccctcgacctgtgtcaggtctat

SEQ ID NO: 326701 - DNA, 27 bp, Artificial Sequence
  Description of Artificial Sequence: Synthetic oligonucleotide
tgcccctcgacctgtgtcaggtctatg

SEQ ID NO: 326702 - DNA, 26 bp, Artificial Sequence
  Description of Artificial Sequence: Synthetic oligonucleotide
gcccctcgacctgtgtcaggtctatg

SEQ ID NO: 326703 - DNA, 26 bp, Artificial Sequence
  Description of Artificial Sequence: Synthetic oligonucleotide
cccctcgacctgtgtcaggtctatgc

SEQ ID NO: 326704 - DNA, 26 bp, Artificial Sequence
  Description of Artificial Sequence: Synthetic oligonucleotide
ccctcgacctgtgtcaggtctatgcc

SEQ ID NO: 326705 - DNA, 26 bp, Artificial Sequence
  Description of Artificial Sequence: Synthetic oligonucleotide
cctcgacctgtgtcaggtctatgccg

SEQ ID NO: 326706 - DNA, 26 bp, Artificial Sequence
  Description of Artificial Sequence: Synthetic oligonucleotide
ctcgacctgtgtcaggtctatgccgg

SEQ ID NO: 326707 - DNA, 26 bp, Artificial Sequence
  Description of Artificial Sequence: Synthetic oligonucleotide
tcgacctgtgtcaggtctatgccggg

SEQ ID NO: 326708 - DNA, 25 bp, Artificial Sequence
  Description of Artificial Sequence: Synthetic oligonucleotide
cgacctgtgtcaggtctatgccggg

SEQ ID NO: 326709 - DNA, 25 bp, Artificial Sequence
  Description of Artificial Sequence: Synthetic oligonucleotide
gacctgtgtcaggtctatgccgggg

SEQ ID NO: 326710 - DNA, 25 bp, Artificial Sequence
  Description of Artificial Sequence: Synthetic oligonucleotide
acctgtgtcaggtctatgccggggg

SEQ ID NO: 326711 - DNA, 24 bp, Artificial Sequence
  Description of Artificial Sequence: Synthetic oligonucleotide
cctgtgtcaggtctatgccggggg

SEQ ID NO: 326712 - DNA, 25 bp, Artificial Sequence
  Description of Artificial Sequence: Synthetic oligonucleotide
ctgtgtcaggtctatgccgggggct

SEQ ID NO: 326713 - DNA, 25 bp, Artificial Sequence
  Description of Artificial Sequence: Synthetic oligonucleotide
tgtgtcaggtctatgccgggggctg

SEQ ID NO: 326714 - DNA, 24 bp, Artificial Sequence
  Description of Artificial Sequence: Synthetic oligonucleotide
gtgtcaggtctatgccgggggctg

SEQ ID NO: 326715 - DNA, 24 bp, Artificial Sequence
  Description of Artificial Sequence: Synthetic oligonucleotide
tgtcaggtctatgccgggggctgg

SEQ ID NO: 326716 - DNA, 23 bp, Artificial Sequence
  Description of Artificial Sequence: Synthetic oligonucleotide
gtcaggtctatgccgggggctgg

SEQ ID NO: 326717 - DNA, 24 bp, Artificial Sequence
  Description of Artificial Sequence: Synthetic oligonucleotide
tcaggtctatgccgggggctggca

SEQ ID NO: 326718 - DNA, 23 bp, Artificial Sequence
  Description of Artificial Sequence: Synthetic oligonucleotide
caggtctatgccgggggctggca

SEQ ID NO: 326719 - DNA, 23 bp, Artificial Sequence
  Description of Artificial Sequence: Synthetic oligonucleotide
aggtctatgccgggggctggcac

SEQ ID NO: 326720 - DNA, 22 bp, Artificial Sequence
  Description of Artificial Sequence: Synthetic oligonucleotide
ggtctatgccgggggctggcac

SEQ ID NO: 326721 - DNA, 22 bp, Artificial Sequence
  Description of Artificial Sequence: Synthetic oligonucleotide
gtctatgccgggggctggcacg

SEQ ID NO: 326722 - DNA, 24 bp, Artificial Sequence
  Description of Artificial Sequence: Synthetic oligonucleotide
tctatgccgggggctggcacggtt

SEQ ID NO: 326723 - DNA, 23 bp, Artificial Sequence
  Description of Artificial Sequence: Synthetic oligonucleotide
ctatgccgggggctggcacggtt

SEQ ID NO: 326724 - DNA, 23 bp, Artificial Sequence
  Description of Artificial Sequence: Synthetic oligonucleotide
tatgccgggggctggcacggttg

SEQ ID NO: 326725 - DNA, 22 bp, Artificial Sequence
  Description of Artificial Sequence: Synthetic oligonucleotide
atgccgggggctggcacggttg

SEQ ID NO: 326726 - DNA, 21 bp, Artificial Sequence
  Description of Artificial Sequence: Synthetic oligonucleotide
tgccgggggctggcacggttg

SEQ ID NO: 326727 - DNA, 20 bp, Artificial Sequence
  Description of Artificial Sequence: Synthetic oligonucleotide
gccgggggctggcacggttg

SEQ ID NO: 326728 - DNA, 20 bp, Artificial Sequence
  Description of Artificial Sequence: Synthetic oligonucleotide
ccgggggctggcacggttgc

SEQ ID NO: 326729 - DNA, 21 bp, Artificial Sequence
  Description of Artificial Sequence: Synthetic oligonucleotide
cgggggctggcacggttgcgt

SEQ ID NO: 326730 - DNA, 23 bp, Artificial Sequence
  Description of Artificial Sequence: Synthetic oligonucleotide
gggggctggcacggttgcgtcat

SEQ ID NO: 326731 - DNA, 24 bp, Artificial Sequence
  Description of Artificial Sequence: Synthetic oligonucleotide
ggggctggcacggttgcgtcatgt

SEQ ID NO: 326732 - DNA, 24 bp, Artificial Sequence
  Description of Artificial Sequence: Synthetic oligonucleotide
gggctggcacggttgcgtcatgtc

SEQ ID NO: 326733 - DNA, 24 bp, Artificial Sequence
  Description of Artificial Sequence: Synthetic oligonucleotide
ggctggcacggttgcgtcatgtcc

SEQ ID NO: 326734 - DNA, 24 bp, Artificial Sequence
  Description of Artificial Sequence: Synthetic oligonucleotide
gctggcacggttgcgtcatgtccc

SEQ ID NO: 326735 - DNA, 25 bp, Artificial Sequence
  Description of Artificial Sequence: Synthetic oligonucleotide
ctggcacggttgcgtcatgtcccca

SEQ ID NO: 326736 - DNA, 26 bp, Artificial Sequence
  Description of Artificial Sequence: Synthetic oligonucleotide
tggcacggttgcgtcatgtccccaga

SEQ ID NO: 326737 - DNA, 25 bp, Artificial Sequence
  Description of Artificial Sequence: Synthetic oligonucleotide
ggcacggttgcgtcatgtccccaga

SEQ ID NO: 326738 - DNA, 25 bp, Artificial Sequence
  Description of Artificial Sequence: Synthetic oligonucleotide
gcacggttgcgtcatgtccccagac

SEQ ID NO: 326739 - DNA, 25 bp, Artificial Sequence
  Description of Artificial Sequence: Synthetic oligonucleotide
cacggttgcgtcatgtccccagacc

SEQ ID NO: 326740 - DNA, 25 bp, Artificial Sequence
  Description of Artificial Sequence: Synthetic oligonucleotide
acggttgcgtcatgtccccagaccc

SEQ ID NO: 326741 - DNA, 24 bp, Artificial Sequence
  Description of Artificial Sequence: Synthetic oligonucleotide
cggttgcgtcatgtccccagaccc

SEQ ID NO: 326742 - DNA, 26 bp, Artificial Sequence
  Description of Artificial Sequence: Synthetic oligonucleotide
ggttgcgtcatgtccccagaccccta

SEQ ID NO: 326743 - DNA, 27 bp, Artificial Sequence
  Description of Artificial Sequence: Synthetic oligonucleotide
gttgcgtcatgtccccagacccctagt

SEQ ID NO: 326744 - DNA, 27 bp, Artificial Sequence
  Description of Artificial Sequence: Synthetic oligonucleotide
ttgcgtcatgtccccagacccctagtg

SEQ ID NO: 326745 - DNA, 26 bp, Artificial Sequence
  Description of Artificial Sequence: Synthetic oligonucleotide
tgcgtcatgtccccagacccctagtg

SEQ ID NO: 326746 - DNA, 25 bp, Artificial Sequence
  Description of Artificial Sequence: Synthetic oligonucleotide
gcgtcatgtccccagacccctagtg

SEQ ID NO: 326747 - DNA, 25 bp, Artificial Sequence
  Description of Artificial Sequence: Synthetic oligonucleotide
cgtcatgtccccagacccctagtgc

SEQ ID NO: 326748 - DNA, 25 bp, Artificial Sequence
  Description of Artificial Sequence: Synthetic oligonucleotide
gtcatgtccccagacccctagtgcg

SEQ ID NO: 326749 - DNA, 25 bp, Artificial Sequence
  Description of Artificial Sequence: Synthetic oligonucleotide
tcatgtccccagacccctagtgcgg

SEQ ID NO: 326750 - DNA, 24 bp, Artificial Sequence
  Description of Artificial Sequence: Synthetic oligonucleotide
catgtccccagacccctagtgcgg

SEQ ID NO: 326751 - DNA, 25 bp, Artificial Sequence
  Description of Artificial Sequence: Synthetic oligonucleotide
atgtccccagacccctagtgcggct

SEQ ID NO: 326752 - DNA, 24 bp, Artificial Sequence
  Description of Artificial Sequence: Synthetic oligonucleotide
tgtccccagacccctagtgcggct

SEQ ID NO: 326753 - DNA, 23 bp, Artificial Sequence
  Description of Artificial Sequence: Synthetic oligonucleotide
gtccccagacccctagtgcggct

SEQ ID NO: 326754 - DNA, 23 bp, Artificial Sequence
  Description of Artificial Sequence: Synthetic oligonucleotide
tccccagacccctagtgcggctg

SEQ ID NO: 326755 - DNA, 22 bp, Artificial Sequence
  Description of Artificial Sequence: Synthetic oligonucleotide
ccccagacccctagtgcggctg

SEQ ID NO: 326756 - DNA, 22 bp, Artificial Sequence
  Description of Artificial Sequence: Synthetic oligonucleotide
cccagacccctagtgcggctgg

SEQ ID NO: 326757 - DNA, 23 bp, Artificial Sequence
  Description of Artificial Sequence: Synthetic oligonucleotide
ccagacccctagtgcggctggca

SEQ ID NO: 326758 - DNA, 23 bp, Artificial Sequence
  Description of Artificial Sequence: Synthetic oligonucleotide
cagacccctagtgcggctggcac

SEQ ID NO: 326759 - DNA, 25 bp, Artificial Sequence
  Description of Artificial Sequence: Synthetic oligonucleotide
agacccctagtgcggctggcaccaa

SEQ ID NO: 326760 - DNA, 24 bp, Artificial Sequence
  Description of Artificial Sequence: Synthetic oligonucleotide
gacccctagtgcggctggcaccaa

SEQ ID NO: 326761 - DNA, 24 bp, Artificial Sequence
  Description of Artificial Sequence: Synthetic oligonucleotide
acccctagtgcggctggcaccaag

SEQ ID NO: 326762 - DNA, 23 bp, Artificial Sequence
  Description of Artificial Sequence: Synthetic oligonucleotide
cccctagtgcggctggcaccaag

SEQ ID NO: 326763 - DNA, 23 bp, Artificial Sequence
  Description of Artificial Sequence: Synthetic oligonucleotide
ccctagtgcggctggcaccaagg

SEQ ID NO: 326764 - DNA, 23 bp, Artificial Sequence
  Description of Artificial Sequence: Synthetic oligonucleotide
cctagtgcggctggcaccaaggc

SEQ ID NO: 326765 - DNA, 23 bp, Artificial Sequence
  Description of Artificial Sequence: Synthetic oligonucleotide
ctagtgcggctggcaccaaggcc

SEQ ID NO: 326766 - DNA, 23 bp, Artificial Sequence
  Description of Artificial Sequence: Synthetic oligonucleotide
tagtgcggctggcaccaaggccc

SEQ ID NO: 326767 - DNA, 22 bp, Artificial Sequence
  Description of Artificial Sequence: Synthetic oligonucleotide
agtgcggctggcaccaaggccc

SEQ ID NO: 326768 - DNA, 21 bp, Artificial Sequence
  Description of Artificial Sequence: Synthetic oligonucleotide
gtgcggctggcaccaaggccc

SEQ ID NO: 326769 - DNA, 22 bp, Artificial Sequence
  Description of Artificial Sequence: Synthetic oligonucleotide
tgcggctggcaccaaggcccct

SEQ ID NO: 326770 - DNA, 21 bp, Artificial Sequence
  Description of Artificial Sequence: Synthetic oligonucleotide
gcggctggcaccaaggcccct

SEQ ID NO: 326771 - DNA, 21 bp, Artificial Sequence
  Description of Artificial Sequence: Synthetic oligonucleotide
cggctggcaccaaggcccctg

SEQ ID NO: 326772 - DNA, 23 bp, Artificial Sequence
  Description of Artificial Sequence: Synthetic oligonucleotide
ggctggcaccaaggcccctgcat

SEQ ID NO: 326773 - DNA, 24 bp, Artificial Sequence
  Description of Artificial Sequence: Synthetic oligonucleotide
gctggcaccaaggcccctgcatct

SEQ ID NO: 326774 - DNA, 24 bp, Artificial Sequence
  Description of Artificial Sequence: Synthetic oligonucleotide
ctggcaccaaggcccctgcatctc

SEQ ID NO: 326775 - DNA, 26 bp, Artificial Sequence
  Description of Artificial Sequence: Synthetic oligonucleotide
tggcaccaaggcccctgcatctcgat

SEQ ID NO: 326776 - DNA, 25 bp, Artificial Sequence
  Description of Artificial Sequence: Synthetic oligonucleotide
ggcaccaaggcccctgcatctcgat

SEQ ID NO: 326777 - DNA, 27 bp, Artificial Sequence
  Description of Artificial Sequence: Synthetic oligonucleotide
gcaccaaggcccctgcatctcgatcta

SEQ ID NO: 326778 - DNA, 27 bp, Artificial Sequence
  Description of Artificial Sequence: Synthetic oligonucleotide
caccaaggcccctgcatctcgatctac

SEQ ID NO: 326779 - DNA, 28 bp, Artificial Sequence
  Description of Artificial Sequence: Synthetic oligonucleotide
accaaggcccctgcatctcgatctacag

SEQ ID NO: 326780 - DNA, 27 bp, Artificial Sequence
  Description of Artificial Sequence: Synthetic oligonucleotide
ccaaggcccctgcatctcgatctacag

SEQ ID NO: 326781 - DNA, 27 bp, Artificial Sequence
  Description of Artificial Sequence: Synthetic oligonucleotide
caaggcccctgcatctcgatctacagc

SEQ ID NO: 326782 - DNA, 28 bp, Artificial Sequence
  Description of Artificial Sequence: Synthetic oligonucleotide
aaggcccctgcatctcgatctacagcac

SEQ ID NO: 326783 - DNA, 27 bp, Artificial Sequence
  Description of Artificial Sequence: Synthetic oligonucleotide
aggcccctgcatctcgatctacagcac

SEQ ID NO: 326784 - DNA, 26 bp, Artificial Sequence
  Description of Artificial Sequence: Synthetic oligonucleotide
ggcccctgcatctcgatctacagcac

SEQ ID NO: 326785 - DNA, 26 bp, Artificial Sequence
  Description of Artificial Sequence: Synthetic oligonucleotide
gcccctgcatctcgatctacagcacc

SEQ ID NO: 326786 - DNA, 27 bp, Artificial Sequence
  Description of Artificial Sequence: Synthetic oligonucleotide
cccctgcatctcgatctacagcaccga

SEQ ID NO: 326787 - DNA, 28 bp, Artificial Sequence
  Description of Artificial Sequence: Synthetic oligonucleotide
ccctgcatctcgatctacagcaccgaac

SEQ ID NO: 326788 - DNA, 28 bp, Artificial Sequence
  Description of Artificial Sequence: Synthetic oligonucleotide
cctgcatctcgatctacagcaccgaacg

SEQ ID NO: 326789 - DNA, 28 bp, Artificial Sequence
  Description of Artificial Sequence: Synthetic oligonucleotide
ctgcatctcgatctacagcaccgaacgg

SEQ ID NO: 326790 - DNA, 29 bp, Artificial Sequence
  Description of Artificial Sequence: Synthetic oligonucleotide
tgcatctcgatctacagcaccgaacggtg

SEQ ID NO: 326791 - DNA, 28 bp, Artificial Sequence
  Description of Artificial Sequence: Synthetic oligonucleotide
gcatctcgatctacagcaccgaacggtg

SEQ ID NO: 326792 - DNA, 29 bp, Artificial Sequence
  Description of Artificial Sequence: Synthetic oligonucleotide
catctcgatctacagcaccgaacggtgag

SEQ ID NO: 326793 - DNA, 30 bp, Artificial Sequence
  Description of Artificial Sequence: Synthetic oligonucleotide
atctcgatctacagcaccgaacggtgagtg

SEQ ID NO: 326794 - DNA, 29 bp, Artificial Sequence
  Description of Artificial Sequence: Synthetic oligonucleotide
tctcgatctacagcaccgaacggtgagtg

SEQ ID NO: 326795 - DNA, 28 bp, Artificial Sequence
  Description of Artificial Sequence: Synthetic oligonucleotide
ctcgatctacagcaccgaacggtgagtg

SEQ ID NO: 326796 - DNA, 28 bp, Artificial Sequence
  Description of Artificial Sequence: Synthetic oligonucleotide
tcgatctacagcaccgaacggtgagtgc

SEQ ID NO: 326797 - DNA, 27 bp, Artificial Sequence
  Description of Artificial Sequence: Synthetic oligonucleotide
cgatctacagcaccgaacggtgagtgc

SEQ ID NO: 326798 - DNA, 28 bp, Artificial Sequence
  Description of Artificial Sequence: Synthetic oligonucleotide
gatctacagcaccgaacggtgagtgctg

SEQ ID NO: 326799 - DNA, 28 bp, Artificial Sequence
  Description of Artificial Sequence: Synthetic oligonucleotide
atctacagcaccgaacggtgagtgctgc

SEQ ID NO: 326800 - DNA, 27 bp, Artificial Sequence
  Description of Artificial Sequence: Synthetic oligonucleotide
tctacagcaccgaacggtgagtgctgc

SEQ ID NO: 326801 - DNA, 27 bp, Artificial Sequence
  Description of Artificial Sequence: Synthetic oligonucleotide
ctacagcaccgaacggtgagtgctgca

SEQ ID NO: 326802 - DNA, 29 bp, Artificial Sequence
  Description of Artificial Sequence: Synthetic oligonucleotide
tacagcaccgaacggtgagtgctgcattc

SEQ ID NO: 326803 - DNA, 28 bp, Artificial Sequence
  Description of Artificial Sequence: Synthetic oligonucleotide
acagcaccgaacggtgagtgctgcattc

SEQ ID NO: 326804 - DNA, 27 bp, Artificial Sequence
  Description of Artificial Sequence: Synthetic oligonucleotide
cagcaccgaacggtgagtgctgcattc

SEQ ID NO: 326805 - DNA, 27 bp, Artificial Sequence
  Description of Artificial Sequence: Synthetic oligonucleotide
agcaccgaacggtgagtgctgcattcc

SEQ ID NO: 326806 - DNA, 27 bp, Artificial Sequence
  Description of Artificial Sequence: Synthetic oligonucleotide
gcaccgaacggtgagtgctgcattcca

SEQ ID NO: 326807 - DNA, 32 bp, Artificial Sequence
  Description of Artificial Sequence: Synthetic oligonucleotide
caccgaacggtgagtgctgcattccattaatg

SEQ ID NO: 326808 - DNA, 32 bp, Artificial Sequence
  Description of Artificial Sequence: Synthetic oligonucleotide
accgaacggtgagtgctgcattccattaatgc

SEQ ID NO: 326809 - DNA, 31 bp, Artificial Sequence
  Description of Artificial Sequence: Synthetic oligonucleotide
ccgaacggtgagtgctgcattccattaatgc

SEQ ID NO: 326810 - DNA, 32 bp, Artificial Sequence
  Description of Artificial Sequence: Synthetic oligonucleotide
cgaacggtgagtgctgcattccattaatgcag

SEQ ID NO: 326811 - DNA, 32 bp, Artificial Sequence
  Description of Artificial Sequence: Synthetic oligonucleotide
gaacggtgagtgctgcattccattaatgcagc

SEQ ID NO: 326812 - DNA, 32 bp, Artificial Sequence
  Description of Artificial Sequence: Synthetic oligonucleotide
aacggtgagtgctgcattccattaatgcagcc

SEQ ID NO: 326813 - DNA, 31 bp, Artificial Sequence
  Description of Artificial Sequence: Synthetic oligonucleotide
acggtgagtgctgcattccattaatgcagcc

SEQ ID NO: 326814 - DNA, 30 bp, Artificial Sequence
  Description of Artificial Sequence: Synthetic oligonucleotide
cggtgagtgctgcattccattaatgcagcc

SEQ ID NO: 326815 - DNA, 30 bp, Artificial Sequence
  Description of Artificial Sequence: Synthetic oligonucleotide
ggtgagtgctgcattccattaatgcagccg

SEQ ID NO: 326816 - DNA, 31 bp, Artificial Sequence
  Description of Artificial Sequence: Synthetic oligonucleotide
gtgagtgctgcattccattaatgcagccgag

SEQ ID NO: 326817 - DNA, 31 bp, Artificial Sequence
  Description of Artificial Sequence: Synthetic oligonucleotide
tgagtgctgcattccattaatgcagccgagc

SEQ ID NO: 326818 - DNA, 30 bp, Artificial Sequence
  Description of Artificial Sequence: Synthetic oligonucleotide
gagtgctgcattccattaatgcagccgagc

SEQ ID NO: 326819 - DNA, 30 bp, Artificial Sequence
  Description of Artificial Sequence: Synthetic oligonucleotide
agtgctgcattccattaatgcagccgagcg

SEQ ID NO: 326820 - DNA, 29 bp, Artificial Sequence
  Description of Artificial Sequence: Synthetic oligonucleotide
gtgctgcattccattaatgcagccgagcg

SEQ ID NO: 326821 - DNA, 30 bp, Artificial Sequence
  Description of Artificial Sequence: Synthetic oligonucleotide
tgctgcattccattaatgcagccgagcgac

SEQ ID NO: 326822 - DNA, 29 bp, Artificial Sequence
  Description of Artificial Sequence: Synthetic oligonucleotide
gctgcattccattaatgcagccgagcgac

SEQ ID NO: 326823 - DNA, 30 bp, Artificial Sequence
  Description of Artificial Sequence: Synthetic oligonucleotide
ctgcattccattaatgcagccgagcgacac

SEQ ID NO: 326824 - DNA, 32 bp, Artificial Sequence
  Description of Artificial Sequence: Synthetic oligonucleotide
tgcattccattaatgcagccgagcgacacaag

SEQ ID NO: 326825 - DNA, 31 bp, Artificial Sequence
  Description of Artificial Sequence: Synthetic oligonucleotide
gcattccattaatgcagccgagcgacacaag

SEQ ID NO: 326826 - DNA, 31 bp, Artificial Sequence
  Description of Artificial Sequence: Synthetic oligonucleotide
cattccattaatgcagccgagcgacacaagg

SEQ ID NO: 326827 - DNA, 32 bp, Artificial Sequence
  Description of Artificial Sequence: Synthetic oligonucleotide
attccattaatgcagccgagcgacacaaggac

SEQ ID NO: 326828 - DNA, 31 bp, Artificial Sequence
  Description of Artificial Sequence: Synthetic oligonucleotide
ttccattaatgcagccgagcgacacaaggac

SEQ ID NO: 326829 - DNA, 30 bp, Artificial Sequence
  Description of Artificial Sequence: Synthetic oligonucleotide
tccattaatgcagccgagcgacacaaggac

SEQ ID NO: 326830 - DNA, 29 bp, Artificial Sequence
  Description of Artificial Sequence: Synthetic oligonucleotide
ccattaatgcagccgagcgacacaaggac

SEQ ID NO: 326831 - DNA, 30 bp, Artificial Sequence
  Description of Artificial Sequence: Synthetic oligonucleotide
cattaatgcagccgagcgacacaaggactg

SEQ ID NO: 326832 - DNA, 31 bp, Artificial Sequence
  Description of Artificial Sequence: Synthetic oligonucleotide
attaatgcagccgagcgacacaaggactgtc

SEQ ID NO: 326833 - DNA, 30 bp, Artificial Sequence
  Description of Artificial Sequence: Synthetic oligonucleotide
ttaatgcagccgagcgacacaaggactgtc

SEQ ID NO: 326834 - DNA, 29 bp, Artificial Sequence
  Description of Artificial Sequence: Synthetic oligonucleotide
taatgcagccgagcgacacaaggactgtc

SEQ ID NO: 326835 - DNA, 28 bp, Artificial Sequence
  Description of Artificial Sequence: Synthetic oligonucleotide
aatgcagccgagcgacacaaggactgtc

SEQ ID NO: 326836 - DNA, 27 bp, Artificial Sequence
  Description of Artificial Sequence: Synthetic oligonucleotide
atgcagccgagcgacacaaggactgtc

SEQ ID NO: 326837 - DNA, 26 bp, Artificial Sequence
  Description of Artificial Sequence: Synthetic oligonucleotide
tgcagccgagcgacacaaggactgtc

SEQ ID NO: 326838 - DNA, 25 bp, Artificial Sequence
  Description of Artificial Sequence: Synthetic oligonucleotide
gcagccgagcgacacaaggactgtc

SEQ ID NO: 326839 - DNA, 25 bp, Artificial Sequence
  Description of Artificial Sequence: Synthetic oligonucleotide
cagccgagcgacacaaggactgtcc

SEQ ID NO: 326840 - DNA, 27 bp, Artificial Sequence
  Description of Artificial Sequence: Synthetic oligonucleotide
agccgagcgacacaaggactgtcccaa

SEQ ID NO: 326841 - DNA, 26 bp, Artificial Sequence
  Description of Artificial Sequence: Synthetic oligonucleotide
gccgagcgacacaaggactgtcccaa

SEQ ID NO: 326842 - DNA, 26 bp, Artificial Sequence
  Description of Artificial Sequence: Synthetic oligonucleotide
ccgagcgacacaaggactgtcccaac

SEQ ID NO: 326843 - DNA, 26 bp, Artificial Sequence
  Description of Artificial Sequence: Synthetic oligonucleotide
cgagcgacacaaggactgtcccaacg

SEQ ID NO: 326844 - DNA, 26 bp, Artificial Sequence
  Description of Artificial Sequence: Synthetic oligonucleotide
gagcgacacaaggactgtcccaacgc

SEQ ID NO: 326845 - DNA, 27 bp, Artificial Sequence
  Description of Artificial Sequence: Synthetic oligonucleotide
agcgacacaaggactgtcccaacgcca

SEQ ID NO: 326846 - DNA, 27 bp, Artificial Sequence
  Description of Artificial Sequence: Synthetic oligonucleotide
gcgacacaaggactgtcccaacgccaa

SEQ ID NO: 326847 - DNA, 28 bp, Artificial Sequence
  Description of Artificial Sequence: Synthetic oligonucleotide
cgacacaaggactgtcccaacgccaaac

SEQ ID NO: 326848 - DNA, 28 bp, Artificial Sequence
  Description of Artificial Sequence: Synthetic oligonucleotide
gacacaaggactgtcccaacgccaaacc

SEQ ID NO: 326849 - DNA, 29 bp, Artificial Sequence
  Description of Artificial Sequence: Synthetic oligonucleotide
acacaaggactgtcccaacgccaaaccag

SEQ ID NO: 326850 - DNA, 28 bp, Artificial Sequence
  Description of Artificial Sequence: Synthetic oligonucleotide
cacaaggactgtcccaacgccaaaccag

SEQ ID NO: 326851 - DNA, 29 bp, Artificial Sequence
  Description of Artificial Sequence: Synthetic oligonucleotide
acaaggactgtcccaacgccaaaccagtc

SEQ ID NO: 326852 - DNA, 28 bp, Artificial Sequence
  Description of Artificial Sequence: Synthetic oligonucleotide
caaggactgtcccaacgccaaaccagtc

SEQ ID NO: 326853 - DNA, 30 bp, Artificial Sequence
  Description of Artificial Sequence: Synthetic oligonucleotide
aaggactgtcccaacgccaaaccagtcaag

SEQ ID NO: 326854 - DNA, 29 bp, Artificial Sequence
  Description of Artificial Sequence: Synthetic oligonucleotide
aggactgtcccaacgccaaaccagtcaag

SEQ ID NO: 326855 - DNA, 28 bp, Artificial Sequence
  Description of Artificial Sequence: Synthetic oligonucleotide
ggactgtcccaacgccaaaccagtcaag

SEQ ID NO: 326856 - DNA, 28 bp, Artificial Sequence
  Description of Artificial Sequence: Synthetic oligonucleotide
gactgtcccaacgccaaaccagtcaagg

SEQ ID NO: 326857 - DNA, 28 bp, Artificial Sequence
  Description of Artificial Sequence: Synthetic oligonucleotide
actgtcccaacgccaaaccagtcaaggc

SEQ ID NO: 326858 - DNA, 27 bp, Artificial Sequence
  Description of Artificial Sequence: Synthetic oligonucleotide
ctgtcccaacgccaaaccagtcaaggc

SEQ ID NO: 326859 - DNA, 27 bp, Artificial Sequence
  Description of Artificial Sequence: Synthetic oligonucleotide
tgtcccaacgccaaaccagtcaaggcc

SEQ ID NO: 326860 - DNA, 26 bp, Artificial Sequence
  Description of Artificial Sequence: Synthetic oligonucleotide
gtcccaacgccaaaccagtcaaggcc

SEQ ID NO: 326861 - DNA, 26 bp, Artificial Sequence
  Description of Artificial Sequence: Synthetic oligonucleotide
tcccaacgccaaaccagtcaaggccc

SEQ ID NO: 326862 - DNA, 25 bp, Artificial Sequence
  Description of Artificial Sequence: Synthetic oligonucleotide
cccaacgccaaaccagtcaaggccc

SEQ ID NO: 326863 - DNA, 26 bp, Artificial Sequence
  Description of Artificial Sequence: Synthetic oligonucleotide
ccaacgccaaaccagtcaaggcccct

SEQ ID NO: 326864 - DNA, 27 bp, Artificial Sequence
  Description of Artificial Sequence: Synthetic oligonucleotide
caacgccaaaccagtcaaggcccctct

SEQ ID NO: 326865 - DNA, 27 bp, Artificial Sequence
  Description of Artificial Sequence: Synthetic oligonucleotide
aacgccaaaccagtcaaggcccctctg

SEQ ID NO: 326866 - DNA, 26 bp, Artificial Sequence
  Description of Artificial Sequence: Synthetic oligonucleotide
acgccaaaccagtcaaggcccctctg

SEQ ID NO: 326867 - DNA, 25 bp, Artificial Sequence
  Description of Artificial Sequence: Synthetic oligonucleotide
cgccaaaccagtcaaggcccctctg

SEQ ID NO: 326868 - DNA, 26 bp, Artificial Sequence
  Description of Artificial Sequence: Synthetic oligonucleotide
gccaaaccagtcaaggcccctctgca

SEQ ID NO: 326869 - DNA, 27 bp, Artificial Sequence
  Description of Artificial Sequence: Synthetic oligonucleotide
ccaaaccagtcaaggcccctctgcaga

SEQ ID NO: 326870 - DNA, 28 bp, Artificial Sequence
  Description of Artificial Sequence: Synthetic oligonucleotide
caaaccagtcaaggcccctctgcagaag

SEQ ID NO: 326871 - DNA, 28 bp, Artificial Sequence
  Description of Artificial Sequence: Synthetic oligonucleotide
aaaccagtcaaggcccctctgcagaagc

SEQ ID NO: 326872 - DNA, 27 bp, Artificial Sequence
  Description of Artificial Sequence: Synthetic oligonucleotide
aaccagtcaaggcccctctgcagaagc

SEQ ID NO: 326873 - DNA, 27 bp, Artificial Sequence
  Description of Artificial Sequence: Synthetic oligonucleotide
accagtcaaggcccctctgcagaagct

SEQ ID NO: 326874 - DNA, 27 bp, Artificial Sequence
  Description of Artificial Sequence: Synthetic oligonucleotide
ccagtcaaggcccctctgcagaagctt

SEQ ID NO: 326875 - DNA, 28 bp, Artificial Sequence
  Description of Artificial Sequence: Synthetic oligonucleotide
cagtcaaggcccctctgcagaagctttc

SEQ ID NO: 326876 - DNA, 28 bp, Artificial Sequence
  Description of Artificial Sequence: Synthetic oligonucleotide
agtcaaggcccctctgcagaagctttcc

SEQ ID NO: 326877 - DNA, 27 bp, Artificial Sequence
  Description of Artificial Sequence: Synthetic oligonucleotide
gtcaaggcccctctgcagaagctttcc

SEQ ID NO: 326878 - DNA, 27 bp, Artificial Sequence
  Description of Artificial Sequence: Synthetic oligonucleotide
tcaaggcccctctgcagaagctttccc

SEQ ID NO: 326879 - DNA, 27 bp, Artificial Sequence
  Description of Artificial Sequence: Synthetic oligonucleotide
caaggcccctctgcagaagctttccct

SEQ ID NO: 326880 - DNA, 27 bp, Artificial Sequence
  Description of Artificial Sequence: Synthetic oligonucleotide
aaggcccctctgcagaagctttccctg

SEQ ID NO: 326881 - DNA, 26 bp, Artificial Sequence
  Description of Artificial Sequence: Synthetic oligonucleotide
aggcccctctgcagaagctttccctg

SEQ ID NO: 326882 - DNA, 25 bp, Artificial Sequence
  Description of Artificial Sequence: Synthetic oligonucleotide
ggcccctctgcagaagctttccctg

SEQ ID NO: 326883 - DNA, 25 bp, Artificial Sequence
  Description of Artificial Sequence: Synthetic oligonucleotide
gcccctctgcagaagctttccctgg

SEQ ID NO: 326884 - DNA, 25 bp, Artificial Sequence
  Description of Artificial Sequence: Synthetic oligonucleotide
cccctctgcagaagctttccctggg

SEQ ID NO: 326885 - DNA, 25 bp, Artificial Sequence
  Description of Artificial Sequence: Synthetic oligonucleotide
ccctctgcagaagctttccctgggc

SEQ ID NO: 326886 - DNA, 25 bp, Artificial Sequence
  Description of Artificial Sequence: Synthetic oligonucleotide
cctctgcagaagctttccctgggcc

SEQ ID NO: 326887 - DNA, 27 bp, Artificial Sequence
  Description of Artificial Sequence: Synthetic oligonucleotide
ctctgcagaagctttccctgggcccaa

SEQ ID NO: 326888 - DNA, 28 bp, Artificial Sequence
  Description of Artificial Sequence: Synthetic oligonucleotide
tctgcagaagctttccctgggcccaaac

SEQ ID NO: 326889 - DNA, 27 bp, Artificial Sequence
  Description of Artificial Sequence: Synthetic oligonucleotide
ctgcagaagctttccctgggcccaaac

SEQ ID NO: 326890 - DNA, 28 bp, Artificial Sequence
  Description of Artificial Sequence: Synthetic oligonucleotide
tgcagaagctttccctgggcccaaactc

SEQ ID NO: 326891 - DNA, 27 bp, Artificial Sequence
  Description of Artificial Sequence: Synthetic oligonucleotide
gcagaagctttccctgggcccaaactc

SEQ ID NO: 326892 - DNA, 28 bp, Artificial Sequence
  Description of Artificial Sequence: Synthetic oligonucleotide
cagaagctttccctgggcccaaactcac

SEQ ID NO: 326893 - DNA, 28 bp, Artificial Sequence
  Description of Artificial Sequence: Synthetic oligonucleotide
agaagctttccctgggcccaaactcacg

SEQ ID NO: 326894 - DNA, 27 bp, Artificial Sequence
  Description of Artificial Sequence: Synthetic oligonucleotide
gaagctttccctgggcccaaactcacg

SEQ ID NO: 326895 - DNA, 27 bp, Artificial Sequence
  Description of Artificial Sequence: Synthetic oligonucleotide
aagctttccctgggcccaaactcacgc

SEQ ID NO: 326896 - DNA, 27 bp, Artificial Sequence
  Description of Artificial Sequence: Synthetic oligonucleotide
agctttccctgggcccaaactcacgct

SEQ ID NO: 326897 - DNA, 27 bp, Artificial Sequence
  Description of Artificial Sequence: Synthetic oligonucleotide
gctttccctgggcccaaactcacgcta

SEQ ID NO: 326898 - DNA, 27 bp, Artificial Sequence
  Description of Artificial Sequence: Synthetic oligonucleotide
ctttccctgggcccaaactcacgctac

SEQ ID NO: 326899 - DNA, 29 bp, Artificial Sequence
  Description of Artificial Sequence: Synthetic oligonucleotide
tttccctgggcccaaactcacgctactac

SEQ ID NO: 326900 - DNA, 28 bp, Artificial Sequence
  Description of Artificial Sequence: Synthetic oligonucleotide
ttccctgggcccaaactcacgctactac

SEQ ID NO: 326901 - DNA, 27 bp, Artificial Sequence
  Description of Artificial Sequence: Synthetic oligonucleotide
tccctgggcccaaactcacgctactac

SEQ ID NO: 326902 - DNA, 26 bp, Artificial Sequence
  Description of Artificial Sequence: Synthetic oligonucleotide
ccctgggcccaaactcacgctactac

SEQ ID NO: 326903 - DNA, 27 bp, Artificial Sequence
  Description of Artificial Sequence: Synthetic oligonucleotide
cctgggcccaaactcacgctactacgt

SEQ ID NO: 326904 - DNA, 27 bp, Artificial Sequence
  Description of Artificial Sequence: Synthetic oligonucleotide
ctgggcccaaactcacgctactacgtg

SEQ ID NO: 326905 - DNA, 28 bp, Artificial Sequence
  Description of Artificial Sequence: Synthetic oligonucleotide
tgggcccaaactcacgctactacgtgag

SEQ ID NO: 326906 - DNA, 27 bp, Artificial Sequence
  Description of Artificial Sequence: Synthetic oligonucleotide
gggcccaaactcacgctactacgtgag

SEQ ID NO: 326907 - DNA, 27 bp, Artificial Sequence
  Description of Artificial Sequence: Synthetic oligonucleotide
ggcccaaactcacgctactacgtgagc

SEQ ID NO: 326908 - DNA, 28 bp, Artificial Sequence
  Description of Artificial Sequence: Synthetic oligonucleotide
gcccaaactcacgctactacgtgagctg

SEQ ID NO: 326909 - DNA, 28 bp, Artificial Sequence
  Description of Artificial Sequence: Synthetic oligonucleotide
cccaaactcacgctactacgtgagctgc

SEQ ID NO: 326910 - DNA, 28 bp, Artificial Sequence
  Description of Artificial Sequence: Synthetic oligonucleotide
ccaaactcacgctactacgtgagctgcc

SEQ ID NO: 326911 - DNA, 28 bp, Artificial Sequence
  Description of Artificial Sequence: Synthetic oligonucleotide
caaactcacgctactacgtgagctgccg

SEQ ID NO: 326912 - DNA, 28 bp, Artificial Sequence
  Description of Artificial Sequence: Synthetic oligonucleotide
aaactcacgctactacgtgagctgccgc

SEQ ID NO: 326913 - DNA, 27 bp, Artificial Sequence
  Description of Artificial Sequence: Synthetic oligonucleotide
aactcacgctactacgtgagctgccgc

SEQ ID NO: 326914 - DNA, 27 bp, Artificial Sequence
  Description of Artificial Sequence: Synthetic oligonucleotide
actcacgctactacgtgagctgccgca

SEQ ID NO: 326915 - DNA, 27 bp, Artificial Sequence
  Description of Artificial Sequence: Synthetic oligonucleotide
ctcacgctactacgtgagctgccgcat

SEQ ID NO: 326916 - DNA, 27 bp, Artificial Sequence
  Description of Artificial Sequence: Synthetic oligonucleotide
tcacgctactacgtgagctgccgcatg

SEQ ID NO: 326917 - DNA, 26 bp, Artificial Sequence
  Description of Artificial Sequence: Synthetic oligonucleotide
cacgctactacgtgagctgccgcatg

SEQ ID NO: 326918 - DNA, 27 bp, Artificial Sequence
  Description of Artificial Sequence: Synthetic oligonucleotide
acgctactacgtgagctgccgcatgga

SEQ ID NO: 326919 - DNA, 27 bp, Artificial Sequence
  Description of Artificial Sequence: Synthetic oligonucleotide
cgctactacgtgagctgccgcatggaa

SEQ ID NO: 326920 - DNA, 28 bp, Artificial Sequence
  Description of Artificial Sequence: Synthetic oligonucleotide
gctactacgtgagctgccgcatggaatc

SEQ ID NO: 326921 - DNA, 28 bp, Artificial Sequence
  Description of Artificial Sequence: Synthetic oligonucleotide
ctactacgtgagctgccgcatggaatcg

SEQ ID NO: 326922 - DNA, 28 bp, Artificial Sequence
  Description of Artificial Sequence: Synthetic oligonucleotide
tactacgtgagctgccgcatggaatcgc

SEQ ID NO: 326923 - DNA, 27 bp, Artificial Sequence
  Description of Artificial Sequence: Synthetic oligonucleotide
actacgtgagctgccgcatggaatcgc

SEQ ID NO: 326924 - DNA, 26 bp, Artificial Sequence
  Description of Artificial Sequence: Synthetic oligonucleotide
ctacgtgagctgccgcatggaatcgc

SEQ ID NO: 326925 - DNA, 26 bp, Artificial Sequence
  Description of Artificial Sequence: Synthetic oligonucleotide
tacgtgagctgccgcatggaatcgcg

SEQ ID NO: 326926 - DNA, 25 bp, Artificial Sequence
  Description of Artificial Sequence: Synthetic oligonucleotide
acgtgagctgccgcatggaatcgcg

SEQ ID NO: 326927 - DNA, 24 bp, Artificial Sequence
  Description of Artificial Sequence: Synthetic oligonucleotide
cgtgagctgccgcatggaatcgcg

SEQ ID NO: 326928 - DNA, 24 bp, Artificial Sequence
  Description of Artificial Sequence: Synthetic oligonucleotide
gtgagctgccgcatggaatcgcgc

SEQ ID NO: 326929 - DNA, 25 bp, Artificial Sequence
  Description of Artificial Sequence: Synthetic oligonucleotide
tgagctgccgcatggaatcgcgcca

SEQ ID NO: 326930 - DNA, 24 bp, Artificial Sequence
  Description of Artificial Sequence: Synthetic oligonucleotide
gagctgccgcatggaatcgcgcca

SEQ ID NO: 326931 - DNA, 24 bp, Artificial Sequence
  Description of Artificial Sequence: Synthetic oligonucleotide
agctgccgcatggaatcgcgccac

SEQ ID NO: 326932 - DNA, 23 bp, Artificial Sequence
  Description of Artificial Sequence: Synthetic oligonucleotide
gctgccgcatggaatcgcgccac

SEQ ID NO: 326933 - DNA, 23 bp, Artificial Sequence
  Description of Artificial Sequence: Synthetic oligonucleotide
ctgccgcatggaatcgcgccacg

SEQ ID NO: 326934 - DNA, 23 bp, Artificial Sequence
  Description of Artificial Sequence: Synthetic oligonucleotide
tgccgcatggaatcgcgccacgc

SEQ ID NO: 326935 - DNA, 22 bp, Artificial Sequence
  Description of Artificial Sequence: Synthetic oligonucleotide
gccgcatggaatcgcgccacgc

SEQ ID NO: 326936 - DNA, 23 bp, Artificial Sequence
  Description of Artificial Sequence: Synthetic oligonucleotide
ccgcatggaatcgcgccacgcct

SEQ ID NO: 326937 - DNA, 23 bp, Artificial Sequence
  Description of Artificial Sequence: Synthetic oligonucleotide
cgcatggaatcgcgccacgcctc

SEQ ID NO: 326938 - DNA, 25 bp, Artificial Sequence
  Description of Artificial Sequence: Synthetic oligonucleotide
gcatggaatcgcgccacgcctccta

SEQ ID NO: 326939 - DNA, 26 bp, Artificial Sequence
  Description of Artificial Sequence: Synthetic oligonucleotide
catggaatcgcgccacgcctcctact

SEQ ID NO: 326940 - DNA, 27 bp, Artificial Sequence
  Description of Artificial Sequence: Synthetic oligonucleotide
atggaatcgcgccacgcctcctactca

SEQ ID NO: 326941 - DNA, 27 bp, Artificial Sequence
  Description of Artificial Sequence: Synthetic oligonucleotide
tggaatcgcgccacgcctcctactcat

SEQ ID NO: 326942 - DNA, 26 bp, Artificial Sequence
  Description of Artificial Sequence: Synthetic oligonucleotide
ggaatcgcgccacgcctcctactcat

SEQ ID NO: 326943 - DNA, 26 bp, Artificial Sequence
  Description of Artificial Sequence: Synthetic oligonucleotide
gaatcgcgccacgcctcctactcatc

SEQ ID NO: 326944 - DNA, 26 bp, Artificial Sequence
  Description of Artificial Sequence: Synthetic oligonucleotide
aatcgcgccacgcctcctactcatcg

SEQ ID NO: 326945 - DNA, 25 bp, Artificial Sequence
  Description of Artificial Sequence: Synthetic oligonucleotide
atcgcgccacgcctcctactcatcg

SEQ ID NO: 326946 - DNA, 24 bp, Artificial Sequence
  Description of Artificial Sequence: Synthetic oligonucleotide
tcgcgccacgcctcctactcatcg

SEQ ID NO: 326947 - DNA, 23 bp, Artificial Sequence
  Description of Artificial Sequence: Synthetic oligonucleotide
cgcgccacgcctcctactcatcg

SEQ ID NO: 326948 - DNA, 23 bp, Artificial Sequence
  Description of Artificial Sequence: Synthetic oligonucleotide
gcgccacgcctcctactcatcgc

SEQ ID NO: 326949 - DNA, 23 bp, Artificial Sequence
  Description of Artificial Sequence: Synthetic oligonucleotide
cgccacgcctcctactcatcgcg

SEQ ID NO: 326950 - DNA, 23 bp, Artificial Sequence
  Description of Artificial Sequence: Synthetic oligonucleotide
gccacgcctcctactcatcgcgc

SEQ ID NO: 326951 - DNA, 24 bp, Artificial Sequence
  Description of Artificial Sequence: Synthetic oligonucleotide
ccacgcctcctactcatcgcgcca

SEQ ID NO: 326952 - DNA, 26 bp, Artificial Sequence
  Description of Artificial Sequence: Synthetic oligonucleotide
cacgcctcctactcatcgcgccacaa

SEQ ID NO: 326953 - DNA, 26 bp, Artificial Sequence
  Description of Artificial Sequence: Synthetic oligonucleotide
acgcctcctactcatcgcgccacaac

SEQ ID NO: 326954 - DNA, 25 bp, Artificial Sequence
  Description of Artificial Sequence: Synthetic oligonucleotide
cgcctcctactcatcgcgccacaac

SEQ ID NO: 326955 - DNA, 26 bp, Artificial Sequence
  Description of Artificial Sequence: Synthetic oligonucleotide
gcctcctactcatcgcgccacaacga

SEQ ID NO: 326956 - DNA, 27 bp, Artificial Sequence
  Description of Artificial Sequence: Synthetic oligonucleotide
cctcctactcatcgcgccacaacgaga

SEQ ID NO: 326957 - DNA, 28 bp, Artificial Sequence
  Description of Artificial Sequence: Synthetic oligonucleotide
ctcctactcatcgcgccacaacgagaac

SEQ ID NO: 326958 - DNA, 28 bp, Artificial Sequence
  Description of Artificial Sequence: Synthetic oligonucleotide
tcctactcatcgcgccacaacgagaacg

SEQ ID NO: 326959 - DNA, 27 bp, Artificial Sequence
  Description of Artificial Sequence: Synthetic oligonucleotide
cctactcatcgcgccacaacgagaacg

SEQ ID NO: 326960 - DNA, 28 bp, Artificial Sequence
  Description of Artificial Sequence: Synthetic oligonucleotide
ctactcatcgcgccacaacgagaacgtg

SEQ ID NO: 326961 - DNA, 28 bp, Artificial Sequence
  Description of Artificial Sequence: Synthetic oligonucleotide
tactcatcgcgccacaacgagaacgtgc

SEQ ID NO: 326962 - DNA, 27 bp, Artificial Sequence
  Description of Artificial Sequence: Synthetic oligonucleotide
actcatcgcgccacaacgagaacgtgc

SEQ ID NO: 326963 - DNA, 27 bp, Artificial Sequence
  Description of Artificial Sequence: Synthetic oligonucleotide
ctcatcgcgccacaacgagaacgtgca

SEQ ID NO: 326964 - DNA, 27 bp, Artificial Sequence
  Description of Artificial Sequence: Synthetic oligonucleotide
tcatcgcgccacaacgagaacgtgcag

SEQ ID NO: 326965 - DNA, 26 bp, Artificial Sequence
  Description of Artificial Sequence: Synthetic oligonucleotide
catcgcgccacaacgagaacgtgcag

SEQ ID NO: 326966 - DNA, 27 bp, Artificial Sequence
  Description of Artificial Sequence: Synthetic oligonucleotide
atcgcgccacaacgagaacgtgcagca

SEQ ID NO: 326967 - DNA, 26 bp, Artificial Sequence
  Description of Artificial Sequence: Synthetic oligonucleotide
tcgcgccacaacgagaacgtgcagca

SEQ ID NO: 326968 - DNA, 25 bp, Artificial Sequence
  Description of Artificial Sequence: Synthetic oligonucleotide
cgcgccacaacgagaacgtgcagca

SEQ ID NO: 326969 - DNA, 26 bp, Artificial Sequence
  Description of Artificial Sequence: Synthetic oligonucleotide
gcgccacaacgagaacgtgcagcaga

SEQ ID NO: 326970 - DNA, 26 bp, Artificial Sequence
  Description of Artificial Sequence: Synthetic oligonucleotide
cgccacaacgagaacgtgcagcagag

SEQ ID NO: 326971 - DNA, 27 bp, Artificial Sequence
  Description of Artificial Sequence: Synthetic oligonucleotide
gccacaacgagaacgtgcagcagagct

SEQ ID NO: 326972 - DNA, 27 bp, Artificial Sequence
  Description of Artificial Sequence: Synthetic oligonucleotide
ccacaacgagaacgtgcagcagagctc

SEQ ID NO: 326973 - DNA, 27 bp, Artificial Sequence
  Description of Artificial Sequence: Synthetic oligonucleotide
cacaacgagaacgtgcagcagagctcc

SEQ ID NO: 326974 - DNA, 27 bp, Artificial Sequence
  Description of Artificial Sequence: Synthetic oligonucleotide
acaacgagaacgtgcagcagagctccg

SEQ ID NO: 326975 - DNA, 27 bp, Artificial Sequence
  Description of Artificial Sequence: Synthetic oligonucleotide
caacgagaacgtgcagcagagctccga

SEQ ID NO: 326976 - DNA, 28 bp, Artificial Sequence
  Description of Artificial Sequence: Synthetic oligonucleotide
aacgagaacgtgcagcagagctccgaac

SEQ ID NO: 326977 - DNA, 27 bp, Artificial Sequence
  Description of Artificial Sequence: Synthetic oligonucleotide
acgagaacgtgcagcagagctccgaac

SEQ ID NO: 326978 - DNA, 26 bp, Artificial Sequence
  Description of Artificial Sequence: Synthetic oligonucleotide
cgagaacgtgcagcagagctccgaac

SEQ ID NO: 326979 - DNA, 27 bp, Artificial Sequence
  Description of Artificial Sequence: Synthetic oligonucleotide
gagaacgtgcagcagagctccgaacct

SEQ ID NO: 326980 - DNA, 27 bp, Artificial Sequence
  Description of Artificial Sequence: Synthetic oligonucleotide
agaacgtgcagcagagctccgaacctg

SEQ ID NO: 326981 - DNA, 26 bp, Artificial Sequence
  Description of Artificial Sequence: Synthetic oligonucleotide
gaacgtgcagcagagctccgaacctg

SEQ ID NO: 326982 - DNA, 27 bp, Artificial Sequence
  Description of Artificial Sequence: Synthetic oligonucleotide
aacgtgcagcagagctccgaacctgga

SEQ ID NO: 326983 - DNA, 26 bp, Artificial Sequence
  Description of Artificial Sequence: Synthetic oligonucleotide
acgtgcagcagagctccgaacctgga

SEQ ID NO: 326984 - DNA, 25 bp, Artificial Sequence
  Description of Artificial Sequence: Synthetic oligonucleotide
cgtgcagcagagctccgaacctgga

SEQ ID NO: 326985 - DNA, 26 bp, Artificial Sequence
  Description of Artificial Sequence: Synthetic oligonucleotide
gtgcagcagagctccgaacctggaca

SEQ ID NO: 326986 - DNA, 26 bp, Artificial Sequence
  Description of Artificial Sequence: Synthetic oligonucleotide
tgcagcagagctccgaacctggacac

SEQ ID NO: 326987 - DNA, 25 bp, Artificial Sequence
  Description of Artificial Sequence: Synthetic oligonucleotide
gcagcagagctccgaacctggacac

SEQ ID NO: 326988 - DNA, 26 bp, Artificial Sequence
  Description of Artificial Sequence: Synthetic oligonucleotide
cagcagagctccgaacctggacacca

SEQ ID NO: 326989 - DNA, 27 bp, Artificial Sequence
  Description of Artificial Sequence: Synthetic oligonucleotide
agcagagctccgaacctggacaccaga

SEQ ID NO: 326990 - DNA, 26 bp, Artificial Sequence
  Description of Artificial Sequence: Synthetic oligonucleotide
gcagagctccgaacctggacaccaga

SEQ ID NO: 326991 - DNA, 26 bp, Artificial Sequence
  Description of Artificial Sequence: Synthetic oligonucleotide
cagagctccgaacctggacaccagag

SEQ ID NO: 326992 - DNA, 26 bp, Artificial Sequence
  Description of Artificial Sequence: Synthetic oligonucleotide
agagctccgaacctggacaccagagc

SEQ ID NO: 326993 - DNA, 25 bp, Artificial Sequence
  Description of Artificial Sequence: Synthetic oligonucleotide
gagctccgaacctggacaccagagc

SEQ ID NO: 326994 - DNA, 25 bp, Artificial Sequence
  Description of Artificial Sequence: Synthetic oligonucleotide
agctccgaacctggacaccagagcg

SEQ ID NO: 326995 - DNA, 24 bp, Artificial Sequence
  Description of Artificial Sequence: Synthetic oligonucleotide
gctccgaacctggacaccagagcg

SEQ ID NO: 326996 - DNA, 24 bp, Artificial Sequence
  Description of Artificial Sequence: Synthetic oligonucleotide
ctccgaacctggacaccagagcgc

SEQ ID NO: 326997 - DNA, 26 bp, Artificial Sequence
  Description of Artificial Sequence: Synthetic oligonucleotide
tccgaacctggacaccagagcgccaa

SEQ ID NO: 326998 - DNA, 25 bp, Artificial Sequence
  Description of Artificial Sequence: Synthetic oligonucleotide
ccgaacctggacaccagagcgccaa

SEQ ID NO: 326999 - DNA, 26 bp, Artificial Sequence
  Description of Artificial Sequence: Synthetic oligonucleotide
cgaacctggacaccagagcgccaact

SEQ ID NO: 327000 - DNA, 26 bp, Artificial Sequence
  Description of Artificial Sequence: Synthetic oligonucleotide
gaacctggacaccagagcgccaactg

SEQ ID NO: 327001 - DNA, 27 bp, Artificial Sequence
  Description of Artificial Sequence: Synthetic oligonucleotide
aacctggacaccagagcgccaactgca

SEQ ID NO: 327002 - DNA, 27 bp, Artificial Sequence
  Description of Artificial Sequence: Synthetic oligonucleotide
acctggacaccagagcgccaactgcaa

SEQ ID NO: 327003 - DNA, 26 bp, Artificial Sequence
  Description of Artificial Sequence: Synthetic oligonucleotide
cctggacaccagagcgccaactgcaa

SEQ ID NO: 327004 - DNA, 26 bp, Artificial Sequence
  Description of Artificial Sequence: Synthetic oligonucleotide
ctggacaccagagcgccaactgcaac

SEQ ID NO: 327005 - DNA, 27 bp, Artificial Sequence
  Description of Artificial Sequence: Synthetic oligonucleotide
tggacaccagagcgccaactgcaacct

SEQ ID NO: 327006 - DNA, 26 bp, Artificial Sequence
  Description of Artificial Sequence: Synthetic oligonucleotide
ggacaccagagcgccaactgcaacct

SEQ ID NO: 327007 - DNA, 27 bp, Artificial Sequence
  Description of Artificial Sequence: Synthetic oligonucleotide
gacaccagagcgccaactgcaacctgt

SEQ ID NO: 327008 - DNA, 28 bp, Artificial Sequence
  Description of Artificial Sequence: Synthetic oligonucleotide
acaccagagcgccaactgcaacctgttc

SEQ ID NO: 327009 - DNA, 27 bp, Artificial Sequence
  Description of Artificial Sequence: Synthetic oligonucleotide
caccagagcgccaactgcaacctgttc

SEQ ID NO: 327010 - DNA, 29 bp, Artificial Sequence
  Description of Artificial Sequence: Synthetic oligonucleotide
accagagcgccaactgcaacctgttcatg

SEQ ID NO: 327011 - DNA, 28 bp, Artificial Sequence
  Description of Artificial Sequence: Synthetic oligonucleotide
ccagagcgccaactgcaacctgttcatg

SEQ ID NO: 327012 - DNA, 28 bp, Artificial Sequence
  Description of Artificial Sequence: Synthetic oligonucleotide
cagagcgccaactgcaacctgttcatgg

SEQ ID NO: 327013 - DNA, 29 bp, Artificial Sequence
  Description of Artificial Sequence: Synthetic oligonucleotide
agagcgccaactgcaacctgttcatggag

SEQ ID NO: 327014 - DNA, 28 bp, Artificial Sequence
  Description of Artificial Sequence: Synthetic oligonucleotide
gagcgccaactgcaacctgttcatggag

SEQ ID NO: 327015 - DNA, 30 bp, Artificial Sequence
  Description of Artificial Sequence: Synthetic oligonucleotide
agcgccaactgcaacctgttcatggagaac

SEQ ID NO: 327016 - DNA, 29 bp, Artificial Sequence
  Description of Artificial Sequence: Synthetic oligonucleotide
gcgccaactgcaacctgttcatggagaac

SEQ ID NO: 327017 - DNA, 29 bp, Artificial Sequence
  Description of Artificial Sequence: Synthetic oligonucleotide
cgccaactgcaacctgttcatggagaacc

SEQ ID NO: 327018 - DNA, 30 bp, Artificial Sequence
  Description of Artificial Sequence: Synthetic oligonucleotide
gccaactgcaacctgttcatggagaacctc

SEQ ID NO: 327019 - DNA, 31 bp, Artificial Sequence
  Description of Artificial Sequence: Synthetic oligonucleotide
ccaactgcaacctgttcatggagaacctctc

SEQ ID NO: 327020 - DNA, 31 bp, Artificial Sequence
  Description of Artificial Sequence: Synthetic oligonucleotide
caactgcaacctgttcatggagaacctctcg

SEQ ID NO: 327021 - DNA, 31 bp, Artificial Sequence
  Description of Artificial Sequence: Synthetic oligonucleotide
aactgcaacctgttcatggagaacctctcgg

SEQ ID NO: 327022 - DNA, 30 bp, Artificial Sequence
  Description of Artificial Sequence: Synthetic oligonucleotide
actgcaacctgttcatggagaacctctcgg

SEQ ID NO: 327023 - DNA, 29 bp, Artificial Sequence
  Description of Artificial Sequence: Synthetic oligonucleotide
ctgcaacctgttcatggagaacctctcgg

SEQ ID NO: 327024 - DNA, 29 bp, Artificial Sequence
  Description of Artificial Sequence: Synthetic oligonucleotide
tgcaacctgttcatggagaacctctcggc

SEQ ID NO: 327025 - DNA, 28 bp, Artificial Sequence
  Description of Artificial Sequence: Synthetic oligonucleotide
gcaacctgttcatggagaacctctcggc

SEQ ID NO: 327026 - DNA, 28 bp, Artificial Sequence
  Description of Artificial Sequence: Synthetic oligonucleotide
caacctgttcatggagaacctctcggcg

SEQ ID NO: 327027 - DNA, 28 bp, Artificial Sequence
  Description of Artificial Sequence: Synthetic oligonucleotide
aacctgttcatggagaacctctcggcgc

SEQ ID NO: 327028 - DNA, 27 bp, Artificial Sequence
  Description of Artificial Sequence: Synthetic oligonucleotide
acctgttcatggagaacctctcggcgc

SEQ ID NO: 327029 - DNA, 27 bp, Artificial Sequence
  Description of Artificial Sequence: Synthetic oligonucleotide
cctgttcatggagaacctctcggcgca

SEQ ID NO: 327030 - DNA, 27 bp, Artificial Sequence
  Description of Artificial Sequence: Synthetic oligonucleotide
ctgttcatggagaacctctcggcgcag

SEQ ID NO: 327031 - DNA, 27 bp, Artificial Sequence
  Description of Artificial Sequence: Synthetic oligonucleotide
tgttcatggagaacctctcggcgcagc

SEQ ID NO: 327032 - DNA, 27 bp, Artificial Sequence
  Description of Artificial Sequence: Synthetic oligonucleotide
gttcatggagaacctctcggcgcagct

SEQ ID NO: 327033 - DNA, 27 bp, Artificial Sequence
  Description of Artificial Sequence: Synthetic oligonucleotide
ttcatggagaacctctcggcgcagctg

SEQ ID NO: 327034 - DNA, 27 bp, Artificial Sequence
  Description of Artificial Sequence: Synthetic oligonucleotide
tcatggagaacctctcggcgcagctgt

SEQ ID NO: 327035 - DNA, 27 bp, Artificial Sequence
  Description of Artificial Sequence: Synthetic oligonucleotide
catggagaacctctcggcgcagctgta

SEQ ID NO: 327036 - DNA, 27 bp, Artificial Sequence
  Description of Artificial Sequence: Synthetic oligonucleotide
atggagaacctctcggcgcagctgtac

SEQ ID NO: 327037 - DNA, 26 bp, Artificial Sequence
  Description of Artificial Sequence: Synthetic oligonucleotide
tggagaacctctcggcgcagctgtac

SEQ ID NO: 327038 - DNA, 25 bp, Artificial Sequence
  Description of Artificial Sequence: Synthetic oligonucleotide
ggagaacctctcggcgcagctgtac

SEQ ID NO: 327039 - DNA, 25 bp, Artificial Sequence
  Description of Artificial Sequence: Synthetic oligonucleotide
gagaacctctcggcgcagctgtacg

SEQ ID NO: 327040 - DNA, 25 bp, Artificial Sequence
  Description of Artificial Sequence: Synthetic oligonucleotide
agaacctctcggcgcagctgtacgg

SEQ ID NO: 327041 - DNA, 24 bp, Artificial Sequence
  Description of Artificial Sequence: Synthetic oligonucleotide
gaacctctcggcgcagctgtacgg

SEQ ID NO: 327042 - DNA, 24 bp, Artificial Sequence
  Description of Artificial Sequence: Synthetic oligonucleotide
aacctctcggcgcagctgtacggc

SEQ ID NO: 327043 - DNA, 23 bp, Artificial Sequence
  Description of Artificial Sequence: Synthetic oligonucleotide
acctctcggcgcagctgtacggc

SEQ ID NO: 327044 - DNA, 22 bp, Artificial Sequence
  Description of Artificial Sequence: Synthetic oligonucleotide
cctctcggcgcagctgtacggc

SEQ ID NO: 327045 - DNA, 23 bp, Artificial Sequence
  Description of Artificial Sequence: Synthetic oligonucleotide
ctctcggcgcagctgtacggcca

SEQ ID NO: 327046 - DNA, 25 bp, Artificial Sequence
  Description of Artificial Sequence: Synthetic oligonucleotide
tctcggcgcagctgtacggccagta

SEQ ID NO: 327047 - DNA, 24 bp, Artificial Sequence
  Description of Artificial Sequence: Synthetic oligonucleotide
ctcggcgcagctgtacggccagta

SEQ ID NO: 327048 - DNA, 26 bp, Artificial Sequence
  Description of Artificial Sequence: Synthetic oligonucleotide
tcggcgcagctgtacggccagtactt

SEQ ID NO: 327049 - DNA, 25 bp, Artificial Sequence
  Description of Artificial Sequence: Synthetic oligonucleotide
cggcgcagctgtacggccagtactt

SEQ ID NO: 327050 - DNA, 26 bp, Artificial Sequence
  Description of Artificial Sequence: Synthetic oligonucleotide
ggcgcagctgtacggccagtacttct

SEQ ID NO: 327051 - DNA, 26 bp, Artificial Sequence
  Description of Artificial Sequence: Synthetic oligonucleotide
gcgcagctgtacggccagtacttctg

SEQ ID NO: 327052 - DNA, 26 bp, Artificial Sequence
  Description of Artificial Sequence: Synthetic oligonucleotide
cgcagctgtacggccagtacttctgc

SEQ ID NO: 327053 - DNA, 27 bp, Artificial Sequence
  Description of Artificial Sequence: Synthetic oligonucleotide
gcagctgtacggccagtacttctgcca

SEQ ID NO: 327054 - DNA, 27 bp, Artificial Sequence
  Description of Artificial Sequence: Synthetic oligonucleotide
cagctgtacggccagtacttctgccag

SEQ ID NO: 327055 - DNA, 27 bp, Artificial Sequence
  Description of Artificial Sequence: Synthetic oligonucleotide
agctgtacggccagtacttctgccagg

SEQ ID NO: 327056 - DNA, 26 bp, Artificial Sequence
  Description of Artificial Sequence: Synthetic oligonucleotide
gctgtacggccagtacttctgccagg

SEQ ID NO: 327057 - DNA, 26 bp, Artificial Sequence
  Description of Artificial Sequence: Synthetic oligonucleotide
ctgtacggccagtacttctgccaggc

SEQ ID NO: 327058 - DNA, 26 bp, Artificial Sequence
  Description of Artificial Sequence: Synthetic oligonucleotide
tgtacggccagtacttctgccaggcc

SEQ ID NO: 327059 - DNA, 25 bp, Artificial Sequence
  Description of Artificial Sequence: Synthetic oligonucleotide
gtacggccagtacttctgccaggcc

SEQ ID NO: 327060 - DNA, 26 bp, Artificial Sequence
  Description of Artificial Sequence: Synthetic oligonucleotide
tacggccagtacttctgccaggccca

SEQ ID NO: 327061 - DNA, 25 bp, Artificial Sequence
  Description of Artificial Sequence: Synthetic oligonucleotide
acggccagtacttctgccaggccca

SEQ ID NO: 327062 - DNA, 24 bp, Artificial Sequence
  Description of Artificial Sequence: Synthetic oligonucleotide
cggccagtacttctgccaggccca

SEQ ID NO: 327063 - DNA, 24 bp, Artificial Sequence
  Description of Artificial Sequence: Synthetic oligonucleotide
ggccagtacttctgccaggcccag

SEQ ID NO: 327064 - DNA, 25 bp, Artificial Sequence
  Description of Artificial Sequence: Synthetic oligonucleotide
gccagtacttctgccaggcccaggt

SEQ ID NO: 327065 - DNA, 25 bp, Artificial Sequence
  Description of Artificial Sequence: Synthetic oligonucleotide
ccagtacttctgccaggcccaggtg

SEQ ID NO: 327066 - DNA, 25 bp, Artificial Sequence
  Description of Artificial Sequence: Synthetic oligonucleotide
cagtacttctgccaggcccaggtgg

SEQ ID NO: 327067 - DNA, 25 bp, Artificial Sequence
  Description of Artificial Sequence: Synthetic oligonucleotide
agtacttctgccaggcccaggtggg

SEQ ID NO: 327068 - DNA, 24 bp, Artificial Sequence
  Description of Artificial Sequence: Synthetic oligonucleotide
gtacttctgccaggcccaggtggg

SEQ ID NO: 327069 - DNA, 25 bp, Artificial Sequence
  Description of Artificial Sequence: Synthetic oligonucleotide
tacttctgccaggcccaggtgggct

SEQ ID NO: 327070 - DNA, 24 bp, Artificial Sequence
  Description of Artificial Sequence: Synthetic oligonucleotide
acttctgccaggcccaggtgggct

SEQ ID NO: 327071 - DNA, 23 bp, Artificial Sequence
  Description of Artificial Sequence: Synthetic oligonucleotide
cttctgccaggcccaggtgggct

SEQ ID NO: 327072 - DNA, 23 bp, Artificial Sequence
  Description of Artificial Sequence: Synthetic oligonucleotide
ttctgccaggcccaggtgggctc

SEQ ID NO: 327073 - DNA, 22 bp, Artificial Sequence
  Description of Artificial Sequence: Synthetic oligonucleotide
tctgccaggcccaggtgggctc

SEQ ID NO: 327074 - DNA, 21 bp, Artificial Sequence
  Description of Artificial Sequence: Synthetic oligonucleotide
ctgccaggcccaggtgggctc

SEQ ID NO: 327075 - DNA, 23 bp, Artificial Sequence
  Description of Artificial Sequence: Synthetic oligonucleotide
tgccaggcccaggtgggctccta

SEQ ID NO: 327076 - DNA, 22 bp, Artificial Sequence
  Description of Artificial Sequence: Synthetic oligonucleotide
gccaggcccaggtgggctccta

SEQ ID NO: 327077 - DNA, 24 bp, Artificial Sequence
  Description of Artificial Sequence: Synthetic oligonucleotide
ccaggcccaggtgggctcctagtt

SEQ ID NO: 327078 - DNA, 24 bp, Artificial Sequence
  Description of Artificial Sequence: Synthetic oligonucleotide
caggcccaggtgggctcctagttc

SEQ ID NO: 327079 - DNA, 24 bp, Artificial Sequence
  Description of Artificial Sequence: Synthetic oligonucleotide
aggcccaggtgggctcctagttcc

SEQ ID NO: 327080 - DNA, 23 bp, Artificial Sequence
  Description of Artificial Sequence: Synthetic oligonucleotide
ggcccaggtgggctcctagttcc

SEQ ID NO: 327081 - DNA, 23 bp, Artificial Sequence
  Description of Artificial Sequence: Synthetic oligonucleotide
gcccaggtgggctcctagttccg

SEQ ID NO: 327082 - DNA, 23 bp, Artificial Sequence
  Description of Artificial Sequence: Synthetic oligonucleotide
cccaggtgggctcctagttccgc

SEQ ID NO: 327083 - DNA, 24 bp, Artificial Sequence
  Description of Artificial Sequence: Synthetic oligonucleotide
ccaggtgggctcctagttccgcga

SEQ ID NO: 327084 - DNA, 24 bp, Artificial Sequence
  Description of Artificial Sequence: Synthetic oligonucleotide
caggtgggctcctagttccgcgag

SEQ ID NO: 327085 - DNA, 24 bp, Artificial Sequence
  Description of Artificial Sequence: Synthetic oligonucleotide
aggtgggctcctagttccgcgagc

SEQ ID NO: 327086 - DNA, 23 bp, Artificial Sequence
  Description of Artificial Sequence: Synthetic oligonucleotide
ggtgggctcctagttccgcgagc

SEQ ID NO: 327087 - DNA, 24 bp, Artificial Sequence
  Description of Artificial Sequence: Synthetic oligonucleotide
gtgggctcctagttccgcgagcct

SEQ ID NO: 327088 - DNA, 25 bp, Artificial Sequence
  Description of Artificial Sequence: Synthetic oligonucleotide
tgggctcctagttccgcgagcctca

SEQ ID NO: 327089 - DNA, 24 bp, Artificial Sequence
  Description of Artificial Sequence: Synthetic oligonucleotide
gggctcctagttccgcgagcctca

SEQ ID NO: 327090 - DNA, 24 bp, Artificial Sequence
  Description of Artificial Sequence: Synthetic oligonucleotide
ggctcctagttccgcgagcctcag

SEQ ID NO: 327091 - DNA, 25 bp, Artificial Sequence
  Description of Artificial Sequence: Synthetic oligonucleotide
gctcctagttccgcgagcctcagca

SEQ ID NO: 327092 - DNA, 26 bp, Artificial Sequence
  Description of Artificial Sequence: Synthetic oligonucleotide
ctcctagttccgcgagcctcagcact

SEQ ID NO: 327093 - DNA, 26 bp, Artificial Sequence
  Description of Artificial Sequence: Synthetic oligonucleotide
tcctagttccgcgagcctcagcactc

SEQ ID NO: 327094 - DNA, 25 bp, Artificial Sequence
  Description of Artificial Sequence: Synthetic oligonucleotide
cctagttccgcgagcctcagcactc

SEQ ID NO: 327095 - DNA, 25 bp, Artificial Sequence
  Description of Artificial Sequence: Synthetic oligonucleotide
ctagttccgcgagcctcagcactcg

SEQ ID NO: 327096 - DNA, 26 bp, Artificial Sequence
  Description of Artificial Sequence: Synthetic oligonucleotide
tagttccgcgagcctcagcactcgca

SEQ ID NO: 327097 - DNA, 25 bp, Artificial Sequence
  Description of Artificial Sequence: Synthetic oligonucleotide
agttccgcgagcctcagcactcgca

SEQ ID NO: 327098 - DNA, 24 bp, Artificial Sequence
  Description of Artificial Sequence: Synthetic oligonucleotide
gttccgcgagcctcagcactcgca

SEQ ID NO: 327099 - DNA, 24 bp, Artificial Sequence
  Description of Artificial Sequence: Synthetic oligonucleotide
ttccgcgagcctcagcactcgcag

SEQ ID NO: 327100 - DNA, 23 bp, Artificial Sequence
  Description of Artificial Sequence: Synthetic oligonucleotide
tccgcgagcctcagcactcgcag

SEQ ID NO: 327101 - DNA, 22 bp, Artificial Sequence
  Description of Artificial Sequence: Synthetic oligonucleotide
ccgcgagcctcagcactcgcag

SEQ ID NO: 327102 - DNA, 23 bp, Artificial Sequence
  Description of Artificial Sequence: Synthetic oligonucleotide
cgcgagcctcagcactcgcagct

SEQ ID NO: 327103 - DNA, 23 bp, Artificial Sequence
  Description of Artificial Sequence: Synthetic oligonucleotide
gcgagcctcagcactcgcagctg

SEQ ID NO: 327104 - DNA, 24 bp, Artificial Sequence
  Description of Artificial Sequence: Synthetic oligonucleotide
cgagcctcagcactcgcagctgct

SEQ ID NO: 327105 - DNA, 24 bp, Artificial Sequence
  Description of Artificial Sequence: Synthetic oligonucleotide
gagcctcagcactcgcagctgctc

SEQ ID NO: 327106 - DNA, 24 bp, Artificial Sequence
  Description of Artificial Sequence: Synthetic oligonucleotide
agcctcagcactcgcagctgctcc

SEQ ID NO: 327107 - DNA, 23 bp, Artificial Sequence
  Description of Artificial Sequence: Synthetic oligonucleotide
gcctcagcactcgcagctgctcc

SEQ ID NO: 327108 - DNA, 23 bp, Artificial Sequence
  Description of Artificial Sequence: Synthetic oligonucleotide
cctcagcactcgcagctgctccc

SEQ ID NO: 327109 - DNA, 23 bp, Artificial Sequence
  Description of Artificial Sequence: Synthetic oligonucleotide
ctcagcactcgcagctgctcccc

SEQ ID NO: 327110 - DNA, 24 bp, Artificial Sequence
  Description of Artificial Sequence: Synthetic oligonucleotide
tcagcactcgcagctgctccccga

SEQ ID NO: 327111 - DNA, 23 bp, Artificial Sequence
  Description of Artificial Sequence: Synthetic oligonucleotide
cagcactcgcagctgctccccga

SEQ ID NO: 327112 - DNA, 23 bp, Artificial Sequence
  Description of Artificial Sequence: Synthetic oligonucleotide
agcactcgcagctgctccccgag

SEQ ID NO: 327113 - DNA, 22 bp, Artificial Sequence
  Description of Artificial Sequence: Synthetic oligonucleotide
gcactcgcagctgctccccgag

SEQ ID NO: 327114 - DNA, 23 bp, Artificial Sequence
  Description of Artificial Sequence: Synthetic oligonucleotide
cactcgcagctgctccccgagga

SEQ ID NO: 327115 - DNA, 23 bp, Artificial Sequence
  Description of Artificial Sequence: Synthetic oligonucleotide
actcgcagctgctccccgaggac

SEQ ID NO: 327116 - DNA, 22 bp, Artificial Sequence
  Description of Artificial Sequence: Synthetic oligonucleotide
ctcgcagctgctccccgaggac

SEQ ID NO: 327117 - DNA, 22 bp, Artificial Sequence
  Description of Artificial Sequence: Synthetic oligonucleotide
tcgcagctgctccccgaggacc

SEQ ID NO: 327118 - DNA, 21 bp, Artificial Sequence
  Description of Artificial Sequence: Synthetic oligonucleotide
cgcagctgctccccgaggacc

SEQ ID NO: 327119 - DNA, 21 bp, Artificial Sequence
  Description of Artificial Sequence: Synthetic oligonucleotide
gcagctgctccccgaggaccg

SEQ ID NO: 327120 - DNA, 23 bp, Artificial Sequence
  Description of Artificial Sequence: Synthetic oligonucleotide
cagctgctccccgaggaccgcat

SEQ ID NO: 327121 - DNA, 25 bp, Artificial Sequence
  Description of Artificial Sequence: Synthetic oligonucleotide
agctgctccccgaggaccgcatcat

SEQ ID NO: 327122 - DNA, 24 bp, Artificial Sequence
  Description of Artificial Sequence: Synthetic oligonucleotide
gctgctccccgaggaccgcatcat

SEQ ID NO: 327123 - DNA, 24 bp, Artificial Sequence
  Description of Artificial Sequence: Synthetic oligonucleotide
ctgctccccgaggaccgcatcatg

SEQ ID NO: 327124 - DNA, 24 bp, Artificial Sequence
  Description of Artificial Sequence: Synthetic oligonucleotide
tgctccccgaggaccgcatcatgg

SEQ ID NO: 327125 - DNA, 23 bp, Artificial Sequence
  Description of Artificial Sequence: Synthetic oligonucleotide
gctccccgaggaccgcatcatgg

SEQ ID NO: 327126 - DNA, 23 bp, Artificial Sequence
  Description of Artificial Sequence: Synthetic oligonucleotide
ctccccgaggaccgcatcatggg

SEQ ID NO: 327127 - DNA, 23 bp, Artificial Sequence
  Description of Artificial Sequence: Synthetic oligonucleotide
tccccgaggaccgcatcatgggc

SEQ ID NO: 327128 - DNA, 22 bp, Artificial Sequence
  Description of Artificial Sequence: Synthetic oligonucleotide
ccccgaggaccgcatcatgggc

SEQ ID NO: 327129 - DNA, 23 bp, Artificial Sequence
  Description of Artificial Sequence: Synthetic oligonucleotide
cccgaggaccgcatcatgggcga

SEQ ID NO: 327130 - DNA, 23 bp, Artificial Sequence
  Description of Artificial Sequence: Synthetic oligonucleotide
ccgaggaccgcatcatgggcgag

SEQ ID NO: 327131 - DNA, 24 bp, Artificial Sequence
  Description of Artificial Sequence: Synthetic oligonucleotide
cgaggaccgcatcatgggcgagca

SEQ ID NO: 327132 - DNA, 24 bp, Artificial Sequence
  Description of Artificial Sequence: Synthetic oligonucleotide
gaggaccgcatcatgggcgagcac

SEQ ID NO: 327133 - DNA, 25 bp, Artificial Sequence
  Description of Artificial Sequence: Synthetic oligonucleotide
aggaccgcatcatgggcgagcacct

SEQ ID NO: 327134 - DNA, 24 bp, Artificial Sequence
  Description of Artificial Sequence: Synthetic oligonucleotide
ggaccgcatcatgggcgagcacct

SEQ ID NO: 327135 - DNA, 24 bp, Artificial Sequence
  Description of Artificial Sequence: Synthetic oligonucleotide
gaccgcatcatgggcgagcacctc

SEQ ID NO: 327136 - DNA, 25 bp, Artificial Sequence
  Description of Artificial Sequence: Synthetic oligonucleotide
accgcatcatgggcgagcacctcct

SEQ ID NO: 327137 - DNA, 24 bp, Artificial Sequence
  Description of Artificial Sequence: Synthetic oligonucleotide
ccgcatcatgggcgagcacctcct

SEQ ID NO: 327138 - DNA, 24 bp, Artificial Sequence
  Description of Artificial Sequence: Synthetic oligonucleotide
cgcatcatgggcgagcacctcctg

SEQ ID NO: 327139 - DNA, 24 bp, Artificial Sequence
  Description of Artificial Sequence: Synthetic oligonucleotide
gcatcatgggcgagcacctcctgg

SEQ ID NO: 327140 - DNA, 25 bp, Artificial Sequence
  Description of Artificial Sequence: Synthetic oligonucleotide
catcatgggcgagcacctcctgggt

SEQ ID NO: 327141 - DNA, 27 bp, Artificial Sequence
  Description of Artificial Sequence: Synthetic oligonucleotide
atcatgggcgagcacctcctgggtcat

SEQ ID NO: 327142 - DNA, 26 bp, Artificial Sequence
  Description of Artificial Sequence: Synthetic oligonucleotide
tcatgggcgagcacctcctgggtcat

SEQ ID NO: 327143 - DNA, 25 bp, Artificial Sequence
  Description of Artificial Sequence: Synthetic oligonucleotide
catgggcgagcacctcctgggtcat

SEQ ID NO: 327144 - DNA, 25 bp, Artificial Sequence
  Description of Artificial Sequence: Synthetic oligonucleotide
atgggcgagcacctcctgggtcatc

SEQ ID NO: 327145 - DNA, 24 bp, Artificial Sequence
  Description of Artificial Sequence: Synthetic oligonucleotide
tgggcgagcacctcctgggtcatc

SEQ ID NO: 327146 - DNA, 23 bp, Artificial Sequence
  Description of Artificial Sequence: Synthetic oligonucleotide
gggcgagcacctcctgggtcatc

SEQ ID NO: 327147 - DNA, 23 bp, Artificial Sequence
  Description of Artificial Sequence: Synthetic oligonucleotide
ggcgagcacctcctgggtcatcc

SEQ ID NO: 327148 - DNA, 24 bp, Artificial Sequence
  Description of Artificial Sequence: Synthetic oligonucleotide
gcgagcacctcctgggtcatccct

SEQ ID NO: 327149 - DNA, 25 bp, Artificial Sequence
  Description of Artificial Sequence: Synthetic oligonucleotide
cgagcacctcctgggtcatccctgt

SEQ ID NO: 327150 - DNA, 25 bp, Artificial Sequence
  Description of Artificial Sequence: Synthetic oligonucleotide
gagcacctcctgggtcatccctgtg

SEQ ID NO: 327151 - DNA, 25 bp, Artificial Sequence
  Description of Artificial Sequence: Synthetic oligonucleotide
agcacctcctgggtcatccctgtgc

SEQ ID NO: 327152 - DNA, 24 bp, Artificial Sequence
  Description of Artificial Sequence: Synthetic oligonucleotide
gcacctcctgggtcatccctgtgc

SEQ ID NO: 327153 - DNA, 24 bp, Artificial Sequence
  Description of Artificial Sequence: Synthetic oligonucleotide
cacctcctgggtcatccctgtgcc

SEQ ID NO: 327154 - DNA, 25 bp, Artificial Sequence
  Description of Artificial Sequence: Synthetic oligonucleotide
acctcctgggtcatccctgtgccca

SEQ ID NO: 327155 - DNA, 24 bp, Artificial Sequence
  Description of Artificial Sequence: Synthetic oligonucleotide
cctcctgggtcatccctgtgccca

SEQ ID NO: 327156 - DNA, 24 bp, Artificial Sequence
  Description of Artificial Sequence: Synthetic oligonucleotide
ctcctgggtcatccctgtgcccag

SEQ ID NO: 327157 - DNA, 24 bp, Artificial Sequence
  Description of Artificial Sequence: Synthetic oligonucleotide
tcctgggtcatccctgtgcccagg

SEQ ID NO: 327158 - DNA, 23 bp, Artificial Sequence
  Description of Artificial Sequence: Synthetic oligonucleotide
cctgggtcatccctgtgcccagg

SEQ ID NO: 327159 - DNA, 23 bp, Artificial Sequence
  Description of Artificial Sequence: Synthetic oligonucleotide
ctgggtcatccctgtgcccaggc

SEQ ID NO: 327160 - DNA, 23 bp, Artificial Sequence
  Description of Artificial Sequence: Synthetic oligonucleotide
tgggtcatccctgtgcccaggcc

SEQ ID NO: 327161 - DNA, 22 bp, Artificial Sequence
  Description of Artificial Sequence: Synthetic oligonucleotide
gggtcatccctgtgcccaggcc

SEQ ID NO: 327162 - DNA, 22 bp, Artificial Sequence
  Description of Artificial Sequence: Synthetic oligonucleotide
ggtcatccctgtgcccaggccg

SEQ ID NO: 327163 - DNA, 22 bp, Artificial Sequence
  Description of Artificial Sequence: Synthetic oligonucleotide
gtcatccctgtgcccaggccgc

SEQ ID NO: 327164 - DNA, 23 bp, Artificial Sequence
  Description of Artificial Sequence: Synthetic oligonucleotide
tcatccctgtgcccaggccgcct

SEQ ID NO: 327165 - DNA, 22 bp, Artificial Sequence
  Description of Artificial Sequence: Synthetic oligonucleotide
catccctgtgcccaggccgcct

SEQ ID NO: 327166 - DNA, 22 bp, Artificial Sequence
  Description of Artificial Sequence: Synthetic oligonucleotide
atccctgtgcccaggccgcctc

SEQ ID NO: 327167 - DNA, 21 bp, Artificial Sequence
  Description of Artificial Sequence: Synthetic oligonucleotide
tccctgtgcccaggccgcctc

SEQ ID NO: 327168 - DNA, 20 bp, Artificial Sequence
  Description of Artificial Sequence: Synthetic oligonucleotide
ccctgtgcccaggccgcctc

SEQ ID NO: 327169 - DNA, 20 bp, Artificial Sequence
  Description of Artificial Sequence: Synthetic oligonucleotide
cctgtgcccaggccgcctcg

SEQ ID NO: 327170 - DNA, 21 bp, Artificial Sequence
  Description of Artificial Sequence: Synthetic oligonucleotide
ctgtgcccaggccgcctcgct

SEQ ID NO: 327171 - DNA, 22 bp, Artificial Sequence
  Description of Artificial Sequence: Synthetic oligonucleotide
tgtgcccaggccgcctcgctct

SEQ ID NO: 327172 - DNA, 21 bp, Artificial Sequence
  Description of Artificial Sequence: Synthetic oligonucleotide
gtgcccaggccgcctcgctct

SEQ ID NO: 327173 - DNA, 21 bp, Artificial Sequence
  Description of Artificial Sequence: Synthetic oligonucleotide
tgcccaggccgcctcgctctg

SEQ ID NO: 327174 - DNA, 20 bp, Artificial Sequence
  Description of Artificial Sequence: Synthetic oligonucleotide
gcccaggccgcctcgctctg

SEQ ID NO: 327175 - DNA, 20 bp, Artificial Sequence
  Description of Artificial Sequence: Synthetic oligonucleotide
cccaggccgcctcgctctgg

SEQ ID NO: 327176 - DNA, 21 bp, Artificial Sequence
  Description of Artificial Sequence: Synthetic oligonucleotide
ccaggccgcctcgctctggct

SEQ ID NO: 327177 - DNA, 21 bp, Artificial Sequence
  Description of Artificial Sequence: Synthetic oligonucleotide
caggccgcctcgctctggctg

SEQ ID NO: 327178 - DNA, 21 bp, Artificial Sequence
  Description of Artificial Sequence: Synthetic oligonucleotide
aggccgcctcgctctggctgc

SEQ ID NO: 327179 - DNA, 20 bp, Artificial Sequence
  Description of Artificial Sequence: Synthetic oligonucleotide
ggccgcctcgctctggctgc

SEQ ID NO: 327180 - DNA, 20 bp, Artificial Sequence
  Description of Artificial Sequence: Synthetic oligonucleotide
gccgcctcgctctggctgcg

SEQ ID NO: 327181 - DNA, 20 bp, Artificial Sequence
  Description of Artificial Sequence: Synthetic oligonucleotide
ccgcctcgctctggctgcgg

SEQ ID NO: 327182 - DNA, 21 bp, Artificial Sequence
  Description of Artificial Sequence: Synthetic oligonucleotide
cgcctcgctctggctgcgggt

SEQ ID NO: 327183 - DNA, 21 bp, Artificial Sequence
  Description of Artificial Sequence: Synthetic oligonucleotide
gcctcgctctggctgcgggtg

SEQ ID NO: 327184 - DNA, 22 bp, Artificial Sequence
  Description of Artificial Sequence: Synthetic oligonucleotide
cctcgctctggctgcgggtgct

SEQ ID NO: 327185 - DNA, 22 bp, Artificial Sequence
  Description of Artificial Sequence: Synthetic oligonucleotide
ctcgctctggctgcgggtgctg

SEQ ID NO: 327186 - DNA, 22 bp, Artificial Sequence
  Description of Artificial Sequence: Synthetic oligonucleotide
tcgctctggctgcgggtgctgc

SEQ ID NO: 327187 - DNA, 21 bp, Artificial Sequence
  Description of Artificial Sequence: Synthetic oligonucleotide
cgctctggctgcgggtgctgc

SEQ ID NO: 327188 - DNA, 21 bp, Artificial Sequence
  Description of Artificial Sequence: Synthetic oligonucleotide
gctctggctgcgggtgctgcg

SEQ ID NO: 327189 - DNA, 22 bp, Artificial Sequence
  Description of Artificial Sequence: Synthetic oligonucleotide
ctctggctgcgggtgctgcgca

SEQ ID NO: 327190 - DNA, 23 bp, Artificial Sequence
  Description of Artificial Sequence: Synthetic oligonucleotide
tctggctgcgggtgctgcgcaca

SEQ ID NO: 327191 - DNA, 22 bp, Artificial Sequence
  Description of Artificial Sequence: Synthetic oligonucleotide
ctggctgcgggtgctgcgcaca

SEQ ID NO: 327192 - DNA, 23 bp, Artificial Sequence
  Description of Artificial Sequence: Synthetic oligonucleotide
tggctgcgggtgctgcgcacact

SEQ ID NO: 327193 - DNA, 22 bp, Artificial Sequence
  Description of Artificial Sequence: Synthetic oligonucleotide
ggctgcgggtgctgcgcacact

SEQ ID NO: 327194 - DNA, 23 bp, Artificial Sequence
  Description of Artificial Sequence: Synthetic oligonucleotide
gctgcgggtgctgcgcacactca

SEQ ID NO: 327195 - DNA, 24 bp, Artificial Sequence
  Description of Artificial Sequence: Synthetic oligonucleotide
ctgcgggtgctgcgcacactcaca

SEQ ID NO: 327196 - DNA, 26 bp, Artificial Sequence
  Description of Artificial Sequence: Synthetic oligonucleotide
tgcgggtgctgcgcacactcacactt

SEQ ID NO: 327197 - DNA, 25 bp, Artificial Sequence
  Description of Artificial Sequence: Synthetic oligonucleotide
gcgggtgctgcgcacactcacactt

SEQ ID NO: 327198 - DNA, 25 bp, Artificial Sequence
  Description of Artificial Sequence: Synthetic oligonucleotide
cgggtgctgcgcacactcacacttg

SEQ ID NO: 327199 - DNA, 25 bp, Artificial Sequence
  Description of Artificial Sequence: Synthetic oligonucleotide
gggtgctgcgcacactcacacttgg

SEQ ID NO: 327200 - DNA, 27 bp, Artificial Sequence
  Description of Artificial Sequence: Synthetic oligonucleotide
ggtgctgcgcacactcacacttggctt

SEQ ID NO: 327201 - DNA, 27 bp, Artificial Sequence
  Description of Artificial Sequence: Synthetic oligonucleotide
gtgctgcgcacactcacacttggcttg

SEQ ID NO: 327202 - DNA, 27 bp, Artificial Sequence
  Description of Artificial Sequence: Synthetic oligonucleotide
tgctgcgcacactcacacttggcttgg

SEQ ID NO: 327203 - DNA, 27 bp, Artificial Sequence
  Description of Artificial Sequence: Synthetic oligonucleotide
gctgcgcacactcacacttggcttggt

SEQ ID NO: 327204 - DNA, 27 bp, Artificial Sequence
  Description of Artificial Sequence: Synthetic oligonucleotide
ctgcgcacactcacacttggcttggtg

SEQ ID NO: 327205 - DNA, 27 bp, Artificial Sequence
  Description of Artificial Sequence: Synthetic oligonucleotide
tgcgcacactcacacttggcttggtgg

SEQ ID NO: 327206 - DNA, 27 bp, Artificial Sequence
  Description of Artificial Sequence: Synthetic oligonucleotide
gcgcacactcacacttggcttggtggt

SEQ ID NO: 327207 - DNA, 27 bp, Artificial Sequence
  Description of Artificial Sequence: Synthetic oligonucleotide
cgcacactcacacttggcttggtggtc

SEQ ID NO: 327208 - DNA, 27 bp, Artificial Sequence
  Description of Artificial Sequence: Synthetic oligonucleotide
gcacactcacacttggcttggtggtcc

SEQ ID NO: 327209 - DNA, 28 bp, Artificial Sequence
  Description of Artificial Sequence: Synthetic oligonucleotide
cacactcacacttggcttggtggtccac

SEQ ID NO: 327210 - DNA, 30 bp, Artificial Sequence
  Description of Artificial Sequence: Synthetic oligonucleotide
acactcacacttggcttggtggtccacttg

SEQ ID NO: 327211 - DNA, 30 bp, Artificial Sequence
  Description of Artificial Sequence: Synthetic oligonucleotide
atggaaggtcgggaccaaactgaggaagac

SEQ ID NO: 327212 - DNA, 29 bp, Artificial Sequence
  Description of Artificial Sequence: Synthetic oligonucleotide
tggaaggtcgggaccaaactgaggaagac

SEQ ID NO: 327213 - DNA, 28 bp, Artificial Sequence
  Description of Artificial Sequence: Synthetic oligonucleotide
ggaaggtcgggaccaaactgaggaagac

SEQ ID NO: 327214 - DNA, 28 bp, Artificial Sequence
  Description of Artificial Sequence: Synthetic oligonucleotide
gaaggtcgggaccaaactgaggaagacc

SEQ ID NO: 327215 - DNA, 28 bp, Artificial Sequence
  Description of Artificial Sequence: Synthetic oligonucleotide
aaggtcgggaccaaactgaggaagaccc

SEQ ID NO: 327216 - DNA, 27 bp, Artificial Sequence
  Description of Artificial Sequence: Synthetic oligonucleotide
aggtcgggaccaaactgaggaagaccc

SEQ ID NO: 327217 - DNA, 26 bp, Artificial Sequence
  Description of Artificial Sequence: Synthetic oligonucleotide
ggtcgggaccaaactgaggaagaccc

SEQ ID NO: 327218 - DNA, 27 bp, Artificial Sequence
  Description of Artificial Sequence: Synthetic oligonucleotide
gtcgggaccaaactgaggaagacccga

SEQ ID NO: 327219 - DNA, 27 bp, Artificial Sequence
  Description of Artificial Sequence: Synthetic oligonucleotide
tcgggaccaaactgaggaagacccgag

SEQ ID NO: 327220 - DNA, 26 bp, Artificial Sequence
  Description of Artificial Sequence: Synthetic oligonucleotide
cgggaccaaactgaggaagacccgag

SEQ ID NO: 327221 - DNA, 26 bp, Artificial Sequence
  Description of Artificial Sequence: Synthetic oligonucleotide
gggaccaaactgaggaagacccgagg

SEQ ID NO: 327222 - DNA, 27 bp, Artificial Sequence
  Description of Artificial Sequence: Synthetic oligonucleotide
ggaccaaactgaggaagacccgaggga

SEQ ID NO: 327223 - DNA, 28 bp, Artificial Sequence
  Description of Artificial Sequence: Synthetic oligonucleotide
gaccaaactgaggaagacccgagggaag

SEQ ID NO: 327224 - DNA, 28 bp, Artificial Sequence
  Description of Artificial Sequence: Synthetic oligonucleotide
accaaactgaggaagacccgagggaagg

SEQ ID NO: 327225 - DNA, 27 bp, Artificial Sequence
  Description of Artificial Sequence: Synthetic oligonucleotide
ccaaactgaggaagacccgagggaagg

SEQ ID NO: 327226 - DNA, 27 bp, Artificial Sequence
  Description of Artificial Sequence: Synthetic oligonucleotide
caaactgaggaagacccgagggaaggc

SEQ ID NO: 327227 - DNA, 28 bp, Artificial Sequence
  Description of Artificial Sequence: Synthetic oligonucleotide
aaactgaggaagacccgagggaaggcag

SEQ ID NO: 327228 - DNA, 27 bp, Artificial Sequence
  Description of Artificial Sequence: Synthetic oligonucleotide
aactgaggaagacccgagggaaggcag

SEQ ID NO: 327229 - DNA, 26 bp, Artificial Sequence
  Description of Artificial Sequence: Synthetic oligonucleotide
actgaggaagacccgagggaaggcag

SEQ ID NO: 327230 - DNA, 25 bp, Artificial Sequence
  Description of Artificial Sequence: Synthetic oligonucleotide
ctgaggaagacccgagggaaggcag

SEQ ID NO: 327231 - DNA, 25 bp, Artificial Sequence
  Description of Artificial Sequence: Synthetic oligonucleotide
tgaggaagacccgagggaaggcagc

SEQ ID NO: 327232 - DNA, 24 bp, Artificial Sequence
  Description of Artificial Sequence: Synthetic oligonucleotide
gaggaagacccgagggaaggcagc

SEQ ID NO: 327233 - DNA, 25 bp, Artificial Sequence
  Description of Artificial Sequence: Synthetic oligonucleotide
aggaagacccgagggaaggcagcca

SEQ ID NO: 327234 - DNA, 24 bp, Artificial Sequence
  Description of Artificial Sequence: Synthetic oligonucleotide
ggaagacccgagggaaggcagcca

SEQ ID NO: 327235 - DNA, 24 bp, Artificial Sequence
  Description of Artificial Sequence: Synthetic oligonucleotide
gaagacccgagggaaggcagccag

SEQ ID NO: 327236 - DNA, 24 bp, Artificial Sequence
  Description of Artificial Sequence: Synthetic oligonucleotide
aagacccgagggaaggcagccagg

SEQ ID NO: 327237 - DNA, 23 bp, Artificial Sequence
  Description of Artificial Sequence: Synthetic oligonucleotide
agacccgagggaaggcagccagg

SEQ ID NO: 327238 - DNA, 22 bp, Artificial Sequence
  Description of Artificial Sequence: Synthetic oligonucleotide
gacccgagggaaggcagccagg

SEQ ID NO: 327239 - DNA, 23 bp, Artificial Sequence
  Description of Artificial Sequence: Synthetic oligonucleotide
acccgagggaaggcagccaggga

SEQ ID NO: 327240 - DNA, 22 bp, Artificial Sequence
  Description of Artificial Sequence: Synthetic oligonucleotide
cccgagggaaggcagccaggga

SEQ ID NO: 327241 - DNA, 22 bp, Artificial Sequence
  Description of Artificial Sequence: Synthetic oligonucleotide
ccgagggaaggcagccagggag

SEQ ID NO: 327242 - DNA, 23 bp, Artificial Sequence
  Description of Artificial Sequence: Synthetic oligonucleotide
cgagggaaggcagccagggaggt

SEQ ID NO: 327243 - DNA, 23 bp, Artificial Sequence
  Description of Artificial Sequence: Synthetic oligonucleotide
gagggaaggcagccagggaggtg

SEQ ID NO: 327244 - DNA, 26 bp, Artificial Sequence
  Description of Artificial Sequence: Synthetic oligonucleotide
agggaaggcagccagggaggtggaat

SEQ ID NO: 327245 - DNA, 25 bp, Artificial Sequence
  Description of Artificial Sequence: Synthetic oligonucleotide
gggaaggcagccagggaggtggaat

SEQ ID NO: 327246 - DNA, 25 bp, Artificial Sequence
  Description of Artificial Sequence: Synthetic oligonucleotide
ggaaggcagccagggaggtggaatc

SEQ ID NO: 327247 - DNA, 25 bp, Artificial Sequence
  Description of Artificial Sequence: Synthetic oligonucleotide
gaaggcagccagggaggtggaatcg

SEQ ID NO: 327248 - DNA, 27 bp, Artificial Sequence
  Description of Artificial Sequence: Synthetic oligonucleotide
aaggcagccagggaggtggaatcggaa

SEQ ID NO: 327249 - DNA, 26 bp, Artificial Sequence
  Description of Artificial Sequence: Synthetic oligonucleotide
aggcagccagggaggtggaatcggaa

SEQ ID NO: 327250 - DNA, 25 bp, Artificial Sequence
  Description of Artificial Sequence: Synthetic oligonucleotide
ggcagccagggaggtggaatcggaa

SEQ ID NO: 327251 - DNA, 26 bp, Artificial Sequence
  Description of Artificial Sequence: Synthetic oligonucleotide
gcagccagggaggtggaatcggaact

SEQ ID NO: 327252 - DNA, 27 bp, Artificial Sequence
  Description of Artificial Sequence: Synthetic oligonucleotide
cagccagggaggtggaatcggaactct

SEQ ID NO: 327253 - DNA, 27 bp, Artificial Sequence
  Description of Artificial Sequence: Synthetic oligonucleotide
agccagggaggtggaatcggaactctc

SEQ ID NO: 327254 - DNA, 27 bp, Artificial Sequence
  Description of Artificial Sequence: Synthetic oligonucleotide
gccagggaggtggaatcggaactctca

SEQ ID NO: 327255 - DNA, 27 bp, Artificial Sequence
  Description of Artificial Sequence: Synthetic oligonucleotide
ccagggaggtggaatcggaactctcag

SEQ ID NO: 327256 - DNA, 27 bp, Artificial Sequence
  Description of Artificial Sequence: Synthetic oligonucleotide
cagggaggtggaatcggaactctcagg

SEQ ID NO: 327257 - DNA, 28 bp, Artificial Sequence
  Description of Artificial Sequence: Synthetic oligonucleotide
agggaggtggaatcggaactctcaggag

SEQ ID NO: 327258 - DNA, 27 bp, Artificial Sequence
  Description of Artificial Sequence: Synthetic oligonucleotide
gggaggtggaatcggaactctcaggag

SEQ ID NO: 327259 - DNA, 27 bp, Artificial Sequence
  Description of Artificial Sequence: Synthetic oligonucleotide
ggaggtggaatcggaactctcaggagc

SEQ ID NO: 327260 - DNA, 27 bp, Artificial Sequence
  Description of Artificial Sequence: Synthetic oligonucleotide
gaggtggaatcggaactctcaggagcc

SEQ ID NO: 327261 - DNA, 29 bp, Artificial Sequence
  Description of Artificial Sequence: Synthetic oligonucleotide
aggtggaatcggaactctcaggagccaag

SEQ ID NO: 327262 - DNA, 28 bp, Artificial Sequence
  Description of Artificial Sequence: Synthetic oligonucleotide
ggtggaatcggaactctcaggagccaag

SEQ ID NO: 327263 - DNA, 29 bp, Artificial Sequence
  Description of Artificial Sequence: Synthetic oligonucleotide
gtggaatcggaactctcaggagccaagtg

SEQ ID NO: 327264 - DNA, 30 bp, Artificial Sequence
  Description of Artificial Sequence: Synthetic oligonucleotide
tggaatcggaactctcaggagccaagtgag

SEQ ID NO: 327265 - DNA, 29 bp, Artificial Sequence
  Description of Artificial Sequence: Synthetic oligonucleotide
ggaatcggaactctcaggagccaagtgag

SEQ ID NO: 327266 - DNA, 29 bp, Artificial Sequence
  Description of Artificial Sequence: Synthetic oligonucleotide
gaatcggaactctcaggagccaagtgagc

SEQ ID NO: 327267 - DNA, 30 bp, Artificial Sequence
  Description of Artificial Sequence: Synthetic oligonucleotide
aatcggaactctcaggagccaagtgagcac

SEQ ID NO: 327268 - DNA, 29 bp, Artificial Sequence
  Description of Artificial Sequence: Synthetic oligonucleotide
atcggaactctcaggagccaagtgagcac

SEQ ID NO: 327269 - DNA, 28 bp, Artificial Sequence
  Description of Artificial Sequence: Synthetic oligonucleotide
tcggaactctcaggagccaagtgagcac

SEQ ID NO: 327270 - DNA, 27 bp, Artificial Sequence
  Description of Artificial Sequence: Synthetic oligonucleotide
cggaactctcaggagccaagtgagcac

SEQ ID NO: 327271 - DNA, 28 bp, Artificial Sequence
  Description of Artificial Sequence: Synthetic oligonucleotide
ggaactctcaggagccaagtgagcactc

SEQ ID NO: 327272 - DNA, 28 bp, Artificial Sequence
  Description of Artificial Sequence: Synthetic oligonucleotide
gaactctcaggagccaagtgagcactcc

SEQ ID NO: 327273 - DNA, 29 bp, Artificial Sequence
  Description of Artificial Sequence: Synthetic oligonucleotide
aactctcaggagccaagtgagcactcctg

SEQ ID NO: 327274 - DNA, 28 bp, Artificial Sequence
  Description of Artificial Sequence: Synthetic oligonucleotide
actctcaggagccaagtgagcactcctg

SEQ ID NO: 327275 - DNA, 27 bp, Artificial Sequence
  Description of Artificial Sequence: Synthetic oligonucleotide
ctctcaggagccaagtgagcactcctg

SEQ ID NO: 327276 - DNA, 29 bp, Artificial Sequence
  Description of Artificial Sequence: Synthetic oligonucleotide
tctcaggagccaagtgagcactcctgaag

SEQ ID NO: 327277 - DNA, 28 bp, Artificial Sequence
  Description of Artificial Sequence: Synthetic oligonucleotide
ctcaggagccaagtgagcactcctgaag

SEQ ID NO: 327278 - DNA, 29 bp, Artificial Sequence
  Description of Artificial Sequence: Synthetic oligonucleotide
tcaggagccaagtgagcactcctgaagag

SEQ ID NO: 327279 - DNA, 28 bp, Artificial Sequence
  Description of Artificial Sequence: Synthetic oligonucleotide
caggagccaagtgagcactcctgaagag

SEQ ID NO: 327280 - DNA, 29 bp, Artificial Sequence
  Description of Artificial Sequence: Synthetic oligonucleotide
aggagccaagtgagcactcctgaagagag

SEQ ID NO: 327281 - DNA, 28 bp, Artificial Sequence
  Description of Artificial Sequence: Synthetic oligonucleotide
ggagccaagtgagcactcctgaagagag

SEQ ID NO: 327282 - DNA, 28 bp, Artificial Sequence
  Description of Artificial Sequence: Synthetic oligonucleotide
gagccaagtgagcactcctgaagagagg

SEQ ID NO: 327283 - DNA, 28 bp, Artificial Sequence
  Description of Artificial Sequence: Synthetic oligonucleotide
agccaagtgagcactcctgaagagaggg

SEQ ID NO: 327284 - DNA, 27 bp, Artificial Sequence
  Description of Artificial Sequence: Synthetic oligonucleotide
gccaagtgagcactcctgaagagaggg

SEQ ID NO: 327285 - DNA, 28 bp, Artificial Sequence
  Description of Artificial Sequence: Synthetic oligonucleotide
ccaagtgagcactcctgaagagagggtg

SEQ ID NO: 327286 - DNA, 28 bp, Artificial Sequence
  Description of Artificial Sequence: Synthetic oligonucleotide
caagtgagcactcctgaagagagggtgc

SEQ ID NO: 327287 - DNA, 28 bp, Artificial Sequence
  Description of Artificial Sequence: Synthetic oligonucleotide
aagtgagcactcctgaagagagggtgcc

SEQ ID NO: 327288 - DNA, 27 bp, Artificial Sequence
  Description of Artificial Sequence: Synthetic oligonucleotide
agtgagcactcctgaagagagggtgcc

SEQ ID NO: 327289 - DNA, 26 bp, Artificial Sequence
  Description of Artificial Sequence: Synthetic oligonucleotide
gtgagcactcctgaagagagggtgcc

SEQ ID NO: 327290 - DNA, 26 bp, Artificial Sequence
  Description of Artificial Sequence: Synthetic oligonucleotide
tgagcactcctgaagagagggtgccc

SEQ ID NO: 327291 - DNA, 25 bp, Artificial Sequence
  Description of Artificial Sequence: Synthetic oligonucleotide
gagcactcctgaagagagggtgccc

SEQ ID NO: 327292 - DNA, 26 bp, Artificial Sequence
  Description of Artificial Sequence: Synthetic oligonucleotide
agcactcctgaagagagggtgcccgt

SEQ ID NO: 327293 - DNA, 25 bp, Artificial Sequence
  Description of Artificial Sequence: Synthetic oligonucleotide
gcactcctgaagagagggtgcccgt

SEQ ID NO: 327294 - DNA, 25 bp, Artificial Sequence
  Description of Artificial Sequence: Synthetic oligonucleotide
cactcctgaagagagggtgcccgtg

SEQ ID NO: 327295 - DNA, 27 bp, Artificial Sequence
  Description of Artificial Sequence: Synthetic oligonucleotide
actcctgaagagagggtgcccgtggta

SEQ ID NO: 327296 - DNA, 26 bp, Artificial Sequence
  Description of Artificial Sequence: Synthetic oligonucleotide
ctcctgaagagagggtgcccgtggta

SEQ ID NO: 327297 - DNA, 26 bp, Artificial Sequence
  Description of Artificial Sequence: Synthetic oligonucleotide
tcctgaagagagggtgcccgtggtag

SEQ ID NO: 327298 - DNA, 25 bp, Artificial Sequence
  Description of Artificial Sequence: Synthetic oligonucleotide
cctgaagagagggtgcccgtggtag

SEQ ID NO: 327299 - DNA, 25 bp, Artificial Sequence
  Description of Artificial Sequence: Synthetic oligonucleotide
ctgaagagagggtgcccgtggtagg

SEQ ID NO: 327300 - DNA, 26 bp, Artificial Sequence
  Description of Artificial Sequence: Synthetic oligonucleotide
tgaagagagggtgcccgtggtaggga

SEQ ID NO: 327301 - DNA, 25 bp, Artificial Sequence
  Description of Artificial Sequence: Synthetic oligonucleotide
gaagagagggtgcccgtggtaggga

SEQ ID NO: 327302 - DNA, 25 bp, Artificial Sequence
  Description of Artificial Sequence: Synthetic oligonucleotide
aagagagggtgcccgtggtagggag

SEQ ID NO: 327303 - DNA, 24 bp, Artificial Sequence
  Description of Artificial Sequence: Synthetic oligonucleotide
agagagggtgcccgtggtagggag

SEQ ID NO: 327304 - DNA, 23 bp, Artificial Sequence
  Description of Artificial Sequence: Synthetic oligonucleotide
gagagggtgcccgtggtagggag

SEQ ID NO: 327305 - DNA, 24 bp, Artificial Sequence
  Description of Artificial Sequence: Synthetic oligonucleotide
agagggtgcccgtggtagggagca

SEQ ID NO: 327306 - DNA, 23 bp, Artificial Sequence
  Description of Artificial Sequence: Synthetic oligonucleotide
gagggtgcccgtggtagggagca

SEQ ID NO: 327307 - DNA, 23 bp, Artificial Sequence
  Description of Artificial Sequence: Synthetic oligonucleotide
agggtgcccgtggtagggagcag

SEQ ID NO: 327308 - DNA, 22 bp, Artificial Sequence
  Description of Artificial Sequence: Synthetic oligonucleotide
gggtgcccgtggtagggagcag

SEQ ID NO: 327309 - DNA, 22 bp, Artificial Sequence
  Description of Artificial Sequence: Synthetic oligonucleotide
ggtgcccgtggtagggagcagc

SEQ ID NO: 327310 - DNA, 22 bp, Artificial Sequence
  Description of Artificial Sequence: Synthetic oligonucleotide
gtgcccgtggtagggagcagcc

SEQ ID NO: 327311 - DNA, 24 bp, Artificial Sequence
  Description of Artificial Sequence: Synthetic oligonucleotide
tgcccgtggtagggagcagcccat

SEQ ID NO: 327312 - DNA, 23 bp, Artificial Sequence
  Description of Artificial Sequence: Synthetic oligonucleotide
gcccgtggtagggagcagcccat

SEQ ID NO: 327313 - DNA, 23 bp, Artificial Sequence
  Description of Artificial Sequence: Synthetic oligonucleotide
cccgtggtagggagcagcccatg

SEQ ID NO: 327314 - DNA, 23 bp, Artificial Sequence
  Description of Artificial Sequence: Synthetic oligonucleotide
ccgtggtagggagcagcccatgg

SEQ ID NO: 327315 - DNA, 23 bp, Artificial Sequence
  Description of Artificial Sequence: Synthetic oligonucleotide
cgtggtagggagcagcccatggg

SEQ ID NO: 327316 - DNA, 24 bp, Artificial Sequence
  Description of Artificial Sequence: Synthetic oligonucleotide
gtggtagggagcagcccatgggca

SEQ ID NO: 327317 - DNA, 25 bp, Artificial Sequence
  Description of Artificial Sequence: Synthetic oligonucleotide
tggtagggagcagcccatgggcact

SEQ ID NO: 327318 - DNA, 24 bp, Artificial Sequence
  Description of Artificial Sequence: Synthetic oligonucleotide
ggtagggagcagcccatgggcact

SEQ ID NO: 327319 - DNA, 24 bp, Artificial Sequence
  Description of Artificial Sequence: Synthetic oligonucleotide
gtagggagcagcccatgggcactg

SEQ ID NO: 327320 - DNA, 24 bp, Artificial Sequence
  Description of Artificial Sequence: Synthetic oligonucleotide
tagggagcagcccatgggcactgg

SEQ ID NO: 327321 - DNA, 23 bp, Artificial Sequence
  Description of Artificial Sequence: Synthetic oligonucleotide
agggagcagcccatgggcactgg

SEQ ID NO: 327322 - DNA, 22 bp, Artificial Sequence
  Description of Artificial Sequence: Synthetic oligonucleotide
gggagcagcccatgggcactgg

SEQ ID NO: 327323 - DNA, 22 bp, Artificial Sequence
  Description of Artificial Sequence: Synthetic oligonucleotide
ggagcagcccatgggcactggc

SEQ ID NO: 327324 - DNA, 23 bp, Artificial Sequence
  Description of Artificial Sequence: Synthetic oligonucleotide
gagcagcccatgggcactggcca

SEQ ID NO: 327325 - DNA, 23 bp, Artificial Sequence
  Description of Artificial Sequence: Synthetic oligonucleotide
agcagcccatgggcactggccag

SEQ ID NO: 327326 - DNA, 22 bp, Artificial Sequence
  Description of Artificial Sequence: Synthetic oligonucleotide
gcagcccatgggcactggccag

SEQ ID NO: 327327 - DNA, 22 bp, Artificial Sequence
  Description of Artificial Sequence: Synthetic oligonucleotide
cagcccatgggcactggccagg

SEQ ID NO: 327328 - DNA, 22 bp, Artificial Sequence
  Description of Artificial Sequence: Synthetic oligonucleotide
agcccatgggcactggccaggc

SEQ ID NO: 327329 - DNA, 21 bp, Artificial Sequence
  Description of Artificial Sequence: Synthetic oligonucleotide
gcccatgggcactggccaggc

SEQ ID NO: 327330 - DNA, 21 bp, Artificial Sequence
  Description of Artificial Sequence: Synthetic oligonucleotide
cccatgggcactggccaggcc

SEQ ID NO: 327331 - DNA, 21 bp, Artificial Sequence
  Description of Artificial Sequence: Synthetic oligonucleotide
ccatgggcactggccaggccg

SEQ ID NO: 327332 - DNA, 22 bp, Artificial Sequence
  Description of Artificial Sequence: Synthetic oligonucleotide
catgggcactggccaggccggt

SEQ ID NO: 327333 - DNA, 22 bp, Artificial Sequence
  Description of Artificial Sequence: Synthetic oligonucleotide
atgggcactggccaggccggtg

SEQ ID NO: 327334 - DNA, 21 bp, Artificial Sequence
  Description of Artificial Sequence: Synthetic oligonucleotide
tgggcactggccaggccggtg

SEQ ID NO: 327335 - DNA, 20 bp, Artificial Sequence
  Description of Artificial Sequence: Synthetic oligonucleotide
gggcactggccaggccggtg

SEQ ID NO: 327336 - DNA, 21 bp, Artificial Sequence
  Description of Artificial Sequence: Synthetic oligonucleotide
ggcactggccaggccggtgct

SEQ ID NO: 327337 - DNA, 22 bp, Artificial Sequence
  Description of Artificial Sequence: Synthetic oligonucleotide
gcactggccaggccggtgctga

SEQ ID NO: 327338 - DNA, 23 bp, Artificial Sequence
  Description of Artificial Sequence: Synthetic oligonucleotide
cactggccaggccggtgctgact

SEQ ID NO: 327339 - DNA, 23 bp, Artificial Sequence
  Description of Artificial Sequence: Synthetic oligonucleotide
actggccaggccggtgctgactg

SEQ ID NO: 327340 - DNA, 22 bp, Artificial Sequence
  Description of Artificial Sequence: Synthetic oligonucleotide
ctggccaggccggtgctgactg

SEQ ID NO: 327341 - DNA, 25 bp, Artificial Sequence
  Description of Artificial Sequence: Synthetic oligonucleotide
tggccaggccggtgctgactgctat

SEQ ID NO: 327342 - DNA, 24 bp, Artificial Sequence
  Description of Artificial Sequence: Synthetic oligonucleotide
ggccaggccggtgctgactgctat

SEQ ID NO: 327343 - DNA, 24 bp, Artificial Sequence
  Description of Artificial Sequence: Synthetic oligonucleotide
gccaggccggtgctgactgctatc

SEQ ID NO: 327344 - DNA, 25 bp, Artificial Sequence
  Description of Artificial Sequence: Synthetic oligonucleotide
ccaggccggtgctgactgctatcct

SEQ ID NO: 327345 - DNA, 27 bp, Artificial Sequence
  Description of Artificial Sequence: Synthetic oligonucleotide
caggccggtgctgactgctatcctgtt

SEQ ID NO: 327346 - DNA, 30 bp, Artificial Sequence
  Description of Artificial Sequence: Synthetic oligonucleotide
aggccggtgctgactgctatcctgtttttg

SEQ ID NO: 327347 - DNA, 29 bp, Artificial Sequence
  Description of Artificial Sequence: Synthetic oligonucleotide
ggccggtgctgactgctatcctgtttttg

SEQ ID NO: 327348 - DNA, 29 bp, Artificial Sequence
  Description of Artificial Sequence: Synthetic oligonucleotide
gccggtgctgactgctatcctgtttttgg

SEQ ID NO: 327349 - DNA, 29 bp, Artificial Sequence
  Description of Artificial Sequence: Synthetic oligonucleotide
ccggtgctgactgctatcctgtttttggg

SEQ ID NO: 327350 - DNA, 29 bp, Artificial Sequence
  Description of Artificial Sequence: Synthetic oligonucleotide
cggtgctgactgctatcctgtttttgggc

SEQ ID NO: 327351 - DNA, 29 bp, Artificial Sequence
  Description of Artificial Sequence: Synthetic oligonucleotide
ggtgctgactgctatcctgtttttgggcc

SEQ ID NO: 327352 - DNA, 30 bp, Artificial Sequence
  Description of Artificial Sequence: Synthetic oligonucleotide
gtgctgactgctatcctgtttttgggccag

SEQ ID NO: 327353 - DNA, 30 bp, Artificial Sequence
  Description of Artificial Sequence: Synthetic oligonucleotide
tgctgactgctatcctgtttttgggccagc

SEQ ID NO: 327354 - DNA, 29 bp, Artificial Sequence
  Description of Artificial Sequence: Synthetic oligonucleotide
gctgactgctatcctgtttttgggccagc

SEQ ID NO: 327355 - DNA, 30 bp, Artificial Sequence
  Description of Artificial Sequence: Synthetic oligonucleotide
ctgactgctatcctgtttttgggccagctc

SEQ ID NO: 327356 - DNA, 30 bp, Artificial Sequence
  Description of Artificial Sequence: Synthetic oligonucleotide
tgactgctatcctgtttttgggccagctcc

SEQ ID NO: 327357 - DNA, 29 bp, Artificial Sequence
  Description of Artificial Sequence: Synthetic oligonucleotide
gactgctatcctgtttttgggccagctcc

SEQ ID NO: 327358 - DNA, 32 bp, Artificial Sequence
  Description of Artificial Sequence: Synthetic oligonucleotide
actgctatcctgtttttgggccagctcctttg

SEQ ID NO: 327359 - DNA, 31 bp, Artificial Sequence
  Description of Artificial Sequence: Synthetic oligonucleotide
ctgctatcctgtttttgggccagctcctttg

SEQ ID NO: 327360 - DNA, 36 bp, Artificial Sequence
  Description of Artificial Sequence: Synthetic oligonucleotide
tgctatcctgtttttgggccagctcctttgattttc

SEQ ID NO: 327361 - DNA, 35 bp, Artificial Sequence
  Description of Artificial Sequence: Synthetic oligonucleotide
gctatcctgtttttgggccagctcctttgattttc

SEQ ID NO: 327362 - DNA, 36 bp, Artificial Sequence
  Description of Artificial Sequence: Synthetic oligonucleotide
ctatcctgtttttgggccagctcctttgattttctg

SEQ ID NO: 327363 - DNA, 37 bp, Artificial Sequence
  Description of Artificial Sequence: Synthetic oligonucleotide
tatcctgtttttgggccagctcctttgattttctgtg

SEQ ID NO: 327364 - DNA, 36 bp, Artificial Sequence
  Description of Artificial Sequence: Synthetic oligonucleotide
atcctgtttttgggccagctcctttgattttctgtg

SEQ ID NO: 327365 - DNA, 35 bp, Artificial Sequence
  Description of Artificial Sequence: Synthetic oligonucleotide
tcctgtttttgggccagctcctttgattttctgtg

SEQ ID NO: 327366 - DNA, 34 bp, Artificial Sequence
  Description of Artificial Sequence: Synthetic oligonucleotide
cctgtttttgggccagctcctttgattttctgtg

SEQ ID NO: 327367 - DNA, 34 bp, Artificial Sequence
  Description of Artificial Sequence: Synthetic oligonucleotide
ctgtttttgggccagctcctttgattttctgtgg

SEQ ID NO: 327368 - DNA, 38 bp, Artificial Sequence
  Description of Artificial Sequence: Synthetic oligonucleotide
tgtttttgggccagctcctttgattttctgtggttttg

SEQ ID NO: 327369 - DNA, 37 bp, Artificial Sequence
  Description of Artificial Sequence: Synthetic oligonucleotide
gtttttgggccagctcctttgattttctgtggttttg

SEQ ID NO: 327370 - DNA, 39 bp, Artificial Sequence
  Description of Artificial Sequence: Synthetic oligonucleotide
tttttgggccagctcctttgattttctgtggttttgttc

SEQ ID NO: 327371 - DNA, 38 bp, Artificial Sequence
  Description of Artificial Sequence: Synthetic oligonucleotide
ttttgggccagctcctttgattttctgtggttttgttc

SEQ ID NO: 327372 - DNA, 37 bp, Artificial Sequence
  Description of Artificial Sequence: Synthetic oligonucleotide
tttgggccagctcctttgattttctgtggttttgttc

SEQ ID NO: 327373 - DNA, 36 bp, Artificial Sequence
  Description of Artificial Sequence: Synthetic oligonucleotide
ttgggccagctcctttgattttctgtggttttgttc

SEQ ID NO: 327374 - DNA, 35 bp, Artificial Sequence
  Description of Artificial Sequence: Synthetic oligonucleotide
tgggccagctcctttgattttctgtggttttgttc

SEQ ID NO: 327375 - DNA, 34 bp, Artificial Sequence
  Description of Artificial Sequence: Synthetic oligonucleotide
gggccagctcctttgattttctgtggttttgttc

SEQ ID NO: 327376 - DNA, 36 bp, Artificial Sequence
  Description of Artificial Sequence: Synthetic oligonucleotide
ggccagctcctttgattttctgtggttttgttcttc

SEQ ID NO: 327377 - DNA, 38 bp, Artificial Sequence
  Description of Artificial Sequence: Synthetic oligonucleotide
gccagctcctttgattttctgtggttttgttcttcaac

SEQ ID NO: 327378 - DNA, 40 bp, Artificial Sequence
  Description of Artificial Sequence: Synthetic oligonucleotide
ccagctcctttgattttctgtggttttgttcttcaacttc

SEQ ID NO: 327379 - DNA, 40 bp, Artificial Sequence
  Description of Artificial Sequence: Synthetic oligonucleotide
cagctcctttgattttctgtggttttgttcttcaacttcc

SEQ ID NO: 327380 - DNA, 41 bp, Artificial Sequence
  Description of Artificial Sequence: Synthetic oligonucleotide
agctcctttgattttctgtggttttgttcttcaacttccac

SEQ ID NO: 327381 - DNA, 40 bp, Artificial Sequence
  Description of Artificial Sequence: Synthetic oligonucleotide
gctcctttgattttctgtggttttgttcttcaacttccac

SEQ ID NO: 327382 - DNA, 42 bp, Artificial Sequence
  Description of Artificial Sequence: Synthetic oligonucleotide
ctcctttgattttctgtggttttgttcttcaacttccacaac

SEQ ID NO: 327383 - DNA, 43 bp, Artificial Sequence
  Description of Artificial Sequence: Synthetic oligonucleotide
tcctttgattttctgtggttttgttcttcaacttccacaactg

SEQ ID NO: 327384 - DNA, 42 bp, Artificial Sequence
  Description of Artificial Sequence: Synthetic oligonucleotide
cctttgattttctgtggttttgttcttcaacttccacaactg

SEQ ID NO: 327385 - DNA, 43 bp, Artificial Sequence
  Description of Artificial Sequence: Synthetic oligonucleotide
ctttgattttctgtggttttgttcttcaacttccacaactgtg

SEQ ID NO: 327386 - DNA, 43 bp, Artificial Sequence
  Description of Artificial Sequence: Synthetic oligonucleotide
tttgattttctgtggttttgttcttcaacttccacaactgtgg

SEQ ID NO: 327387 - DNA, 42 bp, Artificial Sequence
  Description of Artificial Sequence: Synthetic oligonucleotide
ttgattttctgtggttttgttcttcaacttccacaactgtgg

SEQ ID NO: 327388 - DNA, 41 bp, Artificial Sequence
  Description of Artificial Sequence: Synthetic oligonucleotide
tgattttctgtggttttgttcttcaacttccacaactgtgg

SEQ ID NO: 327389 - DNA, 40 bp, Artificial Sequence
  Description of Artificial Sequence: Synthetic oligonucleotide
gattttctgtggttttgttcttcaacttccacaactgtgg

SEQ ID NO: 327390 - DNA, 40 bp, Artificial Sequence
  Description of Artificial Sequence: Synthetic oligonucleotide
attttctgtggttttgttcttcaacttccacaactgtggc

SEQ ID NO: 327391 - DNA, 39 bp, Artificial Sequence
  Description of Artificial Sequence: Synthetic oligonucleotide
ttttctgtggttttgttcttcaacttccacaactgtggc

SEQ ID NO: 327392 - DNA, 38 bp, Artificial Sequence
  Description of Artificial Sequence: Synthetic oligonucleotide
tttctgtggttttgttcttcaacttccacaactgtggc

SEQ ID NO: 327393 - DNA, 37 bp, Artificial Sequence
  Description of Artificial Sequence: Synthetic oligonucleotide
ttctgtggttttgttcttcaacttccacaactgtggc

SEQ ID NO: 327394 - DNA, 36 bp, Artificial Sequence
  Description of Artificial Sequence: Synthetic oligonucleotide
tctgtggttttgttcttcaacttccacaactgtggc

SEQ ID NO: 327395 - DNA, 35 bp, Artificial Sequence
  Description of Artificial Sequence: Synthetic oligonucleotide
ctgtggttttgttcttcaacttccacaactgtggc

SEQ ID NO: 327396 - DNA, 35 bp, Artificial Sequence
  Description of Artificial Sequence: Synthetic oligonucleotide
tgtggttttgttcttcaacttccacaactgtggcg

SEQ ID NO: 327397 - DNA, 34 bp, Artificial Sequence
  Description of Artificial Sequence: Synthetic oligonucleotide
gtggttttgttcttcaacttccacaactgtggcg

SEQ ID NO: 327398 - DNA, 34 bp, Artificial Sequence
  Description of Artificial Sequence: Synthetic oligonucleotide
tggttttgttcttcaacttccacaactgtggcgc

SEQ ID NO: 327399 - DNA, 33 bp, Artificial Sequence
  Description of Artificial Sequence: Synthetic oligonucleotide
ggttttgttcttcaacttccacaactgtggcgc

SEQ ID NO: 327400 - DNA, 34 bp, Artificial Sequence
  Description of Artificial Sequence: Synthetic oligonucleotide
gttttgttcttcaacttccacaactgtggcgctc

SEQ ID NO: 327401 - DNA, 34 bp, Artificial Sequence
  Description of Artificial Sequence: Synthetic oligonucleotide
ttttgttcttcaacttccacaactgtggcgctcg

SEQ ID NO: 327402 - DNA, 33 bp, Artificial Sequence
  Description of Artificial Sequence: Synthetic oligonucleotide
tttgttcttcaacttccacaactgtggcgctcg

SEQ ID NO: 327403 - DNA, 32 bp, Artificial Sequence
  Description of Artificial Sequence: Synthetic oligonucleotide
ttgttcttcaacttccacaactgtggcgctcg

SEQ ID NO: 327404 - DNA, 31 bp, Artificial Sequence
  Description of Artificial Sequence: Synthetic oligonucleotide
tgttcttcaacttccacaactgtggcgctcg

SEQ ID NO: 327405 - DNA, 30 bp, Artificial Sequence
  Description of Artificial Sequence: Synthetic oligonucleotide
gttcttcaacttccacaactgtggcgctcg

SEQ ID NO: 327406 - DNA, 30 bp, Artificial Sequence
  Description of Artificial Sequence: Synthetic oligonucleotide
ttcttcaacttccacaactgtggcgctcgc

SEQ ID NO: 327407 - DNA, 29 bp, Artificial Sequence
  Description of Artificial Sequence: Synthetic oligonucleotide
tcttcaacttccacaactgtggcgctcgc

SEQ ID NO: 327408 - DNA, 28 bp, Artificial Sequence
  Description of Artificial Sequence: Synthetic oligonucleotide
cttcaacttccacaactgtggcgctcgc

SEQ ID NO: 327409 - DNA, 28 bp, Artificial Sequence
  Description of Artificial Sequence: Synthetic oligonucleotide
ttcaacttccacaactgtggcgctcgcc

SEQ ID NO: 327410 - DNA, 27 bp, Artificial Sequence
  Description of Artificial Sequence: Synthetic oligonucleotide
tcaacttccacaactgtggcgctcgcc

SEQ ID NO: 327411 - DNA, 26 bp, Artificial Sequence
  Description of Artificial Sequence: Synthetic oligonucleotide
caacttccacaactgtggcgctcgcc

SEQ ID NO: 327412 - DNA, 26 bp, Artificial Sequence
  Description of Artificial Sequence: Synthetic oligonucleotide
aacttccacaactgtggcgctcgccc

SEQ ID NO: 327413 - DNA, 25 bp, Artificial Sequence
  Description of Artificial Sequence: Synthetic oligonucleotide
acttccacaactgtggcgctcgccc

SEQ ID NO: 327414 - DNA, 24 bp, Artificial Sequence
  Description of Artificial Sequence: Synthetic oligonucleotide
cttccacaactgtggcgctcgccc

SEQ ID NO: 327415 - DNA, 25 bp, Artificial Sequence
  Description of Artificial Sequence: Synthetic oligonucleotide
ttccacaactgtggcgctcgcccct

SEQ ID NO: 327416 - DNA, 24 bp, Artificial Sequence
  Description of Artificial Sequence: Synthetic oligonucleotide
tccacaactgtggcgctcgcccct

SEQ ID NO: 327417 - DNA, 23 bp, Artificial Sequence
  Description of Artificial Sequence: Synthetic oligonucleotide
ccacaactgtggcgctcgcccct

SEQ ID NO: 327418 - DNA, 24 bp, Artificial Sequence
  Description of Artificial Sequence: Synthetic oligonucleotide
cacaactgtggcgctcgcccctct

SEQ ID NO: 327419 - DNA, 25 bp, Artificial Sequence
  Description of Artificial Sequence: Synthetic oligonucleotide
acaactgtggcgctcgcccctctga

SEQ ID NO: 327420 - DNA, 24 bp, Artificial Sequence
  Description of Artificial Sequence: Synthetic oligonucleotide
caactgtggcgctcgcccctctga

SEQ ID NO: 327421 - DNA, 25 bp, Artificial Sequence
  Description of Artificial Sequence: Synthetic oligonucleotide
aactgtggcgctcgcccctctgaga

SEQ ID NO: 327422 - DNA, 24 bp, Artificial Sequence
  Description of Artificial Sequence: Synthetic oligonucleotide
actgtggcgctcgcccctctgaga

SEQ ID NO: 327423 - DNA, 23 bp, Artificial Sequence
  Description of Artificial Sequence: Synthetic oligonucleotide
ctgtggcgctcgcccctctgaga

SEQ ID NO: 327424 - DNA, 25 bp, Artificial Sequence
  Description of Artificial Sequence: Synthetic oligonucleotide
tgtggcgctcgcccctctgagacat

SEQ ID NO: 327425 - DNA, 24 bp, Artificial Sequence
  Description of Artificial Sequence: Synthetic oligonucleotide
gtggcgctcgcccctctgagacat

SEQ ID NO: 327426 - DNA, 25 bp, Artificial Sequence
  Description of Artificial Sequence: Synthetic oligonucleotide
tggcgctcgcccctctgagacatca

SEQ ID NO: 327427 - DNA, 24 bp, Artificial Sequence
  Description of Artificial Sequence: Synthetic oligonucleotide
ggcgctcgcccctctgagacatca

SEQ ID NO: 327428 - DNA, 25 bp, Artificial Sequence
  Description of Artificial Sequence: Synthetic oligonucleotide
gcgctcgcccctctgagacatcagt

SEQ ID NO: 327429 - DNA, 26 bp, Artificial Sequence
  Description of Artificial Sequence: Synthetic oligonucleotide
cgctcgcccctctgagacatcagtgt

SEQ ID NO: 327430 - DNA, 27 bp, Artificial Sequence
  Description of Artificial Sequence: Synthetic oligonucleotide
gctcgcccctctgagacatcagtgtgt

SEQ ID NO: 327431 - DNA, 29 bp, Artificial Sequence
  Description of Artificial Sequence: Synthetic oligonucleotide
ctcgcccctctgagacatcagtgtgtttg

SEQ ID NO: 327432 - DNA, 29 bp, Artificial Sequence
  Description of Artificial Sequence: Synthetic oligonucleotide
tcgcccctctgagacatcagtgtgtttgc

SEQ ID NO: 327433 - DNA, 28 bp, Artificial Sequence
  Description of Artificial Sequence: Synthetic oligonucleotide
cgcccctctgagacatcagtgtgtttgc

SEQ ID NO: 327434 - DNA, 30 bp, Artificial Sequence
  Description of Artificial Sequence: Synthetic oligonucleotide
gcccctctgagacatcagtgtgtttgcatc

SEQ ID NO: 327435 - DNA, 31 bp, Artificial Sequence
  Description of Artificial Sequence: Synthetic oligonucleotide
cccctctgagacatcagtgtgtttgcatctc

SEQ ID NO: 327436 - DNA, 31 bp, Artificial Sequence
  Description of Artificial Sequence: Synthetic oligonucleotide
ccctctgagacatcagtgtgtttgcatctcc

SEQ ID NO: 327437 - DNA, 31 bp, Artificial Sequence
  Description of Artificial Sequence: Synthetic oligonucleotide
cctctgagacatcagtgtgtttgcatctccg

SEQ ID NO: 327438 - DNA, 31 bp, Artificial Sequence
  Description of Artificial Sequence: Synthetic oligonucleotide
ctctgagacatcagtgtgtttgcatctccgg

SEQ ID NO: 327439 - DNA, 31 bp, Artificial Sequence
  Description of Artificial Sequence: Synthetic oligonucleotide
tctgagacatcagtgtgtttgcatctccggg

SEQ ID NO: 327440 - DNA, 30 bp, Artificial Sequence
  Description of Artificial Sequence: Synthetic oligonucleotide
ctgagacatcagtgtgtttgcatctccggg

SEQ ID NO: 327441 - DNA, 32 bp, Artificial Sequence
  Description of Artificial Sequence: Synthetic oligonucleotide
tgagacatcagtgtgtttgcatctccgggttc

SEQ ID NO: 327442 - DNA, 31 bp, Artificial Sequence
  Description of Artificial Sequence: Synthetic oligonucleotide
gagacatcagtgtgtttgcatctccgggttc

SEQ ID NO: 327443 - DNA, 35 bp, Artificial Sequence
  Description of Artificial Sequence: Synthetic oligonucleotide
agacatcagtgtgtttgcatctccgggttcattac

SEQ ID NO: 327444 - DNA, 34 bp, Artificial Sequence
  Description of Artificial Sequence: Synthetic oligonucleotide
gacatcagtgtgtttgcatctccgggttcattac

SEQ ID NO: 327445 - DNA, 34 bp, Artificial Sequence
  Description of Artificial Sequence: Synthetic oligonucleotide
acatcagtgtgtttgcatctccgggttcattacc

SEQ ID NO: 327446 - DNA, 33 bp, Artificial Sequence
  Description of Artificial Sequence: Synthetic oligonucleotide
catcagtgtgtttgcatctccgggttcattacc

SEQ ID NO: 327447 - DNA, 34 bp, Artificial Sequence
  Description of Artificial Sequence: Synthetic oligonucleotide
atcagtgtgtttgcatctccgggttcattacctc

SEQ ID NO: 327448 - DNA, 33 bp, Artificial Sequence
  Description of Artificial Sequence: Synthetic oligonucleotide
tcagtgtgtttgcatctccgggttcattacctc

SEQ ID NO: 327449 - DNA, 32 bp, Artificial Sequence
  Description of Artificial Sequence: Synthetic oligonucleotide
cagtgtgtttgcatctccgggttcattacctc

SEQ ID NO: 327450 - DNA, 32 bp, Artificial Sequence
  Description of Artificial Sequence: Synthetic oligonucleotide
agtgtgtttgcatctccgggttcattacctcg

SEQ ID NO: 327451 - DNA, 31 bp, Artificial Sequence
  Description of Artificial Sequence: Synthetic oligonucleotide
gtgtgtttgcatctccgggttcattacctcg

SEQ ID NO: 327452 - DNA, 31 bp, Artificial Sequence
  Description of Artificial Sequence: Synthetic oligonucleotide
tgtgtttgcatctccgggttcattacctcgc

SEQ ID NO: 327453 - DNA, 30 bp, Artificial Sequence
  Description of Artificial Sequence: Synthetic oligonucleotide
gtgtttgcatctccgggttcattacctcgc

SEQ ID NO: 327454 - DNA, 30 bp, Artificial Sequence
  Description of Artificial Sequence: Synthetic oligonucleotide
tgtttgcatctccgggttcattacctcgcc

SEQ ID NO: 327455 - DNA, 29 bp, Artificial Sequence
  Description of Artificial Sequence: Synthetic oligonucleotide
gtttgcatctccgggttcattacctcgcc

SEQ ID NO: 327456 - DNA, 30 bp, Artificial Sequence
  Description of Artificial Sequence: Synthetic oligonucleotide
tttgcatctccgggttcattacctcgcctc

SEQ ID NO: 327457 - DNA, 29 bp, Artificial Sequence
  Description of Artificial Sequence: Synthetic oligonucleotide
ttgcatctccgggttcattacctcgcctc

SEQ ID NO: 327458 - DNA, 28 bp, Artificial Sequence
  Description of Artificial Sequence: Synthetic oligonucleotide
tgcatctccgggttcattacctcgcctc

SEQ ID NO: 327459 - DNA, 27 bp, Artificial Sequence
  Description of Artificial Sequence: Synthetic oligonucleotide
gcatctccgggttcattacctcgcctc

SEQ ID NO: 327460 - DNA, 28 bp, Artificial Sequence
  Description of Artificial Sequence: Synthetic oligonucleotide
catctccgggttcattacctcgcctctg

SEQ ID NO: 327461 - DNA, 28 bp, Artificial Sequence
  Description of Artificial Sequence: Synthetic oligonucleotide
atctccgggttcattacctcgcctctgg

SEQ ID NO: 327462 - DNA, 27 bp, Artificial Sequence
  Description of Artificial Sequence: Synthetic oligonucleotide
tctccgggttcattacctcgcctctgg

SEQ ID NO: 327463 - DNA, 26 bp, Artificial Sequence
  Description of Artificial Sequence: Synthetic oligonucleotide
ctccgggttcattacctcgcctctgg

SEQ ID NO: 327464 - DNA, 27 bp, Artificial Sequence
  Description of Artificial Sequence: Synthetic oligonucleotide
tccgggttcattacctcgcctctgggt

SEQ ID NO: 327465 - DNA, 27 bp, Artificial Sequence
  Description of Artificial Sequence: Synthetic oligonucleotide
ccgggttcattacctcgcctctgggta

SEQ ID NO: 327466 - DNA, 27 bp, Artificial Sequence
  Description of Artificial Sequence: Synthetic oligonucleotide
cgggttcattacctcgcctctgggtac

SEQ ID NO: 327467 - DNA, 28 bp, Artificial Sequence
  Description of Artificial Sequence: Synthetic oligonucleotide
gggttcattacctcgcctctgggtacac

SEQ ID NO: 327468 - DNA, 30 bp, Artificial Sequence
  Description of Artificial Sequence: Synthetic oligonucleotide
ggttcattacctcgcctctgggtacacaag

SEQ ID NO: 327469 - DNA, 31 bp, Artificial Sequence
  Description of Artificial Sequence: Synthetic oligonucleotide
gttcattacctcgcctctgggtacacaagtg

SEQ ID NO: 327470 - DNA, 32 bp, Artificial Sequence
  Description of Artificial Sequence: Synthetic oligonucleotide
ttcattacctcgcctctgggtacacaagtgag

SEQ ID NO: 327471 - DNA, 31 bp, Artificial Sequence
  Description of Artificial Sequence: Synthetic oligonucleotide
tcattacctcgcctctgggtacacaagtgag

SEQ ID NO: 327472 - DNA, 30 bp, Artificial Sequence
  Description of Artificial Sequence: Synthetic oligonucleotide
cattacctcgcctctgggtacacaagtgag

SEQ ID NO: 327473 - DNA, 30 bp, Artificial Sequence
  Description of Artificial Sequence: Synthetic oligonucleotide
attacctcgcctctgggtacacaagtgagg

SEQ ID NO: 327474 - DNA, 29 bp, Artificial Sequence
  Description of Artificial Sequence: Synthetic oligonucleotide
ttacctcgcctctgggtacacaagtgagg

SEQ ID NO: 327475 - DNA, 28 bp, Artificial Sequence
  Description of Artificial Sequence: Synthetic oligonucleotide
tacctcgcctctgggtacacaagtgagg

SEQ ID NO: 327476 - DNA, 27 bp, Artificial Sequence
  Description of Artificial Sequence: Synthetic oligonucleotide
acctcgcctctgggtacacaagtgagg

SEQ ID NO: 327477 - DNA, 26 bp, Artificial Sequence
  Description of Artificial Sequence: Synthetic oligonucleotide
cctcgcctctgggtacacaagtgagg

SEQ ID NO: 327478 - DNA, 26 bp, Artificial Sequence
  Description of Artificial Sequence: Synthetic oligonucleotide
ctcgcctctgggtacacaagtgaggc

SEQ ID NO: 327479 - DNA, 26 bp, Artificial Sequence
  Description of Artificial Sequence: Synthetic oligonucleotide
tcgcctctgggtacacaagtgaggcc

SEQ ID NO: 327480 - DNA, 25 bp, Artificial Sequence
  Description of Artificial Sequence: Synthetic oligonucleotide
cgcctctgggtacacaagtgaggcc

SEQ ID NO: 327481 - DNA, 25 bp, Artificial Sequence
  Description of Artificial Sequence: Synthetic oligonucleotide
gcctctgggtacacaagtgaggccc

SEQ ID NO: 327482 - DNA, 25 bp, Artificial Sequence
  Description of Artificial Sequence: Synthetic oligonucleotide
cctctgggtacacaagtgaggcccc

SEQ ID NO: 327483 - DNA, 26 bp, Artificial Sequence
  Description of Artificial Sequence: Synthetic oligonucleotide
ctctgggtacacaagtgaggccccct

SEQ ID NO: 327484 - DNA, 26 bp, Artificial Sequence
  Description of Artificial Sequence: Synthetic oligonucleotide
tctgggtacacaagtgaggccccctg

SEQ ID NO: 327485 - DNA, 25 bp, Artificial Sequence
  Description of Artificial Sequence: Synthetic oligonucleotide
ctgggtacacaagtgaggccccctg

SEQ ID NO: 327486 - DNA, 26 bp, Artificial Sequence
  Description of Artificial Sequence: Synthetic oligonucleotide
tgggtacacaagtgaggccccctgga

SEQ ID NO: 327487 - DNA, 25 bp, Artificial Sequence
  Description of Artificial Sequence: Synthetic oligonucleotide
gggtacacaagtgaggccccctgga

SEQ ID NO: 327488 - DNA, 25 bp, Artificial Sequence
  Description of Artificial Sequence: Synthetic oligonucleotide
ggtacacaagtgaggccccctggac

SEQ ID NO: 327489 - DNA, 25 bp, Artificial Sequence
  Description of Artificial Sequence: Synthetic oligonucleotide
gtacacaagtgaggccccctggacc

SEQ ID NO: 327490 - DNA, 26 bp, Artificial Sequence
  Description of Artificial Sequence: Synthetic oligonucleotide
tacacaagtgaggccccctggaccga

SEQ ID NO: 327491 - DNA, 25 bp, Artificial Sequence
  Description of Artificial Sequence: Synthetic oligonucleotide
acacaagtgaggccccctggaccga

SEQ ID NO: 327492 - DNA, 24 bp, Artificial Sequence
  Description of Artificial Sequence: Synthetic oligonucleotide
cacaagtgaggccccctggaccga

SEQ ID NO: 327493 - DNA, 26 bp, Artificial Sequence
  Description of Artificial Sequence: Synthetic oligonucleotide
acaagtgaggccccctggaccgactt

SEQ ID NO: 327494 - DNA, 25 bp, Artificial Sequence
  Description of Artificial Sequence: Synthetic oligonucleotide
caagtgaggccccctggaccgactt

SEQ ID NO: 327495 - DNA, 27 bp, Artificial Sequence
  Description of Artificial Sequence: Synthetic oligonucleotide
aagtgaggccccctggaccgacttcat

SEQ ID NO: 327496 - DNA, 26 bp, Artificial Sequence
  Description of Artificial Sequence: Synthetic oligonucleotide
agtgaggccccctggaccgacttcat

SEQ ID NO: 327497 - DNA, 25 bp, Artificial Sequence
  Description of Artificial Sequence: Synthetic oligonucleotide
gtgaggccccctggaccgacttcat

SEQ ID NO: 327498 - DNA, 26 bp, Artificial Sequence
  Description of Artificial Sequence: Synthetic oligonucleotide
tgaggccccctggaccgacttcatca

SEQ ID NO: 327499 - DNA, 25 bp, Artificial Sequence
  Description of Artificial Sequence: Synthetic oligonucleotide
gaggccccctggaccgacttcatca

SEQ ID NO: 327500 - DNA, 25 bp, Artificial Sequence
  Description of Artificial Sequence: Synthetic oligonucleotide
aggccccctggaccgacttcatcag

SEQ ID NO: 327501 - DNA, 24 bp, Artificial Sequence
  Description of Artificial Sequence: Synthetic oligonucleotide
ggccccctggaccgacttcatcag

SEQ ID NO: 327502 - DNA, 27 bp, Artificial Sequence
  Description of Artificial Sequence: Synthetic oligonucleotide
gccccctggaccgacttcatcagcttt

SEQ ID NO: 327503 - DNA, 27 bp, Artificial Sequence
  Description of Artificial Sequence: Synthetic oligonucleotide
ccccctggaccgacttcatcagctttg

SEQ ID NO: 327504 - DNA, 27 bp, Artificial Sequence
  Description of Artificial Sequence: Synthetic oligonucleotide
cccctggaccgacttcatcagctttgg

SEQ ID NO: 327505 - DNA, 27 bp, Artificial Sequence
  Description of Artificial Sequence: Synthetic oligonucleotide
ccctggaccgacttcatcagctttggc

SEQ ID NO: 327506 - DNA, 28 bp, Artificial Sequence
  Description of Artificial Sequence: Synthetic oligonucleotide
cctggaccgacttcatcagctttggctg

SEQ ID NO: 327507 - DNA, 29 bp, Artificial Sequence
  Description of Artificial Sequence: Synthetic oligonucleotide
ctggaccgacttcatcagctttggctgtg

SEQ ID NO: 327508 - DNA, 29 bp, Artificial Sequence
  Description of Artificial Sequence: Synthetic oligonucleotide
tggaccgacttcatcagctttggctgtgg

SEQ ID NO: 327509 - DNA, 28 bp, Artificial Sequence
  Description of Artificial Sequence: Synthetic oligonucleotide
ggaccgacttcatcagctttggctgtgg

SEQ ID NO: 327510 - DNA, 30 bp, Artificial Sequence
  Description of Artificial Sequence: Synthetic oligonucleotide
gaccgacttcatcagctttggctgtggaag

SEQ ID NO: 327511 - DNA, 30 bp, Artificial Sequence
  Description of Artificial Sequence: Synthetic oligonucleotide
accgacttcatcagctttggctgtggaagc

SEQ ID NO: 327512 - DNA, 29 bp, Artificial Sequence
  Description of Artificial Sequence: Synthetic oligonucleotide
ccgacttcatcagctttggctgtggaagc

SEQ ID NO: 327513 - DNA, 29 bp, Artificial Sequence
  Description of Artificial Sequence: Synthetic oligonucleotide
cgacttcatcagctttggctgtggaagcg

SEQ ID NO: 327514 - DNA, 29 bp, Artificial Sequence
  Description of Artificial Sequence: Synthetic oligonucleotide
gacttcatcagctttggctgtggaagcgc

SEQ ID NO: 327515 - DNA, 29 bp, Artificial Sequence
  Description of Artificial Sequence: Synthetic oligonucleotide
acttcatcagctttggctgtggaagcgcc

SEQ ID NO: 327516 - DNA, 28 bp, Artificial Sequence
  Description of Artificial Sequence: Synthetic oligonucleotide
cttcatcagctttggctgtggaagcgcc

SEQ ID NO: 327517 - DNA, 31 bp, Artificial Sequence
  Description of Artificial Sequence: Synthetic oligonucleotide
ttcatcagctttggctgtggaagcgccaaag

SEQ ID NO: 327518 - DNA, 30 bp, Artificial Sequence
  Description of Artificial Sequence: Synthetic oligonucleotide
tcatcagctttggctgtggaagcgccaaag

SEQ ID NO: 327519 - DNA, 29 bp, Artificial Sequence
  Description of Artificial Sequence: Synthetic oligonucleotide
catcagctttggctgtggaagcgccaaag

SEQ ID NO: 327520 - DNA, 30 bp, Artificial Sequence
  Description of Artificial Sequence: Synthetic oligonucleotide
atcagctttggctgtggaagcgccaaagag

SEQ ID NO: 327521 - DNA, 29 bp, Artificial Sequence
  Description of Artificial Sequence: Synthetic oligonucleotide
tcagctttggctgtggaagcgccaaagag

SEQ ID NO: 327522 - DNA, 28 bp, Artificial Sequence
  Description of Artificial Sequence: Synthetic oligonucleotide
cagctttggctgtggaagcgccaaagag

SEQ ID NO: 327523 - DNA, 29 bp, Artificial Sequence
  Description of Artificial Sequence: Synthetic oligonucleotide
agctttggctgtggaagcgccaaagagtc

SEQ ID NO: 327524 - DNA, 28 bp, Artificial Sequence
  Description of Artificial Sequence: Synthetic oligonucleotide
gctttggctgtggaagcgccaaagagtc

SEQ ID NO: 327525 - DNA, 28 bp, Artificial Sequence
  Description of Artificial Sequence: Synthetic oligonucleotide
ctttggctgtggaagcgccaaagagtcc

SEQ ID NO: 327526 - DNA, 35 bp, Artificial Sequence
  Description of Artificial Sequence: Synthetic oligonucleotide
tttggctgtggaagcgccaaagagtccaataattg

SEQ ID NO: 327527 - DNA, 34 bp, Artificial Sequence
  Description of Artificial Sequence: Synthetic oligonucleotide
ttggctgtggaagcgccaaagagtccaataattg

SEQ ID NO: 327528 - DNA, 33 bp, Artificial Sequence
  Description of Artificial Sequence: Synthetic oligonucleotide
tggctgtggaagcgccaaagagtccaataattg

SEQ ID NO: 327529 - DNA, 32 bp, Artificial Sequence
  Description of Artificial Sequence: Synthetic oligonucleotide
ggctgtggaagcgccaaagagtccaataattg

SEQ ID NO: 327530 - DNA, 36 bp, Artificial Sequence
  Description of Artificial Sequence: Synthetic oligonucleotide
gctgtggaagcgccaaagagtccaataattgttttc

SEQ ID NO: 327531 - DNA, 37 bp, Artificial Sequence
  Description of Artificial Sequence: Synthetic oligonucleotide
ctgtggaagcgccaaagagtccaataattgttttcag

SEQ ID NO: 327532 - DNA, 37 bp, Artificial Sequence
  Description of Artificial Sequence: Synthetic oligonucleotide
tgtggaagcgccaaagagtccaataattgttttcagg

SEQ ID NO: 327533 - DNA, 36 bp, Artificial Sequence
  Description of Artificial Sequence: Synthetic oligonucleotide
gtggaagcgccaaagagtccaataattgttttcagg

SEQ ID NO: 327534 - DNA, 37 bp, Artificial Sequence
  Description of Artificial Sequence: Synthetic oligonucleotide
tggaagcgccaaagagtccaataattgttttcaggac

SEQ ID NO: 327535 - DNA, 36 bp, Artificial Sequence
  Description of Artificial Sequence: Synthetic oligonucleotide
ggaagcgccaaagagtccaataattgttttcaggac

SEQ ID NO: 327536 - DNA, 36 bp, Artificial Sequence
  Description of Artificial Sequence: Synthetic oligonucleotide
gaagcgccaaagagtccaataattgttttcaggacc

SEQ ID NO: 327537 - DNA, 38 bp, Artificial Sequence
  Description of Artificial Sequence: Synthetic oligonucleotide
aagcgccaaagagtccaataattgttttcaggaccttg

SEQ ID NO: 327538 - DNA, 37 bp, Artificial Sequence
  Description of Artificial Sequence: Synthetic oligonucleotide
agcgccaaagagtccaataattgttttcaggaccttg

SEQ ID NO: 327539 - DNA, 36 bp, Artificial Sequence
  Description of Artificial Sequence: Synthetic oligonucleotide
gcgccaaagagtccaataattgttttcaggaccttg

SEQ ID NO: 327540 - DNA, 36 bp, Artificial Sequence
  Description of Artificial Sequence: Synthetic oligonucleotide
cgccaaagagtccaataattgttttcaggaccttgc

SEQ ID NO: 327541 - DNA, 36 bp, Artificial Sequence
  Description of Artificial Sequence: Synthetic oligonucleotide
gccaaagagtccaataattgttttcaggaccttgcc

SEQ ID NO: 327542 - DNA, 37 bp, Artificial Sequence
  Description of Artificial Sequence: Synthetic oligonucleotide
ccaaagagtccaataattgttttcaggaccttgccac

SEQ ID NO: 327543 - DNA, 40 bp, Artificial Sequence
  Description of Artificial Sequence: Synthetic oligonucleotide
caaagagtccaataattgttttcaggaccttgccacatag

SEQ ID NO: 327544 - DNA, 42 bp, Artificial Sequence
  Description of Artificial Sequence: Synthetic oligonucleotide
aaagagtccaataattgttttcaggaccttgccacatagaac

SEQ ID NO: 327545 - DNA, 41 bp, Artificial Sequence
  Description of Artificial Sequence: Synthetic oligonucleotide
aagagtccaataattgttttcaggaccttgccacatagaac

SEQ ID NO: 327546 - DNA, 40 bp, Artificial Sequence
  Description of Artificial Sequence: Synthetic oligonucleotide
agagtccaataattgttttcaggaccttgccacatagaac

SEQ ID NO: 327547 - DNA, 39 bp, Artificial Sequence
  Description of Artificial Sequence: Synthetic oligonucleotide
gagtccaataattgttttcaggaccttgccacatagaac

SEQ ID NO: 327548 - DNA, 44 bp, Artificial Sequence
  Description of Artificial Sequence: Synthetic oligonucleotide
agtccaataattgttttcaggaccttgccacatagaacaaaatc

SEQ ID NO: 327549 - DNA, 43 bp, Artificial Sequence
  Description of Artificial Sequence: Synthetic oligonucleotide
gtccaataattgttttcaggaccttgccacatagaacaaaatc

SEQ ID NO: 327550 - DNA, 43 bp, Artificial Sequence
  Description of Artificial Sequence: Synthetic oligonucleotide
tccaataattgttttcaggaccttgccacatagaacaaaatcc

SEQ ID NO: 327551 - DNA, 42 bp, Artificial Sequence
  Description of Artificial Sequence: Synthetic oligonucleotide
ccaataattgttttcaggaccttgccacatagaacaaaatcc

SEQ ID NO: 327552 - DNA, 42 bp, Artificial Sequence
  Description of Artificial Sequence: Synthetic oligonucleotide
caataattgttttcaggaccttgccacatagaacaaaatccg

SEQ ID NO: 327553 - DNA, 43 bp, Artificial Sequence
  Description of Artificial Sequence: Synthetic oligonucleotide
aataattgttttcaggaccttgccacatagaacaaaatccgac

SEQ ID NO: 327554 - DNA, 42 bp, Artificial Sequence
  Description of Artificial Sequence: Synthetic oligonucleotide
ataattgttttcaggaccttgccacatagaacaaaatccgac

SEQ ID NO: 327555 - DNA, 41 bp, Artificial Sequence
  Description of Artificial Sequence: Synthetic oligonucleotide
taattgttttcaggaccttgccacatagaacaaaatccgac

SEQ ID NO: 327556 - DNA, 40 bp, Artificial Sequence
  Description of Artificial Sequence: Synthetic oligonucleotide
aattgttttcaggaccttgccacatagaacaaaatccgac

SEQ ID NO: 327557 - DNA, 39 bp, Artificial Sequence
  Description of Artificial Sequence: Synthetic oligonucleotide
attgttttcaggaccttgccacatagaacaaaatccgac

SEQ ID NO: 327558 - DNA, 38 bp, Artificial Sequence
  Description of Artificial Sequence: Synthetic oligonucleotide
ttgttttcaggaccttgccacatagaacaaaatccgac

SEQ ID NO: 327559 - DNA, 37 bp, Artificial Sequence
  Description of Artificial Sequence: Synthetic oligonucleotide
tgttttcaggaccttgccacatagaacaaaatccgac

SEQ ID NO: 327560 - DNA, 36 bp, Artificial Sequence
  Description of Artificial Sequence: Synthetic oligonucleotide
gttttcaggaccttgccacatagaacaaaatccgac

SEQ ID NO: 327561 - DNA, 38 bp, Artificial Sequence
  Description of Artificial Sequence: Synthetic oligonucleotide
ttttcaggaccttgccacatagaacaaaatccgacttc

SEQ ID NO: 327562 - DNA, 37 bp, Artificial Sequence
  Description of Artificial Sequence: Synthetic oligonucleotide
tttcaggaccttgccacatagaacaaaatccgacttc

SEQ ID NO: 327563 - DNA, 36 bp, Artificial Sequence
  Description of Artificial Sequence: Synthetic oligonucleotide
ttcaggaccttgccacatagaacaaaatccgacttc

SEQ ID NO: 327564 - DNA, 35 bp, Artificial Sequence
  Description of Artificial Sequence: Synthetic oligonucleotide
tcaggaccttgccacatagaacaaaatccgacttc

SEQ ID NO: 327565 - DNA, 34 bp, Artificial Sequence
  Description of Artificial Sequence: Synthetic oligonucleotide
caggaccttgccacatagaacaaaatccgacttc

SEQ ID NO: 327566 - DNA, 34 bp, Artificial Sequence
  Description of Artificial Sequence: Synthetic oligonucleotide
aggaccttgccacatagaacaaaatccgacttcg

SEQ ID NO: 327567 - DNA, 33 bp, Artificial Sequence
  Description of Artificial Sequence: Synthetic oligonucleotide
ggaccttgccacatagaacaaaatccgacttcg

SEQ ID NO: 327568 - DNA, 33 bp, Artificial Sequence
  Description of Artificial Sequence: Synthetic oligonucleotide
gaccttgccacatagaacaaaatccgacttcgc

SEQ ID NO: 327569 - DNA, 34 bp, Artificial Sequence
  Description of Artificial Sequence: Synthetic oligonucleotide
accttgccacatagaacaaaatccgacttcgcag

SEQ ID NO: 327570 - DNA, 33 bp, Artificial Sequence
  Description of Artificial Sequence: Synthetic oligonucleotide
ccttgccacatagaacaaaatccgacttcgcag

SEQ ID NO: 327571 - DNA, 37 bp, Artificial Sequence
  Description of Artificial Sequence: Synthetic oligonucleotide
cttgccacatagaacaaaatccgacttcgcagaatac

SEQ ID NO: 327572 - DNA, 38 bp, Artificial Sequence
  Description of Artificial Sequence: Synthetic oligonucleotide
ttgccacatagaacaaaatccgacttcgcagaatactg

SEQ ID NO: 327573 - DNA, 37 bp, Artificial Sequence
  Description of Artificial Sequence: Synthetic oligonucleotide
tgccacatagaacaaaatccgacttcgcagaatactg

SEQ ID NO: 327574 - DNA, 36 bp, Artificial Sequence
  Description of Artificial Sequence: Synthetic oligonucleotide
gccacatagaacaaaatccgacttcgcagaatactg

SEQ ID NO: 327575 - DNA, 36 bp, Artificial Sequence
  Description of Artificial Sequence: Synthetic oligonucleotide
ccacatagaacaaaatccgacttcgcagaatactgc

SEQ ID NO: 327576 - DNA, 37 bp, Artificial Sequence
  Description of Artificial Sequence: Synthetic oligonucleotide
cacatagaacaaaatccgacttcgcagaatactgcag

SEQ ID NO: 327577 - DNA, 37 bp, Artificial Sequence
  Description of Artificial Sequence: Synthetic oligonucleotide
acatagaacaaaatccgacttcgcagaatactgcagg

SEQ ID NO: 327578 - DNA, 36 bp, Artificial Sequence
  Description of Artificial Sequence: Synthetic oligonucleotide
catagaacaaaatccgacttcgcagaatactgcagg

SEQ ID NO: 327579 - DNA, 37 bp, Artificial Sequence
  Description of Artificial Sequence: Synthetic oligonucleotide
atagaacaaaatccgacttcgcagaatactgcaggtc

SEQ ID NO: 327580 - DNA, 36 bp, Artificial Sequence
  Description of Artificial Sequence: Synthetic oligonucleotide
tagaacaaaatccgacttcgcagaatactgcaggtc

SEQ ID NO: 327581 - DNA, 35 bp, Artificial Sequence
  Description of Artificial Sequence: Synthetic oligonucleotide
agaacaaaatccgacttcgcagaatactgcaggtc

SEQ ID NO: 327582 - DNA, 34 bp, Artificial Sequence
  Description of Artificial Sequence: Synthetic oligonucleotide
gaacaaaatccgacttcgcagaatactgcaggtc

SEQ ID NO: 327583 - DNA, 34 bp, Artificial Sequence
  Description of Artificial Sequence: Synthetic oligonucleotide
aacaaaatccgacttcgcagaatactgcaggtcc

SEQ ID NO: 327584 - DNA, 33 bp, Artificial Sequence
  Description of Artificial Sequence: Synthetic oligonucleotide
acaaaatccgacttcgcagaatactgcaggtcc

SEQ ID NO: 327585 - DNA, 32 bp, Artificial Sequence
  Description of Artificial Sequence: Synthetic oligonucleotide
caaaatccgacttcgcagaatactgcaggtcc

SEQ ID NO: 327586 - DNA, 33 bp, Artificial Sequence
  Description of Artificial Sequence: Synthetic oligonucleotide
aaaatccgacttcgcagaatactgcaggtccag

SEQ ID NO: 327587 - DNA, 32 bp, Artificial Sequence
  Description of Artificial Sequence: Synthetic oligonucleotide
aaatccgacttcgcagaatactgcaggtccag

SEQ ID NO: 327588 - DNA, 31 bp, Artificial Sequence
  Description of Artificial Sequence: Synthetic oligonucleotide
aatccgacttcgcagaatactgcaggtccag

SEQ ID NO: 327589 - DNA, 30 bp, Artificial Sequence
  Description of Artificial Sequence: Synthetic oligonucleotide
atccgacttcgcagaatactgcaggtccag

SEQ ID NO: 327590 - DNA, 29 bp, Artificial Sequence
  Description of Artificial Sequence: Synthetic oligonucleotide
tccgacttcgcagaatactgcaggtccag

SEQ ID NO: 327591 - DNA, 28 bp, Artificial Sequence
  Description of Artificial Sequence: Synthetic oligonucleotide
ccgacttcgcagaatactgcaggtccag

SEQ ID NO: 327592 - DNA, 32 bp, Artificial Sequence
  Description of Artificial Sequence: Synthetic oligonucleotide
cgacttcgcagaatactgcaggtccagatttc

SEQ ID NO: 327593 - DNA, 32 bp, Artificial Sequence
  Description of Artificial Sequence: Synthetic oligonucleotide
gacttcgcagaatactgcaggtccagatttcc

SEQ ID NO: 327594 - DNA, 33 bp, Artificial Sequence
  Description of Artificial Sequence: Synthetic oligonucleotide
acttcgcagaatactgcaggtccagatttcctg

SEQ ID NO: 327595 - DNA, 32 bp, Artificial Sequence
  Description of Artificial Sequence: Synthetic oligonucleotide
cttcgcagaatactgcaggtccagatttcctg

SEQ ID NO: 327596 - DNA, 32 bp, Artificial Sequence
  Description of Artificial Sequence: Synthetic oligonucleotide
ttcgcagaatactgcaggtccagatttcctgg

SEQ ID NO: 327597 - DNA, 31 bp, Artificial Sequence
  Description of Artificial Sequence: Synthetic oligonucleotide
tcgcagaatactgcaggtccagatttcctgg

SEQ ID NO: 327598 - DNA, 30 bp, Artificial Sequence
  Description of Artificial Sequence: Synthetic oligonucleotide
cgcagaatactgcaggtccagatttcctgg

SEQ ID NO: 327599 - DNA, 30 bp, Artificial Sequence
  Description of Artificial Sequence: Synthetic oligonucleotide
gcagaatactgcaggtccagatttcctggc

SEQ ID NO: 327600 - DNA, 31 bp, Artificial Sequence
  Description of Artificial Sequence: Synthetic oligonucleotide
cagaatactgcaggtccagatttcctggcag

SEQ ID NO: 327601 - DNA, 31 bp, Artificial Sequence
  Description of Artificial Sequence: Synthetic oligonucleotide
agaatactgcaggtccagatttcctggcagc

SEQ ID NO: 327602 - DNA, 30 bp, Artificial Sequence
  Description of Artificial Sequence: Synthetic oligonucleotide
gaatactgcaggtccagatttcctggcagc

SEQ ID NO: 327603 - DNA, 30 bp, Artificial Sequence
  Description of Artificial Sequence: Synthetic oligonucleotide
aatactgcaggtccagatttcctggcagcc

SEQ ID NO: 327604 - DNA, 29 bp, Artificial Sequence
  Description of Artificial Sequence: Synthetic oligonucleotide
atactgcaggtccagatttcctggcagcc

SEQ ID NO: 327605 - DNA, 28 bp, Artificial Sequence
  Description of Artificial Sequence: Synthetic oligonucleotide
tactgcaggtccagatttcctggcagcc

SEQ ID NO: 327606 - DNA, 27 bp, Artificial Sequence
  Description of Artificial Sequence: Synthetic oligonucleotide
actgcaggtccagatttcctggcagcc

SEQ ID NO: 327607 - DNA, 27 bp, Artificial Sequence
  Description of Artificial Sequence: Synthetic oligonucleotide
ctgcaggtccagatttcctggcagcca

SEQ ID NO: 327608 - DNA, 27 bp, Artificial Sequence
  Description of Artificial Sequence: Synthetic oligonucleotide
tgcaggtccagatttcctggcagccag

SEQ ID NO: 327609 - DNA, 26 bp, Artificial Sequence
  Description of Artificial Sequence: Synthetic oligonucleotide
gcaggtccagatttcctggcagccag

SEQ ID NO: 327610 - DNA, 26 bp, Artificial Sequence
  Description of Artificial Sequence: Synthetic oligonucleotide
caggtccagatttcctggcagccagg

SEQ ID NO: 327611 - DNA, 27 bp, Artificial Sequence
  Description of Artificial Sequence: Synthetic oligonucleotide
aggtccagatttcctggcagccaggct

SEQ ID NO: 327612 - DNA, 26 bp, Artificial Sequence
  Description of Artificial Sequence: Synthetic oligonucleotide
ggtccagatttcctggcagccaggct

SEQ ID NO: 327613 - DNA, 27 bp, Artificial Sequence
  Description of Artificial Sequence: Synthetic oligonucleotide
gtccagatttcctggcagccaggctct

SEQ ID NO: 327614 - DNA, 27 bp, Artificial Sequence
  Description of Artificial Sequence: Synthetic oligonucleotide
tccagatttcctggcagccaggctctc

SEQ ID NO: 327615 - DNA, 26 bp, Artificial Sequence
  Description of Artificial Sequence: Synthetic oligonucleotide
ccagatttcctggcagccaggctctc

SEQ ID NO: 327616 - DNA, 26 bp, Artificial Sequence
  Description of Artificial Sequence: Synthetic oligonucleotide
cagatttcctggcagccaggctctcg

SEQ ID NO: 327617 - DNA, 26 bp, Artificial Sequence
  Description of Artificial Sequence: Synthetic oligonucleotide
agatttcctggcagccaggctctcgg

SEQ ID NO: 327618 - DNA, 25 bp, Artificial Sequence
  Description of Artificial Sequence: Synthetic oligonucleotide
gatttcctggcagccaggctctcgg

SEQ ID NO: 327619 - DNA, 26 bp, Artificial Sequence
  Description of Artificial Sequence: Synthetic oligonucleotide
atttcctggcagccaggctctcggga

SEQ ID NO: 327620 - DNA, 25 bp, Artificial Sequence
  Description of Artificial Sequence: Synthetic oligonucleotide
tttcctggcagccaggctctcggga

SEQ ID NO: 327621 - DNA, 24 bp, Artificial Sequence
  Description of Artificial Sequence: Synthetic oligonucleotide
ttcctggcagccaggctctcggga

SEQ ID NO: 327622 - DNA, 23 bp, Artificial Sequence
  Description of Artificial Sequence: Synthetic oligonucleotide
tcctggcagccaggctctcggga

SEQ ID NO: 327623 - DNA, 22 bp, Artificial Sequence
  Description of Artificial Sequence: Synthetic oligonucleotide
cctggcagccaggctctcggga

SEQ ID NO: 327624 - DNA, 22 bp, Artificial Sequence
  Description of Artificial Sequence: Synthetic oligonucleotide
ctggcagccaggctctcgggag

SEQ ID NO: 327625 - DNA, 23 bp, Artificial Sequence
  Description of Artificial Sequence: Synthetic oligonucleotide
tggcagccaggctctcgggagga

SEQ ID NO: 327626 - DNA, 22 bp, Artificial Sequence
  Description of Artificial Sequence: Synthetic oligonucleotide
ggcagccaggctctcgggagga

SEQ ID NO: 327627 - DNA, 25 bp, Artificial Sequence
  Description of Artificial Sequence: Synthetic oligonucleotide
gcagccaggctctcgggaggagata

SEQ ID NO: 327628 - DNA, 25 bp, Artificial Sequence
  Description of Artificial Sequence: Synthetic oligonucleotide
cagccaggctctcgggaggagatag

SEQ ID NO: 327629 - DNA, 25 bp, Artificial Sequence
  Description of Artificial Sequence: Synthetic oligonucleotide
agccaggctctcgggaggagatagc

SEQ ID NO: 327630 - DNA, 24 bp, Artificial Sequence
  Description of Artificial Sequence: Synthetic oligonucleotide
gccaggctctcgggaggagatagc

SEQ ID NO: 327631 - DNA, 26 bp, Artificial Sequence
  Description of Artificial Sequence: Synthetic oligonucleotide
ccaggctctcgggaggagatagcctt

SEQ ID NO: 327632 - DNA, 26 bp, Artificial Sequence
  Description of Artificial Sequence: Synthetic oligonucleotide
caggctctcgggaggagatagccttc

SEQ ID NO: 327633 - DNA, 27 bp, Artificial Sequence
  Description of Artificial Sequence: Synthetic oligonucleotide
aggctctcgggaggagatagccttcca

SEQ ID NO: 327634 - DNA, 26 bp, Artificial Sequence
  Description of Artificial Sequence: Synthetic oligonucleotide
ggctctcgggaggagatagccttcca

SEQ ID NO: 327635 - DNA, 27 bp, Artificial Sequence
  Description of Artificial Sequence: Synthetic oligonucleotide
gctctcgggaggagatagccttccact

SEQ ID NO: 327636 - DNA, 28 bp, Artificial Sequence
  Description of Artificial Sequence: Synthetic oligonucleotide
ctctcgggaggagatagccttccacttc

SEQ ID NO: 327637 - DNA, 30 bp, Artificial Sequence
  Description of Artificial Sequence: Synthetic oligonucleotide
tctcgggaggagatagccttccacttctac

SEQ ID NO: 327638 - DNA, 29 bp, Artificial Sequence
  Description of Artificial Sequence: Synthetic oligonucleotide
ctcgggaggagatagccttccacttctac

SEQ ID NO: 327639 - DNA, 31 bp, Artificial Sequence
  Description of Artificial Sequence: Synthetic oligonucleotide
tcgggaggagatagccttccacttctacaac

SEQ ID NO: 327640 - DNA, 30 bp, Artificial Sequence
  Description of Artificial Sequence: Synthetic oligonucleotide
cgggaggagatagccttccacttctacaac

SEQ ID NO: 327641 - DNA, 31 bp, Artificial Sequence
  Description of Artificial Sequence: Synthetic oligonucleotide
gggaggagatagccttccacttctacaacac

SEQ ID NO: 327642 - DNA, 31 bp, Artificial Sequence
  Description of Artificial Sequence: Synthetic oligonucleotide
ggaggagatagccttccacttctacaacacc

SEQ ID NO: 327643 - DNA, 32 bp, Artificial Sequence
  Description of Artificial Sequence: Synthetic oligonucleotide
gaggagatagccttccacttctacaacacctg

SEQ ID NO: 327644 - DNA, 32 bp, Artificial Sequence
  Description of Artificial Sequence: Synthetic oligonucleotide
aggagatagccttccacttctacaacacctgc

SEQ ID NO: 327645 - DNA, 31 bp, Artificial Sequence
  Description of Artificial Sequence: Synthetic oligonucleotide
ggagatagccttccacttctacaacacctgc

SEQ ID NO: 327646 - DNA, 33 bp, Artificial Sequence
  Description of Artificial Sequence: Synthetic oligonucleotide
gagatagccttccacttctacaacacctgcatg

SEQ ID NO: 327647 - DNA, 33 bp, Artificial Sequence
  Description of Artificial Sequence: Synthetic oligonucleotide
agatagccttccacttctacaacacctgcatgg

SEQ ID NO: 327648 - DNA, 32 bp, Artificial Sequence
  Description of Artificial Sequence: Synthetic oligonucleotide
gatagccttccacttctacaacacctgcatgg

SEQ ID NO: 327649 - DNA, 35 bp, Artificial Sequence
  Description of Artificial Sequence: Synthetic oligonucleotide
atagccttccacttctacaacacctgcatggttac

SEQ ID NO: 327650 - DNA, 34 bp, Artificial Sequence
  Description of Artificial Sequence: Synthetic oligonucleotide
tagccttccacttctacaacacctgcatggttac

SEQ ID NO: 327651 - DNA, 33 bp, Artificial Sequence
  Description of Artificial Sequence: Synthetic oligonucleotide
agccttccacttctacaacacctgcatggttac

SEQ ID NO: 327652 - DNA, 32 bp, Artificial Sequence
  Description of Artificial Sequence: Synthetic oligonucleotide
gccttccacttctacaacacctgcatggttac

SEQ ID NO: 327653 - DNA, 33 bp, Artificial Sequence
  Description of Artificial Sequence: Synthetic oligonucleotide
ccttccacttctacaacacctgcatggttacac

SEQ ID NO: 327654 - DNA, 35 bp, Artificial Sequence
  Description of Artificial Sequence: Synthetic oligonucleotide
cttccacttctacaacacctgcatggttacacttg

SEQ ID NO: 327655 - DNA, 35 bp, Artificial Sequence
  Description of Artificial Sequence: Synthetic oligonucleotide
ttccacttctacaacacctgcatggttacacttgc

SEQ ID NO: 327656 - DNA, 34 bp, Artificial Sequence
  Description of Artificial Sequence: Synthetic oligonucleotide
tccacttctacaacacctgcatggttacacttgc

SEQ ID NO: 327657 - DNA, 33 bp, Artificial Sequence
  Description of Artificial Sequence: Synthetic oligonucleotide
ccacttctacaacacctgcatggttacacttgc

SEQ ID NO: 327658 - DNA, 33 bp, Artificial Sequence
  Description of Artificial Sequence: Synthetic oligonucleotide
cacttctacaacacctgcatggttacacttgcg

SEQ ID NO: 327659 - DNA, 36 bp, Artificial Sequence
  Description of Artificial Sequence: Synthetic oligonucleotide
acttctacaacacctgcatggttacacttgcgattg

SEQ ID NO: 327660 - DNA, 35 bp, Artificial Sequence
  Description of Artificial Sequence: Synthetic oligonucleotide
cttctacaacacctgcatggttacacttgcgattg

SEQ ID NO: 327661 - DNA, 37 bp, Artificial Sequence
  Description of Artificial Sequence: Synthetic oligonucleotide
ttctacaacacctgcatggttacacttgcgattgaag

SEQ ID NO: 327662 - DNA, 36 bp, Artificial Sequence
  Description of Artificial Sequence: Synthetic oligonucleotide
tctacaacacctgcatggttacacttgcgattgaag

SEQ ID NO: 327663 - DNA, 35 bp, Artificial Sequence
  Description of Artificial Sequence: Synthetic oligonucleotide
ctacaacacctgcatggttacacttgcgattgaag

SEQ ID NO: 327664 - DNA, 35 bp, Artificial Sequence
  Description of Artificial Sequence: Synthetic oligonucleotide
tacaacacctgcatggttacacttgcgattgaagc

SEQ ID NO: 327665 - DNA, 34 bp, Artificial Sequence
  Description of Artificial Sequence: Synthetic oligonucleotide
acaacacctgcatggttacacttgcgattgaagc

SEQ ID NO: 327666 - DNA, 33 bp, Artificial Sequence
  Description of Artificial Sequence: Synthetic oligonucleotide
caacacctgcatggttacacttgcgattgaagc

SEQ ID NO: 327667 - DNA, 34 bp, Artificial Sequence
  Description of Artificial Sequence: Synthetic oligonucleotide
aacacctgcatggttacacttgcgattgaagctc

SEQ ID NO: 327668 - DNA, 33 bp, Artificial Sequence
  Description of Artificial Sequence: Synthetic oligonucleotide
acacctgcatggttacacttgcgattgaagctc

SEQ ID NO: 327669 - DNA, 32 bp, Artificial Sequence
  Description of Artificial Sequence: Synthetic oligonucleotide
cacctgcatggttacacttgcgattgaagctc

SEQ ID NO: 327670 - DNA, 32 bp, Artificial Sequence
  Description of Artificial Sequence: Synthetic oligonucleotide
acctgcatggttacacttgcgattgaagctcc

SEQ ID NO: 327671 - DNA, 31 bp, Artificial Sequence
  Description of Artificial Sequence: Synthetic oligonucleotide
cctgcatggttacacttgcgattgaagctcc

SEQ ID NO: 327672 - DNA, 32 bp, Artificial Sequence
  Description of Artificial Sequence: Synthetic oligonucleotide
ctgcatggttacacttgcgattgaagctccag

SEQ ID NO: 327673 - DNA, 32 bp, Artificial Sequence
  Description of Artificial Sequence: Synthetic oligonucleotide
tgcatggttacacttgcgattgaagctccagg

SEQ ID NO: 327674 - DNA, 31 bp, Artificial Sequence
  Description of Artificial Sequence: Synthetic oligonucleotide
gcatggttacacttgcgattgaagctccagg

SEQ ID NO: 327675 - DNA, 31 bp, Artificial Sequence
  Description of Artificial Sequence: Synthetic oligonucleotide
catggttacacttgcgattgaagctccaggg

SEQ ID NO: 327676 - DNA, 32 bp, Artificial Sequence
  Description of Artificial Sequence: Synthetic oligonucleotide
atggttacacttgcgattgaagctccagggac

SEQ ID NO: 327677 - DNA, 31 bp, Artificial Sequence
  Description of Artificial Sequence: Synthetic oligonucleotide
tggttacacttgcgattgaagctccagggac

SEQ ID NO: 327678 - DNA, 30 bp, Artificial Sequence
  Description of Artificial Sequence: Synthetic oligonucleotide
ggttacacttgcgattgaagctccagggac

SEQ ID NO: 327679 - DNA, 31 bp, Artificial Sequence
  Description of Artificial Sequence: Synthetic oligonucleotide
gttacacttgcgattgaagctccagggactg

SEQ ID NO: 327680 - DNA, 31 bp, Artificial Sequence
  Description of Artificial Sequence: Synthetic oligonucleotide
ttacacttgcgattgaagctccagggactgc

SEQ ID NO: 327681 - DNA, 30 bp, Artificial Sequence
  Description of Artificial Sequence: Synthetic oligonucleotide
tacacttgcgattgaagctccagggactgc

SEQ ID NO: 327682 - DNA, 29 bp, Artificial Sequence
  Description of Artificial Sequence: Synthetic oligonucleotide
acacttgcgattgaagctccagggactgc

SEQ ID NO: 327683 - DNA, 28 bp, Artificial Sequence
  Description of Artificial Sequence: Synthetic oligonucleotide
cacttgcgattgaagctccagggactgc

SEQ ID NO: 327684 - DNA, 29 bp, Artificial Sequence
  Description of Artificial Sequence: Synthetic oligonucleotide
acttgcgattgaagctccagggactgctc

SEQ ID NO: 327685 - DNA, 28 bp, Artificial Sequence
  Description of Artificial Sequence: Synthetic oligonucleotide
cttgcgattgaagctccagggactgctc

SEQ ID NO: 327686 - DNA, 28 bp, Artificial Sequence
  Description of Artificial Sequence: Synthetic oligonucleotide
ttgcgattgaagctccagggactgctcc

SEQ ID NO: 327687 - DNA, 27 bp, Artificial Sequence
  Description of Artificial Sequence: Synthetic oligonucleotide
tgcgattgaagctccagggactgctcc

SEQ ID NO: 327688 - DNA, 26 bp, Artificial Sequence
  Description of Artificial Sequence: Synthetic oligonucleotide
gcgattgaagctccagggactgctcc

SEQ ID NO: 327689 - DNA, 26 bp, Artificial Sequence
  Description of Artificial Sequence: Synthetic oligonucleotide
cgattgaagctccagggactgctccc

SEQ ID NO: 327690 - DNA, 27 bp, Artificial Sequence
  Description of Artificial Sequence: Synthetic oligonucleotide
gattgaagctccagggactgctcccct

SEQ ID NO: 327691 - DNA, 27 bp, Artificial Sequence
  Description of Artificial Sequence: Synthetic oligonucleotide
attgaagctccagggactgctcccctc

SEQ ID NO: 327692 - DNA, 27 bp, Artificial Sequence
  Description of Artificial Sequence: Synthetic oligonucleotide
ttgaagctccagggactgctcccctca

SEQ ID NO: 327693 - DNA, 26 bp, Artificial Sequence
  Description of Artificial Sequence: Synthetic oligonucleotide
tgaagctccagggactgctcccctca

SEQ ID NO: 327694 - DNA, 25 bp, Artificial Sequence
  Description of Artificial Sequence: Synthetic oligonucleotide
gaagctccagggactgctcccctca

SEQ ID NO: 327695 - DNA, 26 bp, Artificial Sequence
  Description of Artificial Sequence: Synthetic oligonucleotide
aagctccagggactgctcccctcagt

SEQ ID NO: 327696 - DNA, 25 bp, Artificial Sequence
  Description of Artificial Sequence: Synthetic oligonucleotide
agctccagggactgctcccctcagt

SEQ ID NO: 327697 - DNA, 24 bp, Artificial Sequence
  Description of Artificial Sequence: Synthetic oligonucleotide
gctccagggactgctcccctcagt

SEQ ID NO: 327698 - DNA, 26 bp, Artificial Sequence
  Description of Artificial Sequence: Synthetic oligonucleotide
ctccagggactgctcccctcagtcaa

SEQ ID NO: 327699 - DNA, 27 bp, Artificial Sequence
  Description of Artificial Sequence: Synthetic oligonucleotide
tccagggactgctcccctcagtcaagt

SEQ ID NO: 327700 - DNA, 27 bp, Artificial Sequence
  Description of Artificial Sequence: Synthetic oligonucleotide
ccagggactgctcccctcagtcaagtt

SEQ ID NO: 327701 - DNA, 30 bp, Artificial Sequence
  Description of Artificial Sequence: Synthetic oligonucleotide
cagggactgctcccctcagtcaagttattc

SEQ ID NO: 327702 - DNA, 31 bp, Artificial Sequence
  Description of Artificial Sequence: Synthetic oligonucleotide
agggactgctcccctcagtcaagttattcag

SEQ ID NO: 327703 - DNA, 30 bp, Artificial Sequence
  Description of Artificial Sequence: Synthetic oligonucleotide
gggactgctcccctcagtcaagttattcag

SEQ ID NO: 327704 - DNA, 30 bp, Artificial Sequence
  Description of Artificial Sequence: Synthetic oligonucleotide
ggactgctcccctcagtcaagttattcagg

SEQ ID NO: 327705 - DNA, 31 bp, Artificial Sequence
  Description of Artificial Sequence: Synthetic oligonucleotide
gactgctcccctcagtcaagttattcaggag

SEQ ID NO: 327706 - DNA, 31 bp, Artificial Sequence
  Description of Artificial Sequence: Synthetic oligonucleotide
actgctcccctcagtcaagttattcaggagc

SEQ ID NO: 327707 - DNA, 30 bp, Artificial Sequence
  Description of Artificial Sequence: Synthetic oligonucleotide
ctgctcccctcagtcaagttattcaggagc

SEQ ID NO: 327708 - DNA, 32 bp, Artificial Sequence
  Description of Artificial Sequence: Synthetic oligonucleotide
tgctcccctcagtcaagttattcaggagcttg

SEQ ID NO: 327709 - DNA, 31 bp, Artificial Sequence
  Description of Artificial Sequence: Synthetic oligonucleotide
gctcccctcagtcaagttattcaggagcttg

SEQ ID NO: 327710 - DNA, 31 bp, Artificial Sequence
  Description of Artificial Sequence: Synthetic oligonucleotide
ctcccctcagtcaagttattcaggagcttgc

SEQ ID NO: 327711 - DNA, 32 bp, Artificial Sequence
  Description of Artificial Sequence: Synthetic oligonucleotide
tcccctcagtcaagttattcaggagcttgcag

SEQ ID NO: 327712 - DNA, 31 bp, Artificial Sequence
  Description of Artificial Sequence: Synthetic oligonucleotide
cccctcagtcaagttattcaggagcttgcag

SEQ ID NO: 327713 - DNA, 31 bp, Artificial Sequence
  Description of Artificial Sequence: Synthetic oligonucleotide
ccctcagtcaagttattcaggagcttgcagg

SEQ ID NO: 327714 - DNA, 31 bp, Artificial Sequence
  Description of Artificial Sequence: Synthetic oligonucleotide
cctcagtcaagttattcaggagcttgcaggc

SEQ ID NO: 327715 - DNA, 32 bp, Artificial Sequence
  Description of Artificial Sequence: Synthetic oligonucleotide
ctcagtcaagttattcaggagcttgcaggctg

SEQ ID NO: 327716 - DNA, 32 bp, Artificial Sequence
  Description of Artificial Sequence: Synthetic oligonucleotide
tcagtcaagttattcaggagcttgcaggctgg

SEQ ID NO: 327717 - DNA, 31 bp, Artificial Sequence
  Description of Artificial Sequence: Synthetic oligonucleotide
cagtcaagttattcaggagcttgcaggctgg

SEQ ID NO: 327718 - DNA, 31 bp, Artificial Sequence
  Description of Artificial Sequence: Synthetic oligonucleotide
agtcaagttattcaggagcttgcaggctggc

SEQ ID NO: 327719 - DNA, 30 bp, Artificial Sequence
  Description of Artificial Sequence: Synthetic oligonucleotide
gtcaagttattcaggagcttgcaggctggc

SEQ ID NO: 327720 - DNA, 30 bp, Artificial Sequence
  Description of Artificial Sequence: Synthetic oligonucleotide
tcaagttattcaggagcttgcaggctggcg

SEQ ID NO: 327721 - DNA, 29 bp, Artificial Sequence
  Description of Artificial Sequence: Synthetic oligonucleotide
caagttattcaggagcttgcaggctggcg

SEQ ID NO: 327722 - DNA, 29 bp, Artificial Sequence
  Description of Artificial Sequence: Synthetic oligonucleotide
aagttattcaggagcttgcaggctggcgg

SEQ ID NO: 327723 - DNA, 28 bp, Artificial Sequence
  Description of Artificial Sequence: Synthetic oligonucleotide
agttattcaggagcttgcaggctggcgg

SEQ ID NO: 327724 - DNA, 27 bp, Artificial Sequence
  Description of Artificial Sequence: Synthetic oligonucleotide
gttattcaggagcttgcaggctggcgg

SEQ ID NO: 327725 - DNA, 29 bp, Artificial Sequence
  Description of Artificial Sequence: Synthetic oligonucleotide
ttattcaggagcttgcaggctggcggatc

SEQ ID NO: 327726 - DNA, 28 bp, Artificial Sequence
  Description of Artificial Sequence: Synthetic oligonucleotide
tattcaggagcttgcaggctggcggatc

SEQ ID NO: 327727 - DNA, 27 bp, Artificial Sequence
  Description of Artificial Sequence: Synthetic oligonucleotide
attcaggagcttgcaggctggcggatc

SEQ ID NO: 327728 - DNA, 27 bp, Artificial Sequence
  Description of Artificial Sequence: Synthetic oligonucleotide
ttcaggagcttgcaggctggcggatct

SEQ ID NO: 327729 - DNA, 26 bp, Artificial Sequence
  Description of Artificial Sequence: Synthetic oligonucleotide
tcaggagcttgcaggctggcggatct

SEQ ID NO: 327730 - DNA, 25 bp, Artificial Sequence
  Description of Artificial Sequence: Synthetic oligonucleotide
caggagcttgcaggctggcggatct

SEQ ID NO: 327731 - DNA, 26 bp, Artificial Sequence
  Description of Artificial Sequence: Synthetic oligonucleotide
aggagcttgcaggctggcggatctct

SEQ ID NO: 327732 - DNA, 25 bp, Artificial Sequence
  Description of Artificial Sequence: Synthetic oligonucleotide
ggagcttgcaggctggcggatctct

SEQ ID NO: 327733 - DNA, 25 bp, Artificial Sequence
  Description of Artificial Sequence: Synthetic oligonucleotide
gagcttgcaggctggcggatctctg

SEQ ID NO: 327734 - DNA, 27 bp, Artificial Sequence
  Description of Artificial Sequence: Synthetic oligonucleotide
agcttgcaggctggcggatctctggtt

SEQ ID NO: 327735 - DNA, 27 bp, Artificial Sequence
  Description of Artificial Sequence: Synthetic oligonucleotide
gcttgcaggctggcggatctctggtta

SEQ ID NO: 327736 - DNA, 29 bp, Artificial Sequence
  Description of Artificial Sequence: Synthetic oligonucleotide
cttgcaggctggcggatctctggttaatg

SEQ ID NO: 327737 - DNA, 29 bp, Artificial Sequence
  Description of Artificial Sequence: Synthetic oligonucleotide
ttgcaggctggcggatctctggttaatgg

SEQ ID NO: 327738 - DNA, 28 bp, Artificial Sequence
  Description of Artificial Sequence: Synthetic oligonucleotide
tgcaggctggcggatctctggttaatgg

SEQ ID NO: 327739 - DNA, 27 bp, Artificial Sequence
  Description of Artificial Sequence: Synthetic oligonucleotide
gcaggctggcggatctctggttaatgg

SEQ ID NO: 327740 - DNA, 28 bp, Artificial Sequence
  Description of Artificial Sequence: Synthetic oligonucleotide
caggctggcggatctctggttaatggac

SEQ ID NO: 327741 - DNA, 30 bp, Artificial Sequence
  Description of Artificial Sequence: Synthetic oligonucleotide
aggctggcggatctctggttaatggacttg

SEQ ID NO: 327742 - DNA, 29 bp, Artificial Sequence
  Description of Artificial Sequence: Synthetic oligonucleotide
ggctggcggatctctggttaatggacttg

SEQ ID NO: 327743 - DNA, 29 bp, Artificial Sequence
  Description of Artificial Sequence: Synthetic oligonucleotide
gctggcggatctctggttaatggacttgc

SEQ ID NO: 327744 - DNA, 34 bp, Artificial Sequence
  Description of Artificial Sequence: Synthetic oligonucleotide
ctggcggatctctggttaatggacttgcttaaac

SEQ ID NO: 327745 - DNA, 39 bp, Artificial Sequence
  Description of Artificial Sequence: Synthetic oligonucleotide
tggcggatctctggttaatggacttgcttaaacttaaac

SEQ ID NO: 327746 - DNA, 38 bp, Artificial Sequence
  Description of Artificial Sequence: Synthetic oligonucleotide
ggcggatctctggttaatggacttgcttaaacttaaac

SEQ ID NO: 327747 - DNA, 38 bp, Artificial Sequence
  Description of Artificial Sequence: Synthetic oligonucleotide
gcggatctctggttaatggacttgcttaaacttaaacc

SEQ ID NO: 327748 - DNA, 38 bp, Artificial Sequence
  Description of Artificial Sequence: Synthetic oligonucleotide
cggatctctggttaatggacttgcttaaacttaaaccg

SEQ ID NO: 327749 - DNA, 40 bp, Artificial Sequence
  Description of Artificial Sequence: Synthetic oligonucleotide
ggatctctggttaatggacttgcttaaacttaaaccgaac

SEQ ID NO: 327750 - DNA, 40 bp, Artificial Sequence
  Description of Artificial Sequence: Synthetic oligonucleotide
gatctctggttaatggacttgcttaaacttaaaccgaacg

SEQ ID NO: 327751 - DNA, 40 bp, Artificial Sequence
  Description of Artificial Sequence: Synthetic oligonucleotide
atctctggttaatggacttgcttaaacttaaaccgaacgg

SEQ ID NO: 327752 - DNA, 39 bp, Artificial Sequence
  Description of Artificial Sequence: Synthetic oligonucleotide
tctctggttaatggacttgcttaaacttaaaccgaacgg

SEQ ID NO: 327753 - DNA, 38 bp, Artificial Sequence
  Description of Artificial Sequence: Synthetic oligonucleotide
ctctggttaatggacttgcttaaacttaaaccgaacgg

SEQ ID NO: 327754 - DNA, 39 bp, Artificial Sequence
  Description of Artificial Sequence: Synthetic oligonucleotide
tctggttaatggacttgcttaaacttaaaccgaacggtg

SEQ ID NO: 327755 - DNA, 38 bp, Artificial Sequence
  Description of Artificial Sequence: Synthetic oligonucleotide
ctggttaatggacttgcttaaacttaaaccgaacggtg

SEQ ID NO: 327756 - DNA, 39 bp, Artificial Sequence
  Description of Artificial Sequence: Synthetic oligonucleotide
tggttaatggacttgcttaaacttaaaccgaacggtgag

SEQ ID NO: 327757 - DNA, 38 bp, Artificial Sequence
  Description of Artificial Sequence: Synthetic oligonucleotide
ggttaatggacttgcttaaacttaaaccgaacggtgag

SEQ ID NO: 327758 - DNA, 39 bp, Artificial Sequence
  Description of Artificial Sequence: Synthetic oligonucleotide
gttaatggacttgcttaaacttaaaccgaacggtgagac

SEQ ID NO: 327759 - DNA, 41 bp, Artificial Sequence
  Description of Artificial Sequence: Synthetic oligonucleotide
ttaatggacttgcttaaacttaaaccgaacggtgagacttc

SEQ ID NO: 327760 - DNA, 40 bp, Artificial Sequence
  Description of Artificial Sequence: Synthetic oligonucleotide
taatggacttgcttaaacttaaaccgaacggtgagacttc

SEQ ID NO: 327761 - DNA, 39 bp, Artificial Sequence
  Description of Artificial Sequence: Synthetic oligonucleotide
aatggacttgcttaaacttaaaccgaacggtgagacttc

SEQ ID NO: 327762 - DNA, 38 bp, Artificial Sequence
  Description of Artificial Sequence: Synthetic oligonucleotide
atggacttgcttaaacttaaaccgaacggtgagacttc

SEQ ID NO: 327763 - DNA, 37 bp, Artificial Sequence
  Description of Artificial Sequence: Synthetic oligonucleotide
tggacttgcttaaacttaaaccgaacggtgagacttc

SEQ ID NO: 327764 - DNA, 36 bp, Artificial Sequence
  Description of Artificial Sequence: Synthetic oligonucleotide
ggacttgcttaaacttaaaccgaacggtgagacttc

SEQ ID NO: 327765 - DNA, 37 bp, Artificial Sequence
  Description of Artificial Sequence: Synthetic oligonucleotide
gacttgcttaaacttaaaccgaacggtgagacttcag

SEQ ID NO: 327766 - DNA, 39 bp, Artificial Sequence
  Description of Artificial Sequence: Synthetic oligonucleotide
acttgcttaaacttaaaccgaacggtgagacttcagatg

SEQ ID NO: 327767 - DNA, 38 bp, Artificial Sequence
  Description of Artificial Sequence: Synthetic oligonucleotide
cttgcttaaacttaaaccgaacggtgagacttcagatg

SEQ ID NO: 327768 - DNA, 39 bp, Artificial Sequence
  Description of Artificial Sequence: Synthetic oligonucleotide
ttgcttaaacttaaaccgaacggtgagacttcagatgag

SEQ ID NO: 327769 - DNA, 38 bp, Artificial Sequence
  Description of Artificial Sequence: Synthetic oligonucleotide
tgcttaaacttaaaccgaacggtgagacttcagatgag

SEQ ID NO: 327770 - DNA, 37 bp, Artificial Sequence
  Description of Artificial Sequence: Synthetic oligonucleotide
gcttaaacttaaaccgaacggtgagacttcagatgag

SEQ ID NO: 327771 - DNA, 38 bp, Artificial Sequence
  Description of Artificial Sequence: Synthetic oligonucleotide
cttaaacttaaaccgaacggtgagacttcagatgagtc

SEQ ID NO: 327772 - DNA, 39 bp, Artificial Sequence
  Description of Artificial Sequence: Synthetic oligonucleotide
ttaaacttaaaccgaacggtgagacttcagatgagtcac

SEQ ID NO: 327773 - DNA, 38 bp, Artificial Sequence
  Description of Artificial Sequence: Synthetic oligonucleotide
taaacttaaaccgaacggtgagacttcagatgagtcac

SEQ ID NO: 327774 - DNA, 37 bp, Artificial Sequence
  Description of Artificial Sequence: Synthetic oligonucleotide
aaacttaaaccgaacggtgagacttcagatgagtcac

SEQ ID NO: 327775 - DNA, 36 bp, Artificial Sequence
  Description of Artificial Sequence: Synthetic oligonucleotide
aacttaaaccgaacggtgagacttcagatgagtcac

SEQ ID NO: 327776 - DNA, 35 bp, Artificial Sequence
  Description of Artificial Sequence: Synthetic oligonucleotide
acttaaaccgaacggtgagacttcagatgagtcac

SEQ ID NO: 327777 - DNA, 34 bp, Artificial Sequence
  Description of Artificial Sequence: Synthetic oligonucleotide
cttaaaccgaacggtgagacttcagatgagtcac

SEQ ID NO: 327778 - DNA, 37 bp, Artificial Sequence
  Description of Artificial Sequence: Synthetic oligonucleotide
ttaaaccgaacggtgagacttcagatgagtcactatg

SEQ ID NO: 327779 - DNA, 36 bp, Artificial Sequence
  Description of Artificial Sequence: Synthetic oligonucleotide
taaaccgaacggtgagacttcagatgagtcactatg

SEQ ID NO: 327780 - DNA, 35 bp, Artificial Sequence
  Description of Artificial Sequence: Synthetic oligonucleotide
aaaccgaacggtgagacttcagatgagtcactatg

SEQ ID NO: 327781 - DNA, 34 bp, Artificial Sequence
  Description of Artificial Sequence: Synthetic oligonucleotide
aaccgaacggtgagacttcagatgagtcactatg

SEQ ID NO: 327782 - DNA, 33 bp, Artificial Sequence
  Description of Artificial Sequence: Synthetic oligonucleotide
accgaacggtgagacttcagatgagtcactatg

SEQ ID NO: 327783 - DNA, 32 bp, Artificial Sequence
  Description of Artificial Sequence: Synthetic oligonucleotide
ccgaacggtgagacttcagatgagtcactatg

SEQ ID NO: 327784 - DNA, 32 bp, Artificial Sequence
  Description of Artificial Sequence: Synthetic oligonucleotide
cgaacggtgagacttcagatgagtcactatgg

SEQ ID NO: 327785 - DNA, 32 bp, Artificial Sequence
  Description of Artificial Sequence: Synthetic oligonucleotide
gaacggtgagacttcagatgagtcactatggc

SEQ ID NO: 327786 - DNA, 32 bp, Artificial Sequence
  Description of Artificial Sequence: Synthetic oligonucleotide
aacggtgagacttcagatgagtcactatggcc

SEQ ID NO: 327787 - DNA, 31 bp, Artificial Sequence
  Description of Artificial Sequence: Synthetic oligonucleotide
acggtgagacttcagatgagtcactatggcc

SEQ ID NO: 327788 - DNA, 30 bp, Artificial Sequence
  Description of Artificial Sequence: Synthetic oligonucleotide
cggtgagacttcagatgagtcactatggcc

SEQ ID NO: 327789 - DNA, 34 bp, Artificial Sequence
  Description of Artificial Sequence: Synthetic oligonucleotide
ggtgagacttcagatgagtcactatggccatatc

SEQ ID NO: 327790 - DNA, 34 bp, Artificial Sequence
  Description of Artificial Sequence: Synthetic oligonucleotide
gtgagacttcagatgagtcactatggccatatcc

SEQ ID NO: 327791 - DNA, 34 bp, Artificial Sequence
  Description of Artificial Sequence: Synthetic oligonucleotide
tgagacttcagatgagtcactatggccatatccc

SEQ ID NO: 327792 - DNA, 33 bp, Artificial Sequence
  Description of Artificial Sequence: Synthetic oligonucleotide
gagacttcagatgagtcactatggccatatccc

SEQ ID NO: 327793 - DNA, 36 bp, Artificial Sequence
  Description of Artificial Sequence: Synthetic oligonucleotide
agacttcagatgagtcactatggccatatccctttc

SEQ ID NO: 327794 - DNA, 35 bp, Artificial Sequence
  Description of Artificial Sequence: Synthetic oligonucleotide
gacttcagatgagtcactatggccatatccctttc

SEQ ID NO: 327795 - DNA, 37 bp, Artificial Sequence
  Description of Artificial Sequence: Synthetic oligonucleotide
acttcagatgagtcactatggccatatccctttctac

SEQ ID NO: 327796 - DNA, 36 bp, Artificial Sequence
  Description of Artificial Sequence: Synthetic oligonucleotide
cttcagatgagtcactatggccatatccctttctac

SEQ ID NO: 327797 - DNA, 37 bp, Artificial Sequence
  Description of Artificial Sequence: Synthetic oligonucleotide
ttcagatgagtcactatggccatatccctttctacag

SEQ ID NO: 327798 - DNA, 36 bp, Artificial Sequence
  Description of Artificial Sequence: Synthetic oligonucleotide
tcagatgagtcactatggccatatccctttctacag

SEQ ID NO: 327799 - DNA, 35 bp, Artificial Sequence
  Description of Artificial Sequence: Synthetic oligonucleotide
cagatgagtcactatggccatatccctttctacag

SEQ ID NO: 327800 - DNA, 36 bp, Artificial Sequence
  Description of Artificial Sequence: Synthetic oligonucleotide
agatgagtcactatggccatatccctttctacagag

SEQ ID NO: 327801 - DNA, 35 bp, Artificial Sequence
  Description of Artificial Sequence: Synthetic oligonucleotide
gatgagtcactatggccatatccctttctacagag

SEQ ID NO: 327802 - DNA, 35 bp, Artificial Sequence
  Description of Artificial Sequence: Synthetic oligonucleotide
atgagtcactatggccatatccctttctacagagc

SEQ ID NO: 327803 - DNA, 34 bp, Artificial Sequence
  Description of Artificial Sequence: Synthetic oligonucleotide
tgagtcactatggccatatccctttctacagagc

SEQ ID NO: 327804 - DNA, 33 bp, Artificial Sequence
  Description of Artificial Sequence: Synthetic oligonucleotide
gagtcactatggccatatccctttctacagagc

SEQ ID NO: 327805 - DNA, 33 bp, Artificial Sequence
  Description of Artificial Sequence: Synthetic oligonucleotide
agtcactatggccatatccctttctacagagcc

SEQ ID NO: 327806 - DNA, 32 bp, Artificial Sequence
  Description of Artificial Sequence: Synthetic oligonucleotide
gtcactatggccatatccctttctacagagcc

SEQ ID NO: 327807 - DNA, 34 bp, Artificial Sequence
  Description of Artificial Sequence: Synthetic oligonucleotide
tcactatggccatatccctttctacagagcctag

SEQ ID NO: 327808 - DNA, 33 bp, Artificial Sequence
  Description of Artificial Sequence: Synthetic oligonucleotide
cactatggccatatccctttctacagagcctag

SEQ ID NO: 327809 - DNA, 33 bp, Artificial Sequence
  Description of Artificial Sequence: Synthetic oligonucleotide
actatggccatatccctttctacagagcctagc

SEQ ID NO: 327810 - DNA, 32 bp, Artificial Sequence
  Description of Artificial Sequence: Synthetic oligonucleotide
ctatggccatatccctttctacagagcctagc

SEQ ID NO: 327811 - DNA, 34 bp, Artificial Sequence
  Description of Artificial Sequence: Synthetic oligonucleotide
tatggccatatccctttctacagagcctagctag

SEQ ID NO: 327812 - DNA, 33 bp, Artificial Sequence
  Description of Artificial Sequence: Synthetic oligonucleotide
atggccatatccctttctacagagcctagctag

SEQ ID NO: 327813 - DNA, 32 bp, Artificial Sequence
  Description of Artificial Sequence: Synthetic oligonucleotide
tggccatatccctttctacagagcctagctag

SEQ ID NO: 327814 - DNA, 31 bp, Artificial Sequence
  Description of Artificial Sequence: Synthetic oligonucleotide
ggccatatccctttctacagagcctagctag

SEQ ID NO: 327815 - DNA, 31 bp, Artificial Sequence
  Description of Artificial Sequence: Synthetic oligonucleotide
gccatatccctttctacagagcctagctagg

SEQ ID NO: 327816 - DNA, 32 bp, Artificial Sequence
  Description of Artificial Sequence: Synthetic oligonucleotide
ccatatccctttctacagagcctagctaggac

SEQ ID NO: 327817 - DNA, 32 bp, Artificial Sequence
  Description of Artificial Sequence: Synthetic oligonucleotide
catatccctttctacagagcctagctaggacc

SEQ ID NO: 327818 - DNA, 33 bp, Artificial Sequence
  Description of Artificial Sequence: Synthetic oligonucleotide
atatccctttctacagagcctagctaggacctg

SEQ ID NO: 327819 - DNA, 32 bp, Artificial Sequence
  Description of Artificial Sequence: Synthetic oligonucleotide
tatccctttctacagagcctagctaggacctg

SEQ ID NO: 327820 - DNA, 31 bp, Artificial Sequence
  Description of Artificial Sequence: Synthetic oligonucleotide
atccctttctacagagcctagctaggacctg

SEQ ID NO: 327821 - DNA, 30 bp, Artificial Sequence
  Description of Artificial Sequence: Synthetic oligonucleotide
tccctttctacagagcctagctaggacctg

SEQ ID NO: 327822 - DNA, 29 bp, Artificial Sequence
  Description of Artificial Sequence: Synthetic oligonucleotide
ccctttctacagagcctagctaggacctg

SEQ ID NO: 327823 - DNA, 31 bp, Artificial Sequence
  Description of Artificial Sequence: Synthetic oligonucleotide
cctttctacagagcctagctaggacctgatc

SEQ ID NO: 327824 - DNA, 31 bp, Artificial Sequence
  Description of Artificial Sequence: Synthetic oligonucleotide
ctttctacagagcctagctaggacctgatcc

SEQ ID NO: 327825 - DNA, 32 bp, Artificial Sequence
  Description of Artificial Sequence: Synthetic oligonucleotide
tttctacagagcctagctaggacctgatcctg

SEQ ID NO: 327826 - DNA, 31 bp, Artificial Sequence
  Description of Artificial Sequence: Synthetic oligonucleotide
ttctacagagcctagctaggacctgatcctg

SEQ ID NO: 327827 - DNA, 30 bp, Artificial Sequence
  Description of Artificial Sequence: Synthetic oligonucleotide
tctacagagcctagctaggacctgatcctg

SEQ ID NO: 327828 - DNA, 29 bp, Artificial Sequence
  Description of Artificial Sequence: Synthetic oligonucleotide
ctacagagcctagctaggacctgatcctg

SEQ ID NO: 327829 - DNA, 29 bp, Artificial Sequence
  Description of Artificial Sequence: Synthetic oligonucleotide
tacagagcctagctaggacctgatcctgc

SEQ ID NO: 327830 - DNA, 28 bp, Artificial Sequence
  Description of Artificial Sequence: Synthetic oligonucleotide
acagagcctagctaggacctgatcctgc

SEQ ID NO: 327831 - DNA, 27 bp, Artificial Sequence
  Description of Artificial Sequence: Synthetic oligonucleotide
cagagcctagctaggacctgatcctgc

SEQ ID NO: 327832 - DNA, 27 bp, Artificial Sequence
  Description of Artificial Sequence: Synthetic oligonucleotide
agagcctagctaggacctgatcctgcc

SEQ ID NO: 327833 - DNA, 27 bp, Artificial Sequence
  Description of Artificial Sequence: Synthetic oligonucleotide
gagcctagctaggacctgatcctgcct

SEQ ID NO: 327834 - DNA, 27 bp, Artificial Sequence
  Description of Artificial Sequence: Synthetic oligonucleotide
agcctagctaggacctgatcctgcctg

SEQ ID NO: 327835 - DNA, 27 bp, Artificial Sequence
  Description of Artificial Sequence: Synthetic oligonucleotide
gcctagctaggacctgatcctgcctgt

SEQ ID NO: 327836 - DNA, 27 bp, Artificial Sequence
  Description of Artificial Sequence: Synthetic oligonucleotide
cctagctaggacctgatcctgcctgtc

SEQ ID NO: 327837 - DNA, 27 bp, Artificial Sequence
  Description of Artificial Sequence: Synthetic oligonucleotide
ctagctaggacctgatcctgcctgtcc

SEQ ID NO: 327838 - DNA, 28 bp, Artificial Sequence
  Description of Artificial Sequence: Synthetic oligonucleotide
tagctaggacctgatcctgcctgtccac

SEQ ID NO: 327839 - DNA, 27 bp, Artificial Sequence
  Description of Artificial Sequence: Synthetic oligonucleotide
agctaggacctgatcctgcctgtccac

SEQ ID NO: 327840 - DNA, 27 bp, Artificial Sequence
  Description of Artificial Sequence: Synthetic oligonucleotide
gctaggacctgatcctgcctgtccaca

SEQ ID NO: 327841 - DNA, 27 bp, Artificial Sequence
  Description of Artificial Sequence: Synthetic oligonucleotide
ctaggacctgatcctgcctgtccacac

SEQ ID NO: 327842 - DNA, 28 bp, Artificial Sequence
  Description of Artificial Sequence: Synthetic oligonucleotide
taggacctgatcctgcctgtccacacac

SEQ ID NO: 327843 - DNA, 27 bp, Artificial Sequence
  Description of Artificial Sequence: Synthetic oligonucleotide
aggacctgatcctgcctgtccacacac

SEQ ID NO: 327844 - DNA, 27 bp, Artificial Sequence
  Description of Artificial Sequence: Synthetic oligonucleotide
ggacctgatcctgcctgtccacacact

SEQ ID NO: 327845 - DNA, 27 bp, Artificial Sequence
  Description of Artificial Sequence: Synthetic oligonucleotide
gacctgatcctgcctgtccacacactc

SEQ ID NO: 327846 - DNA, 27 bp, Artificial Sequence
  Description of Artificial Sequence: Synthetic oligonucleotide
acctgatcctgcctgtccacacactcc

SEQ ID NO: 327847 - DNA, 27 bp, Artificial Sequence
  Description of Artificial Sequence: Synthetic oligonucleotide
cctgatcctgcctgtccacacactcca

SEQ ID NO: 327848 - DNA, 27 bp, Artificial Sequence
  Description of Artificial Sequence: Synthetic oligonucleotide
ctgatcctgcctgtccacacactccag

SEQ ID NO: 327849 - DNA, 28 bp, Artificial Sequence
  Description of Artificial Sequence: Synthetic oligonucleotide
tgatcctgcctgtccacacactccagtc

SEQ ID NO: 327850 - DNA, 27 bp, Artificial Sequence
  Description of Artificial Sequence: Synthetic oligonucleotide
gatcctgcctgtccacacactccagtc

SEQ ID NO: 327851 - DNA, 29 bp, Artificial Sequence
  Description of Artificial Sequence: Synthetic oligonucleotide
atcctgcctgtccacacactccagtcatc

SEQ ID NO: 327852 - DNA, 28 bp, Artificial Sequence
  Description of Artificial Sequence: Synthetic oligonucleotide
tcctgcctgtccacacactccagtcatc

SEQ ID NO: 327853 - DNA, 27 bp, Artificial Sequence
  Description of Artificial Sequence: Synthetic oligonucleotide
cctgcctgtccacacactccagtcatc

SEQ ID NO: 327854 - DNA, 27 bp, Artificial Sequence
  Description of Artificial Sequence: Synthetic oligonucleotide
ctgcctgtccacacactccagtcatcg

SEQ ID NO: 327855 - DNA, 28 bp, Artificial Sequence
  Description of Artificial Sequence: Synthetic oligonucleotide
tgcctgtccacacactccagtcatcgag

SEQ ID NO: 327856 - DNA, 27 bp, Artificial Sequence
  Description of Artificial Sequence: Synthetic oligonucleotide
gcctgtccacacactccagtcatcgag

SEQ ID NO: 327857 - DNA, 30 bp, Artificial Sequence
  Description of Artificial Sequence: Synthetic oligonucleotide
cctgtccacacactccagtcatcgagatag

SEQ ID NO: 327858 - DNA, 31 bp, Artificial Sequence
  Description of Artificial Sequence: Synthetic oligonucleotide
ctgtccacacactccagtcatcgagatagac

SEQ ID NO: 327859 - DNA, 31 bp, Artificial Sequence
  Description of Artificial Sequence: Synthetic oligonucleotide
tgtccacacactccagtcatcgagatagacc

SEQ ID NO: 327860 - DNA, 30 bp, Artificial Sequence
  Description of Artificial Sequence: Synthetic oligonucleotide
gtccacacactccagtcatcgagatagacc

SEQ ID NO: 327861 - DNA, 31 bp, Artificial Sequence
  Description of Artificial Sequence: Synthetic oligonucleotide
tccacacactccagtcatcgagatagacctg

SEQ ID NO: 327862 - DNA, 30 bp, Artificial Sequence
  Description of Artificial Sequence: Synthetic oligonucleotide
ccacacactccagtcatcgagatagacctg

SEQ ID NO: 327863 - DNA, 30 bp, Artificial Sequence
  Description of Artificial Sequence: Synthetic oligonucleotide
cacacactccagtcatcgagatagacctgc

SEQ ID NO: 327864 - DNA, 30 bp, Artificial Sequence
  Description of Artificial Sequence: Synthetic oligonucleotide
acacactccagtcatcgagatagacctgcc

SEQ ID NO: 327865 - DNA, 29 bp, Artificial Sequence
  Description of Artificial Sequence: Synthetic oligonucleotide
cacactccagtcatcgagatagacctgcc

SEQ ID NO: 327866 - DNA, 30 bp, Artificial Sequence
  Description of Artificial Sequence: Synthetic oligonucleotide
acactccagtcatcgagatagacctgccag

SEQ ID NO: 327867 - DNA, 29 bp, Artificial Sequence
  Description of Artificial Sequence: Synthetic oligonucleotide
cactccagtcatcgagatagacctgccag

SEQ ID NO: 327868 - DNA, 30 bp, Artificial Sequence
  Description of Artificial Sequence: Synthetic oligonucleotide
actccagtcatcgagatagacctgccagag

SEQ ID NO: 327869 - DNA, 29 bp, Artificial Sequence
  Description of Artificial Sequence: Synthetic oligonucleotide
ctccagtcatcgagatagacctgccagag

SEQ ID NO: 327870 - DNA, 32 bp, Artificial Sequence
  Description of Artificial Sequence: Synthetic oligonucleotide
tccagtcatcgagatagacctgccagagttag

SEQ ID NO: 327871 - DNA, 31 bp, Artificial Sequence
  Description of Artificial Sequence: Synthetic oligonucleotide
ccagtcatcgagatagacctgccagagttag

SEQ ID NO: 327872 - DNA, 33 bp, Artificial Sequence
  Description of Artificial Sequence: Synthetic oligonucleotide
cagtcatcgagatagacctgccagagttagatg

SEQ ID NO: 327873 - DNA, 35 bp, Artificial Sequence
  Description of Artificial Sequence: Synthetic oligonucleotide
agtcatcgagatagacctgccagagttagatgttc

SEQ ID NO: 327874 - DNA, 34 bp, Artificial Sequence
  Description of Artificial Sequence: Synthetic oligonucleotide
gtcatcgagatagacctgccagagttagatgttc

SEQ ID NO: 327875 - DNA, 34 bp, Artificial Sequence
  Description of Artificial Sequence: Synthetic oligonucleotide
tcatcgagatagacctgccagagttagatgttcc

SEQ ID NO: 327876 - DNA, 33 bp, Artificial Sequence
  Description of Artificial Sequence: Synthetic oligonucleotide
catcgagatagacctgccagagttagatgttcc

SEQ ID NO: 327877 - DNA, 33 bp, Artificial Sequence
  Description of Artificial Sequence: Synthetic oligonucleotide
atcgagatagacctgccagagttagatgttccc

SEQ ID NO: 327878 - DNA, 32 bp, Artificial Sequence
  Description of Artificial Sequence: Synthetic oligonucleotide
tcgagatagacctgccagagttagatgttccc

SEQ ID NO: 327879 - DNA, 31 bp, Artificial Sequence
  Description of Artificial Sequence: Synthetic oligonucleotide
cgagatagacctgccagagttagatgttccc

SEQ ID NO: 327880 - DNA, 31 bp, Artificial Sequence
  Description of Artificial Sequence: Synthetic oligonucleotide
gagatagacctgccagagttagatgttcccg

SEQ ID NO: 327881 - DNA, 32 bp, Artificial Sequence
  Description of Artificial Sequence: Synthetic oligonucleotide
agatagacctgccagagttagatgttcccgtc

SEQ ID NO: 327882 - DNA, 31 bp, Artificial Sequence
  Description of Artificial Sequence: Synthetic oligonucleotide
gatagacctgccagagttagatgttcccgtc

SEQ ID NO: 327883 - DNA, 33 bp, Artificial Sequence
  Description of Artificial Sequence: Synthetic oligonucleotide
atagacctgccagagttagatgttcccgtcaag

SEQ ID NO: 327884 - DNA, 32 bp, Artificial Sequence
  Description of Artificial Sequence: Synthetic oligonucleotide
tagacctgccagagttagatgttcccgtcaag

SEQ ID NO: 327885 - DNA, 31 bp, Artificial Sequence
  Description of Artificial Sequence: Synthetic oligonucleotide
agacctgccagagttagatgttcccgtcaag

SEQ ID NO: 327886 - DNA, 30 bp, Artificial Sequence
  Description of Artificial Sequence: Synthetic oligonucleotide
gacctgccagagttagatgttcccgtcaag

SEQ ID NO: 327887 - DNA, 30 bp, Artificial Sequence
  Description of Artificial Sequence: Synthetic oligonucleotide
acctgccagagttagatgttcccgtcaagc

SEQ ID NO: 327888 - DNA, 29 bp, Artificial Sequence
  Description of Artificial Sequence: Synthetic oligonucleotide
cctgccagagttagatgttcccgtcaagc

SEQ ID NO: 327889 - DNA, 31 bp, Artificial Sequence
  Description of Artificial Sequence: Synthetic oligonucleotide
ctgccagagttagatgttcccgtcaagcaag

SEQ ID NO: 327890 - DNA, 33 bp, Artificial Sequence
  Description of Artificial Sequence: Synthetic oligonucleotide
tgccagagttagatgttcccgtcaagcaagttc

SEQ ID NO: 327891 - DNA, 32 bp, Artificial Sequence
  Description of Artificial Sequence: Synthetic oligonucleotide
gccagagttagatgttcccgtcaagcaagttc

SEQ ID NO: 327892 - DNA, 34 bp, Artificial Sequence
  Description of Artificial Sequence: Synthetic oligonucleotide
ccagagttagatgttcccgtcaagcaagttcaag

SEQ ID NO: 327893 - DNA, 36 bp, Artificial Sequence
  Description of Artificial Sequence: Synthetic oligonucleotide
cagagttagatgttcccgtcaagcaagttcaagaac

SEQ ID NO: 327894 - DNA, 37 bp, Artificial Sequence
  Description of Artificial Sequence: Synthetic oligonucleotide
agagttagatgttcccgtcaagcaagttcaagaacac

SEQ ID NO: 327895 - DNA, 36 bp, Artificial Sequence
  Description of Artificial Sequence: Synthetic oligonucleotide
gagttagatgttcccgtcaagcaagttcaagaacac

SEQ ID NO: 327896 - DNA, 38 bp, Artificial Sequence
  Description of Artificial Sequence: Synthetic oligonucleotide
agttagatgttcccgtcaagcaagttcaagaacacaag

SEQ ID NO: 327897 - DNA, 37 bp, Artificial Sequence
  Description of Artificial Sequence: Synthetic oligonucleotide
gttagatgttcccgtcaagcaagttcaagaacacaag

SEQ ID NO: 327898 - DNA, 39 bp, Artificial Sequence
  Description of Artificial Sequence: Synthetic oligonucleotide
ttagatgttcccgtcaagcaagttcaagaacacaagatc

SEQ ID NO: 327899 - DNA, 38 bp, Artificial Sequence
  Description of Artificial Sequence: Synthetic oligonucleotide
tagatgttcccgtcaagcaagttcaagaacacaagatc

SEQ ID NO: 327900 - DNA, 37 bp, Artificial Sequence
  Description of Artificial Sequence: Synthetic oligonucleotide
agatgttcccgtcaagcaagttcaagaacacaagatc

SEQ ID NO: 327901 - DNA, 36 bp, Artificial Sequence
  Description of Artificial Sequence: Synthetic oligonucleotide
gatgttcccgtcaagcaagttcaagaacacaagatc

SEQ ID NO: 327902 - DNA, 39 bp, Artificial Sequence
  Description of Artificial Sequence: Synthetic oligonucleotide
atgttcccgtcaagcaagttcaagaacacaagatctatc

SEQ ID NO: 327903 - DNA, 38 bp, Artificial Sequence
  Description of Artificial Sequence: Synthetic oligonucleotide
tgttcccgtcaagcaagttcaagaacacaagatctatc

SEQ ID NO: 327904 - DNA, 37 bp, Artificial Sequence
  Description of Artificial Sequence: Synthetic oligonucleotide
gttcccgtcaagcaagttcaagaacacaagatctatc

SEQ ID NO: 327905 - DNA, 37 bp, Artificial Sequence
  Description of Artificial Sequence: Synthetic oligonucleotide
ttcccgtcaagcaagttcaagaacacaagatctatcc

SEQ ID NO: 327906 - DNA, 36 bp, Artificial Sequence
  Description of Artificial Sequence: Synthetic oligonucleotide
tcccgtcaagcaagttcaagaacacaagatctatcc

SEQ ID NO: 327907 - DNA, 35 bp, Artificial Sequence
  Description of Artificial Sequence: Synthetic oligonucleotide
cccgtcaagcaagttcaagaacacaagatctatcc

SEQ ID NO: 327908 - DNA, 35 bp, Artificial Sequence
  Description of Artificial Sequence: Synthetic oligonucleotide
ccgtcaagcaagttcaagaacacaagatctatccc

SEQ ID NO: 327909 - DNA, 35 bp, Artificial Sequence
  Description of Artificial Sequence: Synthetic oligonucleotide
cgtcaagcaagttcaagaacacaagatctatcccc

SEQ ID NO: 327910 - DNA, 36 bp, Artificial Sequence
  Description of Artificial Sequence: Synthetic oligonucleotide
gtcaagcaagttcaagaacacaagatctatccccag

SEQ ID NO: 327911 - DNA, 38 bp, Artificial Sequence
  Description of Artificial Sequence: Synthetic oligonucleotide
tcaagcaagttcaagaacacaagatctatccccagatc

SEQ ID NO: 327912 - DNA, 37 bp, Artificial Sequence
  Description of Artificial Sequence: Synthetic oligonucleotide
caagcaagttcaagaacacaagatctatccccagatc

SEQ ID NO: 327913 - DNA, 40 bp, Artificial Sequence
  Description of Artificial Sequence: Synthetic oligonucleotide
aagcaagttcaagaacacaagatctatccccagatctatc

SEQ ID NO: 327914 - DNA, 39 bp, Artificial Sequence
  Description of Artificial Sequence: Synthetic oligonucleotide
agcaagttcaagaacacaagatctatccccagatctatc

SEQ ID NO: 327915 - DNA, 38 bp, Artificial Sequence
  Description of Artificial Sequence: Synthetic oligonucleotide
gcaagttcaagaacacaagatctatccccagatctatc

SEQ ID NO: 327916 - DNA, 38 bp, Artificial Sequence
  Description of Artificial Sequence: Synthetic oligonucleotide
caagttcaagaacacaagatctatccccagatctatcg

SEQ ID NO: 327917 - DNA, 38 bp, Artificial Sequence
  Description of Artificial Sequence: Synthetic oligonucleotide
aagttcaagaacacaagatctatccccagatctatcgg

SEQ ID NO: 327918 - DNA, 37 bp, Artificial Sequence
  Description of Artificial Sequence: Synthetic oligonucleotide
agttcaagaacacaagatctatccccagatctatcgg

SEQ ID NO: 327919 - DNA, 36 bp, Artificial Sequence
  Description of Artificial Sequence: Synthetic oligonucleotide
gttcaagaacacaagatctatccccagatctatcgg

SEQ ID NO: 327920 - DNA, 36 bp, Artificial Sequence
  Description of Artificial Sequence: Synthetic oligonucleotide
ttcaagaacacaagatctatccccagatctatcggg

SEQ ID NO: 327921 - DNA, 35 bp, Artificial Sequence
  Description of Artificial Sequence: Synthetic oligonucleotide
tcaagaacacaagatctatccccagatctatcggg

SEQ ID NO: 327922 - DNA, 34 bp, Artificial Sequence
  Description of Artificial Sequence: Synthetic oligonucleotide
caagaacacaagatctatccccagatctatcggg

SEQ ID NO: 327923 - DNA, 38 bp, Artificial Sequence
  Description of Artificial Sequence: Synthetic oligonucleotide
aagaacacaagatctatccccagatctatcgggaatag

SEQ ID NO: 327924 - DNA, 37 bp, Artificial Sequence
  Description of Artificial Sequence: Synthetic oligonucleotide
agaacacaagatctatccccagatctatcgggaatag

SEQ ID NO: 327925 - DNA, 36 bp, Artificial Sequence
  Description of Artificial Sequence: Synthetic oligonucleotide
gaacacaagatctatccccagatctatcgggaatag

SEQ ID NO: 327926 - DNA, 36 bp, Artificial Sequence
  Description of Artificial Sequence: Synthetic oligonucleotide
aacacaagatctatccccagatctatcgggaatagc

SEQ ID NO: 327927 - DNA, 35 bp, Artificial Sequence
  Description of Artificial Sequence: Synthetic oligonucleotide
acacaagatctatccccagatctatcgggaatagc

SEQ ID NO: 327928 - DNA, 34 bp, Artificial Sequence
  Description of Artificial Sequence: Synthetic oligonucleotide
cacaagatctatccccagatctatcgggaatagc

SEQ ID NO: 327929 - DNA, 35 bp, Artificial Sequence
  Description of Artificial Sequence: Synthetic oligonucleotide
acaagatctatccccagatctatcgggaatagctg

SEQ ID NO: 327930 - DNA, 34 bp, Artificial Sequence
  Description of Artificial Sequence: Synthetic oligonucleotide
caagatctatccccagatctatcgggaatagctg

SEQ ID NO: 327931 - DNA, 35 bp, Artificial Sequence
  Description of Artificial Sequence: Synthetic oligonucleotide
aagatctatccccagatctatcgggaatagctgac

SEQ ID NO: 327932 - DNA, 34 bp, Artificial Sequence
  Description of Artificial Sequence: Synthetic oligonucleotide
agatctatccccagatctatcgggaatagctgac

SEQ ID NO: 327933 - DNA, 33 bp, Artificial Sequence
  Description of Artificial Sequence: Synthetic oligonucleotide
gatctatccccagatctatcgggaatagctgac

SEQ ID NO: 327934 - DNA, 36 bp, Artificial Sequence
  Description of Artificial Sequence: Synthetic oligonucleotide
atctatccccagatctatcgggaatagctgacttac

SEQ ID NO: 327935 - DNA, 35 bp, Artificial Sequence
  Description of Artificial Sequence: Synthetic oligonucleotide
tctatccccagatctatcgggaatagctgacttac

SEQ ID NO: 327936 - DNA, 34 bp, Artificial Sequence
  Description of Artificial Sequence: Synthetic oligonucleotide
ctatccccagatctatcgggaatagctgacttac

SEQ ID NO: 327937 - DNA, 34 bp, Artificial Sequence
  Description of Artificial Sequence: Synthetic oligonucleotide
tatccccagatctatcgggaatagctgacttacg

SEQ ID NO: 327938 - DNA, 33 bp, Artificial Sequence
  Description of Artificial Sequence: Synthetic oligonucleotide
atccccagatctatcgggaatagctgacttacg

SEQ ID NO: 327939 - DNA, 32 bp, Artificial Sequence
  Description of Artificial Sequence: Synthetic oligonucleotide
tccccagatctatcgggaatagctgacttacg

SEQ ID NO: 327940 - DNA, 31 bp, Artificial Sequence
  Description of Artificial Sequence: Synthetic oligonucleotide
ccccagatctatcgggaatagctgacttacg

SEQ ID NO: 327941 - DNA, 32 bp, Artificial Sequence
  Description of Artificial Sequence: Synthetic oligonucleotide
cccagatctatcgggaatagctgacttacgtg

SEQ ID NO: 327942 - DNA, 35 bp, Artificial Sequence
  Description of Artificial Sequence: Synthetic oligonucleotide
ccagatctatcgggaatagctgacttacgtgaatc

SEQ ID NO: 327943 - DNA, 36 bp, Artificial Sequence
  Description of Artificial Sequence: Synthetic oligonucleotide
cagatctatcgggaatagctgacttacgtgaatcag

SEQ ID NO: 327944 - DNA, 36 bp, Artificial Sequence
  Description of Artificial Sequence: Synthetic oligonucleotide
agatctatcgggaatagctgacttacgtgaatcagc

SEQ ID NO: 327945 - DNA, 35 bp, Artificial Sequence
  Description of Artificial Sequence: Synthetic oligonucleotide
gatctatcgggaatagctgacttacgtgaatcagc

SEQ ID NO: 327946 - DNA, 36 bp, Artificial Sequence
  Description of Artificial Sequence: Synthetic oligonucleotide
atctatcgggaatagctgacttacgtgaatcagcag

SEQ ID NO: 327947 - DNA, 35 bp, Artificial Sequence
  Description of Artificial Sequence: Synthetic oligonucleotide
tctatcgggaatagctgacttacgtgaatcagcag

SEQ ID NO: 327948 - DNA, 34 bp, Artificial Sequence
  Description of Artificial Sequence: Synthetic oligonucleotide
ctatcgggaatagctgacttacgtgaatcagcag

SEQ ID NO: 327949 - DNA, 34 bp, Artificial Sequence
  Description of Artificial Sequence: Synthetic oligonucleotide
tatcgggaatagctgacttacgtgaatcagcagg

SEQ ID NO: 327950 - DNA, 33 bp, Artificial Sequence
  Description of Artificial Sequence: Synthetic oligonucleotide
atcgggaatagctgacttacgtgaatcagcagg

SEQ ID NO: 327951 - DNA, 32 bp, Artificial Sequence
  Description of Artificial Sequence: Synthetic oligonucleotide
tcgggaatagctgacttacgtgaatcagcagg

SEQ ID NO: 327952 - DNA, 31 bp, Artificial Sequence
  Description of Artificial Sequence: Synthetic oligonucleotide
cgggaatagctgacttacgtgaatcagcagg

SEQ ID NO: 327953 - DNA, 31 bp, Artificial Sequence
  Description of Artificial Sequence: Synthetic oligonucleotide
gggaatagctgacttacgtgaatcagcaggg

SEQ ID NO: 327954 - DNA, 33 bp, Artificial Sequence
  Description of Artificial Sequence: Synthetic oligonucleotide
ggaatagctgacttacgtgaatcagcagggaac

SEQ ID NO: 327955 - DNA, 33 bp, Artificial Sequence
  Description of Artificial Sequence: Synthetic oligonucleotide
gaatagctgacttacgtgaatcagcagggaacc

SEQ ID NO: 327956 - DNA, 35 bp, Artificial Sequence
  Description of Artificial Sequence: Synthetic oligonucleotide
aatagctgacttacgtgaatcagcagggaaccttc

SEQ ID NO: 327957 - DNA, 34 bp, Artificial Sequence
  Description of Artificial Sequence: Synthetic oligonucleotide
atagctgacttacgtgaatcagcagggaaccttc

SEQ ID NO: 327958 - DNA, 33 bp, Artificial Sequence
  Description of Artificial Sequence: Synthetic oligonucleotide
tagctgacttacgtgaatcagcagggaaccttc

SEQ ID NO: 327959 - DNA, 32 bp, Artificial Sequence
  Description of Artificial Sequence: Synthetic oligonucleotide
agctgacttacgtgaatcagcagggaaccttc

SEQ ID NO: 327960 - DNA, 31 bp, Artificial Sequence
  Description of Artificial Sequence: Synthetic oligonucleotide
gctgacttacgtgaatcagcagggaaccttc

SEQ ID NO: 327961 - DNA, 31 bp, Artificial Sequence
  Description of Artificial Sequence: Synthetic oligonucleotide
ctgacttacgtgaatcagcagggaaccttcc

SEQ ID NO: 327962 - DNA, 32 bp, Artificial Sequence
  Description of Artificial Sequence: Synthetic oligonucleotide
tgacttacgtgaatcagcagggaaccttcctg

SEQ ID NO: 327963 - DNA, 31 bp, Artificial Sequence
  Description of Artificial Sequence: Synthetic oligonucleotide
gacttacgtgaatcagcagggaaccttcctg

SEQ ID NO: 327964 - DNA, 31 bp, Artificial Sequence
  Description of Artificial Sequence: Synthetic oligonucleotide
acttacgtgaatcagcagggaaccttcctgg

SEQ ID NO: 327965 - DNA, 30 bp, Artificial Sequence
  Description of Artificial Sequence: Synthetic oligonucleotide
cttacgtgaatcagcagggaaccttcctgg

SEQ ID NO: 327966 - DNA, 30 bp, Artificial Sequence
  Description of Artificial Sequence: Synthetic oligonucleotide
ttacgtgaatcagcagggaaccttcctggg

SEQ ID NO: 327967 - DNA, 29 bp, Artificial Sequence
  Description of Artificial Sequence: Synthetic oligonucleotide
tacgtgaatcagcagggaaccttcctggg

SEQ ID NO: 327968 - DNA, 28 bp, Artificial Sequence
  Description of Artificial Sequence: Synthetic oligonucleotide
acgtgaatcagcagggaaccttcctggg

SEQ ID NO: 327969 - DNA, 27 bp, Artificial Sequence
  Description of Artificial Sequence: Synthetic oligonucleotide
cgtgaatcagcagggaaccttcctggg

SEQ ID NO: 327970 - DNA, 28 bp, Artificial Sequence
  Description of Artificial Sequence: Synthetic oligonucleotide
gtgaatcagcagggaaccttcctgggag

SEQ ID NO: 327971 - DNA, 28 bp, Artificial Sequence
  Description of Artificial Sequence: Synthetic oligonucleotide
tgaatcagcagggaaccttcctgggagg

SEQ ID NO: 327972 - DNA, 27 bp, Artificial Sequence
  Description of Artificial Sequence: Synthetic oligonucleotide
gaatcagcagggaaccttcctgggagg

SEQ ID NO: 327973 - DNA, 28 bp, Artificial Sequence
  Description of Artificial Sequence: Synthetic oligonucleotide
aatcagcagggaaccttcctgggaggac

SEQ ID NO: 327974 - DNA, 27 bp, Artificial Sequence
  Description of Artificial Sequence: Synthetic oligonucleotide
atcagcagggaaccttcctgggaggac

SEQ ID NO: 327975 - DNA, 27 bp, Artificial Sequence
  Description of Artificial Sequence: Synthetic oligonucleotide
tcagcagggaaccttcctgggaggaca

SEQ ID NO: 327976 - DNA, 26 bp, Artificial Sequence
  Description of Artificial Sequence: Synthetic oligonucleotide
cagcagggaaccttcctgggaggaca

SEQ ID NO: 327977 - DNA, 26 bp, Artificial Sequence
  Description of Artificial Sequence: Synthetic oligonucleotide
agcagggaaccttcctgggaggacac

SEQ ID NO: 327978 - DNA, 25 bp, Artificial Sequence
  Description of Artificial Sequence: Synthetic oligonucleotide
gcagggaaccttcctgggaggacac

SEQ ID NO: 327979 - DNA, 25 bp, Artificial Sequence
  Description of Artificial Sequence: Synthetic oligonucleotide
cagggaaccttcctgggaggacacc

SEQ ID NO: 327980 - DNA, 27 bp, Artificial Sequence
  Description of Artificial Sequence: Synthetic oligonucleotide
agggaaccttcctgggaggacacccaa

SEQ ID NO: 327981 - DNA, 26 bp, Artificial Sequence
  Description of Artificial Sequence: Synthetic oligonucleotide
gggaaccttcctgggaggacacccaa

SEQ ID NO: 327982 - DNA, 26 bp, Artificial Sequence
  Description of Artificial Sequence: Synthetic oligonucleotide
ggaaccttcctgggaggacacccaag

SEQ ID NO: 327983 - DNA, 27 bp, Artificial Sequence
  Description of Artificial Sequence: Synthetic oligonucleotide
gaaccttcctgggaggacacccaagca

SEQ ID NO: 327984 - DNA, 28 bp, Artificial Sequence
  Description of Artificial Sequence: Synthetic oligonucleotide
aaccttcctgggaggacacccaagcatg

SEQ ID NO: 327985 - DNA, 27 bp, Artificial Sequence
  Description of Artificial Sequence: Synthetic oligonucleotide
accttcctgggaggacacccaagcatg

SEQ ID NO: 327986 - DNA, 26 bp, Artificial Sequence
  Description of Artificial Sequence: Synthetic oligonucleotide
ccttcctgggaggacacccaagcatg

SEQ ID NO: 327987 - DNA, 27 bp, Artificial Sequence
  Description of Artificial Sequence: Synthetic oligonucleotide
cttcctgggaggacacccaagcatggt

SEQ ID NO: 327988 - DNA, 27 bp, Artificial Sequence
  Description of Artificial Sequence: Synthetic oligonucleotide
ttcctgggaggacacccaagcatggtg

SEQ ID NO: 327989 - DNA, 26 bp, Artificial Sequence
  Description of Artificial Sequence: Synthetic oligonucleotide
tcctgggaggacacccaagcatggtg

SEQ ID NO: 327990 - DNA, 25 bp, Artificial Sequence
  Description of Artificial Sequence: Synthetic oligonucleotide
cctgggaggacacccaagcatggtg

SEQ ID NO: 327991 - DNA, 27 bp, Artificial Sequence
  Description of Artificial Sequence: Synthetic oligonucleotide
ctgggaggacacccaagcatggtgcaa

SEQ ID NO: 327992 - DNA, 27 bp, Artificial Sequence
  Description of Artificial Sequence: Synthetic oligonucleotide
tgggaggacacccaagcatggtgcaag

SEQ ID NO: 327993 - DNA, 27 bp, Artificial Sequence
  Description of Artificial Sequence: Synthetic oligonucleotide
gggaggacacccaagcatggtgcaaga

SEQ ID NO: 327994 - DNA, 28 bp, Artificial Sequence
  Description of Artificial Sequence: Synthetic oligonucleotide
ggaggacacccaagcatggtgcaagatc

SEQ ID NO: 327995 - DNA, 29 bp, Artificial Sequence
  Description of Artificial Sequence: Synthetic oligonucleotide
gaggacacccaagcatggtgcaagatcac

SEQ ID NO: 327996 - DNA, 30 bp, Artificial Sequence
  Description of Artificial Sequence: Synthetic oligonucleotide
aggacacccaagcatggtgcaagatcactc

SEQ ID NO: 327997 - DNA, 29 bp, Artificial Sequence
  Description of Artificial Sequence: Synthetic oligonucleotide
ggacacccaagcatggtgcaagatcactc

SEQ ID NO: 327998 - DNA, 31 bp, Artificial Sequence
  Description of Artificial Sequence: Synthetic oligonucleotide
gacacccaagcatggtgcaagatcactcttc

SEQ ID NO: 327999 - DNA, 31 bp, Artificial Sequence
  Description of Artificial Sequence: Synthetic oligonucleotide
acacccaagcatggtgcaagatcactcttcc

SEQ ID NO: 328000 - DNA, 30 bp, Artificial Sequence
  Description of Artificial Sequence: Synthetic oligonucleotide
cacccaagcatggtgcaagatcactcttcc

SEQ ID NO: 328001 - DNA, 32 bp, Artificial Sequence
  Description of Artificial Sequence: Synthetic oligonucleotide
acccaagcatggtgcaagatcactcttccatg

SEQ ID NO: 328002 - DNA, 31 bp, Artificial Sequence
  Description of Artificial Sequence: Synthetic oligonucleotide
cccaagcatggtgcaagatcactcttccatg

SEQ ID NO: 328003 - DNA, 32 bp, Artificial Sequence
  Description of Artificial Sequence: Synthetic oligonucleotide
ccaagcatggtgcaagatcactcttccatgtc

SEQ ID NO: 328004 - DNA, 35 bp, Artificial Sequence
  Description of Artificial Sequence: Synthetic oligonucleotide
caagcatggtgcaagatcactcttccatgtcaatc

SEQ ID NO: 328005 - DNA, 36 bp, Artificial Sequence
  Description of Artificial Sequence: Synthetic oligonucleotide
aagcatggtgcaagatcactcttccatgtcaatctg

SEQ ID NO: 328006 - DNA, 35 bp, Artificial Sequence
  Description of Artificial Sequence: Synthetic oligonucleotide
agcatggtgcaagatcactcttccatgtcaatctg

SEQ ID NO: 328007 - DNA, 34 bp, Artificial Sequence
  Description of Artificial Sequence: Synthetic oligonucleotide
gcatggtgcaagatcactcttccatgtcaatctg

SEQ ID NO: 328008 - DNA, 34 bp, Artificial Sequence
  Description of Artificial Sequence: Synthetic oligonucleotide
catggtgcaagatcactcttccatgtcaatctgc

SEQ ID NO: 328009 - DNA, 36 bp, Artificial Sequence
  Description of Artificial Sequence: Synthetic oligonucleotide
atggtgcaagatcactcttccatgtcaatctgcatc

SEQ ID NO: 328010 - DNA, 35 bp, Artificial Sequence
  Description of Artificial Sequence: Synthetic oligonucleotide
tggtgcaagatcactcttccatgtcaatctgcatc

SEQ ID NO: 328011 - DNA, 34 bp, Artificial Sequence
  Description of Artificial Sequence: Synthetic oligonucleotide
ggtgcaagatcactcttccatgtcaatctgcatc

SEQ ID NO: 328012 - DNA, 35 bp, Artificial Sequence
  Description of Artificial Sequence: Synthetic oligonucleotide
gtgcaagatcactcttccatgtcaatctgcatcac

SEQ ID NO: 328013 - DNA, 37 bp, Artificial Sequence
  Description of Artificial Sequence: Synthetic oligonucleotide
tgcaagatcactcttccatgtcaatctgcatcacttc

SEQ ID NO: 328014 - DNA, 36 bp, Artificial Sequence
  Description of Artificial Sequence: Synthetic oligonucleotide
gcaagatcactcttccatgtcaatctgcatcacttc

SEQ ID NO: 328015 - DNA, 37 bp, Artificial Sequence
  Description of Artificial Sequence: Synthetic oligonucleotide
caagatcactcttccatgtcaatctgcatcacttctc

SEQ ID NO: 328016 - DNA, 37 bp, Artificial Sequence
  Description of Artificial Sequence: Synthetic oligonucleotide
aagatcactcttccatgtcaatctgcatcacttctcg

SEQ ID NO: 328017 - DNA, 36 bp, Artificial Sequence
  Description of Artificial Sequence: Synthetic oligonucleotide
agatcactcttccatgtcaatctgcatcacttctcg

SEQ ID NO: 328018 - DNA, 35 bp, Artificial Sequence
  Description of Artificial Sequence: Synthetic oligonucleotide
gatcactcttccatgtcaatctgcatcacttctcg

SEQ ID NO: 328019 - DNA, 35 bp, Artificial Sequence
  Description of Artificial Sequence: Synthetic oligonucleotide
atcactcttccatgtcaatctgcatcacttctcgg

SEQ ID NO: 328020 - DNA, 34 bp, Artificial Sequence
  Description of Artificial Sequence: Synthetic oligonucleotide
tcactcttccatgtcaatctgcatcacttctcgg

SEQ ID NO: 328021 - DNA, 33 bp, Artificial Sequence
  Description of Artificial Sequence: Synthetic oligonucleotide
cactcttccatgtcaatctgcatcacttctcgg

SEQ ID NO: 328022 - DNA, 33 bp, Artificial Sequence
  Description of Artificial Sequence: Synthetic oligonucleotide
actcttccatgtcaatctgcatcacttctcggc

SEQ ID NO: 328023 - DNA, 32 bp, Artificial Sequence
  Description of Artificial Sequence: Synthetic oligonucleotide
ctcttccatgtcaatctgcatcacttctcggc

SEQ ID NO: 328024 - DNA, 33 bp, Artificial Sequence
  Description of Artificial Sequence: Synthetic oligonucleotide
tcttccatgtcaatctgcatcacttctcggctg

SEQ ID NO: 328025 - DNA, 32 bp, Artificial Sequence
  Description of Artificial Sequence: Synthetic oligonucleotide
cttccatgtcaatctgcatcacttctcggctg

SEQ ID NO: 328026 - DNA, 34 bp, Artificial Sequence
  Description of Artificial Sequence: Synthetic oligonucleotide
ttccatgtcaatctgcatcacttctcggctgttc

SEQ ID NO: 328027 - DNA, 33 bp, Artificial Sequence
  Description of Artificial Sequence: Synthetic oligonucleotide
tccatgtcaatctgcatcacttctcggctgttc

SEQ ID NO: 328028 - DNA, 32 bp, Artificial Sequence
  Description of Artificial Sequence: Synthetic oligonucleotide
ccatgtcaatctgcatcacttctcggctgttc

SEQ ID NO: 328029 - DNA, 32 bp, Artificial Sequence
  Description of Artificial Sequence: Synthetic oligonucleotide
catgtcaatctgcatcacttctcggctgttcg

SEQ ID NO: 328030 - DNA, 33 bp, Artificial Sequence
  Description of Artificial Sequence: Synthetic oligonucleotide
atgtcaatctgcatcacttctcggctgttcgag

SEQ ID NO: 328031 - DNA, 32 bp, Artificial Sequence
  Description of Artificial Sequence: Synthetic oligonucleotide
tgtcaatctgcatcacttctcggctgttcgag

SEQ ID NO: 328032 - DNA, 31 bp, Artificial Sequence
  Description of Artificial Sequence: Synthetic oligonucleotide
gtcaatctgcatcacttctcggctgttcgag

SEQ ID NO: 328033 - DNA, 34 bp, Artificial Sequence
  Description of Artificial Sequence: Synthetic oligonucleotide
tcaatctgcatcacttctcggctgttcgagtttc

SEQ ID NO: 328034 - DNA, 33 bp, Artificial Sequence
  Description of Artificial Sequence: Synthetic oligonucleotide
caatctgcatcacttctcggctgttcgagtttc

SEQ ID NO: 328035 - DNA, 34 bp, Artificial Sequence
  Description of Artificial Sequence: Synthetic oligonucleotide
aatctgcatcacttctcggctgttcgagtttctg

SEQ ID NO: 328036 - DNA, 33 bp, Artificial Sequence
  Description of Artificial Sequence: Synthetic oligonucleotide
atctgcatcacttctcggctgttcgagtttctg

SEQ ID NO: 328037 - DNA, 32 bp, Artificial Sequence
  Description of Artificial Sequence: Synthetic oligonucleotide
tctgcatcacttctcggctgttcgagtttctg

SEQ ID NO: 328038 - DNA, 31 bp, Artificial Sequence
  Description of Artificial Sequence: Synthetic oligonucleotide
ctgcatcacttctcggctgttcgagtttctg

SEQ ID NO: 328039 - DNA, 32 bp, Artificial Sequence
  Description of Artificial Sequence: Synthetic oligonucleotide
tgcatcacttctcggctgttcgagtttctgac

SEQ ID NO: 328040 - DNA, 31 bp, Artificial Sequence
  Description of Artificial Sequence: Synthetic oligonucleotide
gcatcacttctcggctgttcgagtttctgac

SEQ ID NO: 328041 - DNA, 31 bp, Artificial Sequence
  Description of Artificial Sequence: Synthetic oligonucleotide
catcacttctcggctgttcgagtttctgacg

SEQ ID NO: 328042 - DNA, 31 bp, Artificial Sequence
  Description of Artificial Sequence: Synthetic oligonucleotide
atcacttctcggctgttcgagtttctgacgc

SEQ ID NO: 328043 - DNA, 30 bp, Artificial Sequence
  Description of Artificial Sequence: Synthetic oligonucleotide
tcacttctcggctgttcgagtttctgacgc

SEQ ID NO: 328044 - DNA, 29 bp, Artificial Sequence
  Description of Artificial Sequence: Synthetic oligonucleotide
cacttctcggctgttcgagtttctgacgc

SEQ ID NO: 328045 - DNA, 29 bp, Artificial Sequence
  Description of Artificial Sequence: Synthetic oligonucleotide
acttctcggctgttcgagtttctgacgcc

SEQ ID NO: 328046 - DNA, 28 bp, Artificial Sequence
  Description of Artificial Sequence: Synthetic oligonucleotide
cttctcggctgttcgagtttctgacgcc

SEQ ID NO: 328047 - DNA, 28 bp, Artificial Sequence
  Description of Artificial Sequence: Synthetic oligonucleotide
ttctcggctgttcgagtttctgacgccc

SEQ ID NO: 328048 - DNA, 27 bp, Artificial Sequence
  Description of Artificial Sequence: Synthetic oligonucleotide
tctcggctgttcgagtttctgacgccc

SEQ ID NO: 328049 - DNA, 26 bp, Artificial Sequence
  Description of Artificial Sequence: Synthetic oligonucleotide
ctcggctgttcgagtttctgacgccc

SEQ ID NO: 328050 - DNA, 27 bp, Artificial Sequence
  Description of Artificial Sequence: Synthetic oligonucleotide
tcggctgttcgagtttctgacgcccct

SEQ ID NO: 328051 - DNA, 26 bp, Artificial Sequence
  Description of Artificial Sequence: Synthetic oligonucleotide
cggctgttcgagtttctgacgcccct

SEQ ID NO: 328052 - DNA, 26 bp, Artificial Sequence
  Description of Artificial Sequence: Synthetic oligonucleotide
ggctgttcgagtttctgacgcccctg

SEQ ID NO: 328053 - DNA, 27 bp, Artificial Sequence
  Description of Artificial Sequence: Synthetic oligonucleotide
gctgttcgagtttctgacgcccctgga

SEQ ID NO: 328054 - DNA, 27 bp, Artificial Sequence
  Description of Artificial Sequence: Synthetic oligonucleotide
ctgttcgagtttctgacgcccctggac

SEQ ID NO: 328055 - DNA, 27 bp, Artificial Sequence
  Description of Artificial Sequence: Synthetic oligonucleotide
tgttcgagtttctgacgcccctggacc

SEQ ID NO: 328056 - DNA, 27 bp, Artificial Sequence
  Description of Artificial Sequence: Synthetic oligonucleotide
gttcgagtttctgacgcccctggacca

SEQ ID NO: 328057 - DNA, 27 bp, Artificial Sequence
  Description of Artificial Sequence: Synthetic oligonucleotide
ttcgagtttctgacgcccctggaccag

SEQ ID NO: 328058 - DNA, 26 bp, Artificial Sequence
  Description of Artificial Sequence: Synthetic oligonucleotide
tcgagtttctgacgcccctggaccag

SEQ ID NO: 328059 - DNA, 25 bp, Artificial Sequence
  Description of Artificial Sequence: Synthetic oligonucleotide
cgagtttctgacgcccctggaccag

SEQ ID NO: 328060 - DNA, 25 bp, Artificial Sequence
  Description of Artificial Sequence: Synthetic oligonucleotide
gagtttctgacgcccctggaccagc

SEQ ID NO: 328061 - DNA, 25 bp, Artificial Sequence
  Description of Artificial Sequence: Synthetic oligonucleotide
agtttctgacgcccctggaccagcg

SEQ ID NO: 328062 - DNA, 24 bp, Artificial Sequence
  Description of Artificial Sequence: Synthetic oligonucleotide
gtttctgacgcccctggaccagcg

SEQ ID NO: 328063 - DNA, 24 bp, Artificial Sequence
  Description of Artificial Sequence: Synthetic oligonucleotide
tttctgacgcccctggaccagcgg

SEQ ID NO: 328064 - DNA, 23 bp, Artificial Sequence
  Description of Artificial Sequence: Synthetic oligonucleotide
ttctgacgcccctggaccagcgg

SEQ ID NO: 328065 - DNA, 22 bp, Artificial Sequence
  Description of Artificial Sequence: Synthetic oligonucleotide
tctgacgcccctggaccagcgg

SEQ ID NO: 328066 - DNA, 21 bp, Artificial Sequence
  Description of Artificial Sequence: Synthetic oligonucleotide
ctgacgcccctggaccagcgg

SEQ ID NO: 328067 - DNA, 21 bp, Artificial Sequence
  Description of Artificial Sequence: Synthetic oligonucleotide
tgacgcccctggaccagcggc

SEQ ID NO: 328068 - DNA, 20 bp, Artificial Sequence
  Description of Artificial Sequence: Synthetic oligonucleotide
gacgcccctggaccagcggc

SEQ ID NO: 328069 - DNA, 20 bp, Artificial Sequence
  Description of Artificial Sequence: Synthetic oligonucleotide
acgcccctggaccagcggcg

SEQ ID NO: 328070 - DNA, 20 bp, Artificial Sequence
  Description of Artificial Sequence: Synthetic oligonucleotide
cgcccctggaccagcggcgt

SEQ ID NO: 328071 - DNA, 20 bp, Artificial Sequence
  Description of Artificial Sequence: Synthetic oligonucleotide
gcccctggaccagcggcggt

SEQ ID NO: 328072 - DNA, 20 bp, Artificial Sequence
  Description of Artificial Sequence: Synthetic oligonucleotide
cccctggaccagcggcggct

SEQ ID NO: 328073 - DNA, 20 bp, Artificial Sequence
  Description of Artificial Sequence: Synthetic oligonucleotide
ccctggaccagcggcggcca

SEQ ID NO: 328074 - DNA, 21 bp, Artificial Sequence
  Description of Artificial Sequence: Synthetic oligonucleotide
cctggaccagcggcggccaca

SEQ ID NO: 328075 - DNA, 21 bp, Artificial Sequence
  Description of Artificial Sequence: Synthetic oligonucleotide
ctggaccagcggcggccacag

SEQ ID NO: 328076 - DNA, 21 bp, Artificial Sequence
  Description of Artificial Sequence: Synthetic oligonucleotide
tggaccagcggcggccacagg

SEQ ID NO: 328077 - DNA, 20 bp, Artificial Sequence
  Description of Artificial Sequence: Synthetic oligonucleotide
ggaccagcggcggccacagg

SEQ ID NO: 328078 - DNA, 20 bp, Artificial Sequence
  Description of Artificial Sequence: Synthetic oligonucleotide
gaccagcggcggccacaggg

SEQ ID NO: 328079 - DNA, 22 bp, Artificial Sequence
  Description of Artificial Sequence: Synthetic oligonucleotide
accagcggcggccacagggcat

SEQ ID NO: 328080 - DNA, 21 bp, Artificial Sequence
  Description of Artificial Sequence: Synthetic oligonucleotide
ccagcggcggccacagggcat

SEQ ID NO: 328081 - DNA, 21 bp, Artificial Sequence
  Description of Artificial Sequence: Synthetic oligonucleotide
cagcggcggccacagggcatg

SEQ ID NO: 328082 - DNA, 22 bp, Artificial Sequence
  Description of Artificial Sequence: Synthetic oligonucleotide
agcggcggccacagggcatgct

SEQ ID NO: 328083 - DNA, 21 bp, Artificial Sequence
  Description of Artificial Sequence: Synthetic oligonucleotide
gcggcggccacagggcatgct

SEQ ID NO: 328084 - DNA, 23 bp, Artificial Sequence
  Description of Artificial Sequence: Synthetic oligonucleotide
cggcggccacagggcatgctctt

SEQ ID NO: 328085 - DNA, 23 bp, Artificial Sequence
  Description of Artificial Sequence: Synthetic oligonucleotide
ggcggccacagggcatgctcttc

SEQ ID NO: 328086 - DNA, 24 bp, Artificial Sequence
  Description of Artificial Sequence: Synthetic oligonucleotide
gcggccacagggcatgctcttcca

SEQ ID NO: 328087 - DNA, 26 bp, Artificial Sequence
  Description of Artificial Sequence: Synthetic oligonucleotide
cggccacagggcatgctcttccacat

SEQ ID NO: 328088 - DNA, 26 bp, Artificial Sequence
  Description of Artificial Sequence: Synthetic oligonucleotide
ggccacagggcatgctcttccacatg

SEQ ID NO: 328089 - DNA, 27 bp, Artificial Sequence
  Description of Artificial Sequence: Synthetic oligonucleotide
gccacagggcatgctcttccacatggt

SEQ ID NO: 328090 - DNA, 27 bp, Artificial Sequence
  Description of Artificial Sequence: Synthetic oligonucleotide
ccacagggcatgctcttccacatggtc

SEQ ID NO: 328091 - DNA, 28 bp, Artificial Sequence
  Description of Artificial Sequence: Synthetic oligonucleotide
cacagggcatgctcttccacatggtcac

SEQ ID NO: 328092 - DNA, 31 bp, Artificial Sequence
  Description of Artificial Sequence: Synthetic oligonucleotide
acagggcatgctcttccacatggtcactttc

SEQ ID NO: 328093 - DNA, 30 bp, Artificial Sequence
  Description of Artificial Sequence: Synthetic oligonucleotide
cagggcatgctcttccacatggtcactttc

SEQ ID NO: 328094 - DNA, 30 bp, Artificial Sequence
  Description of Artificial Sequence: Synthetic oligonucleotide
agggcatgctcttccacatggtcactttcg

SEQ ID NO: 328095 - DNA, 29 bp, Artificial Sequence
  Description of Artificial Sequence: Synthetic oligonucleotide
gggcatgctcttccacatggtcactttcg

SEQ ID NO: 328096 - DNA, 30 bp, Artificial Sequence
  Description of Artificial Sequence: Synthetic oligonucleotide
ggcatgctcttccacatggtcactttcgac

SEQ ID NO: 328097 - DNA, 30 bp, Artificial Sequence
  Description of Artificial Sequence: Synthetic oligonucleotide
gcatgctcttccacatggtcactttcgacc

SEQ ID NO: 328098 - DNA, 31 bp, Artificial Sequence
  Description of Artificial Sequence: Synthetic oligonucleotide
catgctcttccacatggtcactttcgaccag

SEQ ID NO: 328099 - DNA, 31 bp, Artificial Sequence
  Description of Artificial Sequence: Synthetic oligonucleotide
atgctcttccacatggtcactttcgaccagc

SEQ ID NO: 328100 - DNA, 30 bp, Artificial Sequence
  Description of Artificial Sequence: Synthetic oligonucleotide
tgctcttccacatggtcactttcgaccagc

SEQ ID NO: 328101 - DNA, 29 bp, Artificial Sequence
  Description of Artificial Sequence: Synthetic oligonucleotide
gctcttccacatggtcactttcgaccagc

SEQ ID NO: 328102 - DNA, 30 bp, Artificial Sequence
  Description of Artificial Sequence: Synthetic oligonucleotide
ctcttccacatggtcactttcgaccagcac

SEQ ID NO: 328103 - DNA, 32 bp, Artificial Sequence
  Description of Artificial Sequence: Synthetic oligonucleotide
tcttccacatggtcactttcgaccagcacaag

SEQ ID NO: 328104 - DNA, 31 bp, Artificial Sequence
  Description of Artificial Sequence: Synthetic oligonucleotide
cttccacatggtcactttcgaccagcacaag

SEQ ID NO: 328105 - DNA, 31 bp, Artificial Sequence
  Description of Artificial Sequence: Synthetic oligonucleotide
ttccacatggtcactttcgaccagcacaagg

SEQ ID NO: 328106 - DNA, 30 bp, Artificial Sequence
  Description of Artificial Sequence: Synthetic oligonucleotide
tccacatggtcactttcgaccagcacaagg

SEQ ID NO: 328107 - DNA, 29 bp, Artificial Sequence
  Description of Artificial Sequence: Synthetic oligonucleotide
ccacatggtcactttcgaccagcacaagg

SEQ ID NO: 328108 - DNA, 33 bp, Artificial Sequence
  Description of Artificial Sequence: Synthetic oligonucleotide
cacatggtcactttcgaccagcacaaggaaatc

SEQ ID NO: 328109 - DNA, 33 bp, Artificial Sequence
  Description of Artificial Sequence: Synthetic oligonucleotide
acatggtcactttcgaccagcacaaggaaatcg

SEQ ID NO: 328110 - DNA, 32 bp, Artificial Sequence
  Description of Artificial Sequence: Synthetic oligonucleotide
catggtcactttcgaccagcacaaggaaatcg

SEQ ID NO: 328111 - DNA, 32 bp, Artificial Sequence
  Description of Artificial Sequence: Synthetic oligonucleotide
atggtcactttcgaccagcacaaggaaatcgc

SEQ ID NO: 328112 - DNA, 31 bp, Artificial Sequence
  Description of Artificial Sequence: Synthetic oligonucleotide
tggtcactttcgaccagcacaaggaaatcgc

SEQ ID NO: 328113 - DNA, 30 bp, Artificial Sequence
  Description of Artificial Sequence: Synthetic oligonucleotide
ggtcactttcgaccagcacaaggaaatcgc

SEQ ID NO: 328114 - DNA, 30 bp, Artificial Sequence
  Description of Artificial Sequence: Synthetic oligonucleotide
gtcactttcgaccagcacaaggaaatcgcc

SEQ ID NO: 328115 - DNA, 30 bp, Artificial Sequence
  Description of Artificial Sequence: Synthetic oligonucleotide
tcactttcgaccagcacaaggaaatcgccc

SEQ ID NO: 328116 - DNA, 29 bp, Artificial Sequence
  Description of Artificial Sequence: Synthetic oligonucleotide
cactttcgaccagcacaaggaaatcgccc

SEQ ID NO: 328117 - DNA, 29 bp, Artificial Sequence
  Description of Artificial Sequence: Synthetic oligonucleotide
actttcgaccagcacaaggaaatcgcccc

SEQ ID NO: 328118 - DNA, 28 bp, Artificial Sequence
  Description of Artificial Sequence: Synthetic oligonucleotide
ctttcgaccagcacaaggaaatcgcccc

SEQ ID NO: 328119 - DNA, 28 bp, Artificial Sequence
  Description of Artificial Sequence: Synthetic oligonucleotide
tttcgaccagcacaaggaaatcgccccc

SEQ ID NO: 328120 - DNA, 27 bp, Artificial Sequence
  Description of Artificial Sequence: Synthetic oligonucleotide
ttcgaccagcacaaggaaatcgccccc

SEQ ID NO: 328121 - DNA, 26 bp, Artificial Sequence
  Description of Artificial Sequence: Synthetic oligonucleotide
tcgaccagcacaaggaaatcgccccc

SEQ ID NO: 328122 - DNA, 25 bp, Artificial Sequence
  Description of Artificial Sequence: Synthetic oligonucleotide
cgaccagcacaaggaaatcgccccc

SEQ ID NO: 328123 - DNA, 25 bp, Artificial Sequence
  Description of Artificial Sequence: Synthetic oligonucleotide
gaccagcacaaggaaatcgcccccg

SEQ ID NO: 328124 - DNA, 25 bp, Artificial Sequence
  Description of Artificial Sequence: Synthetic oligonucleotide
accagcacaaggaaatcgcccccgc

SEQ ID NO: 328125 - DNA, 24 bp, Artificial Sequence
  Description of Artificial Sequence: Synthetic oligonucleotide
ccagcacaaggaaatcgcccccgc

SEQ ID NO: 328126 - DNA, 26 bp, Artificial Sequence
  Description of Artificial Sequence: Synthetic oligonucleotide
cagcacaaggaaatcgcccccgcctt

SEQ ID NO: 328127 - DNA, 26 bp, Artificial Sequence
  Description of Artificial Sequence: Synthetic oligonucleotide
agcacaaggaaatcgcccccgccttc

SEQ ID NO: 328128 - DNA, 25 bp, Artificial Sequence
  Description of Artificial Sequence: Synthetic oligonucleotide
gcacaaggaaatcgcccccgccttc

SEQ ID NO: 328129 - DNA, 26 bp, Artificial Sequence
  Description of Artificial Sequence: Synthetic oligonucleotide
cacaaggaaatcgcccccgccttcga

SEQ ID NO: 328130 - DNA, 27 bp, Artificial Sequence
  Description of Artificial Sequence: Synthetic oligonucleotide
acaaggaaatcgcccccgccttcgact

SEQ ID NO: 328131 - DNA, 26 bp, Artificial Sequence
  Description of Artificial Sequence: Synthetic oligonucleotide
caaggaaatcgcccccgccttcgact

SEQ ID NO: 328132 - DNA, 26 bp, Artificial Sequence
  Description of Artificial Sequence: Synthetic oligonucleotide
aaggaaatcgcccccgccttcgactg

SEQ ID NO: 328133 - DNA, 25 bp, Artificial Sequence
  Description of Artificial Sequence: Synthetic oligonucleotide
aggaaatcgcccccgccttcgactg

SEQ ID NO: 328134 - DNA, 24 bp, Artificial Sequence
  Description of Artificial Sequence: Synthetic oligonucleotide
ggaaatcgcccccgccttcgactg

SEQ ID NO: 328135 - DNA, 26 bp, Artificial Sequence
  Description of Artificial Sequence: Synthetic oligonucleotide
gaaatcgcccccgccttcgactggta

SEQ ID NO: 328136 - DNA, 27 bp, Artificial Sequence
  Description of Artificial Sequence: Synthetic oligonucleotide
aaatcgcccccgccttcgactggtagt

SEQ ID NO: 328137 - DNA, 26 bp, Artificial Sequence
  Description of Artificial Sequence: Synthetic oligonucleotide
aatcgcccccgccttcgactggtagt

SEQ ID NO: 328138 - DNA, 25 bp, Artificial Sequence
  Description of Artificial Sequence: Synthetic oligonucleotide
atcgcccccgccttcgactggtagt

SEQ ID NO: 328139 - DNA, 24 bp, Artificial Sequence
  Description of Artificial Sequence: Synthetic oligonucleotide
tcgcccccgccttcgactggtagt

SEQ ID NO: 328140 - DNA, 23 bp, Artificial Sequence
  Description of Artificial Sequence: Synthetic oligonucleotide
cgcccccgccttcgactggtagt

SEQ ID NO: 328141 - DNA, 23 bp, Artificial Sequence
  Description of Artificial Sequence: Synthetic oligonucleotide
gcccccgccttcgactggtagtc

SEQ ID NO: 328142 - DNA, 24 bp, Artificial Sequence
  Description of Artificial Sequence: Synthetic oligonucleotide
cccccgccttcgactggtagtcct

SEQ ID NO: 328143 - DNA, 24 bp, Artificial Sequence
  Description of Artificial Sequence: Synthetic oligonucleotide
ccccgccttcgactggtagtcctg

SEQ ID NO: 328144 - DNA, 26 bp, Artificial Sequence
  Description of Artificial Sequence: Synthetic oligonucleotide
cccgccttcgactggtagtcctgctt

SEQ ID NO: 328145 - DNA, 26 bp, Artificial Sequence
  Description of Artificial Sequence: Synthetic oligonucleotide
ccgccttcgactggtagtcctgcttc

SEQ ID NO: 328146 - DNA, 27 bp, Artificial Sequence
  Description of Artificial Sequence: Synthetic oligonucleotide
cgccttcgactggtagtcctgcttcca

SEQ ID NO: 328147 - DNA, 28 bp, Artificial Sequence
  Description of Artificial Sequence: Synthetic oligonucleotide
gccttcgactggtagtcctgcttccaag

SEQ ID NO: 328148 - DNA, 28 bp, Artificial Sequence
  Description of Artificial Sequence: Synthetic oligonucleotide
ccttcgactggtagtcctgcttccaagc

SEQ ID NO: 328149 - DNA, 28 bp, Artificial Sequence
  Description of Artificial Sequence: Synthetic oligonucleotide
cttcgactggtagtcctgcttccaagcg

SEQ ID NO: 328150 - DNA, 29 bp, Artificial Sequence
  Description of Artificial Sequence: Synthetic oligonucleotide
ttcgactggtagtcctgcttccaagcgac

SEQ ID NO: 328151 - DNA, 28 bp, Artificial Sequence
  Description of Artificial Sequence: Synthetic oligonucleotide
tcgactggtagtcctgcttccaagcgac

SEQ ID NO: 328152 - DNA, 27 bp, Artificial Sequence
  Description of Artificial Sequence: Synthetic oligonucleotide
cgactggtagtcctgcttccaagcgac

SEQ ID NO: 328153 - DNA, 30 bp, Artificial Sequence
  Description of Artificial Sequence: Synthetic oligonucleotide
gactggtagtcctgcttccaagcgacaatc

SEQ ID NO: 328154 - DNA, 31 bp, Artificial Sequence
  Description of Artificial Sequence: Synthetic oligonucleotide
actggtagtcctgcttccaagcgacaatcac

SEQ ID NO: 328155 - DNA, 30 bp, Artificial Sequence
  Description of Artificial Sequence: Synthetic oligonucleotide
ctggtagtcctgcttccaagcgacaatcac

SEQ ID NO: 328156 - DNA, 31 bp, Artificial Sequence
  Description of Artificial Sequence: Synthetic oligonucleotide
tggtagtcctgcttccaagcgacaatcacac

SEQ ID NO: 328157 - DNA, 30 bp, Artificial Sequence
  Description of Artificial Sequence: Synthetic oligonucleotide
ggtagtcctgcttccaagcgacaatcacac

SEQ ID NO: 328158 - DNA, 30 bp, Artificial Sequence
  Description of Artificial Sequence: Synthetic oligonucleotide
gtagtcctgcttccaagcgacaatcacacc

SEQ ID NO: 328159 - DNA, 30 bp, Artificial Sequence
  Description of Artificial Sequence: Synthetic oligonucleotide
tagtcctgcttccaagcgacaatcacaccg

SEQ ID NO: 328160 - DNA, 29 bp, Artificial Sequence
  Description of Artificial Sequence: Synthetic oligonucleotide
agtcctgcttccaagcgacaatcacaccg

SEQ ID NO: 328161 - DNA, 28 bp, Artificial Sequence
  Description of Artificial Sequence: Synthetic oligonucleotide
gtcctgcttccaagcgacaatcacaccg

SEQ ID NO: 328162 - DNA, 30 bp, Artificial Sequence
  Description of Artificial Sequence: Synthetic oligonucleotide
tcctgcttccaagcgacaatcacaccgaag

SEQ ID NO: 328163 - DNA, 29 bp, Artificial Sequence
  Description of Artificial Sequence: Synthetic oligonucleotide
cctgcttccaagcgacaatcacaccgaag

SEQ ID NO: 328164 - DNA, 30 bp, Artificial Sequence
  Description of Artificial Sequence: Synthetic oligonucleotide
ctgcttccaagcgacaatcacaccgaagtc

SEQ ID NO: 328165 - DNA, 30 bp, Artificial Sequence
  Description of Artificial Sequence: Synthetic oligonucleotide
tgcttccaagcgacaatcacaccgaagtcc

SEQ ID NO: 328166 - DNA, 29 bp, Artificial Sequence
  Description of Artificial Sequence: Synthetic oligonucleotide
gcttccaagcgacaatcacaccgaagtcc

SEQ ID NO: 328167 - DNA, 29 bp, Artificial Sequence
  Description of Artificial Sequence: Synthetic oligonucleotide
cttccaagcgacaatcacaccgaagtccc

SEQ ID NO: 328168 - DNA, 30 bp, Artificial Sequence
  Description of Artificial Sequence: Synthetic oligonucleotide
ttccaagcgacaatcacaccgaagtccctg

SEQ ID NO: 328169 - DNA, 29 bp, Artificial Sequence
  Description of Artificial Sequence: Synthetic oligonucleotide
tccaagcgacaatcacaccgaagtccctg

SEQ ID NO: 328170 - DNA, 28 bp, Artificial Sequence
  Description of Artificial Sequence: Synthetic oligonucleotide
ccaagcgacaatcacaccgaagtccctg

SEQ ID NO: 328171 - DNA, 29 bp, Artificial Sequence
  Description of Artificial Sequence: Synthetic oligonucleotide
caagcgacaatcacaccgaagtccctgag

SEQ ID NO: 328172 - DNA, 29 bp, Artificial Sequence
  Description of Artificial Sequence: Synthetic oligonucleotide
aagcgacaatcacaccgaagtccctgagg

SEQ ID NO: 328173 - DNA, 28 bp, Artificial Sequence
  Description of Artificial Sequence: Synthetic oligonucleotide
agcgacaatcacaccgaagtccctgagg

SEQ ID NO: 328174 - DNA, 27 bp, Artificial Sequence
  Description of Artificial Sequence: Synthetic oligonucleotide
gcgacaatcacaccgaagtccctgagg

SEQ ID NO: 328175 - DNA, 27 bp, Artificial Sequence
  Description of Artificial Sequence: Synthetic oligonucleotide
cgacaatcacaccgaagtccctgaggc

SEQ ID NO: 328176 - DNA, 27 bp, Artificial Sequence
  Description of Artificial Sequence: Synthetic oligonucleotide
gacaatcacaccgaagtccctgaggcc

SEQ ID NO: 328177 - DNA, 29 bp, Artificial Sequence
  Description of Artificial Sequence: Synthetic oligonucleotide
acaatcacaccgaagtccctgaggccttc

SEQ ID NO: 328178 - DNA, 28 bp, Artificial Sequence
  Description of Artificial Sequence: Synthetic oligonucleotide
caatcacaccgaagtccctgaggccttc

SEQ ID NO: 328179 - DNA, 29 bp, Artificial Sequence
  Description of Artificial Sequence: Synthetic oligonucleotide
aatcacaccgaagtccctgaggccttctc

SEQ ID NO: 328180 - DNA, 28 bp, Artificial Sequence
  Description of Artificial Sequence: Synthetic oligonucleotide
atcacaccgaagtccctgaggccttctc

SEQ ID NO: 328181 - DNA, 27 bp, Artificial Sequence
  Description of Artificial Sequence: Synthetic oligonucleotide
tcacaccgaagtccctgaggccttctc

SEQ ID NO: 328182 - DNA, 27 bp, Artificial Sequence
  Description of Artificial Sequence: Synthetic oligonucleotide
cacaccgaagtccctgaggccttctca

SEQ ID NO: 328183 - DNA, 27 bp, Artificial Sequence
  Description of Artificial Sequence: Synthetic oligonucleotide
acaccgaagtccctgaggccttctcag

SEQ ID NO: 328184 - DNA, 27 bp, Artificial Sequence
  Description of Artificial Sequence: Synthetic oligonucleotide
caccgaagtccctgaggccttctcaga

SEQ ID NO: 328185 - DNA, 27 bp, Artificial Sequence
  Description of Artificial Sequence: Synthetic oligonucleotide
accgaagtccctgaggccttctcagac

SEQ ID NO: 328186 - DNA, 26 bp, Artificial Sequence
  Description of Artificial Sequence: Synthetic oligonucleotide
ccgaagtccctgaggccttctcagac

SEQ ID NO: 328187 - DNA, 26 bp, Artificial Sequence
  Description of Artificial Sequence: Synthetic oligonucleotide
cgaagtccctgaggccttctcagacc

SEQ ID NO: 328188 - DNA, 27 bp, Artificial Sequence
  Description of Artificial Sequence: Synthetic oligonucleotide
gaagtccctgaggccttctcagaccct

SEQ ID NO: 328189 - DNA, 27 bp, Artificial Sequence
  Description of Artificial Sequence: Synthetic oligonucleotide
aagtccctgaggccttctcagaccctc

SEQ ID NO: 328190 - DNA, 26 bp, Artificial Sequence
  Description of Artificial Sequence: Synthetic oligonucleotide
agtccctgaggccttctcagaccctc

SEQ ID NO: 328191 - DNA, 25 bp, Artificial Sequence
  Description of Artificial Sequence: Synthetic oligonucleotide
gtccctgaggccttctcagaccctc

SEQ ID NO: 328192 - DNA, 26 bp, Artificial Sequence
  Description of Artificial Sequence: Synthetic oligonucleotide
tccctgaggccttctcagaccctcgt

SEQ ID NO: 328193 - DNA, 25 bp, Artificial Sequence
  Description of Artificial Sequence: Synthetic oligonucleotide
ccctgaggccttctcagaccctcgt

SEQ ID NO: 328194 - DNA, 25 bp, Artificial Sequence
  Description of Artificial Sequence: Synthetic oligonucleotide
cctgaggccttctcagaccctcgtg

SEQ ID NO: 328195 - DNA, 26 bp, Artificial Sequence
  Description of Artificial Sequence: Synthetic oligonucleotide
ctgaggccttctcagaccctcgtgga

SEQ ID NO: 328196 - DNA, 26 bp, Artificial Sequence
  Description of Artificial Sequence: Synthetic oligonucleotide
tgaggccttctcagaccctcgtggac

SEQ ID NO: 328197 - DNA, 25 bp, Artificial Sequence
  Description of Artificial Sequence: Synthetic oligonucleotide
gaggccttctcagaccctcgtggac

SEQ ID NO: 328198 - DNA, 27 bp, Artificial Sequence
  Description of Artificial Sequence: Synthetic oligonucleotide
aggccttctcagaccctcgtggaccat

SEQ ID NO: 328199 - DNA, 26 bp, Artificial Sequence
  Description of Artificial Sequence: Synthetic oligonucleotide
ggccttctcagaccctcgtggaccat

SEQ ID NO: 328200 - DNA, 27 bp, Artificial Sequence
  Description of Artificial Sequence: Synthetic oligonucleotide
gccttctcagaccctcgtggaccatga

SEQ ID NO: 328201 - DNA, 27 bp, Artificial Sequence
  Description of Artificial Sequence: Synthetic oligonucleotide
ccttctcagaccctcgtggaccatgac

SEQ ID NO: 328202 - DNA, 27 bp, Artificial Sequence
  Description of Artificial Sequence: Synthetic oligonucleotide
cttctcagaccctcgtggaccatgacg

SEQ ID NO: 328203 - DNA, 28 bp, Artificial Sequence
  Description of Artificial Sequence: Synthetic oligonucleotide
ttctcagaccctcgtggaccatgacgtc

SEQ ID NO: 328204 - DNA, 27 bp, Artificial Sequence
  Description of Artificial Sequence: Synthetic oligonucleotide
tctcagaccctcgtggaccatgacgtc

SEQ ID NO: 328205 - DNA, 26 bp, Artificial Sequence
  Description of Artificial Sequence: Synthetic oligonucleotide
ctcagaccctcgtggaccatgacgtc

SEQ ID NO: 328206 - DNA, 27 bp, Artificial Sequence
  Description of Artificial Sequence: Synthetic oligonucleotide
tcagaccctcgtggaccatgacgtcga

SEQ ID NO: 328207 - DNA, 27 bp, Artificial Sequence
  Description of Artificial Sequence: Synthetic oligonucleotide
cagaccctcgtggaccatgacgtcgaa

SEQ ID NO: 328208 - DNA, 32 bp, Artificial Sequence
  Description of Artificial Sequence: Synthetic oligonucleotide
agaccctcgtggaccatgacgtcgaatatttg

SEQ ID NO: 328209 - DNA, 31 bp, Artificial Sequence
  Description of Artificial Sequence: Synthetic oligonucleotide
gaccctcgtggaccatgacgtcgaatatttg

SEQ ID NO: 328210 - DNA, 36 bp, Artificial Sequence
  Description of Artificial Sequence: Synthetic oligonucleotide
accctcgtggaccatgacgtcgaatatttgtaaaac

SEQ ID NO: 328211 - DNA, 35 bp, Artificial Sequence
  Description of Artificial Sequence: Synthetic oligonucleotide
ccctcgtggaccatgacgtcgaatatttgtaaaac

SEQ ID NO: 328212 - DNA, 37 bp, Artificial Sequence
  Description of Artificial Sequence: Synthetic oligonucleotide
cctcgtggaccatgacgtcgaatatttgtaaaacatg

SEQ ID NO: 328213 - DNA, 38 bp, Artificial Sequence
  Description of Artificial Sequence: Synthetic oligonucleotide
ctcgtggaccatgacgtcgaatatttgtaaaacatgtg

SEQ ID NO: 328214 - DNA, 39 bp, Artificial Sequence
  Description of Artificial Sequence: Synthetic oligonucleotide
tcgtggaccatgacgtcgaatatttgtaaaacatgtgac

SEQ ID NO: 328215 - DNA, 38 bp, Artificial Sequence
  Description of Artificial Sequence: Synthetic oligonucleotide
cgtggaccatgacgtcgaatatttgtaaaacatgtgac

SEQ ID NO: 328216 - DNA, 40 bp, Artificial Sequence
  Description of Artificial Sequence: Synthetic oligonucleotide
gtggaccatgacgtcgaatatttgtaaaacatgtgacaac

SEQ ID NO: 328217 - DNA, 41 bp, Artificial Sequence
  Description of Artificial Sequence: Synthetic oligonucleotide
tggaccatgacgtcgaatatttgtaaaacatgtgacaactg

SEQ ID NO: 328218 - DNA, 40 bp, Artificial Sequence
  Description of Artificial Sequence: Synthetic oligonucleotide
ggaccatgacgtcgaatatttgtaaaacatgtgacaactg

SEQ ID NO: 328219 - DNA, 40 bp, Artificial Sequence
  Description of Artificial Sequence: Synthetic oligonucleotide
gaccatgacgtcgaatatttgtaaaacatgtgacaactgg

SEQ ID NO: 328220 - DNA, 41 bp, Artificial Sequence
  Description of Artificial Sequence: Synthetic oligonucleotide
accatgacgtcgaatatttgtaaaacatgtgacaactggtc

SEQ ID NO: 328221 - DNA, 40 bp, Artificial Sequence
  Description of Artificial Sequence: Synthetic oligonucleotide
ccatgacgtcgaatatttgtaaaacatgtgacaactggtc

SEQ ID NO: 328222 - DNA, 40 bp, Artificial Sequence
  Description of Artificial Sequence: Synthetic oligonucleotide
catgacgtcgaatatttgtaaaacatgtgacaactggtcg

SEQ ID NO: 328223 - DNA, 41 bp, Artificial Sequence
  Description of Artificial Sequence: Synthetic oligonucleotide
atgacgtcgaatatttgtaaaacatgtgacaactggtcgag

SEQ ID NO: 328224 - DNA, 40 bp, Artificial Sequence
  Description of Artificial Sequence: Synthetic oligonucleotide
tgacgtcgaatatttgtaaaacatgtgacaactggtcgag

SEQ ID NO: 328225 - DNA, 39 bp, Artificial Sequence
  Description of Artificial Sequence: Synthetic oligonucleotide
gacgtcgaatatttgtaaaacatgtgacaactggtcgag

SEQ ID NO: 328226 - DNA, 39 bp, Artificial Sequence
  Description of Artificial Sequence: Synthetic oligonucleotide
acgtcgaatatttgtaaaacatgtgacaactggtcgagg

SEQ ID NO: 328227 - DNA, 38 bp, Artificial Sequence
  Description of Artificial Sequence: Synthetic oligonucleotide
cgtcgaatatttgtaaaacatgtgacaactggtcgagg

SEQ ID NO: 328228 - DNA, 39 bp, Artificial Sequence
  Description of Artificial Sequence: Synthetic oligonucleotide
gtcgaatatttgtaaaacatgtgacaactggtcgaggag

SEQ ID NO: 328229 - DNA, 41 bp, Artificial Sequence
  Description of Artificial Sequence: Synthetic oligonucleotide
tcgaatatttgtaaaacatgtgacaactggtcgaggagatg

SEQ ID NO: 328230 - DNA, 40 bp, Artificial Sequence
  Description of Artificial Sequence: Synthetic oligonucleotide
cgaatatttgtaaaacatgtgacaactggtcgaggagatg

SEQ ID NO: 328231 - DNA, 40 bp, Artificial Sequence
  Description of Artificial Sequence: Synthetic oligonucleotide
gaatatttgtaaaacatgtgacaactggtcgaggagatgg

SEQ ID NO: 328232 - DNA, 41 bp, Artificial Sequence
  Description of Artificial Sequence: Synthetic oligonucleotide
aatatttgtaaaacatgtgacaactggtcgaggagatggtg

SEQ ID NO: 328233 - DNA, 40 bp, Artificial Sequence
  Description of Artificial Sequence: Synthetic oligonucleotide
atatttgtaaaacatgtgacaactggtcgaggagatggtg

SEQ ID NO: 328234 - DNA, 39 bp, Artificial Sequence
  Description of Artificial Sequence: Synthetic oligonucleotide
tatttgtaaaacatgtgacaactggtcgaggagatggtg

SEQ ID NO: 328235 - DNA, 38 bp, Artificial Sequence
  Description of Artificial Sequence: Synthetic oligonucleotide
atttgtaaaacatgtgacaactggtcgaggagatggtg

SEQ ID NO: 328236 - DNA, 37 bp, Artificial Sequence
  Description of Artificial Sequence: Synthetic oligonucleotide
tttgtaaaacatgtgacaactggtcgaggagatggtg

SEQ ID NO: 328237 - DNA, 36 bp, Artificial Sequence
  Description of Artificial Sequence: Synthetic oligonucleotide
ttgtaaaacatgtgacaactggtcgaggagatggtg

SEQ ID NO: 328238 - DNA, 35 bp, Artificial Sequence
  Description of Artificial Sequence: Synthetic oligonucleotide
tgtaaaacatgtgacaactggtcgaggagatggtg

SEQ ID NO: 328239 - DNA, 34 bp, Artificial Sequence
  Description of Artificial Sequence: Synthetic oligonucleotide
gtaaaacatgtgacaactggtcgaggagatggtg

SEQ ID NO: 328240 - DNA, 34 bp, Artificial Sequence
  Description of Artificial Sequence: Synthetic oligonucleotide
taaaacatgtgacaactggtcgaggagatggtgc

SEQ ID NO: 328241 - DNA, 33 bp, Artificial Sequence
  Description of Artificial Sequence: Synthetic oligonucleotide
aaaacatgtgacaactggtcgaggagatggtgc

SEQ ID NO: 328242 - DNA, 32 bp, Artificial Sequence
  Description of Artificial Sequence: Synthetic oligonucleotide
aaacatgtgacaactggtcgaggagatggtgc

SEQ ID NO: 328243 - DNA, 31 bp, Artificial Sequence
  Description of Artificial Sequence: Synthetic oligonucleotide
aacatgtgacaactggtcgaggagatggtgc

SEQ ID NO: 328244 - DNA, 30 bp, Artificial Sequence
  Description of Artificial Sequence: Synthetic oligonucleotide
acatgtgacaactggtcgaggagatggtgc

SEQ ID NO: 328245 - DNA, 29 bp, Artificial Sequence
  Description of Artificial Sequence: Synthetic oligonucleotide
catgtgacaactggtcgaggagatggtgc

SEQ ID NO: 328246 - DNA, 33 bp, Artificial Sequence
  Description of Artificial Sequence: Synthetic oligonucleotide
atgtgacaactggtcgaggagatggtgctaaag

SEQ ID NO: 328247 - DNA, 32 bp, Artificial Sequence
  Description of Artificial Sequence: Synthetic oligonucleotide
tgtgacaactggtcgaggagatggtgctaaag

SEQ ID NO: 328248 - DNA, 31 bp, Artificial Sequence
  Description of Artificial Sequence: Synthetic oligonucleotide
gtgacaactggtcgaggagatggtgctaaag

SEQ ID NO: 328249 - DNA, 31 bp, Artificial Sequence
  Description of Artificial Sequence: Synthetic oligonucleotide
tgacaactggtcgaggagatggtgctaaagc

SEQ ID NO: 328250 - DNA, 30 bp, Artificial Sequence
  Description of Artificial Sequence: Synthetic oligonucleotide
gacaactggtcgaggagatggtgctaaagc

SEQ ID NO: 328251 - DNA, 31 bp, Artificial Sequence
  Description of Artificial Sequence: Synthetic oligonucleotide
acaactggtcgaggagatggtgctaaagctg

SEQ ID NO: 328252 - DNA, 30 bp, Artificial Sequence
  Description of Artificial Sequence: Synthetic oligonucleotide
caactggtcgaggagatggtgctaaagctg

SEQ ID NO: 328253 - DNA, 31 bp, Artificial Sequence
  Description of Artificial Sequence: Synthetic oligonucleotide
aactggtcgaggagatggtgctaaagctgag

SEQ ID NO: 328254 - DNA, 30 bp, Artificial Sequence
  Description of Artificial Sequence: Synthetic oligonucleotide
actggtcgaggagatggtgctaaagctgag

SEQ ID NO: 328255 - DNA, 29 bp, Artificial Sequence
  Description of Artificial Sequence: Synthetic oligonucleotide
ctggtcgaggagatggtgctaaagctgag

SEQ ID NO: 328256 - DNA, 29 bp, Artificial Sequence
  Description of Artificial Sequence: Synthetic oligonucleotide
tggtcgaggagatggtgctaaagctgagg

SEQ ID NO: 328257 - DNA, 28 bp, Artificial Sequence
  Description of Artificial Sequence: Synthetic oligonucleotide
ggtcgaggagatggtgctaaagctgagg

SEQ ID NO: 328258 - DNA, 28 bp, Artificial Sequence
  Description of Artificial Sequence: Synthetic oligonucleotide
gtcgaggagatggtgctaaagctgaggg

SEQ ID NO: 328259 - DNA, 29 bp, Artificial Sequence
  Description of Artificial Sequence: Synthetic oligonucleotide
tcgaggagatggtgctaaagctgagggac

SEQ ID NO: 328260 - DNA, 28 bp, Artificial Sequence
  Description of Artificial Sequence: Synthetic oligonucleotide
cgaggagatggtgctaaagctgagggac

SEQ ID NO: 328261 - DNA, 31 bp, Artificial Sequence
  Description of Artificial Sequence: Synthetic oligonucleotide
gaggagatggtgctaaagctgagggacttac

SEQ ID NO: 328262 - DNA, 32 bp, Artificial Sequence
  Description of Artificial Sequence: Synthetic oligonucleotide
aggagatggtgctaaagctgagggacttactg

SEQ ID NO: 328263 - DNA, 31 bp, Artificial Sequence
  Description of Artificial Sequence: Synthetic oligonucleotide
ggagatggtgctaaagctgagggacttactg

SEQ ID NO: 328264 - DNA, 31 bp, Artificial Sequence
  Description of Artificial Sequence: Synthetic oligonucleotide
gagatggtgctaaagctgagggacttactgc

SEQ ID NO: 328265 - DNA, 32 bp, Artificial Sequence
  Description of Artificial Sequence: Synthetic oligonucleotide
agatggtgctaaagctgagggacttactgcag

SEQ ID NO: 328266 - DNA, 31 bp, Artificial Sequence
  Description of Artificial Sequence: Synthetic oligonucleotide
gatggtgctaaagctgagggacttactgcag

SEQ ID NO: 328267 - DNA, 32 bp, Artificial Sequence
  Description of Artificial Sequence: Synthetic oligonucleotide
atggtgctaaagctgagggacttactgcagag

SEQ ID NO: 328268 - DNA, 31 bp, Artificial Sequence
  Description of Artificial Sequence: Synthetic oligonucleotide
tggtgctaaagctgagggacttactgcagag

SEQ ID NO: 328269 - DNA, 30 bp, Artificial Sequence
  Description of Artificial Sequence: Synthetic oligonucleotide
ggtgctaaagctgagggacttactgcagag

SEQ ID NO: 328270 - DNA, 30 bp, Artificial Sequence
  Description of Artificial Sequence: Synthetic oligonucleotide
gtgctaaagctgagggacttactgcagagc

SEQ ID NO: 328271 - DNA, 30 bp, Artificial Sequence
  Description of Artificial Sequence: Synthetic oligonucleotide
tgctaaagctgagggacttactgcagagcg

SEQ ID NO: 328272 - DNA, 29 bp, Artificial Sequence
  Description of Artificial Sequence: Synthetic oligonucleotide
gctaaagctgagggacttactgcagagcg

SEQ ID NO: 328273 - DNA, 30 bp, Artificial Sequence
  Description of Artificial Sequence: Synthetic oligonucleotide
ctaaagctgagggacttactgcagagcgac

SEQ ID NO: 328274 - DNA, 32 bp, Artificial Sequence
  Description of Artificial Sequence: Synthetic oligonucleotide
taaagctgagggacttactgcagagcgacatg

SEQ ID NO: 328275 - DNA, 31 bp, Artificial Sequence
  Description of Artificial Sequence: Synthetic oligonucleotide
aaagctgagggacttactgcagagcgacatg

SEQ ID NO: 328276 - DNA, 30 bp, Artificial Sequence
  Description of Artificial Sequence: Synthetic oligonucleotide
aagctgagggacttactgcagagcgacatg

SEQ ID NO: 328277 - DNA, 29 bp, Artificial Sequence
  Description of Artificial Sequence: Synthetic oligonucleotide
agctgagggacttactgcagagcgacatg

SEQ ID NO: 328278 - DNA, 28 bp, Artificial Sequence
  Description of Artificial Sequence: Synthetic oligonucleotide
gctgagggacttactgcagagcgacatg

SEQ ID NO: 328279 - DNA, 30 bp, Artificial Sequence
  Description of Artificial Sequence: Synthetic oligonucleotide
ctgagggacttactgcagagcgacatgatc

SEQ ID NO: 328280 - DNA, 33 bp, Artificial Sequence
  Description of Artificial Sequence: Synthetic oligonucleotide
tgagggacttactgcagagcgacatgatctaag

SEQ ID NO: 328281 - DNA, 32 bp, Artificial Sequence
  Description of Artificial Sequence: Synthetic oligonucleotide
gagggacttactgcagagcgacatgatctaag

SEQ ID NO: 328282 - DNA, 32 bp, Artificial Sequence
  Description of Artificial Sequence: Synthetic oligonucleotide
agggacttactgcagagcgacatgatctaagg

SEQ ID NO: 328283 - DNA, 31 bp, Artificial Sequence
  Description of Artificial Sequence: Synthetic oligonucleotide
gggacttactgcagagcgacatgatctaagg

SEQ ID NO: 328284 - DNA, 31 bp, Artificial Sequence
  Description of Artificial Sequence: Synthetic oligonucleotide
ggacttactgcagagcgacatgatctaaggg

SEQ ID NO: 328285 - DNA, 31 bp, Artificial Sequence
  Description of Artificial Sequence: Synthetic oligonucleotide
gacttactgcagagcgacatgatctaagggc

SEQ ID NO: 328286 - DNA, 32 bp, Artificial Sequence
  Description of Artificial Sequence: Synthetic oligonucleotide
acttactgcagagcgacatgatctaagggctg

SEQ ID NO: 328287 - DNA, 31 bp, Artificial Sequence
  Description of Artificial Sequence: Synthetic oligonucleotide
cttactgcagagcgacatgatctaagggctg

SEQ ID NO: 328288 - DNA, 31 bp, Artificial Sequence
  Description of Artificial Sequence: Synthetic oligonucleotide
ttactgcagagcgacatgatctaagggctgg

SEQ ID NO: 328289 - DNA, 30 bp, Artificial Sequence
  Description of Artificial Sequence: Synthetic oligonucleotide
tactgcagagcgacatgatctaagggctgg

SEQ ID NO: 328290 - DNA, 29 bp, Artificial Sequence
  Description of Artificial Sequence: Synthetic oligonucleotide
actgcagagcgacatgatctaagggctgg

SEQ ID NO: 328291 - DNA, 28 bp, Artificial Sequence
  Description of Artificial Sequence: Synthetic oligonucleotide
ctgcagagcgacatgatctaagggctgg

SEQ ID NO: 328292 - DNA, 29 bp, Artificial Sequence
  Description of Artificial Sequence: Synthetic oligonucleotide
tgcagagcgacatgatctaagggctggtc

SEQ ID NO: 328293 - DNA, 28 bp, Artificial Sequence
  Description of Artificial Sequence: Synthetic oligonucleotide
gcagagcgacatgatctaagggctggtc

SEQ ID NO: 328294 - DNA, 28 bp, Artificial Sequence
  Description of Artificial Sequence: Synthetic oligonucleotide
cagagcgacatgatctaagggctggtcg

SEQ ID NO: 328295 - DNA, 29 bp, Artificial Sequence
  Description of Artificial Sequence: Synthetic oligonucleotide
agagcgacatgatctaagggctggtcgtg

SEQ ID NO: 328296 - DNA, 28 bp, Artificial Sequence
  Description of Artificial Sequence: Synthetic oligonucleotide
gagcgacatgatctaagggctggtcgtg

SEQ ID NO: 328297 - DNA, 29 bp, Artificial Sequence
  Description of Artificial Sequence: Synthetic oligonucleotide
agcgacatgatctaagggctggtcgtgac

SEQ ID NO: 328298 - DNA, 28 bp, Artificial Sequence
  Description of Artificial Sequence: Synthetic oligonucleotide
gcgacatgatctaagggctggtcgtgac

SEQ ID NO: 328299 - DNA, 28 bp, Artificial Sequence
  Description of Artificial Sequence: Synthetic oligonucleotide
cgacatgatctaagggctggtcgtgacc

SEQ ID NO: 328300 - DNA, 28 bp, Artificial Sequence
  Description of Artificial Sequence: Synthetic oligonucleotide
gacatgatctaagggctggtcgtgaccc

SEQ ID NO: 328301 - DNA, 31 bp, Artificial Sequence
  Description of Artificial Sequence: Synthetic oligonucleotide
acatgatctaagggctggtcgtgacccttac

SEQ ID NO: 328302 - DNA, 30 bp, Artificial Sequence
  Description of Artificial Sequence: Synthetic oligonucleotide
catgatctaagggctggtcgtgacccttac

SEQ ID NO: 328303 - DNA, 31 bp, Artificial Sequence
  Description of Artificial Sequence: Synthetic oligonucleotide
atgatctaagggctggtcgtgacccttactc

SEQ ID NO: 328304 - DNA, 30 bp, Artificial Sequence
  Description of Artificial Sequence: Synthetic oligonucleotide
tgatctaagggctggtcgtgacccttactc

SEQ ID NO: 328305 - DNA, 29 bp, Artificial Sequence
  Description of Artificial Sequence: Synthetic oligonucleotide
gatctaagggctggtcgtgacccttactc

SEQ ID NO: 328306 - DNA, 29 bp, Artificial Sequence
  Description of Artificial Sequence: Synthetic oligonucleotide
atctaagggctggtcgtgacccttactcc

SEQ ID NO: 328307 - DNA, 28 bp, Artificial Sequence
  Description of Artificial Sequence: Synthetic oligonucleotide
tctaagggctggtcgtgacccttactcc

SEQ ID NO: 328308 - DNA, 27 bp, Artificial Sequence
  Description of Artificial Sequence: Synthetic oligonucleotide
ctaagggctggtcgtgacccttactcc

SEQ ID NO: 328309 - DNA, 28 bp, Artificial Sequence
  Description of Artificial Sequence: Synthetic oligonucleotide
taagggctggtcgtgacccttactccag

SEQ ID NO: 328310 - DNA, 27 bp, Artificial Sequence
  Description of Artificial Sequence: Synthetic oligonucleotide
aagggctggtcgtgacccttactccag

SEQ ID NO: 328311 - DNA, 26 bp, Artificial Sequence
  Description of Artificial Sequence: Synthetic oligonucleotide
agggctggtcgtgacccttactccag

SEQ ID NO: 328312 - DNA, 25 bp, Artificial Sequence
  Description of Artificial Sequence: Synthetic oligonucleotide
gggctggtcgtgacccttactccag

SEQ ID NO: 328313 - DNA, 25 bp, Artificial Sequence
  Description of Artificial Sequence: Synthetic oligonucleotide
ggctggtcgtgacccttactccagc

SEQ ID NO: 328314 - DNA, 25 bp, Artificial Sequence
  Description of Artificial Sequence: Synthetic oligonucleotide
gctggtcgtgacccttactccagcc

SEQ ID NO: 328315 - DNA, 26 bp, Artificial Sequence
  Description of Artificial Sequence: Synthetic oligonucleotide
ctggtcgtgacccttactccagccca

SEQ ID NO: 328316 - DNA, 26 bp, Artificial Sequence
  Description of Artificial Sequence: Synthetic oligonucleotide
tggtcgtgacccttactccagcccag

SEQ ID NO: 328317 - DNA, 25 bp, Artificial Sequence
  Description of Artificial Sequence: Synthetic oligonucleotide
ggtcgtgacccttactccagcccag

SEQ ID NO: 328318 - DNA, 26 bp, Artificial Sequence
  Description of Artificial Sequence: Synthetic oligonucleotide
gtcgtgacccttactccagcccagga

SEQ ID NO: 328319 - DNA, 27 bp, Artificial Sequence
  Description of Artificial Sequence: Synthetic oligonucleotide
tcgtgacccttactccagcccaggaca

SEQ ID NO: 328320 - DNA, 26 bp, Artificial Sequence
  Description of Artificial Sequence: Synthetic oligonucleotide
cgtgacccttactccagcccaggaca

SEQ ID NO: 328321 - DNA, 27 bp, Artificial Sequence
  Description of Artificial Sequence: Synthetic oligonucleotide
gtgacccttactccagcccaggacagt

SEQ ID NO: 328322 - DNA, 27 bp, Artificial Sequence
  Description of Artificial Sequence: Synthetic oligonucleotide
tgacccttactccagcccaggacagtc

SEQ ID NO: 328323 - DNA, 27 bp, Artificial Sequence
  Description of Artificial Sequence: Synthetic oligonucleotide
gacccttactccagcccaggacagtca

SEQ ID NO: 328324 - DNA, 30 bp, Artificial Sequence
  Description of Artificial Sequence: Synthetic oligonucleotide
acccttactccagcccaggacagtcatttc

SEQ ID NO: 328325 - DNA, 29 bp, Artificial Sequence
  Description of Artificial Sequence: Synthetic oligonucleotide
cccttactccagcccaggacagtcatttc

SEQ ID NO: 328326 - DNA, 29 bp, Artificial Sequence
  Description of Artificial Sequence: Synthetic oligonucleotide
ccttactccagcccaggacagtcatttcc

SEQ ID NO: 328327 - DNA, 30 bp, Artificial Sequence
  Description of Artificial Sequence: Synthetic oligonucleotide
cttactccagcccaggacagtcatttccag

SEQ ID NO: 328328 - DNA, 30 bp, Artificial Sequence
  Description of Artificial Sequence: Synthetic oligonucleotide
ttactccagcccaggacagtcatttccagg

SEQ ID NO: 328329 - DNA, 29 bp, Artificial Sequence
  Description of Artificial Sequence: Synthetic oligonucleotide
tactccagcccaggacagtcatttccagg

SEQ ID NO: 328330 - DNA, 28 bp, Artificial Sequence
  Description of Artificial Sequence: Synthetic oligonucleotide
actccagcccaggacagtcatttccagg

SEQ ID NO: 328331 - DNA, 27 bp, Artificial Sequence
  Description of Artificial Sequence: Synthetic oligonucleotide
ctccagcccaggacagtcatttccagg

SEQ ID NO: 328332 - DNA, 28 bp, Artificial Sequence
  Description of Artificial Sequence: Synthetic oligonucleotide
tccagcccaggacagtcatttccaggag

SEQ ID NO: 328333 - DNA, 27 bp, Artificial Sequence
  Description of Artificial Sequence: Synthetic oligonucleotide
ccagcccaggacagtcatttccaggag

SEQ ID NO: 328334 - DNA, 27 bp, Artificial Sequence
  Description of Artificial Sequence: Synthetic oligonucleotide
cagcccaggacagtcatttccaggagc

SEQ ID NO: 328335 - DNA, 27 bp, Artificial Sequence
  Description of Artificial Sequence: Synthetic oligonucleotide
agcccaggacagtcatttccaggagcc

SEQ ID NO: 328336 - DNA, 27 bp, Artificial Sequence
  Description of Artificial Sequence: Synthetic oligonucleotide
gcccaggacagtcatttccaggagcca

SEQ ID NO: 328337 - DNA, 27 bp, Artificial Sequence
  Description of Artificial Sequence: Synthetic oligonucleotide
cccaggacagtcatttccaggagccac

SEQ ID NO: 328338 - DNA, 27 bp, Artificial Sequence
  Description of Artificial Sequence: Synthetic oligonucleotide
ccaggacagtcatttccaggagccacg

SEQ ID NO: 328339 - DNA, 27 bp, Artificial Sequence
  Description of Artificial Sequence: Synthetic oligonucleotide
caggacagtcatttccaggagccacgc

SEQ ID NO: 328340 - DNA, 28 bp, Artificial Sequence
  Description of Artificial Sequence: Synthetic oligonucleotide
aggacagtcatttccaggagccacgcag

SEQ ID NO: 328341 - DNA, 27 bp, Artificial Sequence
  Description of Artificial Sequence: Synthetic oligonucleotide
ggacagtcatttccaggagccacgcag

SEQ ID NO: 328342 - DNA, 30 bp, Artificial Sequence
  Description of Artificial Sequence: Synthetic oligonucleotide
gacagtcatttccaggagccacgcagaatg

SEQ ID NO: 328343 - DNA, 30 bp, Artificial Sequence
  Description of Artificial Sequence: Synthetic oligonucleotide
acagtcatttccaggagccacgcagaatgc

SEQ ID NO: 328344 - DNA, 29 bp, Artificial Sequence
  Description of Artificial Sequence: Synthetic oligonucleotide
cagtcatttccaggagccacgcagaatgc

SEQ ID NO: 328345 - DNA, 30 bp, Artificial Sequence
  Description of Artificial Sequence: Synthetic oligonucleotide
agtcatttccaggagccacgcagaatgctc

SEQ ID NO: 328346 - DNA, 29 bp, Artificial Sequence
  Description of Artificial Sequence: Synthetic oligonucleotide
gtcatttccaggagccacgcagaatgctc

SEQ ID NO: 328347 - DNA, 30 bp, Artificial Sequence
  Description of Artificial Sequence: Synthetic oligonucleotide
tcatttccaggagccacgcagaatgctcag

SEQ ID NO: 328348 - DNA, 29 bp, Artificial Sequence
  Description of Artificial Sequence: Synthetic oligonucleotide
catttccaggagccacgcagaatgctcag

SEQ ID NO: 328349 - DNA, 29 bp, Artificial Sequence
  Description of Artificial Sequence: Synthetic oligonucleotide
atttccaggagccacgcagaatgctcagc

SEQ ID NO: 328350 - DNA, 28 bp, Artificial Sequence
  Description of Artificial Sequence: Synthetic oligonucleotide
tttccaggagccacgcagaatgctcagc

SEQ ID NO: 328351 - DNA, 27 bp, Artificial Sequence
  Description of Artificial Sequence: Synthetic oligonucleotide
ttccaggagccacgcagaatgctcagc

SEQ ID NO: 328352 - DNA, 26 bp, Artificial Sequence
  Description of Artificial Sequence: Synthetic oligonucleotide
tccaggagccacgcagaatgctcagc

SEQ ID NO: 328353 - DNA, 25 bp, Artificial Sequence
  Description of Artificial Sequence: Synthetic oligonucleotide
ccaggagccacgcagaatgctcagc

SEQ ID NO: 328354 - DNA, 26 bp, Artificial Sequence
  Description of Artificial Sequence: Synthetic oligonucleotide
caggagccacgcagaatgctcagcca

SEQ ID NO: 328355 - DNA, 27 bp, Artificial Sequence
  Description of Artificial Sequence: Synthetic oligonucleotide
aggagccacgcagaatgctcagccaca

SEQ ID NO: 328356 - DNA, 27 bp, Artificial Sequence
  Description of Artificial Sequence: Synthetic oligonucleotide
ggagccacgcagaatgctcagccacaa

SEQ ID NO: 328357 - DNA, 28 bp, Artificial Sequence
  Description of Artificial Sequence: Synthetic oligonucleotide
gagccacgcagaatgctcagccacaaac

SEQ ID NO: 328358 - DNA, 29 bp, Artificial Sequence
  Description of Artificial Sequence: Synthetic oligonucleotide
agccacgcagaatgctcagccacaaactg

SEQ ID NO: 328359 - DNA, 28 bp, Artificial Sequence
  Description of Artificial Sequence: Synthetic oligonucleotide
gccacgcagaatgctcagccacaaactg

SEQ ID NO: 328360 - DNA, 28 bp, Artificial Sequence
  Description of Artificial Sequence: Synthetic oligonucleotide
ccacgcagaatgctcagccacaaactgc

SEQ ID NO: 328361 - DNA, 28 bp, Artificial Sequence
  Description of Artificial Sequence: Synthetic oligonucleotide
cacgcagaatgctcagccacaaactgcg

SEQ ID NO: 328362 - DNA, 28 bp, Artificial Sequence
  Description of Artificial Sequence: Synthetic oligonucleotide
acgcagaatgctcagccacaaactgcgg

SEQ ID NO: 328363 - DNA, 27 bp, Artificial Sequence
  Description of Artificial Sequence: Synthetic oligonucleotide
cgcagaatgctcagccacaaactgcgg

SEQ ID NO: 328364 - DNA, 27 bp, Artificial Sequence
  Description of Artificial Sequence: Synthetic oligonucleotide
gcagaatgctcagccacaaactgcggc

SEQ ID NO: 328365 - DNA, 29 bp, Artificial Sequence
  Description of Artificial Sequence: Synthetic oligonucleotide
cagaatgctcagccacaaactgcggcaac

SEQ ID NO: 328366 - DNA, 30 bp, Artificial Sequence
  Description of Artificial Sequence: Synthetic oligonucleotide
agaatgctcagccacaaactgcggcaactg

SEQ ID NO: 328367 - DNA, 29 bp, Artificial Sequence
  Description of Artificial Sequence: Synthetic oligonucleotide
gaatgctcagccacaaactgcggcaactg

SEQ ID NO: 328368 - DNA, 30 bp, Artificial Sequence
  Description of Artificial Sequence: Synthetic oligonucleotide
aatgctcagccacaaactgcggcaactgac

SEQ ID NO: 328369 - DNA, 29 bp, Artificial Sequence
  Description of Artificial Sequence: Synthetic oligonucleotide
atgctcagccacaaactgcggcaactgac

SEQ ID NO: 328370 - DNA, 28 bp, Artificial Sequence
  Description of Artificial Sequence: Synthetic oligonucleotide
tgctcagccacaaactgcggcaactgac

SEQ ID NO: 328371 - DNA, 27 bp, Artificial Sequence
  Description of Artificial Sequence: Synthetic oligonucleotide
gctcagccacaaactgcggcaactgac

SEQ ID NO: 328372 - DNA, 28 bp, Artificial Sequence
  Description of Artificial Sequence: Synthetic oligonucleotide
ctcagccacaaactgcggcaactgacag

SEQ ID NO: 328373 - DNA, 29 bp, Artificial Sequence
  Description of Artificial Sequence: Synthetic oligonucleotide
tcagccacaaactgcggcaactgacagtg

SEQ ID NO: 328374 - DNA, 28 bp, Artificial Sequence
  Description of Artificial Sequence: Synthetic oligonucleotide
cagccacaaactgcggcaactgacagtg

SEQ ID NO: 328375 - DNA, 28 bp, Artificial Sequence
  Description of Artificial Sequence: Synthetic oligonucleotide
agccacaaactgcggcaactgacagtgc

SEQ ID NO: 328376 - DNA, 27 bp, Artificial Sequence
  Description of Artificial Sequence: Synthetic oligonucleotide
gccacaaactgcggcaactgacagtgc

SEQ ID NO: 328377 - DNA, 29 bp, Artificial Sequence
  Description of Artificial Sequence: Synthetic oligonucleotide
ccacaaactgcggcaactgacagtgcaac

SEQ ID NO: 328378 - DNA, 29 bp, Artificial Sequence
  Description of Artificial Sequence: Synthetic oligonucleotide
cacaaactgcggcaactgacagtgcaacc

SEQ ID NO: 328379 - DNA, 30 bp, Artificial Sequence
  Description of Artificial Sequence: Synthetic oligonucleotide
acaaactgcggcaactgacagtgcaaccac

SEQ ID NO: 328380 - DNA, 29 bp, Artificial Sequence
  Description of Artificial Sequence: Synthetic oligonucleotide
caaactgcggcaactgacagtgcaaccac

SEQ ID NO: 328381 - DNA, 29 bp, Artificial Sequence
  Description of Artificial Sequence: Synthetic oligonucleotide
aaactgcggcaactgacagtgcaaccacc

SEQ ID NO: 328382 - DNA, 28 bp, Artificial Sequence
  Description of Artificial Sequence: Synthetic oligonucleotide
aactgcggcaactgacagtgcaaccacc

SEQ ID NO: 328383 - DNA, 27 bp, Artificial Sequence
  Description of Artificial Sequence: Synthetic oligonucleotide
actgcggcaactgacagtgcaaccacc

SEQ ID NO: 328384 - DNA, 26 bp, Artificial Sequence
  Description of Artificial Sequence: Synthetic oligonucleotide
ctgcggcaactgacagtgcaaccacc

SEQ ID NO: 328385 - DNA, 27 bp, Artificial Sequence
  Description of Artificial Sequence: Synthetic oligonucleotide
tgcggcaactgacagtgcaaccaccga

SEQ ID NO: 328386 - DNA, 27 bp, Artificial Sequence
  Description of Artificial Sequence: Synthetic oligonucleotide
gcggcaactgacagtgcaaccaccgat

SEQ ID NO: 328387 - DNA, 27 bp, Artificial Sequence
  Description of Artificial Sequence: Synthetic oligonucleotide
cggcaactgacagtgcaaccaccgatg

SEQ ID NO: 328388 - DNA, 27 bp, Artificial Sequence
  Description of Artificial Sequence: Synthetic oligonucleotide
ggcaactgacagtgcaaccaccgatgc

SEQ ID NO: 328389 - DNA, 27 bp, Artificial Sequence
  Description of Artificial Sequence: Synthetic oligonucleotide
gcaactgacagtgcaaccaccgatgcc

SEQ ID NO: 328390 - DNA, 28 bp, Artificial Sequence
  Description of Artificial Sequence: Synthetic oligonucleotide
caactgacagtgcaaccaccgatgcctg

SEQ ID NO: 328391 - DNA, 28 bp, Artificial Sequence
  Description of Artificial Sequence: Synthetic oligonucleotide
aactgacagtgcaaccaccgatgcctgc

SEQ ID NO: 328392 - DNA, 27 bp, Artificial Sequence
  Description of Artificial Sequence: Synthetic oligonucleotide
actgacagtgcaaccaccgatgcctgc

SEQ ID NO: 328393 - DNA, 26 bp, Artificial Sequence
  Description of Artificial Sequence: Synthetic oligonucleotide
ctgacagtgcaaccaccgatgcctgc

SEQ ID NO: 328394 - DNA, 26 bp, Artificial Sequence
  Description of Artificial Sequence: Synthetic oligonucleotide
tgacagtgcaaccaccgatgcctgcc

SEQ ID NO: 328395 - DNA, 25 bp, Artificial Sequence
  Description of Artificial Sequence: Synthetic oligonucleotide
gacagtgcaaccaccgatgcctgcc

SEQ ID NO: 328396 - DNA, 25 bp, Artificial Sequence
  Description of Artificial Sequence: Synthetic oligonucleotide
acagtgcaaccaccgatgcctgccg

SEQ ID NO: 328397 - DNA, 24 bp, Artificial Sequence
  Description of Artificial Sequence: Synthetic oligonucleotide
cagtgcaaccaccgatgcctgccg

SEQ ID NO: 328398 - DNA, 24 bp, Artificial Sequence
  Description of Artificial Sequence: Synthetic oligonucleotide
agtgcaaccaccgatgcctgccgg

SEQ ID NO: 328399 - DNA, 23 bp, Artificial Sequence
  Description of Artificial Sequence: Synthetic oligonucleotide
gtgcaaccaccgatgcctgccgg

SEQ ID NO: 328400 - DNA, 23 bp, Artificial Sequence
  Description of Artificial Sequence: Synthetic oligonucleotide
tgcaaccaccgatgcctgccggc

SEQ ID NO: 328401 - DNA, 22 bp, Artificial Sequence
  Description of Artificial Sequence: Synthetic oligonucleotide
gcaaccaccgatgcctgccggc

SEQ ID NO: 328402 - DNA, 22 bp, Artificial Sequence
  Description of Artificial Sequence: Synthetic oligonucleotide
caaccaccgatgcctgccggcc

SEQ ID NO: 328403 - DNA, 23 bp, Artificial Sequence
  Description of Artificial Sequence: Synthetic oligonucleotide
aaccaccgatgcctgccggccca

SEQ ID NO: 328404 - DNA, 22 bp, Artificial Sequence
  Description of Artificial Sequence: Synthetic oligonucleotide
accaccgatgcctgccggccca

SEQ ID NO: 328405 - DNA, 21 bp, Artificial Sequence
  Description of Artificial Sequence: Synthetic oligonucleotide
ccaccgatgcctgccggccca

SEQ ID NO: 328406 - DNA, 21 bp, Artificial Sequence
  Description of Artificial Sequence: Synthetic oligonucleotide
caccgatgcctgccggcccac

SEQ ID NO: 328407 - DNA, 23 bp, Artificial Sequence
  Description of Artificial Sequence: Synthetic oligonucleotide
accgatgcctgccggcccacgat

SEQ ID NO: 328408 - DNA, 22 bp, Artificial Sequence
  Description of Artificial Sequence: Synthetic oligonucleotide
ccgatgcctgccggcccacgat

SEQ ID NO: 328409 - DNA, 22 bp, Artificial Sequence
  Description of Artificial Sequence: Synthetic oligonucleotide
cgatgcctgccggcccacgatc

SEQ ID NO: 328410 - DNA, 24 bp, Artificial Sequence
  Description of Artificial Sequence: Synthetic oligonucleotide
gatgcctgccggcccacgatcgat

SEQ ID NO: 328411 - DNA, 26 bp, Artificial Sequence
  Description of Artificial Sequence: Synthetic oligonucleotide
atgcctgccggcccacgatcgatgaa

SEQ ID NO: 328412 - DNA, 25 bp, Artificial Sequence
  Description of Artificial Sequence: Synthetic oligonucleotide
tgcctgccggcccacgatcgatgaa

SEQ ID NO: 328413 - DNA, 24 bp, Artificial Sequence
  Description of Artificial Sequence: Synthetic oligonucleotide
gcctgccggcccacgatcgatgaa

SEQ ID NO: 328414 - DNA, 25 bp, Artificial Sequence
  Description of Artificial Sequence: Synthetic oligonucleotide
cctgccggcccacgatcgatgaagt

SEQ ID NO: 328415 - DNA, 25 bp, Artificial Sequence
  Description of Artificial Sequence: Synthetic oligonucleotide
ctgccggcccacgatcgatgaagtg

SEQ ID NO: 328416 - DNA, 25 bp, Artificial Sequence
  Description of Artificial Sequence: Synthetic oligonucleotide
tgccggcccacgatcgatgaagtgg

SEQ ID NO: 328417 - DNA, 24 bp, Artificial Sequence
  Description of Artificial Sequence: Synthetic oligonucleotide
gccggcccacgatcgatgaagtgg

SEQ ID NO: 328418 - DNA, 25 bp, Artificial Sequence
  Description of Artificial Sequence: Synthetic oligonucleotide
ccggcccacgatcgatgaagtgggt

SEQ ID NO: 328419 - DNA, 25 bp, Artificial Sequence
  Description of Artificial Sequence: Synthetic oligonucleotide
cggcccacgatcgatgaagtgggtg

SEQ ID NO: 328420 - DNA, 26 bp, Artificial Sequence
  Description of Artificial Sequence: Synthetic oligonucleotide
ggcccacgatcgatgaagtgggtgga

SEQ ID NO: 328421 - DNA, 26 bp, Artificial Sequence
  Description of Artificial Sequence: Synthetic oligonucleotide
gcccacgatcgatgaagtgggtggag

SEQ ID NO: 328422 - DNA, 27 bp, Artificial Sequence
  Description of Artificial Sequence: Synthetic oligonucleotide
cccacgatcgatgaagtgggtggagga

SEQ ID NO: 328423 - DNA, 27 bp, Artificial Sequence
  Description of Artificial Sequence: Synthetic oligonucleotide
ccacgatcgatgaagtgggtggaggag

SEQ ID NO: 328424 - DNA, 28 bp, Artificial Sequence
  Description of Artificial Sequence: Synthetic oligonucleotide
cacgatcgatgaagtgggtggaggagtc

SEQ ID NO: 328425 - DNA, 29 bp, Artificial Sequence
  Description of Artificial Sequence: Synthetic oligonucleotide
acgatcgatgaagtgggtggaggagtcag

SEQ ID NO: 328426 - DNA, 28 bp, Artificial Sequence
  Description of Artificial Sequence: Synthetic oligonucleotide
cgatcgatgaagtgggtggaggagtcag

SEQ ID NO: 328427 - DNA, 28 bp, Artificial Sequence
  Description of Artificial Sequence: Synthetic oligonucleotide
gatcgatgaagtgggtggaggagtcagg

SEQ ID NO: 328428 - DNA, 28 bp, Artificial Sequence
  Description of Artificial Sequence: Synthetic oligonucleotide
atcgatgaagtgggtggaggagtcaggc

SEQ ID NO: 328429 - DNA, 27 bp, Artificial Sequence
  Description of Artificial Sequence: Synthetic oligonucleotide
tcgatgaagtgggtggaggagtcaggc

SEQ ID NO: 328430 - DNA, 27 bp, Artificial Sequence
  Description of Artificial Sequence: Synthetic oligonucleotide
cgatgaagtgggtggaggagtcaggca

SEQ ID NO: 328431 - DNA, 27 bp, Artificial Sequence
  Description of Artificial Sequence: Synthetic oligonucleotide
gatgaagtgggtggaggagtcaggcac

SEQ ID NO: 328432 - DNA, 27 bp, Artificial Sequence
  Description of Artificial Sequence: Synthetic oligonucleotide
atgaagtgggtggaggagtcaggcacg

SEQ ID NO: 328433 - DNA, 27 bp, Artificial Sequence
  Description of Artificial Sequence: Synthetic oligonucleotide
tgaagtgggtggaggagtcaggcacgt

SEQ ID NO: 328434 - DNA, 27 bp, Artificial Sequence
  Description of Artificial Sequence: Synthetic oligonucleotide
gaagtgggtggaggagtcaggcacgta

SEQ ID NO: 328435 - DNA, 27 bp, Artificial Sequence
  Description of Artificial Sequence: Synthetic oligonucleotide
aagtgggtggaggagtcaggcacgtac

SEQ ID NO: 328436 - DNA, 27 bp, Artificial Sequence
  Description of Artificial Sequence: Synthetic oligonucleotide
agtgggtggaggagtcaggcacgtact

SEQ ID NO: 328437 - DNA, 27 bp, Artificial Sequence
  Description of Artificial Sequence: Synthetic oligonucleotide
gtgggtggaggagtcaggcacgtactt

SEQ ID NO: 328438 - DNA, 27 bp, Artificial Sequence
  Description of Artificial Sequence: Synthetic oligonucleotide
tgggtggaggagtcaggcacgtacttc

SEQ ID NO: 328439 - DNA, 26 bp, Artificial Sequence
  Description of Artificial Sequence: Synthetic oligonucleotide
gggtggaggagtcaggcacgtacttc

SEQ ID NO: 328440 - DNA, 27 bp, Artificial Sequence
  Description of Artificial Sequence: Synthetic oligonucleotide
ggtggaggagtcaggcacgtacttcga

SEQ ID NO: 328441 - DNA, 27 bp, Artificial Sequence
  Description of Artificial Sequence: Synthetic oligonucleotide
gtggaggagtcaggcacgtacttcgag

SEQ ID NO: 328442 - DNA, 27 bp, Artificial Sequence
  Description of Artificial Sequence: Synthetic oligonucleotide
tggaggagtcaggcacgtacttcgagc

SEQ ID NO: 328443 - DNA, 26 bp, Artificial Sequence
  Description of Artificial Sequence: Synthetic oligonucleotide
ggaggagtcaggcacgtacttcgagc

SEQ ID NO: 328444 - DNA, 26 bp, Artificial Sequence
  Description of Artificial Sequence: Synthetic oligonucleotide
gaggagtcaggcacgtacttcgagcc

SEQ ID NO: 328445 - DNA, 27 bp, Artificial Sequence
  Description of Artificial Sequence: Synthetic oligonucleotide
aggagtcaggcacgtacttcgagccga

SEQ ID NO: 328446 - DNA, 26 bp, Artificial Sequence
  Description of Artificial Sequence: Synthetic oligonucleotide
ggagtcaggcacgtacttcgagccga

SEQ ID NO: 328447 - DNA, 26 bp, Artificial Sequence
  Description of Artificial Sequence: Synthetic oligonucleotide
gagtcaggcacgtacttcgagccgac

SEQ ID NO: 328448 - DNA, 26 bp, Artificial Sequence
  Description of Artificial Sequence: Synthetic oligonucleotide
agtcaggcacgtacttcgagccgacg

SEQ ID NO: 328449 - DNA, 25 bp, Artificial Sequence
  Description of Artificial Sequence: Synthetic oligonucleotide
gtcaggcacgtacttcgagccgacg

SEQ ID NO: 328450 - DNA, 26 bp, Artificial Sequence
  Description of Artificial Sequence: Synthetic oligonucleotide
tcaggcacgtacttcgagccgacgct

SEQ ID NO: 328451 - DNA, 25 bp, Artificial Sequence
  Description of Artificial Sequence: Synthetic oligonucleotide
caggcacgtacttcgagccgacgct

SEQ ID NO: 328452 - DNA, 25 bp, Artificial Sequence
  Description of Artificial Sequence: Synthetic oligonucleotide
aggcacgtacttcgagccgacgctg

SEQ ID NO: 328453 - DNA, 24 bp, Artificial Sequence
  Description of Artificial Sequence: Synthetic oligonucleotide
ggcacgtacttcgagccgacgctg

SEQ ID NO: 328454 - DNA, 24 bp, Artificial Sequence
  Description of Artificial Sequence: Synthetic oligonucleotide
gcacgtacttcgagccgacgctgg

SEQ ID NO: 328455 - DNA, 24 bp, Artificial Sequence
  Description of Artificial Sequence: Synthetic oligonucleotide
cacgtacttcgagccgacgctggc

SEQ ID NO: 328456 - DNA, 24 bp, Artificial Sequence
  Description of Artificial Sequence: Synthetic oligonucleotide
acgtacttcgagccgacgctggcg

SEQ ID NO: 328457 - DNA, 23 bp, Artificial Sequence
  Description of Artificial Sequence: Synthetic oligonucleotide
cgtacttcgagccgacgctggcg

SEQ ID NO: 328458 - DNA, 23 bp, Artificial Sequence
  Description of Artificial Sequence: Synthetic oligonucleotide
gtacttcgagccgacgctggcgc

SEQ ID NO: 328459 - DNA, 26 bp, Artificial Sequence
  Description of Artificial Sequence: Synthetic oligonucleotide
tacttcgagccgacgctggcgccttt

SEQ ID NO: 328460 - DNA, 25 bp, Artificial Sequence
  Description of Artificial Sequence: Synthetic oligonucleotide
acttcgagccgacgctggcgccttt

SEQ ID NO: 328461 - DNA, 24 bp, Artificial Sequence
  Description of Artificial Sequence: Synthetic oligonucleotide
cttcgagccgacgctggcgccttt

SEQ ID NO: 328462 - DNA, 27 bp, Artificial Sequence
  Description of Artificial Sequence: Synthetic oligonucleotide
ttcgagccgacgctggcgcctttgttt

SEQ ID NO: 328463 - DNA, 26 bp, Artificial Sequence
  Description of Artificial Sequence: Synthetic oligonucleotide
tcgagccgacgctggcgcctttgttt

SEQ ID NO: 328464 - DNA, 25 bp, Artificial Sequence
  Description of Artificial Sequence: Synthetic oligonucleotide
cgagccgacgctggcgcctttgttt

SEQ ID NO: 328465 - DNA, 27 bp, Artificial Sequence
  Description of Artificial Sequence: Synthetic oligonucleotide
gagccgacgctggcgcctttgtttgat

SEQ ID NO: 328466 - DNA, 27 bp, Artificial Sequence
  Description of Artificial Sequence: Synthetic oligonucleotide
agccgacgctggcgcctttgtttgatc

SEQ ID NO: 328467 - DNA, 26 bp, Artificial Sequence
  Description of Artificial Sequence: Synthetic oligonucleotide
gccgacgctggcgcctttgtttgatc

SEQ ID NO: 328468 - DNA, 27 bp, Artificial Sequence
  Description of Artificial Sequence: Synthetic oligonucleotide
ccgacgctggcgcctttgtttgatcgt

SEQ ID NO: 328469 - DNA, 27 bp, Artificial Sequence
  Description of Artificial Sequence: Synthetic oligonucleotide
cgacgctggcgcctttgtttgatcgtg

SEQ ID NO: 328470 - DNA, 28 bp, Artificial Sequence
  Description of Artificial Sequence: Synthetic oligonucleotide
gacgctggcgcctttgtttgatcgtgag

SEQ ID NO: 328471 - DNA, 28 bp, Artificial Sequence
  Description of Artificial Sequence: Synthetic oligonucleotide
acgctggcgcctttgtttgatcgtgagg

SEQ ID NO: 328472 - DNA, 27 bp, Artificial Sequence
  Description of Artificial Sequence: Synthetic oligonucleotide
cgctggcgcctttgtttgatcgtgagg

SEQ ID NO: 328473 - DNA, 27 bp, Artificial Sequence
  Description of Artificial Sequence: Synthetic oligonucleotide
gctggcgcctttgtttgatcgtgaggc

SEQ ID NO: 328474 - DNA, 27 bp, Artificial Sequence
  Description of Artificial Sequence: Synthetic oligonucleotide
ctggcgcctttgtttgatcgtgaggcg

SEQ ID NO: 328475 - DNA, 30 bp, Artificial Sequence
  Description of Artificial Sequence: Synthetic oligonucleotide
tggcgcctttgtttgatcgtgaggcgtttg

SEQ ID NO: 328476 - DNA, 29 bp, Artificial Sequence
  Description of Artificial Sequence: Synthetic oligonucleotide
ggcgcctttgtttgatcgtgaggcgtttg

SEQ ID NO: 328477 - DNA, 29 bp, Artificial Sequence
  Description of Artificial Sequence: Synthetic oligonucleotide
gcgcctttgtttgatcgtgaggcgtttgg

SEQ ID NO: 328478 - DNA, 29 bp, Artificial Sequence
  Description of Artificial Sequence: Synthetic oligonucleotide
cgcctttgtttgatcgtgaggcgtttggc

SEQ ID NO: 328479 - DNA, 29 bp, Artificial Sequence
  Description of Artificial Sequence: Synthetic oligonucleotide
gcctttgtttgatcgtgaggcgtttggcc

SEQ ID NO: 328480 - DNA, 29 bp, Artificial Sequence
  Description of Artificial Sequence: Synthetic oligonucleotide
cctttgtttgatcgtgaggcgtttggccc

SEQ ID NO: 328481 - DNA, 29 bp, Artificial Sequence
  Description of Artificial Sequence: Synthetic oligonucleotide
ctttgtttgatcgtgaggcgtttggcccg

SEQ ID NO: 328482 - DNA, 30 bp, Artificial Sequence
  Description of Artificial Sequence: Synthetic oligonucleotide
tttgtttgatcgtgaggcgtttggcccgtg

SEQ ID NO: 328483 - DNA, 29 bp, Artificial Sequence
  Description of Artificial Sequence: Synthetic oligonucleotide
ttgtttgatcgtgaggcgtttggcccgtg

SEQ ID NO: 328484 - DNA, 28 bp, Artificial Sequence
  Description of Artificial Sequence: Synthetic oligonucleotide
tgtttgatcgtgaggcgtttggcccgtg

SEQ ID NO: 328485 - DNA, 27 bp, Artificial Sequence
  Description of Artificial Sequence: Synthetic oligonucleotide
gtttgatcgtgaggcgtttggcccgtg

SEQ ID NO: 328486 - DNA, 27 bp, Artificial Sequence
  Description of Artificial Sequence: Synthetic oligonucleotide
tttgatcgtgaggcgtttggcccgtgc

SEQ ID NO: 328487 - DNA, 27 bp, Artificial Sequence
  Description of Artificial Sequence: Synthetic oligonucleotide
ttgatcgtgaggcgtttggcccgtgca

SEQ ID NO: 328488 - DNA, 26 bp, Artificial Sequence
  Description of Artificial Sequence: Synthetic oligonucleotide
tgatcgtgaggcgtttggcccgtgca

SEQ ID NO: 328489 - DNA, 25 bp, Artificial Sequence
  Description of Artificial Sequence: Synthetic oligonucleotide
gatcgtgaggcgtttggcccgtgca

SEQ ID NO: 328490 - DNA, 25 bp, Artificial Sequence
  Description of Artificial Sequence: Synthetic oligonucleotide
atcgtgaggcgtttggcccgtgcac

SEQ ID NO: 328491 - DNA, 24 bp, Artificial Sequence
  Description of Artificial Sequence: Synthetic oligonucleotide
tcgtgaggcgtttggcccgtgcac

SEQ ID NO: 328492 - DNA, 23 bp, Artificial Sequence
  Description of Artificial Sequence: Synthetic oligonucleotide
cgtgaggcgtttggcccgtgcac

SEQ ID NO: 328493 - DNA, 23 bp, Artificial Sequence
  Description of Artificial Sequence: Synthetic oligonucleotide
gtgaggcgtttggcccgtgcacc

SEQ ID NO: 328494 - DNA, 23 bp, Artificial Sequence
  Description of Artificial Sequence: Synthetic oligonucleotide
tgaggcgtttggcccgtgcaccc

SEQ ID NO: 328495 - DNA, 22 bp, Artificial Sequence
  Description of Artificial Sequence: Synthetic oligonucleotide
gaggcgtttggcccgtgcaccc

SEQ ID NO: 328496 - DNA, 24 bp, Artificial Sequence
  Description of Artificial Sequence: Synthetic oligonucleotide
aggcgtttggcccgtgcacccgaa

SEQ ID NO: 328497 - DNA, 23 bp, Artificial Sequence
  Description of Artificial Sequence: Synthetic oligonucleotide
ggcgtttggcccgtgcacccgaa

SEQ ID NO: 328498 - DNA, 24 bp, Artificial Sequence
  Description of Artificial Sequence: Synthetic oligonucleotide
gcgtttggcccgtgcacccgaact

SEQ ID NO: 328499 - DNA, 24 bp, Artificial Sequence
  Description of Artificial Sequence: Synthetic oligonucleotide
cgtttggcccgtgcacccgaactg

SEQ ID NO: 328500 - DNA, 25 bp, Artificial Sequence
  Description of Artificial Sequence: Synthetic oligonucleotide
gtttggcccgtgcacccgaactgct

SEQ ID NO: 328501 - DNA, 25 bp, Artificial Sequence
  Description of Artificial Sequence: Synthetic oligonucleotide
tttggcccgtgcacccgaactgctg

SEQ ID NO: 328502 - DNA, 24 bp, Artificial Sequence
  Description of Artificial Sequence: Synthetic oligonucleotide
ttggcccgtgcacccgaactgctg

SEQ ID NO: 328503 - DNA, 23 bp, Artificial Sequence
  Description of Artificial Sequence: Synthetic oligonucleotide
tggcccgtgcacccgaactgctg

SEQ ID NO: 328504 - DNA, 22 bp, Artificial Sequence
  Description of Artificial Sequence: Synthetic oligonucleotide
ggcccgtgcacccgaactgctg

SEQ ID NO: 328505 - DNA, 22 bp, Artificial Sequence
  Description of Artificial Sequence: Synthetic oligonucleotide
gcccgtgcacccgaactgctgc

SEQ ID NO: 328506 - DNA, 24 bp, Artificial Sequence
  Description of Artificial Sequence: Synthetic oligonucleotide
cccgtgcacccgaactgctgccat

SEQ ID NO: 328507 - DNA, 27 bp, Artificial Sequence
  Description of Artificial Sequence: Synthetic oligonucleotide
ccgtgcacccgaactgctgccatcaaa

SEQ ID NO: 328508 - DNA, 32 bp, Artificial Sequence
  Description of Artificial Sequence: Synthetic oligonucleotide
cgtgcacccgaactgctgccatcaaattattc

SEQ ID NO: 328509 - DNA, 33 bp, Artificial Sequence
  Description of Artificial Sequence: Synthetic oligonucleotide
gtgcacccgaactgctgccatcaaattattctc

SEQ ID NO: 328510 - DNA, 34 bp, Artificial Sequence
  Description of Artificial Sequence: Synthetic oligonucleotide
tgcacccgaactgctgccatcaaattattctctg

SEQ ID NO: 328511 - DNA, 33 bp, Artificial Sequence
  Description of Artificial Sequence: Synthetic oligonucleotide
gcacccgaactgctgccatcaaattattctctg

SEQ ID NO: 328512 - DNA, 33 bp, Artificial Sequence
  Description of Artificial Sequence: Synthetic oligonucleotide
cacccgaactgctgccatcaaattattctctgc

SEQ ID NO: 328513 - DNA, 33 bp, Artificial Sequence
  Description of Artificial Sequence: Synthetic oligonucleotide
acccgaactgctgccatcaaattattctctgcg

SEQ ID NO: 328514 - DNA, 32 bp, Artificial Sequence
  Description of Artificial Sequence: Synthetic oligonucleotide
cccgaactgctgccatcaaattattctctgcg

SEQ ID NO: 328515 - DNA, 34 bp, Artificial Sequence
  Description of Artificial Sequence: Synthetic oligonucleotide
ccgaactgctgccatcaaattattctctgcgatc

SEQ ID NO: 328516 - DNA, 34 bp, Artificial Sequence
  Description of Artificial Sequence: Synthetic oligonucleotide
cgaactgctgccatcaaattattctctgcgatcc

SEQ ID NO: 328517 - DNA, 34 bp, Artificial Sequence
  Description of Artificial Sequence: Synthetic oligonucleotide
gaactgctgccatcaaattattctctgcgatccc

SEQ ID NO: 328518 - DNA, 34 bp, Artificial Sequence
  Description of Artificial Sequence: Synthetic oligonucleotide
aactgctgccatcaaattattctctgcgatcccg

SEQ ID NO: 328519 - DNA, 33 bp, Artificial Sequence
  Description of Artificial Sequence: Synthetic oligonucleotide
actgctgccatcaaattattctctgcgatcccg

SEQ ID NO: 328520 - DNA, 32 bp, Artificial Sequence
  Description of Artificial Sequence: Synthetic oligonucleotide
ctgctgccatcaaattattctctgcgatcccg

SEQ ID NO: 328521 - DNA, 32 bp, Artificial Sequence
  Description of Artificial Sequence: Synthetic oligonucleotide
tgctgccatcaaattattctctgcgatcccgg

SEQ ID NO: 328522 - DNA, 31 bp, Artificial Sequence
  Description of Artificial Sequence: Synthetic oligonucleotide
gctgccatcaaattattctctgcgatcccgg

SEQ ID NO: 328523 - DNA, 33 bp, Artificial Sequence
  Description of Artificial Sequence: Synthetic oligonucleotide
ctgccatcaaattattctctgcgatcccggatg

SEQ ID NO: 328524 - DNA, 33 bp, Artificial Sequence
  Description of Artificial Sequence: Synthetic oligonucleotide
tgccatcaaattattctctgcgatcccggatgc

SEQ ID NO: 328525 - DNA, 32 bp, Artificial Sequence
  Description of Artificial Sequence: Synthetic oligonucleotide
gccatcaaattattctctgcgatcccggatgc

SEQ ID NO: 328526 - DNA, 32 bp, Artificial Sequence
  Description of Artificial Sequence: Synthetic oligonucleotide
ccatcaaattattctctgcgatcccggatgcc

SEQ ID NO: 328527 - DNA, 32 bp, Artificial Sequence
  Description of Artificial Sequence: Synthetic oligonucleotide
catcaaattattctctgcgatcccggatgccc

SEQ ID NO: 328528 - DNA, 33 bp, Artificial Sequence
  Description of Artificial Sequence: Synthetic oligonucleotide
atcaaattattctctgcgatcccggatgccctg

SEQ ID NO: 328529 - DNA, 32 bp, Artificial Sequence
  Description of Artificial Sequence: Synthetic oligonucleotide
tcaaattattctctgcgatcccggatgccctg

SEQ ID NO: 328530 - DNA, 31 bp, Artificial Sequence
  Description of Artificial Sequence: Synthetic oligonucleotide
caaattattctctgcgatcccggatgccctg

SEQ ID NO: 328531 - DNA, 33 bp, Artificial Sequence
  Description of Artificial Sequence: Synthetic oligonucleotide
aaattattctctgcgatcccggatgccctgatc

SEQ ID NO: 328532 - DNA, 32 bp, Artificial Sequence
  Description of Artificial Sequence: Synthetic oligonucleotide
aattattctctgcgatcccggatgccctgatc

SEQ ID NO: 328533 - DNA, 31 bp, Artificial Sequence
  Description of Artificial Sequence: Synthetic oligonucleotide
attattctctgcgatcccggatgccctgatc

SEQ ID NO: 328534 - DNA, 30 bp, Artificial Sequence
  Description of Artificial Sequence: Synthetic oligonucleotide
ttattctctgcgatcccggatgccctgatc

SEQ ID NO: 328535 - DNA, 29 bp, Artificial Sequence
  Description of Artificial Sequence: Synthetic oligonucleotide
tattctctgcgatcccggatgccctgatc

SEQ ID NO: 328536 - DNA, 28 bp, Artificial Sequence
  Description of Artificial Sequence: Synthetic oligonucleotide
attctctgcgatcccggatgccctgatc

SEQ ID NO: 328537 - DNA, 27 bp, Artificial Sequence
  Description of Artificial Sequence: Synthetic oligonucleotide
ttctctgcgatcccggatgccctgatc

SEQ ID NO: 328538 - DNA, 27 bp, Artificial Sequence
  Description of Artificial Sequence: Synthetic oligonucleotide
tctctgcgatcccggatgccctgatca

SEQ ID NO: 328539 - DNA, 26 bp, Artificial Sequence
  Description of Artificial Sequence: Synthetic oligonucleotide
ctctgcgatcccggatgccctgatca

SEQ ID NO: 328540 - DNA, 27 bp, Artificial Sequence
  Description of Artificial Sequence: Synthetic oligonucleotide
tctgcgatcccggatgccctgatcact

SEQ ID NO: 328541 - DNA, 26 bp, Artificial Sequence
  Description of Artificial Sequence: Synthetic oligonucleotide
ctgcgatcccggatgccctgatcact

SEQ ID NO: 328542 - DNA, 26 bp, Artificial Sequence
  Description of Artificial Sequence: Synthetic oligonucleotide
tgcgatcccggatgccctgatcactc

SEQ ID NO: 328543 - DNA, 25 bp, Artificial Sequence
  Description of Artificial Sequence: Synthetic oligonucleotide
gcgatcccggatgccctgatcactc

SEQ ID NO: 328544 - DNA, 25 bp, Artificial Sequence
  Description of Artificial Sequence: Synthetic oligonucleotide
cgatcccggatgccctgatcactcg

SEQ ID NO: 328545 - DNA, 25 bp, Artificial Sequence
  Description of Artificial Sequence: Synthetic oligonucleotide
gatcccggatgccctgatcactcgc

SEQ ID NO: 328546 - DNA, 26 bp, Artificial Sequence
  Description of Artificial Sequence: Synthetic oligonucleotide
atcccggatgccctgatcactcgcgt

SEQ ID NO: 328547 - DNA, 25 bp, Artificial Sequence
  Description of Artificial Sequence: Synthetic oligonucleotide
tcccggatgccctgatcactcgcgt

SEQ ID NO: 328548 - DNA, 24 bp, Artificial Sequence
  Description of Artificial Sequence: Synthetic oligonucleotide
cccggatgccctgatcactcgcgt

SEQ ID NO: 328549 - DNA, 25 bp, Artificial Sequence
  Description of Artificial Sequence: Synthetic oligonucleotide
ccggatgccctgatcactcgcgtca

SEQ ID NO: 328550 - DNA, 27 bp, Artificial Sequence
  Description of Artificial Sequence: Synthetic oligonucleotide
cggatgccctgatcactcgcgtcagaa

SEQ ID NO: 328551 - DNA, 28 bp, Artificial Sequence
  Description of Artificial Sequence: Synthetic oligonucleotide
ggatgccctgatcactcgcgtcagaaac

SEQ ID NO: 328552 - DNA, 28 bp, Artificial Sequence
  Description of Artificial Sequence: Synthetic oligonucleotide
gatgccctgatcactcgcgtcagaaacc

SEQ ID NO: 328553 - DNA, 30 bp, Artificial Sequence
  Description of Artificial Sequence: Synthetic oligonucleotide
atgccctgatcactcgcgtcagaaaccatc

SEQ ID NO: 328554 - DNA, 29 bp, Artificial Sequence
  Description of Artificial Sequence: Synthetic oligonucleotide
tgccctgatcactcgcgtcagaaaccatc

SEQ ID NO: 328555 - DNA, 28 bp, Artificial Sequence
  Description of Artificial Sequence: Synthetic oligonucleotide
gccctgatcactcgcgtcagaaaccatc

SEQ ID NO: 328556 - DNA, 28 bp, Artificial Sequence
  Description of Artificial Sequence: Synthetic oligonucleotide
ccctgatcactcgcgtcagaaaccatcc

SEQ ID NO: 328557 - DNA, 28 bp, Artificial Sequence
  Description of Artificial Sequence: Synthetic oligonucleotide
cctgatcactcgcgtcagaaaccatccc

SEQ ID NO: 328558 - DNA, 29 bp, Artificial Sequence
  Description of Artificial Sequence: Synthetic oligonucleotide
ctgatcactcgcgtcagaaaccatccctg

SEQ ID NO: 328559 - DNA, 29 bp, Artificial Sequence
  Description of Artificial Sequence: Synthetic oligonucleotide
tgatcactcgcgtcagaaaccatccctgg

SEQ ID NO: 328560 - DNA, 28 bp, Artificial Sequence
  Description of Artificial Sequence: Synthetic oligonucleotide
gatcactcgcgtcagaaaccatccctgg

SEQ ID NO: 328561 - DNA, 30 bp, Artificial Sequence
  Description of Artificial Sequence: Synthetic oligonucleotide
atcactcgcgtcagaaaccatccctggatc

SEQ ID NO: 328562 - DNA, 29 bp, Artificial Sequence
  Description of Artificial Sequence: Synthetic oligonucleotide
tcactcgcgtcagaaaccatccctggatc

SEQ ID NO: 328563 - DNA, 28 bp, Artificial Sequence
  Description of Artificial Sequence: Synthetic oligonucleotide
cactcgcgtcagaaaccatccctggatc

SEQ ID NO: 328564 - DNA, 31 bp, Artificial Sequence
  Description of Artificial Sequence: Synthetic oligonucleotide
actcgcgtcagaaaccatccctggatcaatg

SEQ ID NO: 328565 - DNA, 30 bp, Artificial Sequence
  Description of Artificial Sequence: Synthetic oligonucleotide
ctcgcgtcagaaaccatccctggatcaatg

SEQ ID NO: 328566 - DNA, 31 bp, Artificial Sequence
  Description of Artificial Sequence: Synthetic oligonucleotide
tcgcgtcagaaaccatccctggatcaatgag

SEQ ID NO: 328567 - DNA, 30 bp, Artificial Sequence
  Description of Artificial Sequence: Synthetic oligonucleotide
cgcgtcagaaaccatccctggatcaatgag

SEQ ID NO: 328568 - DNA, 30 bp, Artificial Sequence
  Description of Artificial Sequence: Synthetic oligonucleotide
gcgtcagaaaccatccctggatcaatgagg

SEQ ID NO: 328569 - DNA, 31 bp, Artificial Sequence
  Description of Artificial Sequence: Synthetic oligonucleotide
cgtcagaaaccatccctggatcaatgaggag

SEQ ID NO: 328570 - DNA, 32 bp, Artificial Sequence
  Description of Artificial Sequence: Synthetic oligonucleotide
gtcagaaaccatccctggatcaatgaggagtc

SEQ ID NO: 328571 - DNA, 32 bp, Artificial Sequence
  Description of Artificial Sequence: Synthetic oligonucleotide
tcagaaaccatccctggatcaatgaggagtcc

SEQ ID NO: 328572 - DNA, 31 bp, Artificial Sequence
  Description of Artificial Sequence: Synthetic oligonucleotide
cagaaaccatccctggatcaatgaggagtcc

SEQ ID NO: 328573 - DNA, 31 bp, Artificial Sequence
  Description of Artificial Sequence: Synthetic oligonucleotide
agaaaccatccctggatcaatgaggagtccc

SEQ ID NO: 328574 - DNA, 30 bp, Artificial Sequence
  Description of Artificial Sequence: Synthetic oligonucleotide
gaaaccatccctggatcaatgaggagtccc

SEQ ID NO: 328575 - DNA, 31 bp, Artificial Sequence
  Description of Artificial Sequence: Synthetic oligonucleotide
aaaccatccctggatcaatgaggagtcccag

SEQ ID NO: 328576 - DNA, 30 bp, Artificial Sequence
  Description of Artificial Sequence: Synthetic oligonucleotide
aaccatccctggatcaatgaggagtcccag

SEQ ID NO: 328577 - DNA, 29 bp, Artificial Sequence
  Description of Artificial Sequence: Synthetic oligonucleotide
accatccctggatcaatgaggagtcccag

SEQ ID NO: 328578 - DNA, 28 bp, Artificial Sequence
  Description of Artificial Sequence: Synthetic oligonucleotide
ccatccctggatcaatgaggagtcccag

SEQ ID NO: 328579 - DNA, 30 bp, Artificial Sequence
  Description of Artificial Sequence: Synthetic oligonucleotide
catccctggatcaatgaggagtcccagaac

SEQ ID NO: 328580 - DNA, 32 bp, Artificial Sequence
  Description of Artificial Sequence: Synthetic oligonucleotide
atccctggatcaatgaggagtcccagaacaag

SEQ ID NO: 328581 - DNA, 31 bp, Artificial Sequence
  Description of Artificial Sequence: Synthetic oligonucleotide
tccctggatcaatgaggagtcccagaacaag

SEQ ID NO: 328582 - DNA, 30 bp, Artificial Sequence
  Description of Artificial Sequence: Synthetic oligonucleotide
ccctggatcaatgaggagtcccagaacaag

SEQ ID NO: 328583 - DNA, 30 bp, Artificial Sequence
  Description of Artificial Sequence: Synthetic oligonucleotide
cctggatcaatgaggagtcccagaacaagg

SEQ ID NO: 328584 - DNA, 30 bp, Artificial Sequence
  Description of Artificial Sequence: Synthetic oligonucleotide
ctggatcaatgaggagtcccagaacaaggc

SEQ ID NO: 328585 - DNA, 30 bp, Artificial Sequence
  Description of Artificial Sequence: Synthetic oligonucleotide
tggatcaatgaggagtcccagaacaaggcc

SEQ ID NO: 328586 - DNA, 29 bp, Artificial Sequence
  Description of Artificial Sequence: Synthetic oligonucleotide
ggatcaatgaggagtcccagaacaaggcc

SEQ ID NO: 328587 - DNA, 29 bp, Artificial Sequence
  Description of Artificial Sequence: Synthetic oligonucleotide
gatcaatgaggagtcccagaacaaggccc

SEQ ID NO: 328588 - DNA, 30 bp, Artificial Sequence
  Description of Artificial Sequence: Synthetic oligonucleotide
atcaatgaggagtcccagaacaaggcccag

SEQ ID NO: 328589 - DNA, 29 bp, Artificial Sequence
  Description of Artificial Sequence: Synthetic oligonucleotide
tcaatgaggagtcccagaacaaggcccag

SEQ ID NO: 328590 - DNA, 28 bp, Artificial Sequence
  Description of Artificial Sequence: Synthetic oligonucleotide
caatgaggagtcccagaacaaggcccag

SEQ ID NO: 328591 - DNA, 28 bp, Artificial Sequence
  Description of Artificial Sequence: Synthetic oligonucleotide
aatgaggagtcccagaacaaggcccagg

SEQ ID NO: 328592 - DNA, 27 bp, Artificial Sequence
  Description of Artificial Sequence: Synthetic oligonucleotide
atgaggagtcccagaacaaggcccagg

SEQ ID NO: 328593 - DNA, 27 bp, Artificial Sequence
  Description of Artificial Sequence: Synthetic oligonucleotide
tgaggagtcccagaacaaggcccagga

SEQ ID NO: 328594 - DNA, 26 bp, Artificial Sequence
  Description of Artificial Sequence: Synthetic oligonucleotide
gaggagtcccagaacaaggcccagga

SEQ ID NO: 328595 - DNA, 27 bp, Artificial Sequence
  Description of Artificial Sequence: Synthetic oligonucleotide
aggagtcccagaacaaggcccaggaga

SEQ ID NO: 328596 - DNA, 27 bp, Artificial Sequence
  Description of Artificial Sequence: Synthetic oligonucleotide
ggagtcccagaacaaggcccaggagaa

SEQ ID NO: 328597 - DNA, 27 bp, Artificial Sequence
  Description of Artificial Sequence: Synthetic oligonucleotide
gagtcccagaacaaggcccaggagaag

SEQ ID NO: 328598 - DNA, 27 bp, Artificial Sequence
  Description of Artificial Sequence: Synthetic oligonucleotide
agtcccagaacaaggcccaggagaagg

SEQ ID NO: 328599 - DNA, 27 bp, Artificial Sequence
  Description of Artificial Sequence: Synthetic oligonucleotide
gtcccagaacaaggcccaggagaaggt

SEQ ID NO: 328600 - DNA, 28 bp, Artificial Sequence
  Description of Artificial Sequence: Synthetic oligonucleotide
tcccagaacaaggcccaggagaaggttg

SEQ ID NO: 328601 - DNA, 27 bp, Artificial Sequence
  Description of Artificial Sequence: Synthetic oligonucleotide
cccagaacaaggcccaggagaaggttg

SEQ ID NO: 328602 - DNA, 27 bp, Artificial Sequence
  Description of Artificial Sequence: Synthetic oligonucleotide
ccagaacaaggcccaggagaaggttgc

SEQ ID NO: 328603 - DNA, 28 bp, Artificial Sequence
  Description of Artificial Sequence: Synthetic oligonucleotide
cagaacaaggcccaggagaaggttgctg

SEQ ID NO: 328604 - DNA, 30 bp, Artificial Sequence
  Description of Artificial Sequence: Synthetic oligonucleotide
agaacaaggcccaggagaaggttgctgaac

SEQ ID NO: 328605 - DNA, 29 bp, Artificial Sequence
  Description of Artificial Sequence: Synthetic oligonucleotide
gaacaaggcccaggagaaggttgctgaac

SEQ ID NO: 328606 - DNA, 30 bp, Artificial Sequence
  Description of Artificial Sequence: Synthetic oligonucleotide
aacaaggcccaggagaaggttgctgaactg

SEQ ID NO: 328607 - DNA, 29 bp, Artificial Sequence
  Description of Artificial Sequence: Synthetic oligonucleotide
acaaggcccaggagaaggttgctgaactg

SEQ ID NO: 328608 - DNA, 28 bp, Artificial Sequence
  Description of Artificial Sequence: Synthetic oligonucleotide
caaggcccaggagaaggttgctgaactg

SEQ ID NO: 328609 - DNA, 28 bp, Artificial Sequence
  Description of Artificial Sequence: Synthetic oligonucleotide
aaggcccaggagaaggttgctgaactgc

SEQ ID NO: 328610 - DNA, 27 bp, Artificial Sequence
  Description of Artificial Sequence: Synthetic oligonucleotide
aggcccaggagaaggttgctgaactgc

SEQ ID NO: 328611 - DNA, 27 bp, Artificial Sequence
  Description of Artificial Sequence: Synthetic oligonucleotide
ggcccaggagaaggttgctgaactgca

SEQ ID NO: 328612 - DNA, 27 bp, Artificial Sequence
  Description of Artificial Sequence: Synthetic oligonucleotide
gcccaggagaaggttgctgaactgcag

SEQ ID NO: 328613 - DNA, 27 bp, Artificial Sequence
  Description of Artificial Sequence: Synthetic oligonucleotide
cccaggagaaggttgctgaactgcagg

SEQ ID NO: 328614 - DNA, 28 bp, Artificial Sequence
  Description of Artificial Sequence: Synthetic oligonucleotide
ccaggagaaggttgctgaactgcaggag

SEQ ID NO: 328615 - DNA, 28 bp, Artificial Sequence
  Description of Artificial Sequence: Synthetic oligonucleotide
caggagaaggttgctgaactgcaggagg

SEQ ID NO: 328616 - DNA, 29 bp, Artificial Sequence
  Description of Artificial Sequence: Synthetic oligonucleotide
aggagaaggttgctgaactgcaggaggag

SEQ ID NO: 328617 - DNA, 28 bp, Artificial Sequence
  Description of Artificial Sequence: Synthetic oligonucleotide
ggagaaggttgctgaactgcaggaggag

SEQ ID NO: 328618 - DNA, 30 bp, Artificial Sequence
  Description of Artificial Sequence: Synthetic oligonucleotide
gagaaggttgctgaactgcaggaggagatg

SEQ ID NO: 328619 - DNA, 30 bp, Artificial Sequence
  Description of Artificial Sequence: Synthetic oligonucleotide
agaaggttgctgaactgcaggaggagatgg

SEQ ID NO: 328620 - DNA, 29 bp, Artificial Sequence
  Description of Artificial Sequence: Synthetic oligonucleotide
gaaggttgctgaactgcaggaggagatgg

SEQ ID NO: 328621 - DNA, 29 bp, Artificial Sequence
  Description of Artificial Sequence: Synthetic oligonucleotide
aaggttgctgaactgcaggaggagatggg

SEQ ID NO: 328622 - DNA, 28 bp, Artificial Sequence
  Description of Artificial Sequence: Synthetic oligonucleotide
aggttgctgaactgcaggaggagatggg

SEQ ID NO: 328623 - DNA, 27 bp, Artificial Sequence
  Description of Artificial Sequence: Synthetic oligonucleotide
ggttgctgaactgcaggaggagatggg

SEQ ID NO: 328624 - DNA, 27 bp, Artificial Sequence
  Description of Artificial Sequence: Synthetic oligonucleotide
gttgctgaactgcaggaggagatgggc

SEQ ID NO: 328625 - DNA, 27 bp, Artificial Sequence
  Description of Artificial Sequence: Synthetic oligonucleotide
ttgctgaactgcaggaggagatgggcg

SEQ ID NO: 328626 - DNA, 26 bp, Artificial Sequence
  Description of Artificial Sequence: Synthetic oligonucleotide
tgctgaactgcaggaggagatgggcg

SEQ ID NO: 328627 - DNA, 25 bp, Artificial Sequence
  Description of Artificial Sequence: Synthetic oligonucleotide
gctgaactgcaggaggagatgggcg

SEQ ID NO: 328628 - DNA, 27 bp, Artificial Sequence
  Description of Artificial Sequence: Synthetic oligonucleotide
ctgaactgcaggaggagatgggcgctt

SEQ ID NO: 328629 - DNA, 27 bp, Artificial Sequence
  Description of Artificial Sequence: Synthetic oligonucleotide
tgaactgcaggaggagatgggcgcttc

SEQ ID NO: 328630 - DNA, 27 bp, Artificial Sequence
  Description of Artificial Sequence: Synthetic oligonucleotide
gaactgcaggaggagatgggcgcttca

SEQ ID NO: 328631 - DNA, 27 bp, Artificial Sequence
  Description of Artificial Sequence: Synthetic oligonucleotide
aactgcaggaggagatgggcgcttcag

SEQ ID NO: 328632 - DNA, 27 bp, Artificial Sequence
  Description of Artificial Sequence: Synthetic oligonucleotide
actgcaggaggagatgggcgcttcaga

SEQ ID NO: 328633 - DNA, 27 bp, Artificial Sequence
  Description of Artificial Sequence: Synthetic oligonucleotide
ctgcaggaggagatgggcgcttcagaa

SEQ ID NO: 328634 - DNA, 28 bp, Artificial Sequence
  Description of Artificial Sequence: Synthetic oligonucleotide
tgcaggaggagatgggcgcttcagaaag

SEQ ID NO: 328635 - DNA, 27 bp, Artificial Sequence
  Description of Artificial Sequence: Synthetic oligonucleotide
gcaggaggagatgggcgcttcagaaag

SEQ ID NO: 328636 - DNA, 27 bp, Artificial Sequence
  Description of Artificial Sequence: Synthetic oligonucleotide
caggaggagatgggcgcttcagaaagg

SEQ ID NO: 328637 - DNA, 27 bp, Artificial Sequence
  Description of Artificial Sequence: Synthetic oligonucleotide
aggaggagatgggcgcttcagaaaggg

SEQ ID NO: 328638 - DNA, 26 bp, Artificial Sequence
  Description of Artificial Sequence: Synthetic oligonucleotide
ggaggagatgggcgcttcagaaaggg

SEQ ID NO: 328639 - DNA, 26 bp, Artificial Sequence
  Description of Artificial Sequence: Synthetic oligonucleotide
gaggagatgggcgcttcagaaagggc

SEQ ID NO: 328640 - DNA, 26 bp, Artificial Sequence
  Description of Artificial Sequence: Synthetic oligonucleotide
aggagatgggcgcttcagaaagggcc

SEQ ID NO: 328641 - DNA, 25 bp, Artificial Sequence
  Description of Artificial Sequence: Synthetic oligonucleotide
ggagatgggcgcttcagaaagggcc

SEQ ID NO: 328642 - DNA, 26 bp, Artificial Sequence
  Description of Artificial Sequence: Synthetic oligonucleotide
gagatgggcgcttcagaaagggccct

SEQ ID NO: 328643 - DNA, 27 bp, Artificial Sequence
  Description of Artificial Sequence: Synthetic oligonucleotide
agatgggcgcttcagaaagggccctga

SEQ ID NO: 328644 - DNA, 27 bp, Artificial Sequence
  Description of Artificial Sequence: Synthetic oligonucleotide
gatgggcgcttcagaaagggccctgat

SEQ ID NO: 328645 - DNA, 27 bp, Artificial Sequence
  Description of Artificial Sequence: Synthetic oligonucleotide
atgggcgcttcagaaagggccctgatg

SEQ ID NO: 328646 - DNA, 26 bp, Artificial Sequence
  Description of Artificial Sequence: Synthetic oligonucleotide
tgggcgcttcagaaagggccctgatg

SEQ ID NO: 328647 - DNA, 25 bp, Artificial Sequence
  Description of Artificial Sequence: Synthetic oligonucleotide
gggcgcttcagaaagggccctgatg

SEQ ID NO: 328648 - DNA, 25 bp, Artificial Sequence
  Description of Artificial Sequence: Synthetic oligonucleotide
ggcgcttcagaaagggccctgatgc

SEQ ID NO: 328649 - DNA, 26 bp, Artificial Sequence
  Description of Artificial Sequence: Synthetic oligonucleotide
gcgcttcagaaagggccctgatgcca

SEQ ID NO: 328650 - DNA, 27 bp, Artificial Sequence
  Description of Artificial Sequence: Synthetic oligonucleotide
cgcttcagaaagggccctgatgccaga

SEQ ID NO: 328651 - DNA, 27 bp, Artificial Sequence
  Description of Artificial Sequence: Synthetic oligonucleotide
gcttcagaaagggccctgatgccagag

SEQ ID NO: 328652 - DNA, 27 bp, Artificial Sequence
  Description of Artificial Sequence: Synthetic oligonucleotide
cttcagaaagggccctgatgccagagc

SEQ ID NO: 328653 - DNA, 28 bp, Artificial Sequence
  Description of Artificial Sequence: Synthetic oligonucleotide
ttcagaaagggccctgatgccagagctc

SEQ ID NO: 328654 - DNA, 27 bp, Artificial Sequence
  Description of Artificial Sequence: Synthetic oligonucleotide
tcagaaagggccctgatgccagagctc

SEQ ID NO: 328655 - DNA, 26 bp, Artificial Sequence
  Description of Artificial Sequence: Synthetic oligonucleotide
cagaaagggccctgatgccagagctc

SEQ ID NO: 328656 - DNA, 26 bp, Artificial Sequence
  Description of Artificial Sequence: Synthetic oligonucleotide
agaaagggccctgatgccagagctcg

SEQ ID NO: 328657 - DNA, 25 bp, Artificial Sequence
  Description of Artificial Sequence: Synthetic oligonucleotide
gaaagggccctgatgccagagctcg

SEQ ID NO: 328658 - DNA, 25 bp, Artificial Sequence
  Description of Artificial Sequence: Synthetic oligonucleotide
aaagggccctgatgccagagctcgc

SEQ ID NO: 328659 - DNA, 24 bp, Artificial Sequence
  Description of Artificial Sequence: Synthetic oligonucleotide
aagggccctgatgccagagctcgc

SEQ ID NO: 328660 - DNA, 23 bp, Artificial Sequence
  Description of Artificial Sequence: Synthetic oligonucleotide
agggccctgatgccagagctcgc

SEQ ID NO: 328661 - DNA, 22 bp, Artificial Sequence
  Description of Artificial Sequence: Synthetic oligonucleotide
gggccctgatgccagagctcgc

SEQ ID NO: 328662 - DNA, 22 bp, Artificial Sequence
  Description of Artificial Sequence: Synthetic oligonucleotide
ggccctgatgccagagctcgcc

SEQ ID NO: 328663 - DNA, 22 bp, Artificial Sequence
  Description of Artificial Sequence: Synthetic oligonucleotide
gccctgatgccagagctcgccc

SEQ ID NO: 328664 - DNA, 23 bp, Artificial Sequence
  Description of Artificial Sequence: Synthetic oligonucleotide
ccctgatgccagagctcgcccga

SEQ ID NO: 328665 - DNA, 25 bp, Artificial Sequence
  Description of Artificial Sequence: Synthetic oligonucleotide
cctgatgccagagctcgcccgacaa

SEQ ID NO: 328666 - DNA, 27 bp, Artificial Sequence
  Description of Artificial Sequence: Synthetic oligonucleotide
ctgatgccagagctcgcccgacaacaa

SEQ ID NO: 328667 - DNA, 29 bp, Artificial Sequence
  Description of Artificial Sequence: Synthetic oligonucleotide
tgatgccagagctcgcccgacaacaatac

SEQ ID NO: 328668 - DNA, 28 bp, Artificial Sequence
  Description of Artificial Sequence: Synthetic oligonucleotide
gatgccagagctcgcccgacaacaatac

SEQ ID NO: 328669 - DNA, 30 bp, Artificial Sequence
  Description of Artificial Sequence: Synthetic oligonucleotide
atgccagagctcgcccgacaacaatacaac

SEQ ID NO: 328670 - DNA, 29 bp, Artificial Sequence
  Description of Artificial Sequence: Synthetic oligonucleotide
tgccagagctcgcccgacaacaatacaac

SEQ ID NO: 328671 - DNA, 28 bp, Artificial Sequence
  Description of Artificial Sequence: Synthetic oligonucleotide
gccagagctcgcccgacaacaatacaac

SEQ ID NO: 328672 - DNA, 28 bp, Artificial Sequence
  Description of Artificial Sequence: Synthetic oligonucleotide
ccagagctcgcccgacaacaatacaacg

SEQ ID NO: 328673 - DNA, 33 bp, Artificial Sequence
  Description of Artificial Sequence: Synthetic oligonucleotide
cagagctcgcccgacaacaatacaacgttatac

SEQ ID NO: 328674 - DNA, 34 bp, Artificial Sequence
  Description of Artificial Sequence: Synthetic oligonucleotide
agagctcgcccgacaacaatacaacgttatacag

SEQ ID NO: 328675 - DNA, 33 bp, Artificial Sequence
  Description of Artificial Sequence: Synthetic oligonucleotide
gagctcgcccgacaacaatacaacgttatacag

SEQ ID NO: 328676 - DNA, 33 bp, Artificial Sequence
  Description of Artificial Sequence: Synthetic oligonucleotide
agctcgcccgacaacaatacaacgttatacagc

SEQ ID NO: 328677 - DNA, 32 bp, Artificial Sequence
  Description of Artificial Sequence: Synthetic oligonucleotide
gctcgcccgacaacaatacaacgttatacagc

SEQ ID NO: 328678 - DNA, 34 bp, Artificial Sequence
  Description of Artificial Sequence: Synthetic oligonucleotide
ctcgcccgacaacaatacaacgttatacagctag

SEQ ID NO: 328679 - DNA, 34 bp, Artificial Sequence
  Description of Artificial Sequence: Synthetic oligonucleotide
tcgcccgacaacaatacaacgttatacagctagg

SEQ ID NO: 328680 - DNA, 33 bp, Artificial Sequence
  Description of Artificial Sequence: Synthetic oligonucleotide
cgcccgacaacaatacaacgttatacagctagg

SEQ ID NO: 328681 - DNA, 35 bp, Artificial Sequence
  Description of Artificial Sequence: Synthetic oligonucleotide
gcccgacaacaatacaacgttatacagctaggatc

SEQ ID NO: 328682 - DNA, 35 bp, Artificial Sequence
  Description of Artificial Sequence: Synthetic oligonucleotide
cccgacaacaatacaacgttatacagctaggatcg

SEQ ID NO: 328683 - DNA, 36 bp, Artificial Sequence
  Description of Artificial Sequence: Synthetic oligonucleotide
ccgacaacaatacaacgttatacagctaggatcgag

SEQ ID NO: 328684 - DNA, 36 bp, Artificial Sequence
  Description of Artificial Sequence: Synthetic oligonucleotide
cgacaacaatacaacgttatacagctaggatcgagc

SEQ ID NO: 328685 - DNA, 38 bp, Artificial Sequence
  Description of Artificial Sequence: Synthetic oligonucleotide
gacaacaatacaacgttatacagctaggatcgagcatc

SEQ ID NO: 328686 - DNA, 38 bp, Artificial Sequence
  Description of Artificial Sequence: Synthetic oligonucleotide
acaacaatacaacgttatacagctaggatcgagcatcc

SEQ ID NO: 328687 - DNA, 37 bp, Artificial Sequence
  Description of Artificial Sequence: Synthetic oligonucleotide
caacaatacaacgttatacagctaggatcgagcatcc

SEQ ID NO: 328688 - DNA, 38 bp, Artificial Sequence
  Description of Artificial Sequence: Synthetic oligonucleotide
aacaatacaacgttatacagctaggatcgagcatcctg

SEQ ID NO: 328689 - DNA, 37 bp, Artificial Sequence
  Description of Artificial Sequence: Synthetic oligonucleotide
acaatacaacgttatacagctaggatcgagcatcctg

SEQ ID NO: 328690 - DNA, 36 bp, Artificial Sequence
  Description of Artificial Sequence: Synthetic oligonucleotide
caatacaacgttatacagctaggatcgagcatcctg

SEQ ID NO: 328691 - DNA, 36 bp, Artificial Sequence
  Description of Artificial Sequence: Synthetic oligonucleotide
aatacaacgttatacagctaggatcgagcatcctgc

SEQ ID NO: 328692 - DNA, 35 bp, Artificial Sequence
  Description of Artificial Sequence: Synthetic oligonucleotide
atacaacgttatacagctaggatcgagcatcctgc

SEQ ID NO: 328693 - DNA, 34 bp, Artificial Sequence
  Description of Artificial Sequence: Synthetic oligonucleotide
tacaacgttatacagctaggatcgagcatcctgc

SEQ ID NO: 328694 - DNA, 33 bp, Artificial Sequence
  Description of Artificial Sequence: Synthetic oligonucleotide
acaacgttatacagctaggatcgagcatcctgc

SEQ ID NO: 328695 - DNA, 32 bp, Artificial Sequence
  Description of Artificial Sequence: Synthetic oligonucleotide
caacgttatacagctaggatcgagcatcctgc

SEQ ID NO: 328696 - DNA, 33 bp, Artificial Sequence
  Description of Artificial Sequence: Synthetic oligonucleotide
aacgttatacagctaggatcgagcatcctgcag

SEQ ID NO: 328697 - DNA, 32 bp, Artificial Sequence
  Description of Artificial Sequence: Synthetic oligonucleotide
acgttatacagctaggatcgagcatcctgcag

SEQ ID NO: 328698 - DNA, 31 bp, Artificial Sequence
  Description of Artificial Sequence: Synthetic oligonucleotide
cgttatacagctaggatcgagcatcctgcag

SEQ ID NO: 328699 - DNA, 32 bp, Artificial Sequence
  Description of Artificial Sequence: Synthetic oligonucleotide
gttatacagctaggatcgagcatcctgcagtg

SEQ ID NO: 328700 - DNA, 33 bp, Artificial Sequence
  Description of Artificial Sequence: Synthetic oligonucleotide
ttatacagctaggatcgagcatcctgcagtgtg

SEQ ID NO: 328701 - DNA, 32 bp, Artificial Sequence
  Description of Artificial Sequence: Synthetic oligonucleotide
tatacagctaggatcgagcatcctgcagtgtg

SEQ ID NO: 328702 - DNA, 31 bp, Artificial Sequence
  Description of Artificial Sequence: Synthetic oligonucleotide
atacagctaggatcgagcatcctgcagtgtg

SEQ ID NO: 328703 - DNA, 30 bp, Artificial Sequence
  Description of Artificial Sequence: Synthetic oligonucleotide
tacagctaggatcgagcatcctgcagtgtg

SEQ ID NO: 328704 - DNA, 29 bp, Artificial Sequence
  Description of Artificial Sequence: Synthetic oligonucleotide
acagctaggatcgagcatcctgcagtgtg

SEQ ID NO: 328705 - DNA, 28 bp, Artificial Sequence
  Description of Artificial Sequence: Synthetic oligonucleotide
cagctaggatcgagcatcctgcagtgtg

SEQ ID NO: 328706 - DNA, 29 bp, Artificial Sequence
  Description of Artificial Sequence: Synthetic oligonucleotide
agctaggatcgagcatcctgcagtgtgtc

SEQ ID NO: 328707 - DNA, 28 bp, Artificial Sequence
  Description of Artificial Sequence: Synthetic oligonucleotide
gctaggatcgagcatcctgcagtgtgtc

SEQ ID NO: 328708 - DNA, 28 bp, Artificial Sequence
  Description of Artificial Sequence: Synthetic oligonucleotide
ctaggatcgagcatcctgcagtgtgtcc

SEQ ID NO: 328709 - DNA, 29 bp, Artificial Sequence
  Description of Artificial Sequence: Synthetic oligonucleotide
taggatcgagcatcctgcagtgtgtcctg

SEQ ID NO: 328710 - DNA, 28 bp, Artificial Sequence
  Description of Artificial Sequence: Synthetic oligonucleotide
aggatcgagcatcctgcagtgtgtcctg

SEQ ID NO: 328711 - DNA, 27 bp, Artificial Sequence
  Description of Artificial Sequence: Synthetic oligonucleotide
ggatcgagcatcctgcagtgtgtcctg

SEQ ID NO: 328712 - DNA, 28 bp, Artificial Sequence
  Description of Artificial Sequence: Synthetic oligonucleotide
gatcgagcatcctgcagtgtgtcctgag

SEQ ID NO: 328713 - DNA, 28 bp, Artificial Sequence
  Description of Artificial Sequence: Synthetic oligonucleotide
atcgagcatcctgcagtgtgtcctgagg

SEQ ID NO: 328714 - DNA, 27 bp, Artificial Sequence
  Description of Artificial Sequence: Synthetic oligonucleotide
tcgagcatcctgcagtgtgtcctgagg

SEQ ID NO: 328715 - DNA, 27 bp, Artificial Sequence
  Description of Artificial Sequence: Synthetic oligonucleotide
cgagcatcctgcagtgtgtcctgaggt

SEQ ID NO: 328716 - DNA, 27 bp, Artificial Sequence
  Description of Artificial Sequence: Synthetic oligonucleotide
gagcatcctgcagtgtgtcctgaggtg

SEQ ID NO: 328717 - DNA, 28 bp, Artificial Sequence
  Description of Artificial Sequence: Synthetic oligonucleotide
agcatcctgcagtgtgtcctgaggtgtg

SEQ ID NO: 328718 - DNA, 27 bp, Artificial Sequence
  Description of Artificial Sequence: Synthetic oligonucleotide
gcatcctgcagtgtgtcctgaggtgtg

SEQ ID NO: 328719 - DNA, 28 bp, Artificial Sequence
  Description of Artificial Sequence: Synthetic oligonucleotide
catcctgcagtgtgtcctgaggtgtgtc

SEQ ID NO: 328720 - DNA, 28 bp, Artificial Sequence
  Description of Artificial Sequence: Synthetic oligonucleotide
atcctgcagtgtgtcctgaggtgtgtcc

SEQ ID NO: 328721 - DNA, 27 bp, Artificial Sequence
  Description of Artificial Sequence: Synthetic oligonucleotide
tcctgcagtgtgtcctgaggtgtgtcc

SEQ ID NO: 328722 - DNA, 26 bp, Artificial Sequence
  Description of Artificial Sequence: Synthetic oligonucleotide
cctgcagtgtgtcctgaggtgtgtcc

SEQ ID NO: 328723 - DNA, 26 bp, Artificial Sequence
  Description of Artificial Sequence: Synthetic oligonucleotide
ctgcagtgtgtcctgaggtgtgtccg

SEQ ID NO: 328724 - DNA, 27 bp, Artificial Sequence
  Description of Artificial Sequence: Synthetic oligonucleotide
tgcagtgtgtcctgaggtgtgtccgga

SEQ ID NO: 328725 - DNA, 26 bp, Artificial Sequence
  Description of Artificial Sequence: Synthetic oligonucleotide
gcagtgtgtcctgaggtgtgtccgga

SEQ ID NO: 328726 - DNA, 26 bp, Artificial Sequence
  Description of Artificial Sequence: Synthetic oligonucleotide
cagtgtgtcctgaggtgtgtccggac

SEQ ID NO: 328727 - DNA, 26 bp, Artificial Sequence
  Description of Artificial Sequence: Synthetic oligonucleotide
agtgtgtcctgaggtgtgtccggacc

SEQ ID NO: 328728 - DNA, 25 bp, Artificial Sequence
  Description of Artificial Sequence: Synthetic oligonucleotide
gtgtgtcctgaggtgtgtccggacc

SEQ ID NO: 328729 - DNA, 26 bp, Artificial Sequence
  Description of Artificial Sequence: Synthetic oligonucleotide
tgtgtcctgaggtgtgtccggaccct

SEQ ID NO: 328730 - DNA, 25 bp, Artificial Sequence
  Description of Artificial Sequence: Synthetic oligonucleotide
gtgtcctgaggtgtgtccggaccct

SEQ ID NO: 328731 - DNA, 25 bp, Artificial Sequence
  Description of Artificial Sequence: Synthetic oligonucleotide
tgtcctgaggtgtgtccggaccctc

SEQ ID NO: 328732 - DNA, 24 bp, Artificial Sequence
  Description of Artificial Sequence: Synthetic oligonucleotide
gtcctgaggtgtgtccggaccctc

SEQ ID NO: 328733 - DNA, 24 bp, Artificial Sequence
  Description of Artificial Sequence: Synthetic oligonucleotide
tcctgaggtgtgtccggaccctcc

SEQ ID NO: 328734 - DNA, 23 bp, Artificial Sequence
  Description of Artificial Sequence: Synthetic oligonucleotide
cctgaggtgtgtccggaccctcc

SEQ ID NO: 328735 - DNA, 24 bp, Artificial Sequence
  Description of Artificial Sequence: Synthetic oligonucleotide
ctgaggtgtgtccggaccctccga

SEQ ID NO: 328736 - DNA, 24 bp, Artificial Sequence
  Description of Artificial Sequence: Synthetic oligonucleotide
tgaggtgtgtccggaccctccgag

SEQ ID NO: 328737 - DNA, 23 bp, Artificial Sequence
  Description of Artificial Sequence: Synthetic oligonucleotide
gaggtgtgtccggaccctccgag

SEQ ID NO: 328738 - DNA, 25 bp, Artificial Sequence
  Description of Artificial Sequence: Synthetic oligonucleotide
aggtgtgtccggaccctccgaggta

SEQ ID NO: 328739 - DNA, 24 bp, Artificial Sequence
  Description of Artificial Sequence: Synthetic oligonucleotide
ggtgtgtccggaccctccgaggta

SEQ ID NO: 328740 - DNA, 27 bp, Artificial Sequence
  Description of Artificial Sequence: Synthetic oligonucleotide
gtgtgtccggaccctccgaggtagaat

SEQ ID NO: 328741 - DNA, 28 bp, Artificial Sequence
  Description of Artificial Sequence: Synthetic oligonucleotide
tgtgtccggaccctccgaggtagaattg

SEQ ID NO: 328742 - DNA, 27 bp, Artificial Sequence
  Description of Artificial Sequence: Synthetic oligonucleotide
gtgtccggaccctccgaggtagaattg

SEQ ID NO: 328743 - DNA, 28 bp, Artificial Sequence
  Description of Artificial Sequence: Synthetic oligonucleotide
tgtccggaccctccgaggtagaattgtg

SEQ ID NO: 328744 - DNA, 27 bp, Artificial Sequence
  Description of Artificial Sequence: Synthetic oligonucleotide
gtccggaccctccgaggtagaattgtg

SEQ ID NO: 328745 - DNA, 27 bp, Artificial Sequence
  Description of Artificial Sequence: Synthetic oligonucleotide
tccggaccctccgaggtagaattgtgc

SEQ ID NO: 328746 - DNA, 27 bp, Artificial Sequence
  Description of Artificial Sequence: Synthetic oligonucleotide
ccggaccctccgaggtagaattgtgca

SEQ ID NO: 328747 - DNA, 27 bp, Artificial Sequence
  Description of Artificial Sequence: Synthetic oligonucleotide
cggaccctccgaggtagaattgtgcag

SEQ ID NO: 328748 - DNA, 28 bp, Artificial Sequence
  Description of Artificial Sequence: Synthetic oligonucleotide
ggaccctccgaggtagaattgtgcagag

SEQ ID NO: 328749 - DNA, 28 bp, Artificial Sequence
  Description of Artificial Sequence: Synthetic oligonucleotide
gaccctccgaggtagaattgtgcagagc

SEQ ID NO: 328750 - DNA, 30 bp, Artificial Sequence
  Description of Artificial Sequence: Synthetic oligonucleotide
accctccgaggtagaattgtgcagagcttc

SEQ ID NO: 328751 - DNA, 29 bp, Artificial Sequence
  Description of Artificial Sequence: Synthetic oligonucleotide
ccctccgaggtagaattgtgcagagcttc

SEQ ID NO: 328752 - DNA, 31 bp, Artificial Sequence
  Description of Artificial Sequence: Synthetic oligonucleotide
cctccgaggtagaattgtgcagagcttcatg

SEQ ID NO: 328753 - DNA, 31 bp, Artificial Sequence
  Description of Artificial Sequence: Synthetic oligonucleotide
ctccgaggtagaattgtgcagagcttcatgc

SEQ ID NO: 328754 - DNA, 32 bp, Artificial Sequence
  Description of Artificial Sequence: Synthetic oligonucleotide
tccgaggtagaattgtgcagagcttcatgcag

SEQ ID NO: 328755 - DNA, 31 bp, Artificial Sequence
  Description of Artificial Sequence: Synthetic oligonucleotide
ccgaggtagaattgtgcagagcttcatgcag

SEQ ID NO: 328756 - DNA, 31 bp, Artificial Sequence
  Description of Artificial Sequence: Synthetic oligonucleotide
cgaggtagaattgtgcagagcttcatgcagc

SEQ ID NO: 328757 - DNA, 31 bp, Artificial Sequence
  Description of Artificial Sequence: Synthetic oligonucleotide
gaggtagaattgtgcagagcttcatgcagcc

SEQ ID NO: 328758 - DNA, 32 bp, Artificial Sequence
  Description of Artificial Sequence: Synthetic oligonucleotide
aggtagaattgtgcagagcttcatgcagcctc

SEQ ID NO: 328759 - DNA, 31 bp, Artificial Sequence
  Description of Artificial Sequence: Synthetic oligonucleotide
ggtagaattgtgcagagcttcatgcagcctc

SEQ ID NO: 328760 - DNA, 32 bp, Artificial Sequence
  Description of Artificial Sequence: Synthetic oligonucleotide
gtagaattgtgcagagcttcatgcagcctctc

SEQ ID NO: 328761 - DNA, 32 bp, Artificial Sequence
  Description of Artificial Sequence: Synthetic oligonucleotide
tagaattgtgcagagcttcatgcagcctctcc

SEQ ID NO: 328762 - DNA, 31 bp, Artificial Sequence
  Description of Artificial Sequence: Synthetic oligonucleotide
agaattgtgcagagcttcatgcagcctctcc

SEQ ID NO: 328763 - DNA, 30 bp, Artificial Sequence
  Description of Artificial Sequence: Synthetic oligonucleotide
gaattgtgcagagcttcatgcagcctctcc

SEQ ID NO: 328764 - DNA, 30 bp, Artificial Sequence
  Description of Artificial Sequence: Synthetic oligonucleotide
aattgtgcagagcttcatgcagcctctccc

SEQ ID NO: 328765 - DNA, 29 bp, Artificial Sequence
  Description of Artificial Sequence: Synthetic oligonucleotide
attgtgcagagcttcatgcagcctctccc

SEQ ID NO: 328766 - DNA, 28 bp, Artificial Sequence
  Description of Artificial Sequence: Synthetic oligonucleotide
ttgtgcagagcttcatgcagcctctccc

SEQ ID NO: 328767 - DNA, 27 bp, Artificial Sequence
  Description of Artificial Sequence: Synthetic oligonucleotide
tgtgcagagcttcatgcagcctctccc

SEQ ID NO: 328768 - DNA, 26 bp, Artificial Sequence
  Description of Artificial Sequence: Synthetic oligonucleotide
gtgcagagcttcatgcagcctctccc

SEQ ID NO: 328769 - DNA, 26 bp, Artificial Sequence
  Description of Artificial Sequence: Synthetic oligonucleotide
tgcagagcttcatgcagcctctcccc

SEQ ID NO: 328770 - DNA, 25 bp, Artificial Sequence
  Description of Artificial Sequence: Synthetic oligonucleotide
gcagagcttcatgcagcctctcccc

SEQ ID NO: 328771 - DNA, 27 bp, Artificial Sequence
  Description of Artificial Sequence: Synthetic oligonucleotide
cagagcttcatgcagcctctcccccaa

SEQ ID NO: 328772 - DNA, 27 bp, Artificial Sequence
  Description of Artificial Sequence: Synthetic oligonucleotide
agagcttcatgcagcctctcccccaac

SEQ ID NO: 328773 - DNA, 27 bp, Artificial Sequence
  Description of Artificial Sequence: Synthetic oligonucleotide
gagcttcatgcagcctctcccccaaca

SEQ ID NO: 328774 - DNA, 27 bp, Artificial Sequence
  Description of Artificial Sequence: Synthetic oligonucleotide
agcttcatgcagcctctcccccaacag

SEQ ID NO: 328775 - DNA, 27 bp, Artificial Sequence
  Description of Artificial Sequence: Synthetic oligonucleotide
gcttcatgcagcctctcccccaacaga

SEQ ID NO: 328776 - DNA, 27 bp, Artificial Sequence
  Description of Artificial Sequence: Synthetic oligonucleotide
cttcatgcagcctctcccccaacagag

SEQ ID NO: 328777 - DNA, 27 bp, Artificial Sequence
  Description of Artificial Sequence: Synthetic oligonucleotide
ttcatgcagcctctcccccaacagagg

SEQ ID NO: 328778 - DNA, 27 bp, Artificial Sequence
  Description of Artificial Sequence: Synthetic oligonucleotide
tcatgcagcctctcccccaacagaggt

SEQ ID NO: 328779 - DNA, 26 bp, Artificial Sequence
  Description of Artificial Sequence: Synthetic oligonucleotide
catgcagcctctcccccaacagaggt

SEQ ID NO: 328780 - DNA, 26 bp, Artificial Sequence
  Description of Artificial Sequence: Synthetic oligonucleotide
atgcagcctctcccccaacagaggtg

SEQ ID NO: 328781 - DNA, 25 bp, Artificial Sequence
  Description of Artificial Sequence: Synthetic oligonucleotide
tgcagcctctcccccaacagaggtg

SEQ ID NO: 328782 - DNA, 24 bp, Artificial Sequence
  Description of Artificial Sequence: Synthetic oligonucleotide
gcagcctctcccccaacagaggtg

SEQ ID NO: 328783 - DNA, 26 bp, Artificial Sequence
  Description of Artificial Sequence: Synthetic oligonucleotide
cagcctctcccccaacagaggtggaa

SEQ ID NO: 328784 - DNA, 26 bp, Artificial Sequence
  Description of Artificial Sequence: Synthetic oligonucleotide
agcctctcccccaacagaggtggaag

SEQ ID NO: 328785 - DNA, 25 bp, Artificial Sequence
  Description of Artificial Sequence: Synthetic oligonucleotide
gcctctcccccaacagaggtggaag

SEQ ID NO: 328786 - DNA, 26 bp, Artificial Sequence
  Description of Artificial Sequence: Synthetic oligonucleotide
cctctcccccaacagaggtggaagct

SEQ ID NO: 328787 - DNA, 27 bp, Artificial Sequence
  Description of Artificial Sequence: Synthetic oligonucleotide
ctctcccccaacagaggtggaagctgt

SEQ ID NO: 328788 - DNA, 27 bp, Artificial Sequence
  Description of Artificial Sequence: Synthetic oligonucleotide
tctcccccaacagaggtggaagctgtc

SEQ ID NO: 328789 - DNA, 26 bp, Artificial Sequence
  Description of Artificial Sequence: Synthetic oligonucleotide
ctcccccaacagaggtggaagctgtc

SEQ ID NO: 328790 - DNA, 26 bp, Artificial Sequence
  Description of Artificial Sequence: Synthetic oligonucleotide
tcccccaacagaggtggaagctgtcc

SEQ ID NO: 328791 - DNA, 25 bp, Artificial Sequence
  Description of Artificial Sequence: Synthetic oligonucleotide
cccccaacagaggtggaagctgtcc

SEQ ID NO: 328792 - DNA, 25 bp, Artificial Sequence
  Description of Artificial Sequence: Synthetic oligonucleotide
ccccaacagaggtggaagctgtccc

SEQ ID NO: 328793 - DNA, 27 bp, Artificial Sequence
  Description of Artificial Sequence: Synthetic oligonucleotide
cccaacagaggtggaagctgtcccctt

SEQ ID NO: 328794 - DNA, 27 bp, Artificial Sequence
  Description of Artificial Sequence: Synthetic oligonucleotide
ccaacagaggtggaagctgtccccttc

SEQ ID NO: 328795 - DNA, 27 bp, Artificial Sequence
  Description of Artificial Sequence: Synthetic oligonucleotide
caacagaggtggaagctgtccccttcg

SEQ ID NO: 328796 - DNA, 27 bp, Artificial Sequence
  Description of Artificial Sequence: Synthetic oligonucleotide
aacagaggtggaagctgtccccttcgg

SEQ ID NO: 328797 - DNA, 27 bp, Artificial Sequence
  Description of Artificial Sequence: Synthetic oligonucleotide
acagaggtggaagctgtccccttcgga

SEQ ID NO: 328798 - DNA, 26 bp, Artificial Sequence
  Description of Artificial Sequence: Synthetic oligonucleotide
cagaggtggaagctgtccccttcgga

SEQ ID NO: 328799 - DNA, 26 bp, Artificial Sequence
  Description of Artificial Sequence: Synthetic oligonucleotide
agaggtggaagctgtccccttcggac

SEQ ID NO: 328800 - DNA, 25 bp, Artificial Sequence
  Description of Artificial Sequence: Synthetic oligonucleotide
gaggtggaagctgtccccttcggac

SEQ ID NO: 328801 - DNA, 26 bp, Artificial Sequence
  Description of Artificial Sequence: Synthetic oligonucleotide
aggtggaagctgtccccttcggacgt

SEQ ID NO: 328802 - DNA, 25 bp, Artificial Sequence
  Description of Artificial Sequence: Synthetic oligonucleotide
ggtggaagctgtccccttcggacgt

SEQ ID NO: 328803 - DNA, 27 bp, Artificial Sequence
  Description of Artificial Sequence: Synthetic oligonucleotide
gtggaagctgtccccttcggacgtcaa

SEQ ID NO: 328804 - DNA, 28 bp, Artificial Sequence
  Description of Artificial Sequence: Synthetic oligonucleotide
tggaagctgtccccttcggacgtcaaag

SEQ ID NO: 328805 - DNA, 27 bp, Artificial Sequence
  Description of Artificial Sequence: Synthetic oligonucleotide
ggaagctgtccccttcggacgtcaaag

SEQ ID NO: 328806 - DNA, 27 bp, Artificial Sequence
  Description of Artificial Sequence: Synthetic oligonucleotide
gaagctgtccccttcggacgtcaaagc

SEQ ID NO: 328807 - DNA, 30 bp, Artificial Sequence
  Description of Artificial Sequence: Synthetic oligonucleotide
aagctgtccccttcggacgtcaaagcttac

SEQ ID NO: 328808 - DNA, 29 bp, Artificial Sequence
  Description of Artificial Sequence: Synthetic oligonucleotide
agctgtccccttcggacgtcaaagcttac

SEQ ID NO: 328809 - DNA, 28 bp, Artificial Sequence
  Description of Artificial Sequence: Synthetic oligonucleotide
gctgtccccttcggacgtcaaagcttac

SEQ ID NO: 328810 - DNA, 32 bp, Artificial Sequence
  Description of Artificial Sequence: Synthetic oligonucleotide
ctgtccccttcggacgtcaaagcttactatac

SEQ ID NO: 328811 - DNA, 32 bp, Artificial Sequence
  Description of Artificial Sequence: Synthetic oligonucleotide
tgtccccttcggacgtcaaagcttactatacg

SEQ ID NO: 328812 - DNA, 31 bp, Artificial Sequence
  Description of Artificial Sequence: Synthetic oligonucleotide
gtccccttcggacgtcaaagcttactatacg

SEQ ID NO: 328813 - DNA, 31 bp, Artificial Sequence
  Description of Artificial Sequence: Synthetic oligonucleotide
tccccttcggacgtcaaagcttactatacgg

SEQ ID NO: 328814 - DNA, 30 bp, Artificial Sequence
  Description of Artificial Sequence: Synthetic oligonucleotide
ccccttcggacgtcaaagcttactatacgg

SEQ ID NO: 328815 - DNA, 33 bp, Artificial Sequence
  Description of Artificial Sequence: Synthetic oligonucleotide
cccttcggacgtcaaagcttactatacggtatc

SEQ ID NO: 328816 - DNA, 34 bp, Artificial Sequence
  Description of Artificial Sequence: Synthetic oligonucleotide
ccttcggacgtcaaagcttactatacggtatctg

SEQ ID NO: 328817 - DNA, 35 bp, Artificial Sequence
  Description of Artificial Sequence: Synthetic oligonucleotide
cttcggacgtcaaagcttactatacggtatctgtc

SEQ ID NO: 328818 - DNA, 35 bp, Artificial Sequence
  Description of Artificial Sequence: Synthetic oligonucleotide
ttcggacgtcaaagcttactatacggtatctgtcc

SEQ ID NO: 328819 - DNA, 34 bp, Artificial Sequence
  Description of Artificial Sequence: Synthetic oligonucleotide
tcggacgtcaaagcttactatacggtatctgtcc

SEQ ID NO: 328820 - DNA, 33 bp, Artificial Sequence
  Description of Artificial Sequence: Synthetic oligonucleotide
cggacgtcaaagcttactatacggtatctgtcc

SEQ ID NO: 328821 - DNA, 35 bp, Artificial Sequence
  Description of Artificial Sequence: Synthetic oligonucleotide
ggacgtcaaagcttactatacggtatctgtccatg

SEQ ID NO: 328822 - DNA, 36 bp, Artificial Sequence
  Description of Artificial Sequence: Synthetic oligonucleotide
gacgtcaaagcttactatacggtatctgtccatgtg

SEQ ID NO: 328823 - DNA, 36 bp, Artificial Sequence
  Description of Artificial Sequence: Synthetic oligonucleotide
acgtcaaagcttactatacggtatctgtccatgtgg

SEQ ID NO: 328824 - DNA, 35 bp, Artificial Sequence
  Description of Artificial Sequence: Synthetic oligonucleotide
cgtcaaagcttactatacggtatctgtccatgtgg

SEQ ID NO: 328825 - DNA, 37 bp, Artificial Sequence
  Description of Artificial Sequence: Synthetic oligonucleotide
gtcaaagcttactatacggtatctgtccatgtggttg

SEQ ID NO: 328826 - DNA, 38 bp, Artificial Sequence
  Description of Artificial Sequence: Synthetic oligonucleotide
tcaaagcttactatacggtatctgtccatgtggttgtc

SEQ ID NO: 328827 - DNA, 37 bp, Artificial Sequence
  Description of Artificial Sequence: Synthetic oligonucleotide
caaagcttactatacggtatctgtccatgtggttgtc

SEQ ID NO: 328828 - DNA, 40 bp, Artificial Sequence
  Description of Artificial Sequence: Synthetic oligonucleotide
aaagcttactatacggtatctgtccatgtggttgtctttc

SEQ ID NO: 328829 - DNA, 39 bp, Artificial Sequence
  Description of Artificial Sequence: Synthetic oligonucleotide
aagcttactatacggtatctgtccatgtggttgtctttc

SEQ ID NO: 328830 - DNA, 38 bp, Artificial Sequence
  Description of Artificial Sequence: Synthetic oligonucleotide
agcttactatacggtatctgtccatgtggttgtctttc

SEQ ID NO: 328831 - DNA, 37 bp, Artificial Sequence
  Description of Artificial Sequence: Synthetic oligonucleotide
gcttactatacggtatctgtccatgtggttgtctttc

SEQ ID NO: 328832 - DNA, 37 bp, Artificial Sequence
  Description of Artificial Sequence: Synthetic oligonucleotide
cttactatacggtatctgtccatgtggttgtctttcc

SEQ ID NO: 328833 - DNA, 38 bp, Artificial Sequence
  Description of Artificial Sequence: Synthetic oligonucleotide
ttactatacggtatctgtccatgtggttgtctttccac

SEQ ID NO: 328834 - DNA, 37 bp, Artificial Sequence
  Description of Artificial Sequence: Synthetic oligonucleotide
tactatacggtatctgtccatgtggttgtctttccac

SEQ ID NO: 328835 - DNA, 36 bp, Artificial Sequence
  Description of Artificial Sequence: Synthetic oligonucleotide
actatacggtatctgtccatgtggttgtctttccac

SEQ ID NO: 328836 - DNA, 35 bp, Artificial Sequence
  Description of Artificial Sequence: Synthetic oligonucleotide
ctatacggtatctgtccatgtggttgtctttccac

SEQ ID NO: 328837 - DNA, 35 bp, Artificial Sequence
  Description of Artificial Sequence: Synthetic oligonucleotide
tatacggtatctgtccatgtggttgtctttccacc

SEQ ID NO: 328838 - DNA, 34 bp, Artificial Sequence
  Description of Artificial Sequence: Synthetic oligonucleotide
atacggtatctgtccatgtggttgtctttccacc

SEQ ID NO: 328839 - DNA, 33 bp, Artificial Sequence
  Description of Artificial Sequence: Synthetic oligonucleotide
tacggtatctgtccatgtggttgtctttccacc

SEQ ID NO: 328840 - DNA, 32 bp, Artificial Sequence
  Description of Artificial Sequence: Synthetic oligonucleotide
acggtatctgtccatgtggttgtctttccacc

SEQ ID NO: 328841 - DNA, 31 bp, Artificial Sequence
  Description of Artificial Sequence: Synthetic oligonucleotide
cggtatctgtccatgtggttgtctttccacc

SEQ ID NO: 328842 - DNA, 32 bp, Artificial Sequence
  Description of Artificial Sequence: Synthetic oligonucleotide
ggtatctgtccatgtggttgtctttccacctg

SEQ ID NO: 328843 - DNA, 32 bp, Artificial Sequence
  Description of Artificial Sequence: Synthetic oligonucleotide
gtatctgtccatgtggttgtctttccacctgg

SEQ ID NO: 328844 - DNA, 33 bp, Artificial Sequence
  Description of Artificial Sequence: Synthetic oligonucleotide
tatctgtccatgtggttgtctttccacctggac

SEQ ID NO: 328845 - DNA, 32 bp, Artificial Sequence
  Description of Artificial Sequence: Synthetic oligonucleotide
atctgtccatgtggttgtctttccacctggac

SEQ ID NO: 328846 - DNA, 31 bp, Artificial Sequence
  Description of Artificial Sequence: Synthetic oligonucleotide
tctgtccatgtggttgtctttccacctggac

SEQ ID NO: 328847 - DNA, 30 bp, Artificial Sequence
  Description of Artificial Sequence: Synthetic oligonucleotide
ctgtccatgtggttgtctttccacctggac

SEQ ID NO: 328848 - DNA, 31 bp, Artificial Sequence
  Description of Artificial Sequence: Synthetic oligonucleotide
tgtccatgtggttgtctttccacctggactc

SEQ ID NO: 328849 - DNA, 30 bp, Artificial Sequence
  Description of Artificial Sequence: Synthetic oligonucleotide
gtccatgtggttgtctttccacctggactc

SEQ ID NO: 328850 - DNA, 30 bp, Artificial Sequence
  Description of Artificial Sequence: Synthetic oligonucleotide
tccatgtggttgtctttccacctggactcc

SEQ ID NO: 328851 - DNA, 29 bp, Artificial Sequence
  Description of Artificial Sequence: Synthetic oligonucleotide
ccatgtggttgtctttccacctggactcc

SEQ ID NO: 328852 - DNA, 30 bp, Artificial Sequence
  Description of Artificial Sequence: Synthetic oligonucleotide
catgtggttgtctttccacctggactccac

SEQ ID NO: 328853 - DNA, 30 bp, Artificial Sequence
  Description of Artificial Sequence: Synthetic oligonucleotide
atgtggttgtctttccacctggactccacc

SEQ ID NO: 328854 - DNA, 29 bp, Artificial Sequence
  Description of Artificial Sequence: Synthetic oligonucleotide
tgtggttgtctttccacctggactccacc

SEQ ID NO: 328855 - DNA, 28 bp, Artificial Sequence
  Description of Artificial Sequence: Synthetic oligonucleotide
gtggttgtctttccacctggactccacc

SEQ ID NO: 328856 - DNA, 30 bp, Artificial Sequence
  Description of Artificial Sequence: Synthetic oligonucleotide
tggttgtctttccacctggactccaccaac

SEQ ID NO: 328857 - DNA, 29 bp, Artificial Sequence
  Description of Artificial Sequence: Synthetic oligonucleotide
ggttgtctttccacctggactccaccaac

SEQ ID NO: 328858 - DNA, 29 bp, Artificial Sequence
  Description of Artificial Sequence: Synthetic oligonucleotide
gttgtctttccacctggactccaccaacc

SEQ ID NO: 328859 - DNA, 29 bp, Artificial Sequence
  Description of Artificial Sequence: Synthetic oligonucleotide
ttgtctttccacctggactccaccaaccc

SEQ ID NO: 328860 - DNA, 28 bp, Artificial Sequence
  Description of Artificial Sequence: Synthetic oligonucleotide
tgtctttccacctggactccaccaaccc

SEQ ID NO: 328861 - DNA, 27 bp, Artificial Sequence
  Description of Artificial Sequence: Synthetic oligonucleotide
gtctttccacctggactccaccaaccc

SEQ ID NO: 328862 - DNA, 27 bp, Artificial Sequence
  Description of Artificial Sequence: Synthetic oligonucleotide
tctttccacctggactccaccaacccc

SEQ ID NO: 328863 - DNA, 26 bp, Artificial Sequence
  Description of Artificial Sequence: Synthetic oligonucleotide
ctttccacctggactccaccaacccc

SEQ ID NO: 328864 - DNA, 27 bp, Artificial Sequence
  Description of Artificial Sequence: Synthetic oligonucleotide
tttccacctggactccaccaaccccct

SEQ ID NO: 328865 - DNA, 27 bp, Artificial Sequence
  Description of Artificial Sequence: Synthetic oligonucleotide
ttccacctggactccaccaaccccctt

SEQ ID NO: 328866 - DNA, 27 bp, Artificial Sequence
  Description of Artificial Sequence: Synthetic oligonucleotide
tccacctggactccaccaacccccttt

SEQ ID NO: 328867 - DNA, 26 bp, Artificial Sequence
  Description of Artificial Sequence: Synthetic oligonucleotide
ccacctggactccaccaacccccttt

SEQ ID NO: 328868 - DNA, 27 bp, Artificial Sequence
  Description of Artificial Sequence: Synthetic oligonucleotide
cacctggactccaccaaccccctttct

SEQ ID NO: 328869 - DNA, 28 bp, Artificial Sequence
  Description of Artificial Sequence: Synthetic oligonucleotide
acctggactccaccaaccccctttcttc

SEQ ID NO: 328870 - DNA, 27 bp, Artificial Sequence
  Description of Artificial Sequence: Synthetic oligonucleotide
cctggactccaccaaccccctttcttc

SEQ ID NO: 328871 - DNA, 27 bp, Artificial Sequence
  Description of Artificial Sequence: Synthetic oligonucleotide
ctggactccaccaaccccctttcttcc

SEQ ID NO: 328872 - DNA, 28 bp, Artificial Sequence
  Description of Artificial Sequence: Synthetic oligonucleotide
tggactccaccaaccccctttcttccac

SEQ ID NO: 328873 - DNA, 27 bp, Artificial Sequence
  Description of Artificial Sequence: Synthetic oligonucleotide
ggactccaccaaccccctttcttccac

SEQ ID NO: 328874 - DNA, 27 bp, Artificial Sequence
  Description of Artificial Sequence: Synthetic oligonucleotide
gactccaccaaccccctttcttccacg

SEQ ID NO: 328875 - DNA, 27 bp, Artificial Sequence
  Description of Artificial Sequence: Synthetic oligonucleotide
actccaccaaccccctttcttccacgc

SEQ ID NO: 328876 - DNA, 27 bp, Artificial Sequence
  Description of Artificial Sequence: Synthetic oligonucleotide
ctccaccaaccccctttcttccacgct

SEQ ID NO: 328877 - DNA, 27 bp, Artificial Sequence
  Description of Artificial Sequence: Synthetic oligonucleotide
tccaccaaccccctttcttccacgctg

SEQ ID NO: 328878 - DNA, 26 bp, Artificial Sequence
  Description of Artificial Sequence: Synthetic oligonucleotide
ccaccaaccccctttcttccacgctg

SEQ ID NO: 328879 - DNA, 26 bp, Artificial Sequence
  Description of Artificial Sequence: Synthetic oligonucleotide
caccaaccccctttcttccacgctgg

SEQ ID NO: 328880 - DNA, 27 bp, Artificial Sequence
  Description of Artificial Sequence: Synthetic oligonucleotide
accaaccccctttcttccacgctggct

SEQ ID NO: 328881 - DNA, 27 bp, Artificial Sequence
  Description of Artificial Sequence: Synthetic oligonucleotide
ccaaccccctttcttccacgctggcta

SEQ ID NO: 328882 - DNA, 28 bp, Artificial Sequence
  Description of Artificial Sequence: Synthetic oligonucleotide
caaccccctttcttccacgctggctatc

SEQ ID NO: 328883 - DNA, 28 bp, Artificial Sequence
  Description of Artificial Sequence: Synthetic oligonucleotide
aaccccctttcttccacgctggctatcg

SEQ ID NO: 328884 - DNA, 27 bp, Artificial Sequence
  Description of Artificial Sequence: Synthetic oligonucleotide
accccctttcttccacgctggctatcg

SEQ ID NO: 328885 - DNA, 26 bp, Artificial Sequence
  Description of Artificial Sequence: Synthetic oligonucleotide
ccccctttcttccacgctggctatcg

SEQ ID NO: 328886 - DNA, 27 bp, Artificial Sequence
  Description of Artificial Sequence: Synthetic oligonucleotide
cccctttcttccacgctggctatcgca

SEQ ID NO: 328887 - DNA, 27 bp, Artificial Sequence
  Description of Artificial Sequence: Synthetic oligonucleotide
ccctttcttccacgctggctatcgcag

SEQ ID NO: 328888 - DNA, 28 bp, Artificial Sequence
  Description of Artificial Sequence: Synthetic oligonucleotide
cctttcttccacgctggctatcgcagag

SEQ ID NO: 328889 - DNA, 28 bp, Artificial Sequence
  Description of Artificial Sequence: Synthetic oligonucleotide
ctttcttccacgctggctatcgcagagc

SEQ ID NO: 328890 - DNA, 28 bp, Artificial Sequence
  Description of Artificial Sequence: Synthetic oligonucleotide
tttcttccacgctggctatcgcagagcc

SEQ ID NO: 328891 - DNA, 27 bp, Artificial Sequence
  Description of Artificial Sequence: Synthetic oligonucleotide
ttcttccacgctggctatcgcagagcc

SEQ ID NO: 328892 - DNA, 26 bp, Artificial Sequence
  Description of Artificial Sequence: Synthetic oligonucleotide
tcttccacgctggctatcgcagagcc

SEQ ID NO: 328893 - DNA, 25 bp, Artificial Sequence
  Description of Artificial Sequence: Synthetic oligonucleotide
cttccacgctggctatcgcagagcc

SEQ ID NO: 328894 - DNA, 26 bp, Artificial Sequence
  Description of Artificial Sequence: Synthetic oligonucleotide
ttccacgctggctatcgcagagccgt

SEQ ID NO: 328895 - DNA, 25 bp, Artificial Sequence
  Description of Artificial Sequence: Synthetic oligonucleotide
tccacgctggctatcgcagagccgt

SEQ ID NO: 328896 - DNA, 24 bp, Artificial Sequence
  Description of Artificial Sequence: Synthetic oligonucleotide
ccacgctggctatcgcagagccgt

SEQ ID NO: 328897 - DNA, 26 bp, Artificial Sequence
  Description of Artificial Sequence: Synthetic oligonucleotide
cacgctggctatcgcagagccgtcaa

SEQ ID NO: 328898 - DNA, 27 bp, Artificial Sequence
  Description of Artificial Sequence: Synthetic oligonucleotide
acgctggctatcgcagagccgtcaact

SEQ ID NO: 328899 - DNA, 27 bp, Artificial Sequence
  Description of Artificial Sequence: Synthetic oligonucleotide
cgctggctatcgcagagccgtcaactt

SEQ ID NO: 328900 - DNA, 28 bp, Artificial Sequence
  Description of Artificial Sequence: Synthetic oligonucleotide
gctggctatcgcagagccgtcaactttg

SEQ ID NO: 328901 - DNA, 28 bp, Artificial Sequence
  Description of Artificial Sequence: Synthetic oligonucleotide
ctggctatcgcagagccgtcaactttgg

SEQ ID NO: 328902 - DNA, 28 bp, Artificial Sequence
  Description of Artificial Sequence: Synthetic oligonucleotide
tggctatcgcagagccgtcaactttggc

SEQ ID NO: 328903 - DNA, 27 bp, Artificial Sequence
  Description of Artificial Sequence: Synthetic oligonucleotide
ggctatcgcagagccgtcaactttggc

SEQ ID NO: 328904 - DNA, 27 bp, Artificial Sequence
  Description of Artificial Sequence: Synthetic oligonucleotide
gctatcgcagagccgtcaactttggcc

SEQ ID NO: 328905 - DNA, 27 bp, Artificial Sequence
  Description of Artificial Sequence: Synthetic oligonucleotide
ctatcgcagagccgtcaactttggccc

SEQ ID NO: 328906 - DNA, 28 bp, Artificial Sequence
  Description of Artificial Sequence: Synthetic oligonucleotide
tatcgcagagccgtcaactttggccctg

SEQ ID NO: 328907 - DNA, 27 bp, Artificial Sequence
  Description of Artificial Sequence: Synthetic oligonucleotide
atcgcagagccgtcaactttggccctg

SEQ ID NO: 328908 - DNA, 26 bp, Artificial Sequence
  Description of Artificial Sequence: Synthetic oligonucleotide
tcgcagagccgtcaactttggccctg

SEQ ID NO: 328909 - DNA, 25 bp, Artificial Sequence
  Description of Artificial Sequence: Synthetic oligonucleotide
cgcagagccgtcaactttggccctg

SEQ ID NO: 328910 - DNA, 26 bp, Artificial Sequence
  Description of Artificial Sequence: Synthetic oligonucleotide
gcagagccgtcaactttggccctgct

SEQ ID NO: 328911 - DNA, 26 bp, Artificial Sequence
  Description of Artificial Sequence: Synthetic oligonucleotide
cagagccgtcaactttggccctgctg

SEQ ID NO: 328912 - DNA, 26 bp, Artificial Sequence
  Description of Artificial Sequence: Synthetic oligonucleotide
agagccgtcaactttggccctgctgg

SEQ ID NO: 328913 - DNA, 25 bp, Artificial Sequence
  Description of Artificial Sequence: Synthetic oligonucleotide
gagccgtcaactttggccctgctgg

SEQ ID NO: 328914 - DNA, 26 bp, Artificial Sequence
  Description of Artificial Sequence: Synthetic oligonucleotide
agccgtcaactttggccctgctggca

SEQ ID NO: 328915 - DNA, 25 bp, Artificial Sequence
  Description of Artificial Sequence: Synthetic oligonucleotide
gccgtcaactttggccctgctggca

SEQ ID NO: 328916 - DNA, 25 bp, Artificial Sequence
  Description of Artificial Sequence: Synthetic oligonucleotide
ccgtcaactttggccctgctggcac

SEQ ID NO: 328917 - DNA, 27 bp, Artificial Sequence
  Description of Artificial Sequence: Synthetic oligonucleotide
cgtcaactttggccctgctggcaccat

SEQ ID NO: 328918 - DNA, 27 bp, Artificial Sequence
  Description of Artificial Sequence: Synthetic oligonucleotide
gtcaactttggccctgctggcaccatc

SEQ ID NO: 328919 - DNA, 29 bp, Artificial Sequence
  Description of Artificial Sequence: Synthetic oligonucleotide
tcaactttggccctgctggcaccatcatg

SEQ ID NO: 328920 - DNA, 28 bp, Artificial Sequence
  Description of Artificial Sequence: Synthetic oligonucleotide
caactttggccctgctggcaccatcatg

SEQ ID NO: 328921 - DNA, 28 bp, Artificial Sequence
  Description of Artificial Sequence: Synthetic oligonucleotide
aactttggccctgctggcaccatcatgg

SEQ ID NO: 328922 - DNA, 27 bp, Artificial Sequence
  Description of Artificial Sequence: Synthetic oligonucleotide
actttggccctgctggcaccatcatgg

SEQ ID NO: 328923 - DNA, 26 bp, Artificial Sequence
  Description of Artificial Sequence: Synthetic oligonucleotide
ctttggccctgctggcaccatcatgg

SEQ ID NO: 328924 - DNA, 26 bp, Artificial Sequence
  Description of Artificial Sequence: Synthetic oligonucleotide
tttggccctgctggcaccatcatggc

SEQ ID NO: 328925 - DNA, 25 bp, Artificial Sequence
  Description of Artificial Sequence: Synthetic oligonucleotide
ttggccctgctggcaccatcatggc

SEQ ID NO: 328926 - DNA, 24 bp, Artificial Sequence
  Description of Artificial Sequence: Synthetic oligonucleotide
tggccctgctggcaccatcatggc

SEQ ID NO: 328927 - DNA, 23 bp, Artificial Sequence
  Description of Artificial Sequence: Synthetic oligonucleotide
ggccctgctggcaccatcatggc

SEQ ID NO: 328928 - DNA, 23 bp, Artificial Sequence
  Description of Artificial Sequence: Synthetic oligonucleotide
gccctgctggcaccatcatggcg

SEQ ID NO: 328929 - DNA, 24 bp, Artificial Sequence
  Description of Artificial Sequence: Synthetic oligonucleotide
ccctgctggcaccatcatggcgca

SEQ ID NO: 328930 - DNA, 24 bp, Artificial Sequence
  Description of Artificial Sequence: Synthetic oligonucleotide
cctgctggcaccatcatggcgcac

SEQ ID NO: 328931 - DNA, 25 bp, Artificial Sequence
  Description of Artificial Sequence: Synthetic oligonucleotide
ctgctggcaccatcatggcgcacga

SEQ ID NO: 328932 - DNA, 25 bp, Artificial Sequence
  Description of Artificial Sequence: Synthetic oligonucleotide
tgctggcaccatcatggcgcacgag

SEQ ID NO: 328933 - DNA, 24 bp, Artificial Sequence
  Description of Artificial Sequence: Synthetic oligonucleotide
gctggcaccatcatggcgcacgag

SEQ ID NO: 328934 - DNA, 25 bp, Artificial Sequence
  Description of Artificial Sequence: Synthetic oligonucleotide
ctggcaccatcatggcgcacgagct

SEQ ID NO: 328935 - DNA, 27 bp, Artificial Sequence
  Description of Artificial Sequence: Synthetic oligonucleotide
tggcaccatcatggcgcacgagctgat

SEQ ID NO: 328936 - DNA, 26 bp, Artificial Sequence
  Description of Artificial Sequence: Synthetic oligonucleotide
ggcaccatcatggcgcacgagctgat

SEQ ID NO: 328937 - DNA, 26 bp, Artificial Sequence
  Description of Artificial Sequence: Synthetic oligonucleotide
gcaccatcatggcgcacgagctgatg

SEQ ID NO: 328938 - DNA, 27 bp, Artificial Sequence
  Description of Artificial Sequence: Synthetic oligonucleotide
caccatcatggcgcacgagctgatgca

SEQ ID NO: 328939 - DNA, 27 bp, Artificial Sequence
  Description of Artificial Sequence: Synthetic oligonucleotide
accatcatggcgcacgagctgatgcac

SEQ ID NO: 328940 - DNA, 27 bp, Artificial Sequence
  Description of Artificial Sequence: Synthetic oligonucleotide
ccatcatggcgcacgagctgatgcaca

SEQ ID NO: 328941 - DNA, 28 bp, Artificial Sequence
  Description of Artificial Sequence: Synthetic oligonucleotide
catcatggcgcacgagctgatgcacatc

SEQ ID NO: 328942 - DNA, 30 bp, Artificial Sequence
  Description of Artificial Sequence: Synthetic oligonucleotide
atcatggcgcacgagctgatgcacatctac

SEQ ID NO: 328943 - DNA, 29 bp, Artificial Sequence
  Description of Artificial Sequence: Synthetic oligonucleotide
tcatggcgcacgagctgatgcacatctac

SEQ ID NO: 328944 - DNA, 28 bp, Artificial Sequence
  Description of Artificial Sequence: Synthetic oligonucleotide
catggcgcacgagctgatgcacatctac

SEQ ID NO: 328945 - DNA, 30 bp, Artificial Sequence
  Description of Artificial Sequence: Synthetic oligonucleotide
atggcgcacgagctgatgcacatctactac

SEQ ID NO: 328946 - DNA, 29 bp, Artificial Sequence
  Description of Artificial Sequence: Synthetic oligonucleotide
tggcgcacgagctgatgcacatctactac

SEQ ID NO: 328947 - DNA, 28 bp, Artificial Sequence
  Description of Artificial Sequence: Synthetic oligonucleotide
ggcgcacgagctgatgcacatctactac

SEQ ID NO: 328948 - DNA, 28 bp, Artificial Sequence
  Description of Artificial Sequence: Synthetic oligonucleotide
gcgcacgagctgatgcacatctactacc

SEQ ID NO: 328949 - DNA, 29 bp, Artificial Sequence
  Description of Artificial Sequence: Synthetic oligonucleotide
cgcacgagctgatgcacatctactaccag

SEQ ID NO: 328950 - DNA, 29 bp, Artificial Sequence
  Description of Artificial Sequence: Synthetic oligonucleotide
gcacgagctgatgcacatctactaccagc

SEQ ID NO: 328951 - DNA, 30 bp, Artificial Sequence
  Description of Artificial Sequence: Synthetic oligonucleotide
cacgagctgatgcacatctactaccagctg

SEQ ID NO: 328952 - DNA, 33 bp, Artificial Sequence
  Description of Artificial Sequence: Synthetic oligonucleotide
acgagctgatgcacatctactaccagctgttac

SEQ ID NO: 328953 - DNA, 32 bp, Artificial Sequence
  Description of Artificial Sequence: Synthetic oligonucleotide
cgagctgatgcacatctactaccagctgttac

SEQ ID NO: 328954 - DNA, 33 bp, Artificial Sequence
  Description of Artificial Sequence: Synthetic oligonucleotide
gagctgatgcacatctactaccagctgttactg

SEQ ID NO: 328955 - DNA, 33 bp, Artificial Sequence
  Description of Artificial Sequence: Synthetic oligonucleotide
agctgatgcacatctactaccagctgttactgc

SEQ ID NO: 328956 - DNA, 32 bp, Artificial Sequence
  Description of Artificial Sequence: Synthetic oligonucleotide
gctgatgcacatctactaccagctgttactgc

SEQ ID NO: 328957 - DNA, 32 bp, Artificial Sequence
  Description of Artificial Sequence: Synthetic oligonucleotide
ctgatgcacatctactaccagctgttactgcc

SEQ ID NO: 328958 - DNA, 33 bp, Artificial Sequence
  Description of Artificial Sequence: Synthetic oligonucleotide
tgatgcacatctactaccagctgttactgcctc

SEQ ID NO: 328959 - DNA, 32 bp, Artificial Sequence
  Description of Artificial Sequence: Synthetic oligonucleotide
gatgcacatctactaccagctgttactgcctc

SEQ ID NO: 328960 - DNA, 32 bp, Artificial Sequence
  Description of Artificial Sequence: Synthetic oligonucleotide
atgcacatctactaccagctgttactgcctcg

SEQ ID NO: 328961 - DNA, 31 bp, Artificial Sequence
  Description of Artificial Sequence: Synthetic oligonucleotide
tgcacatctactaccagctgttactgcctcg

SEQ ID NO: 328962 - DNA, 30 bp, Artificial Sequence
  Description of Artificial Sequence: Synthetic oligonucleotide
gcacatctactaccagctgttactgcctcg

SEQ ID NO: 328963 - DNA, 30 bp, Artificial Sequence
  Description of Artificial Sequence: Synthetic oligonucleotide
cacatctactaccagctgttactgcctcgg

SEQ ID NO: 328964 - DNA, 30 bp, Artificial Sequence
  Description of Artificial Sequence: Synthetic oligonucleotide
acatctactaccagctgttactgcctcggg

SEQ ID NO: 328965 - DNA, 29 bp, Artificial Sequence
  Description of Artificial Sequence: Synthetic oligonucleotide
catctactaccagctgttactgcctcggg

SEQ ID NO: 328966 - DNA, 29 bp, Artificial Sequence
  Description of Artificial Sequence: Synthetic oligonucleotide
atctactaccagctgttactgcctcgggg

SEQ ID NO: 328967 - DNA, 28 bp, Artificial Sequence
  Description of Artificial Sequence: Synthetic oligonucleotide
tctactaccagctgttactgcctcgggg

SEQ ID NO: 328968 - DNA, 27 bp, Artificial Sequence
  Description of Artificial Sequence: Synthetic oligonucleotide
ctactaccagctgttactgcctcgggg

SEQ ID NO: 328969 - DNA, 27 bp, Artificial Sequence
  Description of Artificial Sequence: Synthetic oligonucleotide
tactaccagctgttactgcctcggggc

SEQ ID NO: 328970 - DNA, 27 bp, Artificial Sequence
  Description of Artificial Sequence: Synthetic oligonucleotide
actaccagctgttactgcctcggggct

SEQ ID NO: 328971 - DNA, 26 bp, Artificial Sequence
  Description of Artificial Sequence: Synthetic oligonucleotide
ctaccagctgttactgcctcggggct

SEQ ID NO: 328972 - DNA, 26 bp, Artificial Sequence
  Description of Artificial Sequence: Synthetic oligonucleotide
taccagctgttactgcctcggggctg

SEQ ID NO: 328973 - DNA, 25 bp, Artificial Sequence
  Description of Artificial Sequence: Synthetic oligonucleotide
accagctgttactgcctcggggctg

SEQ ID NO: 328974 - DNA, 24 bp, Artificial Sequence
  Description of Artificial Sequence: Synthetic oligonucleotide
ccagctgttactgcctcggggctg

SEQ ID NO: 328975 - DNA, 24 bp, Artificial Sequence
  Description of Artificial Sequence: Synthetic oligonucleotide
cagctgttactgcctcggggctgc

SEQ ID NO: 328976 - DNA, 25 bp, Artificial Sequence
  Description of Artificial Sequence: Synthetic oligonucleotide
agctgttactgcctcggggctgcca

SEQ ID NO: 328977 - DNA, 24 bp, Artificial Sequence
  Description of Artificial Sequence: Synthetic oligonucleotide
gctgttactgcctcggggctgcca

SEQ ID NO: 328978 - DNA, 24 bp, Artificial Sequence
  Description of Artificial Sequence: Synthetic oligonucleotide
ctgttactgcctcggggctgccac

SEQ ID NO: 328979 - DNA, 24 bp, Artificial Sequence
  Description of Artificial Sequence: Synthetic oligonucleotide
tgttactgcctcggggctgccacg

SEQ ID NO: 328980 - DNA, 23 bp, Artificial Sequence
  Description of Artificial Sequence: Synthetic oligonucleotide
gttactgcctcggggctgccacg

SEQ ID NO: 328981 - DNA, 23 bp, Artificial Sequence
  Description of Artificial Sequence: Synthetic oligonucleotide
ttactgcctcggggctgccacgc

SEQ ID NO: 328982 - DNA, 22 bp, Artificial Sequence
  Description of Artificial Sequence: Synthetic oligonucleotide
tactgcctcggggctgccacgc

SEQ ID NO: 328983 - DNA, 21 bp, Artificial Sequence
  Description of Artificial Sequence: Synthetic oligonucleotide
actgcctcggggctgccacgc

SEQ ID NO: 328984 - DNA, 20 bp, Artificial Sequence
  Description of Artificial Sequence: Synthetic oligonucleotide
ctgcctcggggctgccacgc

SEQ ID NO: 328985 - DNA, 21 bp, Artificial Sequence
  Description of Artificial Sequence: Synthetic oligonucleotide
tgcctcggggctgccacgcct

SEQ ID NO: 328986 - DNA, 20 bp, Artificial Sequence
  Description of Artificial Sequence: Synthetic oligonucleotide
gcctcggggctgccacgcct

SEQ ID NO: 328987 - DNA, 21 bp, Artificial Sequence
  Description of Artificial Sequence: Synthetic oligonucleotide
cctcggggctgccacgcctgt

SEQ ID NO: 328988 - DNA, 22 bp, Artificial Sequence
  Description of Artificial Sequence: Synthetic oligonucleotide
ctcggggctgccacgcctgtga

SEQ ID NO: 328989 - DNA, 24 bp, Artificial Sequence
  Description of Artificial Sequence: Synthetic oligonucleotide
tcggggctgccacgcctgtgagaa

SEQ ID NO: 328990 - DNA, 23 bp, Artificial Sequence
  Description of Artificial Sequence: Synthetic oligonucleotide
cggggctgccacgcctgtgagaa

SEQ ID NO: 328991 - DNA, 23 bp, Artificial Sequence
  Description of Artificial Sequence: Synthetic oligonucleotide
ggggctgccacgcctgtgagaac

SEQ ID NO: 328992 - DNA, 25 bp, Artificial Sequence
  Description of Artificial Sequence: Synthetic oligonucleotide
gggctgccacgcctgtgagaaccat

SEQ ID NO: 328993 - DNA, 25 bp, Artificial Sequence
  Description of Artificial Sequence: Synthetic oligonucleotide
ggctgccacgcctgtgagaaccatg

SEQ ID NO: 328994 - DNA, 25 bp, Artificial Sequence
  Description of Artificial Sequence: Synthetic oligonucleotide
gctgccacgcctgtgagaaccatgc

SEQ ID NO: 328995 - DNA, 25 bp, Artificial Sequence
  Description of Artificial Sequence: Synthetic oligonucleotide
ctgccacgcctgtgagaaccatgcc

SEQ ID NO: 328996 - DNA, 26 bp, Artificial Sequence
  Description of Artificial Sequence: Synthetic oligonucleotide
tgccacgcctgtgagaaccatgccgt

SEQ ID NO: 328997 - DNA, 25 bp, Artificial Sequence
  Description of Artificial Sequence: Synthetic oligonucleotide
gccacgcctgtgagaaccatgccgt

SEQ ID NO: 328998 - DNA, 25 bp, Artificial Sequence
  Description of Artificial Sequence: Synthetic oligonucleotide
ccacgcctgtgagaaccatgccgtc

SEQ ID NO: 328999 - DNA, 26 bp, Artificial Sequence
  Description of Artificial Sequence: Synthetic oligonucleotide
cacgcctgtgagaaccatgccgtcca

SEQ ID NO: 329000 - DNA, 26 bp, Artificial Sequence
  Description of Artificial Sequence: Synthetic oligonucleotide
acgcctgtgagaaccatgccgtccag

SEQ ID NO: 329001 - DNA, 25 bp, Artificial Sequence
  Description of Artificial Sequence: Synthetic oligonucleotide
cgcctgtgagaaccatgccgtccag

SEQ ID NO: 329002 - DNA, 27 bp, Artificial Sequence
  Description of Artificial Sequence: Synthetic oligonucleotide
gcctgtgagaaccatgccgtccaggaa

SEQ ID NO: 329003 - DNA, 27 bp, Artificial Sequence
  Description of Artificial Sequence: Synthetic oligonucleotide
cctgtgagaaccatgccgtccaggaag

SEQ ID NO: 329004 - DNA, 27 bp, Artificial Sequence
  Description of Artificial Sequence: Synthetic oligonucleotide
ctgtgagaaccatgccgtccaggaagg

SEQ ID NO: 329005 - DNA, 28 bp, Artificial Sequence
  Description of Artificial Sequence: Synthetic oligonucleotide
tgtgagaaccatgccgtccaggaaggtc

SEQ ID NO: 329006 - DNA, 27 bp, Artificial Sequence
  Description of Artificial Sequence: Synthetic oligonucleotide
gtgagaaccatgccgtccaggaaggtc

SEQ ID NO: 329007 - DNA, 28 bp, Artificial Sequence
  Description of Artificial Sequence: Synthetic oligonucleotide
tgagaaccatgccgtccaggaaggtcac

SEQ ID NO: 329008 - DNA, 27 bp, Artificial Sequence
  Description of Artificial Sequence: Synthetic oligonucleotide
gagaaccatgccgtccaggaaggtcac

SEQ ID NO: 329009 - DNA, 27 bp, Artificial Sequence
  Description of Artificial Sequence: Synthetic oligonucleotide
agaaccatgccgtccaggaaggtcacc

SEQ ID NO: 329010 - DNA, 27 bp, Artificial Sequence
  Description of Artificial Sequence: Synthetic oligonucleotide
gaaccatgccgtccaggaaggtcacct

SEQ ID NO: 329011 - DNA, 27 bp, Artificial Sequence
  Description of Artificial Sequence: Synthetic oligonucleotide
aaccatgccgtccaggaaggtcacctg

SEQ ID NO: 329012 - DNA, 27 bp, Artificial Sequence
  Description of Artificial Sequence: Synthetic oligonucleotide
accatgccgtccaggaaggtcacctgt

SEQ ID NO: 329013 - DNA, 26 bp, Artificial Sequence
  Description of Artificial Sequence: Synthetic oligonucleotide
ccatgccgtccaggaaggtcacctgt

SEQ ID NO: 329014 - DNA, 26 bp, Artificial Sequence
  Description of Artificial Sequence: Synthetic oligonucleotide
catgccgtccaggaaggtcacctgtg

SEQ ID NO: 329015 - DNA, 26 bp, Artificial Sequence
  Description of Artificial Sequence: Synthetic oligonucleotide
atgccgtccaggaaggtcacctgtgg

SEQ ID NO: 329016 - DNA, 25 bp, Artificial Sequence
  Description of Artificial Sequence: Synthetic oligonucleotide
tgccgtccaggaaggtcacctgtgg

SEQ ID NO: 329017 - DNA, 24 bp, Artificial Sequence
  Description of Artificial Sequence: Synthetic oligonucleotide
gccgtccaggaaggtcacctgtgg

SEQ ID NO: 329018 - DNA, 25 bp, Artificial Sequence
  Description of Artificial Sequence: Synthetic oligonucleotide
ccgtccaggaaggtcacctgtggct

SEQ ID NO: 329019 - DNA, 27 bp, Artificial Sequence
  Description of Artificial Sequence: Synthetic oligonucleotide
cgtccaggaaggtcacctgtggctgaa

SEQ ID NO: 329020 - DNA, 27 bp, Artificial Sequence
  Description of Artificial Sequence: Synthetic oligonucleotide
gtccaggaaggtcacctgtggctgaag

SEQ ID NO: 329021 - DNA, 27 bp, Artificial Sequence
  Description of Artificial Sequence: Synthetic oligonucleotide
tccaggaaggtcacctgtggctgaagc

SEQ ID NO: 329022 - DNA, 26 bp, Artificial Sequence
  Description of Artificial Sequence: Synthetic oligonucleotide
ccaggaaggtcacctgtggctgaagc

SEQ ID NO: 329023 - DNA, 26 bp, Artificial Sequence
  Description of Artificial Sequence: Synthetic oligonucleotide
caggaaggtcacctgtggctgaagcg

SEQ ID NO: 329024 - DNA, 26 bp, Artificial Sequence
  Description of Artificial Sequence: Synthetic oligonucleotide
aggaaggtcacctgtggctgaagcgc

SEQ ID NO: 329025 - DNA, 25 bp, Artificial Sequence
  Description of Artificial Sequence: Synthetic oligonucleotide
ggaaggtcacctgtggctgaagcgc

SEQ ID NO: 329026 - DNA, 27 bp, Artificial Sequence
  Description of Artificial Sequence: Synthetic oligonucleotide
gaaggtcacctgtggctgaagcgcgat

SEQ ID NO: 329027 - DNA, 30 bp, Artificial Sequence
  Description of Artificial Sequence: Synthetic oligonucleotide
aaggtcacctgtggctgaagcgcgattatg

SEQ ID NO: 329028 - DNA, 29 bp, Artificial Sequence
  Description of Artificial Sequence: Synthetic oligonucleotide
aggtcacctgtggctgaagcgcgattatg

SEQ ID NO: 329029 - DNA, 28 bp, Artificial Sequence
  Description of Artificial Sequence: Synthetic oligonucleotide
ggtcacctgtggctgaagcgcgattatg

SEQ ID NO: 329030 - DNA, 28 bp, Artificial Sequence
  Description of Artificial Sequence: Synthetic oligonucleotide
gtcacctgtggctgaagcgcgattatgc

SEQ ID NO: 329031 - DNA, 29 bp, Artificial Sequence
  Description of Artificial Sequence: Synthetic oligonucleotide
tcacctgtggctgaagcgcgattatgctg

SEQ ID NO: 329032 - DNA, 28 bp, Artificial Sequence
  Description of Artificial Sequence: Synthetic oligonucleotide
cacctgtggctgaagcgcgattatgctg

SEQ ID NO: 329033 - DNA, 28 bp, Artificial Sequence
  Description of Artificial Sequence: Synthetic oligonucleotide
acctgtggctgaagcgcgattatgctgg

SEQ ID NO: 329034 - DNA, 27 bp, Artificial Sequence
  Description of Artificial Sequence: Synthetic oligonucleotide
cctgtggctgaagcgcgattatgctgg

SEQ ID NO: 329035 - DNA, 27 bp, Artificial Sequence
  Description of Artificial Sequence: Synthetic oligonucleotide
ctgtggctgaagcgcgattatgctggc

SEQ ID NO: 329036 - DNA, 30 bp, Artificial Sequence
  Description of Artificial Sequence: Synthetic oligonucleotide
tgtggctgaagcgcgattatgctggctttc

SEQ ID NO: 329037 - DNA, 29 bp, Artificial Sequence
  Description of Artificial Sequence: Synthetic oligonucleotide
gtggctgaagcgcgattatgctggctttc

SEQ ID NO: 329038 - DNA, 29 bp, Artificial Sequence
  Description of Artificial Sequence: Synthetic oligonucleotide
tggctgaagcgcgattatgctggctttcc

SEQ ID NO: 329039 - DNA, 28 bp, Artificial Sequence
  Description of Artificial Sequence: Synthetic oligonucleotide
ggctgaagcgcgattatgctggctttcc

SEQ ID NO: 329040 - DNA, 32 bp, Artificial Sequence
  Description of Artificial Sequence: Synthetic oligonucleotide
gctgaagcgcgattatgctggctttccatttc

SEQ ID NO: 329041 - DNA, 32 bp, Artificial Sequence
  Description of Artificial Sequence: Synthetic oligonucleotide
ctgaagcgcgattatgctggctttccatttcc

SEQ ID NO: 329042 - DNA, 34 bp, Artificial Sequence
  Description of Artificial Sequence: Synthetic oligonucleotide
tgaagcgcgattatgctggctttccatttcctag

SEQ ID NO: 329043 - DNA, 33 bp, Artificial Sequence
  Description of Artificial Sequence: Synthetic oligonucleotide
gaagcgcgattatgctggctttccatttcctag

SEQ ID NO: 329044 - DNA, 33 bp, Artificial Sequence
  Description of Artificial Sequence: Synthetic oligonucleotide
aagcgcgattatgctggctttccatttcctagc

SEQ ID NO: 329045 - DNA, 32 bp, Artificial Sequence
  Description of Artificial Sequence: Synthetic oligonucleotide
agcgcgattatgctggctttccatttcctagc

SEQ ID NO: 329046 - DNA, 31 bp, Artificial Sequence
  Description of Artificial Sequence: Synthetic oligonucleotide
gcgcgattatgctggctttccatttcctagc

SEQ ID NO: 329047 - DNA, 32 bp, Artificial Sequence
  Description of Artificial Sequence: Synthetic oligonucleotide
cgcgattatgctggctttccatttcctagcag

SEQ ID NO: 329048 - DNA, 34 bp, Artificial Sequence
  Description of Artificial Sequence: Synthetic oligonucleotide
gcgattatgctggctttccatttcctagcagatc

SEQ ID NO: 329049 - DNA, 34 bp, Artificial Sequence
  Description of Artificial Sequence: Synthetic oligonucleotide
cgattatgctggctttccatttcctagcagatcc

SEQ ID NO: 329050 - DNA, 35 bp, Artificial Sequence
  Description of Artificial Sequence: Synthetic oligonucleotide
gattatgctggctttccatttcctagcagatcctc

SEQ ID NO: 329051 - DNA, 35 bp, Artificial Sequence
  Description of Artificial Sequence: Synthetic oligonucleotide
attatgctggctttccatttcctagcagatcctcc

SEQ ID NO: 329052 - DNA, 34 bp, Artificial Sequence
  Description of Artificial Sequence: Synthetic oligonucleotide
ttatgctggctttccatttcctagcagatcctcc

SEQ ID NO: 329053 - DNA, 33 bp, Artificial Sequence
  Description of Artificial Sequence: Synthetic oligonucleotide
tatgctggctttccatttcctagcagatcctcc

SEQ ID NO: 329054 - DNA, 32 bp, Artificial Sequence
  Description of Artificial Sequence: Synthetic oligonucleotide
atgctggctttccatttcctagcagatcctcc

SEQ ID NO: 329055 - DNA, 31 bp, Artificial Sequence
  Description of Artificial Sequence: Synthetic oligonucleotide
tgctggctttccatttcctagcagatcctcc

SEQ ID NO: 329056 - DNA, 30 bp, Artificial Sequence
  Description of Artificial Sequence: Synthetic oligonucleotide
gctggctttccatttcctagcagatcctcc

SEQ ID NO: 329057 - DNA, 32 bp, Artificial Sequence
  Description of Artificial Sequence: Synthetic oligonucleotide
ctggctttccatttcctagcagatcctccttc

SEQ ID NO: 329058 - DNA, 35 bp, Artificial Sequence
  Description of Artificial Sequence: Synthetic oligonucleotide
tggctttccatttcctagcagatcctccttcattg

SEQ ID NO: 329059 - DNA, 34 bp, Artificial Sequence
  Description of Artificial Sequence: Synthetic oligonucleotide
ggctttccatttcctagcagatcctccttcattg

SEQ ID NO: 329060 - DNA, 35 bp, Artificial Sequence
  Description of Artificial Sequence: Synthetic oligonucleotide
gctttccatttcctagcagatcctccttcattgac

SEQ ID NO: 329061 - DNA, 36 bp, Artificial Sequence
  Description of Artificial Sequence: Synthetic oligonucleotide
ctttccatttcctagcagatcctccttcattgactc

SEQ ID NO: 329062 - DNA, 36 bp, Artificial Sequence
  Description of Artificial Sequence: Synthetic oligonucleotide
tttccatttcctagcagatcctccttcattgactcc

SEQ ID NO: 329063 - DNA, 35 bp, Artificial Sequence
  Description of Artificial Sequence: Synthetic oligonucleotide
ttccatttcctagcagatcctccttcattgactcc

SEQ ID NO: 329064 - DNA, 34 bp, Artificial Sequence
  Description of Artificial Sequence: Synthetic oligonucleotide
tccatttcctagcagatcctccttcattgactcc

SEQ ID NO: 329065 - DNA, 33 bp, Artificial Sequence
  Description of Artificial Sequence: Synthetic oligonucleotide
ccatttcctagcagatcctccttcattgactcc

SEQ ID NO: 329066 - DNA, 33 bp, Artificial Sequence
  Description of Artificial Sequence: Synthetic oligonucleotide
catttcctagcagatcctccttcattgactccc

SEQ ID NO: 329067 - DNA, 34 bp, Artificial Sequence
  Description of Artificial Sequence: Synthetic oligonucleotide
atttcctagcagatcctccttcattgactccctg

SEQ ID NO: 329068 - DNA, 33 bp, Artificial Sequence
  Description of Artificial Sequence: Synthetic oligonucleotide
tttcctagcagatcctccttcattgactccctg

SEQ ID NO: 329069 - DNA, 32 bp, Artificial Sequence
  Description of Artificial Sequence: Synthetic oligonucleotide
ttcctagcagatcctccttcattgactccctg

SEQ ID NO: 329070 - DNA, 31 bp, Artificial Sequence
  Description of Artificial Sequence: Synthetic oligonucleotide
tcctagcagatcctccttcattgactccctg

SEQ ID NO: 329071 - DNA, 30 bp, Artificial Sequence
  Description of Artificial Sequence: Synthetic oligonucleotide
cctagcagatcctccttcattgactccctg

SEQ ID NO: 329072 - DNA, 31 bp, Artificial Sequence
  Description of Artificial Sequence: Synthetic oligonucleotide
ctagcagatcctccttcattgactccctgac

SEQ ID NO: 329073 - DNA, 34 bp, Artificial Sequence
  Description of Artificial Sequence: Synthetic oligonucleotide
tagcagatcctccttcattgactccctgacattc

SEQ ID NO: 329074 - DNA, 33 bp, Artificial Sequence
  Description of Artificial Sequence: Synthetic oligonucleotide
agcagatcctccttcattgactccctgacattc

SEQ ID NO: 329075 - DNA, 32 bp, Artificial Sequence
  Description of Artificial Sequence: Synthetic oligonucleotide
gcagatcctccttcattgactccctgacattc

SEQ ID NO: 329076 - DNA, 35 bp, Artificial Sequence
  Description of Artificial Sequence: Synthetic oligonucleotide
cagatcctccttcattgactccctgacattcttac

SEQ ID NO: 329077 - DNA, 36 bp, Artificial Sequence
  Description of Artificial Sequence: Synthetic oligonucleotide
agatcctccttcattgactccctgacattcttacag

SEQ ID NO: 329078 - DNA, 35 bp, Artificial Sequence
  Description of Artificial Sequence: Synthetic oligonucleotide
gatcctccttcattgactccctgacattcttacag

SEQ ID NO: 329079 - DNA, 38 bp, Artificial Sequence
  Description of Artificial Sequence: Synthetic oligonucleotide
atcctccttcattgactccctgacattcttacagaatg

SEQ ID NO: 329080 - DNA, 37 bp, Artificial Sequence
  Description of Artificial Sequence: Synthetic oligonucleotide
tcctccttcattgactccctgacattcttacagaatg

SEQ ID NO: 329081 - DNA, 36 bp, Artificial Sequence
  Description of Artificial Sequence: Synthetic oligonucleotide
cctccttcattgactccctgacattcttacagaatg

SEQ ID NO: 329082 - DNA, 36 bp, Artificial Sequence
  Description of Artificial Sequence: Synthetic oligonucleotide
ctccttcattgactccctgacattcttacagaatgc

SEQ ID NO: 329083 - DNA, 37 bp, Artificial Sequence
  Description of Artificial Sequence: Synthetic oligonucleotide
tccttcattgactccctgacattcttacagaatgctg

SEQ ID NO: 329084 - DNA, 36 bp, Artificial Sequence
  Description of Artificial Sequence: Synthetic oligonucleotide
ccttcattgactccctgacattcttacagaatgctg

SEQ ID NO: 329085 - DNA, 36 bp, Artificial Sequence
  Description of Artificial Sequence: Synthetic oligonucleotide
cttcattgactccctgacattcttacagaatgctgg

SEQ ID NO: 329086 - DNA, 37 bp, Artificial Sequence
  Description of Artificial Sequence: Synthetic oligonucleotide
ttcattgactccctgacattcttacagaatgctggag

SEQ ID NO: 329087 - DNA, 36 bp, Artificial Sequence
  Description of Artificial Sequence: Synthetic oligonucleotide
tcattgactccctgacattcttacagaatgctggag

SEQ ID NO: 329088 - DNA, 35 bp, Artificial Sequence
  Description of Artificial Sequence: Synthetic oligonucleotide
cattgactccctgacattcttacagaatgctggag

SEQ ID NO: 329089 - DNA, 36 bp, Artificial Sequence
  Description of Artificial Sequence: Synthetic oligonucleotide
attgactccctgacattcttacagaatgctggagac

SEQ ID NO: 329090 - DNA, 35 bp, Artificial Sequence
  Description of Artificial Sequence: Synthetic oligonucleotide
ttgactccctgacattcttacagaatgctggagac

SEQ ID NO: 329091 - DNA, 34 bp, Artificial Sequence
  Description of Artificial Sequence: Synthetic oligonucleotide
tgactccctgacattcttacagaatgctggagac

SEQ ID NO: 329092 - DNA, 33 bp, Artificial Sequence
  Description of Artificial Sequence: Synthetic oligonucleotide
gactccctgacattcttacagaatgctggagac

SEQ ID NO: 329093 - DNA, 33 bp, Artificial Sequence
  Description of Artificial Sequence: Synthetic oligonucleotide
actccctgacattcttacagaatgctggagacg

SEQ ID NO: 329094 - DNA, 32 bp, Artificial Sequence
  Description of Artificial Sequence: Synthetic oligonucleotide
ctccctgacattcttacagaatgctggagacg

SEQ ID NO: 329095 - DNA, 34 bp, Artificial Sequence
  Description of Artificial Sequence: Synthetic oligonucleotide
tccctgacattcttacagaatgctggagacgttg

SEQ ID NO: 329096 - DNA, 33 bp, Artificial Sequence
  Description of Artificial Sequence: Synthetic oligonucleotide
ccctgacattcttacagaatgctggagacgttg

SEQ ID NO: 329097 - DNA, 33 bp, Artificial Sequence
  Description of Artificial Sequence: Synthetic oligonucleotide
cctgacattcttacagaatgctggagacgttgg

SEQ ID NO: 329098 - DNA, 33 bp, Artificial Sequence
  Description of Artificial Sequence: Synthetic oligonucleotide
ctgacattcttacagaatgctggagacgttggc

SEQ ID NO: 329099 - DNA, 33 bp, Artificial Sequence
  Description of Artificial Sequence: Synthetic oligonucleotide
tgacattcttacagaatgctggagacgttggcg

SEQ ID NO: 329100 - DNA, 32 bp, Artificial Sequence
  Description of Artificial Sequence: Synthetic oligonucleotide
gacattcttacagaatgctggagacgttggcg

SEQ ID NO: 329101 - DNA, 32 bp, Artificial Sequence
  Description of Artificial Sequence: Synthetic oligonucleotide
acattcttacagaatgctggagacgttggcgg

SEQ ID NO: 329102 - DNA, 31 bp, Artificial Sequence
  Description of Artificial Sequence: Synthetic oligonucleotide
cattcttacagaatgctggagacgttggcgg

SEQ ID NO: 329103 - DNA, 31 bp, Artificial Sequence
  Description of Artificial Sequence: Synthetic oligonucleotide
attcttacagaatgctggagacgttggcggg

SEQ ID NO: 329104 - DNA, 30 bp, Artificial Sequence
  Description of Artificial Sequence: Synthetic oligonucleotide
ttcttacagaatgctggagacgttggcggg

SEQ ID NO: 329105 - DNA, 29 bp, Artificial Sequence
  Description of Artificial Sequence: Synthetic oligonucleotide
tcttacagaatgctggagacgttggcggg

SEQ ID NO: 329106 - DNA, 28 bp, Artificial Sequence
  Description of Artificial Sequence: Synthetic oligonucleotide
cttacagaatgctggagacgttggcggg

SEQ ID NO: 329107 - DNA, 28 bp, Artificial Sequence
  Description of Artificial Sequence: Synthetic oligonucleotide
ttacagaatgctggagacgttggcgggc

SEQ ID NO: 329108 - DNA, 27 bp, Artificial Sequence
  Description of Artificial Sequence: Synthetic oligonucleotide
tacagaatgctggagacgttggcgggc

SEQ ID NO: 329109 - DNA, 27 bp, Artificial Sequence
  Description of Artificial Sequence: Synthetic oligonucleotide
acagaatgctggagacgttggcgggct

SEQ ID NO: 329110 - DNA, 27 bp, Artificial Sequence
  Description of Artificial Sequence: Synthetic oligonucleotide
cagaatgctggagacgttggcgggcta

SEQ ID NO: 329111 - DNA, 27 bp, Artificial Sequence
  Description of Artificial Sequence: Synthetic oligonucleotide
agaatgctggagacgttggcgggctag

SEQ ID NO: 329112 - DNA, 26 bp, Artificial Sequence
  Description of Artificial Sequence: Synthetic oligonucleotide
gaatgctggagacgttggcgggctag

SEQ ID NO: 329113 - DNA, 26 bp, Artificial Sequence
  Description of Artificial Sequence: Synthetic oligonucleotide
aatgctggagacgttggcgggctagc

SEQ ID NO: 329114 - DNA, 25 bp, Artificial Sequence
  Description of Artificial Sequence: Synthetic oligonucleotide
atgctggagacgttggcgggctagc

SEQ ID NO: 329115 - DNA, 24 bp, Artificial Sequence
  Description of Artificial Sequence: Synthetic oligonucleotide
tgctggagacgttggcgggctagc

SEQ ID NO: 329116 - DNA, 23 bp, Artificial Sequence
  Description of Artificial Sequence: Synthetic oligonucleotide
gctggagacgttggcgggctagc

SEQ ID NO: 329117 - DNA, 25 bp, Artificial Sequence
  Description of Artificial Sequence: Synthetic oligonucleotide
ctggagacgttggcgggctagcctt

SEQ ID NO: 329118 - DNA, 25 bp, Artificial Sequence
  Description of Artificial Sequence: Synthetic oligonucleotide
tggagacgttggcgggctagccttc

SEQ ID NO: 329119 - DNA, 24 bp, Artificial Sequence
  Description of Artificial Sequence: Synthetic oligonucleotide
ggagacgttggcgggctagccttc

SEQ ID NO: 329120 - DNA, 24 bp, Artificial Sequence
  Description of Artificial Sequence: Synthetic oligonucleotide
gagacgttggcgggctagccttcg

SEQ ID NO: 329121 - DNA, 24 bp, Artificial Sequence
  Description of Artificial Sequence: Synthetic oligonucleotide
agacgttggcgggctagccttcgc

SEQ ID NO: 329122 - DNA, 23 bp, Artificial Sequence
  Description of Artificial Sequence: Synthetic oligonucleotide
gacgttggcgggctagccttcgc

SEQ ID NO: 329123 - DNA, 23 bp, Artificial Sequence
  Description of Artificial Sequence: Synthetic oligonucleotide
acgttggcgggctagccttcgcg

SEQ ID NO: 329124 - DNA, 22 bp, Artificial Sequence
  Description of Artificial Sequence: Synthetic oligonucleotide
cgttggcgggctagccttcgcg

SEQ ID NO: 329125 - DNA, 23 bp, Artificial Sequence
  Description of Artificial Sequence: Synthetic oligonucleotide
gttggcgggctagccttcgcgct

SEQ ID NO: 329126 - DNA, 23 bp, Artificial Sequence
  Description of Artificial Sequence: Synthetic oligonucleotide
ttggcgggctagccttcgcgctg

SEQ ID NO: 329127 - DNA, 22 bp, Artificial Sequence
  Description of Artificial Sequence: Synthetic oligonucleotide
tggcgggctagccttcgcgctg

SEQ ID NO: 329128 - DNA, 21 bp, Artificial Sequence
  Description of Artificial Sequence: Synthetic oligonucleotide
ggcgggctagccttcgcgctg

SEQ ID NO: 329129 - DNA, 22 bp, Artificial Sequence
  Description of Artificial Sequence: Synthetic oligonucleotide
gcgggctagccttcgcgctgct

SEQ ID NO: 329130 - DNA, 22 bp, Artificial Sequence
  Description of Artificial Sequence: Synthetic oligonucleotide
cgggctagccttcgcgctgctg

SEQ ID NO: 329131 - DNA, 22 bp, Artificial Sequence
  Description of Artificial Sequence: Synthetic oligonucleotide
gggctagccttcgcgctgctgg

SEQ ID NO: 329132 - DNA, 25 bp, Artificial Sequence
  Description of Artificial Sequence: Synthetic oligonucleotide
ggctagccttcgcgctgctggcata

SEQ ID NO: 329133 - DNA, 26 bp, Artificial Sequence
  Description of Artificial Sequence: Synthetic oligonucleotide
gctagccttcgcgctgctggcataca

SEQ ID NO: 329134 - DNA, 26 bp, Artificial Sequence
  Description of Artificial Sequence: Synthetic oligonucleotide
ctagccttcgcgctgctggcatacag

SEQ ID NO: 329135 - DNA, 27 bp, Artificial Sequence
  Description of Artificial Sequence: Synthetic oligonucleotide
tagccttcgcgctgctggcatacagga

SEQ ID NO: 329136 - DNA, 27 bp, Artificial Sequence
  Description of Artificial Sequence: Synthetic oligonucleotide
agccttcgcgctgctggcatacaggaa

SEQ ID NO: 329137 - DNA, 26 bp, Artificial Sequence
  Description of Artificial Sequence: Synthetic oligonucleotide
gccttcgcgctgctggcatacaggaa

SEQ ID NO: 329138 - DNA, 27 bp, Artificial Sequence
  Description of Artificial Sequence: Synthetic oligonucleotide
ccttcgcgctgctggcatacaggaaga

SEQ ID NO: 329139 - DNA, 27 bp, Artificial Sequence
  Description of Artificial Sequence: Synthetic oligonucleotide
cttcgcgctgctggcatacaggaagag

SEQ ID NO: 329140 - DNA, 27 bp, Artificial Sequence
  Description of Artificial Sequence: Synthetic oligonucleotide
ttcgcgctgctggcatacaggaagagg

SEQ ID NO: 329141 - DNA, 26 bp, Artificial Sequence
  Description of Artificial Sequence: Synthetic oligonucleotide
tcgcgctgctggcatacaggaagagg

SEQ ID NO: 329142 - DNA, 25 bp, Artificial Sequence
  Description of Artificial Sequence: Synthetic oligonucleotide
cgcgctgctggcatacaggaagagg

SEQ ID NO: 329143 - DNA, 26 bp, Artificial Sequence
  Description of Artificial Sequence: Synthetic oligonucleotide
gcgctgctggcatacaggaagaggct

SEQ ID NO: 329144 - DNA, 27 bp, Artificial Sequence
  Description of Artificial Sequence: Synthetic oligonucleotide
cgctgctggcatacaggaagaggctga

SEQ ID NO: 329145 - DNA, 29 bp, Artificial Sequence
  Description of Artificial Sequence: Synthetic oligonucleotide
gctgctggcatacaggaagaggctgatac

SEQ ID NO: 329146 - DNA, 29 bp, Artificial Sequence
  Description of Artificial Sequence: Synthetic oligonucleotide
ctgctggcatacaggaagaggctgatacg

SEQ ID NO: 329147 - DNA, 29 bp, Artificial Sequence
  Description of Artificial Sequence: Synthetic oligonucleotide
tgctggcatacaggaagaggctgatacgg

SEQ ID NO: 329148 - DNA, 28 bp, Artificial Sequence
  Description of Artificial Sequence: Synthetic oligonucleotide
gctggcatacaggaagaggctgatacgg

SEQ ID NO: 329149 - DNA, 28 bp, Artificial Sequence
  Description of Artificial Sequence: Synthetic oligonucleotide
ctggcatacaggaagaggctgatacggc

SEQ ID NO: 329150 - DNA, 29 bp, Artificial Sequence
  Description of Artificial Sequence: Synthetic oligonucleotide
tggcatacaggaagaggctgatacggcac

SEQ ID NO: 329151 - DNA, 28 bp, Artificial Sequence
  Description of Artificial Sequence: Synthetic oligonucleotide
ggcatacaggaagaggctgatacggcac

SEQ ID NO: 329152 - DNA, 28 bp, Artificial Sequence
  Description of Artificial Sequence: Synthetic oligonucleotide
gcatacaggaagaggctgatacggcacc

SEQ ID NO: 329153 - DNA, 30 bp, Artificial Sequence
  Description of Artificial Sequence: Synthetic oligonucleotide
catacaggaagaggctgatacggcaccttg

SEQ ID NO: 329154 - DNA, 30 bp, Artificial Sequence
  Description of Artificial Sequence: Synthetic oligonucleotide
atacaggaagaggctgatacggcaccttgg

SEQ ID NO: 329155 - DNA, 29 bp, Artificial Sequence
  Description of Artificial Sequence: Synthetic oligonucleotide
tacaggaagaggctgatacggcaccttgg

SEQ ID NO: 329156 - DNA, 28 bp, Artificial Sequence
  Description of Artificial Sequence: Synthetic oligonucleotide
acaggaagaggctgatacggcaccttgg

SEQ ID NO: 329157 - DNA, 27 bp, Artificial Sequence
  Description of Artificial Sequence: Synthetic oligonucleotide
caggaagaggctgatacggcaccttgg

SEQ ID NO: 329158 - DNA, 27 bp, Artificial Sequence
  Description of Artificial Sequence: Synthetic oligonucleotide
aggaagaggctgatacggcaccttggg

SEQ ID NO: 329159 - DNA, 26 bp, Artificial Sequence
  Description of Artificial Sequence: Synthetic oligonucleotide
ggaagaggctgatacggcaccttggg

SEQ ID NO: 329160 - DNA, 27 bp, Artificial Sequence
  Description of Artificial Sequence: Synthetic oligonucleotide
gaagaggctgatacggcaccttgggga

SEQ ID NO: 329161 - DNA, 27 bp, Artificial Sequence
  Description of Artificial Sequence: Synthetic oligonucleotide
aagaggctgatacggcaccttggggag

SEQ ID NO: 329162 - DNA, 27 bp, Artificial Sequence
  Description of Artificial Sequence: Synthetic oligonucleotide
agaggctgatacggcaccttggggaga

SEQ ID NO: 329163 - DNA, 26 bp, Artificial Sequence
  Description of Artificial Sequence: Synthetic oligonucleotide
gaggctgatacggcaccttggggaga

SEQ ID NO: 329164 - DNA, 27 bp, Artificial Sequence
  Description of Artificial Sequence: Synthetic oligonucleotide
aggctgatacggcaccttggggagaca

SEQ ID NO: 329165 - DNA, 26 bp, Artificial Sequence
  Description of Artificial Sequence: Synthetic oligonucleotide
ggctgatacggcaccttggggagaca

SEQ ID NO: 329166 - DNA, 27 bp, Artificial Sequence
  Description of Artificial Sequence: Synthetic oligonucleotide
gctgatacggcaccttggggagacagt

SEQ ID NO: 329167 - DNA, 27 bp, Artificial Sequence
  Description of Artificial Sequence: Synthetic oligonucleotide
ctgatacggcaccttggggagacagtc

SEQ ID NO: 329168 - DNA, 27 bp, Artificial Sequence
  Description of Artificial Sequence: Synthetic oligonucleotide
tgatacggcaccttggggagacagtcc

SEQ ID NO: 329169 - DNA, 27 bp, Artificial Sequence
  Description of Artificial Sequence: Synthetic oligonucleotide
gatacggcaccttggggagacagtcct

SEQ ID NO: 329170 - DNA, 27 bp, Artificial Sequence
  Description of Artificial Sequence: Synthetic oligonucleotide
atacggcaccttggggagacagtcctg

SEQ ID NO: 329171 - DNA, 26 bp, Artificial Sequence
  Description of Artificial Sequence: Synthetic oligonucleotide
tacggcaccttggggagacagtcctg

SEQ ID NO: 329172 - DNA, 25 bp, Artificial Sequence
  Description of Artificial Sequence: Synthetic oligonucleotide
acggcaccttggggagacagtcctg

SEQ ID NO: 329173 - DNA, 24 bp, Artificial Sequence
  Description of Artificial Sequence: Synthetic oligonucleotide
cggcaccttggggagacagtcctg

SEQ ID NO: 329174 - DNA, 24 bp, Artificial Sequence
  Description of Artificial Sequence: Synthetic oligonucleotide
ggcaccttggggagacagtcctgc

SEQ ID NO: 329175 - DNA, 24 bp, Artificial Sequence
  Description of Artificial Sequence: Synthetic oligonucleotide
gcaccttggggagacagtcctgcc

SEQ ID NO: 329176 - DNA, 25 bp, Artificial Sequence
  Description of Artificial Sequence: Synthetic oligonucleotide
caccttggggagacagtcctgccct

SEQ ID NO: 329177 - DNA, 25 bp, Artificial Sequence
  Description of Artificial Sequence: Synthetic oligonucleotide
accttggggagacagtcctgccctg

SEQ ID NO: 329178 - DNA, 24 bp, Artificial Sequence
  Description of Artificial Sequence: Synthetic oligonucleotide
ccttggggagacagtcctgccctg

SEQ ID NO: 329179 - DNA, 24 bp, Artificial Sequence
  Description of Artificial Sequence: Synthetic oligonucleotide
cttggggagacagtcctgccctgc

SEQ ID NO: 329180 - DNA, 25 bp, Artificial Sequence
  Description of Artificial Sequence: Synthetic oligonucleotide
ttggggagacagtcctgccctgcct

SEQ ID NO: 329181 - DNA, 24 bp, Artificial Sequence
  Description of Artificial Sequence: Synthetic oligonucleotide
tggggagacagtcctgccctgcct

SEQ ID NO: 329182 - DNA, 23 bp, Artificial Sequence
  Description of Artificial Sequence: Synthetic oligonucleotide
ggggagacagtcctgccctgcct

SEQ ID NO: 329183 - DNA, 23 bp, Artificial Sequence
  Description of Artificial Sequence: Synthetic oligonucleotide
gggagacagtcctgccctgcctg

SEQ ID NO: 329184 - DNA, 24 bp, Artificial Sequence
  Description of Artificial Sequence: Synthetic oligonucleotide
ggagacagtcctgccctgcctgga

SEQ ID NO: 329185 - DNA, 24 bp, Artificial Sequence
  Description of Artificial Sequence: Synthetic oligonucleotide
gagacagtcctgccctgcctggac

SEQ ID NO: 329186 - DNA, 25 bp, Artificial Sequence
  Description of Artificial Sequence: Synthetic oligonucleotide
agacagtcctgccctgcctggacca

SEQ ID NO: 329187 - DNA, 24 bp, Artificial Sequence
  Description of Artificial Sequence: Synthetic oligonucleotide
gacagtcctgccctgcctggacca

SEQ ID NO: 329188 - DNA, 25 bp, Artificial Sequence
  Description of Artificial Sequence: Synthetic oligonucleotide
acagtcctgccctgcctggaccaca

SEQ ID NO: 329189 - DNA, 24 bp, Artificial Sequence
  Description of Artificial Sequence: Synthetic oligonucleotide
cagtcctgccctgcctggaccaca

SEQ ID NO: 329190 - DNA, 24 bp, Artificial Sequence
  Description of Artificial Sequence: Synthetic oligonucleotide
agtcctgccctgcctggaccacag

SEQ ID NO: 329191 - DNA, 23 bp, Artificial Sequence
  Description of Artificial Sequence: Synthetic oligonucleotide
gtcctgccctgcctggaccacag

SEQ ID NO: 329192 - DNA, 23 bp, Artificial Sequence
  Description of Artificial Sequence: Synthetic oligonucleotide
tcctgccctgcctggaccacagc

SEQ ID NO: 329193 - DNA, 22 bp, Artificial Sequence
  Description of Artificial Sequence: Synthetic oligonucleotide
cctgccctgcctggaccacagc

SEQ ID NO: 329194 - DNA, 22 bp, Artificial Sequence
  Description of Artificial Sequence: Synthetic oligonucleotide
ctgccctgcctggaccacagcc

SEQ ID NO: 329195 - DNA, 22 bp, Artificial Sequence
  Description of Artificial Sequence: Synthetic oligonucleotide
tgccctgcctggaccacagccc

SEQ ID NO: 329196 - DNA, 21 bp, Artificial Sequence
  Description of Artificial Sequence: Synthetic oligonucleotide
gccctgcctggaccacagccc

SEQ ID NO: 329197 - DNA, 21 bp, Artificial Sequence
  Description of Artificial Sequence: Synthetic oligonucleotide
ccctgcctggaccacagcccc

SEQ ID NO: 329198 - DNA, 22 bp, Artificial Sequence
  Description of Artificial Sequence: Synthetic oligonucleotide
cctgcctggaccacagccccca

SEQ ID NO: 329199 - DNA, 22 bp, Artificial Sequence
  Description of Artificial Sequence: Synthetic oligonucleotide
ctgcctggaccacagcccccac

SEQ ID NO: 329200 - DNA, 23 bp, Artificial Sequence
  Description of Artificial Sequence: Synthetic oligonucleotide
tgcctggaccacagcccccacca

SEQ ID NO: 329201 - DNA, 22 bp, Artificial Sequence
  Description of Artificial Sequence: Synthetic oligonucleotide
gcctggaccacagcccccacca

SEQ ID NO: 329202 - DNA, 24 bp, Artificial Sequence
  Description of Artificial Sequence: Synthetic oligonucleotide
cctggaccacagcccccaccagat

SEQ ID NO: 329203 - DNA, 26 bp, Artificial Sequence
  Description of Artificial Sequence: Synthetic oligonucleotide
ctggaccacagcccccaccagatctt

SEQ ID NO: 329204 - DNA, 27 bp, Artificial Sequence
  Description of Artificial Sequence: Synthetic oligonucleotide
tggaccacagcccccaccagatcttca

SEQ ID NO: 329205 - DNA, 27 bp, Artificial Sequence
  Description of Artificial Sequence: Synthetic oligonucleotide
ggaccacagcccccaccagatcttcat

SEQ ID NO: 329206 - DNA, 28 bp, Artificial Sequence
  Description of Artificial Sequence: Synthetic oligonucleotide
gaccacagcccccaccagatcttcattc

SEQ ID NO: 329207 - DNA, 28 bp, Artificial Sequence
  Description of Artificial Sequence: Synthetic oligonucleotide
accacagcccccaccagatcttcattcg

SEQ ID NO: 329208 - DNA, 27 bp, Artificial Sequence
  Description of Artificial Sequence: Synthetic oligonucleotide
ccacagcccccaccagatcttcattcg

SEQ ID NO: 329209 - DNA, 29 bp, Artificial Sequence
  Description of Artificial Sequence: Synthetic oligonucleotide
cacagcccccaccagatcttcattcgaag

SEQ ID NO: 329210 - DNA, 29 bp, Artificial Sequence
  Description of Artificial Sequence: Synthetic oligonucleotide
acagcccccaccagatcttcattcgaagc

SEQ ID NO: 329211 - DNA, 28 bp, Artificial Sequence
  Description of Artificial Sequence: Synthetic oligonucleotide
cagcccccaccagatcttcattcgaagc

SEQ ID NO: 329212 - DNA, 31 bp, Artificial Sequence
  Description of Artificial Sequence: Synthetic oligonucleotide
agcccccaccagatcttcattcgaagctttg

SEQ ID NO: 329213 - DNA, 30 bp, Artificial Sequence
  Description of Artificial Sequence: Synthetic oligonucleotide
gcccccaccagatcttcattcgaagctttg

SEQ ID NO: 329214 - DNA, 30 bp, Artificial Sequence
  Description of Artificial Sequence: Synthetic oligonucleotide
cccccaccagatcttcattcgaagctttgc

SEQ ID NO: 329215 - DNA, 30 bp, Artificial Sequence
  Description of Artificial Sequence: Synthetic oligonucleotide
ccccaccagatcttcattcgaagctttgcc

SEQ ID NO: 329216 - DNA, 30 bp, Artificial Sequence
  Description of Artificial Sequence: Synthetic oligonucleotide
cccaccagatcttcattcgaagctttgccc

SEQ ID NO: 329217 - DNA, 31 bp, Artificial Sequence
  Description of Artificial Sequence: Synthetic oligonucleotide
ccaccagatcttcattcgaagctttgcccag

SEQ ID NO: 329218 - DNA, 31 bp, Artificial Sequence
  Description of Artificial Sequence: Synthetic oligonucleotide
caccagatcttcattcgaagctttgcccagg

SEQ ID NO: 329219 - DNA, 32 bp, Artificial Sequence
  Description of Artificial Sequence: Synthetic oligonucleotide
accagatcttcattcgaagctttgcccaggtc

SEQ ID NO: 329220 - DNA, 31 bp, Artificial Sequence
  Description of Artificial Sequence: Synthetic oligonucleotide
ccagatcttcattcgaagctttgcccaggtc

SEQ ID NO: 329221 - DNA, 33 bp, Artificial Sequence
  Description of Artificial Sequence: Synthetic oligonucleotide
cagatcttcattcgaagctttgcccaggtcatg

SEQ ID NO: 329222 - DNA, 34 bp, Artificial Sequence
  Description of Artificial Sequence: Synthetic oligonucleotide
agatcttcattcgaagctttgcccaggtcatgtg

SEQ ID NO: 329223 - DNA, 33 bp, Artificial Sequence
  Description of Artificial Sequence: Synthetic oligonucleotide
gatcttcattcgaagctttgcccaggtcatgtg

SEQ ID NO: 329224 - DNA, 35 bp, Artificial Sequence
  Description of Artificial Sequence: Synthetic oligonucleotide
atcttcattcgaagctttgcccaggtcatgtgtag

SEQ ID NO: 329225 - DNA, 34 bp, Artificial Sequence
  Description of Artificial Sequence: Synthetic oligonucleotide
tcttcattcgaagctttgcccaggtcatgtgtag

SEQ ID NO: 329226 - DNA, 33 bp, Artificial Sequence
  Description of Artificial Sequence: Synthetic oligonucleotide
cttcattcgaagctttgcccaggtcatgtgtag

SEQ ID NO: 329227 - DNA, 33 bp, Artificial Sequence
  Description of Artificial Sequence: Synthetic oligonucleotide
ttcattcgaagctttgcccaggtcatgtgtagg

SEQ ID NO: 329228 - DNA, 32 bp, Artificial Sequence
  Description of Artificial Sequence: Synthetic oligonucleotide
tcattcgaagctttgcccaggtcatgtgtagg

SEQ ID NO: 329229 - DNA, 31 bp, Artificial Sequence
  Description of Artificial Sequence: Synthetic oligonucleotide
cattcgaagctttgcccaggtcatgtgtagg

SEQ ID NO: 329230 - DNA, 33 bp, Artificial Sequence
  Description of Artificial Sequence: Synthetic oligonucleotide
attcgaagctttgcccaggtcatgtgtaggtag

SEQ ID NO: 329231 - DNA, 32 bp, Artificial Sequence
  Description of Artificial Sequence: Synthetic oligonucleotide
ttcgaagctttgcccaggtcatgtgtaggtag

SEQ ID NO: 329232 - DNA, 31 bp, Artificial Sequence
  Description of Artificial Sequence: Synthetic oligonucleotide
tcgaagctttgcccaggtcatgtgtaggtag

SEQ ID NO: 329233 - DNA, 30 bp, Artificial Sequence
  Description of Artificial Sequence: Synthetic oligonucleotide
cgaagctttgcccaggtcatgtgtaggtag

SEQ ID NO: 329234 - DNA, 30 bp, Artificial Sequence
  Description of Artificial Sequence: Synthetic oligonucleotide
gaagctttgcccaggtcatgtgtaggtagc

SEQ ID NO: 329235 - DNA, 30 bp, Artificial Sequence
  Description of Artificial Sequence: Synthetic oligonucleotide
aagctttgcccaggtcatgtgtaggtagcc

SEQ ID NO: 329236 - DNA, 29 bp, Artificial Sequence
  Description of Artificial Sequence: Synthetic oligonucleotide
agctttgcccaggtcatgtgtaggtagcc

SEQ ID NO: 329237 - DNA, 28 bp, Artificial Sequence
  Description of Artificial Sequence: Synthetic oligonucleotide
gctttgcccaggtcatgtgtaggtagcc

SEQ ID NO: 329238 - DNA, 28 bp, Artificial Sequence
  Description of Artificial Sequence: Synthetic oligonucleotide
ctttgcccaggtcatgtgtaggtagccc

SEQ ID NO: 329239 - DNA, 29 bp, Artificial Sequence
  Description of Artificial Sequence: Synthetic oligonucleotide
tttgcccaggtcatgtgtaggtagcccag

SEQ ID NO: 329240 - DNA, 28 bp, Artificial Sequence
  Description of Artificial Sequence: Synthetic oligonucleotide
ttgcccaggtcatgtgtaggtagcccag

SEQ ID NO: 329241 - DNA, 27 bp, Artificial Sequence
  Description of Artificial Sequence: Synthetic oligonucleotide
tgcccaggtcatgtgtaggtagcccag

SEQ ID NO: 329242 - DNA, 26 bp, Artificial Sequence
  Description of Artificial Sequence: Synthetic oligonucleotide
gcccaggtcatgtgtaggtagcccag

SEQ ID NO: 329243 - DNA, 26 bp, Artificial Sequence
  Description of Artificial Sequence: Synthetic oligonucleotide
cccaggtcatgtgtaggtagcccagc

SEQ ID NO: 329244 - DNA, 26 bp, Artificial Sequence
  Description of Artificial Sequence: Synthetic oligonucleotide
ccaggtcatgtgtaggtagcccagcc

SEQ ID NO: 329245 - DNA, 26 bp, Artificial Sequence
  Description of Artificial Sequence: Synthetic oligonucleotide
caggtcatgtgtaggtagcccagccg

SEQ ID NO: 329246 - DNA, 26 bp, Artificial Sequence
  Description of Artificial Sequence: Synthetic oligonucleotide
aggtcatgtgtaggtagcccagccgc

SEQ ID NO: 329247 - DNA, 25 bp, Artificial Sequence
  Description of Artificial Sequence: Synthetic oligonucleotide
ggtcatgtgtaggtagcccagccgc

SEQ ID NO: 329248 - DNA, 26 bp, Artificial Sequence
  Description of Artificial Sequence: Synthetic oligonucleotide
gtcatgtgtaggtagcccagccgcca

SEQ ID NO: 329249 - DNA, 26 bp, Artificial Sequence
  Description of Artificial Sequence: Synthetic oligonucleotide
tcatgtgtaggtagcccagccgccag

SEQ ID NO: 329250 - DNA, 25 bp, Artificial Sequence
  Description of Artificial Sequence: Synthetic oligonucleotide
catgtgtaggtagcccagccgccag

SEQ ID NO: 329251 - DNA, 26 bp, Artificial Sequence
  Description of Artificial Sequence: Synthetic oligonucleotide
atgtgtaggtagcccagccgccagga

SEQ ID NO: 329252 - DNA, 25 bp, Artificial Sequence
  Description of Artificial Sequence: Synthetic oligonucleotide
tgtgtaggtagcccagccgccagga

SEQ ID NO: 329253 - DNA, 24 bp, Artificial Sequence
  Description of Artificial Sequence: Synthetic oligonucleotide
gtgtaggtagcccagccgccagga

SEQ ID NO: 329254 - DNA, 25 bp, Artificial Sequence
  Description of Artificial Sequence: Synthetic oligonucleotide
tgtaggtagcccagccgccaggact

SEQ ID NO: 329255 - DNA, 24 bp, Artificial Sequence
  Description of Artificial Sequence: Synthetic oligonucleotide
gtaggtagcccagccgccaggact

SEQ ID NO: 329256 - DNA, 25 bp, Artificial Sequence
  Description of Artificial Sequence: Synthetic oligonucleotide
taggtagcccagccgccaggactca

SEQ ID NO: 329257 - DNA, 24 bp, Artificial Sequence
  Description of Artificial Sequence: Synthetic oligonucleotide
aggtagcccagccgccaggactca

SEQ ID NO: 329258 - DNA, 23 bp, Artificial Sequence
  Description of Artificial Sequence: Synthetic oligonucleotide
ggtagcccagccgccaggactca

SEQ ID NO: 329259 - DNA, 24 bp, Artificial Sequence
  Description of Artificial Sequence: Synthetic oligonucleotide
gtagcccagccgccaggactcaca

SEQ ID NO: 329260 - DNA, 24 bp, Artificial Sequence
  Description of Artificial Sequence: Synthetic oligonucleotide
tagcccagccgccaggactcacac

SEQ ID NO: 329261 - DNA, 23 bp, Artificial Sequence
  Description of Artificial Sequence: Synthetic oligonucleotide
agcccagccgccaggactcacac

SEQ ID NO: 329262 - DNA, 22 bp, Artificial Sequence
  Description of Artificial Sequence: Synthetic oligonucleotide
gcccagccgccaggactcacac

SEQ ID NO: 329263 - DNA, 23 bp, Artificial Sequence
  Description of Artificial Sequence: Synthetic oligonucleotide
cccagccgccaggactcacacga

SEQ ID NO: 329264 - DNA, 24 bp, Artificial Sequence
  Description of Artificial Sequence: Synthetic oligonucleotide
ccagccgccaggactcacacgaca

SEQ ID NO: 329265 - DNA, 25 bp, Artificial Sequence
  Description of Artificial Sequence: Synthetic oligonucleotide
cagccgccaggactcacacgacact

SEQ ID NO: 329266 - DNA, 26 bp, Artificial Sequence
  Description of Artificial Sequence: Synthetic oligonucleotide
agccgccaggactcacacgacactga

SEQ ID NO: 329267 - DNA, 25 bp, Artificial Sequence
  Description of Artificial Sequence: Synthetic oligonucleotide
gccgccaggactcacacgacactga

SEQ ID NO: 329268 - DNA, 26 bp, Artificial Sequence
  Description of Artificial Sequence: Synthetic oligonucleotide
ccgccaggactcacacgacactgaca

SEQ ID NO: 329269 - DNA, 26 bp, Artificial Sequence
  Description of Artificial Sequence: Synthetic oligonucleotide
cgccaggactcacacgacactgacag

SEQ ID NO: 329270 - DNA, 26 bp, Artificial Sequence
  Description of Artificial Sequence: Synthetic oligonucleotide
gccaggactcacacgacactgacagc

SEQ ID NO: 329271 - DNA, 26 bp, Artificial Sequence
  Description of Artificial Sequence: Synthetic oligonucleotide
ccaggactcacacgacactgacagcc

SEQ ID NO: 329272 - DNA, 27 bp, Artificial Sequence
  Description of Artificial Sequence: Synthetic oligonucleotide
caggactcacacgacactgacagccct

SEQ ID NO: 329273 - DNA, 27 bp, Artificial Sequence
  Description of Artificial Sequence: Synthetic oligonucleotide
aggactcacacgacactgacagccctc

SEQ ID NO: 329274 - DNA, 26 bp, Artificial Sequence
  Description of Artificial Sequence: Synthetic oligonucleotide
ggactcacacgacactgacagccctc

SEQ ID NO: 329275 - DNA, 27 bp, Artificial Sequence
  Description of Artificial Sequence: Synthetic oligonucleotide
gactcacacgacactgacagccctcga

SEQ ID NO: 329276 - DNA, 27 bp, Artificial Sequence
  Description of Artificial Sequence: Synthetic oligonucleotide
actcacacgacactgacagccctcgac

SEQ ID NO: 329277 - DNA, 27 bp, Artificial Sequence
  Description of Artificial Sequence: Synthetic oligonucleotide
ctcacacgacactgacagccctcgaca

SEQ ID NO: 329278 - DNA, 27 bp, Artificial Sequence
  Description of Artificial Sequence: Synthetic oligonucleotide
tcacacgacactgacagccctcgacac

SEQ ID NO: 329279 - DNA, 26 bp, Artificial Sequence
  Description of Artificial Sequence: Synthetic oligonucleotide
cacacgacactgacagccctcgacac

SEQ ID NO: 329280 - DNA, 27 bp, Artificial Sequence
  Description of Artificial Sequence: Synthetic oligonucleotide
acacgacactgacagccctcgacacct

SEQ ID NO: 329281 - DNA, 26 bp, Artificial Sequence
  Description of Artificial Sequence: Synthetic oligonucleotide
cacgacactgacagccctcgacacct

SEQ ID NO: 329282 - DNA, 26 bp, Artificial Sequence
  Description of Artificial Sequence: Synthetic oligonucleotide
acgacactgacagccctcgacacctc

SEQ ID NO: 329283 - DNA, 25 bp, Artificial Sequence
  Description of Artificial Sequence: Synthetic oligonucleotide
cgacactgacagccctcgacacctc

SEQ ID NO: 329284 - DNA, 25 bp, Artificial Sequence
  Description of Artificial Sequence: Synthetic oligonucleotide
gacactgacagccctcgacacctcc

SEQ ID NO: 329285 - DNA, 26 bp, Artificial Sequence
  Description of Artificial Sequence: Synthetic oligonucleotide
acactgacagccctcgacacctccgt

SEQ ID NO: 329286 - DNA, 25 bp, Artificial Sequence
  Description of Artificial Sequence: Synthetic oligonucleotide
cactgacagccctcgacacctccgt

SEQ ID NO: 329287 - DNA, 26 bp, Artificial Sequence
  Description of Artificial Sequence: Synthetic oligonucleotide
actgacagccctcgacacctccgtgt

SEQ ID NO: 329288 - DNA, 25 bp, Artificial Sequence
  Description of Artificial Sequence: Synthetic oligonucleotide
ctgacagccctcgacacctccgtgt

SEQ ID NO: 329289 - DNA, 25 bp, Artificial Sequence
  Description of Artificial Sequence: Synthetic oligonucleotide
tgacagccctcgacacctccgtgtc

SEQ ID NO: 329290 - DNA, 24 bp, Artificial Sequence
  Description of Artificial Sequence: Synthetic oligonucleotide
gacagccctcgacacctccgtgtc

SEQ ID NO: 329291 - DNA, 25 bp, Artificial Sequence
  Description of Artificial Sequence: Synthetic oligonucleotide
acagccctcgacacctccgtgtcca

SEQ ID NO: 329292 - DNA, 24 bp, Artificial Sequence
  Description of Artificial Sequence: Synthetic oligonucleotide
cagccctcgacacctccgtgtcca

SEQ ID NO: 329293 - DNA, 24 bp, Artificial Sequence
  Description of Artificial Sequence: Synthetic oligonucleotide
agccctcgacacctccgtgtccac

SEQ ID NO: 329294 - DNA, 23 bp, Artificial Sequence
  Description of Artificial Sequence: Synthetic oligonucleotide
gccctcgacacctccgtgtccac

SEQ ID NO: 329295 - DNA, 23 bp, Artificial Sequence
  Description of Artificial Sequence: Synthetic oligonucleotide
ccctcgacacctccgtgtccacg

SEQ ID NO: 329296 - DNA, 23 bp, Artificial Sequence
  Description of Artificial Sequence: Synthetic oligonucleotide
cctcgacacctccgtgtccacgg

SEQ ID NO: 329297 - DNA, 23 bp, Artificial Sequence
  Description of Artificial Sequence: Synthetic oligonucleotide
ctcgacacctccgtgtccacggg

SEQ ID NO: 329298 - DNA, 23 bp, Artificial Sequence
  Description of Artificial Sequence: Synthetic oligonucleotide
tcgacacctccgtgtccacgggg

SEQ ID NO: 329299 - DNA, 22 bp, Artificial Sequence
  Description of Artificial Sequence: Synthetic oligonucleotide
cgacacctccgtgtccacgggg

SEQ ID NO: 329300 - DNA, 22 bp, Artificial Sequence
  Description of Artificial Sequence: Synthetic oligonucleotide
gacacctccgtgtccacggggc

SEQ ID NO: 329301 - DNA, 22 bp, Artificial Sequence
  Description of Artificial Sequence: Synthetic oligonucleotide
acacctccgtgtccacggggcc

SEQ ID NO: 329302 - DNA, 21 bp, Artificial Sequence
  Description of Artificial Sequence: Synthetic oligonucleotide
cacctccgtgtccacggggcc

SEQ ID NO: 329303 - DNA, 22 bp, Artificial Sequence
  Description of Artificial Sequence: Synthetic oligonucleotide
acctccgtgtccacggggccct

SEQ ID NO: 329304 - DNA, 21 bp, Artificial Sequence
  Description of Artificial Sequence: Synthetic oligonucleotide
cctccgtgtccacggggccct

SEQ ID NO: 329305 - DNA, 22 bp, Artificial Sequence
  Description of Artificial Sequence: Synthetic oligonucleotide
ctccgtgtccacggggccctca

SEQ ID NO: 329306 - DNA, 22 bp, Artificial Sequence
  Description of Artificial Sequence: Synthetic oligonucleotide
tccgtgtccacggggccctcag

SEQ ID NO: 329307 - DNA, 21 bp, Artificial Sequence
  Description of Artificial Sequence: Synthetic oligonucleotide
ccgtgtccacggggccctcag

SEQ ID NO: 329308 - DNA, 22 bp, Artificial Sequence
  Description of Artificial Sequence: Synthetic oligonucleotide
cgtgtccacggggccctcagca

SEQ ID NO: 329309 - DNA, 22 bp, Artificial Sequence
  Description of Artificial Sequence: Synthetic oligonucleotide
gtgtccacggggccctcagcac

SEQ ID NO: 329310 - DNA, 23 bp, Artificial Sequence
  Description of Artificial Sequence: Synthetic oligonucleotide
tgtccacggggccctcagcacca

SEQ ID NO: 329311 - DNA, 22 bp, Artificial Sequence
  Description of Artificial Sequence: Synthetic oligonucleotide
gtccacggggccctcagcacca

SEQ ID NO: 329312 - DNA, 22 bp, Artificial Sequence
  Description of Artificial Sequence: Synthetic oligonucleotide
tccacggggccctcagcaccac

SEQ ID NO: 329313 - DNA, 21 bp, Artificial Sequence
  Description of Artificial Sequence: Synthetic oligonucleotide
ccacggggccctcagcaccac

SEQ ID NO: 329314 - DNA, 21 bp, Artificial Sequence
  Description of Artificial Sequence: Synthetic oligonucleotide
cacggggccctcagcaccacc

SEQ ID NO: 329315 - DNA, 21 bp, Artificial Sequence
  Description of Artificial Sequence: Synthetic oligonucleotide
acggggccctcagcaccaccc

SEQ ID NO: 329316 - DNA, 20 bp, Artificial Sequence
  Description of Artificial Sequence: Synthetic oligonucleotide
cggggccctcagcaccaccc

SEQ ID NO: 329317 - DNA, 21 bp, Artificial Sequence
  Description of Artificial Sequence: Synthetic oligonucleotide
ggggccctcagcaccacccca

SEQ ID NO: 329318 - DNA, 21 bp, Artificial Sequence
  Description of Artificial Sequence: Synthetic oligonucleotide
gggccctcagcaccaccccag

SEQ ID NO: 329319 - DNA, 21 bp, Artificial Sequence
  Description of Artificial Sequence: Synthetic oligonucleotide
ggccctcagcaccaccccagc

SEQ ID NO: 329320 - DNA, 24 bp, Artificial Sequence
  Description of Artificial Sequence: Synthetic oligonucleotide
gccctcagcaccaccccagcgttt

SEQ ID NO: 329321 - DNA, 24 bp, Artificial Sequence
  Description of Artificial Sequence: Synthetic oligonucleotide
ccctcagcaccaccccagcgtttg

SEQ ID NO: 329322 - DNA, 24 bp, Artificial Sequence
  Description of Artificial Sequence: Synthetic oligonucleotide
cctcagcaccaccccagcgtttgc

SEQ ID NO: 329323 - DNA, 25 bp, Artificial Sequence
  Description of Artificial Sequence: Synthetic oligonucleotide
ctcagcaccaccccagcgtttgcca

SEQ ID NO: 329324 - DNA, 25 bp, Artificial Sequence
  Description of Artificial Sequence: Synthetic oligonucleotide
tcagcaccaccccagcgtttgccag

SEQ ID NO: 329325 - DNA, 24 bp, Artificial Sequence
  Description of Artificial Sequence: Synthetic oligonucleotide
cagcaccaccccagcgtttgccag

SEQ ID NO: 329326 - DNA, 27 bp, Artificial Sequence
  Description of Artificial Sequence: Synthetic oligonucleotide
agcaccaccccagcgtttgccaggaat

SEQ ID NO: 329327 - DNA, 27 bp, Artificial Sequence
  Description of Artificial Sequence: Synthetic oligonucleotide
gcaccaccccagcgtttgccaggaatt

SEQ ID NO: 329328 - DNA, 28 bp, Artificial Sequence
  Description of Artificial Sequence: Synthetic oligonucleotide
caccaccccagcgtttgccaggaatttc

SEQ ID NO: 329329 - DNA, 28 bp, Artificial Sequence
  Description of Artificial Sequence: Synthetic oligonucleotide
accaccccagcgtttgccaggaatttcc

SEQ ID NO: 329330 - DNA, 27 bp, Artificial Sequence
  Description of Artificial Sequence: Synthetic oligonucleotide
ccaccccagcgtttgccaggaatttcc

SEQ ID NO: 329331 - DNA, 27 bp, Artificial Sequence
  Description of Artificial Sequence: Synthetic oligonucleotide
caccccagcgtttgccaggaatttccg

SEQ ID NO: 329332 - DNA, 27 bp, Artificial Sequence
  Description of Artificial Sequence: Synthetic oligonucleotide
accccagcgtttgccaggaatttccgc

SEQ ID NO: 329333 - DNA, 27 bp, Artificial Sequence
  Description of Artificial Sequence: Synthetic oligonucleotide
ccccagcgtttgccaggaatttccgct

SEQ ID NO: 329334 - DNA, 27 bp, Artificial Sequence
  Description of Artificial Sequence: Synthetic oligonucleotide
cccagcgtttgccaggaatttccgctc

SEQ ID NO: 329335 - DNA, 28 bp, Artificial Sequence
  Description of Artificial Sequence: Synthetic oligonucleotide
ccagcgtttgccaggaatttccgctctg

SEQ ID NO: 329336 - DNA, 28 bp, Artificial Sequence
  Description of Artificial Sequence: Synthetic oligonucleotide
cagcgtttgccaggaatttccgctctgc

SEQ ID NO: 329337 - DNA, 29 bp, Artificial Sequence
  Description of Artificial Sequence: Synthetic oligonucleotide
agcgtttgccaggaatttccgctctgcac

SEQ ID NO: 329338 - DNA, 28 bp, Artificial Sequence
  Description of Artificial Sequence: Synthetic oligonucleotide
gcgtttgccaggaatttccgctctgcac

SEQ ID NO: 329339 - DNA, 28 bp, Artificial Sequence
  Description of Artificial Sequence: Synthetic oligonucleotide
cgtttgccaggaatttccgctctgcacg

SEQ ID NO: 329340 - DNA, 29 bp, Artificial Sequence
  Description of Artificial Sequence: Synthetic oligonucleotide
gtttgccaggaatttccgctctgcacgtg

SEQ ID NO: 329341 - DNA, 29 bp, Artificial Sequence
  Description of Artificial Sequence: Synthetic oligonucleotide
tttgccaggaatttccgctctgcacgtgg

SEQ ID NO: 329342 - DNA, 28 bp, Artificial Sequence
  Description of Artificial Sequence: Synthetic oligonucleotide
ttgccaggaatttccgctctgcacgtgg

SEQ ID NO: 329343 - DNA, 27 bp, Artificial Sequence
  Description of Artificial Sequence: Synthetic oligonucleotide
tgccaggaatttccgctctgcacgtgg

SEQ ID NO: 329344 - DNA, 27 bp, Artificial Sequence
  Description of Artificial Sequence: Synthetic oligonucleotide
gccaggaatttccgctctgcacgtgga

SEQ ID NO: 329345 - DNA, 27 bp, Artificial Sequence
  Description of Artificial Sequence: Synthetic oligonucleotide
ccaggaatttccgctctgcacgtggag

SEQ ID NO: 329346 - DNA, 27 bp, Artificial Sequence
  Description of Artificial Sequence: Synthetic oligonucleotide
caggaatttccgctctgcacgtggagc

SEQ ID NO: 329347 - DNA, 28 bp, Artificial Sequence
  Description of Artificial Sequence: Synthetic oligonucleotide
aggaatttccgctctgcacgtggagctc

SEQ ID NO: 329348 - DNA, 27 bp, Artificial Sequence
  Description of Artificial Sequence: Synthetic oligonucleotide
ggaatttccgctctgcacgtggagctc

SEQ ID NO: 329349 - DNA, 28 bp, Artificial Sequence
  Description of Artificial Sequence: Synthetic oligonucleotide
gaatttccgctctgcacgtggagctctc

SEQ ID NO: 329350 - DNA, 30 bp, Artificial Sequence
  Description of Artificial Sequence: Synthetic oligonucleotide
aatttccgctctgcacgtggagctctcttg

SEQ ID NO: 329351 - DNA, 29 bp, Artificial Sequence
  Description of Artificial Sequence: Synthetic oligonucleotide
atttccgctctgcacgtggagctctcttg

SEQ ID NO: 329352 - DNA, 28 bp, Artificial Sequence
  Description of Artificial Sequence: Synthetic oligonucleotide
tttccgctctgcacgtggagctctcttg

SEQ ID NO: 329353 - DNA, 27 bp, Artificial Sequence
  Description of Artificial Sequence: Synthetic oligonucleotide
ttccgctctgcacgtggagctctcttg

SEQ ID NO: 329354 - DNA, 27 bp, Artificial Sequence
  Description of Artificial Sequence: Synthetic oligonucleotide
tccgctctgcacgtggagctctcttgt

SEQ ID NO: 329355 - DNA, 27 bp, Artificial Sequence
  Description of Artificial Sequence: Synthetic oligonucleotide
ccgctctgcacgtggagctctcttgta

SEQ ID NO: 329356 - DNA, 27 bp, Artificial Sequence
  Description of Artificial Sequence: Synthetic oligonucleotide
cgctctgcacgtggagctctcttgtac

SEQ ID NO: 329357 - DNA, 27 bp, Artificial Sequence
  Description of Artificial Sequence: Synthetic oligonucleotide
gctctgcacgtggagctctcttgtacc

SEQ ID NO: 329358 - DNA, 27 bp, Artificial Sequence
  Description of Artificial Sequence: Synthetic oligonucleotide
ctctgcacgtggagctctcttgtaccc

SEQ ID NO: 329359 - DNA, 27 bp, Artificial Sequence
  Description of Artificial Sequence: Synthetic oligonucleotide
tctgcacgtggagctctcttgtacccc

SEQ ID NO: 329360 - DNA, 27 bp, Artificial Sequence
  Description of Artificial Sequence: Synthetic oligonucleotide
ctgcacgtggagctctcttgtacccct

SEQ ID NO: 329361 - DNA, 27 bp, Artificial Sequence
  Description of Artificial Sequence: Synthetic oligonucleotide
tgcacgtggagctctcttgtacccctc

SEQ ID NO: 329362 - DNA, 26 bp, Artificial Sequence
  Description of Artificial Sequence: Synthetic oligonucleotide
gcacgtggagctctcttgtacccctc

SEQ ID NO: 329363 - DNA, 27 bp, Artificial Sequence
  Description of Artificial Sequence: Synthetic oligonucleotide
cacgtggagctctcttgtacccctcca

SEQ ID NO: 329364 - DNA, 27 bp, Artificial Sequence
  Description of Artificial Sequence: Synthetic oligonucleotide
acgtggagctctcttgtacccctccac

SEQ ID NO: 329365 - DNA, 26 bp, Artificial Sequence
  Description of Artificial Sequence: Synthetic oligonucleotide
cgtggagctctcttgtacccctccac

SEQ ID NO: 329366 - DNA, 26 bp, Artificial Sequence
  Description of Artificial Sequence: Synthetic oligonucleotide
gtggagctctcttgtacccctccacc

SEQ ID NO: 329367 - DNA, 26 bp, Artificial Sequence
  Description of Artificial Sequence: Synthetic oligonucleotide
tggagctctcttgtacccctccaccc

SEQ ID NO: 329368 - DNA, 25 bp, Artificial Sequence
  Description of Artificial Sequence: Synthetic oligonucleotide
ggagctctcttgtacccctccaccc

SEQ ID NO: 329369 - DNA, 25 bp, Artificial Sequence
  Description of Artificial Sequence: Synthetic oligonucleotide
gagctctcttgtacccctccacccg

SEQ ID NO: 329370 - DNA, 26 bp, Artificial Sequence
  Description of Artificial Sequence: Synthetic oligonucleotide
agctctcttgtacccctccacccgct

SEQ ID NO: 329371 - DNA, 25 bp, Artificial Sequence
  Description of Artificial Sequence: Synthetic oligonucleotide
gctctcttgtacccctccacccgct

SEQ ID NO: 329372 - DNA, 25 bp, Artificial Sequence
  Description of Artificial Sequence: Synthetic oligonucleotide
ctctcttgtacccctccacccgctg

SEQ ID NO: 329373 - DNA, 25 bp, Artificial Sequence
  Description of Artificial Sequence: Synthetic oligonucleotide
tctcttgtacccctccacccgctgc

SEQ ID NO: 329374 - DNA, 24 bp, Artificial Sequence
  Description of Artificial Sequence: Synthetic oligonucleotide
ctcttgtacccctccacccgctgc

SEQ ID NO: 329375 - DNA, 25 bp, Artificial Sequence
  Description of Artificial Sequence: Synthetic oligonucleotide
tcttgtacccctccacccgctgcca

SEQ ID NO: 329376 - DNA, 24 bp, Artificial Sequence
  Description of Artificial Sequence: Synthetic oligonucleotide
cttgtacccctccacccgctgcca

SEQ ID NO: 329377 - DNA, 24 bp, Artificial Sequence
  Description of Artificial Sequence: Synthetic oligonucleotide
ttgtacccctccacccgctgccac

SEQ ID NO: 329378 - DNA, 23 bp, Artificial Sequence
  Description of Artificial Sequence: Synthetic oligonucleotide
tgtacccctccacccgctgccac

SEQ ID NO: 329379 - DNA, 22 bp, Artificial Sequence
  Description of Artificial Sequence: Synthetic oligonucleotide
gtacccctccacccgctgccac

SEQ ID NO: 329380 - DNA, 23 bp, Artificial Sequence
  Description of Artificial Sequence: Synthetic oligonucleotide
tacccctccacccgctgccacct

SEQ ID NO: 329381 - DNA, 22 bp, Artificial Sequence
  Description of Artificial Sequence: Synthetic oligonucleotide
acccctccacccgctgccacct

SEQ ID NO: 329382 - DNA, 21 bp, Artificial Sequence
  Description of Artificial Sequence: Synthetic oligonucleotide
cccctccacccgctgccacct

SEQ ID NO: 329383 - DNA, 22 bp, Artificial Sequence
  Description of Artificial Sequence: Synthetic oligonucleotide
ccctccacccgctgccacctct

SEQ ID NO: 329384 - DNA, 22 bp, Artificial Sequence
  Description of Artificial Sequence: Synthetic oligonucleotide
cctccacccgctgccacctctg

SEQ ID NO: 329385 - DNA, 25 bp, Artificial Sequence
  Description of Artificial Sequence: Synthetic oligonucleotide
ctccacccgctgccacctctggtaa

SEQ ID NO: 329386 - DNA, 26 bp, Artificial Sequence
  Description of Artificial Sequence: Synthetic oligonucleotide
atgggggccacttctccaacaagccc

SEQ ID NO: 329387 - DNA, 25 bp, Artificial Sequence
  Description of Artificial Sequence: Synthetic oligonucleotide
tgggggccacttctccaacaagccc

SEQ ID NO: 329388 - DNA, 24 bp, Artificial Sequence
  Description of Artificial Sequence: Synthetic oligonucleotide
gggggccacttctccaacaagccc

SEQ ID NO: 329389 - DNA, 24 bp, Artificial Sequence
  Description of Artificial Sequence: Synthetic oligonucleotide
ggggccacttctccaacaagcccg

SEQ ID NO: 329390 - DNA, 25 bp, Artificial Sequence
  Description of Artificial Sequence: Synthetic oligonucleotide
gggccacttctccaacaagcccgga

SEQ ID NO: 329391 - DNA, 25 bp, Artificial Sequence
  Description of Artificial Sequence: Synthetic oligonucleotide
ggccacttctccaacaagcccggac

SEQ ID NO: 329392 - DNA, 25 bp, Artificial Sequence
  Description of Artificial Sequence: Synthetic oligonucleotide
gccacttctccaacaagcccggacc

SEQ ID NO: 329393 - DNA, 26 bp, Artificial Sequence
  Description of Artificial Sequence: Synthetic oligonucleotide
ccacttctccaacaagcccggaccct

SEQ ID NO: 329394 - DNA, 27 bp, Artificial Sequence
  Description of Artificial Sequence: Synthetic oligonucleotide
cacttctccaacaagcccggaccctgt

SEQ ID NO: 329395 - DNA, 27 bp, Artificial Sequence
  Description of Artificial Sequence: Synthetic oligonucleotide
acttctccaacaagcccggaccctgtc

SEQ ID NO: 329396 - DNA, 26 bp, Artificial Sequence
  Description of Artificial Sequence: Synthetic oligonucleotide
cttctccaacaagcccggaccctgtc

SEQ ID NO: 329397 - DNA, 26 bp, Artificial Sequence
  Description of Artificial Sequence: Synthetic oligonucleotide
ttctccaacaagcccggaccctgtcg

SEQ ID NO: 329398 - DNA, 25 bp, Artificial Sequence
  Description of Artificial Sequence: Synthetic oligonucleotide
tctccaacaagcccggaccctgtcg

SEQ ID NO: 329399 - DNA, 24 bp, Artificial Sequence
  Description of Artificial Sequence: Synthetic oligonucleotide
ctccaacaagcccggaccctgtcg

SEQ ID NO: 329400 - DNA, 24 bp, Artificial Sequence
  Description of Artificial Sequence: Synthetic oligonucleotide
tccaacaagcccggaccctgtcgg

SEQ ID NO: 329401 - DNA, 23 bp, Artificial Sequence
  Description of Artificial Sequence: Synthetic oligonucleotide
ccaacaagcccggaccctgtcgg

SEQ ID NO: 329402 - DNA, 23 bp, Artificial Sequence
  Description of Artificial Sequence: Synthetic oligonucleotide
caacaagcccggaccctgtcggg

SEQ ID NO: 329403 - DNA, 23 bp, Artificial Sequence
  Description of Artificial Sequence: Synthetic oligonucleotide
aacaagcccggaccctgtcgggg

SEQ ID NO: 329404 - DNA, 22 bp, Artificial Sequence
  Description of Artificial Sequence: Synthetic oligonucleotide
acaagcccggaccctgtcgggg

SEQ ID NO: 329405 - DNA, 21 bp, Artificial Sequence
  Description of Artificial Sequence: Synthetic oligonucleotide
caagcccggaccctgtcgggg

SEQ ID NO: 329406 - DNA, 21 bp, Artificial Sequence
  Description of Artificial Sequence: Synthetic oligonucleotide
aagcccggaccctgtcggggc

SEQ ID NO: 329407 - DNA, 20 bp, Artificial Sequence
  Description of Artificial Sequence: Synthetic oligonucleotide
agcccggaccctgtcggggc

SEQ ID NO: 329408 - DNA, 20 bp, Artificial Sequence
  Description of Artificial Sequence: Synthetic oligonucleotide
gcccggaccctgtcggggct

SEQ ID NO: 329409 - DNA, 20 bp, Artificial Sequence
  Description of Artificial Sequence: Synthetic oligonucleotide
cccggaccctgtcggggcgt

SEQ ID NO: 329410 - DNA, 20 bp, Artificial Sequence
  Description of Artificial Sequence: Synthetic oligonucleotide
ccggaccctgtcggggcgct

SEQ ID NO: 329411 - DNA, 20 bp, Artificial Sequence
  Description of Artificial Sequence: Synthetic oligonucleotide
cggaccctgtcggggcgcct

SEQ ID NO: 329412 - DNA, 20 bp, Artificial Sequence
  Description of Artificial Sequence: Synthetic oligonucleotide
ggaccctgtcggggcgccgt

SEQ ID NO: 329413 - DNA, 20 bp, Artificial Sequence
  Description of Artificial Sequence: Synthetic oligonucleotide
gaccctgtcggggcgccggt

SEQ ID NO: 329414 - DNA, 20 bp, Artificial Sequence
  Description of Artificial Sequence: Synthetic oligonucleotide
accctgtcggggcgccggct

SEQ ID NO: 329415 - DNA, 20 bp, Artificial Sequence
  Description of Artificial Sequence: Synthetic oligonucleotide
ccctgtcggggcgccggctt

SEQ ID NO: 329416 - DNA, 20 bp, Artificial Sequence
  Description of Artificial Sequence: Synthetic oligonucleotide
cctgtcggggcgccggcgtt

SEQ ID NO: 329417 - DNA, 20 bp, Artificial Sequence
  Description of Artificial Sequence: Synthetic oligonucleotide
ctgtcggggcgccggcgctt

SEQ ID NO: 329418 - DNA, 20 bp, Artificial Sequence
  Description of Artificial Sequence: Synthetic oligonucleotide
tgtcggggcgccggcgcgtt

SEQ ID NO: 329419 - DNA, 20 bp, Artificial Sequence
  Description of Artificial Sequence: Synthetic oligonucleotide
gtcggggcgccggcgcgttt

SEQ ID NO: 329420 - DNA, 20 bp, Artificial Sequence
  Description of Artificial Sequence: Synthetic oligonucleotide
tcggggcgccggcgcgcttt

SEQ ID NO: 329421 - DNA, 20 bp, Artificial Sequence
  Description of Artificial Sequence: Synthetic oligonucleotide
cggggcgccggcgcgctttt

SEQ ID NO: 329422 - DNA, 20 bp, Artificial Sequence
  Description of Artificial Sequence: Synthetic oligonucleotide
ggggcgccggcgcgcgtttt

SEQ ID NO: 329423 - DNA, 20 bp, Artificial Sequence
  Description of Artificial Sequence: Synthetic oligonucleotide
gggcgccggcgcgcggtttt

SEQ ID NO: 329424 - DNA, 20 bp, Artificial Sequence
  Description of Artificial Sequence: Synthetic oligonucleotide
ggcgccggcgcgcggtcttt

SEQ ID NO: 329425 - DNA, 20 bp, Artificial Sequence
  Description of Artificial Sequence: Synthetic oligonucleotide
gcgccggcgcgcggtctctt

SEQ ID NO: 329426 - DNA, 20 bp, Artificial Sequence
  Description of Artificial Sequence: Synthetic oligonucleotide
cgccggcgcgcggtctcctt

SEQ ID NO: 329427 - DNA, 20 bp, Artificial Sequence
  Description of Artificial Sequence: Synthetic oligonucleotide
gccggcgcgcggtctccctt

SEQ ID NO: 329428 - DNA, 20 bp, Artificial Sequence
  Description of Artificial Sequence: Synthetic oligonucleotide
ccggcgcgcggtctcccgtt

SEQ ID NO: 329429 - DNA, 21 bp, Artificial Sequence
  Description of Artificial Sequence: Synthetic oligonucleotide
cggcgcgcggtctcccgttct

SEQ ID NO: 329430 - DNA, 21 bp, Artificial Sequence
  Description of Artificial Sequence: Synthetic oligonucleotide
ggcgcgcggtctcccgttctg

SEQ ID NO: 329431 - DNA, 22 bp, Artificial Sequence
  Description of Artificial Sequence: Synthetic oligonucleotide
gcgcgcggtctcccgttctgct

SEQ ID NO: 329432 - DNA, 22 bp, Artificial Sequence
  Description of Artificial Sequence: Synthetic oligonucleotide
cgcgcggtctcccgttctgctg

SEQ ID NO: 329433 - DNA, 22 bp, Artificial Sequence
  Description of Artificial Sequence: Synthetic oligonucleotide
gcgcggtctcccgttctgctgc

SEQ ID NO: 329434 - DNA, 22 bp, Artificial Sequence
  Description of Artificial Sequence: Synthetic oligonucleotide
cgcggtctcccgttctgctgcc

SEQ ID NO: 329435 - DNA, 23 bp, Artificial Sequence
  Description of Artificial Sequence: Synthetic oligonucleotide
gcggtctcccgttctgctgccga

SEQ ID NO: 329436 - DNA, 23 bp, Artificial Sequence
  Description of Artificial Sequence: Synthetic oligonucleotide
cggtctcccgttctgctgccgag

SEQ ID NO: 329437 - DNA, 25 bp, Artificial Sequence
  Description of Artificial Sequence: Synthetic oligonucleotide
ggtctcccgttctgctgccgaggat

SEQ ID NO: 329438 - DNA, 25 bp, Artificial Sequence
  Description of Artificial Sequence: Synthetic oligonucleotide
gtctcccgttctgctgccgaggatc

SEQ ID NO: 329439 - DNA, 25 bp, Artificial Sequence
  Description of Artificial Sequence: Synthetic oligonucleotide
tctcccgttctgctgccgaggatcc

SEQ ID NO: 329440 - DNA, 24 bp, Artificial Sequence
  Description of Artificial Sequence: Synthetic oligonucleotide
ctcccgttctgctgccgaggatcc

SEQ ID NO: 329441 - DNA, 25 bp, Artificial Sequence
  Description of Artificial Sequence: Synthetic oligonucleotide
tcccgttctgctgccgaggatccca

SEQ ID NO: 329442 - DNA, 24 bp, Artificial Sequence
  Description of Artificial Sequence: Synthetic oligonucleotide
cccgttctgctgccgaggatccca

SEQ ID NO: 329443 - DNA, 24 bp, Artificial Sequence
  Description of Artificial Sequence: Synthetic oligonucleotide
ccgttctgctgccgaggatcccag

SEQ ID NO: 329444 - DNA, 25 bp, Artificial Sequence
  Description of Artificial Sequence: Synthetic oligonucleotide
cgttctgctgccgaggatcccagct

SEQ ID NO: 329445 - DNA, 25 bp, Artificial Sequence
  Description of Artificial Sequence: Synthetic oligonucleotide
gttctgctgccgaggatcccagctg

SEQ ID NO: 329446 - DNA, 25 bp, Artificial Sequence
  Description of Artificial Sequence: Synthetic oligonucleotide
ttctgctgccgaggatcccagctgg

SEQ ID NO: 329447 - DNA, 24 bp, Artificial Sequence
  Description of Artificial Sequence: Synthetic oligonucleotide
tctgctgccgaggatcccagctgg

SEQ ID NO: 329448 - DNA, 23 bp, Artificial Sequence
  Description of Artificial Sequence: Synthetic oligonucleotide
ctgctgccgaggatcccagctgg

SEQ ID NO: 329449 - DNA, 23 bp, Artificial Sequence
  Description of Artificial Sequence: Synthetic oligonucleotide
tgctgccgaggatcccagctggc

SEQ ID NO: 329450 - DNA, 22 bp, Artificial Sequence
  Description of Artificial Sequence: Synthetic oligonucleotide
gctgccgaggatcccagctggc

SEQ ID NO: 329451 - DNA, 22 bp, Artificial Sequence
  Description of Artificial Sequence: Synthetic oligonucleotide
ctgccgaggatcccagctggcg

SEQ ID NO: 329452 - DNA, 24 bp, Artificial Sequence
  Description of Artificial Sequence: Synthetic oligonucleotide
tgccgaggatcccagctggcggta

SEQ ID NO: 329453 - DNA, 23 bp, Artificial Sequence
  Description of Artificial Sequence: Synthetic oligonucleotide
gccgaggatcccagctggcggta

SEQ ID NO: 329454 - DNA, 24 bp, Artificial Sequence
  Description of Artificial Sequence: Synthetic oligonucleotide
ccgaggatcccagctggcggtagt

SEQ ID NO: 329455 - DNA, 24 bp, Artificial Sequence
  Description of Artificial Sequence: Synthetic oligonucleotide
cgaggatcccagctggcggtagtg

SEQ ID NO: 329456 - DNA, 25 bp, Artificial Sequence
  Description of Artificial Sequence: Synthetic oligonucleotide
gaggatcccagctggcggtagtggt

SEQ ID NO: 329457 - DNA, 25 bp, Artificial Sequence
  Description of Artificial Sequence: Synthetic oligonucleotide
aggatcccagctggcggtagtggtg

SEQ ID NO: 329458 - DNA, 24 bp, Artificial Sequence
  Description of Artificial Sequence: Synthetic oligonucleotide
ggatcccagctggcggtagtggtg

SEQ ID NO: 329459 - DNA, 25 bp, Artificial Sequence
  Description of Artificial Sequence: Synthetic oligonucleotide
gatcccagctggcggtagtggtgct

SEQ ID NO: 329460 - DNA, 25 bp, Artificial Sequence
  Description of Artificial Sequence: Synthetic oligonucleotide
atcccagctggcggtagtggtgctg

SEQ ID NO: 329461 - DNA, 24 bp, Artificial Sequence
  Description of Artificial Sequence: Synthetic oligonucleotide
tcccagctggcggtagtggtgctg

SEQ ID NO: 329462 - DNA, 23 bp, Artificial Sequence
  Description of Artificial Sequence: Synthetic oligonucleotide
cccagctggcggtagtggtgctg

SEQ ID NO: 329463 - DNA, 25 bp, Artificial Sequence
  Description of Artificial Sequence: Synthetic oligonucleotide
ccagctggcggtagtggtgctggtt

SEQ ID NO: 329464 - DNA, 25 bp, Artificial Sequence
  Description of Artificial Sequence: Synthetic oligonucleotide
cagctggcggtagtggtgctggttg

SEQ ID NO: 329465 - DNA, 25 bp, Artificial Sequence
  Description of Artificial Sequence: Synthetic oligonucleotide
agctggcggtagtggtgctggttgc

SEQ ID NO: 329466 - DNA, 24 bp, Artificial Sequence
  Description of Artificial Sequence: Synthetic oligonucleotide
gctggcggtagtggtgctggttgc

SEQ ID NO: 329467 - DNA, 24 bp, Artificial Sequence
  Description of Artificial Sequence: Synthetic oligonucleotide
ctggcggtagtggtgctggttgcg

SEQ ID NO: 329468 - DNA, 25 bp, Artificial Sequence
  Description of Artificial Sequence: Synthetic oligonucleotide
tggcggtagtggtgctggttgcgct

SEQ ID NO: 329469 - DNA, 24 bp, Artificial Sequence
  Description of Artificial Sequence: Synthetic oligonucleotide
ggcggtagtggtgctggttgcgct

SEQ ID NO: 329470 - DNA, 24 bp, Artificial Sequence
  Description of Artificial Sequence: Synthetic oligonucleotide
gcggtagtggtgctggttgcgctg

SEQ ID NO: 329471 - DNA, 24 bp, Artificial Sequence
  Description of Artificial Sequence: Synthetic oligonucleotide
cggtagtggtgctggttgcgctgc

SEQ ID NO: 329472 - DNA, 24 bp, Artificial Sequence
  Description of Artificial Sequence: Synthetic oligonucleotide
ggtagtggtgctggttgcgctgcg

SEQ ID NO: 329473 - DNA, 24 bp, Artificial Sequence
  Description of Artificial Sequence: Synthetic oligonucleotide
gtagtggtgctggttgcgctgcgg

SEQ ID NO: 329474 - DNA, 25 bp, Artificial Sequence
  Description of Artificial Sequence: Synthetic oligonucleotide
tagtggtgctggttgcgctgcgggt

SEQ ID NO: 329475 - DNA, 24 bp, Artificial Sequence
  Description of Artificial Sequence: Synthetic oligonucleotide
agtggtgctggttgcgctgcgggt

SEQ ID NO: 329476 - DNA, 23 bp, Artificial Sequence
  Description of Artificial Sequence: Synthetic oligonucleotide
gtggtgctggttgcgctgcgggt

SEQ ID NO: 329477 - DNA, 23 bp, Artificial Sequence
  Description of Artificial Sequence: Synthetic oligonucleotide
tggtgctggttgcgctgcgggtg

SEQ ID NO: 329478 - DNA, 22 bp, Artificial Sequence
  Description of Artificial Sequence: Synthetic oligonucleotide
ggtgctggttgcgctgcgggtg

SEQ ID NO: 329479 - DNA, 22 bp, Artificial Sequence
  Description of Artificial Sequence: Synthetic oligonucleotide
gtgctggttgcgctgcgggtgg

SEQ ID NO: 329480 - DNA, 22 bp, Artificial Sequence
  Description of Artificial Sequence: Synthetic oligonucleotide
tgctggttgcgctgcgggtggc

SEQ ID NO: 329481 - DNA, 21 bp, Artificial Sequence
  Description of Artificial Sequence: Synthetic oligonucleotide
gctggttgcgctgcgggtggc

SEQ ID NO: 329482 - DNA, 22 bp, Artificial Sequence
  Description of Artificial Sequence: Synthetic oligonucleotide
ctggttgcgctgcgggtggcct

SEQ ID NO: 329483 - DNA, 22 bp, Artificial Sequence
  Description of Artificial Sequence: Synthetic oligonucleotide
tggttgcgctgcgggtggcctg

SEQ ID NO: 329484 - DNA, 21 bp, Artificial Sequence
  Description of Artificial Sequence: Synthetic oligonucleotide
ggttgcgctgcgggtggcctg

SEQ ID NO: 329485 - DNA, 21 bp, Artificial Sequence
  Description of Artificial Sequence: Synthetic oligonucleotide
gttgcgctgcgggtggcctgc

SEQ ID NO: 329486 - DNA, 21 bp, Artificial Sequence
  Description of Artificial Sequence: Synthetic oligonucleotide
ttgcgctgcgggtggcctgcg

SEQ ID NO: 329487 - DNA, 20 bp, Artificial Sequence
  Description of Artificial Sequence: Synthetic oligonucleotide
tgcgctgcgggtggcctgcg

SEQ ID NO: 329488 - DNA, 20 bp, Artificial Sequence
  Description of Artificial Sequence: Synthetic oligonucleotide
gcgctgcgggtggcctgcgt

SEQ ID NO: 329489 - DNA, 20 bp, Artificial Sequence
  Description of Artificial Sequence: Synthetic oligonucleotide
cgctgcgggtggcctgcggt

SEQ ID NO: 329490 - DNA, 23 bp, Artificial Sequence
  Description of Artificial Sequence: Synthetic oligonucleotide
gctgcgggtggcctgcggtcaat

SEQ ID NO: 329491 - DNA, 23 bp, Artificial Sequence
  Description of Artificial Sequence: Synthetic oligonucleotide
ctgcgggtggcctgcggtcaatg

SEQ ID NO: 329492 - DNA, 26 bp, Artificial Sequence
  Description of Artificial Sequence: Synthetic oligonucleotide
tgcgggtggcctgcggtcaatgctat

SEQ ID NO: 329493 - DNA, 25 bp, Artificial Sequence
  Description of Artificial Sequence: Synthetic oligonucleotide
gcgggtggcctgcggtcaatgctat

SEQ ID NO: 329494 - DNA, 25 bp, Artificial Sequence
  Description of Artificial Sequence: Synthetic oligonucleotide
cgggtggcctgcggtcaatgctatg

SEQ ID NO: 329495 - DNA, 25 bp, Artificial Sequence
  Description of Artificial Sequence: Synthetic oligonucleotide
gggtggcctgcggtcaatgctatgc

SEQ ID NO: 329496 - DNA, 25 bp, Artificial Sequence
  Description of Artificial Sequence: Synthetic oligonucleotide
ggtggcctgcggtcaatgctatgcc

SEQ ID NO: 329497 - DNA, 25 bp, Artificial Sequence
  Description of Artificial Sequence: Synthetic oligonucleotide
gtggcctgcggtcaatgctatgccc

SEQ ID NO: 329498 - DNA, 26 bp, Artificial Sequence
  Description of Artificial Sequence: Synthetic oligonucleotide
tggcctgcggtcaatgctatgcccca

SEQ ID NO: 329499 - DNA, 25 bp, Artificial Sequence
  Description of Artificial Sequence: Synthetic oligonucleotide
ggcctgcggtcaatgctatgcccca

SEQ ID NO: 329500 - DNA, 27 bp, Artificial Sequence
  Description of Artificial Sequence: Synthetic oligonucleotide
gcctgcggtcaatgctatgccccagta

SEQ ID NO: 329501 - DNA, 28 bp, Artificial Sequence
  Description of Artificial Sequence: Synthetic oligonucleotide
cctgcggtcaatgctatgccccagtatg

SEQ ID NO: 329502 - DNA, 28 bp, Artificial Sequence
  Description of Artificial Sequence: Synthetic oligonucleotide
ctgcggtcaatgctatgccccagtatgg

SEQ ID NO: 329503 - DNA, 28 bp, Artificial Sequence
  Description of Artificial Sequence: Synthetic oligonucleotide
tgcggtcaatgctatgccccagtatggc

SEQ ID NO: 329504 - DNA, 27 bp, Artificial Sequence
  Description of Artificial Sequence: Synthetic oligonucleotide
gcggtcaatgctatgccccagtatggc

SEQ ID NO: 329505 - DNA, 29 bp, Artificial Sequence
  Description of Artificial Sequence: Synthetic oligonucleotide
cggtcaatgctatgccccagtatggcttc

SEQ ID NO: 329506 - DNA, 29 bp, Artificial Sequence
  Description of Artificial Sequence: Synthetic oligonucleotide
ggtcaatgctatgccccagtatggcttcc

SEQ ID NO: 329507 - DNA, 33 bp, Artificial Sequence
  Description of Artificial Sequence: Synthetic oligonucleotide
gtcaatgctatgccccagtatggcttccttttg

SEQ ID NO: 329508 - DNA, 33 bp, Artificial Sequence
  Description of Artificial Sequence: Synthetic oligonucleotide
tcaatgctatgccccagtatggcttccttttgc

SEQ ID NO: 329509 - DNA, 32 bp, Artificial Sequence
  Description of Artificial Sequence: Synthetic oligonucleotide
caatgctatgccccagtatggcttccttttgc

SEQ ID NO: 329510 - DNA, 32 bp, Artificial Sequence
  Description of Artificial Sequence: Synthetic oligonucleotide
aatgctatgccccagtatggcttccttttgcc

SEQ ID NO: 329511 - DNA, 31 bp, Artificial Sequence
  Description of Artificial Sequence: Synthetic oligonucleotide
atgctatgccccagtatggcttccttttgcc

SEQ ID NO: 329512 - DNA, 30 bp, Artificial Sequence
  Description of Artificial Sequence: Synthetic oligonucleotide
tgctatgccccagtatggcttccttttgcc

SEQ ID NO: 329513 - DNA, 29 bp, Artificial Sequence
  Description of Artificial Sequence: Synthetic oligonucleotide
gctatgccccagtatggcttccttttgcc

SEQ ID NO: 329514 - DNA, 30 bp, Artificial Sequence
  Description of Artificial Sequence: Synthetic oligonucleotide
ctatgccccagtatggcttccttttgccag

SEQ ID NO: 329515 - DNA, 30 bp, Artificial Sequence
  Description of Artificial Sequence: Synthetic oligonucleotide
tatgccccagtatggcttccttttgccagg

SEQ ID NO: 329516 - DNA, 29 bp, Artificial Sequence
  Description of Artificial Sequence: Synthetic oligonucleotide
atgccccagtatggcttccttttgccagg

SEQ ID NO: 329517 - DNA, 28 bp, Artificial Sequence
  Description of Artificial Sequence: Synthetic oligonucleotide
tgccccagtatggcttccttttgccagg

SEQ ID NO: 329518 - DNA, 27 bp, Artificial Sequence
  Description of Artificial Sequence: Synthetic oligonucleotide
gccccagtatggcttccttttgccagg

SEQ ID NO: 329519 - DNA, 27 bp, Artificial Sequence
  Description of Artificial Sequence: Synthetic oligonucleotide
ccccagtatggcttccttttgccaggg

SEQ ID NO: 329520 - DNA, 27 bp, Artificial Sequence
  Description of Artificial Sequence: Synthetic oligonucleotide
cccagtatggcttccttttgccagggc

SEQ ID NO: 329521 - DNA, 29 bp, Artificial Sequence
  Description of Artificial Sequence: Synthetic oligonucleotide
ccagtatggcttccttttgccagggctac

SEQ ID NO: 329522 - DNA, 29 bp, Artificial Sequence
  Description of Artificial Sequence: Synthetic oligonucleotide
cagtatggcttccttttgccagggctacc

SEQ ID NO: 329523 - DNA, 31 bp, Artificial Sequence
  Description of Artificial Sequence: Synthetic oligonucleotide
agtatggcttccttttgccagggctaccaac

SEQ ID NO: 329524 - DNA, 30 bp, Artificial Sequence
  Description of Artificial Sequence: Synthetic oligonucleotide
gtatggcttccttttgccagggctaccaac

SEQ ID NO: 329525 - DNA, 30 bp, Artificial Sequence
  Description of Artificial Sequence: Synthetic oligonucleotide
tatggcttccttttgccagggctaccaacc

SEQ ID NO: 329526 - DNA, 29 bp, Artificial Sequence
  Description of Artificial Sequence: Synthetic oligonucleotide
atggcttccttttgccagggctaccaacc

SEQ ID NO: 329527 - DNA, 28 bp, Artificial Sequence
  Description of Artificial Sequence: Synthetic oligonucleotide
tggcttccttttgccagggctaccaacc

SEQ ID NO: 329528 - DNA, 27 bp, Artificial Sequence
  Description of Artificial Sequence: Synthetic oligonucleotide
ggcttccttttgccagggctaccaacc

SEQ ID NO: 329529 - DNA, 30 bp, Artificial Sequence
  Description of Artificial Sequence: Synthetic oligonucleotide
gcttccttttgccagggctaccaaccaaac

SEQ ID NO: 329530 - DNA, 31 bp, Artificial Sequence
  Description of Artificial Sequence: Synthetic oligonucleotide
cttccttttgccagggctaccaaccaaactg

SEQ ID NO: 329531 - DNA, 33 bp, Artificial Sequence
  Description of Artificial Sequence: Synthetic oligonucleotide
ttccttttgccagggctaccaaccaaactgatg

SEQ ID NO: 329532 - DNA, 32 bp, Artificial Sequence
  Description of Artificial Sequence: Synthetic oligonucleotide
tccttttgccagggctaccaaccaaactgatg

SEQ ID NO: 329533 - DNA, 31 bp, Artificial Sequence
  Description of Artificial Sequence: Synthetic oligonucleotide
ccttttgccagggctaccaaccaaactgatg

SEQ ID NO: 329534 - DNA, 36 bp, Artificial Sequence
  Description of Artificial Sequence: Synthetic oligonucleotide
cttttgccagggctaccaaccaaactgatgattttg

SEQ ID NO: 329535 - DNA, 37 bp, Artificial Sequence
  Description of Artificial Sequence: Synthetic oligonucleotide
ttttgccagggctaccaaccaaactgatgattttgag

SEQ ID NO: 329536 - DNA, 36 bp, Artificial Sequence
  Description of Artificial Sequence: Synthetic oligonucleotide
tttgccagggctaccaaccaaactgatgattttgag

SEQ ID NO: 329537 - DNA, 35 bp, Artificial Sequence
  Description of Artificial Sequence: Synthetic oligonucleotide
ttgccagggctaccaaccaaactgatgattttgag

SEQ ID NO: 329538 - DNA, 34 bp, Artificial Sequence
  Description of Artificial Sequence: Synthetic oligonucleotide
tgccagggctaccaaccaaactgatgattttgag

SEQ ID NO: 329539 - DNA, 33 bp, Artificial Sequence
  Description of Artificial Sequence: Synthetic oligonucleotide
gccagggctaccaaccaaactgatgattttgag

SEQ ID NO: 329540 - DNA, 36 bp, Artificial Sequence
  Description of Artificial Sequence: Synthetic oligonucleotide
ccagggctaccaaccaaactgatgattttgagtttg

SEQ ID NO: 329541 - DNA, 36 bp, Artificial Sequence
  Description of Artificial Sequence: Synthetic oligonucleotide
cagggctaccaaccaaactgatgattttgagtttgc

SEQ ID NO: 329542 - DNA, 36 bp, Artificial Sequence
  Description of Artificial Sequence: Synthetic oligonucleotide
agggctaccaaccaaactgatgattttgagtttgcc

SEQ ID NO: 329543 - DNA, 35 bp, Artificial Sequence
  Description of Artificial Sequence: Synthetic oligonucleotide
gggctaccaaccaaactgatgattttgagtttgcc

SEQ ID NO: 329544 - DNA, 38 bp, Artificial Sequence
  Description of Artificial Sequence: Synthetic oligonucleotide
ggctaccaaccaaactgatgattttgagtttgccattg

SEQ ID NO: 329545 - DNA, 38 bp, Artificial Sequence
  Description of Artificial Sequence: Synthetic oligonucleotide
gctaccaaccaaactgatgattttgagtttgccattgg

SEQ ID NO: 329546 - DNA, 38 bp, Artificial Sequence
  Description of Artificial Sequence: Synthetic oligonucleotide
ctaccaaccaaactgatgattttgagtttgccattggg

SEQ ID NO: 329547 - DNA, 39 bp, Artificial Sequence
  Description of Artificial Sequence: Synthetic oligonucleotide
taccaaccaaactgatgattttgagtttgccattgggag

SEQ ID NO: 329548 - DNA, 38 bp, Artificial Sequence
  Description of Artificial Sequence: Synthetic oligonucleotide
accaaccaaactgatgattttgagtttgccattgggag

SEQ ID NO: 329549 - DNA, 37 bp, Artificial Sequence
  Description of Artificial Sequence: Synthetic oligonucleotide
ccaaccaaactgatgattttgagtttgccattgggag

SEQ ID NO: 329550 - DNA, 41 bp, Artificial Sequence
  Description of Artificial Sequence: Synthetic oligonucleotide
caaccaaactgatgattttgagtttgccattgggagatatc

SEQ ID NO: 329551 - DNA, 42 bp, Artificial Sequence
  Description of Artificial Sequence: Synthetic oligonucleotide
aaccaaactgatgattttgagtttgccattgggagatatctg

SEQ ID NO: 329552 - DNA, 41 bp, Artificial Sequence
  Description of Artificial Sequence: Synthetic oligonucleotide
accaaactgatgattttgagtttgccattgggagatatctg

SEQ ID NO: 329553 - DNA, 40 bp, Artificial Sequence
  Description of Artificial Sequence: Synthetic oligonucleotide
ccaaactgatgattttgagtttgccattgggagatatctg

SEQ ID NO: 329554 - DNA, 42 bp, Artificial Sequence
  Description of Artificial Sequence: Synthetic oligonucleotide
caaactgatgattttgagtttgccattgggagatatctgaag

SEQ ID NO: 329555 - DNA, 45 bp, Artificial Sequence
  Description of Artificial Sequence: Synthetic oligonucleotide
aaactgatgattttgagtttgccattgggagatatctgaagtatg

SEQ ID NO: 329556 - DNA, 44 bp, Artificial Sequence
  Description of Artificial Sequence: Synthetic oligonucleotide
aactgatgattttgagtttgccattgggagatatctgaagtatg

SEQ ID NO: 329557 - DNA, 43 bp, Artificial Sequence
  Description of Artificial Sequence: Synthetic oligonucleotide
actgatgattttgagtttgccattgggagatatctgaagtatg

SEQ ID NO: 329558 - DNA, 42 bp, Artificial Sequence
  Description of Artificial Sequence: Synthetic oligonucleotide
ctgatgattttgagtttgccattgggagatatctgaagtatg

SEQ ID NO: 329559 - DNA, 45 bp, Artificial Sequence
  Description of Artificial Sequence: Synthetic oligonucleotide
tgatgattttgagtttgccattgggagatatctgaagtatgaatg

SEQ ID NO: 329560 - DNA, 44 bp, Artificial Sequence
  Description of Artificial Sequence: Synthetic oligonucleotide
gatgattttgagtttgccattgggagatatctgaagtatgaatg

SEQ ID NO: 329561 - DNA, 44 bp, Artificial Sequence
  Description of Artificial Sequence: Synthetic oligonucleotide
atgattttgagtttgccattgggagatatctgaagtatgaatgc

SEQ ID NO: 329562 - DNA, 43 bp, Artificial Sequence
  Description of Artificial Sequence: Synthetic oligonucleotide
tgattttgagtttgccattgggagatatctgaagtatgaatgc

SEQ ID NO: 329563 - DNA, 42 bp, Artificial Sequence
  Description of Artificial Sequence: Synthetic oligonucleotide
gattttgagtttgccattgggagatatctgaagtatgaatgc

SEQ ID NO: 329564 - DNA, 42 bp, Artificial Sequence
  Description of Artificial Sequence: Synthetic oligonucleotide
attttgagtttgccattgggagatatctgaagtatgaatgcg

SEQ ID NO: 329565 - DNA, 41 bp, Artificial Sequence
  Description of Artificial Sequence: Synthetic oligonucleotide
ttttgagtttgccattgggagatatctgaagtatgaatgcg

SEQ ID NO: 329566 - DNA, 40 bp, Artificial Sequence
  Description of Artificial Sequence: Synthetic oligonucleotide
tttgagtttgccattgggagatatctgaagtatgaatgcg

SEQ ID NO: 329567 - DNA, 39 bp, Artificial Sequence
  Description of Artificial Sequence: Synthetic oligonucleotide
ttgagtttgccattgggagatatctgaagtatgaatgcg

SEQ ID NO: 329568 - DNA, 38 bp, Artificial Sequence
  Description of Artificial Sequence: Synthetic oligonucleotide
tgagtttgccattgggagatatctgaagtatgaatgcg

SEQ ID NO: 329569 - DNA, 37 bp, Artificial Sequence
  Description of Artificial Sequence: Synthetic oligonucleotide
gagtttgccattgggagatatctgaagtatgaatgcg

SEQ ID NO: 329570 - DNA, 37 bp, Artificial Sequence
  Description of Artificial Sequence: Synthetic oligonucleotide
agtttgccattgggagatatctgaagtatgaatgcgg

SEQ ID NO: 329571 - DNA, 36 bp, Artificial Sequence
  Description of Artificial Sequence: Synthetic oligonucleotide
gtttgccattgggagatatctgaagtatgaatgcgg

SEQ ID NO: 329572 - DNA, 36 bp, Artificial Sequence
  Description of Artificial Sequence: Synthetic oligonucleotide
tttgccattgggagatatctgaagtatgaatgcggc

SEQ ID NO: 329573 - DNA, 35 bp, Artificial Sequence
  Description of Artificial Sequence: Synthetic oligonucleotide
ttgccattgggagatatctgaagtatgaatgcggc

SEQ ID NO: 329574 - DNA, 34 bp, Artificial Sequence
  Description of Artificial Sequence: Synthetic oligonucleotide
tgccattgggagatatctgaagtatgaatgcggc

SEQ ID NO: 329575 - DNA, 33 bp, Artificial Sequence
  Description of Artificial Sequence: Synthetic oligonucleotide
gccattgggagatatctgaagtatgaatgcggc

SEQ ID NO: 329576 - DNA, 33 bp, Artificial Sequence
  Description of Artificial Sequence: Synthetic oligonucleotide
ccattgggagatatctgaagtatgaatgcggcc

SEQ ID NO: 329577 - DNA, 33 bp, Artificial Sequence
  Description of Artificial Sequence: Synthetic oligonucleotide
cattgggagatatctgaagtatgaatgcggccc

SEQ ID NO: 329578 - DNA, 34 bp, Artificial Sequence
  Description of Artificial Sequence: Synthetic oligonucleotide
attgggagatatctgaagtatgaatgcggccctg

SEQ ID NO: 329579 - DNA, 33 bp, Artificial Sequence
  Description of Artificial Sequence: Synthetic oligonucleotide
ttgggagatatctgaagtatgaatgcggccctg

SEQ ID NO: 329580 - DNA, 32 bp, Artificial Sequence
  Description of Artificial Sequence: Synthetic oligonucleotide
tgggagatatctgaagtatgaatgcggccctg

SEQ ID NO: 329581 - DNA, 31 bp, Artificial Sequence
  Description of Artificial Sequence: Synthetic oligonucleotide
gggagatatctgaagtatgaatgcggccctg

SEQ ID NO: 329582 - DNA, 31 bp, Artificial Sequence
  Description of Artificial Sequence: Synthetic oligonucleotide
ggagatatctgaagtatgaatgcggccctgg

SEQ ID NO: 329583 - DNA, 36 bp, Artificial Sequence
  Description of Artificial Sequence: Synthetic oligonucleotide
gagatatctgaagtatgaatgcggccctggtttttc

SEQ ID NO: 329584 - DNA, 36 bp, Artificial Sequence
  Description of Artificial Sequence: Synthetic oligonucleotide
agatatctgaagtatgaatgcggccctggtttttcc

SEQ ID NO: 329585 - DNA, 35 bp, Artificial Sequence
  Description of Artificial Sequence: Synthetic oligonucleotide
gatatctgaagtatgaatgcggccctggtttttcc

SEQ ID NO: 329586 - DNA, 35 bp, Artificial Sequence
  Description of Artificial Sequence: Synthetic oligonucleotide
atatctgaagtatgaatgcggccctggtttttccg

SEQ ID NO: 329587 - DNA, 34 bp, Artificial Sequence
  Description of Artificial Sequence: Synthetic oligonucleotide
tatctgaagtatgaatgcggccctggtttttccg

SEQ ID NO: 329588 - DNA, 33 bp, Artificial Sequence
  Description of Artificial Sequence: Synthetic oligonucleotide
atctgaagtatgaatgcggccctggtttttccg

SEQ ID NO: 329589 - DNA, 32 bp, Artificial Sequence
  Description of Artificial Sequence: Synthetic oligonucleotide
tctgaagtatgaatgcggccctggtttttccg

SEQ ID NO: 329590 - DNA, 31 bp, Artificial Sequence
  Description of Artificial Sequence: Synthetic oligonucleotide
ctgaagtatgaatgcggccctggtttttccg

SEQ ID NO: 329591 - DNA, 31 bp, Artificial Sequence
  Description of Artificial Sequence: Synthetic oligonucleotide
tgaagtatgaatgcggccctggtttttccgg

SEQ ID NO: 329592 - DNA, 30 bp, Artificial Sequence
  Description of Artificial Sequence: Synthetic oligonucleotide
gaagtatgaatgcggccctggtttttccgg

SEQ ID NO: 329593 - DNA, 32 bp, Artificial Sequence
  Description of Artificial Sequence: Synthetic oligonucleotide
aagtatgaatgcggccctggtttttccggaag

SEQ ID NO: 329594 - DNA, 31 bp, Artificial Sequence
  Description of Artificial Sequence: Synthetic oligonucleotide
agtatgaatgcggccctggtttttccggaag

SEQ ID NO: 329595 - DNA, 30 bp, Artificial Sequence
  Description of Artificial Sequence: Synthetic oligonucleotide
gtatgaatgcggccctggtttttccggaag

SEQ ID NO: 329596 - DNA, 31 bp, Artificial Sequence
  Description of Artificial Sequence: Synthetic oligonucleotide
tatgaatgcggccctggtttttccggaagtc

SEQ ID NO: 329597 - DNA, 30 bp, Artificial Sequence
  Description of Artificial Sequence: Synthetic oligonucleotide
atgaatgcggccctggtttttccggaagtc

SEQ ID NO: 329598 - DNA, 29 bp, Artificial Sequence
  Description of Artificial Sequence: Synthetic oligonucleotide
tgaatgcggccctggtttttccggaagtc

SEQ ID NO: 329599 - DNA, 28 bp, Artificial Sequence
  Description of Artificial Sequence: Synthetic oligonucleotide
gaatgcggccctggtttttccggaagtc

SEQ ID NO: 329600 - DNA, 28 bp, Artificial Sequence
  Description of Artificial Sequence: Synthetic oligonucleotide
aatgcggccctggtttttccggaagtcc

SEQ ID NO: 329601 - DNA, 27 bp, Artificial Sequence
  Description of Artificial Sequence: Synthetic oligonucleotide
atgcggccctggtttttccggaagtcc

SEQ ID NO: 329602 - DNA, 26 bp, Artificial Sequence
  Description of Artificial Sequence: Synthetic oligonucleotide
tgcggccctggtttttccggaagtcc

SEQ ID NO: 329603 - DNA, 25 bp, Artificial Sequence
  Description of Artificial Sequence: Synthetic oligonucleotide
gcggccctggtttttccggaagtcc

SEQ ID NO: 329604 - DNA, 27 bp, Artificial Sequence
  Description of Artificial Sequence: Synthetic oligonucleotide
cggccctggtttttccggaagtccgtt

SEQ ID NO: 329605 - DNA, 29 bp, Artificial Sequence
  Description of Artificial Sequence: Synthetic oligonucleotide
ggccctggtttttccggaagtccgttttc

SEQ ID NO: 329606 - DNA, 32 bp, Artificial Sequence
  Description of Artificial Sequence: Synthetic oligonucleotide
gccctggtttttccggaagtccgttttctttc

SEQ ID NO: 329607 - DNA, 34 bp, Artificial Sequence
  Description of Artificial Sequence: Synthetic oligonucleotide
ccctggtttttccggaagtccgttttctttcatc

SEQ ID NO: 329608 - DNA, 35 bp, Artificial Sequence
  Description of Artificial Sequence: Synthetic oligonucleotide
cctggtttttccggaagtccgttttctttcatctg

SEQ ID NO: 329609 - DNA, 35 bp, Artificial Sequence
  Description of Artificial Sequence: Synthetic oligonucleotide
ctggtttttccggaagtccgttttctttcatctgc

SEQ ID NO: 329610 - DNA, 35 bp, Artificial Sequence
  Description of Artificial Sequence: Synthetic oligonucleotide
tggtttttccggaagtccgttttctttcatctgcc

SEQ ID NO: 329611 - DNA, 34 bp, Artificial Sequence
  Description of Artificial Sequence: Synthetic oligonucleotide
ggtttttccggaagtccgttttctttcatctgcc

SEQ ID NO: 329612 - DNA, 41 bp, Artificial Sequence
  Description of Artificial Sequence: Synthetic oligonucleotide
gtttttccggaagtccgttttctttcatctgccaaaaaaac

SEQ ID NO: 329613 - DNA, 42 bp, Artificial Sequence
  Description of Artificial Sequence: Synthetic oligonucleotide
tttttccggaagtccgttttctttcatctgccaaaaaaactc

SEQ ID NO: 329614 - DNA, 41 bp, Artificial Sequence
  Description of Artificial Sequence: Synthetic oligonucleotide
ttttccggaagtccgttttctttcatctgccaaaaaaactc

SEQ ID NO: 329615 - DNA, 40 bp, Artificial Sequence
  Description of Artificial Sequence: Synthetic oligonucleotide
tttccggaagtccgttttctttcatctgccaaaaaaactc

SEQ ID NO: 329616 - DNA, 39 bp, Artificial Sequence
  Description of Artificial Sequence: Synthetic oligonucleotide
ttccggaagtccgttttctttcatctgccaaaaaaactc

SEQ ID NO: 329617 - DNA, 38 bp, Artificial Sequence
  Description of Artificial Sequence: Synthetic oligonucleotide
tccggaagtccgttttctttcatctgccaaaaaaactc

SEQ ID NO: 329618 - DNA, 37 bp, Artificial Sequence
  Description of Artificial Sequence: Synthetic oligonucleotide
ccggaagtccgttttctttcatctgccaaaaaaactc

SEQ ID NO: 329619 - DNA, 38 bp, Artificial Sequence
  Description of Artificial Sequence: Synthetic oligonucleotide
cggaagtccgttttctttcatctgccaaaaaaactctg

SEQ ID NO: 329620 - DNA, 39 bp, Artificial Sequence
  Description of Artificial Sequence: Synthetic oligonucleotide
ggaagtccgttttctttcatctgccaaaaaaactctgtc

SEQ ID NO: 329621 - DNA, 40 bp, Artificial Sequence
  Description of Artificial Sequence: Synthetic oligonucleotide
gaagtccgttttctttcatctgccaaaaaaactctgtctg

SEQ ID NO: 329622 - DNA, 40 bp, Artificial Sequence
  Description of Artificial Sequence: Synthetic oligonucleotide
aagtccgttttctttcatctgccaaaaaaactctgtctgg

SEQ ID NO: 329623 - DNA, 39 bp, Artificial Sequence
  Description of Artificial Sequence: Synthetic oligonucleotide
agtccgttttctttcatctgccaaaaaaactctgtctgg

SEQ ID NO: 329624 - DNA, 38 bp, Artificial Sequence
  Description of Artificial Sequence: Synthetic oligonucleotide
gtccgttttctttcatctgccaaaaaaactctgtctgg

SEQ ID NO: 329625 - DNA, 39 bp, Artificial Sequence
  Description of Artificial Sequence: Synthetic oligonucleotide
tccgttttctttcatctgccaaaaaaactctgtctggac

SEQ ID NO: 329626 - DNA, 38 bp, Artificial Sequence
  Description of Artificial Sequence: Synthetic oligonucleotide
ccgttttctttcatctgccaaaaaaactctgtctggac

SEQ ID NO: 329627 - DNA, 39 bp, Artificial Sequence
  Description of Artificial Sequence: Synthetic oligonucleotide
cgttttctttcatctgccaaaaaaactctgtctggactc

SEQ ID NO: 329628 - DNA, 39 bp, Artificial Sequence
  Description of Artificial Sequence: Synthetic oligonucleotide
gttttctttcatctgccaaaaaaactctgtctggactcg

SEQ ID NO: 329629 - DNA, 40 bp, Artificial Sequence
  Description of Artificial Sequence: Synthetic oligonucleotide
ttttctttcatctgccaaaaaaactctgtctggactcgtg

SEQ ID NO: 329630 - DNA, 39 bp, Artificial Sequence
  Description of Artificial Sequence: Synthetic oligonucleotide
tttctttcatctgccaaaaaaactctgtctggactcgtg

SEQ ID NO: 329631 - DNA, 38 bp, Artificial Sequence
  Description of Artificial Sequence: Synthetic oligonucleotide
ttctttcatctgccaaaaaaactctgtctggactcgtg

SEQ ID NO: 329632 - DNA, 37 bp, Artificial Sequence
  Description of Artificial Sequence: Synthetic oligonucleotide
tctttcatctgccaaaaaaactctgtctggactcgtg

SEQ ID NO: 329633 - DNA, 36 bp, Artificial Sequence
  Description of Artificial Sequence: Synthetic oligonucleotide
ctttcatctgccaaaaaaactctgtctggactcgtg

SEQ ID NO: 329634 - DNA, 36 bp, Artificial Sequence
  Description of Artificial Sequence: Synthetic oligonucleotide
tttcatctgccaaaaaaactctgtctggactcgtgc

SEQ ID NO: 329635 - DNA, 35 bp, Artificial Sequence
  Description of Artificial Sequence: Synthetic oligonucleotide
ttcatctgccaaaaaaactctgtctggactcgtgc

SEQ ID NO: 329636 - DNA, 34 bp, Artificial Sequence
  Description of Artificial Sequence: Synthetic oligonucleotide
tcatctgccaaaaaaactctgtctggactcgtgc

SEQ ID NO: 329637 - DNA, 33 bp, Artificial Sequence
  Description of Artificial Sequence: Synthetic oligonucleotide
catctgccaaaaaaactctgtctggactcgtgc

SEQ ID NO: 329638 - DNA, 36 bp, Artificial Sequence
  Description of Artificial Sequence: Synthetic oligonucleotide
atctgccaaaaaaactctgtctggactcgtgctaag

SEQ ID NO: 329639 - DNA, 35 bp, Artificial Sequence
  Description of Artificial Sequence: Synthetic oligonucleotide
tctgccaaaaaaactctgtctggactcgtgctaag

SEQ ID NO: 329640 - DNA, 34 bp, Artificial Sequence
  Description of Artificial Sequence: Synthetic oligonucleotide
ctgccaaaaaaactctgtctggactcgtgctaag

SEQ ID NO: 329641 - DNA, 34 bp, Artificial Sequence
  Description of Artificial Sequence: Synthetic oligonucleotide
tgccaaaaaaactctgtctggactcgtgctaagg

SEQ ID NO: 329642 - DNA, 33 bp, Artificial Sequence
  Description of Artificial Sequence: Synthetic oligonucleotide
gccaaaaaaactctgtctggactcgtgctaagg

SEQ ID NO: 329643 - DNA, 34 bp, Artificial Sequence
  Description of Artificial Sequence: Synthetic oligonucleotide
ccaaaaaaactctgtctggactcgtgctaaggtc

SEQ ID NO: 329644 - DNA, 35 bp, Artificial Sequence
  Description of Artificial Sequence: Synthetic oligonucleotide
caaaaaaactctgtctggactcgtgctaaggtcag

SEQ ID NO: 329645 - DNA, 35 bp, Artificial Sequence
  Description of Artificial Sequence: Synthetic oligonucleotide
aaaaaaactctgtctggactcgtgctaaggtcagg

SEQ ID NO: 329646 - DNA, 34 bp, Artificial Sequence
  Description of Artificial Sequence: Synthetic oligonucleotide
aaaaaactctgtctggactcgtgctaaggtcagg

SEQ ID NO: 329647 - DNA, 33 bp, Artificial Sequence
  Description of Artificial Sequence: Synthetic oligonucleotide
aaaaactctgtctggactcgtgctaaggtcagg

SEQ ID NO: 329648 - DNA, 32 bp, Artificial Sequence
  Description of Artificial Sequence: Synthetic oligonucleotide
aaaactctgtctggactcgtgctaaggtcagg

SEQ ID NO: 329649 - DNA, 31 bp, Artificial Sequence
  Description of Artificial Sequence: Synthetic oligonucleotide
aaactctgtctggactcgtgctaaggtcagg

SEQ ID NO: 329650 - DNA, 30 bp, Artificial Sequence
  Description of Artificial Sequence: Synthetic oligonucleotide
aactctgtctggactcgtgctaaggtcagg

SEQ ID NO: 329651 - DNA, 29 bp, Artificial Sequence
  Description of Artificial Sequence: Synthetic oligonucleotide
actctgtctggactcgtgctaaggtcagg

SEQ ID NO: 329652 - DNA, 28 bp, Artificial Sequence
  Description of Artificial Sequence: Synthetic oligonucleotide
ctctgtctggactcgtgctaaggtcagg

SEQ ID NO: 329653 - DNA, 29 bp, Artificial Sequence
  Description of Artificial Sequence: Synthetic oligonucleotide
tctgtctggactcgtgctaaggtcaggtg

SEQ ID NO: 329654 - DNA, 28 bp, Artificial Sequence
  Description of Artificial Sequence: Synthetic oligonucleotide
ctgtctggactcgtgctaaggtcaggtg

SEQ ID NO: 329655 - DNA, 28 bp, Artificial Sequence
  Description of Artificial Sequence: Synthetic oligonucleotide
tgtctggactcgtgctaaggtcaggtgc

SEQ ID NO: 329656 - DNA, 27 bp, Artificial Sequence
  Description of Artificial Sequence: Synthetic oligonucleotide
gtctggactcgtgctaaggtcaggtgc

SEQ ID NO: 329657 - DNA, 28 bp, Artificial Sequence
  Description of Artificial Sequence: Synthetic oligonucleotide
tctggactcgtgctaaggtcaggtgcag

SEQ ID NO: 329658 - DNA, 27 bp, Artificial Sequence
  Description of Artificial Sequence: Synthetic oligonucleotide
ctggactcgtgctaaggtcaggtgcag

SEQ ID NO: 329659 - DNA, 28 bp, Artificial Sequence
  Description of Artificial Sequence: Synthetic oligonucleotide
tggactcgtgctaaggtcaggtgcagtc

SEQ ID NO: 329660 - DNA, 27 bp, Artificial Sequence
  Description of Artificial Sequence: Synthetic oligonucleotide
ggactcgtgctaaggtcaggtgcagtc

SEQ ID NO: 329661 - DNA, 27 bp, Artificial Sequence
  Description of Artificial Sequence: Synthetic oligonucleotide
gactcgtgctaaggtcaggtgcagtcg

SEQ ID NO: 329662 - DNA, 32 bp, Artificial Sequence
  Description of Artificial Sequence: Synthetic oligonucleotide
actcgtgctaaggtcaggtgcagtcgtaaatc

SEQ ID NO: 329663 - DNA, 31 bp, Artificial Sequence
  Description of Artificial Sequence: Synthetic oligonucleotide
ctcgtgctaaggtcaggtgcagtcgtaaatc

SEQ ID NO: 329664 - DNA, 33 bp, Artificial Sequence
  Description of Artificial Sequence: Synthetic oligonucleotide
tcgtgctaaggtcaggtgcagtcgtaaatcaag

SEQ ID NO: 329665 - DNA, 32 bp, Artificial Sequence
  Description of Artificial Sequence: Synthetic oligonucleotide
cgtgctaaggtcaggtgcagtcgtaaatcaag

SEQ ID NO: 329666 - DNA, 33 bp, Artificial Sequence
  Description of Artificial Sequence: Synthetic oligonucleotide
gtgctaaggtcaggtgcagtcgtaaatcaagtc

SEQ ID NO: 329667 - DNA, 33 bp, Artificial Sequence
  Description of Artificial Sequence: Synthetic oligonucleotide
tgctaaggtcaggtgcagtcgtaaatcaagtcg

SEQ ID NO: 329668 - DNA, 32 bp, Artificial Sequence
  Description of Artificial Sequence: Synthetic oligonucleotide
gctaaggtcaggtgcagtcgtaaatcaagtcg

SEQ ID NO: 329669 - DNA, 36 bp, Artificial Sequence
  Description of Artificial Sequence: Synthetic oligonucleotide
ctaaggtcaggtgcagtcgtaaatcaagtcgtaatc

SEQ ID NO: 329670 - DNA, 36 bp, Artificial Sequence
  Description of Artificial Sequence: Synthetic oligonucleotide
taaggtcaggtgcagtcgtaaatcaagtcgtaatcg

SEQ ID NO: 329671 - DNA, 35 bp, Artificial Sequence
  Description of Artificial Sequence: Synthetic oligonucleotide
aaggtcaggtgcagtcgtaaatcaagtcgtaatcg

SEQ ID NO: 329672 - DNA, 34 bp, Artificial Sequence
  Description of Artificial Sequence: Synthetic oligonucleotide
aggtcaggtgcagtcgtaaatcaagtcgtaatcg

SEQ ID NO: 329673 - DNA, 33 bp, Artificial Sequence
  Description of Artificial Sequence: Synthetic oligonucleotide
ggtcaggtgcagtcgtaaatcaagtcgtaatcg

SEQ ID NO: 329674 - DNA, 34 bp, Artificial Sequence
  Description of Artificial Sequence: Synthetic oligonucleotide
gtcaggtgcagtcgtaaatcaagtcgtaatcgtc

SEQ ID NO: 329675 - DNA, 34 bp, Artificial Sequence
  Description of Artificial Sequence: Synthetic oligonucleotide
tcaggtgcagtcgtaaatcaagtcgtaatcgtcc

SEQ ID NO: 329676 - DNA, 33 bp, Artificial Sequence
  Description of Artificial Sequence: Synthetic oligonucleotide
caggtgcagtcgtaaatcaagtcgtaatcgtcc

SEQ ID NO: 329677 - DNA, 34 bp, Artificial Sequence
  Description of Artificial Sequence: Synthetic oligonucleotide
aggtgcagtcgtaaatcaagtcgtaatcgtccag

SEQ ID NO: 329678 - DNA, 33 bp, Artificial Sequence
  Description of Artificial Sequence: Synthetic oligonucleotide
ggtgcagtcgtaaatcaagtcgtaatcgtccag

SEQ ID NO: 329679 - DNA, 35 bp, Artificial Sequence
  Description of Artificial Sequence: Synthetic oligonucleotide
gtgcagtcgtaaatcaagtcgtaatcgtccagatc

SEQ ID NO: 329680 - DNA, 35 bp, Artificial Sequence
  Description of Artificial Sequence: Synthetic oligonucleotide
tgcagtcgtaaatcaagtcgtaatcgtccagatcc

SEQ ID NO: 329681 - DNA, 34 bp, Artificial Sequence
  Description of Artificial Sequence: Synthetic oligonucleotide
gcagtcgtaaatcaagtcgtaatcgtccagatcc

SEQ ID NO: 329682 - DNA, 35 bp, Artificial Sequence
  Description of Artificial Sequence: Synthetic oligonucleotide
cagtcgtaaatcaagtcgtaatcgtccagatccag

SEQ ID NO: 329683 - DNA, 36 bp, Artificial Sequence
  Description of Artificial Sequence: Synthetic oligonucleotide
agtcgtaaatcaagtcgtaatcgtccagatccagtg

SEQ ID NO: 329684 - DNA, 35 bp, Artificial Sequence
  Description of Artificial Sequence: Synthetic oligonucleotide
gtcgtaaatcaagtcgtaatcgtccagatccagtg

SEQ ID NO: 329685 - DNA, 38 bp, Artificial Sequence
  Description of Artificial Sequence: Synthetic oligonucleotide
tcgtaaatcaagtcgtaatcgtccagatccagtgaatg

SEQ ID NO: 329686 - DNA, 37 bp, Artificial Sequence
  Description of Artificial Sequence: Synthetic oligonucleotide
cgtaaatcaagtcgtaatcgtccagatccagtgaatg

SEQ ID NO: 329687 - DNA, 37 bp, Artificial Sequence
  Description of Artificial Sequence: Synthetic oligonucleotide
gtaaatcaagtcgtaatcgtccagatccagtgaatgg

SEQ ID NO: 329688 - DNA, 37 bp, Artificial Sequence
  Description of Artificial Sequence: Synthetic oligonucleotide
taaatcaagtcgtaatcgtccagatccagtgaatggc

SEQ ID NO: 329689 - DNA, 36 bp, Artificial Sequence
  Description of Artificial Sequence: Synthetic oligonucleotide
aaatcaagtcgtaatcgtccagatccagtgaatggc

SEQ ID NO: 329690 - DNA, 35 bp, Artificial Sequence
  Description of Artificial Sequence: Synthetic oligonucleotide
aatcaagtcgtaatcgtccagatccagtgaatggc

SEQ ID NO: 329691 - DNA, 34 bp, Artificial Sequence
  Description of Artificial Sequence: Synthetic oligonucleotide
atcaagtcgtaatcgtccagatccagtgaatggc

SEQ ID NO: 329692 - DNA, 33 bp, Artificial Sequence
  Description of Artificial Sequence: Synthetic oligonucleotide
tcaagtcgtaatcgtccagatccagtgaatggc

SEQ ID NO: 329693 - DNA, 32 bp, Artificial Sequence
  Description of Artificial Sequence: Synthetic oligonucleotide
caagtcgtaatcgtccagatccagtgaatggc

SEQ ID NO: 329694 - DNA, 34 bp, Artificial Sequence
  Description of Artificial Sequence: Synthetic oligonucleotide
aagtcgtaatcgtccagatccagtgaatggcttg

SEQ ID NO: 329695 - DNA, 33 bp, Artificial Sequence
  Description of Artificial Sequence: Synthetic oligonucleotide
agtcgtaatcgtccagatccagtgaatggcttg

SEQ ID NO: 329696 - DNA, 32 bp, Artificial Sequence
  Description of Artificial Sequence: Synthetic oligonucleotide
gtcgtaatcgtccagatccagtgaatggcttg

SEQ ID NO: 329697 - DNA, 32 bp, Artificial Sequence
  Description of Artificial Sequence: Synthetic oligonucleotide
tcgtaatcgtccagatccagtgaatggcttgg

SEQ ID NO: 329698 - DNA, 31 bp, Artificial Sequence
  Description of Artificial Sequence: Synthetic oligonucleotide
cgtaatcgtccagatccagtgaatggcttgg

SEQ ID NO: 329699 - DNA, 32 bp, Artificial Sequence
  Description of Artificial Sequence: Synthetic oligonucleotide
gtaatcgtccagatccagtgaatggcttggtg

SEQ ID NO: 329700 - DNA, 32 bp, Artificial Sequence
  Description of Artificial Sequence: Synthetic oligonucleotide
taatcgtccagatccagtgaatggcttggtgc

SEQ ID NO: 329701 - DNA, 31 bp, Artificial Sequence
  Description of Artificial Sequence: Synthetic oligonucleotide
aatcgtccagatccagtgaatggcttggtgc

SEQ ID NO: 329702 - DNA, 30 bp, Artificial Sequence
  Description of Artificial Sequence: Synthetic oligonucleotide
atcgtccagatccagtgaatggcttggtgc

SEQ ID NO: 329703 - DNA, 29 bp, Artificial Sequence
  Description of Artificial Sequence: Synthetic oligonucleotide
tcgtccagatccagtgaatggcttggtgc

SEQ ID NO: 329704 - DNA, 28 bp, Artificial Sequence
  Description of Artificial Sequence: Synthetic oligonucleotide
cgtccagatccagtgaatggcttggtgc

SEQ ID NO: 329705 - DNA, 30 bp, Artificial Sequence
  Description of Artificial Sequence: Synthetic oligonucleotide
gtccagatccagtgaatggcttggtgcatg

SEQ ID NO: 329706 - DNA, 31 bp, Artificial Sequence
  Description of Artificial Sequence: Synthetic oligonucleotide
tccagatccagtgaatggcttggtgcatgag

SEQ ID NO: 329707 - DNA, 30 bp, Artificial Sequence
  Description of Artificial Sequence: Synthetic oligonucleotide
ccagatccagtgaatggcttggtgcatgag

SEQ ID NO: 329708 - DNA, 32 bp, Artificial Sequence
  Description of Artificial Sequence: Synthetic oligonucleotide
cagatccagtgaatggcttggtgcatgagatc

SEQ ID NO: 329709 - DNA, 35 bp, Artificial Sequence
  Description of Artificial Sequence: Synthetic oligonucleotide
agatccagtgaatggcttggtgcatgagatcaaag

SEQ ID NO: 329710 - DNA, 34 bp, Artificial Sequence
  Description of Artificial Sequence: Synthetic oligonucleotide
gatccagtgaatggcttggtgcatgagatcaaag

SEQ ID NO: 329711 - DNA, 34 bp, Artificial Sequence
  Description of Artificial Sequence: Synthetic oligonucleotide
atccagtgaatggcttggtgcatgagatcaaagg

SEQ ID NO: 329712 - DNA, 33 bp, Artificial Sequence
  Description of Artificial Sequence: Synthetic oligonucleotide
tccagtgaatggcttggtgcatgagatcaaagg

SEQ ID NO: 329713 - DNA, 32 bp, Artificial Sequence
  Description of Artificial Sequence: Synthetic oligonucleotide
ccagtgaatggcttggtgcatgagatcaaagg

SEQ ID NO: 329714 - DNA, 32 bp, Artificial Sequence
  Description of Artificial Sequence: Synthetic oligonucleotide
cagtgaatggcttggtgcatgagatcaaaggg

SEQ ID NO: 329715 - DNA, 34 bp, Artificial Sequence
  Description of Artificial Sequence: Synthetic oligonucleotide
agtgaatggcttggtgcatgagatcaaagggatc

SEQ ID NO: 329716 - DNA, 33 bp, Artificial Sequence
  Description of Artificial Sequence: Synthetic oligonucleotide
gtgaatggcttggtgcatgagatcaaagggatc

SEQ ID NO: 329717 - DNA, 33 bp, Artificial Sequence
  Description of Artificial Sequence: Synthetic oligonucleotide
tgaatggcttggtgcatgagatcaaagggatcc

SEQ ID NO: 329718 - DNA, 32 bp, Artificial Sequence
  Description of Artificial Sequence: Synthetic oligonucleotide
gaatggcttggtgcatgagatcaaagggatcc

SEQ ID NO: 329719 - DNA, 33 bp, Artificial Sequence
  Description of Artificial Sequence: Synthetic oligonucleotide
aatggcttggtgcatgagatcaaagggatccag

SEQ ID NO: 329720 - DNA, 32 bp, Artificial Sequence
  Description of Artificial Sequence: Synthetic oligonucleotide
atggcttggtgcatgagatcaaagggatccag

SEQ ID NO: 329721 - DNA, 31 bp, Artificial Sequence
  Description of Artificial Sequence: Synthetic oligonucleotide
tggcttggtgcatgagatcaaagggatccag

SEQ ID NO: 329722 - DNA, 30 bp, Artificial Sequence
  Description of Artificial Sequence: Synthetic oligonucleotide
ggcttggtgcatgagatcaaagggatccag

SEQ ID NO: 329723 - DNA, 32 bp, Artificial Sequence
  Description of Artificial Sequence: Synthetic oligonucleotide
gcttggtgcatgagatcaaagggatccagttc

SEQ ID NO: 329724 - DNA, 32 bp, Artificial Sequence
  Description of Artificial Sequence: Synthetic oligonucleotide
cttggtgcatgagatcaaagggatccagttcc

SEQ ID NO: 329725 - DNA, 32 bp, Artificial Sequence
  Description of Artificial Sequence: Synthetic oligonucleotide
ttggtgcatgagatcaaagggatccagttccg

SEQ ID NO: 329726 - DNA, 31 bp, Artificial Sequence
  Description of Artificial Sequence: Synthetic oligonucleotide
tggtgcatgagatcaaagggatccagttccg

SEQ ID NO: 329727 - DNA, 30 bp, Artificial Sequence
  Description of Artificial Sequence: Synthetic oligonucleotide
ggtgcatgagatcaaagggatccagttccg

SEQ ID NO: 329728 - DNA, 32 bp, Artificial Sequence
  Description of Artificial Sequence: Synthetic oligonucleotide
gtgcatgagatcaaagggatccagttccgatc

SEQ ID NO: 329729 - DNA, 32 bp, Artificial Sequence
  Description of Artificial Sequence: Synthetic oligonucleotide
tgcatgagatcaaagggatccagttccgatcc

SEQ ID NO: 329730 - DNA, 31 bp, Artificial Sequence
  Description of Artificial Sequence: Synthetic oligonucleotide
gcatgagatcaaagggatccagttccgatcc

SEQ ID NO: 329731 - DNA, 31 bp, Artificial Sequence
  Description of Artificial Sequence: Synthetic oligonucleotide
catgagatcaaagggatccagttccgatccc

SEQ ID NO: 329732 - DNA, 43 bp, Artificial Sequence
  Description of Artificial Sequence: Synthetic oligonucleotide
atgagatcaaagggatccagttccgatcccaaaataaatattc

SEQ ID NO: 329733 - DNA, 42 bp, Artificial Sequence
  Description of Artificial Sequence: Synthetic oligonucleotide
tgagatcaaagggatccagttccgatcccaaaataaatattc

SEQ ID NO: 329734 - DNA, 41 bp, Artificial Sequence
  Description of Artificial Sequence: Synthetic oligonucleotide
gagatcaaagggatccagttccgatcccaaaataaatattc

SEQ ID NO: 329735 - DNA, 43 bp, Artificial Sequence
  Description of Artificial Sequence: Synthetic oligonucleotide
agatcaaagggatccagttccgatcccaaaataaatattcatg

SEQ ID NO: 329736 - DNA, 42 bp, Artificial Sequence
  Description of Artificial Sequence: Synthetic oligonucleotide
gatcaaagggatccagttccgatcccaaaataaatattcatg

SEQ ID NO: 329737 - DNA, 44 bp, Artificial Sequence
  Description of Artificial Sequence: Synthetic oligonucleotide
atcaaagggatccagttccgatcccaaaataaatattcatgtac

SEQ ID NO: 329738 - DNA, 43 bp, Artificial Sequence
  Description of Artificial Sequence: Synthetic oligonucleotide
tcaaagggatccagttccgatcccaaaataaatattcatgtac

SEQ ID NO: 329739 - DNA, 42 bp, Artificial Sequence
  Description of Artificial Sequence: Synthetic oligonucleotide
caaagggatccagttccgatcccaaaataaatattcatgtac

SEQ ID NO: 329740 - DNA, 46 bp, Artificial Sequence
  Description of Artificial Sequence: Synthetic oligonucleotide
aaagggatccagttccgatcccaaaataaatattcatgtactaaac

SEQ ID NO: 329741 - DNA, 45 bp, Artificial Sequence
  Description of Artificial Sequence: Synthetic oligonucleotide
aagggatccagttccgatcccaaaataaatattcatgtactaaac

SEQ ID NO: 329742 - DNA, 44 bp, Artificial Sequence
  Description of Artificial Sequence: Synthetic oligonucleotide
agggatccagttccgatcccaaaataaatattcatgtactaaac

SEQ ID NO: 329743 - DNA, 43 bp, Artificial Sequence
  Description of Artificial Sequence: Synthetic oligonucleotide
gggatccagttccgatcccaaaataaatattcatgtactaaac

SEQ ID NO: 329744 - DNA, 43 bp, Artificial Sequence
  Description of Artificial Sequence: Synthetic oligonucleotide
ggatccagttccgatcccaaaataaatattcatgtactaaacg

SEQ ID NO: 329745 - DNA, 43 bp, Artificial Sequence
  Description of Artificial Sequence: Synthetic oligonucleotide
gatccagttccgatcccaaaataaatattcatgtactaaacgg

SEQ ID NO: 329746 - DNA, 46 bp, Artificial Sequence
  Description of Artificial Sequence: Synthetic oligonucleotide
atccagttccgatcccaaaataaatattcatgtactaaacggatac

SEQ ID NO: 329747 - DNA, 45 bp, Artificial Sequence
  Description of Artificial Sequence: Synthetic oligonucleotide
tccagttccgatcccaaaataaatattcatgtactaaacggatac

SEQ ID NO: 329748 - DNA, 44 bp, Artificial Sequence
  Description of Artificial Sequence: Synthetic oligonucleotide
ccagttccgatcccaaaataaatattcatgtactaaacggatac

SEQ ID NO: 329749 - DNA, 44 bp, Artificial Sequence
  Description of Artificial Sequence: Synthetic oligonucleotide
cagttccgatcccaaaataaatattcatgtactaaacggatacc

SEQ ID NO: 329750 - DNA, 44 bp, Artificial Sequence
  Description of Artificial Sequence: Synthetic oligonucleotide
agttccgatcccaaaataaatattcatgtactaaacggataccg

SEQ ID NO: 329751 - DNA, 43 bp, Artificial Sequence
  Description of Artificial Sequence: Synthetic oligonucleotide
gttccgatcccaaaataaatattcatgtactaaacggataccg

SEQ ID NO: 329752 - DNA, 44 bp, Artificial Sequence
  Description of Artificial Sequence: Synthetic oligonucleotide
ttccgatcccaaaataaatattcatgtactaaacggataccgag

SEQ ID NO: 329753 - DNA, 43 bp, Artificial Sequence
  Description of Artificial Sequence: Synthetic oligonucleotide
tccgatcccaaaataaatattcatgtactaaacggataccgag

SEQ ID NO: 329754 - DNA, 42 bp, Artificial Sequence
  Description of Artificial Sequence: Synthetic oligonucleotide
ccgatcccaaaataaatattcatgtactaaacggataccgag

SEQ ID NO: 329755 - DNA, 43 bp, Artificial Sequence
  Description of Artificial Sequence: Synthetic oligonucleotide
cgatcccaaaataaatattcatgtactaaacggataccgagtc

SEQ ID NO: 329756 - DNA, 46 bp, Artificial Sequence
  Description of Artificial Sequence: Synthetic oligonucleotide
gatcccaaaataaatattcatgtactaaacggataccgagtcattg

SEQ ID NO: 329757 - DNA, 46 bp, Artificial Sequence
  Description of Artificial Sequence: Synthetic oligonucleotide
atcccaaaataaatattcatgtactaaacggataccgagtcattgg

SEQ ID NO: 329758 - DNA, 45 bp, Artificial Sequence
  Description of Artificial Sequence: Synthetic oligonucleotide
tcccaaaataaatattcatgtactaaacggataccgagtcattgg

SEQ ID NO: 329759 - DNA, 44 bp, Artificial Sequence
  Description of Artificial Sequence: Synthetic oligonucleotide
cccaaaataaatattcatgtactaaacggataccgagtcattgg

SEQ ID NO: 329760 - DNA, 46 bp, Artificial Sequence
  Description of Artificial Sequence: Synthetic oligonucleotide
ccaaaataaatattcatgtactaaacggataccgagtcattggttg

SEQ ID NO: 329761 - DNA, 46 bp, Artificial Sequence
  Description of Artificial Sequence: Synthetic oligonucleotide
caaaataaatattcatgtactaaacggataccgagtcattggttgc

SEQ ID NO: 329762 - DNA, 47 bp, Artificial Sequence
  Description of Artificial Sequence: Synthetic oligonucleotide
aaaataaatattcatgtactaaacggataccgagtcattggttgctc

SEQ ID NO: 329763 - DNA, 46 bp, Artificial Sequence
  Description of Artificial Sequence: Synthetic oligonucleotide
aaataaatattcatgtactaaacggataccgagtcattggttgctc

SEQ ID NO: 329764 - DNA, 45 bp, Artificial Sequence
  Description of Artificial Sequence: Synthetic oligonucleotide
aataaatattcatgtactaaacggataccgagtcattggttgctc

SEQ ID NO: 329765 - DNA, 44 bp, Artificial Sequence
  Description of Artificial Sequence: Synthetic oligonucleotide
ataaatattcatgtactaaacggataccgagtcattggttgctc

SEQ ID NO: 329766 - DNA, 43 bp, Artificial Sequence
  Description of Artificial Sequence: Synthetic oligonucleotide
taaatattcatgtactaaacggataccgagtcattggttgctc

SEQ ID NO: 329767 - DNA, 42 bp, Artificial Sequence
  Description of Artificial Sequence: Synthetic oligonucleotide
aaatattcatgtactaaacggataccgagtcattggttgctc

SEQ ID NO: 329768 - DNA, 41 bp, Artificial Sequence
  Description of Artificial Sequence: Synthetic oligonucleotide
aatattcatgtactaaacggataccgagtcattggttgctc

SEQ ID NO: 329769 - DNA, 40 bp, Artificial Sequence
  Description of Artificial Sequence: Synthetic oligonucleotide
atattcatgtactaaacggataccgagtcattggttgctc

SEQ ID NO: 329770 - DNA, 39 bp, Artificial Sequence
  Description of Artificial Sequence: Synthetic oligonucleotide
tattcatgtactaaacggataccgagtcattggttgctc

SEQ ID NO: 329771 - DNA, 38 bp, Artificial Sequence
  Description of Artificial Sequence: Synthetic oligonucleotide
attcatgtactaaacggataccgagtcattggttgctc

SEQ ID NO: 329772 - DNA, 37 bp, Artificial Sequence
  Description of Artificial Sequence: Synthetic oligonucleotide
ttcatgtactaaacggataccgagtcattggttgctc

SEQ ID NO: 329773 - DNA, 36 bp, Artificial Sequence
  Description of Artificial Sequence: Synthetic oligonucleotide
tcatgtactaaacggataccgagtcattggttgctc

SEQ ID NO: 329774 - DNA, 35 bp, Artificial Sequence
  Description of Artificial Sequence: Synthetic oligonucleotide
catgtactaaacggataccgagtcattggttgctc

SEQ ID NO: 329775 - DNA, 35 bp, Artificial Sequence
  Description of Artificial Sequence: Synthetic oligonucleotide
atgtactaaacggataccgagtcattggttgctcg

SEQ ID NO: 329776 - DNA, 34 bp, Artificial Sequence
  Description of Artificial Sequence: Synthetic oligonucleotide
tgtactaaacggataccgagtcattggttgctcg

SEQ ID NO: 329777 - DNA, 33 bp, Artificial Sequence
  Description of Artificial Sequence: Synthetic oligonucleotide
gtactaaacggataccgagtcattggttgctcg

SEQ ID NO: 329778 - DNA, 34 bp, Artificial Sequence
  Description of Artificial Sequence: Synthetic oligonucleotide
tactaaacggataccgagtcattggttgctcgtc

SEQ ID NO: 329779 - DNA, 33 bp, Artificial Sequence
  Description of Artificial Sequence: Synthetic oligonucleotide
actaaacggataccgagtcattggttgctcgtc

SEQ ID NO: 329780 - DNA, 32 bp, Artificial Sequence
  Description of Artificial Sequence: Synthetic oligonucleotide
ctaaacggataccgagtcattggttgctcgtc

SEQ ID NO: 329781 - DNA, 33 bp, Artificial Sequence
  Description of Artificial Sequence: Synthetic oligonucleotide
taaacggataccgagtcattggttgctcgtctg

SEQ ID NO: 329782 - DNA, 32 bp, Artificial Sequence
  Description of Artificial Sequence: Synthetic oligonucleotide
aaacggataccgagtcattggttgctcgtctg

SEQ ID NO: 329783 - DNA, 31 bp, Artificial Sequence
  Description of Artificial Sequence: Synthetic oligonucleotide
aacggataccgagtcattggttgctcgtctg

SEQ ID NO: 329784 - DNA, 30 bp, Artificial Sequence
  Description of Artificial Sequence: Synthetic oligonucleotide
acggataccgagtcattggttgctcgtctg

SEQ ID NO: 329785 - DNA, 29 bp, Artificial Sequence
  Description of Artificial Sequence: Synthetic oligonucleotide
cggataccgagtcattggttgctcgtctg

SEQ ID NO: 329786 - DNA, 29 bp, Artificial Sequence
  Description of Artificial Sequence: Synthetic oligonucleotide
ggataccgagtcattggttgctcgtctgc

SEQ ID NO: 329787 - DNA, 29 bp, Artificial Sequence
  Description of Artificial Sequence: Synthetic oligonucleotide
gataccgagtcattggttgctcgtctgcg

SEQ ID NO: 329788 - DNA, 30 bp, Artificial Sequence
  Description of Artificial Sequence: Synthetic oligonucleotide
ataccgagtcattggttgctcgtctgcgac

SEQ ID NO: 329789 - DNA, 29 bp, Artificial Sequence
  Description of Artificial Sequence: Synthetic oligonucleotide
taccgagtcattggttgctcgtctgcgac

SEQ ID NO: 329790 - DNA, 28 bp, Artificial Sequence
  Description of Artificial Sequence: Synthetic oligonucleotide
accgagtcattggttgctcgtctgcgac

SEQ ID NO: 329791 - DNA, 27 bp, Artificial Sequence
  Description of Artificial Sequence: Synthetic oligonucleotide
ccgagtcattggttgctcgtctgcgac

SEQ ID NO: 329792 - DNA, 29 bp, Artificial Sequence
  Description of Artificial Sequence: Synthetic oligonucleotide
cgagtcattggttgctcgtctgcgacatg

SEQ ID NO: 329793 - DNA, 29 bp, Artificial Sequence
  Description of Artificial Sequence: Synthetic oligonucleotide
gagtcattggttgctcgtctgcgacatgc

SEQ ID NO: 329794 - DNA, 31 bp, Artificial Sequence
  Description of Artificial Sequence: Synthetic oligonucleotide
agtcattggttgctcgtctgcgacatgcatc

SEQ ID NO: 329795 - DNA, 30 bp, Artificial Sequence
  Description of Artificial Sequence: Synthetic oligonucleotide
gtcattggttgctcgtctgcgacatgcatc

SEQ ID NO: 329796 - DNA, 32 bp, Artificial Sequence
  Description of Artificial Sequence: Synthetic oligonucleotide
tcattggttgctcgtctgcgacatgcatcttc

SEQ ID NO: 329797 - DNA, 31 bp, Artificial Sequence
  Description of Artificial Sequence: Synthetic oligonucleotide
cattggttgctcgtctgcgacatgcatcttc

SEQ ID NO: 329798 - DNA, 32 bp, Artificial Sequence
  Description of Artificial Sequence: Synthetic oligonucleotide
attggttgctcgtctgcgacatgcatcttctc

SEQ ID NO: 329799 - DNA, 31 bp, Artificial Sequence
  Description of Artificial Sequence: Synthetic oligonucleotide
ttggttgctcgtctgcgacatgcatcttctc

SEQ ID NO: 329800 - DNA, 30 bp, Artificial Sequence
  Description of Artificial Sequence: Synthetic oligonucleotide
tggttgctcgtctgcgacatgcatcttctc

SEQ ID NO: 329801 - DNA, 29 bp, Artificial Sequence
  Description of Artificial Sequence: Synthetic oligonucleotide
ggttgctcgtctgcgacatgcatcttctc

SEQ ID NO: 329802 - DNA, 30 bp, Artificial Sequence
  Description of Artificial Sequence: Synthetic oligonucleotide
gttgctcgtctgcgacatgcatcttctcag

SEQ ID NO: 329803 - DNA, 30 bp, Artificial Sequence
  Description of Artificial Sequence: Synthetic oligonucleotide
ttgctcgtctgcgacatgcatcttctcagg

SEQ ID NO: 329804 - DNA, 29 bp, Artificial Sequence
  Description of Artificial Sequence: Synthetic oligonucleotide
tgctcgtctgcgacatgcatcttctcagg

SEQ ID NO: 329805 - DNA, 28 bp, Artificial Sequence
  Description of Artificial Sequence: Synthetic oligonucleotide
gctcgtctgcgacatgcatcttctcagg

SEQ ID NO: 329806 - DNA, 29 bp, Artificial Sequence
  Description of Artificial Sequence: Synthetic oligonucleotide
ctcgtctgcgacatgcatcttctcaggtg

SEQ ID NO: 329807 - DNA, 32 bp, Artificial Sequence
  Description of Artificial Sequence: Synthetic oligonucleotide
tcgtctgcgacatgcatcttctcaggtgttac

SEQ ID NO: 329808 - DNA, 31 bp, Artificial Sequence
  Description of Artificial Sequence: Synthetic oligonucleotide
cgtctgcgacatgcatcttctcaggtgttac

SEQ ID NO: 329809 - DNA, 32 bp, Artificial Sequence
  Description of Artificial Sequence: Synthetic oligonucleotide
gtctgcgacatgcatcttctcaggtgttactg

SEQ ID NO: 329810 - DNA, 33 bp, Artificial Sequence
  Description of Artificial Sequence: Synthetic oligonucleotide
tctgcgacatgcatcttctcaggtgttactgtc

SEQ ID NO: 329811 - DNA, 32 bp, Artificial Sequence
  Description of Artificial Sequence: Synthetic oligonucleotide
ctgcgacatgcatcttctcaggtgttactgtc

SEQ ID NO: 329812 - DNA, 36 bp, Artificial Sequence
  Description of Artificial Sequence: Synthetic oligonucleotide
tgcgacatgcatcttctcaggtgttactgtcatatg

SEQ ID NO: 329813 - DNA, 35 bp, Artificial Sequence
  Description of Artificial Sequence: Synthetic oligonucleotide
gcgacatgcatcttctcaggtgttactgtcatatg

SEQ ID NO: 329814 - DNA, 35 bp, Artificial Sequence
  Description of Artificial Sequence: Synthetic oligonucleotide
cgacatgcatcttctcaggtgttactgtcatatgg

SEQ ID NO: 329815 - DNA, 35 bp, Artificial Sequence
  Description of Artificial Sequence: Synthetic oligonucleotide
gacatgcatcttctcaggtgttactgtcatatggg

SEQ ID NO: 329816 - DNA, 40 bp, Artificial Sequence
  Description of Artificial Sequence: Synthetic oligonucleotide
acatgcatcttctcaggtgttactgtcatatgggataatc

SEQ ID NO: 329817 - DNA, 39 bp, Artificial Sequence
  Description of Artificial Sequence: Synthetic oligonucleotide
catgcatcttctcaggtgttactgtcatatgggataatc

SEQ ID NO: 329818 - DNA, 42 bp, Artificial Sequence
  Description of Artificial Sequence: Synthetic oligonucleotide
atgcatcttctcaggtgttactgtcatatgggataatcaaac

SEQ ID NO: 329819 - DNA, 41 bp, Artificial Sequence
  Description of Artificial Sequence: Synthetic oligonucleotide
tgcatcttctcaggtgttactgtcatatgggataatcaaac

SEQ ID NO: 329820 - DNA, 40 bp, Artificial Sequence
  Description of Artificial Sequence: Synthetic oligonucleotide
gcatcttctcaggtgttactgtcatatgggataatcaaac

SEQ ID NO: 329821 - DNA, 41 bp, Artificial Sequence
  Description of Artificial Sequence: Synthetic oligonucleotide
catcttctcaggtgttactgtcatatgggataatcaaacac

SEQ ID NO: 329822 - DNA, 41 bp, Artificial Sequence
  Description of Artificial Sequence: Synthetic oligonucleotide
atcttctcaggtgttactgtcatatgggataatcaaacacc

SEQ ID NO: 329823 - DNA, 40 bp, Artificial Sequence
  Description of Artificial Sequence: Synthetic oligonucleotide
tcttctcaggtgttactgtcatatgggataatcaaacacc

SEQ ID NO: 329824 - DNA, 39 bp, Artificial Sequence
  Description of Artificial Sequence: Synthetic oligonucleotide
cttctcaggtgttactgtcatatgggataatcaaacacc

SEQ ID NO: 329825 - DNA, 44 bp, Artificial Sequence
  Description of Artificial Sequence: Synthetic oligonucleotide
ttctcaggtgttactgtcatatgggataatcaaacacctaattg

SEQ ID NO: 329826 - DNA, 43 bp, Artificial Sequence
  Description of Artificial Sequence: Synthetic oligonucleotide
tctcaggtgttactgtcatatgggataatcaaacacctaattg

SEQ ID NO: 329827 - DNA, 42 bp, Artificial Sequence
  Description of Artificial Sequence: Synthetic oligonucleotide
ctcaggtgttactgtcatatgggataatcaaacacctaattg

SEQ ID NO: 329828 - DNA, 43 bp, Artificial Sequence
  Description of Artificial Sequence: Synthetic oligonucleotide
tcaggtgttactgtcatatgggataatcaaacacctaattgtg

SEQ ID NO: 329829 - DNA, 42 bp, Artificial Sequence
  Description of Artificial Sequence: Synthetic oligonucleotide
caggtgttactgtcatatgggataatcaaacacctaattgtg

SEQ ID NO: 329830 - DNA, 43 bp, Artificial Sequence
  Description of Artificial Sequence: Synthetic oligonucleotide
aggtgttactgtcatatgggataatcaaacacctaattgtgac

SEQ ID NO: 329831 - DNA, 42 bp, Artificial Sequence
  Description of Artificial Sequence: Synthetic oligonucleotide
ggtgttactgtcatatgggataatcaaacacctaattgtgac

SEQ ID NO: 329832 - DNA, 43 bp, Artificial Sequence
  Description of Artificial Sequence: Synthetic oligonucleotide
gtgttactgtcatatgggataatcaaacacctaattgtgacag

SEQ ID NO: 329833 - DNA, 47 bp, Artificial Sequence
  Description of Artificial Sequence: Synthetic oligonucleotide
tgttactgtcatatgggataatcaaacacctaattgtgacagtattc

SEQ ID NO: 329834 - DNA, 46 bp, Artificial Sequence
  Description of Artificial Sequence: Synthetic oligonucleotide
gttactgtcatatgggataatcaaacacctaattgtgacagtattc

SEQ ID NO: 329835 - DNA, 46 bp, Artificial Sequence
  Description of Artificial Sequence: Synthetic oligonucleotide
ttactgtcatatgggataatcaaacacctaattgtgacagtattcc

SEQ ID NO: 329836 - DNA, 45 bp, Artificial Sequence
  Description of Artificial Sequence: Synthetic oligonucleotide
tactgtcatatgggataatcaaacacctaattgtgacagtattcc

SEQ ID NO: 329837 - DNA, 44 bp, Artificial Sequence
  Description of Artificial Sequence: Synthetic oligonucleotide
actgtcatatgggataatcaaacacctaattgtgacagtattcc

SEQ ID NO: 329838 - DNA, 43 bp, Artificial Sequence
  Description of Artificial Sequence: Synthetic oligonucleotide
ctgtcatatgggataatcaaacacctaattgtgacagtattcc

SEQ ID NO: 329839 - DNA, 45 bp, Artificial Sequence
  Description of Artificial Sequence: Synthetic oligonucleotide
tgtcatatgggataatcaaacacctaattgtgacagtattccttg

SEQ ID NO: 329840 - DNA, 44 bp, Artificial Sequence
  Description of Artificial Sequence: Synthetic oligonucleotide
gtcatatgggataatcaaacacctaattgtgacagtattccttg

SEQ ID NO: 329841 - DNA, 45 bp, Artificial Sequence
  Description of Artificial Sequence: Synthetic oligonucleotide
tcatatgggataatcaaacacctaattgtgacagtattccttgtc

SEQ ID NO: 329842 - DNA, 44 bp, Artificial Sequence
  Description of Artificial Sequence: Synthetic oligonucleotide
catatgggataatcaaacacctaattgtgacagtattccttgtc

SEQ ID NO: 329843 - DNA, 44 bp, Artificial Sequence
  Description of Artificial Sequence: Synthetic oligonucleotide
atatgggataatcaaacacctaattgtgacagtattccttgtcg

SEQ ID NO: 329844 - DNA, 43 bp, Artificial Sequence
  Description of Artificial Sequence: Synthetic oligonucleotide
tatgggataatcaaacacctaattgtgacagtattccttgtcg

SEQ ID NO: 329845 - DNA, 42 bp, Artificial Sequence
  Description of Artificial Sequence: Synthetic oligonucleotide
atgggataatcaaacacctaattgtgacagtattccttgtcg

SEQ ID NO: 329846 - DNA, 41 bp, Artificial Sequence
  Description of Artificial Sequence: Synthetic oligonucleotide
tgggataatcaaacacctaattgtgacagtattccttgtcg

SEQ ID NO: 329847 - DNA, 40 bp, Artificial Sequence
  Description of Artificial Sequence: Synthetic oligonucleotide
gggataatcaaacacctaattgtgacagtattccttgtcg

SEQ ID NO: 329848 - DNA, 40 bp, Artificial Sequence
  Description of Artificial Sequence: Synthetic oligonucleotide
ggataatcaaacacctaattgtgacagtattccttgtcgg

SEQ ID NO: 329849 - DNA, 40 bp, Artificial Sequence
  Description of Artificial Sequence: Synthetic oligonucleotide
gataatcaaacacctaattgtgacagtattccttgtcggc

SEQ ID NO: 329850 - DNA, 42 bp, Artificial Sequence
  Description of Artificial Sequence: Synthetic oligonucleotide
ataatcaaacacctaattgtgacagtattccttgtcggctac

SEQ ID NO: 329851 - DNA, 41 bp, Artificial Sequence
  Description of Artificial Sequence: Synthetic oligonucleotide
taatcaaacacctaattgtgacagtattccttgtcggctac

SEQ ID NO: 329852 - DNA, 40 bp, Artificial Sequence
  Description of Artificial Sequence: Synthetic oligonucleotide
aatcaaacacctaattgtgacagtattccttgtcggctac

SEQ ID NO: 329853 - DNA, 39 bp, Artificial Sequence
  Description of Artificial Sequence: Synthetic oligonucleotide
atcaaacacctaattgtgacagtattccttgtcggctac

SEQ ID NO: 329854 - DNA, 38 bp, Artificial Sequence
  Description of Artificial Sequence: Synthetic oligonucleotide
tcaaacacctaattgtgacagtattccttgtcggctac

SEQ ID NO: 329855 - DNA, 37 bp, Artificial Sequence
  Description of Artificial Sequence: Synthetic oligonucleotide
caaacacctaattgtgacagtattccttgtcggctac

SEQ ID NO: 329856 - DNA, 37 bp, Artificial Sequence
  Description of Artificial Sequence: Synthetic oligonucleotide
aaacacctaattgtgacagtattccttgtcggctacc

SEQ ID NO: 329857 - DNA, 36 bp, Artificial Sequence
  Description of Artificial Sequence: Synthetic oligonucleotide
aacacctaattgtgacagtattccttgtcggctacc

SEQ ID NO: 329858 - DNA, 35 bp, Artificial Sequence
  Description of Artificial Sequence: Synthetic oligonucleotide
acacctaattgtgacagtattccttgtcggctacc

SEQ ID NO: 329859 - DNA, 34 bp, Artificial Sequence
  Description of Artificial Sequence: Synthetic oligonucleotide
cacctaattgtgacagtattccttgtcggctacc

SEQ ID NO: 329860 - DNA, 34 bp, Artificial Sequence
  Description of Artificial Sequence: Synthetic oligonucleotide
acctaattgtgacagtattccttgtcggctaccc

SEQ ID NO: 329861 - DNA, 33 bp, Artificial Sequence
  Description of Artificial Sequence: Synthetic oligonucleotide
cctaattgtgacagtattccttgtcggctaccc

SEQ ID NO: 329862 - DNA, 33 bp, Artificial Sequence
  Description of Artificial Sequence: Synthetic oligonucleotide
ctaattgtgacagtattccttgtcggctacccc

SEQ ID NO: 329863 - DNA, 33 bp, Artificial Sequence
  Description of Artificial Sequence: Synthetic oligonucleotide
taattgtgacagtattccttgtcggctaccccg

SEQ ID NO: 329864 - DNA, 32 bp, Artificial Sequence
  Description of Artificial Sequence: Synthetic oligonucleotide
aattgtgacagtattccttgtcggctaccccg

SEQ ID NO: 329865 - DNA, 31 bp, Artificial Sequence
  Description of Artificial Sequence: Synthetic oligonucleotide
attgtgacagtattccttgtcggctaccccg

SEQ ID NO: 329866 - DNA, 30 bp, Artificial Sequence
  Description of Artificial Sequence: Synthetic oligonucleotide
ttgtgacagtattccttgtcggctaccccg

SEQ ID NO: 329867 - DNA, 29 bp, Artificial Sequence
  Description of Artificial Sequence: Synthetic oligonucleotide
tgtgacagtattccttgtcggctaccccg

SEQ ID NO: 329868 - DNA, 28 bp, Artificial Sequence
  Description of Artificial Sequence: Synthetic oligonucleotide
gtgacagtattccttgtcggctaccccg

SEQ ID NO: 329869 - DNA, 28 bp, Artificial Sequence
  Description of Artificial Sequence: Synthetic oligonucleotide
tgacagtattccttgtcggctaccccgc

SEQ ID NO: 329870 - DNA, 27 bp, Artificial Sequence
  Description of Artificial Sequence: Synthetic oligonucleotide
gacagtattccttgtcggctaccccgc

SEQ ID NO: 329871 - DNA, 28 bp, Artificial Sequence
  Description of Artificial Sequence: Synthetic oligonucleotide
acagtattccttgtcggctaccccgcac

SEQ ID NO: 329872 - DNA, 27 bp, Artificial Sequence
  Description of Artificial Sequence: Synthetic oligonucleotide
cagtattccttgtcggctaccccgcac

SEQ ID NO: 329873 - DNA, 27 bp, Artificial Sequence
  Description of Artificial Sequence: Synthetic oligonucleotide
agtattccttgtcggctaccccgcacc

SEQ ID NO: 329874 - DNA, 27 bp, Artificial Sequence
  Description of Artificial Sequence: Synthetic oligonucleotide
gtattccttgtcggctaccccgcacca

SEQ ID NO: 329875 - DNA, 28 bp, Artificial Sequence
  Description of Artificial Sequence: Synthetic oligonucleotide
tattccttgtcggctaccccgcaccatc

SEQ ID NO: 329876 - DNA, 27 bp, Artificial Sequence
  Description of Artificial Sequence: Synthetic oligonucleotide
attccttgtcggctaccccgcaccatc

SEQ ID NO: 329877 - DNA, 27 bp, Artificial Sequence
  Description of Artificial Sequence: Synthetic oligonucleotide
ttccttgtcggctaccccgcaccatca

SEQ ID NO: 329878 - DNA, 26 bp, Artificial Sequence
  Description of Artificial Sequence: Synthetic oligonucleotide
tccttgtcggctaccccgcaccatca

SEQ ID NO: 329879 - DNA, 25 bp, Artificial Sequence
  Description of Artificial Sequence: Synthetic oligonucleotide
ccttgtcggctaccccgcaccatca

SEQ ID NO: 329880 - DNA, 25 bp, Artificial Sequence
  Description of Artificial Sequence: Synthetic oligonucleotide
cttgtcggctaccccgcaccatcac

SEQ ID NO: 329881 - DNA, 27 bp, Artificial Sequence
  Description of Artificial Sequence: Synthetic oligonucleotide
ttgtcggctaccccgcaccatcacgaa

SEQ ID NO: 329882 - DNA, 27 bp, Artificial Sequence
  Description of Artificial Sequence: Synthetic oligonucleotide
tgtcggctaccccgcaccatcacgaat

SEQ ID NO: 329883 - DNA, 26 bp, Artificial Sequence
  Description of Artificial Sequence: Synthetic oligonucleotide
gtcggctaccccgcaccatcacgaat

SEQ ID NO: 329884 - DNA, 26 bp, Artificial Sequence
  Description of Artificial Sequence: Synthetic oligonucleotide
tcggctaccccgcaccatcacgaatg

SEQ ID NO: 329885 - DNA, 25 bp, Artificial Sequence
  Description of Artificial Sequence: Synthetic oligonucleotide
cggctaccccgcaccatcacgaatg

SEQ ID NO: 329886 - DNA, 26 bp, Artificial Sequence
  Description of Artificial Sequence: Synthetic oligonucleotide
ggctaccccgcaccatcacgaatgga

SEQ ID NO: 329887 - DNA, 27 bp, Artificial Sequence
  Description of Artificial Sequence: Synthetic oligonucleotide
gctaccccgcaccatcacgaatggaga

SEQ ID NO: 329888 - DNA, 30 bp, Artificial Sequence
  Description of Artificial Sequence: Synthetic oligonucleotide
ctaccccgcaccatcacgaatggagatatc

SEQ ID NO: 329889 - DNA, 34 bp, Artificial Sequence
  Description of Artificial Sequence: Synthetic oligonucleotide
taccccgcaccatcacgaatggagatatcattag

SEQ ID NO: 329890 - DNA, 33 bp, Artificial Sequence
  Description of Artificial Sequence: Synthetic oligonucleotide
accccgcaccatcacgaatggagatatcattag

SEQ ID NO: 329891 - DNA, 32 bp, Artificial Sequence
  Description of Artificial Sequence: Synthetic oligonucleotide
ccccgcaccatcacgaatggagatatcattag

SEQ ID NO: 329892 - DNA, 32 bp, Artificial Sequence
  Description of Artificial Sequence: Synthetic oligonucleotide
cccgcaccatcacgaatggagatatcattagc

SEQ ID NO: 329893 - DNA, 33 bp, Artificial Sequence
  Description of Artificial Sequence: Synthetic oligonucleotide
ccgcaccatcacgaatggagatatcattagcag

SEQ ID NO: 329894 - DNA, 33 bp, Artificial Sequence
  Description of Artificial Sequence: Synthetic oligonucleotide
cgcaccatcacgaatggagatatcattagcagc

SEQ ID NO: 329895 - DNA, 35 bp, Artificial Sequence
  Description of Artificial Sequence: Synthetic oligonucleotide
gcaccatcacgaatggagatatcattagcagcaac

SEQ ID NO: 329896 - DNA, 36 bp, Artificial Sequence
  Description of Artificial Sequence: Synthetic oligonucleotide
caccatcacgaatggagatatcattagcagcaacag

SEQ ID NO: 329897 - DNA, 37 bp, Artificial Sequence
  Description of Artificial Sequence: Synthetic oligonucleotide
accatcacgaatggagatatcattagcagcaacagag

SEQ ID NO: 329898 - DNA, 36 bp, Artificial Sequence
  Description of Artificial Sequence: Synthetic oligonucleotide
ccatcacgaatggagatatcattagcagcaacagag

SEQ ID NO: 329899 - DNA, 37 bp, Artificial Sequence
  Description of Artificial Sequence: Synthetic oligonucleotide
catcacgaatggagatatcattagcagcaacagagac

SEQ ID NO: 329900 - DNA, 43 bp, Artificial Sequence
  Description of Artificial Sequence: Synthetic oligonucleotide
atcacgaatggagatatcattagcagcaacagagacaattttc

SEQ ID NO: 329901 - DNA, 42 bp, Artificial Sequence
  Description of Artificial Sequence: Synthetic oligonucleotide
tcacgaatggagatatcattagcagcaacagagacaattttc

SEQ ID NO: 329902 - DNA, 41 bp, Artificial Sequence
  Description of Artificial Sequence: Synthetic oligonucleotide
cacgaatggagatatcattagcagcaacagagacaattttc

SEQ ID NO: 329903 - DNA, 42 bp, Artificial Sequence
  Description of Artificial Sequence: Synthetic oligonucleotide
acgaatggagatatcattagcagcaacagagacaattttcac

SEQ ID NO: 329904 - DNA, 41 bp, Artificial Sequence
  Description of Artificial Sequence: Synthetic oligonucleotide
cgaatggagatatcattagcagcaacagagacaattttcac

SEQ ID NO: 329905 - DNA, 44 bp, Artificial Sequence
  Description of Artificial Sequence: Synthetic oligonucleotide
gaatggagatatcattagcagcaacagagacaattttcacaatg

SEQ ID NO: 329906 - DNA, 44 bp, Artificial Sequence
  Description of Artificial Sequence: Synthetic oligonucleotide
aatggagatatcattagcagcaacagagacaattttcacaatgg

SEQ ID NO: 329907 - DNA, 43 bp, Artificial Sequence
  Description of Artificial Sequence: Synthetic oligonucleotide
atggagatatcattagcagcaacagagacaattttcacaatgg

SEQ ID NO: 329908 - DNA, 42 bp, Artificial Sequence
  Description of Artificial Sequence: Synthetic oligonucleotide
tggagatatcattagcagcaacagagacaattttcacaatgg

SEQ ID NO: 329909 - DNA, 41 bp, Artificial Sequence
  Description of Artificial Sequence: Synthetic oligonucleotide
ggagatatcattagcagcaacagagacaattttcacaatgg

SEQ ID NO: 329910 - DNA, 43 bp, Artificial Sequence
  Description of Artificial Sequence: Synthetic oligonucleotide
gagatatcattagcagcaacagagacaattttcacaatggatc

SEQ ID NO: 329911 - DNA, 44 bp, Artificial Sequence
  Description of Artificial Sequence: Synthetic oligonucleotide
agatatcattagcagcaacagagacaattttcacaatggatcag

SEQ ID NO: 329912 - DNA, 43 bp, Artificial Sequence
  Description of Artificial Sequence: Synthetic oligonucleotide
gatatcattagcagcaacagagacaattttcacaatggatcag

SEQ ID NO: 329913 - DNA, 44 bp, Artificial Sequence
  Description of Artificial Sequence: Synthetic oligonucleotide
atatcattagcagcaacagagacaattttcacaatggatcagag

SEQ ID NO: 329914 - DNA, 43 bp, Artificial Sequence
  Description of Artificial Sequence: Synthetic oligonucleotide
tatcattagcagcaacagagacaattttcacaatggatcagag

SEQ ID NO: 329915 - DNA, 42 bp, Artificial Sequence
  Description of Artificial Sequence: Synthetic oligonucleotide
atcattagcagcaacagagacaattttcacaatggatcagag

SEQ ID NO: 329916 - DNA, 41 bp, Artificial Sequence
  Description of Artificial Sequence: Synthetic oligonucleotide
tcattagcagcaacagagacaattttcacaatggatcagag

SEQ ID NO: 329917 - DNA, 40 bp, Artificial Sequence
  Description of Artificial Sequence: Synthetic oligonucleotide
cattagcagcaacagagacaattttcacaatggatcagag

SEQ ID NO: 329918 - DNA, 40 bp, Artificial Sequence
  Description of Artificial Sequence: Synthetic oligonucleotide
attagcagcaacagagacaattttcacaatggatcagagg

SEQ ID NO: 329919 - DNA, 39 bp, Artificial Sequence
  Description of Artificial Sequence: Synthetic oligonucleotide
ttagcagcaacagagacaattttcacaatggatcagagg

SEQ ID NO: 329920 - DNA, 38 bp, Artificial Sequence
  Description of Artificial Sequence: Synthetic oligonucleotide
tagcagcaacagagacaattttcacaatggatcagagg

SEQ ID NO: 329921 - DNA, 37 bp, Artificial Sequence
  Description of Artificial Sequence: Synthetic oligonucleotide
agcagcaacagagacaattttcacaatggatcagagg

SEQ ID NO: 329922 - DNA, 36 bp, Artificial Sequence
  Description of Artificial Sequence: Synthetic oligonucleotide
gcagcaacagagacaattttcacaatggatcagagg

SEQ ID NO: 329923 - DNA, 37 bp, Artificial Sequence
  Description of Artificial Sequence: Synthetic oligonucleotide
cagcaacagagacaattttcacaatggatcagaggtg

SEQ ID NO: 329924 - DNA, 38 bp, Artificial Sequence
  Description of Artificial Sequence: Synthetic oligonucleotide
agcaacagagacaattttcacaatggatcagaggtgac

SEQ ID NO: 329925 - DNA, 37 bp, Artificial Sequence
  Description of Artificial Sequence: Synthetic oligonucleotide
gcaacagagacaattttcacaatggatcagaggtgac

SEQ ID NO: 329926 - DNA, 37 bp, Artificial Sequence
  Description of Artificial Sequence: Synthetic oligonucleotide
caacagagacaattttcacaatggatcagaggtgacc

SEQ ID NO: 329927 - DNA, 39 bp, Artificial Sequence
  Description of Artificial Sequence: Synthetic oligonucleotide
aacagagacaattttcacaatggatcagaggtgacctag

SEQ ID NO: 329928 - DNA, 38 bp, Artificial Sequence
  Description of Artificial Sequence: Synthetic oligonucleotide
acagagacaattttcacaatggatcagaggtgacctag

SEQ ID NO: 329929 - DNA, 37 bp, Artificial Sequence
  Description of Artificial Sequence: Synthetic oligonucleotide
cagagacaattttcacaatggatcagaggtgacctag

SEQ ID NO: 329930 - DNA, 37 bp, Artificial Sequence
  Description of Artificial Sequence: Synthetic oligonucleotide
agagacaattttcacaatggatcagaggtgacctagc

SEQ ID NO: 329931 - DNA, 36 bp, Artificial Sequence
  Description of Artificial Sequence: Synthetic oligonucleotide
gagacaattttcacaatggatcagaggtgacctagc

SEQ ID NO: 329932 - DNA, 36 bp, Artificial Sequence
  Description of Artificial Sequence: Synthetic oligonucleotide
agacaattttcacaatggatcagaggtgacctagcg

SEQ ID NO: 329933 - DNA, 35 bp, Artificial Sequence
  Description of Artificial Sequence: Synthetic oligonucleotide
gacaattttcacaatggatcagaggtgacctagcg

SEQ ID NO: 329934 - DNA, 35 bp, Artificial Sequence
  Description of Artificial Sequence: Synthetic oligonucleotide
acaattttcacaatggatcagaggtgacctagcgc

SEQ ID NO: 329935 - DNA, 34 bp, Artificial Sequence
  Description of Artificial Sequence: Synthetic oligonucleotide
caattttcacaatggatcagaggtgacctagcgc

SEQ ID NO: 329936 - DNA, 35 bp, Artificial Sequence
  Description of Artificial Sequence: Synthetic oligonucleotide
aattttcacaatggatcagaggtgacctagcgctg

SEQ ID NO: 329937 - DNA, 34 bp, Artificial Sequence
  Description of Artificial Sequence: Synthetic oligonucleotide
attttcacaatggatcagaggtgacctagcgctg

SEQ ID NO: 329938 - DNA, 33 bp, Artificial Sequence
  Description of Artificial Sequence: Synthetic oligonucleotide
ttttcacaatggatcagaggtgacctagcgctg

SEQ ID NO: 329939 - DNA, 32 bp, Artificial Sequence
  Description of Artificial Sequence: Synthetic oligonucleotide
tttcacaatggatcagaggtgacctagcgctg

SEQ ID NO: 329940 - DNA, 31 bp, Artificial Sequence
  Description of Artificial Sequence: Synthetic oligonucleotide
ttcacaatggatcagaggtgacctagcgctg

SEQ ID NO: 329941 - DNA, 30 bp, Artificial Sequence
  Description of Artificial Sequence: Synthetic oligonucleotide
tcacaatggatcagaggtgacctagcgctg

SEQ ID NO: 329942 - DNA, 29 bp, Artificial Sequence
  Description of Artificial Sequence: Synthetic oligonucleotide
cacaatggatcagaggtgacctagcgctg

SEQ ID NO: 329943 - DNA, 29 bp, Artificial Sequence
  Description of Artificial Sequence: Synthetic oligonucleotide
acaatggatcagaggtgacctagcgctgc

SEQ ID NO: 329944 - DNA, 28 bp, Artificial Sequence
  Description of Artificial Sequence: Synthetic oligonucleotide
caatggatcagaggtgacctagcgctgc

SEQ ID NO: 329945 - DNA, 31 bp, Artificial Sequence
  Description of Artificial Sequence: Synthetic oligonucleotide
aatggatcagaggtgacctagcgctgcaatg

SEQ ID NO: 329946 - DNA, 30 bp, Artificial Sequence
  Description of Artificial Sequence: Synthetic oligonucleotide
atggatcagaggtgacctagcgctgcaatg

SEQ ID NO: 329947 - DNA, 29 bp, Artificial Sequence
  Description of Artificial Sequence: Synthetic oligonucleotide
tggatcagaggtgacctagcgctgcaatg

SEQ ID NO: 329948 - DNA, 28 bp, Artificial Sequence
  Description of Artificial Sequence: Synthetic oligonucleotide
ggatcagaggtgacctagcgctgcaatg

SEQ ID NO: 329949 - DNA, 28 bp, Artificial Sequence
  Description of Artificial Sequence: Synthetic oligonucleotide
gatcagaggtgacctagcgctgcaatgc

SEQ ID NO: 329950 - DNA, 29 bp, Artificial Sequence
  Description of Artificial Sequence: Synthetic oligonucleotide
atcagaggtgacctagcgctgcaatgctg

SEQ ID NO: 329951 - DNA, 28 bp, Artificial Sequence
  Description of Artificial Sequence: Synthetic oligonucleotide
tcagaggtgacctagcgctgcaatgctg

SEQ ID NO: 329952 - DNA, 27 bp, Artificial Sequence
  Description of Artificial Sequence: Synthetic oligonucleotide
cagaggtgacctagcgctgcaatgctg

SEQ ID NO: 329953 - DNA, 27 bp, Artificial Sequence
  Description of Artificial Sequence: Synthetic oligonucleotide
agaggtgacctagcgctgcaatgctgg

SEQ ID NO: 329954 - DNA, 27 bp, Artificial Sequence
  Description of Artificial Sequence: Synthetic oligonucleotide
gaggtgacctagcgctgcaatgctgga

SEQ ID NO: 329955 - DNA, 28 bp, Artificial Sequence
  Description of Artificial Sequence: Synthetic oligonucleotide
aggtgacctagcgctgcaatgctggaag

SEQ ID NO: 329956 - DNA, 27 bp, Artificial Sequence
  Description of Artificial Sequence: Synthetic oligonucleotide
ggtgacctagcgctgcaatgctggaag

SEQ ID NO: 329957 - DNA, 27 bp, Artificial Sequence
  Description of Artificial Sequence: Synthetic oligonucleotide
gtgacctagcgctgcaatgctggaagc

SEQ ID NO: 329958 - DNA, 27 bp, Artificial Sequence
  Description of Artificial Sequence: Synthetic oligonucleotide
tgacctagcgctgcaatgctggaagcg

SEQ ID NO: 329959 - DNA, 26 bp, Artificial Sequence
  Description of Artificial Sequence: Synthetic oligonucleotide
gacctagcgctgcaatgctggaagcg

SEQ ID NO: 329960 - DNA, 27 bp, Artificial Sequence
  Description of Artificial Sequence: Synthetic oligonucleotide
acctagcgctgcaatgctggaagcgca

SEQ ID NO: 329961 - DNA, 26 bp, Artificial Sequence
  Description of Artificial Sequence: Synthetic oligonucleotide
cctagcgctgcaatgctggaagcgca

SEQ ID NO: 329962 - DNA, 26 bp, Artificial Sequence
  Description of Artificial Sequence: Synthetic oligonucleotide
ctagcgctgcaatgctggaagcgcag

SEQ ID NO: 329963 - DNA, 26 bp, Artificial Sequence
  Description of Artificial Sequence: Synthetic oligonucleotide
tagcgctgcaatgctggaagcgcagg

SEQ ID NO: 329964 - DNA, 25 bp, Artificial Sequence
  Description of Artificial Sequence: Synthetic oligonucleotide
agcgctgcaatgctggaagcgcagg

SEQ ID NO: 329965 - DNA, 24 bp, Artificial Sequence
  Description of Artificial Sequence: Synthetic oligonucleotide
gcgctgcaatgctggaagcgcagg

SEQ ID NO: 329966 - DNA, 25 bp, Artificial Sequence
  Description of Artificial Sequence: Synthetic oligonucleotide
cgctgcaatgctggaagcgcaggga

SEQ ID NO: 329967 - DNA, 27 bp, Artificial Sequence
  Description of Artificial Sequence: Synthetic oligonucleotide
gctgcaatgctggaagcgcagggagaa

SEQ ID NO: 329968 - DNA, 28 bp, Artificial Sequence
  Description of Artificial Sequence: Synthetic oligonucleotide
ctgcaatgctggaagcgcagggagaaac

SEQ ID NO: 329969 - DNA, 28 bp, Artificial Sequence
  Description of Artificial Sequence: Synthetic oligonucleotide
tgcaatgctggaagcgcagggagaaacg

SEQ ID NO: 329970 - DNA, 27 bp, Artificial Sequence
  Description of Artificial Sequence: Synthetic oligonucleotide
gcaatgctggaagcgcagggagaaacg

SEQ ID NO: 329971 - DNA, 28 bp, Artificial Sequence
  Description of Artificial Sequence: Synthetic oligonucleotide
caatgctggaagcgcagggagaaacgtg

SEQ ID NO: 329972 - DNA, 31 bp, Artificial Sequence
  Description of Artificial Sequence: Synthetic oligonucleotide
aatgctggaagcgcagggagaaacgtgtttg

SEQ ID NO: 329973 - DNA, 30 bp, Artificial Sequence
  Description of Artificial Sequence: Synthetic oligonucleotide
atgctggaagcgcagggagaaacgtgtttg

SEQ ID NO: 329974 - DNA, 29 bp, Artificial Sequence
  Description of Artificial Sequence: Synthetic oligonucleotide
tgctggaagcgcagggagaaacgtgtttg

SEQ ID NO: 329975 - DNA, 28 bp, Artificial Sequence
  Description of Artificial Sequence: Synthetic oligonucleotide
gctggaagcgcagggagaaacgtgtttg

SEQ ID NO: 329976 - DNA, 29 bp, Artificial Sequence
  Description of Artificial Sequence: Synthetic oligonucleotide
ctggaagcgcagggagaaacgtgtttgag

SEQ ID NO: 329977 - DNA, 29 bp, Artificial Sequence
  Description of Artificial Sequence: Synthetic oligonucleotide
tggaagcgcagggagaaacgtgtttgagg

SEQ ID NO: 329978 - DNA, 28 bp, Artificial Sequence
  Description of Artificial Sequence: Synthetic oligonucleotide
ggaagcgcagggagaaacgtgtttgagg

SEQ ID NO: 329979 - DNA, 30 bp, Artificial Sequence
  Description of Artificial Sequence: Synthetic oligonucleotide
gaagcgcagggagaaacgtgtttgaggttg

SEQ ID NO: 329980 - DNA, 31 bp, Artificial Sequence
  Description of Artificial Sequence: Synthetic oligonucleotide
aagcgcagggagaaacgtgtttgaggttgtg

SEQ ID NO: 329981 - DNA, 30 bp, Artificial Sequence
  Description of Artificial Sequence: Synthetic oligonucleotide
agcgcagggagaaacgtgtttgaggttgtg

SEQ ID NO: 329982 - DNA, 29 bp, Artificial Sequence
  Description of Artificial Sequence: Synthetic oligonucleotide
gcgcagggagaaacgtgtttgaggttgtg

SEQ ID NO: 329983 - DNA, 29 bp, Artificial Sequence
  Description of Artificial Sequence: Synthetic oligonucleotide
cgcagggagaaacgtgtttgaggttgtgg

SEQ ID NO: 329984 - DNA, 29 bp, Artificial Sequence
  Description of Artificial Sequence: Synthetic oligonucleotide
gcagggagaaacgtgtttgaggttgtggg

SEQ ID NO: 329985 - DNA, 30 bp, Artificial Sequence
  Description of Artificial Sequence: Synthetic oligonucleotide
cagggagaaacgtgtttgaggttgtgggtg

SEQ ID NO: 329986 - DNA, 31 bp, Artificial Sequence
  Description of Artificial Sequence: Synthetic oligonucleotide
agggagaaacgtgtttgaggttgtgggtgtg

SEQ ID NO: 329987 - DNA, 30 bp, Artificial Sequence
  Description of Artificial Sequence: Synthetic oligonucleotide
gggagaaacgtgtttgaggttgtgggtgtg

SEQ ID NO: 329988 - DNA, 30 bp, Artificial Sequence
  Description of Artificial Sequence: Synthetic oligonucleotide
ggagaaacgtgtttgaggttgtgggtgtgc

SEQ ID NO: 329989 - DNA, 30 bp, Artificial Sequence
  Description of Artificial Sequence: Synthetic oligonucleotide
gagaaacgtgtttgaggttgtgggtgtgcc

SEQ ID NO: 329990 - DNA, 30 bp, Artificial Sequence
  Description of Artificial Sequence: Synthetic oligonucleotide
agaaacgtgtttgaggttgtgggtgtgccc

SEQ ID NO: 329991 - DNA, 29 bp, Artificial Sequence
  Description of Artificial Sequence: Synthetic oligonucleotide
gaaacgtgtttgaggttgtgggtgtgccc

SEQ ID NO: 329992 - DNA, 30 bp, Artificial Sequence
  Description of Artificial Sequence: Synthetic oligonucleotide
aaacgtgtttgaggttgtgggtgtgccctc

SEQ ID NO: 329993 - DNA, 29 bp, Artificial Sequence
  Description of Artificial Sequence: Synthetic oligonucleotide
aacgtgtttgaggttgtgggtgtgccctc

SEQ ID NO: 329994 - DNA, 28 bp, Artificial Sequence
  Description of Artificial Sequence: Synthetic oligonucleotide
acgtgtttgaggttgtgggtgtgccctc

SEQ ID NO: 329995 - DNA, 27 bp, Artificial Sequence
  Description of Artificial Sequence: Synthetic oligonucleotide
cgtgtttgaggttgtgggtgtgccctc

SEQ ID NO: 329996 - DNA, 27 bp, Artificial Sequence
  Description of Artificial Sequence: Synthetic oligonucleotide
gtgtttgaggttgtgggtgtgccctcc

SEQ ID NO: 329997 - DNA, 32 bp, Artificial Sequence
  Description of Artificial Sequence: Synthetic oligonucleotide
tgtttgaggttgtgggtgtgccctccatttac

SEQ ID NO: 329998 - DNA, 31 bp, Artificial Sequence
  Description of Artificial Sequence: Synthetic oligonucleotide
gtttgaggttgtgggtgtgccctccatttac

SEQ ID NO: 329999 - DNA, 32 bp, Artificial Sequence
  Description of Artificial Sequence: Synthetic oligonucleotide
tttgaggttgtgggtgtgccctccatttactg

SEQ ID NO: 330000 - DNA, 31 bp, Artificial Sequence
  Description of Artificial Sequence: Synthetic oligonucleotide
ttgaggttgtgggtgtgccctccatttactg

SEQ ID NO: 330001 - DNA, 30 bp, Artificial Sequence
  Description of Artificial Sequence: Synthetic oligonucleotide
tgaggttgtgggtgtgccctccatttactg

SEQ ID NO: 330002 - DNA, 29 bp, Artificial Sequence
  Description of Artificial Sequence: Synthetic oligonucleotide
gaggttgtgggtgtgccctccatttactg

SEQ ID NO: 330003 - DNA, 29 bp, Artificial Sequence
  Description of Artificial Sequence: Synthetic oligonucleotide
aggttgtgggtgtgccctccatttactgc

SEQ ID NO: 330004 - DNA, 28 bp, Artificial Sequence
  Description of Artificial Sequence: Synthetic oligonucleotide
ggttgtgggtgtgccctccatttactgc

SEQ ID NO: 330005 - DNA, 29 bp, Artificial Sequence
  Description of Artificial Sequence: Synthetic oligonucleotide
gttgtgggtgtgccctccatttactgcac

SEQ ID NO: 330006 - DNA, 29 bp, Artificial Sequence
  Description of Artificial Sequence: Synthetic oligonucleotide
ttgtgggtgtgccctccatttactgcacc

SEQ ID NO: 330007 - DNA, 28 bp, Artificial Sequence
  Description of Artificial Sequence: Synthetic oligonucleotide
tgtgggtgtgccctccatttactgcacc

SEQ ID NO: 330008 - DNA, 27 bp, Artificial Sequence
  Description of Artificial Sequence: Synthetic oligonucleotide
gtgggtgtgccctccatttactgcacc

SEQ ID NO: 330009 - DNA, 28 bp, Artificial Sequence
  Description of Artificial Sequence: Synthetic oligonucleotide
tgggtgtgccctccatttactgcacctg

SEQ ID NO: 330010 - DNA, 27 bp, Artificial Sequence
  Description of Artificial Sequence: Synthetic oligonucleotide
gggtgtgccctccatttactgcacctg

SEQ ID NO: 330011 - DNA, 27 bp, Artificial Sequence
  Description of Artificial Sequence: Synthetic oligonucleotide
ggtgtgccctccatttactgcacctgc

SEQ ID NO: 330012 - DNA, 30 bp, Artificial Sequence
  Description of Artificial Sequence: Synthetic oligonucleotide
gtgtgccctccatttactgcacctgcaatg

SEQ ID NO: 330013 - DNA, 31 bp, Artificial Sequence
  Description of Artificial Sequence: Synthetic oligonucleotide
tgtgccctccatttactgcacctgcaatgac

SEQ ID NO: 330014 - DNA, 30 bp, Artificial Sequence
  Description of Artificial Sequence: Synthetic oligonucleotide
gtgccctccatttactgcacctgcaatgac

SEQ ID NO: 330015 - DNA, 30 bp, Artificial Sequence
  Description of Artificial Sequence: Synthetic oligonucleotide
tgccctccatttactgcacctgcaatgacg

SEQ ID NO: 330016 - DNA, 29 bp, Artificial Sequence
  Description of Artificial Sequence: Synthetic oligonucleotide
gccctccatttactgcacctgcaatgacg

SEQ ID NO: 330017 - DNA, 31 bp, Artificial Sequence
  Description of Artificial Sequence: Synthetic oligonucleotide
ccctccatttactgcacctgcaatgacgttc

SEQ ID NO: 330018 - DNA, 33 bp, Artificial Sequence
  Description of Artificial Sequence: Synthetic oligonucleotide
cctccatttactgcacctgcaatgacgttcaag

SEQ ID NO: 330019 - DNA, 34 bp, Artificial Sequence
  Description of Artificial Sequence: Synthetic oligonucleotide
ctccatttactgcacctgcaatgacgttcaagtg

SEQ ID NO: 330020 - DNA, 34 bp, Artificial Sequence
  Description of Artificial Sequence: Synthetic oligonucleotide
tccatttactgcacctgcaatgacgttcaagtgg

SEQ ID NO: 330021 - DNA, 33 bp, Artificial Sequence
  Description of Artificial Sequence: Synthetic oligonucleotide
ccatttactgcacctgcaatgacgttcaagtgg

SEQ ID NO: 330022 - DNA, 33 bp, Artificial Sequence
  Description of Artificial Sequence: Synthetic oligonucleotide
catttactgcacctgcaatgacgttcaagtggg

SEQ ID NO: 330023 - DNA, 33 bp, Artificial Sequence
  Description of Artificial Sequence: Synthetic oligonucleotide
atttactgcacctgcaatgacgttcaagtgggg

SEQ ID NO: 330024 - DNA, 32 bp, Artificial Sequence
  Description of Artificial Sequence: Synthetic oligonucleotide
tttactgcacctgcaatgacgttcaagtgggg

SEQ ID NO: 330025 - DNA, 31 bp, Artificial Sequence
  Description of Artificial Sequence: Synthetic oligonucleotide
ttactgcacctgcaatgacgttcaagtgggg

SEQ ID NO: 330026 - DNA, 30 bp, Artificial Sequence
  Description of Artificial Sequence: Synthetic oligonucleotide
tactgcacctgcaatgacgttcaagtgggg

SEQ ID NO: 330027 - DNA, 29 bp, Artificial Sequence
  Description of Artificial Sequence: Synthetic oligonucleotide
actgcacctgcaatgacgttcaagtgggg

SEQ ID NO: 330028 - DNA, 28 bp, Artificial Sequence
  Description of Artificial Sequence: Synthetic oligonucleotide
ctgcacctgcaatgacgttcaagtgggg

SEQ ID NO: 330029 - DNA, 30 bp, Artificial Sequence
  Description of Artificial Sequence: Synthetic oligonucleotide
tgcacctgcaatgacgttcaagtggggatc

SEQ ID NO: 330030 - DNA, 29 bp, Artificial Sequence
  Description of Artificial Sequence: Synthetic oligonucleotide
gcacctgcaatgacgttcaagtggggatc

SEQ ID NO: 330031 - DNA, 30 bp, Artificial Sequence
  Description of Artificial Sequence: Synthetic oligonucleotide
cacctgcaatgacgttcaagtggggatctg

SEQ ID NO: 330032 - DNA, 30 bp, Artificial Sequence
  Description of Artificial Sequence: Synthetic oligonucleotide
acctgcaatgacgttcaagtggggatctgg

SEQ ID NO: 330033 - DNA, 29 bp, Artificial Sequence
  Description of Artificial Sequence: Synthetic oligonucleotide
cctgcaatgacgttcaagtggggatctgg

SEQ ID NO: 330034 - DNA, 30 bp, Artificial Sequence
  Description of Artificial Sequence: Synthetic oligonucleotide
ctgcaatgacgttcaagtggggatctggag

SEQ ID NO: 330035 - DNA, 30 bp, Artificial Sequence
  Description of Artificial Sequence: Synthetic oligonucleotide
tgcaatgacgttcaagtggggatctggagc

SEQ ID NO: 330036 - DNA, 29 bp, Artificial Sequence
  Description of Artificial Sequence: Synthetic oligonucleotide
gcaatgacgttcaagtggggatctggagc

SEQ ID NO: 330037 - DNA, 29 bp, Artificial Sequence
  Description of Artificial Sequence: Synthetic oligonucleotide
caatgacgttcaagtggggatctggagcc

SEQ ID NO: 330038 - DNA, 29 bp, Artificial Sequence
  Description of Artificial Sequence: Synthetic oligonucleotide
aatgacgttcaagtggggatctggagccg

SEQ ID NO: 330039 - DNA, 28 bp, Artificial Sequence
  Description of Artificial Sequence: Synthetic oligonucleotide
atgacgttcaagtggggatctggagccg

SEQ ID NO: 330040 - DNA, 27 bp, Artificial Sequence
  Description of Artificial Sequence: Synthetic oligonucleotide
tgacgttcaagtggggatctggagccg

SEQ ID NO: 330041 - DNA, 26 bp, Artificial Sequence
  Description of Artificial Sequence: Synthetic oligonucleotide
gacgttcaagtggggatctggagccg

SEQ ID NO: 330042 - DNA, 26 bp, Artificial Sequence
  Description of Artificial Sequence: Synthetic oligonucleotide
acgttcaagtggggatctggagccgc

SEQ ID NO: 330043 - DNA, 25 bp, Artificial Sequence
  Description of Artificial Sequence: Synthetic oligonucleotide
cgttcaagtggggatctggagccgc

SEQ ID NO: 330044 - DNA, 25 bp, Artificial Sequence
  Description of Artificial Sequence: Synthetic oligonucleotide
gttcaagtggggatctggagccgcc

SEQ ID NO: 330045 - DNA, 25 bp, Artificial Sequence
  Description of Artificial Sequence: Synthetic oligonucleotide
ttcaagtggggatctggagccgccc

SEQ ID NO: 330046 - DNA, 24 bp, Artificial Sequence
  Description of Artificial Sequence: Synthetic oligonucleotide
tcaagtggggatctggagccgccc

SEQ ID NO: 330047 - DNA, 23 bp, Artificial Sequence
  Description of Artificial Sequence: Synthetic oligonucleotide
caagtggggatctggagccgccc

SEQ ID NO: 330048 - DNA, 23 bp, Artificial Sequence
  Description of Artificial Sequence: Synthetic oligonucleotide
aagtggggatctggagccgcccc

SEQ ID NO: 330049 - DNA, 22 bp, Artificial Sequence
  Description of Artificial Sequence: Synthetic oligonucleotide
agtggggatctggagccgcccc

SEQ ID NO: 330050 - DNA, 21 bp, Artificial Sequence
  Description of Artificial Sequence: Synthetic oligonucleotide
gtggggatctggagccgcccc

SEQ ID NO: 330051 - DNA, 21 bp, Artificial Sequence
  Description of Artificial Sequence: Synthetic oligonucleotide
tggggatctggagccgccccg

SEQ ID NO: 330052 - DNA, 20 bp, Artificial Sequence
  Description of Artificial Sequence: Synthetic oligonucleotide
ggggatctggagccgccccg

SEQ ID NO: 330053 - DNA, 20 bp, Artificial Sequence
  Description of Artificial Sequence: Synthetic oligonucleotide
gggatctggagccgccccgc

SEQ ID NO: 330054 - DNA, 20 bp, Artificial Sequence
  Description of Artificial Sequence: Synthetic oligonucleotide
ggatctggagccgccccgcc

SEQ ID NO: 330055 - DNA, 20 bp, Artificial Sequence
  Description of Artificial Sequence: Synthetic oligonucleotide
gatctggagccgccccgccc

SEQ ID NO: 330056 - DNA, 21 bp, Artificial Sequence
  Description of Artificial Sequence: Synthetic oligonucleotide
atctggagccgccccgcccgt

SEQ ID NO: 330057 - DNA, 20 bp, Artificial Sequence
  Description of Artificial Sequence: Synthetic oligonucleotide
tctggagccgccccgcccgt

SEQ ID NO: 330058 - DNA, 20 bp, Artificial Sequence
  Description of Artificial Sequence: Synthetic oligonucleotide
ctggagccgccccgcccgtt

SEQ ID NO: 330059 - DNA, 20 bp, Artificial Sequence
  Description of Artificial Sequence: Synthetic oligonucleotide
tggagccgccccgcccgtca

SEQ ID NO: 330060 - DNA, 20 bp, Artificial Sequence
  Description of Artificial Sequence: Synthetic oligonucleotide
ggagccgccccgcccgtcat

SEQ ID NO: 330061 - DNA, 20 bp, Artificial Sequence
  Description of Artificial Sequence: Synthetic oligonucleotide
gagccgccccgcccgtcagt

SEQ ID NO: 330062 - DNA, 20 bp, Artificial Sequence
  Description of Artificial Sequence: Synthetic oligonucleotide
agccgccccgcccgtcagtg

SEQ ID NO: 330063 - DNA, 20 bp, Artificial Sequence
  Description of Artificial Sequence: Synthetic oligonucleotide
gccgccccgcccgtcagtgt

SEQ ID NO: 330064 - DNA, 25 bp, Artificial Sequence
  Description of Artificial Sequence: Synthetic oligonucleotide
ccgccccgcccgtcagtgcataata

SEQ ID NO: 330065 - DNA, 25 bp, Artificial Sequence
  Description of Artificial Sequence: Synthetic oligonucleotide
cgccccgcccgtcagtgcataatac

SEQ ID NO: 330066 - DNA, 27 bp, Artificial Sequence
  Description of Artificial Sequence: Synthetic oligonucleotide
gccccgcccgtcagtgcataataccta

SEQ ID NO: 330067 - DNA, 28 bp, Artificial Sequence
  Description of Artificial Sequence: Synthetic oligonucleotide
ccccgcccgtcagtgcataatacctaac

SEQ ID NO: 330068 - DNA, 32 bp, Artificial Sequence
  Description of Artificial Sequence: Synthetic oligonucleotide
cccgcccgtcagtgcataatacctaactaatg

SEQ ID NO: 330069 - DNA, 32 bp, Artificial Sequence
  Description of Artificial Sequence: Synthetic oligonucleotide
ccgcccgtcagtgcataatacctaactaatgc

SEQ ID NO: 330070 - DNA, 33 bp, Artificial Sequence
  Description of Artificial Sequence: Synthetic oligonucleotide
cgcccgtcagtgcataatacctaactaatgcac

SEQ ID NO: 330071 - DNA, 33 bp, Artificial Sequence
  Description of Artificial Sequence: Synthetic oligonucleotide
gcccgtcagtgcataatacctaactaatgcacg

SEQ ID NO: 330072 - DNA, 33 bp, Artificial Sequence
  Description of Artificial Sequence: Synthetic oligonucleotide
cccgtcagtgcataatacctaactaatgcacgc

SEQ ID NO: 330073 - DNA, 33 bp, Artificial Sequence
  Description of Artificial Sequence: Synthetic oligonucleotide
ccgtcagtgcataatacctaactaatgcacgcg

SEQ ID NO: 330074 - DNA, 34 bp, Artificial Sequence
  Description of Artificial Sequence: Synthetic oligonucleotide
cgtcagtgcataatacctaactaatgcacgcgtc

SEQ ID NO: 330075 - DNA, 34 bp, Artificial Sequence
  Description of Artificial Sequence: Synthetic oligonucleotide
gtcagtgcataatacctaactaatgcacgcgtcc

SEQ ID NO: 330076 - DNA, 38 bp, Artificial Sequence
  Description of Artificial Sequence: Synthetic oligonucleotide
tcagtgcataatacctaactaatgcacgcgtccaaatg

SEQ ID NO: 330077 - DNA, 37 bp, Artificial Sequence
  Description of Artificial Sequence: Synthetic oligonucleotide
cagtgcataatacctaactaatgcacgcgtccaaatg

SEQ ID NO: 330078 - DNA, 38 bp, Artificial Sequence
  Description of Artificial Sequence: Synthetic oligonucleotide
agtgcataatacctaactaatgcacgcgtccaaatgtc

SEQ ID NO: 330079 - DNA, 37 bp, Artificial Sequence
  Description of Artificial Sequence: Synthetic oligonucleotide
gtgcataatacctaactaatgcacgcgtccaaatgtc

SEQ ID NO: 330080 - DNA, 37 bp, Artificial Sequence
  Description of Artificial Sequence: Synthetic oligonucleotide
tgcataatacctaactaatgcacgcgtccaaatgtcg

SEQ ID NO: 330081 - DNA, 36 bp, Artificial Sequence
  Description of Artificial Sequence: Synthetic oligonucleotide
gcataatacctaactaatgcacgcgtccaaatgtcg

SEQ ID NO: 330082 - DNA, 41 bp, Artificial Sequence
  Description of Artificial Sequence: Synthetic oligonucleotide
cataatacctaactaatgcacgcgtccaaatgtcgaaaatg

SEQ ID NO: 330083 - DNA, 41 bp, Artificial Sequence
  Description of Artificial Sequence: Synthetic oligonucleotide
ataatacctaactaatgcacgcgtccaaatgtcgaaaatgg

SEQ ID NO: 330084 - DNA, 40 bp, Artificial Sequence
  Description of Artificial Sequence: Synthetic oligonucleotide
taatacctaactaatgcacgcgtccaaatgtcgaaaatgg

SEQ ID NO: 330085 - DNA, 39 bp, Artificial Sequence
  Description of Artificial Sequence: Synthetic oligonucleotide
aatacctaactaatgcacgcgtccaaatgtcgaaaatgg

SEQ ID NO: 330086 - DNA, 38 bp, Artificial Sequence
  Description of Artificial Sequence: Synthetic oligonucleotide
atacctaactaatgcacgcgtccaaatgtcgaaaatgg

SEQ ID NO: 330087 - DNA, 37 bp, Artificial Sequence
  Description of Artificial Sequence: Synthetic oligonucleotide
tacctaactaatgcacgcgtccaaatgtcgaaaatgg

SEQ ID NO: 330088 - DNA, 36 bp, Artificial Sequence
  Description of Artificial Sequence: Synthetic oligonucleotide
acctaactaatgcacgcgtccaaatgtcgaaaatgg

SEQ ID NO: 330089 - DNA, 35 bp, Artificial Sequence
  Description of Artificial Sequence: Synthetic oligonucleotide
cctaactaatgcacgcgtccaaatgtcgaaaatgg

SEQ ID NO: 330090 - DNA, 41 bp, Artificial Sequence
  Description of Artificial Sequence: Synthetic oligonucleotide
ctaactaatgcacgcgtccaaatgtcgaaaatggattattg

SEQ ID NO: 330091 - DNA, 41 bp, Artificial Sequence
  Description of Artificial Sequence: Synthetic oligonucleotide
taactaatgcacgcgtccaaatgtcgaaaatggattattgg

SEQ ID NO: 330092 - DNA, 40 bp, Artificial Sequence
  Description of Artificial Sequence: Synthetic oligonucleotide
aactaatgcacgcgtccaaatgtcgaaaatggattattgg

SEQ ID NO: 330093 - DNA, 39 bp, Artificial Sequence
  Description of Artificial Sequence: Synthetic oligonucleotide
actaatgcacgcgtccaaatgtcgaaaatggattattgg

SEQ ID NO: 330094 - DNA, 38 bp, Artificial Sequence
  Description of Artificial Sequence: Synthetic oligonucleotide
ctaatgcacgcgtccaaatgtcgaaaatggattattgg

SEQ ID NO: 330095 - DNA, 41 bp, Artificial Sequence
  Description of Artificial Sequence: Synthetic oligonucleotide
taatgcacgcgtccaaatgtcgaaaatggattattggtatg

SEQ ID NO: 330096 - DNA, 40 bp, Artificial Sequence
  Description of Artificial Sequence: Synthetic oligonucleotide
aatgcacgcgtccaaatgtcgaaaatggattattggtatg

SEQ ID NO: 330097 - DNA, 39 bp, Artificial Sequence
  Description of Artificial Sequence: Synthetic oligonucleotide
atgcacgcgtccaaatgtcgaaaatggattattggtatg

SEQ ID NO: 330098 - DNA, 38 bp, Artificial Sequence
  Description of Artificial Sequence: Synthetic oligonucleotide
tgcacgcgtccaaatgtcgaaaatggattattggtatg

SEQ ID NO: 330099 - DNA, 37 bp, Artificial Sequence
  Description of Artificial Sequence: Synthetic oligonucleotide
gcacgcgtccaaatgtcgaaaatggattattggtatg

SEQ ID NO: 330100 - DNA, 38 bp, Artificial Sequence
  Description of Artificial Sequence: Synthetic oligonucleotide
cacgcgtccaaatgtcgaaaatggattattggtatgtg

SEQ ID NO: 330101 - DNA, 39 bp, Artificial Sequence
  Description of Artificial Sequence: Synthetic oligonucleotide
acgcgtccaaatgtcgaaaatggattattggtatgtgac

SEQ ID NO: 330102 - DNA, 38 bp, Artificial Sequence
  Description of Artificial Sequence: Synthetic oligonucleotide
cgcgtccaaatgtcgaaaatggattattggtatgtgac

SEQ ID NO: 330103 - DNA, 40 bp, Artificial Sequence
  Description of Artificial Sequence: Synthetic oligonucleotide
gcgtccaaatgtcgaaaatggattattggtatgtgacaac

SEQ ID NO: 330104 - DNA, 41 bp, Artificial Sequence
  Description of Artificial Sequence: Synthetic oligonucleotide
cgtccaaatgtcgaaaatggattattggtatgtgacaacag

SEQ ID NO: 330105 - DNA, 43 bp, Artificial Sequence
  Description of Artificial Sequence: Synthetic oligonucleotide
gtccaaatgtcgaaaatggattattggtatgtgacaacagtag

SEQ ID NO: 330106 - DNA, 43 bp, Artificial Sequence
  Description of Artificial Sequence: Synthetic oligonucleotide
tccaaatgtcgaaaatggattattggtatgtgacaacagtagc

SEQ ID NO: 330107 - DNA, 42 bp, Artificial Sequence
  Description of Artificial Sequence: Synthetic oligonucleotide
ccaaatgtcgaaaatggattattggtatgtgacaacagtagc

SEQ ID NO: 330108 - DNA, 49 bp, Artificial Sequence
  Description of Artificial Sequence: Synthetic oligonucleotide
caaatgtcgaaaatggattattggtatgtgacaacagtagcttatttac

SEQ ID NO: 330109 - DNA, 49 bp, Artificial Sequence
  Description of Artificial Sequence: Synthetic oligonucleotide
aaatgtcgaaaatggattattggtatgtgacaacagtagcttatttacc

SEQ ID NO: 330110 - DNA, 48 bp, Artificial Sequence
  Description of Artificial Sequence: Synthetic oligonucleotide
aatgtcgaaaatggattattggtatgtgacaacagtagcttatttacc

SEQ ID NO: 330111 - DNA, 47 bp, Artificial Sequence
  Description of Artificial Sequence: Synthetic oligonucleotide
atgtcgaaaatggattattggtatgtgacaacagtagcttatttacc

SEQ ID NO: 330112 - DNA, 46 bp, Artificial Sequence
  Description of Artificial Sequence: Synthetic oligonucleotide
tgtcgaaaatggattattggtatgtgacaacagtagcttatttacc

SEQ ID NO: 330113 - DNA, 45 bp, Artificial Sequence
  Description of Artificial Sequence: Synthetic oligonucleotide
gtcgaaaatggattattggtatgtgacaacagtagcttatttacc

SEQ ID NO: 330114 - DNA, 51 bp, Artificial Sequence
  Description of Artificial Sequence: Synthetic oligonucleotide
tcgaaaatggattattggtatgtgacaacagtagcttatttaccttaaatg

SEQ ID NO: 330115 - DNA, 50 bp, Artificial Sequence
  Description of Artificial Sequence: Synthetic oligonucleotide
cgaaaatggattattggtatgtgacaacagtagcttatttaccttaaatg

SEQ ID NO: 330116 - DNA, 52 bp, Artificial Sequence
  Description of Artificial Sequence: Synthetic oligonucleotide
gaaaatggattattggtatgtgacaacagtagcttatttaccttaaatgtag

SEQ ID NO: 330117 - DNA, 54 bp, Artificial Sequence
  Description of Artificial Sequence: Synthetic oligonucleotide
aaaatggattattggtatgtgacaacagtagcttatttaccttaaatgtagttg

SEQ ID NO: 330118 - DNA, 53 bp, Artificial Sequence
  Description of Artificial Sequence: Synthetic oligonucleotide
aaatggattattggtatgtgacaacagtagcttatttaccttaaatgtagttg

SEQ ID NO: 330119 - DNA, 52 bp, Artificial Sequence
  Description of Artificial Sequence: Synthetic oligonucleotide
aatggattattggtatgtgacaacagtagcttatttaccttaaatgtagttg

SEQ ID NO: 330120 - DNA, 51 bp, Artificial Sequence
  Description of Artificial Sequence: Synthetic oligonucleotide
atggattattggtatgtgacaacagtagcttatttaccttaaatgtagttg

SEQ ID NO: 330121 - DNA, 50 bp, Artificial Sequence
  Description of Artificial Sequence: Synthetic oligonucleotide
tggattattggtatgtgacaacagtagcttatttaccttaaatgtagttg

SEQ ID NO: 330122 - DNA, 49 bp, Artificial Sequence
  Description of Artificial Sequence: Synthetic oligonucleotide
ggattattggtatgtgacaacagtagcttatttaccttaaatgtagttg

SEQ ID NO: 330123 - DNA, 50 bp, Artificial Sequence
  Description of Artificial Sequence: Synthetic oligonucleotide
gattattggtatgtgacaacagtagcttatttaccttaaatgtagttgtg

SEQ ID NO: 330124 - DNA, 50 bp, Artificial Sequence
  Description of Artificial Sequence: Synthetic oligonucleotide
attattggtatgtgacaacagtagcttatttaccttaaatgtagttgtgg

SEQ ID NO: 330125 - DNA, 49 bp, Artificial Sequence
  Description of Artificial Sequence: Synthetic oligonucleotide
ttattggtatgtgacaacagtagcttatttaccttaaatgtagttgtgg

SEQ ID NO: 330126 - DNA, 48 bp, Artificial Sequence
  Description of Artificial Sequence: Synthetic oligonucleotide
tattggtatgtgacaacagtagcttatttaccttaaatgtagttgtgg

SEQ ID NO: 330127 - DNA, 47 bp, Artificial Sequence
  Description of Artificial Sequence: Synthetic oligonucleotide
attggtatgtgacaacagtagcttatttaccttaaatgtagttgtgg

SEQ ID NO: 330128 - DNA, 46 bp, Artificial Sequence
  Description of Artificial Sequence: Synthetic oligonucleotide
ttggtatgtgacaacagtagcttatttaccttaaatgtagttgtgg

SEQ ID NO: 330129 - DNA, 45 bp, Artificial Sequence
  Description of Artificial Sequence: Synthetic oligonucleotide
tggtatgtgacaacagtagcttatttaccttaaatgtagttgtgg

SEQ ID NO: 330130 - DNA, 44 bp, Artificial Sequence
  Description of Artificial Sequence: Synthetic oligonucleotide
ggtatgtgacaacagtagcttatttaccttaaatgtagttgtgg

SEQ ID NO: 330131 - DNA, 45 bp, Artificial Sequence
  Description of Artificial Sequence: Synthetic oligonucleotide
gtatgtgacaacagtagcttatttaccttaaatgtagttgtggac

SEQ ID NO: 330132 - DNA, 49 bp, Artificial Sequence
  Description of Artificial Sequence: Synthetic oligonucleotide
tatgtgacaacagtagcttatttaccttaaatgtagttgtggactttag

SEQ ID NO: 330133 - DNA, 48 bp, Artificial Sequence
  Description of Artificial Sequence: Synthetic oligonucleotide
atgtgacaacagtagcttatttaccttaaatgtagttgtggactttag

SEQ ID NO: 330134 - DNA, 47 bp, Artificial Sequence
  Description of Artificial Sequence: Synthetic oligonucleotide
tgtgacaacagtagcttatttaccttaaatgtagttgtggactttag

SEQ ID NO: 330135 - DNA, 46 bp, Artificial Sequence
  Description of Artificial Sequence: Synthetic oligonucleotide
gtgacaacagtagcttatttaccttaaatgtagttgtggactttag

SEQ ID NO: 330136 - DNA, 46 bp, Artificial Sequence
  Description of Artificial Sequence: Synthetic oligonucleotide
tgacaacagtagcttatttaccttaaatgtagttgtggactttagg

SEQ ID NO: 330137 - DNA, 45 bp, Artificial Sequence
  Description of Artificial Sequence: Synthetic oligonucleotide
gacaacagtagcttatttaccttaaatgtagttgtggactttagg

SEQ ID NO: 330138 - DNA, 46 bp, Artificial Sequence
  Description of Artificial Sequence: Synthetic oligonucleotide
acaacagtagcttatttaccttaaatgtagttgtggactttaggtg

SEQ ID NO: 330139 - DNA, 45 bp, Artificial Sequence
  Description of Artificial Sequence: Synthetic oligonucleotide
caacagtagcttatttaccttaaatgtagttgtggactttaggtg

SEQ ID NO: 330140 - DNA, 46 bp, Artificial Sequence
  Description of Artificial Sequence: Synthetic oligonucleotide
aacagtagcttatttaccttaaatgtagttgtggactttaggtgtg

SEQ ID NO: 330141 - DNA, 45 bp, Artificial Sequence
  Description of Artificial Sequence: Synthetic oligonucleotide
acagtagcttatttaccttaaatgtagttgtggactttaggtgtg

SEQ ID NO: 330142 - DNA, 44 bp, Artificial Sequence
  Description of Artificial Sequence: Synthetic oligonucleotide
cagtagcttatttaccttaaatgtagttgtggactttaggtgtg

SEQ ID NO: 330143 - DNA, 45 bp, Artificial Sequence
  Description of Artificial Sequence: Synthetic oligonucleotide
agtagcttatttaccttaaatgtagttgtggactttaggtgtgag

SEQ ID NO: 330144 - DNA, 44 bp, Artificial Sequence
  Description of Artificial Sequence: Synthetic oligonucleotide
gtagcttatttaccttaaatgtagttgtggactttaggtgtgag

SEQ ID NO: 330145 - DNA, 44 bp, Artificial Sequence
  Description of Artificial Sequence: Synthetic oligonucleotide
tagcttatttaccttaaatgtagttgtggactttaggtgtgagc

SEQ ID NO: 330146 - DNA, 43 bp, Artificial Sequence
  Description of Artificial Sequence: Synthetic oligonucleotide
agcttatttaccttaaatgtagttgtggactttaggtgtgagc

SEQ ID NO: 330147 - DNA, 42 bp, Artificial Sequence
  Description of Artificial Sequence: Synthetic oligonucleotide
gcttatttaccttaaatgtagttgtggactttaggtgtgagc

SEQ ID NO: 330148 - DNA, 42 bp, Artificial Sequence
  Description of Artificial Sequence: Synthetic oligonucleotide
cttatttaccttaaatgtagttgtggactttaggtgtgagcc

SEQ ID NO: 330149 - DNA, 43 bp, Artificial Sequence
  Description of Artificial Sequence: Synthetic oligonucleotide
ttatttaccttaaatgtagttgtggactttaggtgtgagcctg

SEQ ID NO: 330150 - DNA, 42 bp, Artificial Sequence
  Description of Artificial Sequence: Synthetic oligonucleotide
tatttaccttaaatgtagttgtggactttaggtgtgagcctg

SEQ ID NO: 330151 - DNA, 41 bp, Artificial Sequence
  Description of Artificial Sequence: Synthetic oligonucleotide
atttaccttaaatgtagttgtggactttaggtgtgagcctg

SEQ ID NO: 330152 - DNA, 40 bp, Artificial Sequence
  Description of Artificial Sequence: Synthetic oligonucleotide
tttaccttaaatgtagttgtggactttaggtgtgagcctg

SEQ ID NO: 330153 - DNA, 39 bp, Artificial Sequence
  Description of Artificial Sequence: Synthetic oligonucleotide
ttaccttaaatgtagttgtggactttaggtgtgagcctg

SEQ ID NO: 330154 - DNA, 38 bp, Artificial Sequence
  Description of Artificial Sequence: Synthetic oligonucleotide
taccttaaatgtagttgtggactttaggtgtgagcctg

SEQ ID NO: 330155 - DNA, 37 bp, Artificial Sequence
  Description of Artificial Sequence: Synthetic oligonucleotide
accttaaatgtagttgtggactttaggtgtgagcctg

SEQ ID NO: 330156 - DNA, 36 bp, Artificial Sequence
  Description of Artificial Sequence: Synthetic oligonucleotide
ccttaaatgtagttgtggactttaggtgtgagcctg

SEQ ID NO: 330157 - DNA, 36 bp, Artificial Sequence
  Description of Artificial Sequence: Synthetic oligonucleotide
cttaaatgtagttgtggactttaggtgtgagcctgg

SEQ ID NO: 330158 - DNA, 36 bp, Artificial Sequence
  Description of Artificial Sequence: Synthetic oligonucleotide
ttaaatgtagttgtggactttaggtgtgagcctggc

SEQ ID NO: 330159 - DNA, 35 bp, Artificial Sequence
  Description of Artificial Sequence: Synthetic oligonucleotide
taaatgtagttgtggactttaggtgtgagcctggc

SEQ ID NO: 330160 - DNA, 34 bp, Artificial Sequence
  Description of Artificial Sequence: Synthetic oligonucleotide
aaatgtagttgtggactttaggtgtgagcctggc

SEQ ID NO: 330161 - DNA, 33 bp, Artificial Sequence
  Description of Artificial Sequence: Synthetic oligonucleotide
aatgtagttgtggactttaggtgtgagcctggc

SEQ ID NO: 330162 - DNA, 32 bp, Artificial Sequence
  Description of Artificial Sequence: Synthetic oligonucleotide
atgtagttgtggactttaggtgtgagcctggc

SEQ ID NO: 330163 - DNA, 31 bp, Artificial Sequence
  Description of Artificial Sequence: Synthetic oligonucleotide
tgtagttgtggactttaggtgtgagcctggc

SEQ ID NO: 330164 - DNA, 30 bp, Artificial Sequence
  Description of Artificial Sequence: Synthetic oligonucleotide
gtagttgtggactttaggtgtgagcctggc

SEQ ID NO: 330165 - DNA, 33 bp, Artificial Sequence
  Description of Artificial Sequence: Synthetic oligonucleotide
tagttgtggactttaggtgtgagcctggctatg

SEQ ID NO: 330166 - DNA, 32 bp, Artificial Sequence
  Description of Artificial Sequence: Synthetic oligonucleotide
agttgtggactttaggtgtgagcctggctatg

SEQ ID NO: 330167 - DNA, 31 bp, Artificial Sequence
  Description of Artificial Sequence: Synthetic oligonucleotide
gttgtggactttaggtgtgagcctggctatg

SEQ ID NO: 330168 - DNA, 32 bp, Artificial Sequence
  Description of Artificial Sequence: Synthetic oligonucleotide
ttgtggactttaggtgtgagcctggctatgtc

SEQ ID NO: 330169 - DNA, 31 bp, Artificial Sequence
  Description of Artificial Sequence: Synthetic oligonucleotide
tgtggactttaggtgtgagcctggctatgtc

SEQ ID NO: 330170 - DNA, 30 bp, Artificial Sequence
  Description of Artificial Sequence: Synthetic oligonucleotide
gtggactttaggtgtgagcctggctatgtc

SEQ ID NO: 330171 - DNA, 32 bp, Artificial Sequence
  Description of Artificial Sequence: Synthetic oligonucleotide
tggactttaggtgtgagcctggctatgtcatg

SEQ ID NO: 330172 - DNA, 31 bp, Artificial Sequence
  Description of Artificial Sequence: Synthetic oligonucleotide
ggactttaggtgtgagcctggctatgtcatg

SEQ ID NO: 330173 - DNA, 34 bp, Artificial Sequence
  Description of Artificial Sequence: Synthetic oligonucleotide
gactttaggtgtgagcctggctatgtcatgaatg

SEQ ID NO: 330174 - DNA, 34 bp, Artificial Sequence
  Description of Artificial Sequence: Synthetic oligonucleotide
actttaggtgtgagcctggctatgtcatgaatgg

SEQ ID NO: 330175 - DNA, 33 bp, Artificial Sequence
  Description of Artificial Sequence: Synthetic oligonucleotide
ctttaggtgtgagcctggctatgtcatgaatgg

SEQ ID NO: 330176 - DNA, 34 bp, Artificial Sequence
  Description of Artificial Sequence: Synthetic oligonucleotide
tttaggtgtgagcctggctatgtcatgaatggac

SEQ ID NO: 330177 - DNA, 33 bp, Artificial Sequence
  Description of Artificial Sequence: Synthetic oligonucleotide
ttaggtgtgagcctggctatgtcatgaatggac

SEQ ID NO: 330178 - DNA, 32 bp, Artificial Sequence
  Description of Artificial Sequence: Synthetic oligonucleotide
taggtgtgagcctggctatgtcatgaatggac

SEQ ID NO: 330179 - DNA, 31 bp, Artificial Sequence
  Description of Artificial Sequence: Synthetic oligonucleotide
aggtgtgagcctggctatgtcatgaatggac

SEQ ID NO: 330180 - DNA, 30 bp, Artificial Sequence
  Description of Artificial Sequence: Synthetic oligonucleotide
ggtgtgagcctggctatgtcatgaatggac

SEQ ID NO: 330181 - DNA, 30 bp, Artificial Sequence
  Description of Artificial Sequence: Synthetic oligonucleotide
gtgtgagcctggctatgtcatgaatggacc

SEQ ID NO: 330182 - DNA, 30 bp, Artificial Sequence
  Description of Artificial Sequence: Synthetic oligonucleotide
tgtgagcctggctatgtcatgaatggaccc

SEQ ID NO: 330183 - DNA, 29 bp, Artificial Sequence
  Description of Artificial Sequence: Synthetic oligonucleotide
gtgagcctggctatgtcatgaatggaccc

SEQ ID NO: 330184 - DNA, 29 bp, Artificial Sequence
  Description of Artificial Sequence: Synthetic oligonucleotide
tgagcctggctatgtcatgaatggacccc

SEQ ID NO: 330185 - DNA, 28 bp, Artificial Sequence
  Description of Artificial Sequence: Synthetic oligonucleotide
gagcctggctatgtcatgaatggacccc

SEQ ID NO: 330186 - DNA, 28 bp, Artificial Sequence
  Description of Artificial Sequence: Synthetic oligonucleotide
agcctggctatgtcatgaatggaccccg

SEQ ID NO: 330187 - DNA, 27 bp, Artificial Sequence
  Description of Artificial Sequence: Synthetic oligonucleotide
gcctggctatgtcatgaatggaccccg

SEQ ID NO: 330188 - DNA, 27 bp, Artificial Sequence
  Description of Artificial Sequence: Synthetic oligonucleotide
cctggctatgtcatgaatggaccccgc

SEQ ID NO: 330189 - DNA, 27 bp, Artificial Sequence
  Description of Artificial Sequence: Synthetic oligonucleotide
ctggctatgtcatgaatggaccccgcg

SEQ ID NO: 330190 - DNA, 27 bp, Artificial Sequence
  Description of Artificial Sequence: Synthetic oligonucleotide
tggctatgtcatgaatggaccccgcgg

SEQ ID NO: 330191 - DNA, 27 bp, Artificial Sequence
  Description of Artificial Sequence: Synthetic oligonucleotide
ggctatgtcatgaatggaccccgcggt

SEQ ID NO: 330192 - DNA, 27 bp, Artificial Sequence
  Description of Artificial Sequence: Synthetic oligonucleotide
gctatgtcatgaatggaccccgcggtg

SEQ ID NO: 330193 - DNA, 28 bp, Artificial Sequence
  Description of Artificial Sequence: Synthetic oligonucleotide
ctatgtcatgaatggaccccgcggtgtg

SEQ ID NO: 330194 - DNA, 30 bp, Artificial Sequence
  Description of Artificial Sequence: Synthetic oligonucleotide
tatgtcatgaatggaccccgcggtgtgaag

SEQ ID NO: 330195 - DNA, 29 bp, Artificial Sequence
  Description of Artificial Sequence: Synthetic oligonucleotide
atgtcatgaatggaccccgcggtgtgaag

SEQ ID NO: 330196 - DNA, 28 bp, Artificial Sequence
  Description of Artificial Sequence: Synthetic oligonucleotide
tgtcatgaatggaccccgcggtgtgaag

SEQ ID NO: 330197 - DNA, 27 bp, Artificial Sequence
  Description of Artificial Sequence: Synthetic oligonucleotide
gtcatgaatggaccccgcggtgtgaag

SEQ ID NO: 330198 - DNA, 28 bp, Artificial Sequence
  Description of Artificial Sequence: Synthetic oligonucleotide
tcatgaatggaccccgcggtgtgaagtc

SEQ ID NO: 330199 - DNA, 27 bp, Artificial Sequence
  Description of Artificial Sequence: Synthetic oligonucleotide
catgaatggaccccgcggtgtgaagtc

SEQ ID NO: 330200 - DNA, 27 bp, Artificial Sequence
  Description of Artificial Sequence: Synthetic oligonucleotide
atgaatggaccccgcggtgtgaagtcc

SEQ ID NO: 330201 - DNA, 26 bp, Artificial Sequence
  Description of Artificial Sequence: Synthetic oligonucleotide
tgaatggaccccgcggtgtgaagtcc

SEQ ID NO: 330202 - DNA, 25 bp, Artificial Sequence
  Description of Artificial Sequence: Synthetic oligonucleotide
gaatggaccccgcggtgtgaagtcc

SEQ ID NO: 330203 - DNA, 26 bp, Artificial Sequence
  Description of Artificial Sequence: Synthetic oligonucleotide
aatggaccccgcggtgtgaagtccca

SEQ ID NO: 330204 - DNA, 25 bp, Artificial Sequence
  Description of Artificial Sequence: Synthetic oligonucleotide
atggaccccgcggtgtgaagtccca

SEQ ID NO: 330205 - DNA, 24 bp, Artificial Sequence
  Description of Artificial Sequence: Synthetic oligonucleotide
tggaccccgcggtgtgaagtccca

SEQ ID NO: 330206 - DNA, 23 bp, Artificial Sequence
  Description of Artificial Sequence: Synthetic oligonucleotide
ggaccccgcggtgtgaagtccca

SEQ ID NO: 330207 - DNA, 23 bp, Artificial Sequence
  Description of Artificial Sequence: Synthetic oligonucleotide
gaccccgcggtgtgaagtcccag

SEQ ID NO: 330208 - DNA, 23 bp, Artificial Sequence
  Description of Artificial Sequence: Synthetic oligonucleotide
accccgcggtgtgaagtcccagg

SEQ ID NO: 330209 - DNA, 22 bp, Artificial Sequence
  Description of Artificial Sequence: Synthetic oligonucleotide
ccccgcggtgtgaagtcccagg

SEQ ID NO: 330210 - DNA, 22 bp, Artificial Sequence
  Description of Artificial Sequence: Synthetic oligonucleotide
cccgcggtgtgaagtcccaggc

SEQ ID NO: 330211 - DNA, 22 bp, Artificial Sequence
  Description of Artificial Sequence: Synthetic oligonucleotide
ccgcggtgtgaagtcccaggcc

SEQ ID NO: 330212 - DNA, 23 bp, Artificial Sequence
  Description of Artificial Sequence: Synthetic oligonucleotide
cgcggtgtgaagtcccaggccct

SEQ ID NO: 330213 - DNA, 25 bp, Artificial Sequence
  Description of Artificial Sequence: Synthetic oligonucleotide
gcggtgtgaagtcccaggccctcaa

SEQ ID NO: 330214 - DNA, 27 bp, Artificial Sequence
  Description of Artificial Sequence: Synthetic oligonucleotide
cggtgtgaagtcccaggccctcaacaa

SEQ ID NO: 330215 - DNA, 29 bp, Artificial Sequence
  Description of Artificial Sequence: Synthetic oligonucleotide
ggtgtgaagtcccaggccctcaacaaatg

SEQ ID NO: 330216 - DNA, 29 bp, Artificial Sequence
  Description of Artificial Sequence: Synthetic oligonucleotide
gtgtgaagtcccaggccctcaacaaatgg

SEQ ID NO: 330217 - DNA, 29 bp, Artificial Sequence
  Description of Artificial Sequence: Synthetic oligonucleotide
tgtgaagtcccaggccctcaacaaatggc

SEQ ID NO: 330218 - DNA, 28 bp, Artificial Sequence
  Description of Artificial Sequence: Synthetic oligonucleotide
gtgaagtcccaggccctcaacaaatggc

SEQ ID NO: 330219 - DNA, 29 bp, Artificial Sequence
  Description of Artificial Sequence: Synthetic oligonucleotide
tgaagtcccaggccctcaacaaatggcag

SEQ ID NO: 330220 - DNA, 28 bp, Artificial Sequence
  Description of Artificial Sequence: Synthetic oligonucleotide
gaagtcccaggccctcaacaaatggcag

SEQ ID NO: 330221 - DNA, 28 bp, Artificial Sequence
  Description of Artificial Sequence: Synthetic oligonucleotide
aagtcccaggccctcaacaaatggcagc

SEQ ID NO: 330222 - DNA, 27 bp, Artificial Sequence
  Description of Artificial Sequence: Synthetic oligonucleotide
agtcccaggccctcaacaaatggcagc

SEQ ID NO: 330223 - DNA, 26 bp, Artificial Sequence
  Description of Artificial Sequence: Synthetic oligonucleotide
gtcccaggccctcaacaaatggcagc

SEQ ID NO: 330224 - DNA, 26 bp, Artificial Sequence
  Description of Artificial Sequence: Synthetic oligonucleotide
tcccaggccctcaacaaatggcagcc

SEQ ID NO: 330225 - DNA, 25 bp, Artificial Sequence
  Description of Artificial Sequence: Synthetic oligonucleotide
cccaggccctcaacaaatggcagcc

SEQ ID NO: 330226 - DNA, 25 bp, Artificial Sequence
  Description of Artificial Sequence: Synthetic oligonucleotide
ccaggccctcaacaaatggcagccg

SEQ ID NO: 330227 - DNA, 26 bp, Artificial Sequence
  Description of Artificial Sequence: Synthetic oligonucleotide
caggccctcaacaaatggcagccgga

SEQ ID NO: 330228 - DNA, 26 bp, Artificial Sequence
  Description of Artificial Sequence: Synthetic oligonucleotide
aggccctcaacaaatggcagccggag

SEQ ID NO: 330229 - DNA, 25 bp, Artificial Sequence
  Description of Artificial Sequence: Synthetic oligonucleotide
ggccctcaacaaatggcagccggag

SEQ ID NO: 330230 - DNA, 27 bp, Artificial Sequence
  Description of Artificial Sequence: Synthetic oligonucleotide
gccctcaacaaatggcagccggagcaa

SEQ ID NO: 330231 - DNA, 27 bp, Artificial Sequence
  Description of Artificial Sequence: Synthetic oligonucleotide
ccctcaacaaatggcagccggagcaac

SEQ ID NO: 330232 - DNA, 27 bp, Artificial Sequence
  Description of Artificial Sequence: Synthetic oligonucleotide
cctcaacaaatggcagccggagcaacc

SEQ ID NO: 330233 - DNA, 29 bp, Artificial Sequence
  Description of Artificial Sequence: Synthetic oligonucleotide
ctcaacaaatggcagccggagcaaccaag

SEQ ID NO: 330234 - DNA, 29 bp, Artificial Sequence
  Description of Artificial Sequence: Synthetic oligonucleotide
tcaacaaatggcagccggagcaaccaagc

SEQ ID NO: 330235 - DNA, 28 bp, Artificial Sequence
  Description of Artificial Sequence: Synthetic oligonucleotide
caacaaatggcagccggagcaaccaagc

SEQ ID NO: 330236 - DNA, 29 bp, Artificial Sequence
  Description of Artificial Sequence: Synthetic oligonucleotide
aacaaatggcagccggagcaaccaagctg

SEQ ID NO: 330237 - DNA, 28 bp, Artificial Sequence
  Description of Artificial Sequence: Synthetic oligonucleotide
acaaatggcagccggagcaaccaagctg

SEQ ID NO: 330238 - DNA, 27 bp, Artificial Sequence
  Description of Artificial Sequence: Synthetic oligonucleotide
caaatggcagccggagcaaccaagctg

SEQ ID NO: 330239 - DNA, 27 bp, Artificial Sequence
  Description of Artificial Sequence: Synthetic oligonucleotide
aaatggcagccggagcaaccaagctgg

SEQ ID NO: 330240 - DNA, 27 bp, Artificial Sequence
  Description of Artificial Sequence: Synthetic oligonucleotide
aatggcagccggagcaaccaagctggt

SEQ ID NO: 330241 - DNA, 26 bp, Artificial Sequence
  Description of Artificial Sequence: Synthetic oligonucleotide
atggcagccggagcaaccaagctggt

SEQ ID NO: 330242 - DNA, 25 bp, Artificial Sequence
  Description of Artificial Sequence: Synthetic oligonucleotide
tggcagccggagcaaccaagctggt

SEQ ID NO: 330243 - DNA, 24 bp, Artificial Sequence
  Description of Artificial Sequence: Synthetic oligonucleotide
ggcagccggagcaaccaagctggt

SEQ ID NO: 330244 - DNA, 24 bp, Artificial Sequence
  Description of Artificial Sequence: Synthetic oligonucleotide
gcagccggagcaaccaagctggtc

SEQ ID NO: 330245 - DNA, 25 bp, Artificial Sequence
  Description of Artificial Sequence: Synthetic oligonucleotide
cagccggagcaaccaagctggtcca

SEQ ID NO: 330246 - DNA, 25 bp, Artificial Sequence
  Description of Artificial Sequence: Synthetic oligonucleotide
agccggagcaaccaagctggtccag

SEQ ID NO: 330247 - DNA, 24 bp, Artificial Sequence
  Description of Artificial Sequence: Synthetic oligonucleotide
gccggagcaaccaagctggtccag

SEQ ID NO: 330248 - DNA, 24 bp, Artificial Sequence
  Description of Artificial Sequence: Synthetic oligonucleotide
ccggagcaaccaagctggtccagg

SEQ ID NO: 330249 - DNA, 27 bp, Artificial Sequence
  Description of Artificial Sequence: Synthetic oligonucleotide
cggagcaaccaagctggtccagggtaa

SEQ ID NO: 330250 - DNA, 27 bp, Artificial Sequence
  Description of Artificial Sequence: Synthetic oligonucleotide
ggagcaaccaagctggtccagggtaag

SEQ ID NO: 330251 - DNA, 28 bp, Artificial Sequence
  Description of Artificial Sequence: Synthetic oligonucleotide
gagcaaccaagctggtccagggtaagtc

SEQ ID NO: 330252 - DNA, 29 bp, Artificial Sequence
  Description of Artificial Sequence: Synthetic oligonucleotide
agcaaccaagctggtccagggtaagtcag

SEQ ID NO: 330253 - DNA, 28 bp, Artificial Sequence
  Description of Artificial Sequence: Synthetic oligonucleotide
gcaaccaagctggtccagggtaagtcag

SEQ ID NO: 330254 - DNA, 28 bp, Artificial Sequence
  Description of Artificial Sequence: Synthetic oligonucleotide
caaccaagctggtccagggtaagtcagc

SEQ ID NO: 330255 - DNA, 28 bp, Artificial Sequence
  Description of Artificial Sequence: Synthetic oligonucleotide
aaccaagctggtccagggtaagtcagcc

SEQ ID NO: 330256 - DNA, 27 bp, Artificial Sequence
  Description of Artificial Sequence: Synthetic oligonucleotide
accaagctggtccagggtaagtcagcc

SEQ ID NO: 330257 - DNA, 27 bp, Artificial Sequence
  Description of Artificial Sequence: Synthetic oligonucleotide
ccaagctggtccagggtaagtcagcca

SEQ ID NO: 330258 - DNA, 27 bp, Artificial Sequence
  Description of Artificial Sequence: Synthetic oligonucleotide
caagctggtccagggtaagtcagccac

SEQ ID NO: 330259 - DNA, 27 bp, Artificial Sequence
  Description of Artificial Sequence: Synthetic oligonucleotide
aagctggtccagggtaagtcagccacg

SEQ ID NO: 330260 - DNA, 27 bp, Artificial Sequence
  Description of Artificial Sequence: Synthetic oligonucleotide
agctggtccagggtaagtcagccacgt

SEQ ID NO: 330261 - DNA, 26 bp, Artificial Sequence
  Description of Artificial Sequence: Synthetic oligonucleotide
gctggtccagggtaagtcagccacgt

SEQ ID NO: 330262 - DNA, 26 bp, Artificial Sequence
  Description of Artificial Sequence: Synthetic oligonucleotide
ctggtccagggtaagtcagccacgtc

SEQ ID NO: 330263 - DNA, 27 bp, Artificial Sequence
  Description of Artificial Sequence: Synthetic oligonucleotide
tggtccagggtaagtcagccacgtcca

SEQ ID NO: 330264 - DNA, 26 bp, Artificial Sequence
  Description of Artificial Sequence: Synthetic oligonucleotide
ggtccagggtaagtcagccacgtcca

SEQ ID NO: 330265 - DNA, 27 bp, Artificial Sequence
  Description of Artificial Sequence: Synthetic oligonucleotide
gtccagggtaagtcagccacgtccaga

SEQ ID NO: 330266 - DNA, 28 bp, Artificial Sequence
  Description of Artificial Sequence: Synthetic oligonucleotide
tccagggtaagtcagccacgtccagatg

SEQ ID NO: 330267 - DNA, 27 bp, Artificial Sequence
  Description of Artificial Sequence: Synthetic oligonucleotide
ccagggtaagtcagccacgtccagatg

SEQ ID NO: 330268 - DNA, 28 bp, Artificial Sequence
  Description of Artificial Sequence: Synthetic oligonucleotide
cagggtaagtcagccacgtccagatgtg

SEQ ID NO: 330269 - DNA, 28 bp, Artificial Sequence
  Description of Artificial Sequence: Synthetic oligonucleotide
agggtaagtcagccacgtccagatgtgc

SEQ ID NO: 330270 - DNA, 27 bp, Artificial Sequence
  Description of Artificial Sequence: Synthetic oligonucleotide
gggtaagtcagccacgtccagatgtgc

SEQ ID NO: 330271 - DNA, 28 bp, Artificial Sequence
  Description of Artificial Sequence: Synthetic oligonucleotide
ggtaagtcagccacgtccagatgtgctg

SEQ ID NO: 330272 - DNA, 28 bp, Artificial Sequence
  Description of Artificial Sequence: Synthetic oligonucleotide
gtaagtcagccacgtccagatgtgctgc

SEQ ID NO: 330273 - DNA, 30 bp, Artificial Sequence
  Description of Artificial Sequence: Synthetic oligonucleotide
taagtcagccacgtccagatgtgctgcatg

SEQ ID NO: 330274 - DNA, 29 bp, Artificial Sequence
  Description of Artificial Sequence: Synthetic oligonucleotide
aagtcagccacgtccagatgtgctgcatg

SEQ ID NO: 330275 - DNA, 28 bp, Artificial Sequence
  Description of Artificial Sequence: Synthetic oligonucleotide
agtcagccacgtccagatgtgctgcatg

SEQ ID NO: 330276 - DNA, 27 bp, Artificial Sequence
  Description of Artificial Sequence: Synthetic oligonucleotide
gtcagccacgtccagatgtgctgcatg

SEQ ID NO: 330277 - DNA, 27 bp, Artificial Sequence
  Description of Artificial Sequence: Synthetic oligonucleotide
tcagccacgtccagatgtgctgcatgc

SEQ ID NO: 330278 - DNA, 27 bp, Artificial Sequence
  Description of Artificial Sequence: Synthetic oligonucleotide
cagccacgtccagatgtgctgcatgct

SEQ ID NO: 330279 - DNA, 27 bp, Artificial Sequence
  Description of Artificial Sequence: Synthetic oligonucleotide
agccacgtccagatgtgctgcatgctc

SEQ ID NO: 330280 - DNA, 27 bp, Artificial Sequence
  Description of Artificial Sequence: Synthetic oligonucleotide
gccacgtccagatgtgctgcatgctca

SEQ ID NO: 330281 - DNA, 27 bp, Artificial Sequence
  Description of Artificial Sequence: Synthetic oligonucleotide
ccacgtccagatgtgctgcatgctcag

SEQ ID NO: 330282 - DNA, 27 bp, Artificial Sequence
  Description of Artificial Sequence: Synthetic oligonucleotide
cacgtccagatgtgctgcatgctcagc

SEQ ID NO: 330283 - DNA, 27 bp, Artificial Sequence
  Description of Artificial Sequence: Synthetic oligonucleotide
acgtccagatgtgctgcatgctcagcg

SEQ ID NO: 330284 - DNA, 27 bp, Artificial Sequence
  Description of Artificial Sequence: Synthetic oligonucleotide
cgtccagatgtgctgcatgctcagcgt

SEQ ID NO: 330285 - DNA, 28 bp, Artificial Sequence
  Description of Artificial Sequence: Synthetic oligonucleotide
gtccagatgtgctgcatgctcagcgtac

SEQ ID NO: 330286 - DNA, 28 bp, Artificial Sequence
  Description of Artificial Sequence: Synthetic oligonucleotide
tccagatgtgctgcatgctcagcgtacc

SEQ ID NO: 330287 - DNA, 27 bp, Artificial Sequence
  Description of Artificial Sequence: Synthetic oligonucleotide
ccagatgtgctgcatgctcagcgtacc

SEQ ID NO: 330288 - DNA, 27 bp, Artificial Sequence
  Description of Artificial Sequence: Synthetic oligonucleotide
cagatgtgctgcatgctcagcgtaccc

SEQ ID NO: 330289 - DNA, 30 bp, Artificial Sequence
  Description of Artificial Sequence: Synthetic oligonucleotide
agatgtgctgcatgctcagcgtaccctaag

SEQ ID NO: 330290 - DNA, 29 bp, Artificial Sequence
  Description of Artificial Sequence: Synthetic oligonucleotide
gatgtgctgcatgctcagcgtaccctaag

SEQ ID NO: 330291 - DNA, 29 bp, Artificial Sequence
  Description of Artificial Sequence: Synthetic oligonucleotide
atgtgctgcatgctcagcgtaccctaagg

SEQ ID NO: 330292 - DNA, 28 bp, Artificial Sequence
  Description of Artificial Sequence: Synthetic oligonucleotide
tgtgctgcatgctcagcgtaccctaagg

SEQ ID NO: 330293 - DNA, 27 bp, Artificial Sequence
  Description of Artificial Sequence: Synthetic oligonucleotide
gtgctgcatgctcagcgtaccctaagg

SEQ ID NO: 330294 - DNA, 27 bp, Artificial Sequence
  Description of Artificial Sequence: Synthetic oligonucleotide
tgctgcatgctcagcgtaccctaaggg

SEQ ID NO: 330295 - DNA, 27 bp, Artificial Sequence
  Description of Artificial Sequence: Synthetic oligonucleotide
gctgcatgctcagcgtaccctaaggga

SEQ ID NO: 330296 - DNA, 27 bp, Artificial Sequence
  Description of Artificial Sequence: Synthetic oligonucleotide
ctgcatgctcagcgtaccctaagggac

SEQ ID NO: 330297 - DNA, 29 bp, Artificial Sequence
  Description of Artificial Sequence: Synthetic oligonucleotide
tgcatgctcagcgtaccctaagggacaac

SEQ ID NO: 330298 - DNA, 28 bp, Artificial Sequence
  Description of Artificial Sequence: Synthetic oligonucleotide
gcatgctcagcgtaccctaagggacaac

SEQ ID NO: 330299 - DNA, 28 bp, Artificial Sequence
  Description of Artificial Sequence: Synthetic oligonucleotide
catgctcagcgtaccctaagggacaacg

SEQ ID NO: 330300 - DNA, 29 bp, Artificial Sequence
  Description of Artificial Sequence: Synthetic oligonucleotide
atgctcagcgtaccctaagggacaacgac

SEQ ID NO: 330301 - DNA, 28 bp, Artificial Sequence
  Description of Artificial Sequence: Synthetic oligonucleotide
tgctcagcgtaccctaagggacaacgac

SEQ ID NO: 330302 - DNA, 27 bp, Artificial Sequence
  Description of Artificial Sequence: Synthetic oligonucleotide
gctcagcgtaccctaagggacaacgac

SEQ ID NO: 330303 - DNA, 29 bp, Artificial Sequence
  Description of Artificial Sequence: Synthetic oligonucleotide
ctcagcgtaccctaagggacaacgacaac

SEQ ID NO: 330304 - DNA, 33 bp, Artificial Sequence
  Description of Artificial Sequence: Synthetic oligonucleotide
tcagcgtaccctaagggacaacgacaactttac

SEQ ID NO: 330305 - DNA, 32 bp, Artificial Sequence
  Description of Artificial Sequence: Synthetic oligonucleotide
cagcgtaccctaagggacaacgacaactttac

SEQ ID NO: 330306 - DNA, 33 bp, Artificial Sequence
  Description of Artificial Sequence: Synthetic oligonucleotide
agcgtaccctaagggacaacgacaactttacac

SEQ ID NO: 330307 - DNA, 32 bp, Artificial Sequence
  Description of Artificial Sequence: Synthetic oligonucleotide
gcgtaccctaagggacaacgacaactttacac

SEQ ID NO: 330308 - DNA, 32 bp, Artificial Sequence
  Description of Artificial Sequence: Synthetic oligonucleotide
cgtaccctaagggacaacgacaactttacacc

SEQ ID NO: 330309 - DNA, 33 bp, Artificial Sequence
  Description of Artificial Sequence: Synthetic oligonucleotide
gtaccctaagggacaacgacaactttacacctg

SEQ ID NO: 330310 - DNA, 33 bp, Artificial Sequence
  Description of Artificial Sequence: Synthetic oligonucleotide
taccctaagggacaacgacaactttacacctgg

SEQ ID NO: 330311 - DNA, 32 bp, Artificial Sequence
  Description of Artificial Sequence: Synthetic oligonucleotide
accctaagggacaacgacaactttacacctgg

SEQ ID NO: 330312 - DNA, 31 bp, Artificial Sequence
  Description of Artificial Sequence: Synthetic oligonucleotide
ccctaagggacaacgacaactttacacctgg

SEQ ID NO: 330313 - DNA, 31 bp, Artificial Sequence
  Description of Artificial Sequence: Synthetic oligonucleotide
cctaagggacaacgacaactttacacctggg

SEQ ID NO: 330314 - DNA, 31 bp, Artificial Sequence
  Description of Artificial Sequence: Synthetic oligonucleotide
ctaagggacaacgacaactttacacctgggc

SEQ ID NO: 330315 - DNA, 32 bp, Artificial Sequence
  Description of Artificial Sequence: Synthetic oligonucleotide
taagggacaacgacaactttacacctgggctg

SEQ ID NO: 330316 - DNA, 31 bp, Artificial Sequence
  Description of Artificial Sequence: Synthetic oligonucleotide
aagggacaacgacaactttacacctgggctg

SEQ ID NO: 330317 - DNA, 30 bp, Artificial Sequence
  Description of Artificial Sequence: Synthetic oligonucleotide
agggacaacgacaactttacacctgggctg

SEQ ID NO: 330318 - DNA, 29 bp, Artificial Sequence
  Description of Artificial Sequence: Synthetic oligonucleotide
gggacaacgacaactttacacctgggctg

SEQ ID NO: 330319 - DNA, 29 bp, Artificial Sequence
  Description of Artificial Sequence: Synthetic oligonucleotide
ggacaacgacaactttacacctgggctgg

SEQ ID NO: 330320 - DNA, 31 bp, Artificial Sequence
  Description of Artificial Sequence: Synthetic oligonucleotide
gacaacgacaactttacacctgggctggaag

SEQ ID NO: 330321 - DNA, 32 bp, Artificial Sequence
  Description of Artificial Sequence: Synthetic oligonucleotide
acaacgacaactttacacctgggctggaagtg

SEQ ID NO: 330322 - DNA, 31 bp, Artificial Sequence
  Description of Artificial Sequence: Synthetic oligonucleotide
caacgacaactttacacctgggctggaagtg

SEQ ID NO: 330323 - DNA, 33 bp, Artificial Sequence
  Description of Artificial Sequence: Synthetic oligonucleotide
aacgacaactttacacctgggctggaagtgttg

SEQ ID NO: 330324 - DNA, 32 bp, Artificial Sequence
  Description of Artificial Sequence: Synthetic oligonucleotide
acgacaactttacacctgggctggaagtgttg

SEQ ID NO: 330325 - DNA, 31 bp, Artificial Sequence
  Description of Artificial Sequence: Synthetic oligonucleotide
cgacaactttacacctgggctggaagtgttg

SEQ ID NO: 330326 - DNA, 33 bp, Artificial Sequence
  Description of Artificial Sequence: Synthetic oligonucleotide
gacaactttacacctgggctggaagtgttgtac

SEQ ID NO: 330327 - DNA, 34 bp, Artificial Sequence
  Description of Artificial Sequence: Synthetic oligonucleotide
acaactttacacctgggctggaagtgttgtacag

SEQ ID NO: 330328 - DNA, 33 bp, Artificial Sequence
  Description of Artificial Sequence: Synthetic oligonucleotide
caactttacacctgggctggaagtgttgtacag

SEQ ID NO: 330329 - DNA, 33 bp, Artificial Sequence
  Description of Artificial Sequence: Synthetic oligonucleotide
aactttacacctgggctggaagtgttgtacagc

SEQ ID NO: 330330 - DNA, 32 bp, Artificial Sequence
  Description of Artificial Sequence: Synthetic oligonucleotide
actttacacctgggctggaagtgttgtacagc

SEQ ID NO: 330331 - DNA, 31 bp, Artificial Sequence
  Description of Artificial Sequence: Synthetic oligonucleotide
ctttacacctgggctggaagtgttgtacagc

SEQ ID NO: 330332 - DNA, 32 bp, Artificial Sequence
  Description of Artificial Sequence: Synthetic oligonucleotide
tttacacctgggctggaagtgttgtacagctg

SEQ ID NO: 330333 - DNA, 31 bp, Artificial Sequence
  Description of Artificial Sequence: Synthetic oligonucleotide
ttacacctgggctggaagtgttgtacagctg

SEQ ID NO: 330334 - DNA, 30 bp, Artificial Sequence
  Description of Artificial Sequence: Synthetic oligonucleotide
tacacctgggctggaagtgttgtacagctg

SEQ ID NO: 330335 - DNA, 29 bp, Artificial Sequence
  Description of Artificial Sequence: Synthetic oligonucleotide
acacctgggctggaagtgttgtacagctg

SEQ ID NO: 330336 - DNA, 28 bp, Artificial Sequence
  Description of Artificial Sequence: Synthetic oligonucleotide
cacctgggctggaagtgttgtacagctg

SEQ ID NO: 330337 - DNA, 29 bp, Artificial Sequence
  Description of Artificial Sequence: Synthetic oligonucleotide
acctgggctggaagtgttgtacagctgtc

SEQ ID NO: 330338 - DNA, 28 bp, Artificial Sequence
  Description of Artificial Sequence: Synthetic oligonucleotide
cctgggctggaagtgttgtacagctgtc

SEQ ID NO: 330339 - DNA, 29 bp, Artificial Sequence
  Description of Artificial Sequence: Synthetic oligonucleotide
ctgggctggaagtgttgtacagctgtcag

SEQ ID NO: 330340 - DNA, 29 bp, Artificial Sequence
  Description of Artificial Sequence: Synthetic oligonucleotide
tgggctggaagtgttgtacagctgtcagc

SEQ ID NO: 330341 - DNA, 28 bp, Artificial Sequence
  Description of Artificial Sequence: Synthetic oligonucleotide
gggctggaagtgttgtacagctgtcagc

SEQ ID NO: 330342 - DNA, 28 bp, Artificial Sequence
  Description of Artificial Sequence: Synthetic oligonucleotide
ggctggaagtgttgtacagctgtcagcc

SEQ ID NO: 330343 - DNA, 28 bp, Artificial Sequence
  Description of Artificial Sequence: Synthetic oligonucleotide
gctggaagtgttgtacagctgtcagccc

SEQ ID NO: 330344 - DNA, 28 bp, Artificial Sequence
  Description of Artificial Sequence: Synthetic oligonucleotide
ctggaagtgttgtacagctgtcagcccg

SEQ ID NO: 330345 - DNA, 28 bp, Artificial Sequence
  Description of Artificial Sequence: Synthetic oligonucleotide
tggaagtgttgtacagctgtcagcccgg

SEQ ID NO: 330346 - DNA, 27 bp, Artificial Sequence
  Description of Artificial Sequence: Synthetic oligonucleotide
ggaagtgttgtacagctgtcagcccgg

SEQ ID NO: 330347 - DNA, 27 bp, Artificial Sequence
  Description of Artificial Sequence: Synthetic oligonucleotide
gaagtgttgtacagctgtcagcccggc

SEQ ID NO: 330348 - DNA, 29 bp, Artificial Sequence
  Description of Artificial Sequence: Synthetic oligonucleotide
aagtgttgtacagctgtcagcccggcttc

SEQ ID NO: 330349 - DNA, 28 bp, Artificial Sequence
  Description of Artificial Sequence: Synthetic oligonucleotide
agtgttgtacagctgtcagcccggcttc

SEQ ID NO: 330350 - DNA, 27 bp, Artificial Sequence
  Description of Artificial Sequence: Synthetic oligonucleotide
gtgttgtacagctgtcagcccggcttc

SEQ ID NO: 330351 - DNA, 27 bp, Artificial Sequence
  Description of Artificial Sequence: Synthetic oligonucleotide
tgttgtacagctgtcagcccggcttcg

SEQ ID NO: 330352 - DNA, 27 bp, Artificial Sequence
  Description of Artificial Sequence: Synthetic oligonucleotide
gttgtacagctgtcagcccggcttcga

SEQ ID NO: 330353 - DNA, 27 bp, Artificial Sequence
  Description of Artificial Sequence: Synthetic oligonucleotide
ttgtacagctgtcagcccggcttcgac

SEQ ID NO: 330354 - DNA, 26 bp, Artificial Sequence
  Description of Artificial Sequence: Synthetic oligonucleotide
tgtacagctgtcagcccggcttcgac

SEQ ID NO: 330355 - DNA, 25 bp, Artificial Sequence
  Description of Artificial Sequence: Synthetic oligonucleotide
gtacagctgtcagcccggcttcgac

SEQ ID NO: 330356 - DNA, 26 bp, Artificial Sequence
  Description of Artificial Sequence: Synthetic oligonucleotide
tacagctgtcagcccggcttcgacct

SEQ ID NO: 330357 - DNA, 25 bp, Artificial Sequence
  Description of Artificial Sequence: Synthetic oligonucleotide
acagctgtcagcccggcttcgacct

SEQ ID NO: 330358 - DNA, 24 bp, Artificial Sequence
  Description of Artificial Sequence: Synthetic oligonucleotide
cagctgtcagcccggcttcgacct

SEQ ID NO: 330359 - DNA, 25 bp, Artificial Sequence
  Description of Artificial Sequence: Synthetic oligonucleotide
agctgtcagcccggcttcgacctca

SEQ ID NO: 330360 - DNA, 24 bp, Artificial Sequence
  Description of Artificial Sequence: Synthetic oligonucleotide
gctgtcagcccggcttcgacctca

SEQ ID NO: 330361 - DNA, 25 bp, Artificial Sequence
  Description of Artificial Sequence: Synthetic oligonucleotide
ctgtcagcccggcttcgacctcagt

SEQ ID NO: 330362 - DNA, 25 bp, Artificial Sequence
  Description of Artificial Sequence: Synthetic oligonucleotide
tgtcagcccggcttcgacctcagtg

SEQ ID NO: 330363 - DNA, 24 bp, Artificial Sequence
  Description of Artificial Sequence: Synthetic oligonucleotide
gtcagcccggcttcgacctcagtg

SEQ ID NO: 330364 - DNA, 24 bp, Artificial Sequence
  Description of Artificial Sequence: Synthetic oligonucleotide
tcagcccggcttcgacctcagtgg

SEQ ID NO: 330365 - DNA, 23 bp, Artificial Sequence
  Description of Artificial Sequence: Synthetic oligonucleotide
cagcccggcttcgacctcagtgg

SEQ ID NO: 330366 - DNA, 23 bp, Artificial Sequence
  Description of Artificial Sequence: Synthetic oligonucleotide
agcccggcttcgacctcagtggg

SEQ ID NO: 330367 - DNA, 22 bp, Artificial Sequence
  Description of Artificial Sequence: Synthetic oligonucleotide
gcccggcttcgacctcagtggg

SEQ ID NO: 330368 - DNA, 22 bp, Artificial Sequence
  Description of Artificial Sequence: Synthetic oligonucleotide
cccggcttcgacctcagtgggg

SEQ ID NO: 330369 - DNA, 23 bp, Artificial Sequence
  Description of Artificial Sequence: Synthetic oligonucleotide
ccggcttcgacctcagtggggct

SEQ ID NO: 330370 - DNA, 23 bp, Artificial Sequence
  Description of Artificial Sequence: Synthetic oligonucleotide
cggcttcgacctcagtggggctg

SEQ ID NO: 330371 - DNA, 23 bp, Artificial Sequence
  Description of Artificial Sequence: Synthetic oligonucleotide
ggcttcgacctcagtggggctgc

SEQ ID NO: 330372 - DNA, 24 bp, Artificial Sequence
  Description of Artificial Sequence: Synthetic oligonucleotide
gcttcgacctcagtggggctgcga

SEQ ID NO: 330373 - DNA, 27 bp, Artificial Sequence
  Description of Artificial Sequence: Synthetic oligonucleotide
cttcgacctcagtggggctgcgactat

SEQ ID NO: 330374 - DNA, 27 bp, Artificial Sequence
  Description of Artificial Sequence: Synthetic oligonucleotide
ttcgacctcagtggggctgcgactatg

SEQ ID NO: 330375 - DNA, 26 bp, Artificial Sequence
  Description of Artificial Sequence: Synthetic oligonucleotide
tcgacctcagtggggctgcgactatg

SEQ ID NO: 330376 - DNA, 25 bp, Artificial Sequence
  Description of Artificial Sequence: Synthetic oligonucleotide
cgacctcagtggggctgcgactatg

SEQ ID NO: 330377 - DNA, 25 bp, Artificial Sequence
  Description of Artificial Sequence: Synthetic oligonucleotide
gacctcagtggggctgcgactatgc

SEQ ID NO: 330378 - DNA, 25 bp, Artificial Sequence
  Description of Artificial Sequence: Synthetic oligonucleotide
acctcagtggggctgcgactatgcg

SEQ ID NO: 330379 - DNA, 24 bp, Artificial Sequence
  Description of Artificial Sequence: Synthetic oligonucleotide
cctcagtggggctgcgactatgcg

SEQ ID NO: 330380 - DNA, 25 bp, Artificial Sequence
  Description of Artificial Sequence: Synthetic oligonucleotide
ctcagtggggctgcgactatgcgct

SEQ ID NO: 330381 - DNA, 25 bp, Artificial Sequence
  Description of Artificial Sequence: Synthetic oligonucleotide
tcagtggggctgcgactatgcgctc

SEQ ID NO: 330382 - DNA, 24 bp, Artificial Sequence
  Description of Artificial Sequence: Synthetic oligonucleotide
cagtggggctgcgactatgcgctc

SEQ ID NO: 330383 - DNA, 25 bp, Artificial Sequence
  Description of Artificial Sequence: Synthetic oligonucleotide
agtggggctgcgactatgcgctcca

SEQ ID NO: 330384 - DNA, 24 bp, Artificial Sequence
  Description of Artificial Sequence: Synthetic oligonucleotide
gtggggctgcgactatgcgctcca

SEQ ID NO: 330385 - DNA, 25 bp, Artificial Sequence
  Description of Artificial Sequence: Synthetic oligonucleotide
tggggctgcgactatgcgctccaca

SEQ ID NO: 330386 - DNA, 24 bp, Artificial Sequence
  Description of Artificial Sequence: Synthetic oligonucleotide
ggggctgcgactatgcgctccaca

SEQ ID NO: 330387 - DNA, 24 bp, Artificial Sequence
  Description of Artificial Sequence: Synthetic oligonucleotide
gggctgcgactatgcgctccacac

SEQ ID NO: 330388 - DNA, 24 bp, Artificial Sequence
  Description of Artificial Sequence: Synthetic oligonucleotide
ggctgcgactatgcgctccacacc

SEQ ID NO: 330389 - DNA, 24 bp, Artificial Sequence
  Description of Artificial Sequence: Synthetic oligonucleotide
gctgcgactatgcgctccacaccc

SEQ ID NO: 330390 - DNA, 25 bp, Artificial Sequence
  Description of Artificial Sequence: Synthetic oligonucleotide
ctgcgactatgcgctccacacccca

SEQ ID NO: 330391 - DNA, 25 bp, Artificial Sequence
  Description of Artificial Sequence: Synthetic oligonucleotide
tgcgactatgcgctccacaccccac

SEQ ID NO: 330392 - DNA, 24 bp, Artificial Sequence
  Description of Artificial Sequence: Synthetic oligonucleotide
gcgactatgcgctccacaccccac

SEQ ID NO: 330393 - DNA, 24 bp, Artificial Sequence
  Description of Artificial Sequence: Synthetic oligonucleotide
cgactatgcgctccacaccccacg

SEQ ID NO: 330394 - DNA, 25 bp, Artificial Sequence
  Description of Artificial Sequence: Synthetic oligonucleotide
gactatgcgctccacaccccacgga

SEQ ID NO: 330395 - DNA, 26 bp, Artificial Sequence
  Description of Artificial Sequence: Synthetic oligonucleotide
actatgcgctccacaccccacggaga

SEQ ID NO: 330396 - DNA, 25 bp, Artificial Sequence
  Description of Artificial Sequence: Synthetic oligonucleotide
ctatgcgctccacaccccacggaga

SEQ ID NO: 330397 - DNA, 26 bp, Artificial Sequence
  Description of Artificial Sequence: Synthetic oligonucleotide
tatgcgctccacaccccacggagact

SEQ ID NO: 330398 - DNA, 25 bp, Artificial Sequence
  Description of Artificial Sequence: Synthetic oligonucleotide
atgcgctccacaccccacggagact

SEQ ID NO: 330399 - DNA, 24 bp, Artificial Sequence
  Description of Artificial Sequence: Synthetic oligonucleotide
tgcgctccacaccccacggagact

SEQ ID NO: 330400 - DNA, 23 bp, Artificial Sequence
  Description of Artificial Sequence: Synthetic oligonucleotide
gcgctccacaccccacggagact

SEQ ID NO: 330401 - DNA, 23 bp, Artificial Sequence
  Description of Artificial Sequence: Synthetic oligonucleotide
cgctccacaccccacggagactg

SEQ ID NO: 330402 - DNA, 24 bp, Artificial Sequence
  Description of Artificial Sequence: Synthetic oligonucleotide
gctccacaccccacggagactggt

SEQ ID NO: 330403 - DNA, 24 bp, Artificial Sequence
  Description of Artificial Sequence: Synthetic oligonucleotide
ctccacaccccacggagactggtg

SEQ ID NO: 330404 - DNA, 24 bp, Artificial Sequence
  Description of Artificial Sequence: Synthetic oligonucleotide
tccacaccccacggagactggtgc

SEQ ID NO: 330405 - DNA, 23 bp, Artificial Sequence
  Description of Artificial Sequence: Synthetic oligonucleotide
ccacaccccacggagactggtgc

SEQ ID NO: 330406 - DNA, 23 bp, Artificial Sequence
  Description of Artificial Sequence: Synthetic oligonucleotide
cacaccccacggagactggtgcc

SEQ ID NO: 330407 - DNA, 24 bp, Artificial Sequence
  Description of Artificial Sequence: Synthetic oligonucleotide
acaccccacggagactggtgccct

SEQ ID NO: 330408 - DNA, 23 bp, Artificial Sequence
  Description of Artificial Sequence: Synthetic oligonucleotide
caccccacggagactggtgccct

SEQ ID NO: 330409 - DNA, 23 bp, Artificial Sequence
  Description of Artificial Sequence: Synthetic oligonucleotide
accccacggagactggtgccctg

SEQ ID NO: 330410 - DNA, 22 bp, Artificial Sequence
  Description of Artificial Sequence: Synthetic oligonucleotide
ccccacggagactggtgccctg

SEQ ID NO: 330411 - DNA, 23 bp, Artificial Sequence
  Description of Artificial Sequence: Synthetic oligonucleotide
cccacggagactggtgccctgca

SEQ ID NO: 330412 - DNA, 23 bp, Artificial Sequence
  Description of Artificial Sequence: Synthetic oligonucleotide
ccacggagactggtgccctgcag

SEQ ID NO: 330413 - DNA, 23 bp, Artificial Sequence
  Description of Artificial Sequence: Synthetic oligonucleotide
cacggagactggtgccctgcagg

SEQ ID NO: 330414 - DNA, 23 bp, Artificial Sequence
  Description of Artificial Sequence: Synthetic oligonucleotide
acggagactggtgccctgcaggc

SEQ ID NO: 330415 - DNA, 22 bp, Artificial Sequence
  Description of Artificial Sequence: Synthetic oligonucleotide
cggagactggtgccctgcaggc

SEQ ID NO: 330416 - DNA, 22 bp, Artificial Sequence
  Description of Artificial Sequence: Synthetic oligonucleotide
ggagactggtgccctgcaggcc

SEQ ID NO: 330417 - DNA, 22 bp, Artificial Sequence
  Description of Artificial Sequence: Synthetic oligonucleotide
gagactggtgccctgcaggccc

SEQ ID NO: 330418 - DNA, 23 bp, Artificial Sequence
  Description of Artificial Sequence: Synthetic oligonucleotide
agactggtgccctgcaggcccca

SEQ ID NO: 330419 - DNA, 22 bp, Artificial Sequence
  Description of Artificial Sequence: Synthetic oligonucleotide
gactggtgccctgcaggcccca

SEQ ID NO: 330420 - DNA, 24 bp, Artificial Sequence
  Description of Artificial Sequence: Synthetic oligonucleotide
actggtgccctgcaggccccacat

SEQ ID NO: 330421 - DNA, 23 bp, Artificial Sequence
  Description of Artificial Sequence: Synthetic oligonucleotide
ctggtgccctgcaggccccacat

SEQ ID NO: 330422 - DNA, 24 bp, Artificial Sequence
  Description of Artificial Sequence: Synthetic oligonucleotide
tggtgccctgcaggccccacatga

SEQ ID NO: 330423 - DNA, 23 bp, Artificial Sequence
  Description of Artificial Sequence: Synthetic oligonucleotide
ggtgccctgcaggccccacatga

SEQ ID NO: 330424 - DNA, 25 bp, Artificial Sequence
  Description of Artificial Sequence: Synthetic oligonucleotide
gtgccctgcaggccccacatgagaa

SEQ ID NO: 330425 - DNA, 26 bp, Artificial Sequence
  Description of Artificial Sequence: Synthetic oligonucleotide
tgccctgcaggccccacatgagaagt

SEQ ID NO: 330426 - DNA, 25 bp, Artificial Sequence
  Description of Artificial Sequence: Synthetic oligonucleotide
gccctgcaggccccacatgagaagt

SEQ ID NO: 330427 - DNA, 27 bp, Artificial Sequence
  Description of Artificial Sequence: Synthetic oligonucleotide
ccctgcaggccccacatgagaagtgaa

SEQ ID NO: 330428 - DNA, 29 bp, Artificial Sequence
  Description of Artificial Sequence: Synthetic oligonucleotide
cctgcaggccccacatgagaagtgaaaac

SEQ ID NO: 330429 - DNA, 29 bp, Artificial Sequence
  Description of Artificial Sequence: Synthetic oligonucleotide
ctgcaggccccacatgagaagtgaaaacc

SEQ ID NO: 330430 - DNA, 30 bp, Artificial Sequence
  Description of Artificial Sequence: Synthetic oligonucleotide
tgcaggccccacatgagaagtgaaaacctg

SEQ ID NO: 330431 - DNA, 29 bp, Artificial Sequence
  Description of Artificial Sequence: Synthetic oligonucleotide
gcaggccccacatgagaagtgaaaacctg

SEQ ID NO: 330432 - DNA, 30 bp, Artificial Sequence
  Description of Artificial Sequence: Synthetic oligonucleotide
caggccccacatgagaagtgaaaacctgtg

SEQ ID NO: 330433 - DNA, 32 bp, Artificial Sequence
  Description of Artificial Sequence: Synthetic oligonucleotide
aggccccacatgagaagtgaaaacctgtgatg

SEQ ID NO: 330434 - DNA, 31 bp, Artificial Sequence
  Description of Artificial Sequence: Synthetic oligonucleotide
ggccccacatgagaagtgaaaacctgtgatg

SEQ ID NO: 330435 - DNA, 32 bp, Artificial Sequence
  Description of Artificial Sequence: Synthetic oligonucleotide
gccccacatgagaagtgaaaacctgtgatgtc

SEQ ID NO: 330436 - DNA, 34 bp, Artificial Sequence
  Description of Artificial Sequence: Synthetic oligonucleotide
ccccacatgagaagtgaaaacctgtgatgtcttc

SEQ ID NO: 330437 - DNA, 36 bp, Artificial Sequence
  Description of Artificial Sequence: Synthetic oligonucleotide
cccacatgagaagtgaaaacctgtgatgtcttcatg

SEQ ID NO: 330438 - DNA, 36 bp, Artificial Sequence
  Description of Artificial Sequence: Synthetic oligonucleotide
ccacatgagaagtgaaaacctgtgatgtcttcatgg

SEQ ID NO: 330439 - DNA, 36 bp, Artificial Sequence
  Description of Artificial Sequence: Synthetic oligonucleotide
cacatgagaagtgaaaacctgtgatgtcttcatggg

SEQ ID NO: 330440 - DNA, 36 bp, Artificial Sequence
  Description of Artificial Sequence: Synthetic oligonucleotide
acatgagaagtgaaaacctgtgatgtcttcatgggg

SEQ ID NO: 330441 - DNA, 35 bp, Artificial Sequence
  Description of Artificial Sequence: Synthetic oligonucleotide
catgagaagtgaaaacctgtgatgtcttcatgggg

SEQ ID NO: 330442 - DNA, 35 bp, Artificial Sequence
  Description of Artificial Sequence: Synthetic oligonucleotide
atgagaagtgaaaacctgtgatgtcttcatggggc

SEQ ID NO: 330443 - DNA, 34 bp, Artificial Sequence
  Description of Artificial Sequence: Synthetic oligonucleotide
tgagaagtgaaaacctgtgatgtcttcatggggc

SEQ ID NO: 330444 - DNA, 33 bp, Artificial Sequence
  Description of Artificial Sequence: Synthetic oligonucleotide
gagaagtgaaaacctgtgatgtcttcatggggc

SEQ ID NO: 330445 - DNA, 35 bp, Artificial Sequence
  Description of Artificial Sequence: Synthetic oligonucleotide
agaagtgaaaacctgtgatgtcttcatggggcaac

SEQ ID NO: 330446 - DNA, 34 bp, Artificial Sequence
  Description of Artificial Sequence: Synthetic oligonucleotide
gaagtgaaaacctgtgatgtcttcatggggcaac

SEQ ID NO: 330447 - DNA, 36 bp, Artificial Sequence
  Description of Artificial Sequence: Synthetic oligonucleotide
aagtgaaaacctgtgatgtcttcatggggcaacttc

SEQ ID NO: 330448 - DNA, 35 bp, Artificial Sequence
  Description of Artificial Sequence: Synthetic oligonucleotide
agtgaaaacctgtgatgtcttcatggggcaacttc

SEQ ID NO: 330449 - DNA, 34 bp, Artificial Sequence
  Description of Artificial Sequence: Synthetic oligonucleotide
gtgaaaacctgtgatgtcttcatggggcaacttc

SEQ ID NO: 330450 - DNA, 39 bp, Artificial Sequence
  Description of Artificial Sequence: Synthetic oligonucleotide
tgaaaacctgtgatgtcttcatggggcaacttctttatg

SEQ ID NO: 330451 - DNA, 38 bp, Artificial Sequence
  Description of Artificial Sequence: Synthetic oligonucleotide
gaaaacctgtgatgtcttcatggggcaacttctttatg

SEQ ID NO: 330452 - DNA, 38 bp, Artificial Sequence
  Description of Artificial Sequence: Synthetic oligonucleotide
aaaacctgtgatgtcttcatggggcaacttctttatgg

SEQ ID NO: 330453 - DNA, 37 bp, Artificial Sequence
  Description of Artificial Sequence: Synthetic oligonucleotide
aaacctgtgatgtcttcatggggcaacttctttatgg

SEQ ID NO: 330454 - DNA, 36 bp, Artificial Sequence
  Description of Artificial Sequence: Synthetic oligonucleotide
aacctgtgatgtcttcatggggcaacttctttatgg

SEQ ID NO: 330455 - DNA, 35 bp, Artificial Sequence
  Description of Artificial Sequence: Synthetic oligonucleotide
acctgtgatgtcttcatggggcaacttctttatgg

SEQ ID NO: 330456 - DNA, 34 bp, Artificial Sequence
  Description of Artificial Sequence: Synthetic oligonucleotide
cctgtgatgtcttcatggggcaacttctttatgg

SEQ ID NO: 330457 - DNA, 34 bp, Artificial Sequence
  Description of Artificial Sequence: Synthetic oligonucleotide
ctgtgatgtcttcatggggcaacttctttatggc

SEQ ID NO: 330458 - DNA, 34 bp, Artificial Sequence
  Description of Artificial Sequence: Synthetic oligonucleotide
tgtgatgtcttcatggggcaacttctttatggcc

SEQ ID NO: 330459 - DNA, 33 bp, Artificial Sequence
  Description of Artificial Sequence: Synthetic oligonucleotide
gtgatgtcttcatggggcaacttctttatggcc

SEQ ID NO: 330460 - DNA, 33 bp, Artificial Sequence
  Description of Artificial Sequence: Synthetic oligonucleotide
tgatgtcttcatggggcaacttctttatggccg

SEQ ID NO: 330461 - DNA, 32 bp, Artificial Sequence
  Description of Artificial Sequence: Synthetic oligonucleotide
gatgtcttcatggggcaacttctttatggccg

SEQ ID NO: 330462 - DNA, 33 bp, Artificial Sequence
  Description of Artificial Sequence: Synthetic oligonucleotide
atgtcttcatggggcaacttctttatggccgtg

SEQ ID NO: 330463 - DNA, 32 bp, Artificial Sequence
  Description of Artificial Sequence: Synthetic oligonucleotide
tgtcttcatggggcaacttctttatggccgtg

SEQ ID NO: 330464 - DNA, 31 bp, Artificial Sequence
  Description of Artificial Sequence: Synthetic oligonucleotide
gtcttcatggggcaacttctttatggccgtg

SEQ ID NO: 330465 - DNA, 32 bp, Artificial Sequence
  Description of Artificial Sequence: Synthetic oligonucleotide
tcttcatggggcaacttctttatggccgtgag

SEQ ID NO: 330466 - DNA, 31 bp, Artificial Sequence
  Description of Artificial Sequence: Synthetic oligonucleotide
cttcatggggcaacttctttatggccgtgag

SEQ ID NO: 330467 - DNA, 31 bp, Artificial Sequence
  Description of Artificial Sequence: Synthetic oligonucleotide
ttcatggggcaacttctttatggccgtgagc

SEQ ID NO: 330468 - DNA, 30 bp, Artificial Sequence
  Description of Artificial Sequence: Synthetic oligonucleotide
tcatggggcaacttctttatggccgtgagc

SEQ ID NO: 330469 - DNA, 29 bp, Artificial Sequence
  Description of Artificial Sequence: Synthetic oligonucleotide
catggggcaacttctttatggccgtgagc

SEQ ID NO: 330470 - DNA, 34 bp, Artificial Sequence
  Description of Artificial Sequence: Synthetic oligonucleotide
atggggcaacttctttatggccgtgagctatttc

SEQ ID NO: 330471 - DNA, 33 bp, Artificial Sequence
  Description of Artificial Sequence: Synthetic oligonucleotide
tggggcaacttctttatggccgtgagctatttc

SEQ ID NO: 330472 - DNA, 32 bp, Artificial Sequence
  Description of Artificial Sequence: Synthetic oligonucleotide
ggggcaacttctttatggccgtgagctatttc

SEQ ID NO: 330473 - DNA, 32 bp, Artificial Sequence
  Description of Artificial Sequence: Synthetic oligonucleotide
gggcaacttctttatggccgtgagctatttcc

SEQ ID NO: 330474 - DNA, 33 bp, Artificial Sequence
  Description of Artificial Sequence: Synthetic oligonucleotide
ggcaacttctttatggccgtgagctatttcctg

SEQ ID NO: 330475 - DNA, 38 bp, Artificial Sequence
  Description of Artificial Sequence: Synthetic oligonucleotide
gcaacttctttatggccgtgagctatttcctgtaaatc

SEQ ID NO: 330476 - DNA, 39 bp, Artificial Sequence
  Description of Artificial Sequence: Synthetic oligonucleotide
caacttctttatggccgtgagctatttcctgtaaatctc

SEQ ID NO: 330477 - DNA, 39 bp, Artificial Sequence
  Description of Artificial Sequence: Synthetic oligonucleotide
aacttctttatggccgtgagctatttcctgtaaatctcg

SEQ ID NO: 330478 - DNA, 38 bp, Artificial Sequence
  Description of Artificial Sequence: Synthetic oligonucleotide
acttctttatggccgtgagctatttcctgtaaatctcg

SEQ ID NO: 330479 - DNA, 37 bp, Artificial Sequence
  Description of Artificial Sequence: Synthetic oligonucleotide
cttctttatggccgtgagctatttcctgtaaatctcg

SEQ ID NO: 330480 - DNA, 38 bp, Artificial Sequence
  Description of Artificial Sequence: Synthetic oligonucleotide
ttctttatggccgtgagctatttcctgtaaatctcgag

SEQ ID NO: 330481 - DNA, 37 bp, Artificial Sequence
  Description of Artificial Sequence: Synthetic oligonucleotide
tctttatggccgtgagctatttcctgtaaatctcgag

SEQ ID NO: 330482 - DNA, 36 bp, Artificial Sequence
  Description of Artificial Sequence: Synthetic oligonucleotide
ctttatggccgtgagctatttcctgtaaatctcgag

SEQ ID NO: 330483 - DNA, 36 bp, Artificial Sequence
  Description of Artificial Sequence: Synthetic oligonucleotide
tttatggccgtgagctatttcctgtaaatctcgagc

SEQ ID NO: 330484 - DNA, 35 bp, Artificial Sequence
  Description of Artificial Sequence: Synthetic oligonucleotide
ttatggccgtgagctatttcctgtaaatctcgagc

SEQ ID NO: 330485 - DNA, 34 bp, Artificial Sequence
  Description of Artificial Sequence: Synthetic oligonucleotide
tatggccgtgagctatttcctgtaaatctcgagc

SEQ ID NO: 330486 - DNA, 33 bp, Artificial Sequence
  Description of Artificial Sequence: Synthetic oligonucleotide
atggccgtgagctatttcctgtaaatctcgagc

SEQ ID NO: 330487 - DNA, 32 bp, Artificial Sequence
  Description of Artificial Sequence: Synthetic oligonucleotide
tggccgtgagctatttcctgtaaatctcgagc

SEQ ID NO: 330488 - DNA, 31 bp, Artificial Sequence
  Description of Artificial Sequence: Synthetic oligonucleotide
ggccgtgagctatttcctgtaaatctcgagc

SEQ ID NO: 330489 - DNA, 33 bp, Artificial Sequence
  Description of Artificial Sequence: Synthetic oligonucleotide
gccgtgagctatttcctgtaaatctcgagcttg

SEQ ID NO: 330490 - DNA, 33 bp, Artificial Sequence
  Description of Artificial Sequence: Synthetic oligonucleotide
ccgtgagctatttcctgtaaatctcgagcttgg

SEQ ID NO: 330491 - DNA, 34 bp, Artificial Sequence
  Description of Artificial Sequence: Synthetic oligonucleotide
cgtgagctatttcctgtaaatctcgagcttggag

SEQ ID NO: 330492 - DNA, 34 bp, Artificial Sequence
  Description of Artificial Sequence: Synthetic oligonucleotide
gtgagctatttcctgtaaatctcgagcttggagg

SEQ ID NO: 330493 - DNA, 38 bp, Artificial Sequence
  Description of Artificial Sequence: Synthetic oligonucleotide
tgagctatttcctgtaaatctcgagcttggaggaaaag

SEQ ID NO: 330494 - DNA, 37 bp, Artificial Sequence
  Description of Artificial Sequence: Synthetic oligonucleotide
gagctatttcctgtaaatctcgagcttggaggaaaag

SEQ ID NO: 330495 - DNA, 38 bp, Artificial Sequence
  Description of Artificial Sequence: Synthetic oligonucleotide
agctatttcctgtaaatctcgagcttggaggaaaagtg

SEQ ID NO: 330496 - DNA, 37 bp, Artificial Sequence
  Description of Artificial Sequence: Synthetic oligonucleotide
gctatttcctgtaaatctcgagcttggaggaaaagtg

SEQ ID NO: 330497 - DNA, 37 bp, Artificial Sequence
  Description of Artificial Sequence: Synthetic oligonucleotide
ctatttcctgtaaatctcgagcttggaggaaaagtgg

SEQ ID NO: 330498 - DNA, 42 bp, Artificial Sequence
  Description of Artificial Sequence: Synthetic oligonucleotide
tatttcctgtaaatctcgagcttggaggaaaagtggaatttg

SEQ ID NO: 330499 - DNA, 41 bp, Artificial Sequence
  Description of Artificial Sequence: Synthetic oligonucleotide
atttcctgtaaatctcgagcttggaggaaaagtggaatttg

SEQ ID NO: 330500 - DNA, 40 bp, Artificial Sequence
  Description of Artificial Sequence: Synthetic oligonucleotide
tttcctgtaaatctcgagcttggaggaaaagtggaatttg

SEQ ID NO: 330501 - DNA, 39 bp, Artificial Sequence
  Description of Artificial Sequence: Synthetic oligonucleotide
ttcctgtaaatctcgagcttggaggaaaagtggaatttg

SEQ ID NO: 330502 - DNA, 38 bp, Artificial Sequence
  Description of Artificial Sequence: Synthetic oligonucleotide
tcctgtaaatctcgagcttggaggaaaagtggaatttg

SEQ ID NO: 330503 - DNA, 37 bp, Artificial Sequence
  Description of Artificial Sequence: Synthetic oligonucleotide
cctgtaaatctcgagcttggaggaaaagtggaatttg

SEQ ID NO: 330504 - DNA, 40 bp, Artificial Sequence
  Description of Artificial Sequence: Synthetic oligonucleotide
ctgtaaatctcgagcttggaggaaaagtggaatttgtttg

SEQ ID NO: 330505 - DNA, 41 bp, Artificial Sequence
  Description of Artificial Sequence: Synthetic oligonucleotide
tgtaaatctcgagcttggaggaaaagtggaatttgtttgtc

SEQ ID NO: 330506 - DNA, 40 bp, Artificial Sequence
  Description of Artificial Sequence: Synthetic oligonucleotide
gtaaatctcgagcttggaggaaaagtggaatttgtttgtc

SEQ ID NO: 330507 - DNA, 42 bp, Artificial Sequence
  Description of Artificial Sequence: Synthetic oligonucleotide
taaatctcgagcttggaggaaaagtggaatttgtttgtcatg

SEQ ID NO: 330508 - DNA, 41 bp, Artificial Sequence
  Description of Artificial Sequence: Synthetic oligonucleotide
aaatctcgagcttggaggaaaagtggaatttgtttgtcatg

SEQ ID NO: 330509 - DNA, 40 bp, Artificial Sequence
  Description of Artificial Sequence: Synthetic oligonucleotide
aatctcgagcttggaggaaaagtggaatttgtttgtcatg

SEQ ID NO: 330510 - DNA, 39 bp, Artificial Sequence
  Description of Artificial Sequence: Synthetic oligonucleotide
atctcgagcttggaggaaaagtggaatttgtttgtcatg

SEQ ID NO: 330511 - DNA, 38 bp, Artificial Sequence
  Description of Artificial Sequence: Synthetic oligonucleotide
tctcgagcttggaggaaaagtggaatttgtttgtcatg

SEQ ID NO: 330512 - DNA, 37 bp, Artificial Sequence
  Description of Artificial Sequence: Synthetic oligonucleotide
ctcgagcttggaggaaaagtggaatttgtttgtcatg

SEQ ID NO: 330513 - DNA, 39 bp, Artificial Sequence
  Description of Artificial Sequence: Synthetic oligonucleotide
tcgagcttggaggaaaagtggaatttgtttgtcatgaag

SEQ ID NO: 330514 - DNA, 38 bp, Artificial Sequence
  Description of Artificial Sequence: Synthetic oligonucleotide
cgagcttggaggaaaagtggaatttgtttgtcatgaag

SEQ ID NO: 330515 - DNA, 38 bp, Artificial Sequence
  Description of Artificial Sequence: Synthetic oligonucleotide
gagcttggaggaaaagtggaatttgtttgtcatgaagg

SEQ ID NO: 330516 - DNA, 42 bp, Artificial Sequence
  Description of Artificial Sequence: Synthetic oligonucleotide
agcttggaggaaaagtggaatttgtttgtcatgaaggatatc

SEQ ID NO: 330517 - DNA, 41 bp, Artificial Sequence
  Description of Artificial Sequence: Synthetic oligonucleotide
gcttggaggaaaagtggaatttgtttgtcatgaaggatatc

SEQ ID NO: 330518 - DNA, 49 bp, Artificial Sequence
  Description of Artificial Sequence: Synthetic oligonucleotide
cttggaggaaaagtggaatttgtttgtcatgaaggatatcaattaaatg

SEQ ID NO: 330519 - DNA, 49 bp, Artificial Sequence
  Description of Artificial Sequence: Synthetic oligonucleotide
ttggaggaaaagtggaatttgtttgtcatgaaggatatcaattaaatgg

SEQ ID NO: 330520 - DNA, 48 bp, Artificial Sequence
  Description of Artificial Sequence: Synthetic oligonucleotide
tggaggaaaagtggaatttgtttgtcatgaaggatatcaattaaatgg

SEQ ID NO: 330521 - DNA, 47 bp, Artificial Sequence
  Description of Artificial Sequence: Synthetic oligonucleotide
ggaggaaaagtggaatttgtttgtcatgaaggatatcaattaaatgg

SEQ ID NO: 330522 - DNA, 47 bp, Artificial Sequence
  Description of Artificial Sequence: Synthetic oligonucleotide
gaggaaaagtggaatttgtttgtcatgaaggatatcaattaaatggc

SEQ ID NO: 330523 - DNA, 48 bp, Artificial Sequence
  Description of Artificial Sequence: Synthetic oligonucleotide
aggaaaagtggaatttgtttgtcatgaaggatatcaattaaatggcag

SEQ ID NO: 330524 - DNA, 47 bp, Artificial Sequence
  Description of Artificial Sequence: Synthetic oligonucleotide
ggaaaagtggaatttgtttgtcatgaaggatatcaattaaatggcag

SEQ ID NO: 330525 - DNA, 47 bp, Artificial Sequence
  Description of Artificial Sequence: Synthetic oligonucleotide
gaaaagtggaatttgtttgtcatgaaggatatcaattaaatggcagc

SEQ ID NO: 330526 - DNA, 48 bp, Artificial Sequence
  Description of Artificial Sequence: Synthetic oligonucleotide
aaaagtggaatttgtttgtcatgaaggatatcaattaaatggcagctc

SEQ ID NO: 330527 - DNA, 47 bp, Artificial Sequence
  Description of Artificial Sequence: Synthetic oligonucleotide
aaagtggaatttgtttgtcatgaaggatatcaattaaatggcagctc

SEQ ID NO: 330528 - DNA, 46 bp, Artificial Sequence
  Description of Artificial Sequence: Synthetic oligonucleotide
aagtggaatttgtttgtcatgaaggatatcaattaaatggcagctc

SEQ ID NO: 330529 - DNA, 45 bp, Artificial Sequence
  Description of Artificial Sequence: Synthetic oligonucleotide
agtggaatttgtttgtcatgaaggatatcaattaaatggcagctc

SEQ ID NO: 330530 - DNA, 44 bp, Artificial Sequence
  Description of Artificial Sequence: Synthetic oligonucleotide
gtggaatttgtttgtcatgaaggatatcaattaaatggcagctc

SEQ ID NO: 330531 - DNA, 45 bp, Artificial Sequence
  Description of Artificial Sequence: Synthetic oligonucleotide
tggaatttgtttgtcatgaaggatatcaattaaatggcagctctc

SEQ ID NO: 330532 - DNA, 44 bp, Artificial Sequence
  Description of Artificial Sequence: Synthetic oligonucleotide
ggaatttgtttgtcatgaaggatatcaattaaatggcagctctc

SEQ ID NO: 330533 - DNA, 44 bp, Artificial Sequence
  Description of Artificial Sequence: Synthetic oligonucleotide
gaatttgtttgtcatgaaggatatcaattaaatggcagctctcc

SEQ ID NO: 330534 - DNA, 46 bp, Artificial Sequence
  Description of Artificial Sequence: Synthetic oligonucleotide
aatttgtttgtcatgaaggatatcaattaaatggcagctctcctag

SEQ ID NO: 330535 - DNA, 45 bp, Artificial Sequence
  Description of Artificial Sequence: Synthetic oligonucleotide
atttgtttgtcatgaaggatatcaattaaatggcagctctcctag

SEQ ID NO: 330536 - DNA, 44 bp, Artificial Sequence
  Description of Artificial Sequence: Synthetic oligonucleotide
tttgtttgtcatgaaggatatcaattaaatggcagctctcctag

SEQ ID NO: 330537 - DNA, 43 bp, Artificial Sequence
  Description of Artificial Sequence: Synthetic oligonucleotide
ttgtttgtcatgaaggatatcaattaaatggcagctctcctag

SEQ ID NO: 330538 - DNA, 42 bp, Artificial Sequence
  Description of Artificial Sequence: Synthetic oligonucleotide
tgtttgtcatgaaggatatcaattaaatggcagctctcctag

SEQ ID NO: 330539 - DNA, 41 bp, Artificial Sequence
  Description of Artificial Sequence: Synthetic oligonucleotide
gtttgtcatgaaggatatcaattaaatggcagctctcctag

SEQ ID NO: 330540 - DNA, 44 bp, Artificial Sequence
  Description of Artificial Sequence: Synthetic oligonucleotide
tttgtcatgaaggatatcaattaaatggcagctctcctagttac

SEQ ID NO: 330541 - DNA, 43 bp, Artificial Sequence
  Description of Artificial Sequence: Synthetic oligonucleotide
ttgtcatgaaggatatcaattaaatggcagctctcctagttac

SEQ ID NO: 330542 - DNA, 42 bp, Artificial Sequence
  Description of Artificial Sequence: Synthetic oligonucleotide
tgtcatgaaggatatcaattaaatggcagctctcctagttac

SEQ ID NO: 330543 - DNA, 41 bp, Artificial Sequence
  Description of Artificial Sequence: Synthetic oligonucleotide
gtcatgaaggatatcaattaaatggcagctctcctagttac

SEQ ID NO: 330544 - DNA, 42 bp, Artificial Sequence
  Description of Artificial Sequence: Synthetic oligonucleotide
tcatgaaggatatcaattaaatggcagctctcctagttactc

SEQ ID NO: 330545 - DNA, 41 bp, Artificial Sequence
  Description of Artificial Sequence: Synthetic oligonucleotide
catgaaggatatcaattaaatggcagctctcctagttactc

SEQ ID NO: 330546 - DNA, 42 bp, Artificial Sequence
  Description of Artificial Sequence: Synthetic oligonucleotide
atgaaggatatcaattaaatggcagctctcctagttactctg

SEQ ID NO: 330547 - DNA, 41 bp, Artificial Sequence
  Description of Artificial Sequence: Synthetic oligonucleotide
tgaaggatatcaattaaatggcagctctcctagttactctg

SEQ ID NO: 330548 - DNA, 40 bp, Artificial Sequence
  Description of Artificial Sequence: Synthetic oligonucleotide
gaaggatatcaattaaatggcagctctcctagttactctg

SEQ ID NO: 330549 - DNA, 41 bp, Artificial Sequence
  Description of Artificial Sequence: Synthetic oligonucleotide
aaggatatcaattaaatggcagctctcctagttactctgtc

SEQ ID NO: 330550 - DNA, 40 bp, Artificial Sequence
  Description of Artificial Sequence: Synthetic oligonucleotide
aggatatcaattaaatggcagctctcctagttactctgtc

SEQ ID NO: 330551 - DNA, 39 bp, Artificial Sequence
  Description of Artificial Sequence: Synthetic oligonucleotide
ggatatcaattaaatggcagctctcctagttactctgtc

SEQ ID NO: 330552 - DNA, 41 bp, Artificial Sequence
  Description of Artificial Sequence: Synthetic oligonucleotide
gatatcaattaaatggcagctctcctagttactctgtcttg

SEQ ID NO: 330553 - DNA, 41 bp, Artificial Sequence
  Description of Artificial Sequence: Synthetic oligonucleotide
atatcaattaaatggcagctctcctagttactctgtcttgg

SEQ ID NO: 330554 - DNA, 40 bp, Artificial Sequence
  Description of Artificial Sequence: Synthetic oligonucleotide
tatcaattaaatggcagctctcctagttactctgtcttgg

SEQ ID NO: 330555 - DNA, 39 bp, Artificial Sequence
  Description of Artificial Sequence: Synthetic oligonucleotide
atcaattaaatggcagctctcctagttactctgtcttgg

SEQ ID NO: 330556 - DNA, 38 bp, Artificial Sequence
  Description of Artificial Sequence: Synthetic oligonucleotide
tcaattaaatggcagctctcctagttactctgtcttgg

SEQ ID NO: 330557 - DNA, 37 bp, Artificial Sequence
  Description of Artificial Sequence: Synthetic oligonucleotide
caattaaatggcagctctcctagttactctgtcttgg

SEQ ID NO: 330558 - DNA, 37 bp, Artificial Sequence
  Description of Artificial Sequence: Synthetic oligonucleotide
aattaaatggcagctctcctagttactctgtcttggc

SEQ ID NO: 330559 - DNA, 36 bp, Artificial Sequence
  Description of Artificial Sequence: Synthetic oligonucleotide
attaaatggcagctctcctagttactctgtcttggc

SEQ ID NO: 330560 - DNA, 35 bp, Artificial Sequence
  Description of Artificial Sequence: Synthetic oligonucleotide
ttaaatggcagctctcctagttactctgtcttggc

SEQ ID NO: 330561 - DNA, 34 bp, Artificial Sequence
  Description of Artificial Sequence: Synthetic oligonucleotide
taaatggcagctctcctagttactctgtcttggc

SEQ ID NO: 330562 - DNA, 33 bp, Artificial Sequence
  Description of Artificial Sequence: Synthetic oligonucleotide
aaatggcagctctcctagttactctgtcttggc

SEQ ID NO: 330563 - DNA, 32 bp, Artificial Sequence
  Description of Artificial Sequence: Synthetic oligonucleotide
aatggcagctctcctagttactctgtcttggc

SEQ ID NO: 330564 - DNA, 31 bp, Artificial Sequence
  Description of Artificial Sequence: Synthetic oligonucleotide
atggcagctctcctagttactctgtcttggc

SEQ ID NO: 330565 - DNA, 30 bp, Artificial Sequence
  Description of Artificial Sequence: Synthetic oligonucleotide
tggcagctctcctagttactctgtcttggc

SEQ ID NO: 330566 - DNA, 29 bp, Artificial Sequence
  Description of Artificial Sequence: Synthetic oligonucleotide
ggcagctctcctagttactctgtcttggc

SEQ ID NO: 330567 - DNA, 30 bp, Artificial Sequence
  Description of Artificial Sequence: Synthetic oligonucleotide
gcagctctcctagttactctgtcttggcag

SEQ ID NO: 330568 - DNA, 30 bp, Artificial Sequence
  Description of Artificial Sequence: Synthetic oligonucleotide
cagctctcctagttactctgtcttggcagg

SEQ ID NO: 330569 - DNA, 33 bp, Artificial Sequence
  Description of Artificial Sequence: Synthetic oligonucleotide
agctctcctagttactctgtcttggcaggaatg

SEQ ID NO: 330570 - DNA, 32 bp, Artificial Sequence
  Description of Artificial Sequence: Synthetic oligonucleotide
gctctcctagttactctgtcttggcaggaatg

SEQ ID NO: 330571 - DNA, 32 bp, Artificial Sequence
  Description of Artificial Sequence: Synthetic oligonucleotide
ctctcctagttactctgtcttggcaggaatgg

SEQ ID NO: 330572 - DNA, 35 bp, Artificial Sequence
  Description of Artificial Sequence: Synthetic oligonucleotide
tctcctagttactctgtcttggcaggaatggaatg

SEQ ID NO: 330573 - DNA, 34 bp, Artificial Sequence
  Description of Artificial Sequence: Synthetic oligonucleotide
ctcctagttactctgtcttggcaggaatggaatg

SEQ ID NO: 330574 - DNA, 34 bp, Artificial Sequence
  Description of Artificial Sequence: Synthetic oligonucleotide
tcctagttactctgtcttggcaggaatggaatgc

SEQ ID NO: 330575 - DNA, 33 bp, Artificial Sequence
  Description of Artificial Sequence: Synthetic oligonucleotide
cctagttactctgtcttggcaggaatggaatgc

SEQ ID NO: 330576 - DNA, 33 bp, Artificial Sequence
  Description of Artificial Sequence: Synthetic oligonucleotide
ctagttactctgtcttggcaggaatggaatgcc

SEQ ID NO: 330577 - DNA, 36 bp, Artificial Sequence
  Description of Artificial Sequence: Synthetic oligonucleotide
tagttactctgtcttggcaggaatggaatgcctttg

SEQ ID NO: 330578 - DNA, 35 bp, Artificial Sequence
  Description of Artificial Sequence: Synthetic oligonucleotide
agttactctgtcttggcaggaatggaatgcctttg

SEQ ID NO: 330579 - DNA, 34 bp, Artificial Sequence
  Description of Artificial Sequence: Synthetic oligonucleotide
gttactctgtcttggcaggaatggaatgcctttg

SEQ ID NO: 330580 - DNA, 34 bp, Artificial Sequence
  Description of Artificial Sequence: Synthetic oligonucleotide
ttactctgtcttggcaggaatggaatgcctttgg

SEQ ID NO: 330581 - DNA, 33 bp, Artificial Sequence
  Description of Artificial Sequence: Synthetic oligonucleotide
tactctgtcttggcaggaatggaatgcctttgg

SEQ ID NO: 330582 - DNA, 32 bp, Artificial Sequence
  Description of Artificial Sequence: Synthetic oligonucleotide
actctgtcttggcaggaatggaatgcctttgg

SEQ ID NO: 330583 - DNA, 31 bp, Artificial Sequence
  Description of Artificial Sequence: Synthetic oligonucleotide
ctctgtcttggcaggaatggaatgcctttgg

SEQ ID NO: 330584 - DNA, 35 bp, Artificial Sequence
  Description of Artificial Sequence: Synthetic oligonucleotide
tctgtcttggcaggaatggaatgcctttggattag

SEQ ID NO: 330585 - DNA, 34 bp, Artificial Sequence
  Description of Artificial Sequence: Synthetic oligonucleotide
ctgtcttggcaggaatggaatgcctttggattag

SEQ ID NO: 330586 - DNA, 34 bp, Artificial Sequence
  Description of Artificial Sequence: Synthetic oligonucleotide
tgtcttggcaggaatggaatgcctttggattagc

SEQ ID NO: 330587 - DNA, 33 bp, Artificial Sequence
  Description of Artificial Sequence: Synthetic oligonucleotide
gtcttggcaggaatggaatgcctttggattagc

SEQ ID NO: 330588 - DNA, 34 bp, Artificial Sequence
  Description of Artificial Sequence: Synthetic oligonucleotide
tcttggcaggaatggaatgcctttggattagcag

SEQ ID NO: 330589 - DNA, 33 bp, Artificial Sequence
  Description of Artificial Sequence: Synthetic oligonucleotide
cttggcaggaatggaatgcctttggattagcag

SEQ ID NO: 330590 - DNA, 34 bp, Artificial Sequence
  Description of Artificial Sequence: Synthetic oligonucleotide
ttggcaggaatggaatgcctttggattagcagtg

SEQ ID NO: 330591 - DNA, 33 bp, Artificial Sequence
  Description of Artificial Sequence: Synthetic oligonucleotide
tggcaggaatggaatgcctttggattagcagtg

SEQ ID NO: 330592 - DNA, 32 bp, Artificial Sequence
  Description of Artificial Sequence: Synthetic oligonucleotide
ggcaggaatggaatgcctttggattagcagtg

SEQ ID NO: 330593 - DNA, 34 bp, Artificial Sequence
  Description of Artificial Sequence: Synthetic oligonucleotide
gcaggaatggaatgcctttggattagcagtgtac

SEQ ID NO: 330594 - DNA, 34 bp, Artificial Sequence
  Description of Artificial Sequence: Synthetic oligonucleotide
caggaatggaatgcctttggattagcagtgtacc

SEQ ID NO: 330595 - DNA, 35 bp, Artificial Sequence
  Description of Artificial Sequence: Synthetic oligonucleotide
aggaatggaatgcctttggattagcagtgtaccag

SEQ ID NO: 330596 - DNA, 34 bp, Artificial Sequence
  Description of Artificial Sequence: Synthetic oligonucleotide
ggaatggaatgcctttggattagcagtgtaccag

SEQ ID NO: 330597 - DNA, 35 bp, Artificial Sequence
  Description of Artificial Sequence: Synthetic oligonucleotide
gaatggaatgcctttggattagcagtgtaccagtg

SEQ ID NO: 330598 - DNA, 36 bp, Artificial Sequence
  Description of Artificial Sequence: Synthetic oligonucleotide
aatggaatgcctttggattagcagtgtaccagtgtg

SEQ ID NO: 330599 - DNA, 35 bp, Artificial Sequence
  Description of Artificial Sequence: Synthetic oligonucleotide
atggaatgcctttggattagcagtgtaccagtgtg

SEQ ID NO: 330600 - DNA, 34 bp, Artificial Sequence
  Description of Artificial Sequence: Synthetic oligonucleotide
tggaatgcctttggattagcagtgtaccagtgtg

SEQ ID NO: 330601 - DNA, 33 bp, Artificial Sequence
  Description of Artificial Sequence: Synthetic oligonucleotide
ggaatgcctttggattagcagtgtaccagtgtg

SEQ ID NO: 330602 - DNA, 34 bp, Artificial Sequence
  Description of Artificial Sequence: Synthetic oligonucleotide
gaatgcctttggattagcagtgtaccagtgtgtc

SEQ ID NO: 330603 - DNA, 36 bp, Artificial Sequence
  Description of Artificial Sequence: Synthetic oligonucleotide
aatgcctttggattagcagtgtaccagtgtgtcaac

SEQ ID NO: 330604 - DNA, 35 bp, Artificial Sequence
  Description of Artificial Sequence: Synthetic oligonucleotide
atgcctttggattagcagtgtaccagtgtgtcaac

SEQ ID NO: 330605 - DNA, 34 bp, Artificial Sequence
  Description of Artificial Sequence: Synthetic oligonucleotide
tgcctttggattagcagtgtaccagtgtgtcaac

SEQ ID NO: 330606 - DNA, 33 bp, Artificial Sequence
  Description of Artificial Sequence: Synthetic oligonucleotide
gcctttggattagcagtgtaccagtgtgtcaac

SEQ ID NO: 330607 - DNA, 37 bp, Artificial Sequence
  Description of Artificial Sequence: Synthetic oligonucleotide
cctttggattagcagtgtaccagtgtgtcaacaaatc

SEQ ID NO: 330608 - DNA, 41 bp, Artificial Sequence
  Description of Artificial Sequence: Synthetic oligonucleotide
ctttggattagcagtgtaccagtgtgtcaacaaatctattg

SEQ ID NO: 330609 - DNA, 42 bp, Artificial Sequence
  Description of Artificial Sequence: Synthetic oligonucleotide
tttggattagcagtgtaccagtgtgtcaacaaatctattgtc

SEQ ID NO: 330610 - DNA, 41 bp, Artificial Sequence
  Description of Artificial Sequence: Synthetic oligonucleotide
ttggattagcagtgtaccagtgtgtcaacaaatctattgtc

SEQ ID NO: 330611 - DNA, 40 bp, Artificial Sequence
  Description of Artificial Sequence: Synthetic oligonucleotide
tggattagcagtgtaccagtgtgtcaacaaatctattgtc

SEQ ID NO: 330612 - DNA, 39 bp, Artificial Sequence
  Description of Artificial Sequence: Synthetic oligonucleotide
ggattagcagtgtaccagtgtgtcaacaaatctattgtc

SEQ ID NO: 330613 - DNA, 39 bp, Artificial Sequence
  Description of Artificial Sequence: Synthetic oligonucleotide
gattagcagtgtaccagtgtgtcaacaaatctattgtcc

SEQ ID NO: 330614 - DNA, 41 bp, Artificial Sequence
  Description of Artificial Sequence: Synthetic oligonucleotide
attagcagtgtaccagtgtgtcaacaaatctattgtccaag

SEQ ID NO: 330615 - DNA, 40 bp, Artificial Sequence
  Description of Artificial Sequence: Synthetic oligonucleotide
ttagcagtgtaccagtgtgtcaacaaatctattgtccaag

SEQ ID NO: 330616 - DNA, 39 bp, Artificial Sequence
  Description of Artificial Sequence: Synthetic oligonucleotide
tagcagtgtaccagtgtgtcaacaaatctattgtccaag

SEQ ID NO: 330617 - DNA, 38 bp, Artificial Sequence
  Description of Artificial Sequence: Synthetic oligonucleotide
agcagtgtaccagtgtgtcaacaaatctattgtccaag

SEQ ID NO: 330618 - DNA, 37 bp, Artificial Sequence
  Description of Artificial Sequence: Synthetic oligonucleotide
gcagtgtaccagtgtgtcaacaaatctattgtccaag

SEQ ID NO: 330619 - DNA, 38 bp, Artificial Sequence
  Description of Artificial Sequence: Synthetic oligonucleotide
cagtgtaccagtgtgtcaacaaatctattgtccaagac

SEQ ID NO: 330620 - DNA, 38 bp, Artificial Sequence
  Description of Artificial Sequence: Synthetic oligonucleotide
agtgtaccagtgtgtcaacaaatctattgtccaagacc

SEQ ID NO: 330621 - DNA, 37 bp, Artificial Sequence
  Description of Artificial Sequence: Synthetic oligonucleotide
gtgtaccagtgtgtcaacaaatctattgtccaagacc

SEQ ID NO: 330622 - DNA, 38 bp, Artificial Sequence
  Description of Artificial Sequence: Synthetic oligonucleotide
tgtaccagtgtgtcaacaaatctattgtccaagacctc

SEQ ID NO: 330623 - DNA, 37 bp, Artificial Sequence
  Description of Artificial Sequence: Synthetic oligonucleotide
gtaccagtgtgtcaacaaatctattgtccaagacctc

SEQ ID NO: 330624 - DNA, 37 bp, Artificial Sequence
  Description of Artificial Sequence: Synthetic oligonucleotide
taccagtgtgtcaacaaatctattgtccaagacctcc

SEQ ID NO: 330625 - DNA, 36 bp, Artificial Sequence
  Description of Artificial Sequence: Synthetic oligonucleotide
accagtgtgtcaacaaatctattgtccaagacctcc

SEQ ID NO: 330626 - DNA, 35 bp, Artificial Sequence
  Description of Artificial Sequence: Synthetic oligonucleotide
ccagtgtgtcaacaaatctattgtccaagacctcc

SEQ ID NO: 330627 - DNA, 36 bp, Artificial Sequence
  Description of Artificial Sequence: Synthetic oligonucleotide
cagtgtgtcaacaaatctattgtccaagacctccag

SEQ ID NO: 330628 - DNA, 41 bp, Artificial Sequence
  Description of Artificial Sequence: Synthetic oligonucleotide
agtgtgtcaacaaatctattgtccaagacctccagtttttc

SEQ ID NO: 330629 - DNA, 40 bp, Artificial Sequence
  Description of Artificial Sequence: Synthetic oligonucleotide
gtgtgtcaacaaatctattgtccaagacctccagtttttc

SEQ ID NO: 330630 - DNA, 40 bp, Artificial Sequence
  Description of Artificial Sequence: Synthetic oligonucleotide
tgtgtcaacaaatctattgtccaagacctccagtttttcc

SEQ ID NO: 330631 - DNA, 39 bp, Artificial Sequence
  Description of Artificial Sequence: Synthetic oligonucleotide
gtgtcaacaaatctattgtccaagacctccagtttttcc

SEQ ID NO: 330632 - DNA, 43 bp, Artificial Sequence
  Description of Artificial Sequence: Synthetic oligonucleotide
tgtcaacaaatctattgtccaagacctccagtttttcctaatg

SEQ ID NO: 330633 - DNA, 42 bp, Artificial Sequence
  Description of Artificial Sequence: Synthetic oligonucleotide
gtcaacaaatctattgtccaagacctccagtttttcctaatg

SEQ ID NO: 330634 - DNA, 42 bp, Artificial Sequence
  Description of Artificial Sequence: Synthetic oligonucleotide
tcaacaaatctattgtccaagacctccagtttttcctaatgc

SEQ ID NO: 330635 - DNA, 41 bp, Artificial Sequence
  Description of Artificial Sequence: Synthetic oligonucleotide
caacaaatctattgtccaagacctccagtttttcctaatgc

SEQ ID NO: 330636 - DNA, 41 bp, Artificial Sequence
  Description of Artificial Sequence: Synthetic oligonucleotide
aacaaatctattgtccaagacctccagtttttcctaatgcg

SEQ ID NO: 330637 - DNA, 40 bp, Artificial Sequence
  Description of Artificial Sequence: Synthetic oligonucleotide
acaaatctattgtccaagacctccagtttttcctaatgcg

SEQ ID NO: 330638 - DNA, 39 bp, Artificial Sequence
  Description of Artificial Sequence: Synthetic oligonucleotide
caaatctattgtccaagacctccagtttttcctaatgcg

SEQ ID NO: 330639 - DNA, 40 bp, Artificial Sequence
  Description of Artificial Sequence: Synthetic oligonucleotide
aaatctattgtccaagacctccagtttttcctaatgcgag

SEQ ID NO: 330640 - DNA, 39 bp, Artificial Sequence
  Description of Artificial Sequence: Synthetic oligonucleotide
aatctattgtccaagacctccagtttttcctaatgcgag

SEQ ID NO: 330641 - DNA, 38 bp, Artificial Sequence
  Description of Artificial Sequence: Synthetic oligonucleotide
atctattgtccaagacctccagtttttcctaatgcgag

SEQ ID NO: 330642 - DNA, 37 bp, Artificial Sequence
  Description of Artificial Sequence: Synthetic oligonucleotide
tctattgtccaagacctccagtttttcctaatgcgag

SEQ ID NO: 330643 - DNA, 36 bp, Artificial Sequence
  Description of Artificial Sequence: Synthetic oligonucleotide
ctattgtccaagacctccagtttttcctaatgcgag

SEQ ID NO: 330644 - DNA, 37 bp, Artificial Sequence
  Description of Artificial Sequence: Synthetic oligonucleotide
tattgtccaagacctccagtttttcctaatgcgagac

SEQ ID NO: 330645 - DNA, 36 bp, Artificial Sequence
  Description of Artificial Sequence: Synthetic oligonucleotide
attgtccaagacctccagtttttcctaatgcgagac

SEQ ID NO: 330646 - DNA, 35 bp, Artificial Sequence
  Description of Artificial Sequence: Synthetic oligonucleotide
ttgtccaagacctccagtttttcctaatgcgagac

SEQ ID NO: 330647 - DNA, 34 bp, Artificial Sequence
  Description of Artificial Sequence: Synthetic oligonucleotide
tgtccaagacctccagtttttcctaatgcgagac

SEQ ID NO: 330648 - DNA, 33 bp, Artificial Sequence
  Description of Artificial Sequence: Synthetic oligonucleotide
gtccaagacctccagtttttcctaatgcgagac

SEQ ID NO: 330649 - DNA, 34 bp, Artificial Sequence
  Description of Artificial Sequence: Synthetic oligonucleotide
tccaagacctccagtttttcctaatgcgagacac

SEQ ID NO: 330650 - DNA, 33 bp, Artificial Sequence
  Description of Artificial Sequence: Synthetic oligonucleotide
ccaagacctccagtttttcctaatgcgagacac

SEQ ID NO: 330651 - DNA, 34 bp, Artificial Sequence
  Description of Artificial Sequence: Synthetic oligonucleotide
caagacctccagtttttcctaatgcgagacacac

SEQ ID NO: 330652 - DNA, 35 bp, Artificial Sequence
  Description of Artificial Sequence: Synthetic oligonucleotide
aagacctccagtttttcctaatgcgagacacactg

SEQ ID NO: 330653 - DNA, 34 bp, Artificial Sequence
  Description of Artificial Sequence: Synthetic oligonucleotide
agacctccagtttttcctaatgcgagacacactg

SEQ ID NO: 330654 - DNA, 33 bp, Artificial Sequence
  Description of Artificial Sequence: Synthetic oligonucleotide
gacctccagtttttcctaatgcgagacacactg

SEQ ID NO: 330655 - DNA, 33 bp, Artificial Sequence
  Description of Artificial Sequence: Synthetic oligonucleotide
acctccagtttttcctaatgcgagacacactgg

SEQ ID NO: 330656 - DNA, 32 bp, Artificial Sequence
  Description of Artificial Sequence: Synthetic oligonucleotide
cctccagtttttcctaatgcgagacacactgg

SEQ ID NO: 330657 - DNA, 36 bp, Artificial Sequence
  Description of Artificial Sequence: Synthetic oligonucleotide
ctccagtttttcctaatgcgagacacactggaaaac

SEQ ID NO: 330658 - DNA, 36 bp, Artificial Sequence
  Description of Artificial Sequence: Synthetic oligonucleotide
tccagtttttcctaatgcgagacacactggaaaacc

SEQ ID NO: 330659 - DNA, 35 bp, Artificial Sequence
  Description of Artificial Sequence: Synthetic oligonucleotide
ccagtttttcctaatgcgagacacactggaaaacc

SEQ ID NO: 330660 - DNA, 36 bp, Artificial Sequence
  Description of Artificial Sequence: Synthetic oligonucleotide
cagtttttcctaatgcgagacacactggaaaacctg

SEQ ID NO: 330661 - DNA, 37 bp, Artificial Sequence
  Description of Artificial Sequence: Synthetic oligonucleotide
agtttttcctaatgcgagacacactggaaaacctgtg

SEQ ID NO: 330662 - DNA, 36 bp, Artificial Sequence
  Description of Artificial Sequence: Synthetic oligonucleotide
gtttttcctaatgcgagacacactggaaaacctgtg

SEQ ID NO: 330663 - DNA, 36 bp, Artificial Sequence
  Description of Artificial Sequence: Synthetic oligonucleotide
tttttcctaatgcgagacacactggaaaacctgtgg

SEQ ID NO: 330664 - DNA, 35 bp, Artificial Sequence
  Description of Artificial Sequence: Synthetic oligonucleotide
ttttcctaatgcgagacacactggaaaacctgtgg

SEQ ID NO: 330665 - DNA, 34 bp, Artificial Sequence
  Description of Artificial Sequence: Synthetic oligonucleotide
tttcctaatgcgagacacactggaaaacctgtgg

SEQ ID NO: 330666 - DNA, 33 bp, Artificial Sequence
  Description of Artificial Sequence: Synthetic oligonucleotide
ttcctaatgcgagacacactggaaaacctgtgg

SEQ ID NO: 330667 - DNA, 32 bp, Artificial Sequence
  Description of Artificial Sequence: Synthetic oligonucleotide
tcctaatgcgagacacactggaaaacctgtgg

SEQ ID NO: 330668 - DNA, 31 bp, Artificial Sequence
  Description of Artificial Sequence: Synthetic oligonucleotide
cctaatgcgagacacactggaaaacctgtgg

SEQ ID NO: 330669 - DNA, 33 bp, Artificial Sequence
  Description of Artificial Sequence: Synthetic oligonucleotide
ctaatgcgagacacactggaaaacctgtggaag

SEQ ID NO: 330670 - DNA, 34 bp, Artificial Sequence
  Description of Artificial Sequence: Synthetic oligonucleotide
taatgcgagacacactggaaaacctgtggaagtc

SEQ ID NO: 330671 - DNA, 33 bp, Artificial Sequence
  Description of Artificial Sequence: Synthetic oligonucleotide
aatgcgagacacactggaaaacctgtggaagtc

SEQ ID NO: 330672 - DNA, 32 bp, Artificial Sequence
  Description of Artificial Sequence: Synthetic oligonucleotide
atgcgagacacactggaaaacctgtggaagtc

SEQ ID NO: 330673 - DNA, 31 bp, Artificial Sequence
  Description of Artificial Sequence: Synthetic oligonucleotide
tgcgagacacactggaaaacctgtggaagtc

SEQ ID NO: 330674 - DNA, 30 bp, Artificial Sequence
  Description of Artificial Sequence: Synthetic oligonucleotide
gcgagacacactggaaaacctgtggaagtc

SEQ ID NO: 330675 - DNA, 33 bp, Artificial Sequence
  Description of Artificial Sequence: Synthetic oligonucleotide
cgagacacactggaaaacctgtggaagtctatc

SEQ ID NO: 330676 - DNA, 33 bp, Artificial Sequence
  Description of Artificial Sequence: Synthetic oligonucleotide
gagacacactggaaaacctgtggaagtctatcc

SEQ ID NO: 330677 - DNA, 33 bp, Artificial Sequence
  Description of Artificial Sequence: Synthetic oligonucleotide
agacacactggaaaacctgtggaagtctatccc

SEQ ID NO: 330678 - DNA, 32 bp, Artificial Sequence
  Description of Artificial Sequence: Synthetic oligonucleotide
gacacactggaaaacctgtggaagtctatccc

SEQ ID NO: 330679 - DNA, 35 bp, Artificial Sequence
  Description of Artificial Sequence: Synthetic oligonucleotide
acacactggaaaacctgtggaagtctatccctttg

SEQ ID NO: 330680 - DNA, 34 bp, Artificial Sequence
  Description of Artificial Sequence: Synthetic oligonucleotide
cacactggaaaacctgtggaagtctatccctttg

SEQ ID NO: 330681 - DNA, 34 bp, Artificial Sequence
  Description of Artificial Sequence: Synthetic oligonucleotide
acactggaaaacctgtggaagtctatccctttgg

SEQ ID NO: 330682 - DNA, 33 bp, Artificial Sequence
  Description of Artificial Sequence: Synthetic oligonucleotide
cactggaaaacctgtggaagtctatccctttgg

SEQ ID NO: 330683 - DNA, 33 bp, Artificial Sequence
  Description of Artificial Sequence: Synthetic oligonucleotide
actggaaaacctgtggaagtctatccctttggc

SEQ ID NO: 330684 - DNA, 32 bp, Artificial Sequence
  Description of Artificial Sequence: Synthetic oligonucleotide
ctggaaaacctgtggaagtctatccctttggc

SEQ ID NO: 330685 - DNA, 36 bp, Artificial Sequence
  Description of Artificial Sequence: Synthetic oligonucleotide
tggaaaacctgtggaagtctatccctttggcaaaac

SEQ ID NO: 330686 - DNA, 35 bp, Artificial Sequence
  Description of Artificial Sequence: Synthetic oligonucleotide
ggaaaacctgtggaagtctatccctttggcaaaac

SEQ ID NO: 330687 - DNA, 36 bp, Artificial Sequence
  Description of Artificial Sequence: Synthetic oligonucleotide
gaaaacctgtggaagtctatccctttggcaaaacag

SEQ ID NO: 330688 - DNA, 43 bp, Artificial Sequence
  Description of Artificial Sequence: Synthetic oligonucleotide
aaaacctgtggaagtctatccctttggcaaaacagtatattac

SEQ ID NO: 330689 - DNA, 42 bp, Artificial Sequence
  Description of Artificial Sequence: Synthetic oligonucleotide
aaacctgtggaagtctatccctttggcaaaacagtatattac

SEQ ID NO: 330690 - DNA, 41 bp, Artificial Sequence
  Description of Artificial Sequence: Synthetic oligonucleotide
aacctgtggaagtctatccctttggcaaaacagtatattac

SEQ ID NO: 330691 - DNA, 40 bp, Artificial Sequence
  Description of Artificial Sequence: Synthetic oligonucleotide
acctgtggaagtctatccctttggcaaaacagtatattac

SEQ ID NO: 330692 - DNA, 39 bp, Artificial Sequence
  Description of Artificial Sequence: Synthetic oligonucleotide
cctgtggaagtctatccctttggcaaaacagtatattac

SEQ ID NO: 330693 - DNA, 40 bp, Artificial Sequence
  Description of Artificial Sequence: Synthetic oligonucleotide
ctgtggaagtctatccctttggcaaaacagtatattacac

SEQ ID NO: 330694 - DNA, 42 bp, Artificial Sequence
  Description of Artificial Sequence: Synthetic oligonucleotide
tgtggaagtctatccctttggcaaaacagtatattacacatc

SEQ ID NO: 330695 - DNA, 41 bp, Artificial Sequence
  Description of Artificial Sequence: Synthetic oligonucleotide
gtggaagtctatccctttggcaaaacagtatattacacatc

SEQ ID NO: 330696 - DNA, 41 bp, Artificial Sequence
  Description of Artificial Sequence: Synthetic oligonucleotide
tggaagtctatccctttggcaaaacagtatattacacatcc

SEQ ID NO: 330697 - DNA, 40 bp, Artificial Sequence
  Description of Artificial Sequence: Synthetic oligonucleotide
ggaagtctatccctttggcaaaacagtatattacacatcc

SEQ ID NO: 330698 - DNA, 40 bp, Artificial Sequence
  Description of Artificial Sequence: Synthetic oligonucleotide
gaagtctatccctttggcaaaacagtatattacacatccg

SEQ ID NO: 330699 - DNA, 41 bp, Artificial Sequence
  Description of Artificial Sequence: Synthetic oligonucleotide
aagtctatccctttggcaaaacagtatattacacatccgac

SEQ ID NO: 330700 - DNA, 40 bp, Artificial Sequence
  Description of Artificial Sequence: Synthetic oligonucleotide
agtctatccctttggcaaaacagtatattacacatccgac

SEQ ID NO: 330701 - DNA, 39 bp, Artificial Sequence
  Description of Artificial Sequence: Synthetic oligonucleotide
gtctatccctttggcaaaacagtatattacacatccgac

SEQ ID NO: 330702 - DNA, 39 bp, Artificial Sequence
  Description of Artificial Sequence: Synthetic oligonucleotide
tctatccctttggcaaaacagtatattacacatccgacc

SEQ ID NO: 330703 - DNA, 38 bp, Artificial Sequence
  Description of Artificial Sequence: Synthetic oligonucleotide
ctatccctttggcaaaacagtatattacacatccgacc

SEQ ID NO: 330704 - DNA, 38 bp, Artificial Sequence
  Description of Artificial Sequence: Synthetic oligonucleotide
tatccctttggcaaaacagtatattacacatccgaccc

SEQ ID NO: 330705 - DNA, 37 bp, Artificial Sequence
  Description of Artificial Sequence: Synthetic oligonucleotide
atccctttggcaaaacagtatattacacatccgaccc

SEQ ID NO: 330706 - DNA, 36 bp, Artificial Sequence
  Description of Artificial Sequence: Synthetic oligonucleotide
tccctttggcaaaacagtatattacacatccgaccc

SEQ ID NO: 330707 - DNA, 35 bp, Artificial Sequence
  Description of Artificial Sequence: Synthetic oligonucleotide
ccctttggcaaaacagtatattacacatccgaccc

SEQ ID NO: 330708 - DNA, 35 bp, Artificial Sequence
  Description of Artificial Sequence: Synthetic oligonucleotide
cctttggcaaaacagtatattacacatccgacccc

SEQ ID NO: 330709 - DNA, 35 bp, Artificial Sequence
  Description of Artificial Sequence: Synthetic oligonucleotide
ctttggcaaaacagtatattacacatccgaccccc

SEQ ID NO: 330710 - DNA, 36 bp, Artificial Sequence
  Description of Artificial Sequence: Synthetic oligonucleotide
tttggcaaaacagtatattacacatccgacccccag

SEQ ID NO: 330711 - DNA, 35 bp, Artificial Sequence
  Description of Artificial Sequence: Synthetic oligonucleotide
ttggcaaaacagtatattacacatccgacccccag

SEQ ID NO: 330712 - DNA, 34 bp, Artificial Sequence
  Description of Artificial Sequence: Synthetic oligonucleotide
tggcaaaacagtatattacacatccgacccccag

SEQ ID NO: 330713 - DNA, 33 bp, Artificial Sequence
  Description of Artificial Sequence: Synthetic oligonucleotide
ggcaaaacagtatattacacatccgacccccag

SEQ ID NO: 330714 - DNA, 33 bp, Artificial Sequence
  Description of Artificial Sequence: Synthetic oligonucleotide
gcaaaacagtatattacacatccgacccccagc

SEQ ID NO: 330715 - DNA, 33 bp, Artificial Sequence
  Description of Artificial Sequence: Synthetic oligonucleotide
caaaacagtatattacacatccgacccccagcc

SEQ ID NO: 330716 - DNA, 34 bp, Artificial Sequence
  Description of Artificial Sequence: Synthetic oligonucleotide
aaaacagtatattacacatccgacccccagccag

SEQ ID NO: 330717 - DNA, 33 bp, Artificial Sequence
  Description of Artificial Sequence: Synthetic oligonucleotide
aaacagtatattacacatccgacccccagccag

SEQ ID NO: 330718 - DNA, 32 bp, Artificial Sequence
  Description of Artificial Sequence: Synthetic oligonucleotide
aacagtatattacacatccgacccccagccag

SEQ ID NO: 330719 - DNA, 31 bp, Artificial Sequence
  Description of Artificial Sequence: Synthetic oligonucleotide
acagtatattacacatccgacccccagccag

SEQ ID NO: 330720 - DNA, 30 bp, Artificial Sequence
  Description of Artificial Sequence: Synthetic oligonucleotide
cagtatattacacatccgacccccagccag

SEQ ID NO: 330721 - DNA, 31 bp, Artificial Sequence
  Description of Artificial Sequence: Synthetic oligonucleotide
agtatattacacatccgacccccagccagac

SEQ ID NO: 330722 - DNA, 30 bp, Artificial Sequence
  Description of Artificial Sequence: Synthetic oligonucleotide
gtatattacacatccgacccccagccagac

SEQ ID NO: 330723 - DNA, 31 bp, Artificial Sequence
  Description of Artificial Sequence: Synthetic oligonucleotide
tatattacacatccgacccccagccagacag

SEQ ID NO: 330724 - DNA, 30 bp, Artificial Sequence
  Description of Artificial Sequence: Synthetic oligonucleotide
atattacacatccgacccccagccagacag

SEQ ID NO: 330725 - DNA, 29 bp, Artificial Sequence
  Description of Artificial Sequence: Synthetic oligonucleotide
tattacacatccgacccccagccagacag

SEQ ID NO: 330726 - DNA, 28 bp, Artificial Sequence
  Description of Artificial Sequence: Synthetic oligonucleotide
attacacatccgacccccagccagacag

SEQ ID NO: 330727 - DNA, 27 bp, Artificial Sequence
  Description of Artificial Sequence: Synthetic oligonucleotide
ttacacatccgacccccagccagacag

SEQ ID NO: 330728 - DNA, 27 bp, Artificial Sequence
  Description of Artificial Sequence: Synthetic oligonucleotide
tacacatccgacccccagccagacaga

SEQ ID NO: 330729 - DNA, 26 bp, Artificial Sequence
  Description of Artificial Sequence: Synthetic oligonucleotide
acacatccgacccccagccagacaga

SEQ ID NO: 330730 - DNA, 25 bp, Artificial Sequence
  Description of Artificial Sequence: Synthetic oligonucleotide
cacatccgacccccagccagacaga

SEQ ID NO: 330731 - DNA, 25 bp, Artificial Sequence
  Description of Artificial Sequence: Synthetic oligonucleotide
acatccgacccccagccagacagac

SEQ ID NO: 330732 - DNA, 24 bp, Artificial Sequence
  Description of Artificial Sequence: Synthetic oligonucleotide
catccgacccccagccagacagac

SEQ ID NO: 330733 - DNA, 24 bp, Artificial Sequence
  Description of Artificial Sequence: Synthetic oligonucleotide
atccgacccccagccagacagacg

SEQ ID NO: 330734 - DNA, 23 bp, Artificial Sequence
  Description of Artificial Sequence: Synthetic oligonucleotide
tccgacccccagccagacagacg

SEQ ID NO: 330735 - DNA, 22 bp, Artificial Sequence
  Description of Artificial Sequence: Synthetic oligonucleotide
ccgacccccagccagacagacg

SEQ ID NO: 330736 - DNA, 23 bp, Artificial Sequence
  Description of Artificial Sequence: Synthetic oligonucleotide
cgacccccagccagacagacgga

SEQ ID NO: 330737 - DNA, 23 bp, Artificial Sequence
  Description of Artificial Sequence: Synthetic oligonucleotide
gacccccagccagacagacggac

SEQ ID NO: 330738 - DNA, 24 bp, Artificial Sequence
  Description of Artificial Sequence: Synthetic oligonucleotide
acccccagccagacagacggacga

SEQ ID NO: 330739 - DNA, 23 bp, Artificial Sequence
  Description of Artificial Sequence: Synthetic oligonucleotide
cccccagccagacagacggacga

SEQ ID NO: 330740 - DNA, 23 bp, Artificial Sequence
  Description of Artificial Sequence: Synthetic oligonucleotide
ccccagccagacagacggacgag

SEQ ID NO: 330741 - DNA, 25 bp, Artificial Sequence
  Description of Artificial Sequence: Synthetic oligonucleotide
cccagccagacagacggacgagcta

SEQ ID NO: 330742 - DNA, 25 bp, Artificial Sequence
  Description of Artificial Sequence: Synthetic oligonucleotide
ccagccagacagacggacgagctac

SEQ ID NO: 330743 - DNA, 26 bp, Artificial Sequence
  Description of Artificial Sequence: Synthetic oligonucleotide
cagccagacagacggacgagctacga

SEQ ID NO: 330744 - DNA, 26 bp, Artificial Sequence
  Description of Artificial Sequence: Synthetic oligonucleotide
agccagacagacggacgagctacgac

SEQ ID NO: 330745 - DNA, 25 bp, Artificial Sequence
  Description of Artificial Sequence: Synthetic oligonucleotide
gccagacagacggacgagctacgac

SEQ ID NO: 330746 - DNA, 26 bp, Artificial Sequence
  Description of Artificial Sequence: Synthetic oligonucleotide
ccagacagacggacgagctacgacct

SEQ ID NO: 330747 - DNA, 27 bp, Artificial Sequence
  Description of Artificial Sequence: Synthetic oligonucleotide
cagacagacggacgagctacgacctca

SEQ ID NO: 330748 - DNA, 29 bp, Artificial Sequence
  Description of Artificial Sequence: Synthetic oligonucleotide
agacagacggacgagctacgacctcatag

SEQ ID NO: 330749 - DNA, 28 bp, Artificial Sequence
  Description of Artificial Sequence: Synthetic oligonucleotide
gacagacggacgagctacgacctcatag

SEQ ID NO: 330750 - DNA, 28 bp, Artificial Sequence
  Description of Artificial Sequence: Synthetic oligonucleotide
acagacggacgagctacgacctcatagg

SEQ ID NO: 330751 - DNA, 27 bp, Artificial Sequence
  Description of Artificial Sequence: Synthetic oligonucleotide
cagacggacgagctacgacctcatagg

SEQ ID NO: 330752 - DNA, 28 bp, Artificial Sequence
  Description of Artificial Sequence: Synthetic oligonucleotide
agacggacgagctacgacctcataggag

SEQ ID NO: 330753 - DNA, 27 bp, Artificial Sequence
  Description of Artificial Sequence: Synthetic oligonucleotide
gacggacgagctacgacctcataggag

SEQ ID NO: 330754 - DNA, 28 bp, Artificial Sequence
  Description of Artificial Sequence: Synthetic oligonucleotide
acggacgagctacgacctcataggagag

SEQ ID NO: 330755 - DNA, 27 bp, Artificial Sequence
  Description of Artificial Sequence: Synthetic oligonucleotide
cggacgagctacgacctcataggagag

SEQ ID NO: 330756 - DNA, 28 bp, Artificial Sequence
  Description of Artificial Sequence: Synthetic oligonucleotide
ggacgagctacgacctcataggagagag

SEQ ID NO: 330757 - DNA, 28 bp, Artificial Sequence
  Description of Artificial Sequence: Synthetic oligonucleotide
gacgagctacgacctcataggagagagc

SEQ ID NO: 330758 - DNA, 29 bp, Artificial Sequence
  Description of Artificial Sequence: Synthetic oligonucleotide
acgagctacgacctcataggagagagctc

SEQ ID NO: 330759 - DNA, 28 bp, Artificial Sequence
  Description of Artificial Sequence: Synthetic oligonucleotide
cgagctacgacctcataggagagagctc

SEQ ID NO: 330760 - DNA, 28 bp, Artificial Sequence
  Description of Artificial Sequence: Synthetic oligonucleotide
gagctacgacctcataggagagagctcc

SEQ ID NO: 330761 - DNA, 30 bp, Artificial Sequence
  Description of Artificial Sequence: Synthetic oligonucleotide
agctacgacctcataggagagagctccatc

SEQ ID NO: 330762 - DNA, 29 bp, Artificial Sequence
  Description of Artificial Sequence: Synthetic oligonucleotide
gctacgacctcataggagagagctccatc

SEQ ID NO: 330763 - DNA, 29 bp, Artificial Sequence
  Description of Artificial Sequence: Synthetic oligonucleotide
ctacgacctcataggagagagctccatcc

SEQ ID NO: 330764 - DNA, 29 bp, Artificial Sequence
  Description of Artificial Sequence: Synthetic oligonucleotide
tacgacctcataggagagagctccatccg

SEQ ID NO: 330765 - DNA, 28 bp, Artificial Sequence
  Description of Artificial Sequence: Synthetic oligonucleotide
acgacctcataggagagagctccatccg

SEQ ID NO: 330766 - DNA, 27 bp, Artificial Sequence
  Description of Artificial Sequence: Synthetic oligonucleotide
cgacctcataggagagagctccatccg

SEQ ID NO: 330767 - DNA, 27 bp, Artificial Sequence
  Description of Artificial Sequence: Synthetic oligonucleotide
gacctcataggagagagctccatccgc

SEQ ID NO: 330768 - DNA, 28 bp, Artificial Sequence
  Description of Artificial Sequence: Synthetic oligonucleotide
acctcataggagagagctccatccgctc

SEQ ID NO: 330769 - DNA, 27 bp, Artificial Sequence
  Description of Artificial Sequence: Synthetic oligonucleotide
cctcataggagagagctccatccgctc

SEQ ID NO: 330770 - DNA, 27 bp, Artificial Sequence
  Description of Artificial Sequence: Synthetic oligonucleotide
ctcataggagagagctccatccgctcc

SEQ ID NO: 330771 - DNA, 28 bp, Artificial Sequence
  Description of Artificial Sequence: Synthetic oligonucleotide
tcataggagagagctccatccgctccac

SEQ ID NO: 330772 - DNA, 27 bp, Artificial Sequence
  Description of Artificial Sequence: Synthetic oligonucleotide
cataggagagagctccatccgctccac

SEQ ID NO: 330773 - DNA, 29 bp, Artificial Sequence
  Description of Artificial Sequence: Synthetic oligonucleotide
ataggagagagctccatccgctccacaag

SEQ ID NO: 330774 - DNA, 28 bp, Artificial Sequence
  Description of Artificial Sequence: Synthetic oligonucleotide
taggagagagctccatccgctccacaag

SEQ ID NO: 330775 - DNA, 27 bp, Artificial Sequence
  Description of Artificial Sequence: Synthetic oligonucleotide
aggagagagctccatccgctccacaag

SEQ ID NO: 330776 - DNA, 27 bp, Artificial Sequence
  Description of Artificial Sequence: Synthetic oligonucleotide
ggagagagctccatccgctccacaagt

SEQ ID NO: 330777 - DNA, 27 bp, Artificial Sequence
  Description of Artificial Sequence: Synthetic oligonucleotide
gagagagctccatccgctccacaagtg

SEQ ID NO: 330778 - DNA, 28 bp, Artificial Sequence
  Description of Artificial Sequence: Synthetic oligonucleotide
agagagctccatccgctccacaagtgag

SEQ ID NO: 330779 - DNA, 27 bp, Artificial Sequence
  Description of Artificial Sequence: Synthetic oligonucleotide
gagagctccatccgctccacaagtgag

SEQ ID NO: 330780 - DNA, 27 bp, Artificial Sequence
  Description of Artificial Sequence: Synthetic oligonucleotide
agagctccatccgctccacaagtgagc

SEQ ID NO: 330781 - DNA, 26 bp, Artificial Sequence
  Description of Artificial Sequence: Synthetic oligonucleotide
gagctccatccgctccacaagtgagc

SEQ ID NO: 330782 - DNA, 27 bp, Artificial Sequence
  Description of Artificial Sequence: Synthetic oligonucleotide
agctccatccgctccacaagtgagcct

SEQ ID NO: 330783 - DNA, 26 bp, Artificial Sequence
  Description of Artificial Sequence: Synthetic oligonucleotide
gctccatccgctccacaagtgagcct

SEQ ID NO: 330784 - DNA, 27 bp, Artificial Sequence
  Description of Artificial Sequence: Synthetic oligonucleotide
ctccatccgctccacaagtgagcctca

SEQ ID NO: 330785 - DNA, 28 bp, Artificial Sequence
  Description of Artificial Sequence: Synthetic oligonucleotide
tccatccgctccacaagtgagcctcaag

SEQ ID NO: 330786 - DNA, 27 bp, Artificial Sequence
  Description of Artificial Sequence: Synthetic oligonucleotide
ccatccgctccacaagtgagcctcaag

SEQ ID NO: 330787 - DNA, 27 bp, Artificial Sequence
  Description of Artificial Sequence: Synthetic oligonucleotide
catccgctccacaagtgagcctcaagg

SEQ ID NO: 330788 - DNA, 27 bp, Artificial Sequence
  Description of Artificial Sequence: Synthetic oligonucleotide
atccgctccacaagtgagcctcaaggg

SEQ ID NO: 330789 - DNA, 27 bp, Artificial Sequence
  Description of Artificial Sequence: Synthetic oligonucleotide
tccgctccacaagtgagcctcaagggt

SEQ ID NO: 330790 - DNA, 27 bp, Artificial Sequence
  Description of Artificial Sequence: Synthetic oligonucleotide
ccgctccacaagtgagcctcaagggta

SEQ ID NO: 330791 - DNA, 28 bp, Artificial Sequence
  Description of Artificial Sequence: Synthetic oligonucleotide
cgctccacaagtgagcctcaagggtatg

SEQ ID NO: 330792 - DNA, 28 bp, Artificial Sequence
  Description of Artificial Sequence: Synthetic oligonucleotide
gctccacaagtgagcctcaagggtatgg

SEQ ID NO: 330793 - DNA, 28 bp, Artificial Sequence
  Description of Artificial Sequence: Synthetic oligonucleotide
ctccacaagtgagcctcaagggtatggg

SEQ ID NO: 330794 - DNA, 28 bp, Artificial Sequence
  Description of Artificial Sequence: Synthetic oligonucleotide
tccacaagtgagcctcaagggtatgggg

SEQ ID NO: 330795 - DNA, 27 bp, Artificial Sequence
  Description of Artificial Sequence: Synthetic oligonucleotide
ccacaagtgagcctcaagggtatgggg

SEQ ID NO: 330796 - DNA, 30 bp, Artificial Sequence
  Description of Artificial Sequence: Synthetic oligonucleotide
cacaagtgagcctcaagggtatggggtttc

SEQ ID NO: 330797 - DNA, 30 bp, Artificial Sequence
  Description of Artificial Sequence: Synthetic oligonucleotide
acaagtgagcctcaagggtatggggtttcg

SEQ ID NO: 330798 - DNA, 29 bp, Artificial Sequence
  Description of Artificial Sequence: Synthetic oligonucleotide
caagtgagcctcaagggtatggggtttcg

SEQ ID NO: 330799 - DNA, 30 bp, Artificial Sequence
  Description of Artificial Sequence: Synthetic oligonucleotide
aagtgagcctcaagggtatggggtttcgag

SEQ ID NO: 330800 - DNA, 29 bp, Artificial Sequence
  Description of Artificial Sequence: Synthetic oligonucleotide
agtgagcctcaagggtatggggtttcgag

SEQ ID NO: 330801 - DNA, 28 bp, Artificial Sequence
  Description of Artificial Sequence: Synthetic oligonucleotide
gtgagcctcaagggtatggggtttcgag

SEQ ID NO: 330802 - DNA, 28 bp, Artificial Sequence
  Description of Artificial Sequence: Synthetic oligonucleotide
tgagcctcaagggtatggggtttcgagc

SEQ ID NO: 330803 - DNA, 27 bp, Artificial Sequence
  Description of Artificial Sequence: Synthetic oligonucleotide
gagcctcaagggtatggggtttcgagc

SEQ ID NO: 330804 - DNA, 28 bp, Artificial Sequence
  Description of Artificial Sequence: Synthetic oligonucleotide
agcctcaagggtatggggtttcgagcag

SEQ ID NO: 330805 - DNA, 27 bp, Artificial Sequence
  Description of Artificial Sequence: Synthetic oligonucleotide
gcctcaagggtatggggtttcgagcag

SEQ ID NO: 330806 - DNA, 27 bp, Artificial Sequence
  Description of Artificial Sequence: Synthetic oligonucleotide
cctcaagggtatggggtttcgagcagc

SEQ ID NO: 330807 - DNA, 27 bp, Artificial Sequence
  Description of Artificial Sequence: Synthetic oligonucleotide
ctcaagggtatggggtttcgagcagcc

SEQ ID NO: 330808 - DNA, 27 bp, Artificial Sequence
  Description of Artificial Sequence: Synthetic oligonucleotide
tcaagggtatggggtttcgagcagccc

SEQ ID NO: 330809 - DNA, 27 bp, Artificial Sequence
  Description of Artificial Sequence: Synthetic oligonucleotide
caagggtatggggtttcgagcagccca

SEQ ID NO: 330810 - DNA, 27 bp, Artificial Sequence
  Description of Artificial Sequence: Synthetic oligonucleotide
aagggtatggggtttcgagcagcccag

SEQ ID NO: 330811 - DNA, 26 bp, Artificial Sequence
  Description of Artificial Sequence: Synthetic oligonucleotide
agggtatggggtttcgagcagcccag

SEQ ID NO: 330812 - DNA, 25 bp, Artificial Sequence
  Description of Artificial Sequence: Synthetic oligonucleotide
gggtatggggtttcgagcagcccag

SEQ ID NO: 330813 - DNA, 25 bp, Artificial Sequence
  Description of Artificial Sequence: Synthetic oligonucleotide
ggtatggggtttcgagcagcccagc

SEQ ID NO: 330814 - DNA, 25 bp, Artificial Sequence
  Description of Artificial Sequence: Synthetic oligonucleotide
gtatggggtttcgagcagcccagcc

SEQ ID NO: 330815 - DNA, 25 bp, Artificial Sequence
  Description of Artificial Sequence: Synthetic oligonucleotide
tatggggtttcgagcagcccagccc

SEQ ID NO: 330816 - DNA, 24 bp, Artificial Sequence
  Description of Artificial Sequence: Synthetic oligonucleotide
atggggtttcgagcagcccagccc

SEQ ID NO: 330817 - DNA, 23 bp, Artificial Sequence
  Description of Artificial Sequence: Synthetic oligonucleotide
tggggtttcgagcagcccagccc

SEQ ID NO: 330818 - DNA, 22 bp, Artificial Sequence
  Description of Artificial Sequence: Synthetic oligonucleotide
ggggtttcgagcagcccagccc

SEQ ID NO: 330819 - DNA, 23 bp, Artificial Sequence
  Description of Artificial Sequence: Synthetic oligonucleotide
gggtttcgagcagcccagcccct

SEQ ID NO: 330820 - DNA, 23 bp, Artificial Sequence
  Description of Artificial Sequence: Synthetic oligonucleotide
ggtttcgagcagcccagcccctc

SEQ ID NO: 330821 - DNA, 23 bp, Artificial Sequence
  Description of Artificial Sequence: Synthetic oligonucleotide
gtttcgagcagcccagcccctcg

SEQ ID NO: 330822 - DNA, 24 bp, Artificial Sequence
  Description of Artificial Sequence: Synthetic oligonucleotide
tttcgagcagcccagcccctcgca

SEQ ID NO: 330823 - DNA, 23 bp, Artificial Sequence
  Description of Artificial Sequence: Synthetic oligonucleotide
ttcgagcagcccagcccctcgca

SEQ ID NO: 330824 - DNA, 22 bp, Artificial Sequence
  Description of Artificial Sequence: Synthetic oligonucleotide
tcgagcagcccagcccctcgca

SEQ ID NO: 330825 - DNA, 21 bp, Artificial Sequence
  Description of Artificial Sequence: Synthetic oligonucleotide
cgagcagcccagcccctcgca

SEQ ID NO: 330826 - DNA, 22 bp, Artificial Sequence
  Description of Artificial Sequence: Synthetic oligonucleotide
gagcagcccagcccctcgcagt

SEQ ID NO: 330827 - DNA, 22 bp, Artificial Sequence
  Description of Artificial Sequence: Synthetic oligonucleotide
agcagcccagcccctcgcagtg

SEQ ID NO: 330828 - DNA, 21 bp, Artificial Sequence
  Description of Artificial Sequence: Synthetic oligonucleotide
gcagcccagcccctcgcagtg

SEQ ID NO: 330829 - DNA, 25 bp, Artificial Sequence
  Description of Artificial Sequence: Synthetic oligonucleotide
cagcccagcccctcgcagtggaatt

SEQ ID NO: 330830 - DNA, 26 bp, Artificial Sequence
  Description of Artificial Sequence: Synthetic oligonucleotide
agcccagcccctcgcagtggaattca

SEQ ID NO: 330831 - DNA, 25 bp, Artificial Sequence
  Description of Artificial Sequence: Synthetic oligonucleotide
gcccagcccctcgcagtggaattca

SEQ ID NO: 330832 - DNA, 25 bp, Artificial Sequence
  Description of Artificial Sequence: Synthetic oligonucleotide
cccagcccctcgcagtggaattcag

SEQ ID NO: 330833 - DNA, 25 bp, Artificial Sequence
  Description of Artificial Sequence: Synthetic oligonucleotide
ccagcccctcgcagtggaattcagg

SEQ ID NO: 330834 - DNA, 26 bp, Artificial Sequence
  Description of Artificial Sequence: Synthetic oligonucleotide
cagcccctcgcagtggaattcagggt

SEQ ID NO: 330835 - DNA, 27 bp, Artificial Sequence
  Description of Artificial Sequence: Synthetic oligonucleotide
agcccctcgcagtggaattcagggtca

SEQ ID NO: 330836 - DNA, 26 bp, Artificial Sequence
  Description of Artificial Sequence: Synthetic oligonucleotide
gcccctcgcagtggaattcagggtca

SEQ ID NO: 330837 - DNA, 27 bp, Artificial Sequence
  Description of Artificial Sequence: Synthetic oligonucleotide
cccctcgcagtggaattcagggtcact

SEQ ID NO: 330838 - DNA, 27 bp, Artificial Sequence
  Description of Artificial Sequence: Synthetic oligonucleotide
ccctcgcagtggaattcagggtcactg

SEQ ID NO: 330839 - DNA, 28 bp, Artificial Sequence
  Description of Artificial Sequence: Synthetic oligonucleotide
cctcgcagtggaattcagggtcactgac

SEQ ID NO: 330840 - DNA, 30 bp, Artificial Sequence
  Description of Artificial Sequence: Synthetic oligonucleotide
ctcgcagtggaattcagggtcactgacaag

SEQ ID NO: 330841 - DNA, 30 bp, Artificial Sequence
  Description of Artificial Sequence: Synthetic oligonucleotide
tcgcagtggaattcagggtcactgacaagc

SEQ ID NO: 330842 - DNA, 29 bp, Artificial Sequence
  Description of Artificial Sequence: Synthetic oligonucleotide
cgcagtggaattcagggtcactgacaagc

SEQ ID NO: 330843 - DNA, 29 bp, Artificial Sequence
  Description of Artificial Sequence: Synthetic oligonucleotide
gcagtggaattcagggtcactgacaagcc

SEQ ID NO: 330844 - DNA, 29 bp, Artificial Sequence
  Description of Artificial Sequence: Synthetic oligonucleotide
cagtggaattcagggtcactgacaagccc

SEQ ID NO: 330845 - DNA, 29 bp, Artificial Sequence
  Description of Artificial Sequence: Synthetic oligonucleotide
agtggaattcagggtcactgacaagcccc

SEQ ID NO: 330846 - DNA, 28 bp, Artificial Sequence
  Description of Artificial Sequence: Synthetic oligonucleotide
gtggaattcagggtcactgacaagcccc

SEQ ID NO: 330847 - DNA, 29 bp, Artificial Sequence
  Description of Artificial Sequence: Synthetic oligonucleotide
tggaattcagggtcactgacaagccccac

SEQ ID NO: 330848 - DNA, 28 bp, Artificial Sequence
  Description of Artificial Sequence: Synthetic oligonucleotide
ggaattcagggtcactgacaagccccac

SEQ ID NO: 330849 - DNA, 30 bp, Artificial Sequence
  Description of Artificial Sequence: Synthetic oligonucleotide
gaattcagggtcactgacaagccccacatc

SEQ ID NO: 330850 - DNA, 35 bp, Artificial Sequence
  Description of Artificial Sequence: Synthetic oligonucleotide
aattcagggtcactgacaagccccacatcattttc

SEQ ID NO: 330851 - DNA, 34 bp, Artificial Sequence
  Description of Artificial Sequence: Synthetic oligonucleotide
attcagggtcactgacaagccccacatcattttc

SEQ ID NO: 330852 - DNA, 33 bp, Artificial Sequence
  Description of Artificial Sequence: Synthetic oligonucleotide
ttcagggtcactgacaagccccacatcattttc

SEQ ID NO: 330853 - DNA, 32 bp, Artificial Sequence
  Description of Artificial Sequence: Synthetic oligonucleotide
tcagggtcactgacaagccccacatcattttc

SEQ ID NO: 330854 - DNA, 31 bp, Artificial Sequence
  Description of Artificial Sequence: Synthetic oligonucleotide
cagggtcactgacaagccccacatcattttc

SEQ ID NO: 330855 - DNA, 32 bp, Artificial Sequence
  Description of Artificial Sequence: Synthetic oligonucleotide
agggtcactgacaagccccacatcattttcag

SEQ ID NO: 330856 - DNA, 31 bp, Artificial Sequence
  Description of Artificial Sequence: Synthetic oligonucleotide
gggtcactgacaagccccacatcattttcag

SEQ ID NO: 330857 - DNA, 34 bp, Artificial Sequence
  Description of Artificial Sequence: Synthetic oligonucleotide
ggtcactgacaagccccacatcattttcagtttg

SEQ ID NO: 330858 - DNA, 34 bp, Artificial Sequence
  Description of Artificial Sequence: Synthetic oligonucleotide
gtcactgacaagccccacatcattttcagtttgc

SEQ ID NO: 330859 - DNA, 34 bp, Artificial Sequence
  Description of Artificial Sequence: Synthetic oligonucleotide
tcactgacaagccccacatcattttcagtttgcc

SEQ ID NO: 330860 - DNA, 33 bp, Artificial Sequence
  Description of Artificial Sequence: Synthetic oligonucleotide
cactgacaagccccacatcattttcagtttgcc

SEQ ID NO: 330861 - DNA, 35 bp, Artificial Sequence
  Description of Artificial Sequence: Synthetic oligonucleotide
actgacaagccccacatcattttcagtttgccaac

SEQ ID NO: 330862 - DNA, 34 bp, Artificial Sequence
  Description of Artificial Sequence: Synthetic oligonucleotide
ctgacaagccccacatcattttcagtttgccaac

SEQ ID NO: 330863 - DNA, 36 bp, Artificial Sequence
  Description of Artificial Sequence: Synthetic oligonucleotide
tgacaagccccacatcattttcagtttgccaacttg

SEQ ID NO: 330864 - DNA, 35 bp, Artificial Sequence
  Description of Artificial Sequence: Synthetic oligonucleotide
gacaagccccacatcattttcagtttgccaacttg

SEQ ID NO: 330865 - DNA, 39 bp, Artificial Sequence
  Description of Artificial Sequence: Synthetic oligonucleotide
acaagccccacatcattttcagtttgccaacttgaaaac

SEQ ID NO: 330866 - DNA, 38 bp, Artificial Sequence
  Description of Artificial Sequence: Synthetic oligonucleotide
caagccccacatcattttcagtttgccaacttgaaaac

SEQ ID NO: 330867 - DNA, 38 bp, Artificial Sequence
  Description of Artificial Sequence: Synthetic oligonucleotide
aagccccacatcattttcagtttgccaacttgaaaacc

SEQ ID NO: 330868 - DNA, 37 bp, Artificial Sequence
  Description of Artificial Sequence: Synthetic oligonucleotide
agccccacatcattttcagtttgccaacttgaaaacc

SEQ ID NO: 330869 - DNA, 36 bp, Artificial Sequence
  Description of Artificial Sequence: Synthetic oligonucleotide
gccccacatcattttcagtttgccaacttgaaaacc

SEQ ID NO: 330870 - DNA, 36 bp, Artificial Sequence
  Description of Artificial Sequence: Synthetic oligonucleotide
ccccacatcattttcagtttgccaacttgaaaaccg

SEQ ID NO: 330871 - DNA, 39 bp, Artificial Sequence
  Description of Artificial Sequence: Synthetic oligonucleotide
cccacatcattttcagtttgccaacttgaaaaccgaaac

SEQ ID NO: 330872 - DNA, 39 bp, Artificial Sequence
  Description of Artificial Sequence: Synthetic oligonucleotide
ccacatcattttcagtttgccaacttgaaaaccgaaacc

SEQ ID NO: 330873 - DNA, 42 bp, Artificial Sequence
  Description of Artificial Sequence: Synthetic oligonucleotide
cacatcattttcagtttgccaacttgaaaaccgaaaccaatg

SEQ ID NO: 330874 - DNA, 42 bp, Artificial Sequence
  Description of Artificial Sequence: Synthetic oligonucleotide
acatcattttcagtttgccaacttgaaaaccgaaaccaatgg

SEQ ID NO: 330875 - DNA, 41 bp, Artificial Sequence
  Description of Artificial Sequence: Synthetic oligonucleotide
catcattttcagtttgccaacttgaaaaccgaaaccaatgg

SEQ ID NO: 330876 - DNA, 43 bp, Artificial Sequence
  Description of Artificial Sequence: Synthetic oligonucleotide
atcattttcagtttgccaacttgaaaaccgaaaccaatggatc

SEQ ID NO: 330877 - DNA, 42 bp, Artificial Sequence
  Description of Artificial Sequence: Synthetic oligonucleotide
tcattttcagtttgccaacttgaaaaccgaaaccaatggatc

SEQ ID NO: 330878 - DNA, 41 bp, Artificial Sequence
  Description of Artificial Sequence: Synthetic oligonucleotide
cattttcagtttgccaacttgaaaaccgaaaccaatggatc

SEQ ID NO: 330879 - DNA, 42 bp, Artificial Sequence
  Description of Artificial Sequence: Synthetic oligonucleotide
attttcagtttgccaacttgaaaaccgaaaccaatggatctg

SEQ ID NO: 330880 - DNA, 41 bp, Artificial Sequence
  Description of Artificial Sequence: Synthetic oligonucleotide
ttttcagtttgccaacttgaaaaccgaaaccaatggatctg

SEQ ID NO: 330881 - DNA, 40 bp, Artificial Sequence
  Description of Artificial Sequence: Synthetic oligonucleotide
tttcagtttgccaacttgaaaaccgaaaccaatggatctg

SEQ ID NO: 330882 - DNA, 39 bp, Artificial Sequence
  Description of Artificial Sequence: Synthetic oligonucleotide
ttcagtttgccaacttgaaaaccgaaaccaatggatctg

SEQ ID NO: 330883 - DNA, 38 bp, Artificial Sequence
  Description of Artificial Sequence: Synthetic oligonucleotide
tcagtttgccaacttgaaaaccgaaaccaatggatctg

SEQ ID NO: 330884 - DNA, 37 bp, Artificial Sequence
  Description of Artificial Sequence: Synthetic oligonucleotide
cagtttgccaacttgaaaaccgaaaccaatggatctg

SEQ ID NO: 330885 - DNA, 38 bp, Artificial Sequence
  Description of Artificial Sequence: Synthetic oligonucleotide
agtttgccaacttgaaaaccgaaaccaatggatctgac

SEQ ID NO: 330886 - DNA, 37 bp, Artificial Sequence
  Description of Artificial Sequence: Synthetic oligonucleotide
gtttgccaacttgaaaaccgaaaccaatggatctgac

SEQ ID NO: 330887 - DNA, 40 bp, Artificial Sequence
  Description of Artificial Sequence: Synthetic oligonucleotide
tttgccaacttgaaaaccgaaaccaatggatctgacttac

SEQ ID NO: 330888 - DNA, 39 bp, Artificial Sequence
  Description of Artificial Sequence: Synthetic oligonucleotide
ttgccaacttgaaaaccgaaaccaatggatctgacttac

SEQ ID NO: 330889 - DNA, 38 bp, Artificial Sequence
  Description of Artificial Sequence: Synthetic oligonucleotide
tgccaacttgaaaaccgaaaccaatggatctgacttac

SEQ ID NO: 330890 - DNA, 37 bp, Artificial Sequence
  Description of Artificial Sequence: Synthetic oligonucleotide
gccaacttgaaaaccgaaaccaatggatctgacttac

SEQ ID NO: 330891 - DNA, 37 bp, Artificial Sequence
  Description of Artificial Sequence: Synthetic oligonucleotide
ccaacttgaaaaccgaaaccaatggatctgacttacc

SEQ ID NO: 330892 - DNA, 37 bp, Artificial Sequence
  Description of Artificial Sequence: Synthetic oligonucleotide
caacttgaaaaccgaaaccaatggatctgacttaccc

SEQ ID NO: 330893 - DNA, 40 bp, Artificial Sequence
  Description of Artificial Sequence: Synthetic oligonucleotide
aacttgaaaaccgaaaccaatggatctgacttacccattg

SEQ ID NO: 330894 - DNA, 39 bp, Artificial Sequence
  Description of Artificial Sequence: Synthetic oligonucleotide
acttgaaaaccgaaaccaatggatctgacttacccattg

SEQ ID NO: 330895 - DNA, 38 bp, Artificial Sequence
  Description of Artificial Sequence: Synthetic oligonucleotide
cttgaaaaccgaaaccaatggatctgacttacccattg

SEQ ID NO: 330896 - DNA, 38 bp, Artificial Sequence
  Description of Artificial Sequence: Synthetic oligonucleotide
ttgaaaaccgaaaccaatggatctgacttacccattgg

SEQ ID NO: 330897 - DNA, 37 bp, Artificial Sequence
  Description of Artificial Sequence: Synthetic oligonucleotide
tgaaaaccgaaaccaatggatctgacttacccattgg

SEQ ID NO: 330898 - DNA, 36 bp, Artificial Sequence
  Description of Artificial Sequence: Synthetic oligonucleotide
gaaaaccgaaaccaatggatctgacttacccattgg

SEQ ID NO: 330899 - DNA, 36 bp, Artificial Sequence
  Description of Artificial Sequence: Synthetic oligonucleotide
aaaaccgaaaccaatggatctgacttacccattggg

SEQ ID NO: 330900 - DNA, 35 bp, Artificial Sequence
  Description of Artificial Sequence: Synthetic oligonucleotide
aaaccgaaaccaatggatctgacttacccattggg

SEQ ID NO: 330901 - DNA, 34 bp, Artificial Sequence
  Description of Artificial Sequence: Synthetic oligonucleotide
aaccgaaaccaatggatctgacttacccattggg

SEQ ID NO: 330902 - DNA, 33 bp, Artificial Sequence
  Description of Artificial Sequence: Synthetic oligonucleotide
accgaaaccaatggatctgacttacccattggg

SEQ ID NO: 330903 - DNA, 32 bp, Artificial Sequence
  Description of Artificial Sequence: Synthetic oligonucleotide
ccgaaaccaatggatctgacttacccattggg

SEQ ID NO: 330904 - DNA, 33 bp, Artificial Sequence
  Description of Artificial Sequence: Synthetic oligonucleotide
cgaaaccaatggatctgacttacccattgggtc

SEQ ID NO: 330905 - DNA, 35 bp, Artificial Sequence
  Description of Artificial Sequence: Synthetic oligonucleotide
gaaaccaatggatctgacttacccattgggtcatc

SEQ ID NO: 330906 - DNA, 41 bp, Artificial Sequence
  Description of Artificial Sequence: Synthetic oligonucleotide
aaaccaatggatctgacttacccattgggtcatctttaatg

SEQ ID NO: 330907 - DNA, 40 bp, Artificial Sequence
  Description of Artificial Sequence: Synthetic oligonucleotide
aaccaatggatctgacttacccattgggtcatctttaatg

SEQ ID NO: 330908 - DNA, 39 bp, Artificial Sequence
  Description of Artificial Sequence: Synthetic oligonucleotide
accaatggatctgacttacccattgggtcatctttaatg

SEQ ID NO: 330909 - DNA, 38 bp, Artificial Sequence
  Description of Artificial Sequence: Synthetic oligonucleotide
ccaatggatctgacttacccattgggtcatctttaatg

SEQ ID NO: 330910 - DNA, 40 bp, Artificial Sequence
  Description of Artificial Sequence: Synthetic oligonucleotide
caatggatctgacttacccattgggtcatctttaatgtac

SEQ ID NO: 330911 - DNA, 40 bp, Artificial Sequence
  Description of Artificial Sequence: Synthetic oligonucleotide
aatggatctgacttacccattgggtcatctttaatgtacg

SEQ ID NO: 330912 - DNA, 39 bp, Artificial Sequence
  Description of Artificial Sequence: Synthetic oligonucleotide
atggatctgacttacccattgggtcatctttaatgtacg

SEQ ID NO: 330913 - DNA, 38 bp, Artificial Sequence
  Description of Artificial Sequence: Synthetic oligonucleotide
tggatctgacttacccattgggtcatctttaatgtacg

SEQ ID NO: 330914 - DNA, 37 bp, Artificial Sequence
  Description of Artificial Sequence: Synthetic oligonucleotide
ggatctgacttacccattgggtcatctttaatgtacg

SEQ ID NO: 330915 - DNA, 40 bp, Artificial Sequence
  Description of Artificial Sequence: Synthetic oligonucleotide
gatctgacttacccattgggtcatctttaatgtacgaatg

SEQ ID NO: 330916 - DNA, 40 bp, Artificial Sequence
  Description of Artificial Sequence: Synthetic oligonucleotide
atctgacttacccattgggtcatctttaatgtacgaatgg

SEQ ID NO: 330917 - DNA, 39 bp, Artificial Sequence
  Description of Artificial Sequence: Synthetic oligonucleotide
tctgacttacccattgggtcatctttaatgtacgaatgg

SEQ ID NO: 330918 - DNA, 38 bp, Artificial Sequence
  Description of Artificial Sequence: Synthetic oligonucleotide
ctgacttacccattgggtcatctttaatgtacgaatgg

SEQ ID NO: 330919 - DNA, 38 bp, Artificial Sequence
  Description of Artificial Sequence: Synthetic oligonucleotide
tgacttacccattgggtcatctttaatgtacgaatggc

SEQ ID NO: 330920 - DNA, 37 bp, Artificial Sequence
  Description of Artificial Sequence: Synthetic oligonucleotide
gacttacccattgggtcatctttaatgtacgaatggc

SEQ ID NO: 330921 - DNA, 37 bp, Artificial Sequence
  Description of Artificial Sequence: Synthetic oligonucleotide
acttacccattgggtcatctttaatgtacgaatggcg

SEQ ID NO: 330922 - DNA, 36 bp, Artificial Sequence
  Description of Artificial Sequence: Synthetic oligonucleotide
cttacccattgggtcatctttaatgtacgaatggcg

SEQ ID NO: 330923 - DNA, 37 bp, Artificial Sequence
  Description of Artificial Sequence: Synthetic oligonucleotide
ttacccattgggtcatctttaatgtacgaatggcgtc

SEQ ID NO: 330924 - DNA, 36 bp, Artificial Sequence
  Description of Artificial Sequence: Synthetic oligonucleotide
tacccattgggtcatctttaatgtacgaatggcgtc

SEQ ID NO: 330925 - DNA, 35 bp, Artificial Sequence
  Description of Artificial Sequence: Synthetic oligonucleotide
acccattgggtcatctttaatgtacgaatggcgtc

SEQ ID NO: 330926 - DNA, 34 bp, Artificial Sequence
  Description of Artificial Sequence: Synthetic oligonucleotide
cccattgggtcatctttaatgtacgaatggcgtc

SEQ ID NO: 330927 - DNA, 34 bp, Artificial Sequence
  Description of Artificial Sequence: Synthetic oligonucleotide
ccattgggtcatctttaatgtacgaatggcgtcc

SEQ ID NO: 330928 - DNA, 35 bp, Artificial Sequence
  Description of Artificial Sequence: Synthetic oligonucleotide
cattgggtcatctttaatgtacgaatggcgtcctg

SEQ ID NO: 330929 - DNA, 36 bp, Artificial Sequence
  Description of Artificial Sequence: Synthetic oligonucleotide
attgggtcatctttaatgtacgaatggcgtcctgag

SEQ ID NO: 330930 - DNA, 35 bp, Artificial Sequence
  Description of Artificial Sequence: Synthetic oligonucleotide
ttgggtcatctttaatgtacgaatggcgtcctgag

SEQ ID NO: 330931 - DNA, 34 bp, Artificial Sequence
  Description of Artificial Sequence: Synthetic oligonucleotide
tgggtcatctttaatgtacgaatggcgtcctgag

SEQ ID NO: 330932 - DNA, 33 bp, Artificial Sequence
  Description of Artificial Sequence: Synthetic oligonucleotide
gggtcatctttaatgtacgaatggcgtcctgag

SEQ ID NO: 330933 - DNA, 35 bp, Artificial Sequence
  Description of Artificial Sequence: Synthetic oligonucleotide
ggtcatctttaatgtacgaatggcgtcctgagaac

SEQ ID NO: 330934 - DNA, 37 bp, Artificial Sequence
  Description of Artificial Sequence: Synthetic oligonucleotide
gtcatctttaatgtacgaatggcgtcctgagaactac

SEQ ID NO: 330935 - DNA, 37 bp, Artificial Sequence
  Description of Artificial Sequence: Synthetic oligonucleotide
tcatctttaatgtacgaatggcgtcctgagaactacg

SEQ ID NO: 330936 - DNA, 36 bp, Artificial Sequence
  Description of Artificial Sequence: Synthetic oligonucleotide
catctttaatgtacgaatggcgtcctgagaactacg

SEQ ID NO: 330937 - DNA, 36 bp, Artificial Sequence
  Description of Artificial Sequence: Synthetic oligonucleotide
atctttaatgtacgaatggcgtcctgagaactacgg

SEQ ID NO: 330938 - DNA, 35 bp, Artificial Sequence
  Description of Artificial Sequence: Synthetic oligonucleotide
tctttaatgtacgaatggcgtcctgagaactacgg

SEQ ID NO: 330939 - DNA, 34 bp, Artificial Sequence
  Description of Artificial Sequence: Synthetic oligonucleotide
ctttaatgtacgaatggcgtcctgagaactacgg

SEQ ID NO: 330940 - DNA, 34 bp, Artificial Sequence
  Description of Artificial Sequence: Synthetic oligonucleotide
tttaatgtacgaatggcgtcctgagaactacggg

SEQ ID NO: 330941 - DNA, 33 bp, Artificial Sequence
  Description of Artificial Sequence: Synthetic oligonucleotide
ttaatgtacgaatggcgtcctgagaactacggg

SEQ ID NO: 330942 - DNA, 32 bp, Artificial Sequence
  Description of Artificial Sequence: Synthetic oligonucleotide
taatgtacgaatggcgtcctgagaactacggg

SEQ ID NO: 330943 - DNA, 31 bp, Artificial Sequence
  Description of Artificial Sequence: Synthetic oligonucleotide
aatgtacgaatggcgtcctgagaactacggg

SEQ ID NO: 330944 - DNA, 30 bp, Artificial Sequence
  Description of Artificial Sequence: Synthetic oligonucleotide
atgtacgaatggcgtcctgagaactacggg

SEQ ID NO: 330945 - DNA, 29 bp, Artificial Sequence
  Description of Artificial Sequence: Synthetic oligonucleotide
tgtacgaatggcgtcctgagaactacggg

SEQ ID NO: 330946 - DNA, 28 bp, Artificial Sequence
  Description of Artificial Sequence: Synthetic oligonucleotide
gtacgaatggcgtcctgagaactacggg

SEQ ID NO: 330947 - DNA, 29 bp, Artificial Sequence
  Description of Artificial Sequence: Synthetic oligonucleotide
tacgaatggcgtcctgagaactacgggac

SEQ ID NO: 330948 - DNA, 28 bp, Artificial Sequence
  Description of Artificial Sequence: Synthetic oligonucleotide
acgaatggcgtcctgagaactacgggac

SEQ ID NO: 330949 - DNA, 27 bp, Artificial Sequence
  Description of Artificial Sequence: Synthetic oligonucleotide
cgaatggcgtcctgagaactacgggac

SEQ ID NO: 330950 - DNA, 27 bp, Artificial Sequence
  Description of Artificial Sequence: Synthetic oligonucleotide
gaatggcgtcctgagaactacgggacg

SEQ ID NO: 330951 - DNA, 27 bp, Artificial Sequence
  Description of Artificial Sequence: Synthetic oligonucleotide
aatggcgtcctgagaactacgggacgc

SEQ ID NO: 330952 - DNA, 26 bp, Artificial Sequence
  Description of Artificial Sequence: Synthetic oligonucleotide
atggcgtcctgagaactacgggacgc

SEQ ID NO: 330953 - DNA, 25 bp, Artificial Sequence
  Description of Artificial Sequence: Synthetic oligonucleotide
tggcgtcctgagaactacgggacgc

SEQ ID NO: 330954 - DNA, 24 bp, Artificial Sequence
  Description of Artificial Sequence: Synthetic oligonucleotide
ggcgtcctgagaactacgggacgc

SEQ ID NO: 330955 - DNA, 27 bp, Artificial Sequence
  Description of Artificial Sequence: Synthetic oligonucleotide
gcgtcctgagaactacgggacgccatt

SEQ ID NO: 330956 - DNA, 27 bp, Artificial Sequence
  Description of Artificial Sequence: Synthetic oligonucleotide
cgtcctgagaactacgggacgccattc

SEQ ID NO: 330957 - DNA, 28 bp, Artificial Sequence
  Description of Artificial Sequence: Synthetic oligonucleotide
gtcctgagaactacgggacgccattctc

SEQ ID NO: 330958 - DNA, 31 bp, Artificial Sequence
  Description of Artificial Sequence: Synthetic oligonucleotide
tcctgagaactacgggacgccattctcaatc

SEQ ID NO: 330959 - DNA, 30 bp, Artificial Sequence
  Description of Artificial Sequence: Synthetic oligonucleotide
cctgagaactacgggacgccattctcaatc

SEQ ID NO: 330960 - DNA, 31 bp, Artificial Sequence
  Description of Artificial Sequence: Synthetic oligonucleotide
ctgagaactacgggacgccattctcaatcac

SEQ ID NO: 330961 - DNA, 33 bp, Artificial Sequence
  Description of Artificial Sequence: Synthetic oligonucleotide
tgagaactacgggacgccattctcaatcacatg

SEQ ID NO: 330962 - DNA, 32 bp, Artificial Sequence
  Description of Artificial Sequence: Synthetic oligonucleotide
gagaactacgggacgccattctcaatcacatg

SEQ ID NO: 330963 - DNA, 33 bp, Artificial Sequence
  Description of Artificial Sequence: Synthetic oligonucleotide
agaactacgggacgccattctcaatcacatgtg

SEQ ID NO: 330964 - DNA, 32 bp, Artificial Sequence
  Description of Artificial Sequence: Synthetic oligonucleotide
gaactacgggacgccattctcaatcacatgtg

SEQ ID NO: 330965 - DNA, 34 bp, Artificial Sequence
  Description of Artificial Sequence: Synthetic oligonucleotide
aactacgggacgccattctcaatcacatgtgtag

SEQ ID NO: 330966 - DNA, 33 bp, Artificial Sequence
  Description of Artificial Sequence: Synthetic oligonucleotide
actacgggacgccattctcaatcacatgtgtag

SEQ ID NO: 330967 - DNA, 32 bp, Artificial Sequence
  Description of Artificial Sequence: Synthetic oligonucleotide
ctacgggacgccattctcaatcacatgtgtag

SEQ ID NO: 330968 - DNA, 36 bp, Artificial Sequence
  Description of Artificial Sequence: Synthetic oligonucleotide
tacgggacgccattctcaatcacatgtgtagataac

SEQ ID NO: 330969 - DNA, 35 bp, Artificial Sequence
  Description of Artificial Sequence: Synthetic oligonucleotide
acgggacgccattctcaatcacatgtgtagataac

SEQ ID NO: 330970 - DNA, 34 bp, Artificial Sequence
  Description of Artificial Sequence: Synthetic oligonucleotide
cgggacgccattctcaatcacatgtgtagataac

SEQ ID NO: 330971 - DNA, 34 bp, Artificial Sequence
  Description of Artificial Sequence: Synthetic oligonucleotide
gggacgccattctcaatcacatgtgtagataacc

SEQ ID NO: 330972 - DNA, 35 bp, Artificial Sequence
  Description of Artificial Sequence: Synthetic oligonucleotide
ggacgccattctcaatcacatgtgtagataaccag

SEQ ID NO: 330973 - DNA, 35 bp, Artificial Sequence
  Description of Artificial Sequence: Synthetic oligonucleotide
gacgccattctcaatcacatgtgtagataaccagg

SEQ ID NO: 330974 - DNA, 36 bp, Artificial Sequence
  Description of Artificial Sequence: Synthetic oligonucleotide
acgccattctcaatcacatgtgtagataaccaggtc

SEQ ID NO: 330975 - DNA, 35 bp, Artificial Sequence
  Description of Artificial Sequence: Synthetic oligonucleotide
cgccattctcaatcacatgtgtagataaccaggtc

SEQ ID NO: 330976 - DNA, 36 bp, Artificial Sequence
  Description of Artificial Sequence: Synthetic oligonucleotide
gccattctcaatcacatgtgtagataaccaggtctg

SEQ ID NO: 330977 - DNA, 36 bp, Artificial Sequence
  Description of Artificial Sequence: Synthetic oligonucleotide
ccattctcaatcacatgtgtagataaccaggtctgg

SEQ ID NO: 330978 - DNA, 37 bp, Artificial Sequence
  Description of Artificial Sequence: Synthetic oligonucleotide
cattctcaatcacatgtgtagataaccaggtctggtc

SEQ ID NO: 330979 - DNA, 39 bp, Artificial Sequence
  Description of Artificial Sequence: Synthetic oligonucleotide
attctcaatcacatgtgtagataaccaggtctggtctag

SEQ ID NO: 330980 - DNA, 38 bp, Artificial Sequence
  Description of Artificial Sequence: Synthetic oligonucleotide
ttctcaatcacatgtgtagataaccaggtctggtctag

SEQ ID NO: 330981 - DNA, 37 bp, Artificial Sequence
  Description of Artificial Sequence: Synthetic oligonucleotide
tctcaatcacatgtgtagataaccaggtctggtctag

SEQ ID NO: 330982 - DNA, 36 bp, Artificial Sequence
  Description of Artificial Sequence: Synthetic oligonucleotide
ctcaatcacatgtgtagataaccaggtctggtctag

SEQ ID NO: 330983 - DNA, 37 bp, Artificial Sequence
  Description of Artificial Sequence: Synthetic oligonucleotide
tcaatcacatgtgtagataaccaggtctggtctagtc

SEQ ID NO: 330984 - DNA, 36 bp, Artificial Sequence
  Description of Artificial Sequence: Synthetic oligonucleotide
caatcacatgtgtagataaccaggtctggtctagtc

SEQ ID NO: 330985 - DNA, 36 bp, Artificial Sequence
  Description of Artificial Sequence: Synthetic oligonucleotide
aatcacatgtgtagataaccaggtctggtctagtcc

SEQ ID NO: 330986 - DNA, 35 bp, Artificial Sequence
  Description of Artificial Sequence: Synthetic oligonucleotide
atcacatgtgtagataaccaggtctggtctagtcc

SEQ ID NO: 330987 - DNA, 34 bp, Artificial Sequence
  Description of Artificial Sequence: Synthetic oligonucleotide
tcacatgtgtagataaccaggtctggtctagtcc

SEQ ID NO: 330988 - DNA, 33 bp, Artificial Sequence
  Description of Artificial Sequence: Synthetic oligonucleotide
cacatgtgtagataaccaggtctggtctagtcc

SEQ ID NO: 330989 - DNA, 33 bp, Artificial Sequence
  Description of Artificial Sequence: Synthetic oligonucleotide
acatgtgtagataaccaggtctggtctagtccc

SEQ ID NO: 330990 - DNA, 32 bp, Artificial Sequence
  Description of Artificial Sequence: Synthetic oligonucleotide
catgtgtagataaccaggtctggtctagtccc

SEQ ID NO: 330991 - DNA, 35 bp, Artificial Sequence
  Description of Artificial Sequence: Synthetic oligonucleotide
atgtgtagataaccaggtctggtctagtcccaaac

SEQ ID NO: 330992 - DNA, 34 bp, Artificial Sequence
  Description of Artificial Sequence: Synthetic oligonucleotide
tgtgtagataaccaggtctggtctagtcccaaac

SEQ ID NO: 330993 - DNA, 33 bp, Artificial Sequence
  Description of Artificial Sequence: Synthetic oligonucleotide
gtgtagataaccaggtctggtctagtcccaaac

SEQ ID NO: 330994 - DNA, 35 bp, Artificial Sequence
  Description of Artificial Sequence: Synthetic oligonucleotide
tgtagataaccaggtctggtctagtcccaaacatg

SEQ ID NO: 330995 - DNA, 34 bp, Artificial Sequence
  Description of Artificial Sequence: Synthetic oligonucleotide
gtagataaccaggtctggtctagtcccaaacatg

SEQ ID NO: 330996 - DNA, 35 bp, Artificial Sequence
  Description of Artificial Sequence: Synthetic oligonucleotide
tagataaccaggtctggtctagtcccaaacatgtc

SEQ ID NO: 330997 - DNA, 34 bp, Artificial Sequence
  Description of Artificial Sequence: Synthetic oligonucleotide
agataaccaggtctggtctagtcccaaacatgtc

SEQ ID NO: 330998 - DNA, 33 bp, Artificial Sequence
  Description of Artificial Sequence: Synthetic oligonucleotide
gataaccaggtctggtctagtcccaaacatgtc

SEQ ID NO: 330999 - DNA, 34 bp, Artificial Sequence
  Description of Artificial Sequence: Synthetic oligonucleotide
ataaccaggtctggtctagtcccaaacatgtctg

SEQ ID NO: 331000 - DNA, 33 bp, Artificial Sequence
  Description of Artificial Sequence: Synthetic oligonucleotide
taaccaggtctggtctagtcccaaacatgtctg

SEQ ID NO: 331001 - DNA, 32 bp, Artificial Sequence
  Description of Artificial Sequence: Synthetic oligonucleotide
aaccaggtctggtctagtcccaaacatgtctg

SEQ ID NO: 331002 - DNA, 31 bp, Artificial Sequence
  Description of Artificial Sequence: Synthetic oligonucleotide
accaggtctggtctagtcccaaacatgtctg

SEQ ID NO: 331003 - DNA, 30 bp, Artificial Sequence
  Description of Artificial Sequence: Synthetic oligonucleotide
ccaggtctggtctagtcccaaacatgtctg

SEQ ID NO: 331004 - DNA, 34 bp, Artificial Sequence
  Description of Artificial Sequence: Synthetic oligonucleotide
caggtctggtctagtcccaaacatgtctgtatac

SEQ ID NO: 331005 - DNA, 34 bp, Artificial Sequence
  Description of Artificial Sequence: Synthetic oligonucleotide
aggtctggtctagtcccaaacatgtctgtatacg

SEQ ID NO: 331006 - DNA, 33 bp, Artificial Sequence
  Description of Artificial Sequence: Synthetic oligonucleotide
ggtctggtctagtcccaaacatgtctgtatacg

SEQ ID NO: 331007 - DNA, 38 bp, Artificial Sequence
  Description of Artificial Sequence: Synthetic oligonucleotide
gtctggtctagtcccaaacatgtctgtatacgtaaatc

SEQ ID NO: 331008 - DNA, 40 bp, Artificial Sequence
  Description of Artificial Sequence: Synthetic oligonucleotide
tctggtctagtcccaaacatgtctgtatacgtaaatcttg

SEQ ID NO: 331009 - DNA, 39 bp, Artificial Sequence
  Description of Artificial Sequence: Synthetic oligonucleotide
ctggtctagtcccaaacatgtctgtatacgtaaatcttg

SEQ ID NO: 331010 - DNA, 44 bp, Artificial Sequence
  Description of Artificial Sequence: Synthetic oligonucleotide
tggtctagtcccaaacatgtctgtatacgtaaatcttgtaaaac

SEQ ID NO: 331011 - DNA, 43 bp, Artificial Sequence
  Description of Artificial Sequence: Synthetic oligonucleotide
ggtctagtcccaaacatgtctgtatacgtaaatcttgtaaaac

SEQ ID NO: 331012 - DNA, 44 bp, Artificial Sequence
  Description of Artificial Sequence: Synthetic oligonucleotide
gtctagtcccaaacatgtctgtatacgtaaatcttgtaaaactg

SEQ ID NO: 331013 - DNA, 44 bp, Artificial Sequence
  Description of Artificial Sequence: Synthetic oligonucleotide
tctagtcccaaacatgtctgtatacgtaaatcttgtaaaactgc

SEQ ID NO: 331014 - DNA, 43 bp, Artificial Sequence
  Description of Artificial Sequence: Synthetic oligonucleotide
ctagtcccaaacatgtctgtatacgtaaatcttgtaaaactgc

SEQ ID NO: 331015 - DNA, 44 bp, Artificial Sequence
  Description of Artificial Sequence: Synthetic oligonucleotide
tagtcccaaacatgtctgtatacgtaaatcttgtaaaactgctc

SEQ ID NO: 331016 - DNA, 43 bp, Artificial Sequence
  Description of Artificial Sequence: Synthetic oligonucleotide
agtcccaaacatgtctgtatacgtaaatcttgtaaaactgctc

SEQ ID NO: 331017 - DNA, 42 bp, Artificial Sequence
  Description of Artificial Sequence: Synthetic oligonucleotide
gtcccaaacatgtctgtatacgtaaatcttgtaaaactgctc

SEQ ID NO: 331018 - DNA, 42 bp, Artificial Sequence
  Description of Artificial Sequence: Synthetic oligonucleotide
tcccaaacatgtctgtatacgtaaatcttgtaaaactgctcc

SEQ ID NO: 331019 - DNA, 41 bp, Artificial Sequence
  Description of Artificial Sequence: Synthetic oligonucleotide
cccaaacatgtctgtatacgtaaatcttgtaaaactgctcc

SEQ ID NO: 331020 - DNA, 42 bp, Artificial Sequence
  Description of Artificial Sequence: Synthetic oligonucleotide
ccaaacatgtctgtatacgtaaatcttgtaaaactgctccag

SEQ ID NO: 331021 - DNA, 44 bp, Artificial Sequence
  Description of Artificial Sequence: Synthetic oligonucleotide
caaacatgtctgtatacgtaaatcttgtaaaactgctccagatc

SEQ ID NO: 331022 - DNA, 44 bp, Artificial Sequence
  Description of Artificial Sequence: Synthetic oligonucleotide
aaacatgtctgtatacgtaaatcttgtaaaactgctccagatcg

SEQ ID NO: 331023 - DNA, 43 bp, Artificial Sequence
  Description of Artificial Sequence: Synthetic oligonucleotide
aacatgtctgtatacgtaaatcttgtaaaactgctccagatcg

SEQ ID NO: 331024 - DNA, 42 bp, Artificial Sequence
  Description of Artificial Sequence: Synthetic oligonucleotide
acatgtctgtatacgtaaatcttgtaaaactgctccagatcg

SEQ ID NO: 331025 - DNA, 41 bp, Artificial Sequence
  Description of Artificial Sequence: Synthetic oligonucleotide
catgtctgtatacgtaaatcttgtaaaactgctccagatcg

SEQ ID NO: 331026 - DNA, 42 bp, Artificial Sequence
  Description of Artificial Sequence: Synthetic oligonucleotide
atgtctgtatacgtaaatcttgtaaaactgctccagatcgag

SEQ ID NO: 331027 - DNA, 41 bp, Artificial Sequence
  Description of Artificial Sequence: Synthetic oligonucleotide
tgtctgtatacgtaaatcttgtaaaactgctccagatcgag

SEQ ID NO: 331028 - DNA, 40 bp, Artificial Sequence
  Description of Artificial Sequence: Synthetic oligonucleotide
gtctgtatacgtaaatcttgtaaaactgctccagatcgag

SEQ ID NO: 331029 - DNA, 41 bp, Artificial Sequence
  Description of Artificial Sequence: Synthetic oligonucleotide
tctgtatacgtaaatcttgtaaaactgctccagatcgagtg

SEQ ID NO: 331030 - DNA, 40 bp, Artificial Sequence
  Description of Artificial Sequence: Synthetic oligonucleotide
ctgtatacgtaaatcttgtaaaactgctccagatcgagtg

SEQ ID NO: 331031 - DNA, 43 bp, Artificial Sequence
  Description of Artificial Sequence: Synthetic oligonucleotide
tgtatacgtaaatcttgtaaaactgctccagatcgagtgaatg

SEQ ID NO: 331032 - DNA, 42 bp, Artificial Sequence
  Description of Artificial Sequence: Synthetic oligonucleotide
gtatacgtaaatcttgtaaaactgctccagatcgagtgaatg

SEQ ID NO: 331033 - DNA, 42 bp, Artificial Sequence
  Description of Artificial Sequence: Synthetic oligonucleotide
tatacgtaaatcttgtaaaactgctccagatcgagtgaatgg

SEQ ID NO: 331034 - DNA, 41 bp, Artificial Sequence
  Description of Artificial Sequence: Synthetic oligonucleotide
atacgtaaatcttgtaaaactgctccagatcgagtgaatgg

SEQ ID NO: 331035 - DNA, 40 bp, Artificial Sequence
  Description of Artificial Sequence: Synthetic oligonucleotide
tacgtaaatcttgtaaaactgctccagatcgagtgaatgg

SEQ ID NO: 331036 - DNA, 39 bp, Artificial Sequence
  Description of Artificial Sequence: Synthetic oligonucleotide
acgtaaatcttgtaaaactgctccagatcgagtgaatgg

SEQ ID NO: 331037 - DNA, 38 bp, Artificial Sequence
  Description of Artificial Sequence: Synthetic oligonucleotide
cgtaaatcttgtaaaactgctccagatcgagtgaatgg

SEQ ID NO: 331038 - DNA, 38 bp, Artificial Sequence
  Description of Artificial Sequence: Synthetic oligonucleotide
gtaaatcttgtaaaactgctccagatcgagtgaatggg

SEQ ID NO: 331039 - DNA, 40 bp, Artificial Sequence
  Description of Artificial Sequence: Synthetic oligonucleotide
taaatcttgtaaaactgctccagatcgagtgaatgggatg

SEQ ID NO: 331040 - DNA, 39 bp, Artificial Sequence
  Description of Artificial Sequence: Synthetic oligonucleotide
aaatcttgtaaaactgctccagatcgagtgaatgggatg

SEQ ID NO: 331041 - DNA, 38 bp, Artificial Sequence
  Description of Artificial Sequence: Synthetic oligonucleotide
aatcttgtaaaactgctccagatcgagtgaatgggatg

SEQ ID NO: 331042 - DNA, 37 bp, Artificial Sequence
  Description of Artificial Sequence: Synthetic oligonucleotide
atcttgtaaaactgctccagatcgagtgaatgggatg

SEQ ID NO: 331043 - DNA, 36 bp, Artificial Sequence
  Description of Artificial Sequence: Synthetic oligonucleotide
tcttgtaaaactgctccagatcgagtgaatgggatg

SEQ ID NO: 331044 - DNA, 35 bp, Artificial Sequence
  Description of Artificial Sequence: Synthetic oligonucleotide
cttgtaaaactgctccagatcgagtgaatgggatg

SEQ ID NO: 331045 - DNA, 35 bp, Artificial Sequence
  Description of Artificial Sequence: Synthetic oligonucleotide
ttgtaaaactgctccagatcgagtgaatgggatgg

SEQ ID NO: 331046 - DNA, 34 bp, Artificial Sequence
  Description of Artificial Sequence: Synthetic oligonucleotide
tgtaaaactgctccagatcgagtgaatgggatgg

SEQ ID NO: 331047 - DNA, 33 bp, Artificial Sequence
  Description of Artificial Sequence: Synthetic oligonucleotide
gtaaaactgctccagatcgagtgaatgggatgg

SEQ ID NO: 331048 - DNA, 34 bp, Artificial Sequence
  Description of Artificial Sequence: Synthetic oligonucleotide
taaaactgctccagatcgagtgaatgggatggtg

SEQ ID NO: 331049 - DNA, 33 bp, Artificial Sequence
  Description of Artificial Sequence: Synthetic oligonucleotide
aaaactgctccagatcgagtgaatgggatggtg

SEQ ID NO: 331050 - DNA, 32 bp, Artificial Sequence
  Description of Artificial Sequence: Synthetic oligonucleotide
aaactgctccagatcgagtgaatgggatggtg

SEQ ID NO: 331051 - DNA, 31 bp, Artificial Sequence
  Description of Artificial Sequence: Synthetic oligonucleotide
aactgctccagatcgagtgaatgggatggtg

SEQ ID NO: 331052 - DNA, 30 bp, Artificial Sequence
  Description of Artificial Sequence: Synthetic oligonucleotide
actgctccagatcgagtgaatgggatggtg

SEQ ID NO: 331053 - DNA, 29 bp, Artificial Sequence
  Description of Artificial Sequence: Synthetic oligonucleotide
ctgctccagatcgagtgaatgggatggtg

SEQ ID NO: 331054 - DNA, 29 bp, Artificial Sequence
  Description of Artificial Sequence: Synthetic oligonucleotide
tgctccagatcgagtgaatgggatggtgc

SEQ ID NO: 331055 - DNA, 28 bp, Artificial Sequence
  Description of Artificial Sequence: Synthetic oligonucleotide
gctccagatcgagtgaatgggatggtgc

SEQ ID NO: 331056 - DNA, 30 bp, Artificial Sequence
  Description of Artificial Sequence: Synthetic oligonucleotide
ctccagatcgagtgaatgggatggtgcatc

SEQ ID NO: 331057 - DNA, 31 bp, Artificial Sequence
  Description of Artificial Sequence: Synthetic oligonucleotide
tccagatcgagtgaatgggatggtgcatctg

SEQ ID NO: 331058 - DNA, 30 bp, Artificial Sequence
  Description of Artificial Sequence: Synthetic oligonucleotide
ccagatcgagtgaatgggatggtgcatctg

SEQ ID NO: 331059 - DNA, 32 bp, Artificial Sequence
  Description of Artificial Sequence: Synthetic oligonucleotide
cagatcgagtgaatgggatggtgcatctgatc

SEQ ID NO: 331060 - DNA, 33 bp, Artificial Sequence
  Description of Artificial Sequence: Synthetic oligonucleotide
agatcgagtgaatgggatggtgcatctgatcac

SEQ ID NO: 331061 - DNA, 32 bp, Artificial Sequence
  Description of Artificial Sequence: Synthetic oligonucleotide
gatcgagtgaatgggatggtgcatctgatcac

SEQ ID NO: 331062 - DNA, 33 bp, Artificial Sequence
  Description of Artificial Sequence: Synthetic oligonucleotide
atcgagtgaatgggatggtgcatctgatcacag

SEQ ID NO: 331063 - DNA, 32 bp, Artificial Sequence
  Description of Artificial Sequence: Synthetic oligonucleotide
tcgagtgaatgggatggtgcatctgatcacag

SEQ ID NO: 331064 - DNA, 31 bp, Artificial Sequence
  Description of Artificial Sequence: Synthetic oligonucleotide
cgagtgaatgggatggtgcatctgatcacag

SEQ ID NO: 331065 - DNA, 32 bp, Artificial Sequence
  Description of Artificial Sequence: Synthetic oligonucleotide
gagtgaatgggatggtgcatctgatcacagtc

SEQ ID NO: 331066 - DNA, 34 bp, Artificial Sequence
  Description of Artificial Sequence: Synthetic oligonucleotide
agtgaatgggatggtgcatctgatcacagtcatc

SEQ ID NO: 331067 - DNA, 33 bp, Artificial Sequence
  Description of Artificial Sequence: Synthetic oligonucleotide
gtgaatgggatggtgcatctgatcacagtcatc

SEQ ID NO: 331068 - DNA, 33 bp, Artificial Sequence
  Description of Artificial Sequence: Synthetic oligonucleotide
tgaatgggatggtgcatctgatcacagtcatcc

SEQ ID NO: 331069 - DNA, 32 bp, Artificial Sequence
  Description of Artificial Sequence: Synthetic oligonucleotide
gaatgggatggtgcatctgatcacagtcatcc

SEQ ID NO: 331070 - DNA, 33 bp, Artificial Sequence
  Description of Artificial Sequence: Synthetic oligonucleotide
aatgggatggtgcatctgatcacagtcatccag

SEQ ID NO: 331071 - DNA, 32 bp, Artificial Sequence
  Description of Artificial Sequence: Synthetic oligonucleotide
atgggatggtgcatctgatcacagtcatccag

SEQ ID NO: 331072 - DNA, 31 bp, Artificial Sequence
  Description of Artificial Sequence: Synthetic oligonucleotide
tgggatggtgcatctgatcacagtcatccag

SEQ ID NO: 331073 - DNA, 30 bp, Artificial Sequence
  Description of Artificial Sequence: Synthetic oligonucleotide
gggatggtgcatctgatcacagtcatccag

SEQ ID NO: 331074 - DNA, 30 bp, Artificial Sequence
  Description of Artificial Sequence: Synthetic oligonucleotide
ggatggtgcatctgatcacagtcatccagg

SEQ ID NO: 331075 - DNA, 32 bp, Artificial Sequence
  Description of Artificial Sequence: Synthetic oligonucleotide
gatggtgcatctgatcacagtcatccaggtag

SEQ ID NO: 331076 - DNA, 32 bp, Artificial Sequence
  Description of Artificial Sequence: Synthetic oligonucleotide
atggtgcatctgatcacagtcatccaggtagg

SEQ ID NO: 331077 - DNA, 31 bp, Artificial Sequence
  Description of Artificial Sequence: Synthetic oligonucleotide
tggtgcatctgatcacagtcatccaggtagg

SEQ ID NO: 331078 - DNA, 30 bp, Artificial Sequence
  Description of Artificial Sequence: Synthetic oligonucleotide
ggtgcatctgatcacagtcatccaggtagg

SEQ ID NO: 331079 - DNA, 32 bp, Artificial Sequence
  Description of Artificial Sequence: Synthetic oligonucleotide
gtgcatctgatcacagtcatccaggtaggatc

SEQ ID NO: 331080 - DNA, 32 bp, Artificial Sequence
  Description of Artificial Sequence: Synthetic oligonucleotide
tgcatctgatcacagtcatccaggtaggatcc

SEQ ID NO: 331081 - DNA, 31 bp, Artificial Sequence
  Description of Artificial Sequence: Synthetic oligonucleotide
gcatctgatcacagtcatccaggtaggatcc

SEQ ID NO: 331082 - DNA, 32 bp, Artificial Sequence
  Description of Artificial Sequence: Synthetic oligonucleotide
catctgatcacagtcatccaggtaggatccag

SEQ ID NO: 331083 - DNA, 35 bp, Artificial Sequence
  Description of Artificial Sequence: Synthetic oligonucleotide
atctgatcacagtcatccaggtaggatccagattc

SEQ ID NO: 331084 - DNA, 34 bp, Artificial Sequence
  Description of Artificial Sequence: Synthetic oligonucleotide
tctgatcacagtcatccaggtaggatccagattc

SEQ ID NO: 331085 - DNA, 33 bp, Artificial Sequence
  Description of Artificial Sequence: Synthetic oligonucleotide
ctgatcacagtcatccaggtaggatccagattc

SEQ ID NO: 331086 - DNA, 35 bp, Artificial Sequence
  Description of Artificial Sequence: Synthetic oligonucleotide
tgatcacagtcatccaggtaggatccagattcaac

SEQ ID NO: 331087 - DNA, 34 bp, Artificial Sequence
  Description of Artificial Sequence: Synthetic oligonucleotide
gatcacagtcatccaggtaggatccagattcaac

SEQ ID NO: 331088 - DNA, 38 bp, Artificial Sequence
  Description of Artificial Sequence: Synthetic oligonucleotide
atcacagtcatccaggtaggatccagattcaactattg

SEQ ID NO: 331089 - DNA, 37 bp, Artificial Sequence
  Description of Artificial Sequence: Synthetic oligonucleotide
tcacagtcatccaggtaggatccagattcaactattg

SEQ ID NO: 331090 - DNA, 36 bp, Artificial Sequence
  Description of Artificial Sequence: Synthetic oligonucleotide
cacagtcatccaggtaggatccagattcaactattg

SEQ ID NO: 331091 - DNA, 38 bp, Artificial Sequence
  Description of Artificial Sequence: Synthetic oligonucleotide
acagtcatccaggtaggatccagattcaactattgttg

SEQ ID NO: 331092 - DNA, 37 bp, Artificial Sequence
  Description of Artificial Sequence: Synthetic oligonucleotide
cagtcatccaggtaggatccagattcaactattgttg

SEQ ID NO: 331093 - DNA, 39 bp, Artificial Sequence
  Description of Artificial Sequence: Synthetic oligonucleotide
agtcatccaggtaggatccagattcaactattgttgtac

SEQ ID NO: 331094 - DNA, 38 bp, Artificial Sequence
  Description of Artificial Sequence: Synthetic oligonucleotide
gtcatccaggtaggatccagattcaactattgttgtac

SEQ ID NO: 331095 - DNA, 40 bp, Artificial Sequence
  Description of Artificial Sequence: Synthetic oligonucleotide
tcatccaggtaggatccagattcaactattgttgtactac

SEQ ID NO: 331096 - DNA, 39 bp, Artificial Sequence
  Description of Artificial Sequence: Synthetic oligonucleotide
catccaggtaggatccagattcaactattgttgtactac

SEQ ID NO: 331097 - DNA, 40 bp, Artificial Sequence
  Description of Artificial Sequence: Synthetic oligonucleotide
atccaggtaggatccagattcaactattgttgtactactg

SEQ ID NO: 331098 - DNA, 39 bp, Artificial Sequence
  Description of Artificial Sequence: Synthetic oligonucleotide
tccaggtaggatccagattcaactattgttgtactactg

SEQ ID NO: 331099 - DNA, 38 bp, Artificial Sequence
  Description of Artificial Sequence: Synthetic oligonucleotide
ccaggtaggatccagattcaactattgttgtactactg

SEQ ID NO: 331100 - DNA, 38 bp, Artificial Sequence
  Description of Artificial Sequence: Synthetic oligonucleotide
caggtaggatccagattcaactattgttgtactactgg

SEQ ID NO: 331101 - DNA, 38 bp, Artificial Sequence
  Description of Artificial Sequence: Synthetic oligonucleotide
aggtaggatccagattcaactattgttgtactactggg

SEQ ID NO: 331102 - DNA, 37 bp, Artificial Sequence
  Description of Artificial Sequence: Synthetic oligonucleotide
ggtaggatccagattcaactattgttgtactactggg

SEQ ID NO: 331103 - DNA, 37 bp, Artificial Sequence
  Description of Artificial Sequence: Synthetic oligonucleotide
gtaggatccagattcaactattgttgtactactgggc

SEQ ID NO: 331104 - DNA, 38 bp, Artificial Sequence
  Description of Artificial Sequence: Synthetic oligonucleotide
taggatccagattcaactattgttgtactactgggcac

SEQ ID NO: 331105 - DNA, 37 bp, Artificial Sequence
  Description of Artificial Sequence: Synthetic oligonucleotide
aggatccagattcaactattgttgtactactgggcac

SEQ ID NO: 331106 - DNA, 36 bp, Artificial Sequence
  Description of Artificial Sequence: Synthetic oligonucleotide
ggatccagattcaactattgttgtactactgggcac

SEQ ID NO: 331107 - DNA, 36 bp, Artificial Sequence
  Description of Artificial Sequence: Synthetic oligonucleotide
gatccagattcaactattgttgtactactgggcacc

SEQ ID NO: 331108 - DNA, 36 bp, Artificial Sequence
  Description of Artificial Sequence: Synthetic oligonucleotide
atccagattcaactattgttgtactactgggcaccg

SEQ ID NO: 331109 - DNA, 35 bp, Artificial Sequence
  Description of Artificial Sequence: Synthetic oligonucleotide
tccagattcaactattgttgtactactgggcaccg

SEQ ID NO: 331110 - DNA, 34 bp, Artificial Sequence
  Description of Artificial Sequence: Synthetic oligonucleotide
ccagattcaactattgttgtactactgggcaccg

SEQ ID NO: 331111 - DNA, 35 bp, Artificial Sequence
  Description of Artificial Sequence: Synthetic oligonucleotide
cagattcaactattgttgtactactgggcaccgag

SEQ ID NO: 331112 - DNA, 36 bp, Artificial Sequence
  Description of Artificial Sequence: Synthetic oligonucleotide
agattcaactattgttgtactactgggcaccgagtc

SEQ ID NO: 331113 - DNA, 35 bp, Artificial Sequence
  Description of Artificial Sequence: Synthetic oligonucleotide
gattcaactattgttgtactactgggcaccgagtc

SEQ ID NO: 331114 - DNA, 38 bp, Artificial Sequence
  Description of Artificial Sequence: Synthetic oligonucleotide
attcaactattgttgtactactgggcaccgagtcattg

SEQ ID NO: 331115 - DNA, 37 bp, Artificial Sequence
  Description of Artificial Sequence: Synthetic oligonucleotide
ttcaactattgttgtactactgggcaccgagtcattg

SEQ ID NO: 331116 - DNA, 36 bp, Artificial Sequence
  Description of Artificial Sequence: Synthetic oligonucleotide
tcaactattgttgtactactgggcaccgagtcattg

SEQ ID NO: 331117 - DNA, 35 bp, Artificial Sequence
  Description of Artificial Sequence: Synthetic oligonucleotide
caactattgttgtactactgggcaccgagtcattg

SEQ ID NO: 331118 - DNA, 35 bp, Artificial Sequence
  Description of Artificial Sequence: Synthetic oligonucleotide
aactattgttgtactactgggcaccgagtcattgg

SEQ ID NO: 331119 - DNA, 34 bp, Artificial Sequence
  Description of Artificial Sequence: Synthetic oligonucleotide
actattgttgtactactgggcaccgagtcattgg

SEQ ID NO: 331120 - DNA, 33 bp, Artificial Sequence
  Description of Artificial Sequence: Synthetic oligonucleotide
ctattgttgtactactgggcaccgagtcattgg

SEQ ID NO: 331121 - DNA, 34 bp, Artificial Sequence
  Description of Artificial Sequence: Synthetic oligonucleotide
tattgttgtactactgggcaccgagtcattggtc

SEQ ID NO: 331122 - DNA, 33 bp, Artificial Sequence
  Description of Artificial Sequence: Synthetic oligonucleotide
attgttgtactactgggcaccgagtcattggtc

SEQ ID NO: 331123 - DNA, 32 bp, Artificial Sequence
  Description of Artificial Sequence: Synthetic oligonucleotide
ttgttgtactactgggcaccgagtcattggtc

SEQ ID NO: 331124 - DNA, 31 bp, Artificial Sequence
  Description of Artificial Sequence: Synthetic oligonucleotide
tgttgtactactgggcaccgagtcattggtc

SEQ ID NO: 331125 - DNA, 30 bp, Artificial Sequence
  Description of Artificial Sequence: Synthetic oligonucleotide
gttgtactactgggcaccgagtcattggtc

SEQ ID NO: 331126 - DNA, 31 bp, Artificial Sequence
  Description of Artificial Sequence: Synthetic oligonucleotide
ttgtactactgggcaccgagtcattggtctc

SEQ ID NO: 331127 - DNA, 30 bp, Artificial Sequence
  Description of Artificial Sequence: Synthetic oligonucleotide
tgtactactgggcaccgagtcattggtctc

SEQ ID NO: 331128 - DNA, 29 bp, Artificial Sequence
  Description of Artificial Sequence: Synthetic oligonucleotide
gtactactgggcaccgagtcattggtctc

SEQ ID NO: 331129 - DNA, 30 bp, Artificial Sequence
  Description of Artificial Sequence: Synthetic oligonucleotide
tactactgggcaccgagtcattggtctctc

SEQ ID NO: 331130 - DNA, 29 bp, Artificial Sequence
  Description of Artificial Sequence: Synthetic oligonucleotide
actactgggcaccgagtcattggtctctc

SEQ ID NO: 331131 - DNA, 28 bp, Artificial Sequence
  Description of Artificial Sequence: Synthetic oligonucleotide
ctactgggcaccgagtcattggtctctc

SEQ ID NO: 331132 - DNA, 30 bp, Artificial Sequence
  Description of Artificial Sequence: Synthetic oligonucleotide
tactgggcaccgagtcattggtctctcatc

SEQ ID NO: 331133 - DNA, 29 bp, Artificial Sequence
  Description of Artificial Sequence: Synthetic oligonucleotide
actgggcaccgagtcattggtctctcatc

SEQ ID NO: 331134 - DNA, 28 bp, Artificial Sequence
  Description of Artificial Sequence: Synthetic oligonucleotide
ctgggcaccgagtcattggtctctcatc

SEQ ID NO: 331135 - DNA, 29 bp, Artificial Sequence
  Description of Artificial Sequence: Synthetic oligonucleotide
tgggcaccgagtcattggtctctcatctg

SEQ ID NO: 331136 - DNA, 28 bp, Artificial Sequence
  Description of Artificial Sequence: Synthetic oligonucleotide
gggcaccgagtcattggtctctcatctg

SEQ ID NO: 331137 - DNA, 28 bp, Artificial Sequence
  Description of Artificial Sequence: Synthetic oligonucleotide
ggcaccgagtcattggtctctcatctgc

SEQ ID NO: 331138 - DNA, 29 bp, Artificial Sequence
  Description of Artificial Sequence: Synthetic oligonucleotide
gcaccgagtcattggtctctcatctgcag

SEQ ID NO: 331139 - DNA, 32 bp, Artificial Sequence
  Description of Artificial Sequence: Synthetic oligonucleotide
caccgagtcattggtctctcatctgcagaatg

SEQ ID NO: 331140 - DNA, 35 bp, Artificial Sequence
  Description of Artificial Sequence: Synthetic oligonucleotide
accgagtcattggtctctcatctgcagaatgtatc

SEQ ID NO: 331141 - DNA, 34 bp, Artificial Sequence
  Description of Artificial Sequence: Synthetic oligonucleotide
ccgagtcattggtctctcatctgcagaatgtatc

SEQ ID NO: 331142 - DNA, 34 bp, Artificial Sequence
  Description of Artificial Sequence: Synthetic oligonucleotide
cgagtcattggtctctcatctgcagaatgtatcg

SEQ ID NO: 331143 - DNA, 35 bp, Artificial Sequence
  Description of Artificial Sequence: Synthetic oligonucleotide
gagtcattggtctctcatctgcagaatgtatcgtc

SEQ ID NO: 331144 - DNA, 36 bp, Artificial Sequence
  Description of Artificial Sequence: Synthetic oligonucleotide
agtcattggtctctcatctgcagaatgtatcgtctc

SEQ ID NO: 331145 - DNA, 35 bp, Artificial Sequence
  Description of Artificial Sequence: Synthetic oligonucleotide
gtcattggtctctcatctgcagaatgtatcgtctc

SEQ ID NO: 331146 - DNA, 35 bp, Artificial Sequence
  Description of Artificial Sequence: Synthetic oligonucleotide
tcattggtctctcatctgcagaatgtatcgtctcg

SEQ ID NO: 331147 - DNA, 34 bp, Artificial Sequence
  Description of Artificial Sequence: Synthetic oligonucleotide
cattggtctctcatctgcagaatgtatcgtctcg

SEQ ID NO: 331148 - DNA, 34 bp, Artificial Sequence
  Description of Artificial Sequence: Synthetic oligonucleotide
attggtctctcatctgcagaatgtatcgtctcgg

SEQ ID NO: 331149 - DNA, 33 bp, Artificial Sequence
  Description of Artificial Sequence: Synthetic oligonucleotide
ttggtctctcatctgcagaatgtatcgtctcgg

SEQ ID NO: 331150 - DNA, 32 bp, Artificial Sequence
  Description of Artificial Sequence: Synthetic oligonucleotide
tggtctctcatctgcagaatgtatcgtctcgg

SEQ ID NO: 331151 - DNA, 31 bp, Artificial Sequence
  Description of Artificial Sequence: Synthetic oligonucleotide
ggtctctcatctgcagaatgtatcgtctcgg

SEQ ID NO: 331152 - DNA, 31 bp, Artificial Sequence
  Description of Artificial Sequence: Synthetic oligonucleotide
gtctctcatctgcagaatgtatcgtctcggg

SEQ ID NO: 331153 - DNA, 31 bp, Artificial Sequence
  Description of Artificial Sequence: Synthetic oligonucleotide
tctctcatctgcagaatgtatcgtctcgggc

SEQ ID NO: 331154 - DNA, 30 bp, Artificial Sequence
  Description of Artificial Sequence: Synthetic oligonucleotide
ctctcatctgcagaatgtatcgtctcgggc

SEQ ID NO: 331155 - DNA, 33 bp, Artificial Sequence
  Description of Artificial Sequence: Synthetic oligonucleotide
tctcatctgcagaatgtatcgtctcgggcattg

SEQ ID NO: 331156 - DNA, 32 bp, Artificial Sequence
  Description of Artificial Sequence: Synthetic oligonucleotide
ctcatctgcagaatgtatcgtctcgggcattg

SEQ ID NO: 331157 - DNA, 32 bp, Artificial Sequence
  Description of Artificial Sequence: Synthetic oligonucleotide
tcatctgcagaatgtatcgtctcgggcattgc

SEQ ID NO: 331158 - DNA, 31 bp, Artificial Sequence
  Description of Artificial Sequence: Synthetic oligonucleotide
catctgcagaatgtatcgtctcgggcattgc

SEQ ID NO: 331159 - DNA, 32 bp, Artificial Sequence
  Description of Artificial Sequence: Synthetic oligonucleotide
atctgcagaatgtatcgtctcgggcattgctg

SEQ ID NO: 331160 - DNA, 31 bp, Artificial Sequence
  Description of Artificial Sequence: Synthetic oligonucleotide
tctgcagaatgtatcgtctcgggcattgctg

SEQ ID NO: 331161 - DNA, 30 bp, Artificial Sequence
  Description of Artificial Sequence: Synthetic oligonucleotide
ctgcagaatgtatcgtctcgggcattgctg

SEQ ID NO: 331162 - DNA, 30 bp, Artificial Sequence
  Description of Artificial Sequence: Synthetic oligonucleotide
tgcagaatgtatcgtctcgggcattgctgc

SEQ ID NO: 331163 - DNA, 29 bp, Artificial Sequence
  Description of Artificial Sequence: Synthetic oligonucleotide
gcagaatgtatcgtctcgggcattgctgc

SEQ ID NO: 331164 - DNA, 29 bp, Artificial Sequence
  Description of Artificial Sequence: Synthetic oligonucleotide
cagaatgtatcgtctcgggcattgctgcc

SEQ ID NO: 331165 - DNA, 29 bp, Artificial Sequence
  Description of Artificial Sequence: Synthetic oligonucleotide
agaatgtatcgtctcgggcattgctgccc

SEQ ID NO: 331166 - DNA, 28 bp, Artificial Sequence
  Description of Artificial Sequence: Synthetic oligonucleotide
gaatgtatcgtctcgggcattgctgccc

SEQ ID NO: 331167 - DNA, 31 bp, Artificial Sequence
  Description of Artificial Sequence: Synthetic oligonucleotide
aatgtatcgtctcgggcattgctgcccaatg

SEQ ID NO: 331168 - DNA, 30 bp, Artificial Sequence
  Description of Artificial Sequence: Synthetic oligonucleotide
atgtatcgtctcgggcattgctgcccaatg

SEQ ID NO: 331169 - DNA, 29 bp, Artificial Sequence
  Description of Artificial Sequence: Synthetic oligonucleotide
tgtatcgtctcgggcattgctgcccaatg

SEQ ID NO: 331170 - DNA, 28 bp, Artificial Sequence
  Description of Artificial Sequence: Synthetic oligonucleotide
gtatcgtctcgggcattgctgcccaatg

SEQ ID NO: 331171 - DNA, 28 bp, Artificial Sequence
  Description of Artificial Sequence: Synthetic oligonucleotide
tatcgtctcgggcattgctgcccaatgg

SEQ ID NO: 331172 - DNA, 27 bp, Artificial Sequence
  Description of Artificial Sequence: Synthetic oligonucleotide
atcgtctcgggcattgctgcccaatgg

SEQ ID NO: 331173 - DNA, 27 bp, Artificial Sequence
  Description of Artificial Sequence: Synthetic oligonucleotide
tcgtctcgggcattgctgcccaatgga

SEQ ID NO: 331174 - DNA, 26 bp, Artificial Sequence
  Description of Artificial Sequence: Synthetic oligonucleotide
cgtctcgggcattgctgcccaatgga

SEQ ID NO: 331175 - DNA, 26 bp, Artificial Sequence
  Description of Artificial Sequence: Synthetic oligonucleotide
gtctcgggcattgctgcccaatggag

SEQ ID NO: 331176 - DNA, 27 bp, Artificial Sequence
  Description of Artificial Sequence: Synthetic oligonucleotide
tctcgggcattgctgcccaatggagca

SEQ ID NO: 331177 - DNA, 26 bp, Artificial Sequence
  Description of Artificial Sequence: Synthetic oligonucleotide
ctcgggcattgctgcccaatggagca

SEQ ID NO: 331178 - DNA, 26 bp, Artificial Sequence
  Description of Artificial Sequence: Synthetic oligonucleotide
tcgggcattgctgcccaatggagcac

SEQ ID NO: 331179 - DNA, 25 bp, Artificial Sequence
  Description of Artificial Sequence: Synthetic oligonucleotide
cgggcattgctgcccaatggagcac

SEQ ID NO: 331180 - DNA, 27 bp, Artificial Sequence
  Description of Artificial Sequence: Synthetic oligonucleotide
gggcattgctgcccaatggagcacgta

SEQ ID NO: 331181 - DNA, 27 bp, Artificial Sequence
  Description of Artificial Sequence: Synthetic oligonucleotide
ggcattgctgcccaatggagcacgtag

SEQ ID NO: 331182 - DNA, 27 bp, Artificial Sequence
  Description of Artificial Sequence: Synthetic oligonucleotide
gcattgctgcccaatggagcacgtagc

SEQ ID NO: 331183 - DNA, 27 bp, Artificial Sequence
  Description of Artificial Sequence: Synthetic oligonucleotide
cattgctgcccaatggagcacgtagcc

SEQ ID NO: 331184 - DNA, 27 bp, Artificial Sequence
  Description of Artificial Sequence: Synthetic oligonucleotide
attgctgcccaatggagcacgtagccg

SEQ ID NO: 331185 - DNA, 26 bp, Artificial Sequence
  Description of Artificial Sequence: Synthetic oligonucleotide
ttgctgcccaatggagcacgtagccg

SEQ ID NO: 331186 - DNA, 25 bp, Artificial Sequence
  Description of Artificial Sequence: Synthetic oligonucleotide
tgctgcccaatggagcacgtagccg

SEQ ID NO: 331187 - DNA, 24 bp, Artificial Sequence
  Description of Artificial Sequence: Synthetic oligonucleotide
gctgcccaatggagcacgtagccg

SEQ ID NO: 331188 - DNA, 24 bp, Artificial Sequence
  Description of Artificial Sequence: Synthetic oligonucleotide
ctgcccaatggagcacgtagccgc

SEQ ID NO: 331189 - DNA, 27 bp, Artificial Sequence
  Description of Artificial Sequence: Synthetic oligonucleotide
tgcccaatggagcacgtagccgccaaa

SEQ ID NO: 331190 - DNA, 27 bp, Artificial Sequence
  Description of Artificial Sequence: Synthetic oligonucleotide
gcccaatggagcacgtagccgccaaat

SEQ ID NO: 331191 - DNA, 28 bp, Artificial Sequence
  Description of Artificial Sequence: Synthetic oligonucleotide
cccaatggagcacgtagccgccaaattg

SEQ ID NO: 331192 - DNA, 29 bp, Artificial Sequence
  Description of Artificial Sequence: Synthetic oligonucleotide
ccaatggagcacgtagccgccaaattgtc

SEQ ID NO: 331193 - DNA, 31 bp, Artificial Sequence
  Description of Artificial Sequence: Synthetic oligonucleotide
caatggagcacgtagccgccaaattgtcaac

SEQ ID NO: 331194 - DNA, 31 bp, Artificial Sequence
  Description of Artificial Sequence: Synthetic oligonucleotide
aatggagcacgtagccgccaaattgtcaacg

SEQ ID NO: 331195 - DNA, 30 bp, Artificial Sequence
  Description of Artificial Sequence: Synthetic oligonucleotide
atggagcacgtagccgccaaattgtcaacg

SEQ ID NO: 331196 - DNA, 29 bp, Artificial Sequence
  Description of Artificial Sequence: Synthetic oligonucleotide
tggagcacgtagccgccaaattgtcaacg

SEQ ID NO: 331197 - DNA, 28 bp, Artificial Sequence
  Description of Artificial Sequence: Synthetic oligonucleotide
ggagcacgtagccgccaaattgtcaacg

SEQ ID NO: 331198 - DNA, 32 bp, Artificial Sequence
  Description of Artificial Sequence: Synthetic oligonucleotide
gagcacgtagccgccaaattgtcaacgtattc

SEQ ID NO: 331199 - DNA, 32 bp, Artificial Sequence
  Description of Artificial Sequence: Synthetic oligonucleotide
agcacgtagccgccaaattgtcaacgtattcc

SEQ ID NO: 331200 - DNA, 31 bp, Artificial Sequence
  Description of Artificial Sequence: Synthetic oligonucleotide
gcacgtagccgccaaattgtcaacgtattcc

SEQ ID NO: 331201 - DNA, 33 bp, Artificial Sequence
  Description of Artificial Sequence: Synthetic oligonucleotide
cacgtagccgccaaattgtcaacgtattccttg

SEQ ID NO: 331202 - DNA, 34 bp, Artificial Sequence
  Description of Artificial Sequence: Synthetic oligonucleotide
acgtagccgccaaattgtcaacgtattccttgtc

SEQ ID NO: 331203 - DNA, 33 bp, Artificial Sequence
  Description of Artificial Sequence: Synthetic oligonucleotide
cgtagccgccaaattgtcaacgtattccttgtc

SEQ ID NO: 331204 - DNA, 33 bp, Artificial Sequence
  Description of Artificial Sequence: Synthetic oligonucleotide
gtagccgccaaattgtcaacgtattccttgtcg

SEQ ID NO: 331205 - DNA, 33 bp, Artificial Sequence
  Description of Artificial Sequence: Synthetic oligonucleotide
tagccgccaaattgtcaacgtattccttgtcgg

SEQ ID NO: 331206 - DNA, 32 bp, Artificial Sequence
  Description of Artificial Sequence: Synthetic oligonucleotide
agccgccaaattgtcaacgtattccttgtcgg

SEQ ID NO: 331207 - DNA, 31 bp, Artificial Sequence
  Description of Artificial Sequence: Synthetic oligonucleotide
gccgccaaattgtcaacgtattccttgtcgg

SEQ ID NO: 331208 - DNA, 31 bp, Artificial Sequence
  Description of Artificial Sequence: Synthetic oligonucleotide
ccgccaaattgtcaacgtattccttgtcggc

SEQ ID NO: 331209 - DNA, 33 bp, Artificial Sequence
  Description of Artificial Sequence: Synthetic oligonucleotide
cgccaaattgtcaacgtattccttgtcggctac

SEQ ID NO: 331210 - DNA, 33 bp, Artificial Sequence
  Description of Artificial Sequence: Synthetic oligonucleotide
gccaaattgtcaacgtattccttgtcggctacc

SEQ ID NO: 331211 - DNA, 33 bp, Artificial Sequence
  Description of Artificial Sequence: Synthetic oligonucleotide
ccaaattgtcaacgtattccttgtcggctaccc

SEQ ID NO: 331212 - DNA, 33 bp, Artificial Sequence
  Description of Artificial Sequence: Synthetic oligonucleotide
caaattgtcaacgtattccttgtcggctacccc

SEQ ID NO: 331213 - DNA, 33 bp, Artificial Sequence
  Description of Artificial Sequence: Synthetic oligonucleotide
aaattgtcaacgtattccttgtcggctaccccg

SEQ ID NO: 331214 - DNA, 32 bp, Artificial Sequence
  Description of Artificial Sequence: Synthetic oligonucleotide
aattgtcaacgtattccttgtcggctaccccg

SEQ ID NO: 331215 - DNA, 31 bp, Artificial Sequence
  Description of Artificial Sequence: Synthetic oligonucleotide
attgtcaacgtattccttgtcggctaccccg

SEQ ID NO: 331216 - DNA, 30 bp, Artificial Sequence
  Description of Artificial Sequence: Synthetic oligonucleotide
ttgtcaacgtattccttgtcggctaccccg

SEQ ID NO: 331217 - DNA, 29 bp, Artificial Sequence
  Description of Artificial Sequence: Synthetic oligonucleotide
tgtcaacgtattccttgtcggctaccccg

SEQ ID NO: 331218 - DNA, 28 bp, Artificial Sequence
  Description of Artificial Sequence: Synthetic oligonucleotide
gtcaacgtattccttgtcggctaccccg

SEQ ID NO: 331219 - DNA, 28 bp, Artificial Sequence
  Description of Artificial Sequence: Synthetic oligonucleotide
tcaacgtattccttgtcggctaccccgc

SEQ ID NO: 331220 - DNA, 27 bp, Artificial Sequence
  Description of Artificial Sequence: Synthetic oligonucleotide
caacgtattccttgtcggctaccccgc

SEQ ID NO: 331221 - DNA, 28 bp, Artificial Sequence
  Description of Artificial Sequence: Synthetic oligonucleotide
aacgtattccttgtcggctaccccgcac

SEQ ID NO: 331222 - DNA, 27 bp, Artificial Sequence
  Description of Artificial Sequence: Synthetic oligonucleotide
acgtattccttgtcggctaccccgcac

SEQ ID NO: 331223 - DNA, 26 bp, Artificial Sequence
  Description of Artificial Sequence: Synthetic oligonucleotide
cgtattccttgtcggctaccccgcac

SEQ ID NO: 331224 - DNA, 26 bp, Artificial Sequence
  Description of Artificial Sequence: Synthetic oligonucleotide
ttccttgtcggctaccccgcaccatc

SEQ ID NO: 331225 - DNA, 25 bp, Artificial Sequence
  Description of Artificial Sequence: Synthetic oligonucleotide
tccttgtcggctaccccgcaccatc

SEQ ID NO: 331226 - DNA, 24 bp, Artificial Sequence
  Description of Artificial Sequence: Synthetic oligonucleotide
ccttgtcggctaccccgcaccatc

SEQ ID NO: 331227 - DNA, 24 bp, Artificial Sequence
  Description of Artificial Sequence: Synthetic oligonucleotide
cttgtcggctaccccgcaccatcg

SEQ ID NO: 331228 - DNA, 24 bp, Artificial Sequence
  Description of Artificial Sequence: Synthetic oligonucleotide
ttgtcggctaccccgcaccatcgc

SEQ ID NO: 331229 - DNA, 23 bp, Artificial Sequence
  Description of Artificial Sequence: Synthetic oligonucleotide
tgtcggctaccccgcaccatcgc

SEQ ID NO: 331230 - DNA, 22 bp, Artificial Sequence
  Description of Artificial Sequence: Synthetic oligonucleotide
gtcggctaccccgcaccatcgc

SEQ ID NO: 331231 - DNA, 25 bp, Artificial Sequence
  Description of Artificial Sequence: Synthetic oligonucleotide
tcggctaccccgcaccatcgcgaat

SEQ ID NO: 331232 - DNA, 24 bp, Artificial Sequence
  Description of Artificial Sequence: Synthetic oligonucleotide
cggctaccccgcaccatcgcgaat

SEQ ID NO: 331233 - DNA, 24 bp, Artificial Sequence
  Description of Artificial Sequence: Synthetic oligonucleotide
ggctaccccgcaccatcgcgaatg

SEQ ID NO: 331234 - DNA, 25 bp, Artificial Sequence
  Description of Artificial Sequence: Synthetic oligonucleotide
gctaccccgcaccatcgcgaatgga

SEQ ID NO: 331235 - DNA, 27 bp, Artificial Sequence
  Description of Artificial Sequence: Synthetic oligonucleotide
ctaccccgcaccatcgcgaatggagat

SEQ ID NO: 331236 - DNA, 29 bp, Artificial Sequence
  Description of Artificial Sequence: Synthetic oligonucleotide
taccccgcaccatcgcgaatggagatatc

SEQ ID NO: 331237 - DNA, 28 bp, Artificial Sequence
  Description of Artificial Sequence: Synthetic oligonucleotide
accccgcaccatcgcgaatggagatatc

SEQ ID NO: 331238 - DNA, 27 bp, Artificial Sequence
  Description of Artificial Sequence: Synthetic oligonucleotide
ccccgcaccatcgcgaatggagatatc

SEQ ID NO: 331239 - DNA, 31 bp, Artificial Sequence
  Description of Artificial Sequence: Synthetic oligonucleotide
cccgcaccatcgcgaatggagatatcattag

SEQ ID NO: 331240 - DNA, 31 bp, Artificial Sequence
  Description of Artificial Sequence: Synthetic oligonucleotide
ccgcaccatcgcgaatggagatatcattagc

SEQ ID NO: 331241 - DNA, 32 bp, Artificial Sequence
  Description of Artificial Sequence: Synthetic oligonucleotide
cgcaccatcgcgaatggagatatcattagcag

SEQ ID NO: 331242 - DNA, 32 bp, Artificial Sequence
  Description of Artificial Sequence: Synthetic oligonucleotide
gcaccatcgcgaatggagatatcattagcagc

SEQ ID NO: 331243 - DNA, 34 bp, Artificial Sequence
  Description of Artificial Sequence: Synthetic oligonucleotide
caccatcgcgaatggagatatcattagcagcaac

SEQ ID NO: 331244 - DNA, 35 bp, Artificial Sequence
  Description of Artificial Sequence: Synthetic oligonucleotide
accatcgcgaatggagatatcattagcagcaacag

SEQ ID NO: 331245 - DNA, 34 bp, Artificial Sequence
  Description of Artificial Sequence: Synthetic oligonucleotide
ccatcgcgaatggagatatcattagcagcaacag

SEQ ID NO: 331246 - DNA, 35 bp, Artificial Sequence
  Description of Artificial Sequence: Synthetic oligonucleotide
catcgcgaatggagatatcattagcagcaacagag

SEQ ID NO: 331247 - DNA, 36 bp, Artificial Sequence
  Description of Artificial Sequence: Synthetic oligonucleotide
atcgcgaatggagatatcattagcagcaacagagac

SEQ ID NO: 331248 - DNA, 35 bp, Artificial Sequence
  Description of Artificial Sequence: Synthetic oligonucleotide
tcgcgaatggagatatcattagcagcaacagagac

SEQ ID NO: 331249 - DNA, 34 bp, Artificial Sequence
  Description of Artificial Sequence: Synthetic oligonucleotide
cgcgaatggagatatcattagcagcaacagagac

SEQ ID NO: 331250 - DNA, 40 bp, Artificial Sequence
  Description of Artificial Sequence: Synthetic oligonucleotide
gcgaatggagatatcattagcagcaacagagacaattttc

SEQ ID NO: 331251 - DNA, 23 bp, Artificial Sequence
  Description of Artificial Sequence: Synthetic oligonucleotide
aagtggggatctggagccgcccg

SEQ ID NO: 331252 - DNA, 22 bp, Artificial Sequence
  Description of Artificial Sequence: Synthetic oligonucleotide
agtggggatctggagccgcccg

SEQ ID NO: 331253 - DNA, 21 bp, Artificial Sequence
  Description of Artificial Sequence: Synthetic oligonucleotide
gtggggatctggagccgcccg

SEQ ID NO: 331254 - DNA, 21 bp, Artificial Sequence
  Description of Artificial Sequence: Synthetic oligonucleotide
tggggatctggagccgcccgg

SEQ ID NO: 331255 - DNA, 20 bp, Artificial Sequence
  Description of Artificial Sequence: Synthetic oligonucleotide
ggggatctggagccgcccgg

SEQ ID NO: 331256 - DNA, 20 bp, Artificial Sequence
  Description of Artificial Sequence: Synthetic oligonucleotide
gggatctggagccgcccggc

SEQ ID NO: 331257 - DNA, 20 bp, Artificial Sequence
  Description of Artificial Sequence: Synthetic oligonucleotide
ggatctggagccgcccggcc

SEQ ID NO: 331258 - DNA, 20 bp, Artificial Sequence
  Description of Artificial Sequence: Synthetic oligonucleotide
gatctggagccgcccggccc

SEQ ID NO: 331259 - DNA, 21 bp, Artificial Sequence
  Description of Artificial Sequence: Synthetic oligonucleotide
atctggagccgcccggcccgt

SEQ ID NO: 331260 - DNA, 20 bp, Artificial Sequence
  Description of Artificial Sequence: Synthetic oligonucleotide
tctggagccgcccggcccgt

SEQ ID NO: 331261 - DNA, 20 bp, Artificial Sequence
  Description of Artificial Sequence: Synthetic oligonucleotide
ctggagccgcccggcccgtt

SEQ ID NO: 331262 - DNA, 20 bp, Artificial Sequence
  Description of Artificial Sequence: Synthetic oligonucleotide
tggagccgcccggcccgtca

SEQ ID NO: 331263 - DNA, 20 bp, Artificial Sequence
  Description of Artificial Sequence: Synthetic oligonucleotide
ggagccgcccggcccgtcat

SEQ ID NO: 331264 - DNA, 20 bp, Artificial Sequence
  Description of Artificial Sequence: Synthetic oligonucleotide
gagccgcccggcccgtcagt

SEQ ID NO: 331265 - DNA, 20 bp, Artificial Sequence
  Description of Artificial Sequence: Synthetic oligonucleotide
agccgcccggcccgtcagtg

SEQ ID NO: 331266 - DNA, 20 bp, Artificial Sequence
  Description of Artificial Sequence: Synthetic oligonucleotide
gccgcccggcccgtcagtgt

SEQ ID NO: 331267 - DNA, 25 bp, Artificial Sequence
  Description of Artificial Sequence: Synthetic oligonucleotide
ccgcccggcccgtcagtgcataata

SEQ ID NO: 331268 - DNA, 25 bp, Artificial Sequence
  Description of Artificial Sequence: Synthetic oligonucleotide
cgcccggcccgtcagtgcataatac

SEQ ID NO: 331269 - DNA, 27 bp, Artificial Sequence
  Description of Artificial Sequence: Synthetic oligonucleotide
gcccggcccgtcagtgcataataccta

SEQ ID NO: 331270 - DNA, 28 bp, Artificial Sequence
  Description of Artificial Sequence: Synthetic oligonucleotide
cccggcccgtcagtgcataatacctaac

SEQ ID NO: 331271 - DNA, 32 bp, Artificial Sequence
  Description of Artificial Sequence: Synthetic oligonucleotide
ccggcccgtcagtgcataatacctaactaatg

SEQ ID NO: 331272 - DNA, 32 bp, Artificial Sequence
  Description of Artificial Sequence: Synthetic oligonucleotide
cggcccgtcagtgcataatacctaactaatgc

SEQ ID NO: 331273 - DNA, 33 bp, Artificial Sequence
  Description of Artificial Sequence: Synthetic oligonucleotide
ggcccgtcagtgcataatacctaactaatgcac

SEQ ID NO: 331274 - DNA, 32 bp, Artificial Sequence
  Description of Artificial Sequence: Synthetic oligonucleotide
gtaccctaagggacaacgacaactttacaccc

SEQ ID NO: 331275 - DNA, 32 bp, Artificial Sequence
  Description of Artificial Sequence: Synthetic oligonucleotide
taccctaagggacaacgacaactttacacccg

SEQ ID NO: 331276 - DNA, 31 bp, Artificial Sequence
  Description of Artificial Sequence: Synthetic oligonucleotide
accctaagggacaacgacaactttacacccg

SEQ ID NO: 331277 - DNA, 30 bp, Artificial Sequence
  Description of Artificial Sequence: Synthetic oligonucleotide
ccctaagggacaacgacaactttacacccg

SEQ ID NO: 331278 - DNA, 30 bp, Artificial Sequence
  Description of Artificial Sequence: Synthetic oligonucleotide
cctaagggacaacgacaactttacacccgg

SEQ ID NO: 331279 - DNA, 30 bp, Artificial Sequence
  Description of Artificial Sequence: Synthetic oligonucleotide
ctaagggacaacgacaactttacacccggg

SEQ ID NO: 331280 - DNA, 30 bp, Artificial Sequence
  Description of Artificial Sequence: Synthetic oligonucleotide
taagggacaacgacaactttacacccgggc

SEQ ID NO: 331281 - DNA, 29 bp, Artificial Sequence
  Description of Artificial Sequence: Synthetic oligonucleotide
aagggacaacgacaactttacacccgggc

SEQ ID NO: 331282 - DNA, 28 bp, Artificial Sequence
  Description of Artificial Sequence: Synthetic oligonucleotide
agggacaacgacaactttacacccgggc

SEQ ID NO: 331283 - DNA, 27 bp, Artificial Sequence
  Description of Artificial Sequence: Synthetic oligonucleotide
gggacaacgacaactttacacccgggc

SEQ ID NO: 331284 - DNA, 28 bp, Artificial Sequence
  Description of Artificial Sequence: Synthetic oligonucleotide
ggacaacgacaactttacacccgggctg

SEQ ID NO: 331285 - DNA, 28 bp, Artificial Sequence
  Description of Artificial Sequence: Synthetic oligonucleotide
gacaacgacaactttacacccgggctgg

SEQ ID NO: 331286 - DNA, 30 bp, Artificial Sequence
  Description of Artificial Sequence: Synthetic oligonucleotide
acaacgacaactttacacccgggctggaag

SEQ ID NO: 331287 - DNA, 29 bp, Artificial Sequence
  Description of Artificial Sequence: Synthetic oligonucleotide
caacgacaactttacacccgggctggaag

SEQ ID NO: 331288 - DNA, 30 bp, Artificial Sequence
  Description of Artificial Sequence: Synthetic oligonucleotide
aacgacaactttacacccgggctggaagtg

SEQ ID NO: 331289 - DNA, 29 bp, Artificial Sequence
  Description of Artificial Sequence: Synthetic oligonucleotide
acgacaactttacacccgggctggaagtg

SEQ ID NO: 331290 - DNA, 28 bp, Artificial Sequence
  Description of Artificial Sequence: Synthetic oligonucleotide
cgacaactttacacccgggctggaagtg

SEQ ID NO: 331291 - DNA, 30 bp, Artificial Sequence
  Description of Artificial Sequence: Synthetic oligonucleotide
gacaactttacacccgggctggaagtgttg

SEQ ID NO: 331292 - DNA, 32 bp, Artificial Sequence
  Description of Artificial Sequence: Synthetic oligonucleotide
acaactttacacccgggctggaagtgttgtac

SEQ ID NO: 331293 - DNA, 31 bp, Artificial Sequence
  Description of Artificial Sequence: Synthetic oligonucleotide
caactttacacccgggctggaagtgttgtac

SEQ ID NO: 331294 - DNA, 32 bp, Artificial Sequence
  Description of Artificial Sequence: Synthetic oligonucleotide
aactttacacccgggctggaagtgttgtacag

SEQ ID NO: 331295 - DNA, 31 bp, Artificial Sequence
  Description of Artificial Sequence: Synthetic oligonucleotide
actttacacccgggctggaagtgttgtacag

SEQ ID NO: 331296 - DNA, 30 bp, Artificial Sequence
  Description of Artificial Sequence: Synthetic oligonucleotide
ctttacacccgggctggaagtgttgtacag

SEQ ID NO: 331297 - DNA, 30 bp, Artificial Sequence
  Description of Artificial Sequence: Synthetic oligonucleotide
tttacacccgggctggaagtgttgtacagc

SEQ ID NO: 331298 - DNA, 29 bp, Artificial Sequence
  Description of Artificial Sequence: Synthetic oligonucleotide
ttacacccgggctggaagtgttgtacagc

SEQ ID NO: 331299 - DNA, 28 bp, Artificial Sequence
  Description of Artificial Sequence: Synthetic oligonucleotide
tacacccgggctggaagtgttgtacagc

SEQ ID NO: 331300 - DNA, 27 bp, Artificial Sequence
  Description of Artificial Sequence: Synthetic oligonucleotide
acacccgggctggaagtgttgtacagc

SEQ ID NO: 331301 - DNA, 27 bp, Artificial Sequence
  Description of Artificial Sequence: Synthetic oligonucleotide
cacccgggctggaagtgttgtacagct

SEQ ID NO: 331302 - DNA, 27 bp, Artificial Sequence
  Description of Artificial Sequence: Synthetic oligonucleotide
acccgggctggaagtgttgtacagctg

SEQ ID NO: 331303 - DNA, 27 bp, Artificial Sequence
  Description of Artificial Sequence: Synthetic oligonucleotide
cccgggctggaagtgttgtacagctgt

SEQ ID NO: 331304 - DNA, 27 bp, Artificial Sequence
  Description of Artificial Sequence: Synthetic oligonucleotide
ccgggctggaagtgttgtacagctgtc

SEQ ID NO: 331305 - DNA, 28 bp, Artificial Sequence
  Description of Artificial Sequence: Synthetic oligonucleotide
cgggctggaagtgttgtacagctgtcag

SEQ ID NO: 331306 - DNA, 30 bp, Artificial Sequence
  Description of Artificial Sequence: Synthetic oligonucleotide
aagtgttgtacagctgtcagcccggctttg

SEQ ID NO: 331307 - DNA, 29 bp, Artificial Sequence
  Description of Artificial Sequence: Synthetic oligonucleotide
agtgttgtacagctgtcagcccggctttg

SEQ ID NO: 331308 - DNA, 28 bp, Artificial Sequence
  Description of Artificial Sequence: Synthetic oligonucleotide
gtgttgtacagctgtcagcccggctttg

SEQ ID NO: 331309 - DNA, 29 bp, Artificial Sequence
  Description of Artificial Sequence: Synthetic oligonucleotide
tgttgtacagctgtcagcccggctttgac

SEQ ID NO: 331310 - DNA, 28 bp, Artificial Sequence
  Description of Artificial Sequence: Synthetic oligonucleotide
gttgtacagctgtcagcccggctttgac

SEQ ID NO: 331311 - DNA, 28 bp, Artificial Sequence
  Description of Artificial Sequence: Synthetic oligonucleotide
ttgtacagctgtcagcccggctttgacc

SEQ ID NO: 331312 - DNA, 27 bp, Artificial Sequence
  Description of Artificial Sequence: Synthetic oligonucleotide
tgtacagctgtcagcccggctttgacc

SEQ ID NO: 331313 - DNA, 27 bp, Artificial Sequence
  Description of Artificial Sequence: Synthetic oligonucleotide
gtacagctgtcagcccggctttgacct

SEQ ID NO: 331314 - DNA, 27 bp, Artificial Sequence
  Description of Artificial Sequence: Synthetic oligonucleotide
tacagctgtcagcccggctttgacctc

SEQ ID NO: 331315 - DNA, 27 bp, Artificial Sequence
  Description of Artificial Sequence: Synthetic oligonucleotide
acagctgtcagcccggctttgacctca

SEQ ID NO: 331316 - DNA, 26 bp, Artificial Sequence
  Description of Artificial Sequence: Synthetic oligonucleotide
cagctgtcagcccggctttgacctca

SEQ ID NO: 331317 - DNA, 27 bp, Artificial Sequence
  Description of Artificial Sequence: Synthetic oligonucleotide
agctgtcagcccggctttgacctcagt

SEQ ID NO: 331318 - DNA, 26 bp, Artificial Sequence
  Description of Artificial Sequence: Synthetic oligonucleotide
gctgtcagcccggctttgacctcagt

SEQ ID NO: 331319 - DNA, 26 bp, Artificial Sequence
  Description of Artificial Sequence: Synthetic oligonucleotide
ctgtcagcccggctttgacctcagtg

SEQ ID NO: 331320 - DNA, 26 bp, Artificial Sequence
  Description of Artificial Sequence: Synthetic oligonucleotide
tgtcagcccggctttgacctcagtgg

SEQ ID NO: 331321 - DNA, 25 bp, Artificial Sequence
  Description of Artificial Sequence: Synthetic oligonucleotide
gtcagcccggctttgacctcagtgg

SEQ ID NO: 331322 - DNA, 25 bp, Artificial Sequence
  Description of Artificial Sequence: Synthetic oligonucleotide
tcagcccggctttgacctcagtggg

SEQ ID NO: 331323 - DNA, 24 bp, Artificial Sequence
  Description of Artificial Sequence: Synthetic oligonucleotide
cagcccggctttgacctcagtggg

SEQ ID NO: 331324 - DNA, 24 bp, Artificial Sequence
  Description of Artificial Sequence: Synthetic oligonucleotide
agcccggctttgacctcagtgggg

SEQ ID NO: 331325 - DNA, 23 bp, Artificial Sequence
  Description of Artificial Sequence: Synthetic oligonucleotide
gcccggctttgacctcagtgggg

SEQ ID NO: 331326 - DNA, 24 bp, Artificial Sequence
  Description of Artificial Sequence: Synthetic oligonucleotide
cccggctttgacctcagtggggct

SEQ ID NO: 331327 - DNA, 24 bp, Artificial Sequence
  Description of Artificial Sequence: Synthetic oligonucleotide
ccggctttgacctcagtggggctg

SEQ ID NO: 331328 - DNA, 24 bp, Artificial Sequence
  Description of Artificial Sequence: Synthetic oligonucleotide
cggctttgacctcagtggggctgc

SEQ ID NO: 331329 - DNA, 25 bp, Artificial Sequence
  Description of Artificial Sequence: Synthetic oligonucleotide
ggctttgacctcagtggggctgcga

SEQ ID NO: 331330 - DNA, 27 bp, Artificial Sequence
  Description of Artificial Sequence: Synthetic oligonucleotide
gctttgacctcagtggggctgcgacta

SEQ ID NO: 331331 - DNA, 28 bp, Artificial Sequence
  Description of Artificial Sequence: Synthetic oligonucleotide
ctttgacctcagtggggctgcgactatg

SEQ ID NO: 331332 - DNA, 28 bp, Artificial Sequence
  Description of Artificial Sequence: Synthetic oligonucleotide
tttgacctcagtggggctgcgactatgc

SEQ ID NO: 331333 - DNA, 27 bp, Artificial Sequence
  Description of Artificial Sequence: Synthetic oligonucleotide
ttgacctcagtggggctgcgactatgc

SEQ ID NO: 331334 - DNA, 26 bp, Artificial Sequence
  Description of Artificial Sequence: Synthetic oligonucleotide
tgacctcagtggggctgcgactatgc

SEQ ID NO: 331335 - DNA, 46 bp, Artificial Sequence
  Description of Artificial Sequence: Synthetic oligonucleotide
tttgtcatgaaggatatcaattaaatggcagctctcctagttattc

SEQ ID NO: 331336 - DNA, 45 bp, Artificial Sequence
  Description of Artificial Sequence: Synthetic oligonucleotide
ttgtcatgaaggatatcaattaaatggcagctctcctagttattc

SEQ ID NO: 331337 - DNA, 44 bp, Artificial Sequence
  Description of Artificial Sequence: Synthetic oligonucleotide
tgtcatgaaggatatcaattaaatggcagctctcctagttattc

SEQ ID NO: 331338 - DNA, 43 bp, Artificial Sequence
  Description of Artificial Sequence: Synthetic oligonucleotide
gtcatgaaggatatcaattaaatggcagctctcctagttattc

SEQ ID NO: 331339 - DNA, 44 bp, Artificial Sequence
  Description of Artificial Sequence: Synthetic oligonucleotide
tcatgaaggatatcaattaaatggcagctctcctagttattctg

SEQ ID NO: 331340 - DNA, 43 bp, Artificial Sequence
  Description of Artificial Sequence: Synthetic oligonucleotide
catgaaggatatcaattaaatggcagctctcctagttattctg

SEQ ID NO: 331341 - DNA, 44 bp, Artificial Sequence
  Description of Artificial Sequence: Synthetic oligonucleotide
atgaaggatatcaattaaatggcagctctcctagttattctgtc

SEQ ID NO: 331342 - DNA, 43 bp, Artificial Sequence
  Description of Artificial Sequence: Synthetic oligonucleotide
tgaaggatatcaattaaatggcagctctcctagttattctgtc

SEQ ID NO: 331343 - DNA, 42 bp, Artificial Sequence
  Description of Artificial Sequence: Synthetic oligonucleotide
gaaggatatcaattaaatggcagctctcctagttattctgtc

SEQ ID NO: 331344 - DNA, 44 bp, Artificial Sequence
  Description of Artificial Sequence: Synthetic oligonucleotide
aaggatatcaattaaatggcagctctcctagttattctgtcttg

SEQ ID NO: 331345 - DNA, 43 bp, Artificial Sequence
  Description of Artificial Sequence: Synthetic oligonucleotide
aggatatcaattaaatggcagctctcctagttattctgtcttg

SEQ ID NO: 331346 - DNA, 42 bp, Artificial Sequence
  Description of Artificial Sequence: Synthetic oligonucleotide
ggatatcaattaaatggcagctctcctagttattctgtcttg

SEQ ID NO: 331347 - DNA, 42 bp, Artificial Sequence
  Description of Artificial Sequence: Synthetic oligonucleotide
gatatcaattaaatggcagctctcctagttattctgtcttgg

SEQ ID NO: 331348 - DNA, 42 bp, Artificial Sequence
  Description of Artificial Sequence: Synthetic oligonucleotide
atatcaattaaatggcagctctcctagttattctgtcttggc

SEQ ID NO: 331349 - DNA, 41 bp, Artificial Sequence
  Description of Artificial Sequence: Synthetic oligonucleotide
tatcaattaaatggcagctctcctagttattctgtcttggc

SEQ ID NO: 331350 - DNA, 40 bp, Artificial Sequence
  Description of Artificial Sequence: Synthetic oligonucleotide
atcaattaaatggcagctctcctagttattctgtcttggc

SEQ ID NO: 331351 - DNA, 39 bp, Artificial Sequence
  Description of Artificial Sequence: Synthetic oligonucleotide
tcaattaaatggcagctctcctagttattctgtcttggc

SEQ ID NO: 331352 - DNA, 38 bp, Artificial Sequence
  Description of Artificial Sequence: Synthetic oligonucleotide
caattaaatggcagctctcctagttattctgtcttggc

SEQ ID NO: 331353 - DNA, 39 bp, Artificial Sequence
  Description of Artificial Sequence: Synthetic oligonucleotide
aattaaatggcagctctcctagttattctgtcttggcag

SEQ ID NO: 331354 - DNA, 38 bp, Artificial Sequence
  Description of Artificial Sequence: Synthetic oligonucleotide
attaaatggcagctctcctagttattctgtcttggcag

SEQ ID NO: 331355 - DNA, 37 bp, Artificial Sequence
  Description of Artificial Sequence: Synthetic oligonucleotide
ttaaatggcagctctcctagttattctgtcttggcag

SEQ ID NO: 331356 - DNA, 36 bp, Artificial Sequence
  Description of Artificial Sequence: Synthetic oligonucleotide
taaatggcagctctcctagttattctgtcttggcag

SEQ ID NO: 331357 - DNA, 35 bp, Artificial Sequence
  Description of Artificial Sequence: Synthetic oligonucleotide
aaatggcagctctcctagttattctgtcttggcag

SEQ ID NO: 331358 - DNA, 34 bp, Artificial Sequence
  Description of Artificial Sequence: Synthetic oligonucleotide
aatggcagctctcctagttattctgtcttggcag

SEQ ID NO: 331359 - DNA, 33 bp, Artificial Sequence
  Description of Artificial Sequence: Synthetic oligonucleotide
atggcagctctcctagttattctgtcttggcag

SEQ ID NO: 331360 - DNA, 32 bp, Artificial Sequence
  Description of Artificial Sequence: Synthetic oligonucleotide
tggcagctctcctagttattctgtcttggcag

SEQ ID NO: 331361 - DNA, 31 bp, Artificial Sequence
  Description of Artificial Sequence: Synthetic oligonucleotide
ggcagctctcctagttattctgtcttggcag

SEQ ID NO: 331362 - DNA, 31 bp, Artificial Sequence
  Description of Artificial Sequence: Synthetic oligonucleotide
gcagctctcctagttattctgtcttggcagg

SEQ ID NO: 331363 - DNA, 34 bp, Artificial Sequence
  Description of Artificial Sequence: Synthetic oligonucleotide
cagctctcctagttattctgtcttggcaggaatg

SEQ ID NO: 331364 - DNA, 34 bp, Artificial Sequence
  Description of Artificial Sequence: Synthetic oligonucleotide
agctctcctagttattctgtcttggcaggaatgg

SEQ ID NO: 331365 - DNA, 33 bp, Artificial Sequence
  Description of Artificial Sequence: Synthetic oligonucleotide
gctctcctagttattctgtcttggcaggaatgg

SEQ ID NO: 331366 - DNA, 36 bp, Artificial Sequence
  Description of Artificial Sequence: Synthetic oligonucleotide
ctctcctagttattctgtcttggcaggaatggaatg

SEQ ID NO: 331367 - DNA, 36 bp, Artificial Sequence
  Description of Artificial Sequence: Synthetic oligonucleotide
tctcctagttattctgtcttggcaggaatggaatgc

SEQ ID NO: 331368 - DNA, 35 bp, Artificial Sequence
  Description of Artificial Sequence: Synthetic oligonucleotide
ctcctagttattctgtcttggcaggaatggaatgc

SEQ ID NO: 331369 - DNA, 35 bp, Artificial Sequence
  Description of Artificial Sequence: Synthetic oligonucleotide
tcctagttattctgtcttggcaggaatggaatgcc

SEQ ID NO: 331370 - DNA, 34 bp, Artificial Sequence
  Description of Artificial Sequence: Synthetic oligonucleotide
cctagttattctgtcttggcaggaatggaatgcc

SEQ ID NO: 331371 - DNA, 37 bp, Artificial Sequence
  Description of Artificial Sequence: Synthetic oligonucleotide
ctagttattctgtcttggcaggaatggaatgcctttg

SEQ ID NO: 331372 - DNA, 37 bp, Artificial Sequence
  Description of Artificial Sequence: Synthetic oligonucleotide
tagttattctgtcttggcaggaatggaatgcctttgg

SEQ ID NO: 331373 - DNA, 36 bp, Artificial Sequence
  Description of Artificial Sequence: Synthetic oligonucleotide
agttattctgtcttggcaggaatggaatgcctttgg

SEQ ID NO: 331374 - DNA, 35 bp, Artificial Sequence
  Description of Artificial Sequence: Synthetic oligonucleotide
gttattctgtcttggcaggaatggaatgcctttgg

SEQ ID NO: 331375 - DNA, 39 bp, Artificial Sequence
  Description of Artificial Sequence: Synthetic oligonucleotide
ttattctgtcttggcaggaatggaatgcctttggattag

SEQ ID NO: 331376 - DNA, 38 bp, Artificial Sequence
  Description of Artificial Sequence: Synthetic oligonucleotide
tattctgtcttggcaggaatggaatgcctttggattag

SEQ ID NO: 331377 - DNA, 37 bp, Artificial Sequence
  Description of Artificial Sequence: Synthetic oligonucleotide
attctgtcttggcaggaatggaatgcctttggattag

SEQ ID NO: 331378 - DNA, 36 bp, Artificial Sequence
  Description of Artificial Sequence: Synthetic oligonucleotide
ttctgtcttggcaggaatggaatgcctttggattag

SEQ ID NO: 331379 - DNA, 37 bp, Artificial Sequence
  Description of Artificial Sequence: Synthetic oligonucleotide
actggaaaacctgtggaagtctatccctttggtaaag

SEQ ID NO: 331380 - DNA, 36 bp, Artificial Sequence
  Description of Artificial Sequence: Synthetic oligonucleotide
ctggaaaacctgtggaagtctatccctttggtaaag

SEQ ID NO: 331381 - DNA, 36 bp, Artificial Sequence
  Description of Artificial Sequence: Synthetic oligonucleotide
tggaaaacctgtggaagtctatccctttggtaaagc

SEQ ID NO: 331382 - DNA, 35 bp, Artificial Sequence
  Description of Artificial Sequence: Synthetic oligonucleotide
ggaaaacctgtggaagtctatccctttggtaaagc

SEQ ID NO: 331383 - DNA, 36 bp, Artificial Sequence
  Description of Artificial Sequence: Synthetic oligonucleotide
gaaaacctgtggaagtctatccctttggtaaagcag

SEQ ID NO: 331384 - DNA, 43 bp, Artificial Sequence
  Description of Artificial Sequence: Synthetic oligonucleotide
aaaacctgtggaagtctatccctttggtaaagcagtatattac

SEQ ID NO: 331385 - DNA, 42 bp, Artificial Sequence
  Description of Artificial Sequence: Synthetic oligonucleotide
aaacctgtggaagtctatccctttggtaaagcagtatattac

SEQ ID NO: 331386 - DNA, 41 bp, Artificial Sequence
  Description of Artificial Sequence: Synthetic oligonucleotide
aacctgtggaagtctatccctttggtaaagcagtatattac

SEQ ID NO: 331387 - DNA, 40 bp, Artificial Sequence
  Description of Artificial Sequence: Synthetic oligonucleotide
acctgtggaagtctatccctttggtaaagcagtatattac

SEQ ID NO: 331388 - DNA, 39 bp, Artificial Sequence
  Description of Artificial Sequence: Synthetic oligonucleotide
cctgtggaagtctatccctttggtaaagcagtatattac

SEQ ID NO: 331389 - DNA, 40 bp, Artificial Sequence
  Description of Artificial Sequence: Synthetic oligonucleotide
ctgtggaagtctatccctttggtaaagcagtatattacac

SEQ ID NO: 331390 - DNA, 42 bp, Artificial Sequence
  Description of Artificial Sequence: Synthetic oligonucleotide
tgtggaagtctatccctttggtaaagcagtatattacacatc

SEQ ID NO: 331391 - DNA, 41 bp, Artificial Sequence
  Description of Artificial Sequence: Synthetic oligonucleotide
gtggaagtctatccctttggtaaagcagtatattacacatc

SEQ ID NO: 331392 - DNA, 41 bp, Artificial Sequence
  Description of Artificial Sequence: Synthetic oligonucleotide
tggaagtctatccctttggtaaagcagtatattacacatcc

SEQ ID NO: 331393 - DNA, 40 bp, Artificial Sequence
  Description of Artificial Sequence: Synthetic oligonucleotide
ggaagtctatccctttggtaaagcagtatattacacatcc

SEQ ID NO: 331394 - DNA, 40 bp, Artificial Sequence
  Description of Artificial Sequence: Synthetic oligonucleotide
gaagtctatccctttggtaaagcagtatattacacatccg

SEQ ID NO: 331395 - DNA, 41 bp, Artificial Sequence
  Description of Artificial Sequence: Synthetic oligonucleotide
aagtctatccctttggtaaagcagtatattacacatccgac

SEQ ID NO: 331396 - DNA, 40 bp, Artificial Sequence
  Description of Artificial Sequence: Synthetic oligonucleotide
agtctatccctttggtaaagcagtatattacacatccgac

SEQ ID NO: 331397 - DNA, 39 bp, Artificial Sequence
  Description of Artificial Sequence: Synthetic oligonucleotide
gtctatccctttggtaaagcagtatattacacatccgac

SEQ ID NO: 331398 - DNA, 39 bp, Artificial Sequence
  Description of Artificial Sequence: Synthetic oligonucleotide
tctatccctttggtaaagcagtatattacacatccgacc

SEQ ID NO: 331399 - DNA, 38 bp, Artificial Sequence
  Description of Artificial Sequence: Synthetic oligonucleotide
ctatccctttggtaaagcagtatattacacatccgacc

SEQ ID NO: 331400 - DNA, 38 bp, Artificial Sequence
  Description of Artificial Sequence: Synthetic oligonucleotide
tatccctttggtaaagcagtatattacacatccgaccc

SEQ ID NO: 331401 - DNA, 37 bp, Artificial Sequence
  Description of Artificial Sequence: Synthetic oligonucleotide
atccctttggtaaagcagtatattacacatccgaccc

SEQ ID NO: 331402 - DNA, 36 bp, Artificial Sequence
  Description of Artificial Sequence: Synthetic oligonucleotide
tccctttggtaaagcagtatattacacatccgaccc

SEQ ID NO: 331403 - DNA, 35 bp, Artificial Sequence
  Description of Artificial Sequence: Synthetic oligonucleotide
ccctttggtaaagcagtatattacacatccgaccc

SEQ ID NO: 331404 - DNA, 35 bp, Artificial Sequence
  Description of Artificial Sequence: Synthetic oligonucleotide
cctttggtaaagcagtatattacacatccgacccc

SEQ ID NO: 331405 - DNA, 35 bp, Artificial Sequence
  Description of Artificial Sequence: Synthetic oligonucleotide
ctttggtaaagcagtatattacacatccgaccccc

SEQ ID NO: 331406 - DNA, 36 bp, Artificial Sequence
  Description of Artificial Sequence: Synthetic oligonucleotide
tttggtaaagcagtatattacacatccgacccccag

SEQ ID NO: 331407 - DNA, 35 bp, Artificial Sequence
  Description of Artificial Sequence: Synthetic oligonucleotide
ttggtaaagcagtatattacacatccgacccccag

SEQ ID NO: 331408 - DNA, 34 bp, Artificial Sequence
  Description of Artificial Sequence: Synthetic oligonucleotide
tggtaaagcagtatattacacatccgacccccag

SEQ ID NO: 331409 - DNA, 33 bp, Artificial Sequence
  Description of Artificial Sequence: Synthetic oligonucleotide
ggtaaagcagtatattacacatccgacccccag

SEQ ID NO: 331410 - DNA, 33 bp, Artificial Sequence
  Description of Artificial Sequence: Synthetic oligonucleotide
gtaaagcagtatattacacatccgacccccagc

SEQ ID NO: 331411 - DNA, 33 bp, Artificial Sequence
  Description of Artificial Sequence: Synthetic oligonucleotide
taaagcagtatattacacatccgacccccagcc

SEQ ID NO: 331412 - DNA, 32 bp, Artificial Sequence
  Description of Artificial Sequence: Synthetic oligonucleotide
aaagcagtatattacacatccgacccccagcc

SEQ ID NO: 331413 - DNA, 31 bp, Artificial Sequence
  Description of Artificial Sequence: Synthetic oligonucleotide
aagcagtatattacacatccgacccccagcc

SEQ ID NO: 331414 - DNA, 30 bp, Artificial Sequence
  Description of Artificial Sequence: Synthetic oligonucleotide
agcagtatattacacatccgacccccagcc

SEQ ID NO: 331415 - DNA, 29 bp, Artificial Sequence
  Description of Artificial Sequence: Synthetic oligonucleotide
gcagtatattacacatccgacccccagcc

SEQ ID NO: 331416 - DNA, 37 bp, Artificial Sequence
  Description of Artificial Sequence: Synthetic oligonucleotide
gtaggatccagattcaactattgttgtactactgggg

SEQ ID NO: 331417 - DNA, 37 bp, Artificial Sequence
  Description of Artificial Sequence: Synthetic oligonucleotide
taggatccagattcaactattgttgtactactggggc

SEQ ID NO: 331418 - DNA, 36 bp, Artificial Sequence
  Description of Artificial Sequence: Synthetic oligonucleotide
aggatccagattcaactattgttgtactactggggc

SEQ ID NO: 331419 - DNA, 35 bp, Artificial Sequence
  Description of Artificial Sequence: Synthetic oligonucleotide
ggatccagattcaactattgttgtactactggggc

SEQ ID NO: 331420 - DNA, 36 bp, Artificial Sequence
  Description of Artificial Sequence: Synthetic oligonucleotide
gatccagattcaactattgttgtactactggggcac

SEQ ID NO: 331421 - DNA, 36 bp, Artificial Sequence
  Description of Artificial Sequence: Synthetic oligonucleotide
atccagattcaactattgttgtactactggggcacc

SEQ ID NO: 331422 - DNA, 35 bp, Artificial Sequence
  Description of Artificial Sequence: Synthetic oligonucleotide
tccagattcaactattgttgtactactggggcacc

SEQ ID NO: 331423 - DNA, 34 bp, Artificial Sequence
  Description of Artificial Sequence: Synthetic oligonucleotide
ccagattcaactattgttgtactactggggcacc

SEQ ID NO: 331424 - DNA, 34 bp, Artificial Sequence
  Description of Artificial Sequence: Synthetic oligonucleotide
cagattcaactattgttgtactactggggcaccg

SEQ ID NO: 331425 - DNA, 35 bp, Artificial Sequence
  Description of Artificial Sequence: Synthetic oligonucleotide
agattcaactattgttgtactactggggcaccgtc

SEQ ID NO: 331426 - DNA, 34 bp, Artificial Sequence
  Description of Artificial Sequence: Synthetic oligonucleotide
gattcaactattgttgtactactggggcaccgtc

SEQ ID NO: 331427 - DNA, 35 bp, Artificial Sequence
  Description of Artificial Sequence: Synthetic oligonucleotide
attcaactattgttgtactactggggcaccgtctc

SEQ ID NO: 331428 - DNA, 34 bp, Artificial Sequence
  Description of Artificial Sequence: Synthetic oligonucleotide
ttcaactattgttgtactactggggcaccgtctc

SEQ ID NO: 331429 - DNA, 33 bp, Artificial Sequence
  Description of Artificial Sequence: Synthetic oligonucleotide
tcaactattgttgtactactggggcaccgtctc

SEQ ID NO: 331430 - DNA, 32 bp, Artificial Sequence
  Description of Artificial Sequence: Synthetic oligonucleotide
caactattgttgtactactggggcaccgtctc

SEQ ID NO: 331431 - DNA, 35 bp, Artificial Sequence
  Description of Artificial Sequence: Synthetic oligonucleotide
aactattgttgtactactggggcaccgtctcattg

SEQ ID NO: 331432 - DNA, 34 bp, Artificial Sequence
  Description of Artificial Sequence: Synthetic oligonucleotide
actattgttgtactactggggcaccgtctcattg

SEQ ID NO: 331433 - DNA, 33 bp, Artificial Sequence
  Description of Artificial Sequence: Synthetic oligonucleotide
ctattgttgtactactggggcaccgtctcattg

SEQ ID NO: 331434 - DNA, 33 bp, Artificial Sequence
  Description of Artificial Sequence: Synthetic oligonucleotide
tattgttgtactactggggcaccgtctcattgg

SEQ ID NO: 331435 - DNA, 32 bp, Artificial Sequence
  Description of Artificial Sequence: Synthetic oligonucleotide
attgttgtactactggggcaccgtctcattgg

SEQ ID NO: 331436 - DNA, 31 bp, Artificial Sequence
  Description of Artificial Sequence: Synthetic oligonucleotide
ttgttgtactactggggcaccgtctcattgg

SEQ ID NO: 331437 - DNA, 30 bp, Artificial Sequence
  Description of Artificial Sequence: Synthetic oligonucleotide
tgttgtactactggggcaccgtctcattgg

SEQ ID NO: 331438 - DNA, 29 bp, Artificial Sequence
  Description of Artificial Sequence: Synthetic oligonucleotide
gttgtactactggggcaccgtctcattgg

SEQ ID NO: 331439 - DNA, 30 bp, Artificial Sequence
  Description of Artificial Sequence: Synthetic oligonucleotide
ttgtactactggggcaccgtctcattggtg

SEQ ID NO: 331440 - DNA, 29 bp, Artificial Sequence
  Description of Artificial Sequence: Synthetic oligonucleotide
tgtactactggggcaccgtctcattggtg

SEQ ID NO: 331441 - DNA, 28 bp, Artificial Sequence
  Description of Artificial Sequence: Synthetic oligonucleotide
gtactactggggcaccgtctcattggtg

SEQ ID NO: 331442 - DNA, 29 bp, Artificial Sequence
  Description of Artificial Sequence: Synthetic oligonucleotide
tactactggggcaccgtctcattggtgac

SEQ ID NO: 331443 - DNA, 28 bp, Artificial Sequence
  Description of Artificial Sequence: Synthetic oligonucleotide
actactggggcaccgtctcattggtgac

SEQ ID NO: 331444 - DNA, 27 bp, Artificial Sequence
  Description of Artificial Sequence: Synthetic oligonucleotide
ctactggggcaccgtctcattggtgac

SEQ ID NO: 331445 - DNA, 28 bp, Artificial Sequence
  Description of Artificial Sequence: Synthetic oligonucleotide
tactggggcaccgtctcattggtgactc

SEQ ID NO: 331446 - DNA, 27 bp, Artificial Sequence
  Description of Artificial Sequence: Synthetic oligonucleotide
actggggcaccgtctcattggtgactc

SEQ ID NO: 331447 - DNA, 27 bp, Artificial Sequence
  Description of Artificial Sequence: Synthetic oligonucleotide
ctggggcaccgtctcattggtgactca

SEQ ID NO: 331448 - DNA, 28 bp, Artificial Sequence
  Description of Artificial Sequence: Synthetic oligonucleotide
tggggcaccgtctcattggtgactcatc

SEQ ID NO: 331449 - DNA, 27 bp, Artificial Sequence
  Description of Artificial Sequence: Synthetic oligonucleotide
ggggcaccgtctcattggtgactcatc

SEQ ID NO: 331450 - DNA, 28 bp, Artificial Sequence
  Description of Artificial Sequence: Synthetic oligonucleotide
gggcaccgtctcattggtgactcatctg

SEQ ID NO: 331451 - DNA, 28 bp, Artificial Sequence
  Description of Artificial Sequence: Synthetic oligonucleotide
ggcaccgtctcattggtgactcatctgg

SEQ ID NO: 331452 - DNA, 29 bp, Artificial Sequence
  Description of Artificial Sequence: Synthetic oligonucleotide
gcaccgtctcattggtgactcatctggtg

SEQ ID NO: 331453 - DNA, 32 bp, Artificial Sequence
  Description of Artificial Sequence: Synthetic oligonucleotide
caccgtctcattggtgactcatctggtgaatg

SEQ ID NO: 331454 - DNA, 35 bp, Artificial Sequence
  Description of Artificial Sequence: Synthetic oligonucleotide
accgtctcattggtgactcatctggtgaatgtatg

SEQ ID NO: 331455 - DNA, 34 bp, Artificial Sequence
  Description of Artificial Sequence: Synthetic oligonucleotide
ccgtctcattggtgactcatctggtgaatgtatg

SEQ ID NO: 331456 - DNA, 34 bp, Artificial Sequence
  Description of Artificial Sequence: Synthetic oligonucleotide
cgtctcattggtgactcatctggtgaatgtatgc

SEQ ID NO: 331457 - DNA, 35 bp, Artificial Sequence
  Description of Artificial Sequence: Synthetic oligonucleotide
gtctcattggtgactcatctggtgaatgtatgctc

SEQ ID NO: 331458 - DNA, 36 bp, Artificial Sequence
  Description of Artificial Sequence: Synthetic oligonucleotide
tctcattggtgactcatctggtgaatgtatgctctc

SEQ ID NO: 331459 - DNA, 35 bp, Artificial Sequence
  Description of Artificial Sequence: Synthetic oligonucleotide
ctcattggtgactcatctggtgaatgtatgctctc

SEQ ID NO: 331460 - DNA, 36 bp, Artificial Sequence
  Description of Artificial Sequence: Synthetic oligonucleotide
tcattggtgactcatctggtgaatgtatgctctcag

SEQ ID NO: 331461 - DNA, 35 bp, Artificial Sequence
  Description of Artificial Sequence: Synthetic oligonucleotide
cattggtgactcatctggtgaatgtatgctctcag

SEQ ID NO: 331462 - DNA, 35 bp, Artificial Sequence
  Description of Artificial Sequence: Synthetic oligonucleotide
attggtgactcatctggtgaatgtatgctctcagg

SEQ ID NO: 331463 - DNA, 34 bp, Artificial Sequence
  Description of Artificial Sequence: Synthetic oligonucleotide
ttggtgactcatctggtgaatgtatgctctcagg

SEQ ID NO: 331464 - DNA, 33 bp, Artificial Sequence
  Description of Artificial Sequence: Synthetic oligonucleotide
tggtgactcatctggtgaatgtatgctctcagg

SEQ ID NO: 331465 - DNA, 32 bp, Artificial Sequence
  Description of Artificial Sequence: Synthetic oligonucleotide
ggtgactcatctggtgaatgtatgctctcagg

SEQ ID NO: 331466 - DNA, 32 bp, Artificial Sequence
  Description of Artificial Sequence: Synthetic oligonucleotide
gtgactcatctggtgaatgtatgctctcaggc

SEQ ID NO: 331467 - DNA, 36 bp, Artificial Sequence
  Description of Artificial Sequence: Synthetic oligonucleotide
tgactcatctggtgaatgtatgctctcaggctatac

SEQ ID NO: 331468 - DNA, 35 bp, Artificial Sequence
  Description of Artificial Sequence: Synthetic oligonucleotide
gactcatctggtgaatgtatgctctcaggctatac

SEQ ID NO: 331469 - DNA, 36 bp, Artificial Sequence
  Description of Artificial Sequence: Synthetic oligonucleotide
actcatctggtgaatgtatgctctcaggctatactg

SEQ ID NO: 331470 - DNA, 35 bp, Artificial Sequence
  Description of Artificial Sequence: Synthetic oligonucleotide
ctcatctggtgaatgtatgctctcaggctatactg

SEQ ID NO: 331471 - DNA, 35 bp, Artificial Sequence
  Description of Artificial Sequence: Synthetic oligonucleotide
tcatctggtgaatgtatgctctcaggctatactgc

SEQ ID NO: 331472 - DNA, 34 bp, Artificial Sequence
  Description of Artificial Sequence: Synthetic oligonucleotide
catctggtgaatgtatgctctcaggctatactgc

SEQ ID NO: 331473 - DNA, 34 bp, Artificial Sequence
  Description of Artificial Sequence: Synthetic oligonucleotide
atctggtgaatgtatgctctcaggctatactgcc

SEQ ID NO: 331474 - DNA, 33 bp, Artificial Sequence
  Description of Artificial Sequence: Synthetic oligonucleotide
tctggtgaatgtatgctctcaggctatactgcc

SEQ ID NO: 331475 - DNA, 32 bp, Artificial Sequence
  Description of Artificial Sequence: Synthetic oligonucleotide
ctggtgaatgtatgctctcaggctatactgcc

SEQ ID NO: 331476 - DNA, 32 bp, Artificial Sequence
  Description of Artificial Sequence: Synthetic oligonucleotide
tggtgaatgtatgctctcaggctatactgccc

SEQ ID NO: 331477 - DNA, 31 bp, Artificial Sequence
  Description of Artificial Sequence: Synthetic oligonucleotide
ggtgaatgtatgctctcaggctatactgccc

SEQ ID NO: 331478 - DNA, 34 bp, Artificial Sequence
  Description of Artificial Sequence: Synthetic oligonucleotide
gtgaatgtatgctctcaggctatactgccctttg

SEQ ID NO: 331479 - DNA, 34 bp, Artificial Sequence
  Description of Artificial Sequence: Synthetic oligonucleotide
tgaatgtatgctctcaggctatactgccctttgg

SEQ ID NO: 331480 - DNA, 33 bp, Artificial Sequence
  Description of Artificial Sequence: Synthetic oligonucleotide
gaatgtatgctctcaggctatactgccctttgg

SEQ ID NO: 331481 - DNA, 34 bp, Artificial Sequence
  Description of Artificial Sequence: Synthetic oligonucleotide
aatgtatgctctcaggctatactgccctttggag

SEQ ID NO: 331482 - DNA, 33 bp, Artificial Sequence
  Description of Artificial Sequence: Synthetic oligonucleotide
atgtatgctctcaggctatactgccctttggag

SEQ ID NO: 331483 - DNA, 32 bp, Artificial Sequence
  Description of Artificial Sequence: Synthetic oligonucleotide
tgtatgctctcaggctatactgccctttggag

SEQ ID NO: 331484 - DNA, 31 bp, Artificial Sequence
  Description of Artificial Sequence: Synthetic oligonucleotide
gtatgctctcaggctatactgccctttggag

SEQ ID NO: 331485 - DNA, 31 bp, Artificial Sequence
  Description of Artificial Sequence: Synthetic oligonucleotide
tatgctctcaggctatactgccctttggagc

SEQ ID NO: 331486 - DNA, 30 bp, Artificial Sequence
  Description of Artificial Sequence: Synthetic oligonucleotide
atgctctcaggctatactgccctttggagc

SEQ ID NO: 331487 - DNA, 29 bp, Artificial Sequence
  Description of Artificial Sequence: Synthetic oligonucleotide
tgctctcaggctatactgccctttggagc

SEQ ID NO: 331488 - DNA, 28 bp, Artificial Sequence
  Description of Artificial Sequence: Synthetic oligonucleotide
gctctcaggctatactgccctttggagc

SEQ ID NO: 331489 - DNA, 29 bp, Artificial Sequence
  Description of Artificial Sequence: Synthetic oligonucleotide
ctctcaggctatactgccctttggagcac

SEQ ID NO: 331490 - DNA, 29 bp, Artificial Sequence
  Description of Artificial Sequence: Synthetic oligonucleotide
tctcaggctatactgccctttggagcacc

SEQ ID NO: 331491 - DNA, 28 bp, Artificial Sequence
  Description of Artificial Sequence: Synthetic oligonucleotide
ctcaggctatactgccctttggagcacc

SEQ ID NO: 331492 - DNA, 30 bp, Artificial Sequence
  Description of Artificial Sequence: Synthetic oligonucleotide
tcaggctatactgccctttggagcaccaag

SEQ ID NO: 331493 - DNA, 29 bp, Artificial Sequence
  Description of Artificial Sequence: Synthetic oligonucleotide
caggctatactgccctttggagcaccaag

SEQ ID NO: 331494 - DNA, 29 bp, Artificial Sequence
  Description of Artificial Sequence: Synthetic oligonucleotide
aggctatactgccctttggagcaccaagc

SEQ ID NO: 331495 - DNA, 28 bp, Artificial Sequence
  Description of Artificial Sequence: Synthetic oligonucleotide
ggctatactgccctttggagcaccaagc

SEQ ID NO: 331496 - DNA, 28 bp, Artificial Sequence
  Description of Artificial Sequence: Synthetic oligonucleotide
gctatactgccctttggagcaccaagcc

SEQ ID NO: 331497 - DNA, 28 bp, Artificial Sequence
  Description of Artificial Sequence: Synthetic oligonucleotide
ctatactgccctttggagcaccaagccg

SEQ ID NO: 331498 - DNA, 28 bp, Artificial Sequence
  Description of Artificial Sequence: Synthetic oligonucleotide
tatactgccctttggagcaccaagccgc

SEQ ID NO: 331499 - DNA, 27 bp, Artificial Sequence
  Description of Artificial Sequence: Synthetic oligonucleotide
atactgccctttggagcaccaagccgc

SEQ ID NO: 331500 - DNA, 26 bp, Artificial Sequence
  Description of Artificial Sequence: Synthetic oligonucleotide
tactgccctttggagcaccaagccgc

SEQ ID NO: 331501 - DNA, 25 bp, Artificial Sequence
  Description of Artificial Sequence: Synthetic oligonucleotide
actgccctttggagcaccaagccgc

SEQ ID NO: 331502 - DNA, 24 bp, Artificial Sequence
  Description of Artificial Sequence: Synthetic oligonucleotide
ctgccctttggagcaccaagccgc

SEQ ID NO: 331503 - DNA, 27 bp, Artificial Sequence
  Description of Artificial Sequence: Synthetic oligonucleotide
tgccctttggagcaccaagccgccatt

SEQ ID NO: 331504 - DNA, 27 bp, Artificial Sequence
  Description of Artificial Sequence: Synthetic oligonucleotide
gccctttggagcaccaagccgccattt

SEQ ID NO: 331505 - DNA, 28 bp, Artificial Sequence
  Description of Artificial Sequence: Synthetic oligonucleotide
ccctttggagcaccaagccgccattttg

SEQ ID NO: 331506 - DNA, 29 bp, Artificial Sequence
  Description of Artificial Sequence: Synthetic oligonucleotide
cctttggagcaccaagccgccattttgtc

SEQ ID NO: 331507 - DNA, 31 bp, Artificial Sequence
  Description of Artificial Sequence: Synthetic oligonucleotide
ctttggagcaccaagccgccattttgtcaac

SEQ ID NO: 331508 - DNA, 31 bp, Artificial Sequence
  Description of Artificial Sequence: Synthetic oligonucleotide
tttggagcaccaagccgccattttgtcaacc

SEQ ID NO: 331509 - DNA, 30 bp, Artificial Sequence
  Description of Artificial Sequence: Synthetic oligonucleotide
ttggagcaccaagccgccattttgtcaacc

SEQ ID NO: 331510 - DNA, 29 bp, Artificial Sequence
  Description of Artificial Sequence: Synthetic oligonucleotide
tggagcaccaagccgccattttgtcaacc

SEQ ID NO: 331511 - DNA, 28 bp, Artificial Sequence
  Description of Artificial Sequence: Synthetic oligonucleotide
ggagcaccaagccgccattttgtcaacc

SEQ ID NO: 331512 - DNA, 32 bp, Artificial Sequence
  Description of Artificial Sequence: Synthetic oligonucleotide
gagcaccaagccgccattttgtcaaccaattc

SEQ ID NO: 331513 - DNA, 32 bp, Artificial Sequence
  Description of Artificial Sequence: Synthetic oligonucleotide
agcaccaagccgccattttgtcaaccaattcc

SEQ ID NO: 331514 - DNA, 31 bp, Artificial Sequence
  Description of Artificial Sequence: Synthetic oligonucleotide
gcaccaagccgccattttgtcaaccaattcc

SEQ ID NO: 331515 - DNA, 33 bp, Artificial Sequence
  Description of Artificial Sequence: Synthetic oligonucleotide
caccaagccgccattttgtcaaccaattccttg

SEQ ID NO: 331516 - DNA, 34 bp, Artificial Sequence
  Description of Artificial Sequence: Synthetic oligonucleotide
accaagccgccattttgtcaaccaattccttgag

SEQ ID NO: 331517 - DNA, 33 bp, Artificial Sequence
  Description of Artificial Sequence: Synthetic oligonucleotide
ccaagccgccattttgtcaaccaattccttgag

SEQ ID NO: 331518 - DNA, 33 bp, Artificial Sequence
  Description of Artificial Sequence: Synthetic oligonucleotide
caagccgccattttgtcaaccaattccttgagg

SEQ ID NO: 331519 - DNA, 33 bp, Artificial Sequence
  Description of Artificial Sequence: Synthetic oligonucleotide
aagccgccattttgtcaaccaattccttgaggg

SEQ ID NO: 331520 - DNA, 32 bp, Artificial Sequence
  Description of Artificial Sequence: Synthetic oligonucleotide
agccgccattttgtcaaccaattccttgaggg

SEQ ID NO: 331521 - DNA, 31 bp, Artificial Sequence
  Description of Artificial Sequence: Synthetic oligonucleotide
gccgccattttgtcaaccaattccttgaggg

SEQ ID NO: 331522 - DNA, 31 bp, Artificial Sequence
  Description of Artificial Sequence: Synthetic oligonucleotide
ccgccattttgtcaaccaattccttgagggc

SEQ ID NO: 331523 - DNA, 33 bp, Artificial Sequence
  Description of Artificial Sequence: Synthetic oligonucleotide
cgccattttgtcaaccaattccttgagggctac

SEQ ID NO: 331524 - DNA, 33 bp, Artificial Sequence
  Description of Artificial Sequence: Synthetic oligonucleotide
gccattttgtcaaccaattccttgagggctacc

SEQ ID NO: 331525 - DNA, 33 bp, Artificial Sequence
  Description of Artificial Sequence: Synthetic oligonucleotide
ccattttgtcaaccaattccttgagggctaccc

SEQ ID NO: 331526 - DNA, 33 bp, Artificial Sequence
  Description of Artificial Sequence: Synthetic oligonucleotide
cattttgtcaaccaattccttgagggctacccg

SEQ ID NO: 331527 - DNA, 33 bp, Artificial Sequence
  Description of Artificial Sequence: Synthetic oligonucleotide
attttgtcaaccaattccttgagggctacccgc

SEQ ID NO: 331528 - DNA, 32 bp, Artificial Sequence
  Description of Artificial Sequence: Synthetic oligonucleotide
ttttgtcaaccaattccttgagggctacccgc

SEQ ID NO: 331529 - DNA, 31 bp, Artificial Sequence
  Description of Artificial Sequence: Synthetic oligonucleotide
tttgtcaaccaattccttgagggctacccgc

SEQ ID NO: 331530 - DNA, 30 bp, Artificial Sequence
  Description of Artificial Sequence: Synthetic oligonucleotide
ttgtcaaccaattccttgagggctacccgc

SEQ ID NO: 331531 - DNA, 29 bp, Artificial Sequence
  Description of Artificial Sequence: Synthetic oligonucleotide
tgtcaaccaattccttgagggctacccgc

SEQ ID NO: 331532 - DNA, 28 bp, Artificial Sequence
  Description of Artificial Sequence: Synthetic oligonucleotide
gtcaaccaattccttgagggctacccgc

SEQ ID NO: 331533 - DNA, 30 bp, Artificial Sequence
  Description of Artificial Sequence: Synthetic oligonucleotide
tcaaccaattccttgagggctacccgcaac

SEQ ID NO: 331534 - DNA, 29 bp, Artificial Sequence
  Description of Artificial Sequence: Synthetic oligonucleotide
caaccaattccttgagggctacccgcaac

SEQ ID NO: 331535 - DNA, 29 bp, Artificial Sequence
  Description of Artificial Sequence: Synthetic oligonucleotide
aaccaattccttgagggctacccgcaacc

SEQ ID NO: 331536 - DNA, 28 bp, Artificial Sequence
  Description of Artificial Sequence: Synthetic oligonucleotide
accaattccttgagggctacccgcaacc

SEQ ID NO: 331537 - DNA, 27 bp, Artificial Sequence
  Description of Artificial Sequence: Synthetic oligonucleotide
ccaattccttgagggctacccgcaacc

SEQ ID NO: 331538 - DNA, 29 bp, Artificial Sequence
  Description of Artificial Sequence: Synthetic oligonucleotide
caattccttgagggctacccgcaaccatc

SEQ ID NO: 331539 - DNA, 29 bp, Artificial Sequence
  Description of Artificial Sequence: Synthetic oligonucleotide
aattccttgagggctacccgcaaccatcg

SEQ ID NO: 331540 - DNA, 28 bp, Artificial Sequence
  Description of Artificial Sequence: Synthetic oligonucleotide
attccttgagggctacccgcaaccatcg

SEQ ID NO: 331541 - DNA, 27 bp, Artificial Sequence
  Description of Artificial Sequence: Synthetic oligonucleotide
ttccttgagggctacccgcaaccatcg

SEQ ID NO: 331542 - DNA, 26 bp, Artificial Sequence
  Description of Artificial Sequence: Synthetic oligonucleotide
tccttgagggctacccgcaaccatcg

SEQ ID NO: 331543 - DNA, 25 bp, Artificial Sequence
  Description of Artificial Sequence: Synthetic oligonucleotide
ccttgagggctacccgcaaccatcg

SEQ ID NO: 331544 - DNA, 25 bp, Artificial Sequence
  Description of Artificial Sequence: Synthetic oligonucleotide
cttgagggctacccgcaaccatcgg

SEQ ID NO: 331545 - DNA, 27 bp, Artificial Sequence
  Description of Artificial Sequence: Synthetic oligonucleotide
ttgagggctacccgcaaccatcggcaa

SEQ ID NO: 331546 - DNA, 27 bp, Artificial Sequence
  Description of Artificial Sequence: Synthetic oligonucleotide
tgagggctacccgcaaccatcggcaat

SEQ ID NO: 331547 - DNA, 26 bp, Artificial Sequence
  Description of Artificial Sequence: Synthetic oligonucleotide
gagggctacccgcaaccatcggcaat

SEQ ID NO: 331548 - DNA, 26 bp, Artificial Sequence
  Description of Artificial Sequence: Synthetic oligonucleotide
agggctacccgcaaccatcggcaatg

SEQ ID NO: 331549 - DNA, 25 bp, Artificial Sequence
  Description of Artificial Sequence: Synthetic oligonucleotide
gggctacccgcaaccatcggcaatg

SEQ ID NO: 331550 - DNA, 26 bp, Artificial Sequence
  Description of Artificial Sequence: Synthetic oligonucleotide
ggctacccgcaaccatcggcaatgga

SEQ ID NO: 331551 - DNA, 27 bp, Artificial Sequence
  Description of Artificial Sequence: Synthetic oligonucleotide
gctacccgcaaccatcggcaatggaga

SEQ ID NO: 331552 - DNA, 30 bp, Artificial Sequence
  Description of Artificial Sequence: Synthetic oligonucleotide
ctacccgcaaccatcggcaatggagaattc

SEQ ID NO: 331553 - DNA, 34 bp, Artificial Sequence
  Description of Artificial Sequence: Synthetic oligonucleotide
tacccgcaaccatcggcaatggagaattcattag

SEQ ID NO: 331554 - DNA, 33 bp, Artificial Sequence
  Description of Artificial Sequence: Synthetic oligonucleotide
acccgcaaccatcggcaatggagaattcattag

SEQ ID NO: 331555 - DNA, 32 bp, Artificial Sequence
  Description of Artificial Sequence: Synthetic oligonucleotide
cccgcaaccatcggcaatggagaattcattag

SEQ ID NO: 331556 - DNA, 32 bp, Artificial Sequence
  Description of Artificial Sequence: Synthetic oligonucleotide
ccgcaaccatcggcaatggagaattcattagc

SEQ ID NO: 331557 - DNA, 33 bp, Artificial Sequence
  Description of Artificial Sequence: Synthetic oligonucleotide
cgcaaccatcggcaatggagaattcattagctc

SEQ ID NO: 331558 - DNA, 33 bp, Artificial Sequence
  Description of Artificial Sequence: Synthetic oligonucleotide
gcaaccatcggcaatggagaattcattagctcc

SEQ ID NO: 331559 - DNA, 35 bp, Artificial Sequence
  Description of Artificial Sequence: Synthetic oligonucleotide
caaccatcggcaatggagaattcattagctccaac

SEQ ID NO: 331560 - DNA, 36 bp, Artificial Sequence
  Description of Artificial Sequence: Synthetic oligonucleotide
aaccatcggcaatggagaattcattagctccaacag

SEQ ID NO: 331561 - DNA, 35 bp, Artificial Sequence
  Description of Artificial Sequence: Synthetic oligonucleotide
accatcggcaatggagaattcattagctccaacag

SEQ ID NO: 331562 - DNA, 34 bp, Artificial Sequence
  Description of Artificial Sequence: Synthetic oligonucleotide
ccatcggcaatggagaattcattagctccaacag

SEQ ID NO: 331563 - DNA, 35 bp, Artificial Sequence
  Description of Artificial Sequence: Synthetic oligonucleotide
catcggcaatggagaattcattagctccaacagag

SEQ ID NO: 331564 - DNA, 36 bp, Artificial Sequence
  Description of Artificial Sequence: Synthetic oligonucleotide
atcggcaatggagaattcattagctccaacagagtg

SEQ ID NO: 331565 - DNA, 35 bp, Artificial Sequence
  Description of Artificial Sequence: Synthetic oligonucleotide
tcggcaatggagaattcattagctccaacagagtg

SEQ ID NO: 331566 - DNA, 34 bp, Artificial Sequence
  Description of Artificial Sequence: Synthetic oligonucleotide
cggcaatggagaattcattagctccaacagagtg

SEQ ID NO: 331567 - DNA, 40 bp, Artificial Sequence
  Description of Artificial Sequence: Synthetic oligonucleotide
ggcaatggagaattcattagctccaacagagtgaattttc

SEQ ID NO: 331568 - DNA, 41 bp, Artificial Sequence
  Description of Artificial Sequence: Synthetic oligonucleotide
gcaatggagaattcattagctccaacagagtgaattttcag

SEQ ID NO: 331569 - DNA, 44 bp, Artificial Sequence
  Description of Artificial Sequence: Synthetic oligonucleotide
caatggagaattcattagctccaacagagtgaattttcagtatg

SEQ ID NO: 331570 - DNA, 44 bp, Artificial Sequence
  Description of Artificial Sequence: Synthetic oligonucleotide
aatggagaattcattagctccaacagagtgaattttcagtatgg

SEQ ID NO: 331571 - DNA, 43 bp, Artificial Sequence
  Description of Artificial Sequence: Synthetic oligonucleotide
atggagaattcattagctccaacagagtgaattttcagtatgg

SEQ ID NO: 331572 - DNA, 42 bp, Artificial Sequence
  Description of Artificial Sequence: Synthetic oligonucleotide
tggagaattcattagctccaacagagtgaattttcagtatgg

SEQ ID NO: 331573 - DNA, 41 bp, Artificial Sequence
  Description of Artificial Sequence: Synthetic oligonucleotide
ggagaattcattagctccaacagagtgaattttcagtatgg

SEQ ID NO: 331574 - DNA, 43 bp, Artificial Sequence
  Description of Artificial Sequence: Synthetic oligonucleotide
gagaattcattagctccaacagagtgaattttcagtatggatc

SEQ ID NO: 331575 - DNA, 44 bp, Artificial Sequence
  Description of Artificial Sequence: Synthetic oligonucleotide
agaattcattagctccaacagagtgaattttcagtatggatcac

SEQ ID NO: 331576 - DNA, 43 bp, Artificial Sequence
  Description of Artificial Sequence: Synthetic oligonucleotide
gaattcattagctccaacagagtgaattttcagtatggatcac

SEQ ID NO: 331577 - DNA, 44 bp, Artificial Sequence
  Description of Artificial Sequence: Synthetic oligonucleotide
aattcattagctccaacagagtgaattttcagtatggatcactg

SEQ ID NO: 331578 - DNA, 43 bp, Artificial Sequence
  Description of Artificial Sequence: Synthetic oligonucleotide
attcattagctccaacagagtgaattttcagtatggatcactg

SEQ ID NO: 331579 - DNA, 42 bp, Artificial Sequence
  Description of Artificial Sequence: Synthetic oligonucleotide
ttcattagctccaacagagtgaattttcagtatggatcactg

SEQ ID NO: 331580 - DNA, 41 bp, Artificial Sequence
  Description of Artificial Sequence: Synthetic oligonucleotide
tcattagctccaacagagtgaattttcagtatggatcactg

SEQ ID NO: 331581 - DNA, 40 bp, Artificial Sequence
  Description of Artificial Sequence: Synthetic oligonucleotide
cattagctccaacagagtgaattttcagtatggatcactg

SEQ ID NO: 331582 - DNA, 40 bp, Artificial Sequence
  Description of Artificial Sequence: Synthetic oligonucleotide
attagctccaacagagtgaattttcagtatggatcactgg

SEQ ID NO: 331583 - DNA, 39 bp, Artificial Sequence
  Description of Artificial Sequence: Synthetic oligonucleotide
ttagctccaacagagtgaattttcagtatggatcactgg

SEQ ID NO: 331584 - DNA, 38 bp, Artificial Sequence
  Description of Artificial Sequence: Synthetic oligonucleotide
tagctccaacagagtgaattttcagtatggatcactgg

SEQ ID NO: 331585 - DNA, 37 bp, Artificial Sequence
  Description of Artificial Sequence: Synthetic oligonucleotide
agctccaacagagtgaattttcagtatggatcactgg

SEQ ID NO: 331586 - DNA, 36 bp, Artificial Sequence
  Description of Artificial Sequence: Synthetic oligonucleotide
gctccaacagagtgaattttcagtatggatcactgg

SEQ ID NO: 331587 - DNA, 37 bp, Artificial Sequence
  Description of Artificial Sequence: Synthetic oligonucleotide
ctccaacagagtgaattttcagtatggatcactggtg

SEQ ID NO: 331588 - DNA, 38 bp, Artificial Sequence
  Description of Artificial Sequence: Synthetic oligonucleotide
tccaacagagtgaattttcagtatggatcactggtgac

SEQ ID NO: 331589 - DNA, 37 bp, Artificial Sequence
  Description of Artificial Sequence: Synthetic oligonucleotide
ccaacagagtgaattttcagtatggatcactggtgac

SEQ ID NO: 331590 - DNA, 37 bp, Artificial Sequence
  Description of Artificial Sequence: Synthetic oligonucleotide
caacagagtgaattttcagtatggatcactggtgacc

SEQ ID NO: 331591 - DNA, 39 bp, Artificial Sequence
  Description of Artificial Sequence: Synthetic oligonucleotide
aacagagtgaattttcagtatggatcactggtgaccttc

SEQ ID NO: 331592 - DNA, 38 bp, Artificial Sequence
  Description of Artificial Sequence: Synthetic oligonucleotide
acagagtgaattttcagtatggatcactggtgaccttc

SEQ ID NO: 331593 - DNA, 37 bp, Artificial Sequence
  Description of Artificial Sequence: Synthetic oligonucleotide
cagagtgaattttcagtatggatcactggtgaccttc

SEQ ID NO: 331594 - DNA, 37 bp, Artificial Sequence
  Description of Artificial Sequence: Synthetic oligonucleotide
agagtgaattttcagtatggatcactggtgaccttcc

SEQ ID NO: 331595 - DNA, 36 bp, Artificial Sequence
  Description of Artificial Sequence: Synthetic oligonucleotide
gagtgaattttcagtatggatcactggtgaccttcc

SEQ ID NO: 331596 - DNA, 36 bp, Artificial Sequence
  Description of Artificial Sequence: Synthetic oligonucleotide
agtgaattttcagtatggatcactggtgaccttccg

SEQ ID NO: 331597 - DNA, 35 bp, Artificial Sequence
  Description of Artificial Sequence: Synthetic oligonucleotide
gtgaattttcagtatggatcactggtgaccttccg

SEQ ID NO: 331598 - DNA, 35 bp, Artificial Sequence
  Description of Artificial Sequence: Synthetic oligonucleotide
tgaattttcagtatggatcactggtgaccttccgc

SEQ ID NO: 331599 - DNA, 34 bp, Artificial Sequence
  Description of Artificial Sequence: Synthetic oligonucleotide
gaattttcagtatggatcactggtgaccttccgc

SEQ ID NO: 331600 - DNA, 35 bp, Artificial Sequence
  Description of Artificial Sequence: Synthetic oligonucleotide
aattttcagtatggatcactggtgaccttccgctg

SEQ ID NO: 331601 - DNA, 34 bp, Artificial Sequence
  Description of Artificial Sequence: Synthetic oligonucleotide
attttcagtatggatcactggtgaccttccgctg

SEQ ID NO: 331602 - DNA, 33 bp, Artificial Sequence
  Description of Artificial Sequence: Synthetic oligonucleotide
ttttcagtatggatcactggtgaccttccgctg

SEQ ID NO: 331603 - DNA, 32 bp, Artificial Sequence
  Description of Artificial Sequence: Synthetic oligonucleotide
tttcagtatggatcactggtgaccttccgctg

SEQ ID NO: 331604 - DNA, 31 bp, Artificial Sequence
  Description of Artificial Sequence: Synthetic oligonucleotide
ttcagtatggatcactggtgaccttccgctg

SEQ ID NO: 331605 - DNA, 30 bp, Artificial Sequence
  Description of Artificial Sequence: Synthetic oligonucleotide
tcagtatggatcactggtgaccttccgctg

SEQ ID NO: 331606 - DNA, 29 bp, Artificial Sequence
  Description of Artificial Sequence: Synthetic oligonucleotide
cagtatggatcactggtgaccttccgctg

SEQ ID NO: 331607 - DNA, 29 bp, Artificial Sequence
  Description of Artificial Sequence: Synthetic oligonucleotide
agtatggatcactggtgaccttccgctgc

SEQ ID NO: 331608 - DNA, 28 bp, Artificial Sequence
  Description of Artificial Sequence: Synthetic oligonucleotide
gtatggatcactggtgaccttccgctgc

SEQ ID NO: 331609 - DNA, 31 bp, Artificial Sequence
  Description of Artificial Sequence: Synthetic oligonucleotide
tatggatcactggtgaccttccgctgcaaac

SEQ ID NO: 331610 - DNA, 30 bp, Artificial Sequence
  Description of Artificial Sequence: Synthetic oligonucleotide
atggatcactggtgaccttccgctgcaaac

SEQ ID NO: 331611 - DNA, 29 bp, Artificial Sequence
  Description of Artificial Sequence: Synthetic oligonucleotide
tggatcactggtgaccttccgctgcaaac

SEQ ID NO: 331612 - DNA, 28 bp, Artificial Sequence
  Description of Artificial Sequence: Synthetic oligonucleotide
ggatcactggtgaccttccgctgcaaac

SEQ ID NO: 331613 - DNA, 30 bp, Artificial Sequence
  Description of Artificial Sequence: Synthetic oligonucleotide
gatcactggtgaccttccgctgcaaacttg

SEQ ID NO: 331614 - DNA, 30 bp, Artificial Sequence
  Description of Artificial Sequence: Synthetic oligonucleotide
atcactggtgaccttccgctgcaaacttgg

SEQ ID NO: 331615 - DNA, 29 bp, Artificial Sequence
  Description of Artificial Sequence: Synthetic oligonucleotide
tcactggtgaccttccgctgcaaacttgg

SEQ ID NO: 331616 - DNA, 28 bp, Artificial Sequence
  Description of Artificial Sequence: Synthetic oligonucleotide
cactggtgaccttccgctgcaaacttgg

SEQ ID NO: 331617 - DNA, 30 bp, Artificial Sequence
  Description of Artificial Sequence: Synthetic oligonucleotide
actggtgaccttccgctgcaaacttggaag

SEQ ID NO: 331618 - DNA, 29 bp, Artificial Sequence
  Description of Artificial Sequence: Synthetic oligonucleotide
ctggtgaccttccgctgcaaacttggaag

SEQ ID NO: 331619 - DNA, 29 bp, Artificial Sequence
  Description of Artificial Sequence: Synthetic oligonucleotide
tggtgaccttccgctgcaaacttggaagc

SEQ ID NO: 331620 - DNA, 28 bp, Artificial Sequence
  Description of Artificial Sequence: Synthetic oligonucleotide
ggtgaccttccgctgcaaacttggaagc

SEQ ID NO: 331621 - DNA, 29 bp, Artificial Sequence
  Description of Artificial Sequence: Synthetic oligonucleotide
gtgaccttccgctgcaaacttggaagctg

SEQ ID NO: 331622 - DNA, 30 bp, Artificial Sequence
  Description of Artificial Sequence: Synthetic oligonucleotide
tgaccttccgctgcaaacttggaagctgag

SEQ ID NO: 331623 - DNA, 29 bp, Artificial Sequence
  Description of Artificial Sequence: Synthetic oligonucleotide
gaccttccgctgcaaacttggaagctgag

SEQ ID NO: 331624 - DNA, 29 bp, Artificial Sequence
  Description of Artificial Sequence: Synthetic oligonucleotide
accttccgctgcaaacttggaagctgagg

SEQ ID NO: 331625 - DNA, 28 bp, Artificial Sequence
  Description of Artificial Sequence: Synthetic oligonucleotide
ccttccgctgcaaacttggaagctgagg

SEQ ID NO: 331626 - DNA, 28 bp, Artificial Sequence
  Description of Artificial Sequence: Synthetic oligonucleotide
cttccgctgcaaacttggaagctgaggg

SEQ ID NO: 331627 - DNA, 29 bp, Artificial Sequence
  Description of Artificial Sequence: Synthetic oligonucleotide
ttccgctgcaaacttggaagctgagggag

SEQ ID NO: 331628 - DNA, 28 bp, Artificial Sequence
  Description of Artificial Sequence: Synthetic oligonucleotide
tccgctgcaaacttggaagctgagggag

SEQ ID NO: 331629 - DNA, 27 bp, Artificial Sequence
  Description of Artificial Sequence: Synthetic oligonucleotide
ccgctgcaaacttggaagctgagggag

SEQ ID NO: 331630 - DNA, 30 bp, Artificial Sequence
  Description of Artificial Sequence: Synthetic oligonucleotide
cgctgcaaacttggaagctgagggagaatg

SEQ ID NO: 331631 - DNA, 30 bp, Artificial Sequence
  Description of Artificial Sequence: Synthetic oligonucleotide
gctgcaaacttggaagctgagggagaatgg

SEQ ID NO: 331632 - DNA, 31 bp, Artificial Sequence
  Description of Artificial Sequence: Synthetic oligonucleotide
ctgcaaacttggaagctgagggagaatggtg

SEQ ID NO: 331633 - DNA, 34 bp, Artificial Sequence
  Description of Artificial Sequence: Synthetic oligonucleotide
tgcaaacttggaagctgagggagaatggtgtttg

SEQ ID NO: 331634 - DNA, 33 bp, Artificial Sequence
  Description of Artificial Sequence: Synthetic oligonucleotide
gcaaacttggaagctgagggagaatggtgtttg

SEQ ID NO: 331635 - DNA, 34 bp, Artificial Sequence
  Description of Artificial Sequence: Synthetic oligonucleotide
caaacttggaagctgagggagaatggtgtttgac

SEQ ID NO: 331636 - DNA, 34 bp, Artificial Sequence
  Description of Artificial Sequence: Synthetic oligonucleotide
aaacttggaagctgagggagaatggtgtttgacc

SEQ ID NO: 331637 - DNA, 33 bp, Artificial Sequence
  Description of Artificial Sequence: Synthetic oligonucleotide
aacttggaagctgagggagaatggtgtttgacc

SEQ ID NO: 331638 - DNA, 32 bp, Artificial Sequence
  Description of Artificial Sequence: Synthetic oligonucleotide
acttggaagctgagggagaatggtgtttgacc

SEQ ID NO: 331639 - DNA, 31 bp, Artificial Sequence
  Description of Artificial Sequence: Synthetic oligonucleotide
cttggaagctgagggagaatggtgtttgacc

SEQ ID NO: 331640 - DNA, 33 bp, Artificial Sequence
  Description of Artificial Sequence: Synthetic oligonucleotide
ttggaagctgagggagaatggtgtttgaccttg

SEQ ID NO: 331641 - DNA, 32 bp, Artificial Sequence
  Description of Artificial Sequence: Synthetic oligonucleotide
tggaagctgagggagaatggtgtttgaccttg

SEQ ID NO: 331642 - DNA, 31 bp, Artificial Sequence
  Description of Artificial Sequence: Synthetic oligonucleotide
ggaagctgagggagaatggtgtttgaccttg

SEQ ID NO: 331643 - DNA, 32 bp, Artificial Sequence
  Description of Artificial Sequence: Synthetic oligonucleotide
gaagctgagggagaatggtgtttgaccttgtg

SEQ ID NO: 331644 - DNA, 32 bp, Artificial Sequence
  Description of Artificial Sequence: Synthetic oligonucleotide
aagctgagggagaatggtgtttgaccttgtgg

SEQ ID NO: 331645 - DNA, 31 bp, Artificial Sequence
  Description of Artificial Sequence: Synthetic oligonucleotide
agctgagggagaatggtgtttgaccttgtgg

SEQ ID NO: 331646 - DNA, 30 bp, Artificial Sequence
  Description of Artificial Sequence: Synthetic oligonucleotide
gctgagggagaatggtgtttgaccttgtgg

SEQ ID NO: 331647 - DNA, 30 bp, Artificial Sequence
  Description of Artificial Sequence: Synthetic oligonucleotide
ctgagggagaatggtgtttgaccttgtggg

SEQ ID NO: 331648 - DNA, 31 bp, Artificial Sequence
  Description of Artificial Sequence: Synthetic oligonucleotide
tgagggagaatggtgtttgaccttgtgggtc

SEQ ID NO: 331649 - DNA, 30 bp, Artificial Sequence
  Description of Artificial Sequence: Synthetic oligonucleotide
gagggagaatggtgtttgaccttgtgggtc

SEQ ID NO: 331650 - DNA, 31 bp, Artificial Sequence
  Description of Artificial Sequence: Synthetic oligonucleotide
agggagaatggtgtttgaccttgtgggtcag

SEQ ID NO: 331651 - DNA, 30 bp, Artificial Sequence
  Description of Artificial Sequence: Synthetic oligonucleotide
gggagaatggtgtttgaccttgtgggtcag

SEQ ID NO: 331652 - DNA, 30 bp, Artificial Sequence
  Description of Artificial Sequence: Synthetic oligonucleotide
ggagaatggtgtttgaccttgtgggtcagc

SEQ ID NO: 331653 - DNA, 30 bp, Artificial Sequence
  Description of Artificial Sequence: Synthetic oligonucleotide
gagaatggtgtttgaccttgtgggtcagcc

SEQ ID NO: 331654 - DNA, 30 bp, Artificial Sequence
  Description of Artificial Sequence: Synthetic oligonucleotide
agaatggtgtttgaccttgtgggtcagccc

SEQ ID NO: 331655 - DNA, 29 bp, Artificial Sequence
  Description of Artificial Sequence: Synthetic oligonucleotide
gaatggtgtttgaccttgtgggtcagccc

SEQ ID NO: 331656 - DNA, 30 bp, Artificial Sequence
  Description of Artificial Sequence: Synthetic oligonucleotide
aatggtgtttgaccttgtgggtcagccctc

SEQ ID NO: 331657 - DNA, 29 bp, Artificial Sequence
  Description of Artificial Sequence: Synthetic oligonucleotide
atggtgtttgaccttgtgggtcagccctc

SEQ ID NO: 331658 - DNA, 28 bp, Artificial Sequence
  Description of Artificial Sequence: Synthetic oligonucleotide
tggtgtttgaccttgtgggtcagccctc

SEQ ID NO: 331659 - DNA, 27 bp, Artificial Sequence
  Description of Artificial Sequence: Synthetic oligonucleotide
ggtgtttgaccttgtgggtcagccctc

SEQ ID NO: 331660 - DNA, 27 bp, Artificial Sequence
  Description of Artificial Sequence: Synthetic oligonucleotide
gtgtttgaccttgtgggtcagccctcc

SEQ ID NO: 331661 - DNA, 32 bp, Artificial Sequence
  Description of Artificial Sequence: Synthetic oligonucleotide
tgtttgaccttgtgggtcagccctccaaatac

SEQ ID NO: 331662 - DNA, 31 bp, Artificial Sequence
  Description of Artificial Sequence: Synthetic oligonucleotide
gtttgaccttgtgggtcagccctccaaatac

SEQ ID NO: 331663 - DNA, 32 bp, Artificial Sequence
  Description of Artificial Sequence: Synthetic oligonucleotide
tttgaccttgtgggtcagccctccaaatactg

SEQ ID NO: 331664 - DNA, 31 bp, Artificial Sequence
  Description of Artificial Sequence: Synthetic oligonucleotide
ttgaccttgtgggtcagccctccaaatactg

SEQ ID NO: 331665 - DNA, 30 bp, Artificial Sequence
  Description of Artificial Sequence: Synthetic oligonucleotide
tgaccttgtgggtcagccctccaaatactg

SEQ ID NO: 331666 - DNA, 29 bp, Artificial Sequence
  Description of Artificial Sequence: Synthetic oligonucleotide
gaccttgtgggtcagccctccaaatactg

SEQ ID NO: 331667 - DNA, 29 bp, Artificial Sequence
  Description of Artificial Sequence: Synthetic oligonucleotide
accttgtgggtcagccctccaaatactgc

SEQ ID NO: 331668 - DNA, 28 bp, Artificial Sequence
  Description of Artificial Sequence: Synthetic oligonucleotide
ccttgtgggtcagccctccaaatactgc

SEQ ID NO: 331669 - DNA, 29 bp, Artificial Sequence
  Description of Artificial Sequence: Synthetic oligonucleotide
cttgtgggtcagccctccaaatactgcac

SEQ ID NO: 331670 - DNA, 29 bp, Artificial Sequence
  Description of Artificial Sequence: Synthetic oligonucleotide
ttgtgggtcagccctccaaatactgcacg

SEQ ID NO: 331671 - DNA, 28 bp, Artificial Sequence
  Description of Artificial Sequence: Synthetic oligonucleotide
tgtgggtcagccctccaaatactgcacg

SEQ ID NO: 331672 - DNA, 27 bp, Artificial Sequence
  Description of Artificial Sequence: Synthetic oligonucleotide
gtgggtcagccctccaaatactgcacg

SEQ ID NO: 331673 - DNA, 28 bp, Artificial Sequence
  Description of Artificial Sequence: Synthetic oligonucleotide
tgggtcagccctccaaatactgcacgag

SEQ ID NO: 331674 - DNA, 27 bp, Artificial Sequence
  Description of Artificial Sequence: Synthetic oligonucleotide
gggtcagccctccaaatactgcacgag

SEQ ID NO: 331675 - DNA, 27 bp, Artificial Sequence
  Description of Artificial Sequence: Synthetic oligonucleotide
ggtcagccctccaaatactgcacgagc

SEQ ID NO: 331676 - DNA, 30 bp, Artificial Sequence
  Description of Artificial Sequence: Synthetic oligonucleotide
gtcagccctccaaatactgcacgagcaatg

SEQ ID NO: 331677 - DNA, 31 bp, Artificial Sequence
  Description of Artificial Sequence: Synthetic oligonucleotide
tcagccctccaaatactgcacgagcaatgac

SEQ ID NO: 331678 - DNA, 30 bp, Artificial Sequence
  Description of Artificial Sequence: Synthetic oligonucleotide
cagccctccaaatactgcacgagcaatgac

SEQ ID NO: 331679 - DNA, 30 bp, Artificial Sequence
  Description of Artificial Sequence: Synthetic oligonucleotide
agccctccaaatactgcacgagcaatgacc

SEQ ID NO: 331680 - DNA, 29 bp, Artificial Sequence
  Description of Artificial Sequence: Synthetic oligonucleotide
gccctccaaatactgcacgagcaatgacc

SEQ ID NO: 331681 - DNA, 31 bp, Artificial Sequence
  Description of Artificial Sequence: Synthetic oligonucleotide
ccctccaaatactgcacgagcaatgaccatc

SEQ ID NO: 331682 - DNA, 33 bp, Artificial Sequence
  Description of Artificial Sequence: Synthetic oligonucleotide
cctccaaatactgcacgagcaatgaccatcaag

SEQ ID NO: 331683 - DNA, 34 bp, Artificial Sequence
  Description of Artificial Sequence: Synthetic oligonucleotide
ctccaaatactgcacgagcaatgaccatcaagtg

SEQ ID NO: 331684 - DNA, 34 bp, Artificial Sequence
  Description of Artificial Sequence: Synthetic oligonucleotide
tccaaatactgcacgagcaatgaccatcaagtgg

SEQ ID NO: 331685 - DNA, 33 bp, Artificial Sequence
  Description of Artificial Sequence: Synthetic oligonucleotide
ccaaatactgcacgagcaatgaccatcaagtgg

SEQ ID NO: 331686 - DNA, 33 bp, Artificial Sequence
  Description of Artificial Sequence: Synthetic oligonucleotide
caaatactgcacgagcaatgaccatcaagtggc

SEQ ID NO: 331687 - DNA, 33 bp, Artificial Sequence
  Description of Artificial Sequence: Synthetic oligonucleotide
aaatactgcacgagcaatgaccatcaagtggcc

SEQ ID NO: 331688 - DNA, 32 bp, Artificial Sequence
  Description of Artificial Sequence: Synthetic oligonucleotide
aatactgcacgagcaatgaccatcaagtggcc

SEQ ID NO: 331689 - DNA, 31 bp, Artificial Sequence
  Description of Artificial Sequence: Synthetic oligonucleotide
atactgcacgagcaatgaccatcaagtggcc

SEQ ID NO: 331690 - DNA, 30 bp, Artificial Sequence
  Description of Artificial Sequence: Synthetic oligonucleotide
tactgcacgagcaatgaccatcaagtggcc

SEQ ID NO: 331691 - DNA, 29 bp, Artificial Sequence
  Description of Artificial Sequence: Synthetic oligonucleotide
actgcacgagcaatgaccatcaagtggcc

SEQ ID NO: 331692 - DNA, 28 bp, Artificial Sequence
  Description of Artificial Sequence: Synthetic oligonucleotide
ctgcacgagcaatgaccatcaagtggcc

SEQ ID NO: 331693 - DNA, 30 bp, Artificial Sequence
  Description of Artificial Sequence: Synthetic oligonucleotide
tgcacgagcaatgaccatcaagtggccatc

SEQ ID NO: 331694 - DNA, 29 bp, Artificial Sequence
  Description of Artificial Sequence: Synthetic oligonucleotide
gcacgagcaatgaccatcaagtggccatc

SEQ ID NO: 331695 - DNA, 30 bp, Artificial Sequence
  Description of Artificial Sequence: Synthetic oligonucleotide
cacgagcaatgaccatcaagtggccatctg

SEQ ID NO: 331696 - DNA, 30 bp, Artificial Sequence
  Description of Artificial Sequence: Synthetic oligonucleotide
acgagcaatgaccatcaagtggccatctgg

SEQ ID NO: 331697 - DNA, 29 bp, Artificial Sequence
  Description of Artificial Sequence: Synthetic oligonucleotide
cgagcaatgaccatcaagtggccatctgg

SEQ ID NO: 331698 - DNA, 30 bp, Artificial Sequence
  Description of Artificial Sequence: Synthetic oligonucleotide
gagcaatgaccatcaagtggccatctggag

SEQ ID NO: 331699 - DNA, 30 bp, Artificial Sequence
  Description of Artificial Sequence: Synthetic oligonucleotide
agcaatgaccatcaagtggccatctggagg

SEQ ID NO: 331700 - DNA, 29 bp, Artificial Sequence
  Description of Artificial Sequence: Synthetic oligonucleotide
gcaatgaccatcaagtggccatctggagg

SEQ ID NO: 331701 - DNA, 29 bp, Artificial Sequence
  Description of Artificial Sequence: Synthetic oligonucleotide
caatgaccatcaagtggccatctggaggg

SEQ ID NO: 331702 - DNA, 29 bp, Artificial Sequence
  Description of Artificial Sequence: Synthetic oligonucleotide
aatgaccatcaagtggccatctggagggg

SEQ ID NO: 331703 - DNA, 28 bp, Artificial Sequence
  Description of Artificial Sequence: Synthetic oligonucleotide
atgaccatcaagtggccatctggagggg

SEQ ID NO: 331704 - DNA, 27 bp, Artificial Sequence
  Description of Artificial Sequence: Synthetic oligonucleotide
tgaccatcaagtggccatctggagggg

SEQ ID NO: 331705 - DNA, 26 bp, Artificial Sequence
  Description of Artificial Sequence: Synthetic oligonucleotide
gaccatcaagtggccatctggagggg

SEQ ID NO: 331706 - DNA, 26 bp, Artificial Sequence
  Description of Artificial Sequence: Synthetic oligonucleotide
accatcaagtggccatctggaggggc

SEQ ID NO: 331707 - DNA, 25 bp, Artificial Sequence
  Description of Artificial Sequence: Synthetic oligonucleotide
ccatcaagtggccatctggaggggc

SEQ ID NO: 331708 - DNA, 25 bp, Artificial Sequence
  Description of Artificial Sequence: Synthetic oligonucleotide
catcaagtggccatctggaggggcc

SEQ ID NO: 331709 - DNA, 25 bp, Artificial Sequence
  Description of Artificial Sequence: Synthetic oligonucleotide
atcaagtggccatctggaggggccc

SEQ ID NO: 331710 - DNA, 24 bp, Artificial Sequence
  Description of Artificial Sequence: Synthetic oligonucleotide
tcaagtggccatctggaggggccc

SEQ ID NO: 331711 - DNA, 23 bp, Artificial Sequence
  Description of Artificial Sequence: Synthetic oligonucleotide
caagtggccatctggaggggccc

SEQ ID NO: 331712 - DNA, 23 bp, Artificial Sequence
  Description of Artificial Sequence: Synthetic oligonucleotide
aagtggccatctggaggggcccc

SEQ ID NO: 331713 - DNA, 22 bp, Artificial Sequence
  Description of Artificial Sequence: Synthetic oligonucleotide
agtggccatctggaggggcccc

SEQ ID NO: 331714 - DNA, 21 bp, Artificial Sequence
  Description of Artificial Sequence: Synthetic oligonucleotide
gtggccatctggaggggcccc

SEQ ID NO: 331715 - DNA, 21 bp, Artificial Sequence
  Description of Artificial Sequence: Synthetic oligonucleotide
tggccatctggaggggccccg

SEQ ID NO: 331716 - DNA, 20 bp, Artificial Sequence
  Description of Artificial Sequence: Synthetic oligonucleotide
ggccatctggaggggccccg

SEQ ID NO: 331717 - DNA, 20 bp, Artificial Sequence
  Description of Artificial Sequence: Synthetic oligonucleotide
gccatctggaggggccccgc

SEQ ID NO: 331718 - DNA, 20 bp, Artificial Sequence
  Description of Artificial Sequence: Synthetic oligonucleotide
ccatctggaggggccccgcc

SEQ ID NO: 331719 - DNA, 20 bp, Artificial Sequence
  Description of Artificial Sequence: Synthetic oligonucleotide
catctggaggggccccgccg

SEQ ID NO: 331720 - DNA, 21 bp, Artificial Sequence
  Description of Artificial Sequence: Synthetic oligonucleotide
atctggaggggccccgccgct

SEQ ID NO: 331721 - DNA, 20 bp, Artificial Sequence
  Description of Artificial Sequence: Synthetic oligonucleotide
tctggaggggccccgccgct

SEQ ID NO: 331722 - DNA, 20 bp, Artificial Sequence
  Description of Artificial Sequence: Synthetic oligonucleotide
ctggaggggccccgccgctt

SEQ ID NO: 331723 - DNA, 20 bp, Artificial Sequence
  Description of Artificial Sequence: Synthetic oligonucleotide
tggaggggccccgccgctca

SEQ ID NO: 331724 - DNA, 20 bp, Artificial Sequence
  Description of Artificial Sequence: Synthetic oligonucleotide
ggaggggccccgccgctcat

SEQ ID NO: 331725 - DNA, 20 bp, Artificial Sequence
  Description of Artificial Sequence: Synthetic oligonucleotide
gaggggccccgccgctcagt

SEQ ID NO: 331726 - DNA, 20 bp, Artificial Sequence
  Description of Artificial Sequence: Synthetic oligonucleotide
aggggccccgccgctcagtg

SEQ ID NO: 331727 - DNA, 20 bp, Artificial Sequence
  Description of Artificial Sequence: Synthetic oligonucleotide
ggggccccgccgctcagtgt

SEQ ID NO: 331728 - DNA, 25 bp, Artificial Sequence
  Description of Artificial Sequence: Synthetic oligonucleotide
gggccccgccgctcagtgcaatata

SEQ ID NO: 331729 - DNA, 25 bp, Artificial Sequence
  Description of Artificial Sequence: Synthetic oligonucleotide
ggccccgccgctcagtgcaatatac

SEQ ID NO: 331730 - DNA, 27 bp, Artificial Sequence
  Description of Artificial Sequence: Synthetic oligonucleotide
gccccgccgctcagtgcaatataccta

SEQ ID NO: 331731 - DNA, 28 bp, Artificial Sequence
  Description of Artificial Sequence: Synthetic oligonucleotide
ccccgccgctcagtgcaatatacctaag

SEQ ID NO: 331732 - DNA, 32 bp, Artificial Sequence
  Description of Artificial Sequence: Synthetic oligonucleotide
cccgccgctcagtgcaatatacctaagaaatg

SEQ ID NO: 331733 - DNA, 32 bp, Artificial Sequence
  Description of Artificial Sequence: Synthetic oligonucleotide
ccgccgctcagtgcaatatacctaagaaatgc

SEQ ID NO: 331734 - DNA, 33 bp, Artificial Sequence
  Description of Artificial Sequence: Synthetic oligonucleotide
cgccgctcagtgcaatatacctaagaaatgcac

SEQ ID NO: 331735 - DNA, 33 bp, Artificial Sequence
  Description of Artificial Sequence: Synthetic oligonucleotide
gccgctcagtgcaatatacctaagaaatgcacg

SEQ ID NO: 331736 - DNA, 33 bp, Artificial Sequence
  Description of Artificial Sequence: Synthetic oligonucleotide
ccgctcagtgcaatatacctaagaaatgcacgg

SEQ ID NO: 331737 - DNA, 33 bp, Artificial Sequence
  Description of Artificial Sequence: Synthetic oligonucleotide
cgctcagtgcaatatacctaagaaatgcacggc

SEQ ID NO: 331738 - DNA, 34 bp, Artificial Sequence
  Description of Artificial Sequence: Synthetic oligonucleotide
gctcagtgcaatatacctaagaaatgcacggctc

SEQ ID NO: 331739 - DNA, 34 bp, Artificial Sequence
  Description of Artificial Sequence: Synthetic oligonucleotide
ctcagtgcaatatacctaagaaatgcacggctcc

SEQ ID NO: 331740 - DNA, 38 bp, Artificial Sequence
  Description of Artificial Sequence: Synthetic oligonucleotide
tcagtgcaatatacctaagaaatgcacggctccaaatg

SEQ ID NO: 331741 - DNA, 37 bp, Artificial Sequence
  Description of Artificial Sequence: Synthetic oligonucleotide
cagtgcaatatacctaagaaatgcacggctccaaatg

SEQ ID NO: 331742 - DNA, 38 bp, Artificial Sequence
  Description of Artificial Sequence: Synthetic oligonucleotide
agtgcaatatacctaagaaatgcacggctccaaatgag

SEQ ID NO: 331743 - DNA, 37 bp, Artificial Sequence
  Description of Artificial Sequence: Synthetic oligonucleotide
gtgcaatatacctaagaaatgcacggctccaaatgag

SEQ ID NO: 331744 - DNA, 37 bp, Artificial Sequence
  Description of Artificial Sequence: Synthetic oligonucleotide
tgcaatatacctaagaaatgcacggctccaaatgagg

SEQ ID NO: 331745 - DNA, 36 bp, Artificial Sequence
  Description of Artificial Sequence: Synthetic oligonucleotide
gcaatatacctaagaaatgcacggctccaaatgagg

SEQ ID NO: 331746 - DNA, 41 bp, Artificial Sequence
  Description of Artificial Sequence: Synthetic oligonucleotide
caatatacctaagaaatgcacggctccaaatgaggaaaatg

SEQ ID NO: 331747 - DNA, 41 bp, Artificial Sequence
  Description of Artificial Sequence: Synthetic oligonucleotide
aatatacctaagaaatgcacggctccaaatgaggaaaatgg

SEQ ID NO: 331748 - DNA, 40 bp, Artificial Sequence
  Description of Artificial Sequence: Synthetic oligonucleotide
atatacctaagaaatgcacggctccaaatgaggaaaatgg

SEQ ID NO: 331749 - DNA, 39 bp, Artificial Sequence
  Description of Artificial Sequence: Synthetic oligonucleotide
tatacctaagaaatgcacggctccaaatgaggaaaatgg

SEQ ID NO: 331750 - DNA, 38 bp, Artificial Sequence
  Description of Artificial Sequence: Synthetic oligonucleotide
atacctaagaaatgcacggctccaaatgaggaaaatgg

SEQ ID NO: 331751 - DNA, 37 bp, Artificial Sequence
  Description of Artificial Sequence: Synthetic oligonucleotide
tacctaagaaatgcacggctccaaatgaggaaaatgg

SEQ ID NO: 331752 - DNA, 36 bp, Artificial Sequence
  Description of Artificial Sequence: Synthetic oligonucleotide
acctaagaaatgcacggctccaaatgaggaaaatgg

SEQ ID NO: 331753 - DNA, 35 bp, Artificial Sequence
  Description of Artificial Sequence: Synthetic oligonucleotide
cctaagaaatgcacggctccaaatgaggaaaatgg

SEQ ID NO: 331754 - DNA, 41 bp, Artificial Sequence
  Description of Artificial Sequence: Synthetic oligonucleotide
ctaagaaatgcacggctccaaatgaggaaaatggtatattg

SEQ ID NO: 331755 - DNA, 41 bp, Artificial Sequence
  Description of Artificial Sequence: Synthetic oligonucleotide
taagaaatgcacggctccaaatgaggaaaatggtatattgg

SEQ ID NO: 331756 - DNA, 40 bp, Artificial Sequence
  Description of Artificial Sequence: Synthetic oligonucleotide
aagaaatgcacggctccaaatgaggaaaatggtatattgg

SEQ ID NO: 331757 - DNA, 39 bp, Artificial Sequence
  Description of Artificial Sequence: Synthetic oligonucleotide
agaaatgcacggctccaaatgaggaaaatggtatattgg

SEQ ID NO: 331758 - DNA, 38 bp, Artificial Sequence
  Description of Artificial Sequence: Synthetic oligonucleotide
gaaatgcacggctccaaatgaggaaaatggtatattgg

SEQ ID NO: 331759 - DNA, 41 bp, Artificial Sequence
  Description of Artificial Sequence: Synthetic oligonucleotide
aaatgcacggctccaaatgaggaaaatggtatattggtaac

SEQ ID NO: 331760 - DNA, 40 bp, Artificial Sequence
  Description of Artificial Sequence: Synthetic oligonucleotide
aatgcacggctccaaatgaggaaaatggtatattggtaac

SEQ ID NO: 331761 - DNA, 39 bp, Artificial Sequence
  Description of Artificial Sequence: Synthetic oligonucleotide
atgcacggctccaaatgaggaaaatggtatattggtaac

SEQ ID NO: 331762 - DNA, 38 bp, Artificial Sequence
  Description of Artificial Sequence: Synthetic oligonucleotide
tgcacggctccaaatgaggaaaatggtatattggtaac

SEQ ID NO: 331763 - DNA, 37 bp, Artificial Sequence
  Description of Artificial Sequence: Synthetic oligonucleotide
gcacggctccaaatgaggaaaatggtatattggtaac

SEQ ID NO: 331764 - DNA, 38 bp, Artificial Sequence
  Description of Artificial Sequence: Synthetic oligonucleotide
cacggctccaaatgaggaaaatggtatattggtaactg

SEQ ID NO: 331765 - DNA, 39 bp, Artificial Sequence
  Description of Artificial Sequence: Synthetic oligonucleotide
acggctccaaatgaggaaaatggtatattggtaactgac

SEQ ID NO: 331766 - DNA, 38 bp, Artificial Sequence
  Description of Artificial Sequence: Synthetic oligonucleotide
cggctccaaatgaggaaaatggtatattggtaactgac

SEQ ID NO: 331767 - DNA, 40 bp, Artificial Sequence
  Description of Artificial Sequence: Synthetic oligonucleotide
ggctccaaatgaggaaaatggtatattggtaactgacaac

SEQ ID NO: 331768 - DNA, 41 bp, Artificial Sequence
  Description of Artificial Sequence: Synthetic oligonucleotide
gctccaaatgaggaaaatggtatattggtaactgacaacac

SEQ ID NO: 331769 - DNA, 43 bp, Artificial Sequence
  Description of Artificial Sequence: Synthetic oligonucleotide
ctccaaatgaggaaaatggtatattggtaactgacaacacaag

SEQ ID NO: 331770 - DNA, 43 bp, Artificial Sequence
  Description of Artificial Sequence: Synthetic oligonucleotide
tccaaatgaggaaaatggtatattggtaactgacaacacaagc

SEQ ID NO: 331771 - DNA, 42 bp, Artificial Sequence
  Description of Artificial Sequence: Synthetic oligonucleotide
ccaaatgaggaaaatggtatattggtaactgacaacacaagc

SEQ ID NO: 331772 - DNA, 49 bp, Artificial Sequence
  Description of Artificial Sequence: Synthetic oligonucleotide
caaatgaggaaaatggtatattggtaactgacaacacaagcttattatc

SEQ ID NO: 331773 - DNA, 49 bp, Artificial Sequence
  Description of Artificial Sequence: Synthetic oligonucleotide
aaatgaggaaaatggtatattggtaactgacaacacaagcttattatcc

SEQ ID NO: 331774 - DNA, 48 bp, Artificial Sequence
  Description of Artificial Sequence: Synthetic oligonucleotide
aatgaggaaaatggtatattggtaactgacaacacaagcttattatcc

SEQ ID NO: 331775 - DNA, 47 bp, Artificial Sequence
  Description of Artificial Sequence: Synthetic oligonucleotide
atgaggaaaatggtatattggtaactgacaacacaagcttattatcc

SEQ ID NO: 331776 - DNA, 46 bp, Artificial Sequence
  Description of Artificial Sequence: Synthetic oligonucleotide
tgaggaaaatggtatattggtaactgacaacacaagcttattatcc

SEQ ID NO: 331777 - DNA, 45 bp, Artificial Sequence
  Description of Artificial Sequence: Synthetic oligonucleotide
gaggaaaatggtatattggtaactgacaacacaagcttattatcc

SEQ ID NO: 331778 - DNA, 51 bp, Artificial Sequence
  Description of Artificial Sequence: Synthetic oligonucleotide
aggaaaatggtatattggtaactgacaacacaagcttattatccttaaatc

SEQ ID NO: 331779 - DNA, 50 bp, Artificial Sequence
  Description of Artificial Sequence: Synthetic oligonucleotide
ggaaaatggtatattggtaactgacaacacaagcttattatccttaaatc

SEQ ID NO: 331780 - DNA, 52 bp, Artificial Sequence
  Description of Artificial Sequence: Synthetic oligonucleotide
gaaaatggtatattggtaactgacaacacaagcttattatccttaaatcaag

SEQ ID NO: 331781 - DNA, 54 bp, Artificial Sequence
  Description of Artificial Sequence: Synthetic oligonucleotide
aaaatggtatattggtaactgacaacacaagcttattatccttaaatcaagttg

SEQ ID NO: 331782 - DNA, 53 bp, Artificial Sequence
  Description of Artificial Sequence: Synthetic oligonucleotide
aaatggtatattggtaactgacaacacaagcttattatccttaaatcaagttg

SEQ ID NO: 331783 - DNA, 52 bp, Artificial Sequence
  Description of Artificial Sequence: Synthetic oligonucleotide
aatggtatattggtaactgacaacacaagcttattatccttaaatcaagttg

SEQ ID NO: 331784 - DNA, 51 bp, Artificial Sequence
  Description of Artificial Sequence: Synthetic oligonucleotide
atggtatattggtaactgacaacacaagcttattatccttaaatcaagttg

SEQ ID NO: 331785 - DNA, 50 bp, Artificial Sequence
  Description of Artificial Sequence: Synthetic oligonucleotide
tggtatattggtaactgacaacacaagcttattatccttaaatcaagttg

SEQ ID NO: 331786 - DNA, 49 bp, Artificial Sequence
  Description of Artificial Sequence: Synthetic oligonucleotide
ggtatattggtaactgacaacacaagcttattatccttaaatcaagttg

SEQ ID NO: 331787 - DNA, 50 bp, Artificial Sequence
  Description of Artificial Sequence: Synthetic oligonucleotide
gtatattggtaactgacaacacaagcttattatccttaaatcaagttgtg

SEQ ID NO: 331788 - DNA, 50 bp, Artificial Sequence
  Description of Artificial Sequence: Synthetic oligonucleotide
tatattggtaactgacaacacaagcttattatccttaaatcaagttgtgg

SEQ ID NO: 331789 - DNA, 49 bp, Artificial Sequence
  Description of Artificial Sequence: Synthetic oligonucleotide
atattggtaactgacaacacaagcttattatccttaaatcaagttgtgg

SEQ ID NO: 331790 - DNA, 48 bp, Artificial Sequence
  Description of Artificial Sequence: Synthetic oligonucleotide
tattggtaactgacaacacaagcttattatccttaaatcaagttgtgg

SEQ ID NO: 331791 - DNA, 47 bp, Artificial Sequence
  Description of Artificial Sequence: Synthetic oligonucleotide
attggtaactgacaacacaagcttattatccttaaatcaagttgtgg

SEQ ID NO: 331792 - DNA, 46 bp, Artificial Sequence
  Description of Artificial Sequence: Synthetic oligonucleotide
ttggtaactgacaacacaagcttattatccttaaatcaagttgtgg

SEQ ID NO: 331793 - DNA, 45 bp, Artificial Sequence
  Description of Artificial Sequence: Synthetic oligonucleotide
tggtaactgacaacacaagcttattatccttaaatcaagttgtgg

SEQ ID NO: 331794 - DNA, 44 bp, Artificial Sequence
  Description of Artificial Sequence: Synthetic oligonucleotide
ggtaactgacaacacaagcttattatccttaaatcaagttgtgg

SEQ ID NO: 331795 - DNA, 45 bp, Artificial Sequence
  Description of Artificial Sequence: Synthetic oligonucleotide
gtaactgacaacacaagcttattatccttaaatcaagttgtggtg

SEQ ID NO: 331796 - DNA, 49 bp, Artificial Sequence
  Description of Artificial Sequence: Synthetic oligonucleotide
taactgacaacacaagcttattatccttaaatcaagttgtggtgtttag

SEQ ID NO: 331797 - DNA, 48 bp, Artificial Sequence
  Description of Artificial Sequence: Synthetic oligonucleotide
aactgacaacacaagcttattatccttaaatcaagttgtggtgtttag

SEQ ID NO: 331798 - DNA, 47 bp, Artificial Sequence
  Description of Artificial Sequence: Synthetic oligonucleotide
actgacaacacaagcttattatccttaaatcaagttgtggtgtttag

SEQ ID NO: 331799 - DNA, 46 bp, Artificial Sequence
  Description of Artificial Sequence: Synthetic oligonucleotide
ctgacaacacaagcttattatccttaaatcaagttgtggtgtttag

SEQ ID NO: 331800 - DNA, 46 bp, Artificial Sequence
  Description of Artificial Sequence: Synthetic oligonucleotide
tgacaacacaagcttattatccttaaatcaagttgtggtgtttagg

SEQ ID NO: 331801 - DNA, 45 bp, Artificial Sequence
  Description of Artificial Sequence: Synthetic oligonucleotide
gacaacacaagcttattatccttaaatcaagttgtggtgtttagg

SEQ ID NO: 331802 - DNA, 46 bp, Artificial Sequence
  Description of Artificial Sequence: Synthetic oligonucleotide
acaacacaagcttattatccttaaatcaagttgtggtgtttaggtg

SEQ ID NO: 331803 - DNA, 45 bp, Artificial Sequence
  Description of Artificial Sequence: Synthetic oligonucleotide
caacacaagcttattatccttaaatcaagttgtggtgtttaggtg

SEQ ID NO: 331804 - DNA, 46 bp, Artificial Sequence
  Description of Artificial Sequence: Synthetic oligonucleotide
aacacaagcttattatccttaaatcaagttgtggtgtttaggtgac

SEQ ID NO: 331805 - DNA, 45 bp, Artificial Sequence
  Description of Artificial Sequence: Synthetic oligonucleotide
acacaagcttattatccttaaatcaagttgtggtgtttaggtgac

SEQ ID NO: 331806 - DNA, 44 bp, Artificial Sequence
  Description of Artificial Sequence: Synthetic oligonucleotide
cacaagcttattatccttaaatcaagttgtggtgtttaggtgac

SEQ ID NO: 331807 - DNA, 45 bp, Artificial Sequence
  Description of Artificial Sequence: Synthetic oligonucleotide
acaagcttattatccttaaatcaagttgtggtgtttaggtgacag

SEQ ID NO: 331808 - DNA, 44 bp, Artificial Sequence
  Description of Artificial Sequence: Synthetic oligonucleotide
caagcttattatccttaaatcaagttgtggtgtttaggtgacag

SEQ ID NO: 331809 - DNA, 44 bp, Artificial Sequence
  Description of Artificial Sequence: Synthetic oligonucleotide
aagcttattatccttaaatcaagttgtggtgtttaggtgacagc

SEQ ID NO: 331810 - DNA, 43 bp, Artificial Sequence
  Description of Artificial Sequence: Synthetic oligonucleotide
agcttattatccttaaatcaagttgtggtgtttaggtgacagc

SEQ ID NO: 331811 - DNA, 42 bp, Artificial Sequence
  Description of Artificial Sequence: Synthetic oligonucleotide
gcttattatccttaaatcaagttgtggtgtttaggtgacagc

SEQ ID NO: 331812 - DNA, 42 bp, Artificial Sequence
  Description of Artificial Sequence: Synthetic oligonucleotide
cttattatccttaaatcaagttgtggtgtttaggtgacagcc

SEQ ID NO: 331813 - DNA, 43 bp, Artificial Sequence
  Description of Artificial Sequence: Synthetic oligonucleotide
ttattatccttaaatcaagttgtggtgtttaggtgacagcctg

SEQ ID NO: 331814 - DNA, 42 bp, Artificial Sequence
  Description of Artificial Sequence: Synthetic oligonucleotide
tattatccttaaatcaagttgtggtgtttaggtgacagcctg

SEQ ID NO: 331815 - DNA, 41 bp, Artificial Sequence
  Description of Artificial Sequence: Synthetic oligonucleotide
attatccttaaatcaagttgtggtgtttaggtgacagcctg

SEQ ID NO: 331816 - DNA, 40 bp, Artificial Sequence
  Description of Artificial Sequence: Synthetic oligonucleotide
ttatccttaaatcaagttgtggtgtttaggtgacagcctg

SEQ ID NO: 331817 - DNA, 39 bp, Artificial Sequence
  Description of Artificial Sequence: Synthetic oligonucleotide
tatccttaaatcaagttgtggtgtttaggtgacagcctg

SEQ ID NO: 331818 - DNA, 38 bp, Artificial Sequence
  Description of Artificial Sequence: Synthetic oligonucleotide
atccttaaatcaagttgtggtgtttaggtgacagcctg

SEQ ID NO: 331819 - DNA, 37 bp, Artificial Sequence
  Description of Artificial Sequence: Synthetic oligonucleotide
tccttaaatcaagttgtggtgtttaggtgacagcctg

SEQ ID NO: 331820 - DNA, 36 bp, Artificial Sequence
  Description of Artificial Sequence: Synthetic oligonucleotide
ccttaaatcaagttgtggtgtttaggtgacagcctg

SEQ ID NO: 331821 - DNA, 36 bp, Artificial Sequence
  Description of Artificial Sequence: Synthetic oligonucleotide
cttaaatcaagttgtggtgtttaggtgacagcctgg

SEQ ID NO: 331822 - DNA, 36 bp, Artificial Sequence
  Description of Artificial Sequence: Synthetic oligonucleotide
ttaaatcaagttgtggtgtttaggtgacagcctggc

SEQ ID NO: 331823 - DNA, 35 bp, Artificial Sequence
  Description of Artificial Sequence: Synthetic oligonucleotide
taaatcaagttgtggtgtttaggtgacagcctggc

SEQ ID NO: 331824 - DNA, 34 bp, Artificial Sequence
  Description of Artificial Sequence: Synthetic oligonucleotide
aaatcaagttgtggtgtttaggtgacagcctggc

SEQ ID NO: 331825 - DNA, 33 bp, Artificial Sequence
  Description of Artificial Sequence: Synthetic oligonucleotide
aatcaagttgtggtgtttaggtgacagcctggc

SEQ ID NO: 331826 - DNA, 32 bp, Artificial Sequence
  Description of Artificial Sequence: Synthetic oligonucleotide
atcaagttgtggtgtttaggtgacagcctggc

SEQ ID NO: 331827 - DNA, 31 bp, Artificial Sequence
  Description of Artificial Sequence: Synthetic oligonucleotide
tcaagttgtggtgtttaggtgacagcctggc

SEQ ID NO: 331828 - DNA, 30 bp, Artificial Sequence
  Description of Artificial Sequence: Synthetic oligonucleotide
caagttgtggtgtttaggtgacagcctggc

SEQ ID NO: 331829 - DNA, 33 bp, Artificial Sequence
  Description of Artificial Sequence: Synthetic oligonucleotide
aagttgtggtgtttaggtgacagcctggcattg

SEQ ID NO: 331830 - DNA, 32 bp, Artificial Sequence
  Description of Artificial Sequence: Synthetic oligonucleotide
agttgtggtgtttaggtgacagcctggcattg

SEQ ID NO: 331831 - DNA, 31 bp, Artificial Sequence
  Description of Artificial Sequence: Synthetic oligonucleotide
gttgtggtgtttaggtgacagcctggcattg

SEQ ID NO: 331832 - DNA, 32 bp, Artificial Sequence
  Description of Artificial Sequence: Synthetic oligonucleotide
ttgtggtgtttaggtgacagcctggcattgtc

SEQ ID NO: 331833 - DNA, 31 bp, Artificial Sequence
  Description of Artificial Sequence: Synthetic oligonucleotide
tgtggtgtttaggtgacagcctggcattgtc

SEQ ID NO: 331834 - DNA, 30 bp, Artificial Sequence
  Description of Artificial Sequence: Synthetic oligonucleotide
gtggtgtttaggtgacagcctggcattgtc

SEQ ID NO: 331835 - DNA, 32 bp, Artificial Sequence
  Description of Artificial Sequence: Synthetic oligonucleotide
tggtgtttaggtgacagcctggcattgtcatg

SEQ ID NO: 331836 - DNA, 31 bp, Artificial Sequence
  Description of Artificial Sequence: Synthetic oligonucleotide
ggtgtttaggtgacagcctggcattgtcatg

SEQ ID NO: 331837 - DNA, 34 bp, Artificial Sequence
  Description of Artificial Sequence: Synthetic oligonucleotide
gtgtttaggtgacagcctggcattgtcatgatag

SEQ ID NO: 331838 - DNA, 34 bp, Artificial Sequence
  Description of Artificial Sequence: Synthetic oligonucleotide
tgtttaggtgacagcctggcattgtcatgatagg

SEQ ID NO: 331839 - DNA, 33 bp, Artificial Sequence
  Description of Artificial Sequence: Synthetic oligonucleotide
gtttaggtgacagcctggcattgtcatgatagg

SEQ ID NO: 331840 - DNA, 34 bp, Artificial Sequence
  Description of Artificial Sequence: Synthetic oligonucleotide
tttaggtgacagcctggcattgtcatgataggac

SEQ ID NO: 331841 - DNA, 33 bp, Artificial Sequence
  Description of Artificial Sequence: Synthetic oligonucleotide
ttaggtgacagcctggcattgtcatgataggac

SEQ ID NO: 331842 - DNA, 32 bp, Artificial Sequence
  Description of Artificial Sequence: Synthetic oligonucleotide
taggtgacagcctggcattgtcatgataggac

SEQ ID NO: 331843 - DNA, 31 bp, Artificial Sequence
  Description of Artificial Sequence: Synthetic oligonucleotide
aggtgacagcctggcattgtcatgataggac

SEQ ID NO: 331844 - DNA, 30 bp, Artificial Sequence
  Description of Artificial Sequence: Synthetic oligonucleotide
ggtgacagcctggcattgtcatgataggac

SEQ ID NO: 331845 - DNA, 30 bp, Artificial Sequence
  Description of Artificial Sequence: Synthetic oligonucleotide
gtgacagcctggcattgtcatgataggacc

SEQ ID NO: 331846 - DNA, 30 bp, Artificial Sequence
  Description of Artificial Sequence: Synthetic oligonucleotide
tgacagcctggcattgtcatgataggaccc

SEQ ID NO: 331847 - DNA, 29 bp, Artificial Sequence
  Description of Artificial Sequence: Synthetic oligonucleotide
gacagcctggcattgtcatgataggaccc

SEQ ID NO: 331848 - DNA, 29 bp, Artificial Sequence
  Description of Artificial Sequence: Synthetic oligonucleotide
acagcctggcattgtcatgataggacccc

SEQ ID NO: 331849 - DNA, 28 bp, Artificial Sequence
  Description of Artificial Sequence: Synthetic oligonucleotide
cagcctggcattgtcatgataggacccc

SEQ ID NO: 331850 - DNA, 28 bp, Artificial Sequence
  Description of Artificial Sequence: Synthetic oligonucleotide
agcctggcattgtcatgataggaccccg

SEQ ID NO: 331851 - DNA, 27 bp, Artificial Sequence
  Description of Artificial Sequence: Synthetic oligonucleotide
gcctggcattgtcatgataggaccccg

SEQ ID NO: 331852 - DNA, 27 bp, Artificial Sequence
  Description of Artificial Sequence: Synthetic oligonucleotide
cctggcattgtcatgataggaccccgg

SEQ ID NO: 331853 - DNA, 27 bp, Artificial Sequence
  Description of Artificial Sequence: Synthetic oligonucleotide
ctggcattgtcatgataggaccccggc

SEQ ID NO: 331854 - DNA, 27 bp, Artificial Sequence
  Description of Artificial Sequence: Synthetic oligonucleotide
tggcattgtcatgataggaccccggcg

SEQ ID NO: 331855 - DNA, 27 bp, Artificial Sequence
  Description of Artificial Sequence: Synthetic oligonucleotide
ggcattgtcatgataggaccccggcgt

SEQ ID NO: 331856 - DNA, 27 bp, Artificial Sequence
  Description of Artificial Sequence: Synthetic oligonucleotide
gcattgtcatgataggaccccggcgtg

SEQ ID NO: 331857 - DNA, 28 bp, Artificial Sequence
  Description of Artificial Sequence: Synthetic oligonucleotide
cattgtcatgataggaccccggcgtgtg

SEQ ID NO: 331858 - DNA, 30 bp, Artificial Sequence
  Description of Artificial Sequence: Synthetic oligonucleotide
attgtcatgataggaccccggcgtgtgaag

SEQ ID NO: 331859 - DNA, 29 bp, Artificial Sequence
  Description of Artificial Sequence: Synthetic oligonucleotide
ttgtcatgataggaccccggcgtgtgaag

SEQ ID NO: 331860 - DNA, 28 bp, Artificial Sequence
  Description of Artificial Sequence: Synthetic oligonucleotide
tgtcatgataggaccccggcgtgtgaag

SEQ ID NO: 331861 - DNA, 27 bp, Artificial Sequence
  Description of Artificial Sequence: Synthetic oligonucleotide
gtcatgataggaccccggcgtgtgaag

SEQ ID NO: 331862 - DNA, 28 bp, Artificial Sequence
  Description of Artificial Sequence: Synthetic oligonucleotide
tcatgataggaccccggcgtgtgaagag

SEQ ID NO: 331863 - DNA, 27 bp, Artificial Sequence
  Description of Artificial Sequence: Synthetic oligonucleotide
catgataggaccccggcgtgtgaagag

SEQ ID NO: 331864 - DNA, 27 bp, Artificial Sequence
  Description of Artificial Sequence: Synthetic oligonucleotide
atgataggaccccggcgtgtgaagagc

SEQ ID NO: 331865 - DNA, 26 bp, Artificial Sequence
  Description of Artificial Sequence: Synthetic oligonucleotide
tgataggaccccggcgtgtgaagagc

SEQ ID NO: 331866 - DNA, 25 bp, Artificial Sequence
  Description of Artificial Sequence: Synthetic oligonucleotide
gataggaccccggcgtgtgaagagc

SEQ ID NO: 331867 - DNA, 26 bp, Artificial Sequence
  Description of Artificial Sequence: Synthetic oligonucleotide
ataggaccccggcgtgtgaagagcca

SEQ ID NO: 331868 - DNA, 25 bp, Artificial Sequence
  Description of Artificial Sequence: Synthetic oligonucleotide
taggaccccggcgtgtgaagagcca

SEQ ID NO: 331869 - DNA, 24 bp, Artificial Sequence
  Description of Artificial Sequence: Synthetic oligonucleotide
aggaccccggcgtgtgaagagcca

SEQ ID NO: 331870 - DNA, 23 bp, Artificial Sequence
  Description of Artificial Sequence: Synthetic oligonucleotide
ggaccccggcgtgtgaagagcca

SEQ ID NO: 331871 - DNA, 23 bp, Artificial Sequence
  Description of Artificial Sequence: Synthetic oligonucleotide
gaccccggcgtgtgaagagccag

SEQ ID NO: 331872 - DNA, 23 bp, Artificial Sequence
  Description of Artificial Sequence: Synthetic oligonucleotide
accccggcgtgtgaagagccagg

SEQ ID NO: 331873 - DNA, 22 bp, Artificial Sequence
  Description of Artificial Sequence: Synthetic oligonucleotide
ccccggcgtgtgaagagccagg

SEQ ID NO: 331874 - DNA, 22 bp, Artificial Sequence
  Description of Artificial Sequence: Synthetic oligonucleotide
cccggcgtgtgaagagccaggc

SEQ ID NO: 331875 - DNA, 22 bp, Artificial Sequence
  Description of Artificial Sequence: Synthetic oligonucleotide
ccggcgtgtgaagagccaggcc

SEQ ID NO: 331876 - DNA, 23 bp, Artificial Sequence
  Description of Artificial Sequence: Synthetic oligonucleotide
cggcgtgtgaagagccaggccca

SEQ ID NO: 331877 - DNA, 25 bp, Artificial Sequence
  Description of Artificial Sequence: Synthetic oligonucleotide
ggcgtgtgaagagccaggcccagaa

SEQ ID NO: 331878 - DNA, 27 bp, Artificial Sequence
  Description of Artificial Sequence: Synthetic oligonucleotide
gcgtgtgaagagccaggcccagaacaa

SEQ ID NO: 331879 - DNA, 29 bp, Artificial Sequence
  Description of Artificial Sequence: Synthetic oligonucleotide
cgtgtgaagagccaggcccagaacaaatg

SEQ ID NO: 331880 - DNA, 29 bp, Artificial Sequence
  Description of Artificial Sequence: Synthetic oligonucleotide
gtgtgaagagccaggcccagaacaaatgc

SEQ ID NO: 331881 - DNA, 29 bp, Artificial Sequence
  Description of Artificial Sequence: Synthetic oligonucleotide
tgtgaagagccaggcccagaacaaatgcg

SEQ ID NO: 331882 - DNA, 28 bp, Artificial Sequence
  Description of Artificial Sequence: Synthetic oligonucleotide
gtgaagagccaggcccagaacaaatgcg

SEQ ID NO: 331883 - DNA, 29 bp, Artificial Sequence
  Description of Artificial Sequence: Synthetic oligonucleotide
tgaagagccaggcccagaacaaatgcgag

SEQ ID NO: 331884 - DNA, 28 bp, Artificial Sequence
  Description of Artificial Sequence: Synthetic oligonucleotide
gaagagccaggcccagaacaaatgcgag

SEQ ID NO: 331885 - DNA, 28 bp, Artificial Sequence
  Description of Artificial Sequence: Synthetic oligonucleotide
aagagccaggcccagaacaaatgcgagc

SEQ ID NO: 331886 - DNA, 27 bp, Artificial Sequence
  Description of Artificial Sequence: Synthetic oligonucleotide
agagccaggcccagaacaaatgcgagc

SEQ ID NO: 331887 - DNA, 26 bp, Artificial Sequence
  Description of Artificial Sequence: Synthetic oligonucleotide
gagccaggcccagaacaaatgcgagc

SEQ ID NO: 331888 - DNA, 27 bp, Artificial Sequence
  Description of Artificial Sequence: Synthetic oligonucleotide
agccaggcccagaacaaatgcgagcca

SEQ ID NO: 331889 - DNA, 26 bp, Artificial Sequence
  Description of Artificial Sequence: Synthetic oligonucleotide
gccaggcccagaacaaatgcgagcca

SEQ ID NO: 331890 - DNA, 27 bp, Artificial Sequence
  Description of Artificial Sequence: Synthetic oligonucleotide
ccaggcccagaacaaatgcgagccaga

SEQ ID NO: 331891 - DNA, 27 bp, Artificial Sequence
  Description of Artificial Sequence: Synthetic oligonucleotide
caggcccagaacaaatgcgagccagag

SEQ ID NO: 331892 - DNA, 30 bp, Artificial Sequence
  Description of Artificial Sequence: Synthetic oligonucleotide
aggcccagaacaaatgcgagccagagatac

SEQ ID NO: 331893 - DNA, 29 bp, Artificial Sequence
  Description of Artificial Sequence: Synthetic oligonucleotide
ggcccagaacaaatgcgagccagagatac

SEQ ID NO: 331894 - DNA, 29 bp, Artificial Sequence
  Description of Artificial Sequence: Synthetic oligonucleotide
gcccagaacaaatgcgagccagagatacc

SEQ ID NO: 331895 - DNA, 31 bp, Artificial Sequence
  Description of Artificial Sequence: Synthetic oligonucleotide
cccagaacaaatgcgagccagagataccaag

SEQ ID NO: 331896 - DNA, 31 bp, Artificial Sequence
  Description of Artificial Sequence: Synthetic oligonucleotide
ccagaacaaatgcgagccagagataccaagc

SEQ ID NO: 331897 - DNA, 32 bp, Artificial Sequence
  Description of Artificial Sequence: Synthetic oligonucleotide
cagaacaaatgcgagccagagataccaagctc

SEQ ID NO: 331898 - DNA, 32 bp, Artificial Sequence
  Description of Artificial Sequence: Synthetic oligonucleotide
agaacaaatgcgagccagagataccaagctcc

SEQ ID NO: 331899 - DNA, 31 bp, Artificial Sequence
  Description of Artificial Sequence: Synthetic oligonucleotide
gaacaaatgcgagccagagataccaagctcc

SEQ ID NO: 331900 - DNA, 32 bp, Artificial Sequence
  Description of Artificial Sequence: Synthetic oligonucleotide
aacaaatgcgagccagagataccaagctcctc

SEQ ID NO: 331901 - DNA, 31 bp, Artificial Sequence
  Description of Artificial Sequence: Synthetic oligonucleotide
acaaatgcgagccagagataccaagctcctc

SEQ ID NO: 331902 - DNA, 30 bp, Artificial Sequence
  Description of Artificial Sequence: Synthetic oligonucleotide
caaatgcgagccagagataccaagctcctc

SEQ ID NO: 331903 - DNA, 30 bp, Artificial Sequence
  Description of Artificial Sequence: Synthetic oligonucleotide
aaatgcgagccagagataccaagctcctcc

SEQ ID NO: 331904 - DNA, 29 bp, Artificial Sequence
  Description of Artificial Sequence: Synthetic oligonucleotide
aatgcgagccagagataccaagctcctcc

SEQ ID NO: 331905 - DNA, 28 bp, Artificial Sequence
  Description of Artificial Sequence: Synthetic oligonucleotide
atgcgagccagagataccaagctcctcc

SEQ ID NO: 331906 - DNA, 27 bp, Artificial Sequence
  Description of Artificial Sequence: Synthetic oligonucleotide
tgcgagccagagataccaagctcctcc

SEQ ID NO: 331907 - DNA, 27 bp, Artificial Sequence
  Description of Artificial Sequence: Synthetic oligonucleotide
gcgagccagagataccaagctcctcca

SEQ ID NO: 331908 - DNA, 27 bp, Artificial Sequence
  Description of Artificial Sequence: Synthetic oligonucleotide
cgagccagagataccaagctcctccag

SEQ ID NO: 331909 - DNA, 27 bp, Artificial Sequence
  Description of Artificial Sequence: Synthetic oligonucleotide
gagccagagataccaagctcctccagg

SEQ ID NO: 331910 - DNA, 27 bp, Artificial Sequence
  Description of Artificial Sequence: Synthetic oligonucleotide
agccagagataccaagctcctccaggg

SEQ ID NO: 331911 - DNA, 27 bp, Artificial Sequence
  Description of Artificial Sequence: Synthetic oligonucleotide
gccagagataccaagctcctccagggt

SEQ ID NO: 331912 - DNA, 27 bp, Artificial Sequence
  Description of Artificial Sequence: Synthetic oligonucleotide
ccagagataccaagctcctccagggtc

SEQ ID NO: 331913 - DNA, 28 bp, Artificial Sequence
  Description of Artificial Sequence: Synthetic oligonucleotide
cagagataccaagctcctccagggtctg

SEQ ID NO: 331914 - DNA, 29 bp, Artificial Sequence
  Description of Artificial Sequence: Synthetic oligonucleotide
agagataccaagctcctccagggtctgtc

SEQ ID NO: 331915 - DNA, 28 bp, Artificial Sequence
  Description of Artificial Sequence: Synthetic oligonucleotide
gagataccaagctcctccagggtctgtc

SEQ ID NO: 331916 - DNA, 29 bp, Artificial Sequence
  Description of Artificial Sequence: Synthetic oligonucleotide
agataccaagctcctccagggtctgtcag

SEQ ID NO: 331917 - DNA, 28 bp, Artificial Sequence
  Description of Artificial Sequence: Synthetic oligonucleotide
gataccaagctcctccagggtctgtcag

SEQ ID NO: 331918 - DNA, 28 bp, Artificial Sequence
  Description of Artificial Sequence: Synthetic oligonucleotide
ataccaagctcctccagggtctgtcagc

SEQ ID NO: 331919 - DNA, 27 bp, Artificial Sequence
  Description of Artificial Sequence: Synthetic oligonucleotide
taccaagctcctccagggtctgtcagc

SEQ ID NO: 331920 - DNA, 26 bp, Artificial Sequence
  Description of Artificial Sequence: Synthetic oligonucleotide
accaagctcctccagggtctgtcagc

SEQ ID NO: 331921 - DNA, 25 bp, Artificial Sequence
  Description of Artificial Sequence: Synthetic oligonucleotide
ccaagctcctccagggtctgtcagc

SEQ ID NO: 331922 - DNA, 25 bp, Artificial Sequence
  Description of Artificial Sequence: Synthetic oligonucleotide
caagctcctccagggtctgtcagcc

SEQ ID NO: 331923 - DNA, 25 bp, Artificial Sequence
  Description of Artificial Sequence: Synthetic oligonucleotide
aagctcctccagggtctgtcagccg

SEQ ID NO: 331924 - DNA, 24 bp, Artificial Sequence
  Description of Artificial Sequence: Synthetic oligonucleotide
agctcctccagggtctgtcagccg

SEQ ID NO: 331925 - DNA, 23 bp, Artificial Sequence
  Description of Artificial Sequence: Synthetic oligonucleotide
gctcctccagggtctgtcagccg

SEQ ID NO: 331926 - DNA, 23 bp, Artificial Sequence
  Description of Artificial Sequence: Synthetic oligonucleotide
ctcctccagggtctgtcagccgg

SEQ ID NO: 331927 - DNA, 24 bp, Artificial Sequence
  Description of Artificial Sequence: Synthetic oligonucleotide
tcctccagggtctgtcagccggct

SEQ ID NO: 331928 - DNA, 23 bp, Artificial Sequence
  Description of Artificial Sequence: Synthetic oligonucleotide
cctccagggtctgtcagccggct

SEQ ID NO: 331929 - DNA, 23 bp, Artificial Sequence
  Description of Artificial Sequence: Synthetic oligonucleotide
ctccagggtctgtcagccggctc

SEQ ID NO: 331930 - DNA, 24 bp, Artificial Sequence
  Description of Artificial Sequence: Synthetic oligonucleotide
tccagggtctgtcagccggctcca

SEQ ID NO: 331931 - DNA, 23 bp, Artificial Sequence
  Description of Artificial Sequence: Synthetic oligonucleotide
ccagggtctgtcagccggctcca

SEQ ID NO: 331932 - DNA, 27 bp, Artificial Sequence
  Description of Artificial Sequence: Synthetic oligonucleotide
cagggtctgtcagccggctccagaaaa

SEQ ID NO: 331933 - DNA, 27 bp, Artificial Sequence
  Description of Artificial Sequence: Synthetic oligonucleotide
agggtctgtcagccggctccagaaaac

SEQ ID NO: 331934 - DNA, 26 bp, Artificial Sequence
  Description of Artificial Sequence: Synthetic oligonucleotide
gggtctgtcagccggctccagaaaac

SEQ ID NO: 331935 - DNA, 27 bp, Artificial Sequence
  Description of Artificial Sequence: Synthetic oligonucleotide
ggtctgtcagccggctccagaaaacct

SEQ ID NO: 331936 - DNA, 27 bp, Artificial Sequence
  Description of Artificial Sequence: Synthetic oligonucleotide
gtctgtcagccggctccagaaaacctg

SEQ ID NO: 331937 - DNA, 27 bp, Artificial Sequence
  Description of Artificial Sequence: Synthetic oligonucleotide
tctgtcagccggctccagaaaacctgc

SEQ ID NO: 331938 - DNA, 27 bp, Artificial Sequence
  Description of Artificial Sequence: Synthetic oligonucleotide
ctgtcagccggctccagaaaacctgca

SEQ ID NO: 331939 - DNA, 28 bp, Artificial Sequence
  Description of Artificial Sequence: Synthetic oligonucleotide
tgtcagccggctccagaaaacctgcatg

SEQ ID NO: 331940 - DNA, 27 bp, Artificial Sequence
  Description of Artificial Sequence: Synthetic oligonucleotide
gtcagccggctccagaaaacctgcatg

SEQ ID NO: 331941 - DNA, 27 bp, Artificial Sequence
  Description of Artificial Sequence: Synthetic oligonucleotide
tcagccggctccagaaaacctgcatgg

SEQ ID NO: 331942 - DNA, 27 bp, Artificial Sequence
  Description of Artificial Sequence: Synthetic oligonucleotide
cagccggctccagaaaacctgcatgga

SEQ ID NO: 331943 - DNA, 27 bp, Artificial Sequence
  Description of Artificial Sequence: Synthetic oligonucleotide
agccggctccagaaaacctgcatggag

SEQ ID NO: 331944 - DNA, 27 bp, Artificial Sequence
  Description of Artificial Sequence: Synthetic oligonucleotide
gccggctccagaaaacctgcatggaga

SEQ ID NO: 331945 - DNA, 27 bp, Artificial Sequence
  Description of Artificial Sequence: Synthetic oligonucleotide
ccggctccagaaaacctgcatggagag

SEQ ID NO: 331946 - DNA, 27 bp, Artificial Sequence
  Description of Artificial Sequence: Synthetic oligonucleotide
cggctccagaaaacctgcatggagagc

SEQ ID NO: 331947 - DNA, 30 bp, Artificial Sequence
  Description of Artificial Sequence: Synthetic oligonucleotide
ggctccagaaaacctgcatggagagcatac

SEQ ID NO: 331948 - DNA, 30 bp, Artificial Sequence
  Description of Artificial Sequence: Synthetic oligonucleotide
gctccagaaaacctgcatggagagcatacc

SEQ ID NO: 331949 - DNA, 30 bp, Artificial Sequence
  Description of Artificial Sequence: Synthetic oligonucleotide
ctccagaaaacctgcatggagagcataccg

SEQ ID NO: 331950 - DNA, 30 bp, Artificial Sequence
  Description of Artificial Sequence: Synthetic oligonucleotide
tccagaaaacctgcatggagagcataccgc

SEQ ID NO: 331951 - DNA, 29 bp, Artificial Sequence
  Description of Artificial Sequence: Synthetic oligonucleotide
ccagaaaacctgcatggagagcataccgc

SEQ ID NO: 331952 - DNA, 31 bp, Artificial Sequence
  Description of Artificial Sequence: Synthetic oligonucleotide
cagaaaacctgcatggagagcataccgcaag

SEQ ID NO: 331953 - DNA, 31 bp, Artificial Sequence
  Description of Artificial Sequence: Synthetic oligonucleotide
agaaaacctgcatggagagcataccgcaagc

SEQ ID NO: 331954 - DNA, 30 bp, Artificial Sequence
  Description of Artificial Sequence: Synthetic oligonucleotide
gaaaacctgcatggagagcataccgcaagc

SEQ ID NO: 331955 - DNA, 30 bp, Artificial Sequence
  Description of Artificial Sequence: Synthetic oligonucleotide
aaaacctgcatggagagcataccgcaagcc

SEQ ID NO: 331956 - DNA, 29 bp, Artificial Sequence
  Description of Artificial Sequence: Synthetic oligonucleotide
aaacctgcatggagagcataccgcaagcc

SEQ ID NO: 331957 - DNA, 28 bp, Artificial Sequence
  Description of Artificial Sequence: Synthetic oligonucleotide
aacctgcatggagagcataccgcaagcc

SEQ ID NO: 331958 - DNA, 27 bp, Artificial Sequence
  Description of Artificial Sequence: Synthetic oligonucleotide
acctgcatggagagcataccgcaagcc

SEQ ID NO: 331959 - DNA, 27 bp, Artificial Sequence
  Description of Artificial Sequence: Synthetic oligonucleotide
cctgcatggagagcataccgcaagcca

SEQ ID NO: 331960 - DNA, 28 bp, Artificial Sequence
  Description of Artificial Sequence: Synthetic oligonucleotide
ctgcatggagagcataccgcaagccatc

SEQ ID NO: 331961 - DNA, 29 bp, Artificial Sequence
  Description of Artificial Sequence: Synthetic oligonucleotide
tgcatggagagcataccgcaagccatctg

SEQ ID NO: 331962 - DNA, 28 bp, Artificial Sequence
  Description of Artificial Sequence: Synthetic oligonucleotide
gcatggagagcataccgcaagccatctg

SEQ ID NO: 331963 - DNA, 28 bp, Artificial Sequence
  Description of Artificial Sequence: Synthetic oligonucleotide
catggagagcataccgcaagccatctgg

SEQ ID NO: 331964 - DNA, 29 bp, Artificial Sequence
  Description of Artificial Sequence: Synthetic oligonucleotide
atggagagcataccgcaagccatctggac

SEQ ID NO: 331965 - DNA, 28 bp, Artificial Sequence
  Description of Artificial Sequence: Synthetic oligonucleotide
tggagagcataccgcaagccatctggac

SEQ ID NO: 331966 - DNA, 27 bp, Artificial Sequence
  Description of Artificial Sequence: Synthetic oligonucleotide
ggagagcataccgcaagccatctggac

SEQ ID NO: 331967 - DNA, 29 bp, Artificial Sequence
  Description of Artificial Sequence: Synthetic oligonucleotide
gagagcataccgcaagccatctggacaac

SEQ ID NO: 331968 - DNA, 33 bp, Artificial Sequence
  Description of Artificial Sequence: Synthetic oligonucleotide
agagcataccgcaagccatctggacaacttatc

SEQ ID NO: 331969 - DNA, 32 bp, Artificial Sequence
  Description of Artificial Sequence: Synthetic oligonucleotide
gagcataccgcaagccatctggacaacttatc

SEQ ID NO: 331970 - DNA, 33 bp, Artificial Sequence
  Description of Artificial Sequence: Synthetic oligonucleotide
agcataccgcaagccatctggacaacttatcac

SEQ ID NO: 331971 - DNA, 32 bp, Artificial Sequence
  Description of Artificial Sequence: Synthetic oligonucleotide
gcataccgcaagccatctggacaacttatcac

SEQ ID NO: 331972 - DNA, 32 bp, Artificial Sequence
  Description of Artificial Sequence: Synthetic oligonucleotide
cataccgcaagccatctggacaacttatcacc

SEQ ID NO: 331973 - DNA, 33 bp, Artificial Sequence
  Description of Artificial Sequence: Synthetic oligonucleotide
ataccgcaagccatctggacaacttatcacctg

SEQ ID NO: 331974 - DNA, 32 bp, Artificial Sequence
  Description of Artificial Sequence: Synthetic oligonucleotide
taccgcaagccatctggacaacttatcacctg

SEQ ID NO: 331975 - DNA, 31 bp, Artificial Sequence
  Description of Artificial Sequence: Synthetic oligonucleotide
accgcaagccatctggacaacttatcacctg

SEQ ID NO: 331976 - DNA, 30 bp, Artificial Sequence
  Description of Artificial Sequence: Synthetic oligonucleotide
ccgcaagccatctggacaacttatcacctg

SEQ ID NO: 331977 - DNA, 30 bp, Artificial Sequence
  Description of Artificial Sequence: Synthetic oligonucleotide
cgcaagccatctggacaacttatcacctgg

SEQ ID NO: 331978 - DNA, 30 bp, Artificial Sequence
  Description of Artificial Sequence: Synthetic oligonucleotide
gcaagccatctggacaacttatcacctggg

SEQ ID NO: 331979 - DNA, 30 bp, Artificial Sequence
  Description of Artificial Sequence: Synthetic oligonucleotide
caagccatctggacaacttatcacctgggg

SEQ ID NO: 331980 - DNA, 31 bp, Artificial Sequence
  Description of Artificial Sequence: Synthetic oligonucleotide
aagccatctggacaacttatcacctggggag

SEQ ID NO: 331981 - DNA, 30 bp, Artificial Sequence
  Description of Artificial Sequence: Synthetic oligonucleotide
agccatctggacaacttatcacctggggag

SEQ ID NO: 331982 - DNA, 29 bp, Artificial Sequence
  Description of Artificial Sequence: Synthetic oligonucleotide
gccatctggacaacttatcacctggggag

SEQ ID NO: 331983 - DNA, 29 bp, Artificial Sequence
  Description of Artificial Sequence: Synthetic oligonucleotide
ccatctggacaacttatcacctggggagg

SEQ ID NO: 331984 - DNA, 31 bp, Artificial Sequence
  Description of Artificial Sequence: Synthetic oligonucleotide
catctggacaacttatcacctggggaggaag

SEQ ID NO: 331985 - DNA, 32 bp, Artificial Sequence
  Description of Artificial Sequence: Synthetic oligonucleotide
atctggacaacttatcacctggggaggaagtg

SEQ ID NO: 331986 - DNA, 31 bp, Artificial Sequence
  Description of Artificial Sequence: Synthetic oligonucleotide
tctggacaacttatcacctggggaggaagtg

SEQ ID NO: 331987 - DNA, 30 bp, Artificial Sequence
  Description of Artificial Sequence: Synthetic oligonucleotide
ctggacaacttatcacctggggaggaagtg

SEQ ID NO: 331988 - DNA, 32 bp, Artificial Sequence
  Description of Artificial Sequence: Synthetic oligonucleotide
tggacaacttatcacctggggaggaagtgtac

SEQ ID NO: 331989 - DNA, 31 bp, Artificial Sequence
  Description of Artificial Sequence: Synthetic oligonucleotide
ggacaacttatcacctggggaggaagtgtac

SEQ ID NO: 331990 - DNA, 33 bp, Artificial Sequence
  Description of Artificial Sequence: Synthetic oligonucleotide
gacaacttatcacctggggaggaagtgtactac

SEQ ID NO: 331991 - DNA, 34 bp, Artificial Sequence
  Description of Artificial Sequence: Synthetic oligonucleotide
acaacttatcacctggggaggaagtgtactacag

SEQ ID NO: 331992 - DNA, 33 bp, Artificial Sequence
  Description of Artificial Sequence: Synthetic oligonucleotide
caacttatcacctggggaggaagtgtactacag

SEQ ID NO: 331993 - DNA, 33 bp, Artificial Sequence
  Description of Artificial Sequence: Synthetic oligonucleotide
aacttatcacctggggaggaagtgtactacagc

SEQ ID NO: 331994 - DNA, 32 bp, Artificial Sequence
  Description of Artificial Sequence: Synthetic oligonucleotide
acttatcacctggggaggaagtgtactacagc

SEQ ID NO: 331995 - DNA, 31 bp, Artificial Sequence
  Description of Artificial Sequence: Synthetic oligonucleotide
cttatcacctggggaggaagtgtactacagc

SEQ ID NO: 331996 - DNA, 32 bp, Artificial Sequence
  Description of Artificial Sequence: Synthetic oligonucleotide
ttatcacctggggaggaagtgtactacagctg

SEQ ID NO: 331997 - DNA, 31 bp, Artificial Sequence
  Description of Artificial Sequence: Synthetic oligonucleotide
tatcacctggggaggaagtgtactacagctg

SEQ ID NO: 331998 - DNA, 30 bp, Artificial Sequence
  Description of Artificial Sequence: Synthetic oligonucleotide
atcacctggggaggaagtgtactacagctg

SEQ ID NO: 331999 - DNA, 29 bp, Artificial Sequence
  Description of Artificial Sequence: Synthetic oligonucleotide
tcacctggggaggaagtgtactacagctg

SEQ ID NO: 332000 - DNA, 28 bp, Artificial Sequence
  Description of Artificial Sequence: Synthetic oligonucleotide
cacctggggaggaagtgtactacagctg

SEQ ID NO: 332001 - DNA, 29 bp, Artificial Sequence
  Description of Artificial Sequence: Synthetic oligonucleotide
acctggggaggaagtgtactacagctgag

SEQ ID NO: 332002 - DNA, 28 bp, Artificial Sequence
  Description of Artificial Sequence: Synthetic oligonucleotide
cctggggaggaagtgtactacagctgag

SEQ ID NO: 332003 - DNA, 29 bp, Artificial Sequence
  Description of Artificial Sequence: Synthetic oligonucleotide
ctggggaggaagtgtactacagctgagag

SEQ ID NO: 332004 - DNA, 29 bp, Artificial Sequence
  Description of Artificial Sequence: Synthetic oligonucleotide
tggggaggaagtgtactacagctgagagc

SEQ ID NO: 332005 - DNA, 28 bp, Artificial Sequence
  Description of Artificial Sequence: Synthetic oligonucleotide
ggggaggaagtgtactacagctgagagc

SEQ ID NO: 332006 - DNA, 28 bp, Artificial Sequence
  Description of Artificial Sequence: Synthetic oligonucleotide
gggaggaagtgtactacagctgagagcc

SEQ ID NO: 332007 - DNA, 29 bp, Artificial Sequence
  Description of Artificial Sequence: Synthetic oligonucleotide
ggaggaagtgtactacagctgagagcctg

SEQ ID NO: 332008 - DNA, 29 bp, Artificial Sequence
  Description of Artificial Sequence: Synthetic oligonucleotide
gaggaagtgtactacagctgagagcctgg

SEQ ID NO: 332009 - DNA, 29 bp, Artificial Sequence
  Description of Artificial Sequence: Synthetic oligonucleotide
aggaagtgtactacagctgagagcctggc

SEQ ID NO: 332010 - DNA, 28 bp, Artificial Sequence
  Description of Artificial Sequence: Synthetic oligonucleotide
ggaagtgtactacagctgagagcctggc

SEQ ID NO: 332011 - DNA, 31 bp, Artificial Sequence
  Description of Artificial Sequence: Synthetic oligonucleotide
gaagtgtactacagctgagagcctggcaatg

SEQ ID NO: 332012 - DNA, 32 bp, Artificial Sequence
  Description of Artificial Sequence: Synthetic oligonucleotide
aagtgtactacagctgagagcctggcaatgac

SEQ ID NO: 332013 - DNA, 31 bp, Artificial Sequence
  Description of Artificial Sequence: Synthetic oligonucleotide
agtgtactacagctgagagcctggcaatgac

SEQ ID NO: 332014 - DNA, 30 bp, Artificial Sequence
  Description of Artificial Sequence: Synthetic oligonucleotide
gtgtactacagctgagagcctggcaatgac

SEQ ID NO: 332015 - DNA, 30 bp, Artificial Sequence
  Description of Artificial Sequence: Synthetic oligonucleotide
tgtactacagctgagagcctggcaatgacc

SEQ ID NO: 332016 - DNA, 29 bp, Artificial Sequence
  Description of Artificial Sequence: Synthetic oligonucleotide
gtactacagctgagagcctggcaatgacc

SEQ ID NO: 332017 - DNA, 30 bp, Artificial Sequence
  Description of Artificial Sequence: Synthetic oligonucleotide
tactacagctgagagcctggcaatgacctc

SEQ ID NO: 332018 - DNA, 29 bp, Artificial Sequence
  Description of Artificial Sequence: Synthetic oligonucleotide
actacagctgagagcctggcaatgacctc

SEQ ID NO: 332019 - DNA, 28 bp, Artificial Sequence
  Description of Artificial Sequence: Synthetic oligonucleotide
ctacagctgagagcctggcaatgacctc

SEQ ID NO: 332020 - DNA, 29 bp, Artificial Sequence
  Description of Artificial Sequence: Synthetic oligonucleotide
tacagctgagagcctggcaatgacctcac

SEQ ID NO: 332021 - DNA, 28 bp, Artificial Sequence
  Description of Artificial Sequence: Synthetic oligonucleotide
acagctgagagcctggcaatgacctcac

SEQ ID NO: 332022 - DNA, 27 bp, Artificial Sequence
  Description of Artificial Sequence: Synthetic oligonucleotide
cagctgagagcctggcaatgacctcac

SEQ ID NO: 332023 - DNA, 28 bp, Artificial Sequence
  Description of Artificial Sequence: Synthetic oligonucleotide
agctgagagcctggcaatgacctcacag

SEQ ID NO: 332024 - DNA, 27 bp, Artificial Sequence
  Description of Artificial Sequence: Synthetic oligonucleotide
gctgagagcctggcaatgacctcacag

SEQ ID NO: 332025 - DNA, 27 bp, Artificial Sequence
  Description of Artificial Sequence: Synthetic oligonucleotide
ctgagagcctggcaatgacctcacagg

SEQ ID NO: 332026 - DNA, 27 bp, Artificial Sequence
  Description of Artificial Sequence: Synthetic oligonucleotide
tgagagcctggcaatgacctcacaggg

SEQ ID NO: 332027 - DNA, 26 bp, Artificial Sequence
  Description of Artificial Sequence: Synthetic oligonucleotide
gagagcctggcaatgacctcacaggg

SEQ ID NO: 332028 - DNA, 26 bp, Artificial Sequence
  Description of Artificial Sequence: Synthetic oligonucleotide
agagcctggcaatgacctcacagggg

SEQ ID NO: 332029 - DNA, 25 bp, Artificial Sequence
  Description of Artificial Sequence: Synthetic oligonucleotide
gagcctggcaatgacctcacagggg

SEQ ID NO: 332030 - DNA, 26 bp, Artificial Sequence
  Description of Artificial Sequence: Synthetic oligonucleotide
agcctggcaatgacctcacaggggct

SEQ ID NO: 332031 - DNA, 25 bp, Artificial Sequence
  Description of Artificial Sequence: Synthetic oligonucleotide
gcctggcaatgacctcacaggggct

SEQ ID NO: 332032 - DNA, 25 bp, Artificial Sequence
  Description of Artificial Sequence: Synthetic oligonucleotide
cctggcaatgacctcacaggggctg

SEQ ID NO: 332033 - DNA, 25 bp, Artificial Sequence
  Description of Artificial Sequence: Synthetic oligonucleotide
ctggcaatgacctcacaggggctgc

SEQ ID NO: 332034 - DNA, 26 bp, Artificial Sequence
  Description of Artificial Sequence: Synthetic oligonucleotide
tggcaatgacctcacaggggctgcct

SEQ ID NO: 332035 - DNA, 25 bp, Artificial Sequence
  Description of Artificial Sequence: Synthetic oligonucleotide
ggcaatgacctcacaggggctgcct

SEQ ID NO: 332036 - DNA, 26 bp, Artificial Sequence
  Description of Artificial Sequence: Synthetic oligonucleotide
gcaatgacctcacaggggctgcctct

SEQ ID NO: 332037 - DNA, 27 bp, Artificial Sequence
  Description of Artificial Sequence: Synthetic oligonucleotide
caatgacctcacaggggctgcctctct

SEQ ID NO: 332038 - DNA, 27 bp, Artificial Sequence
  Description of Artificial Sequence: Synthetic oligonucleotide
aatgacctcacaggggctgcctctctg

SEQ ID NO: 332039 - DNA, 26 bp, Artificial Sequence
  Description of Artificial Sequence: Synthetic oligonucleotide
atgacctcacaggggctgcctctctg

SEQ ID NO: 332040 - DNA, 25 bp, Artificial Sequence
  Description of Artificial Sequence: Synthetic oligonucleotide
tgacctcacaggggctgcctctctg

SEQ ID NO: 332041 - DNA, 24 bp, Artificial Sequence
  Description of Artificial Sequence: Synthetic oligonucleotide
gacctcacaggggctgcctctctg

SEQ ID NO: 332042 - DNA, 25 bp, Artificial Sequence
  Description of Artificial Sequence: Synthetic oligonucleotide
acctcacaggggctgcctctctgca

SEQ ID NO: 332043 - DNA, 24 bp, Artificial Sequence
  Description of Artificial Sequence: Synthetic oligonucleotide
cctcacaggggctgcctctctgca

SEQ ID NO: 332044 - DNA, 25 bp, Artificial Sequence
  Description of Artificial Sequence: Synthetic oligonucleotide
ctcacaggggctgcctctctgcaca

SEQ ID NO: 332045 - DNA, 25 bp, Artificial Sequence
  Description of Artificial Sequence: Synthetic oligonucleotide
tcacaggggctgcctctctgcacag

SEQ ID NO: 332046 - DNA, 24 bp, Artificial Sequence
  Description of Artificial Sequence: Synthetic oligonucleotide
cacaggggctgcctctctgcacag

SEQ ID NO: 332047 - DNA, 25 bp, Artificial Sequence
  Description of Artificial Sequence: Synthetic oligonucleotide
acaggggctgcctctctgcacagca

SEQ ID NO: 332048 - DNA, 24 bp, Artificial Sequence
  Description of Artificial Sequence: Synthetic oligonucleotide
caggggctgcctctctgcacagca

SEQ ID NO: 332049 - DNA, 25 bp, Artificial Sequence
  Description of Artificial Sequence: Synthetic oligonucleotide
aggggctgcctctctgcacagcaca

SEQ ID NO: 332050 - DNA, 24 bp, Artificial Sequence
  Description of Artificial Sequence: Synthetic oligonucleotide
ggggctgcctctctgcacagcaca

SEQ ID NO: 332051 - DNA, 24 bp, Artificial Sequence
  Description of Artificial Sequence: Synthetic oligonucleotide
gggctgcctctctgcacagcacac

SEQ ID NO: 332052 - DNA, 24 bp, Artificial Sequence
  Description of Artificial Sequence: Synthetic oligonucleotide
ggctgcctctctgcacagcacacc

SEQ ID NO: 332053 - DNA, 24 bp, Artificial Sequence
  Description of Artificial Sequence: Synthetic oligonucleotide
gctgcctctctgcacagcacaccc

SEQ ID NO: 332054 - DNA, 25 bp, Artificial Sequence
  Description of Artificial Sequence: Synthetic oligonucleotide
ctgcctctctgcacagcacacccct

SEQ ID NO: 332055 - DNA, 25 bp, Artificial Sequence
  Description of Artificial Sequence: Synthetic oligonucleotide
tgcctctctgcacagcacacccctg

SEQ ID NO: 332056 - DNA, 24 bp, Artificial Sequence
  Description of Artificial Sequence: Synthetic oligonucleotide
gcctctctgcacagcacacccctg

SEQ ID NO: 332057 - DNA, 24 bp, Artificial Sequence
  Description of Artificial Sequence: Synthetic oligonucleotide
cctctctgcacagcacacccctgg

SEQ ID NO: 332058 - DNA, 25 bp, Artificial Sequence
  Description of Artificial Sequence: Synthetic oligonucleotide
ctctctgcacagcacacccctggga

SEQ ID NO: 332059 - DNA, 26 bp, Artificial Sequence
  Description of Artificial Sequence: Synthetic oligonucleotide
tctctgcacagcacacccctgggaga

SEQ ID NO: 332060 - DNA, 25 bp, Artificial Sequence
  Description of Artificial Sequence: Synthetic oligonucleotide
ctctgcacagcacacccctgggaga

SEQ ID NO: 332061 - DNA, 26 bp, Artificial Sequence
  Description of Artificial Sequence: Synthetic oligonucleotide
tctgcacagcacacccctgggagact

SEQ ID NO: 332062 - DNA, 25 bp, Artificial Sequence
  Description of Artificial Sequence: Synthetic oligonucleotide
ctgcacagcacacccctgggagact

SEQ ID NO: 332063 - DNA, 25 bp, Artificial Sequence
  Description of Artificial Sequence: Synthetic oligonucleotide
tgcacagcacacccctgggagactg

SEQ ID NO: 332064 - DNA, 24 bp, Artificial Sequence
  Description of Artificial Sequence: Synthetic oligonucleotide
gcacagcacacccctgggagactg

SEQ ID NO: 332065 - DNA, 25 bp, Artificial Sequence
  Description of Artificial Sequence: Synthetic oligonucleotide
cacagcacacccctgggagactgca

SEQ ID NO: 332066 - DNA, 25 bp, Artificial Sequence
  Description of Artificial Sequence: Synthetic oligonucleotide
acagcacacccctgggagactgcag

SEQ ID NO: 332067 - DNA, 24 bp, Artificial Sequence
  Description of Artificial Sequence: Synthetic oligonucleotide
cagcacacccctgggagactgcag

SEQ ID NO: 332068 - DNA, 24 bp, Artificial Sequence
  Description of Artificial Sequence: Synthetic oligonucleotide
agcacacccctgggagactgcagc

SEQ ID NO: 332069 - DNA, 23 bp, Artificial Sequence
  Description of Artificial Sequence: Synthetic oligonucleotide
gcacacccctgggagactgcagc

SEQ ID NO: 332070 - DNA, 23 bp, Artificial Sequence
  Description of Artificial Sequence: Synthetic oligonucleotide
cacacccctgggagactgcagcc

SEQ ID NO: 332071 - DNA, 24 bp, Artificial Sequence
  Description of Artificial Sequence: Synthetic oligonucleotide
acacccctgggagactgcagccct

SEQ ID NO: 332072 - DNA, 23 bp, Artificial Sequence
  Description of Artificial Sequence: Synthetic oligonucleotide
cacccctgggagactgcagccct

SEQ ID NO: 332073 - DNA, 25 bp, Artificial Sequence
  Description of Artificial Sequence: Synthetic oligonucleotide
acccctgggagactgcagccctgaa

SEQ ID NO: 332074 - DNA, 24 bp, Artificial Sequence
  Description of Artificial Sequence: Synthetic oligonucleotide
cccctgggagactgcagccctgaa

SEQ ID NO: 332075 - DNA, 24 bp, Artificial Sequence
  Description of Artificial Sequence: Synthetic oligonucleotide
ccctgggagactgcagccctgaac

SEQ ID NO: 332076 - DNA, 24 bp, Artificial Sequence
  Description of Artificial Sequence: Synthetic oligonucleotide
cctgggagactgcagccctgaacc

SEQ ID NO: 332077 - DNA, 24 bp, Artificial Sequence
  Description of Artificial Sequence: Synthetic oligonucleotide
ctgggagactgcagccctgaaccc

SEQ ID NO: 332078 - DNA, 24 bp, Artificial Sequence
  Description of Artificial Sequence: Synthetic oligonucleotide
tgggagactgcagccctgaacccc

SEQ ID NO: 332079 - DNA, 23 bp, Artificial Sequence
  Description of Artificial Sequence: Synthetic oligonucleotide
gggagactgcagccctgaacccc

SEQ ID NO: 332080 - DNA, 23 bp, Artificial Sequence
  Description of Artificial Sequence: Synthetic oligonucleotide
ggagactgcagccctgaaccccc

SEQ ID NO: 332081 - DNA, 24 bp, Artificial Sequence
  Description of Artificial Sequence: Synthetic oligonucleotide
gagactgcagccctgaacccccga

SEQ ID NO: 332082 - DNA, 26 bp, Artificial Sequence
  Description of Artificial Sequence: Synthetic oligonucleotide
agactgcagccctgaacccccgagat

SEQ ID NO: 332083 - DNA, 25 bp, Artificial Sequence
  Description of Artificial Sequence: Synthetic oligonucleotide
gactgcagccctgaacccccgagat

SEQ ID NO: 332084 - DNA, 26 bp, Artificial Sequence
  Description of Artificial Sequence: Synthetic oligonucleotide
actgcagccctgaacccccgagatct

SEQ ID NO: 332085 - DNA, 25 bp, Artificial Sequence
  Description of Artificial Sequence: Synthetic oligonucleotide
ctgcagccctgaacccccgagatct

SEQ ID NO: 332086 - DNA, 25 bp, Artificial Sequence
  Description of Artificial Sequence: Synthetic oligonucleotide
tgcagccctgaacccccgagatctg

SEQ ID NO: 332087 - DNA, 24 bp, Artificial Sequence
  Description of Artificial Sequence: Synthetic oligonucleotide
gcagccctgaacccccgagatctg

SEQ ID NO: 332088 - DNA, 25 bp, Artificial Sequence
  Description of Artificial Sequence: Synthetic oligonucleotide
cagccctgaacccccgagatctgca

SEQ ID NO: 332089 - DNA, 26 bp, Artificial Sequence
  Description of Artificial Sequence: Synthetic oligonucleotide
agccctgaacccccgagatctgcagt

SEQ ID NO: 332090 - DNA, 25 bp, Artificial Sequence
  Description of Artificial Sequence: Synthetic oligonucleotide
gccctgaacccccgagatctgcagt

SEQ ID NO: 332091 - DNA, 27 bp, Artificial Sequence
  Description of Artificial Sequence: Synthetic oligonucleotide
ccctgaacccccgagatctgcagtgaa

SEQ ID NO: 332092 - DNA, 29 bp, Artificial Sequence
  Description of Artificial Sequence: Synthetic oligonucleotide
cctgaacccccgagatctgcagtgaattc

SEQ ID NO: 332093 - DNA, 29 bp, Artificial Sequence
  Description of Artificial Sequence: Synthetic oligonucleotide
ctgaacccccgagatctgcagtgaattcc

SEQ ID NO: 332094 - DNA, 30 bp, Artificial Sequence
  Description of Artificial Sequence: Synthetic oligonucleotide
tgaacccccgagatctgcagtgaattcctg

SEQ ID NO: 332095 - DNA, 29 bp, Artificial Sequence
  Description of Artificial Sequence: Synthetic oligonucleotide
gaacccccgagatctgcagtgaattcctg

SEQ ID NO: 332096 - DNA, 30 bp, Artificial Sequence
  Description of Artificial Sequence: Synthetic oligonucleotide
aacccccgagatctgcagtgaattcctgtg

SEQ ID NO: 332097 - DNA, 29 bp, Artificial Sequence
  Description of Artificial Sequence: Synthetic oligonucleotide
acccccgagatctgcagtgaattcctgtg

SEQ ID NO: 332098 - DNA, 28 bp, Artificial Sequence
  Description of Artificial Sequence: Synthetic oligonucleotide
cccccgagatctgcagtgaattcctgtg

SEQ ID NO: 332099 - DNA, 30 bp, Artificial Sequence
  Description of Artificial Sequence: Synthetic oligonucleotide
ccccgagatctgcagtgaattcctgtgatc

SEQ ID NO: 332100 - DNA, 31 bp, Artificial Sequence
  Description of Artificial Sequence: Synthetic oligonucleotide
cccgagatctgcagtgaattcctgtgatcac

SEQ ID NO: 332101 - DNA, 33 bp, Artificial Sequence
  Description of Artificial Sequence: Synthetic oligonucleotide
ccgagatctgcagtgaattcctgtgatcacttc

SEQ ID NO: 332102 - DNA, 35 bp, Artificial Sequence
  Description of Artificial Sequence: Synthetic oligonucleotide
cgagatctgcagtgaattcctgtgatcacttcttg

SEQ ID NO: 332103 - DNA, 35 bp, Artificial Sequence
  Description of Artificial Sequence: Synthetic oligonucleotide
gagatctgcagtgaattcctgtgatcacttcttgg

SEQ ID NO: 332104 - DNA, 35 bp, Artificial Sequence
  Description of Artificial Sequence: Synthetic oligonucleotide
agatctgcagtgaattcctgtgatcacttcttggc

SEQ ID NO: 332105 - DNA, 34 bp, Artificial Sequence
  Description of Artificial Sequence: Synthetic oligonucleotide
gatctgcagtgaattcctgtgatcacttcttggc

SEQ ID NO: 332106 - DNA, 35 bp, Artificial Sequence
  Description of Artificial Sequence: Synthetic oligonucleotide
atctgcagtgaattcctgtgatcacttcttggctc

SEQ ID NO: 332107 - DNA, 34 bp, Artificial Sequence
  Description of Artificial Sequence: Synthetic oligonucleotide
tctgcagtgaattcctgtgatcacttcttggctc

SEQ ID NO: 332108 - DNA, 33 bp, Artificial Sequence
  Description of Artificial Sequence: Synthetic oligonucleotide
ctgcagtgaattcctgtgatcacttcttggctc

SEQ ID NO: 332109 - DNA, 35 bp, Artificial Sequence
  Description of Artificial Sequence: Synthetic oligonucleotide
tgcagtgaattcctgtgatcacttcttggctcaac

SEQ ID NO: 332110 - DNA, 34 bp, Artificial Sequence
  Description of Artificial Sequence: Synthetic oligonucleotide
gcagtgaattcctgtgatcacttcttggctcaac

SEQ ID NO: 332111 - DNA, 35 bp, Artificial Sequence
  Description of Artificial Sequence: Synthetic oligonucleotide
cagtgaattcctgtgatcacttcttggctcaactc

SEQ ID NO: 332112 - DNA, 35 bp, Artificial Sequence
  Description of Artificial Sequence: Synthetic oligonucleotide
agtgaattcctgtgatcacttcttggctcaactcc

SEQ ID NO: 332113 - DNA, 34 bp, Artificial Sequence
  Description of Artificial Sequence: Synthetic oligonucleotide
gtgaattcctgtgatcacttcttggctcaactcc

SEQ ID NO: 332114 - DNA, 34 bp, Artificial Sequence
  Description of Artificial Sequence: Synthetic oligonucleotide
tgaattcctgtgatcacttcttggctcaactccc

SEQ ID NO: 332115 - DNA, 33 bp, Artificial Sequence
  Description of Artificial Sequence: Synthetic oligonucleotide
gaattcctgtgatcacttcttggctcaactccc

SEQ ID NO: 332116 - DNA, 34 bp, Artificial Sequence
  Description of Artificial Sequence: Synthetic oligonucleotide
aattcctgtgatcacttcttggctcaactcccac

SEQ ID NO: 332117 - DNA, 33 bp, Artificial Sequence
  Description of Artificial Sequence: Synthetic oligonucleotide
attcctgtgatcacttcttggctcaactcccac

SEQ ID NO: 332118 - DNA, 32 bp, Artificial Sequence
  Description of Artificial Sequence: Synthetic oligonucleotide
ttcctgtgatcacttcttggctcaactcccac

SEQ ID NO: 332119 - DNA, 31 bp, Artificial Sequence
  Description of Artificial Sequence: Synthetic oligonucleotide
tcctgtgatcacttcttggctcaactcccac

SEQ ID NO: 332120 - DNA, 30 bp, Artificial Sequence
  Description of Artificial Sequence: Synthetic oligonucleotide
cctgtgatcacttcttggctcaactcccac

SEQ ID NO: 332121 - DNA, 32 bp, Artificial Sequence
  Description of Artificial Sequence: Synthetic oligonucleotide
ctgtgatcacttcttggctcaactcccacatg

SEQ ID NO: 332122 - DNA, 32 bp, Artificial Sequence
  Description of Artificial Sequence: Synthetic oligonucleotide
tgtgatcacttcttggctcaactcccacatgg

SEQ ID NO: 332123 - DNA, 31 bp, Artificial Sequence
  Description of Artificial Sequence: Synthetic oligonucleotide
gtgatcacttcttggctcaactcccacatgg

SEQ ID NO: 332124 - DNA, 31 bp, Artificial Sequence
  Description of Artificial Sequence: Synthetic oligonucleotide
tgatcacttcttggctcaactcccacatggc

SEQ ID NO: 332125 - DNA, 30 bp, Artificial Sequence
  Description of Artificial Sequence: Synthetic oligonucleotide
gatcacttcttggctcaactcccacatggc

SEQ ID NO: 332126 - DNA, 30 bp, Artificial Sequence
  Description of Artificial Sequence: Synthetic oligonucleotide
atcacttcttggctcaactcccacatggcc

SEQ ID NO: 332127 - DNA, 29 bp, Artificial Sequence
  Description of Artificial Sequence: Synthetic oligonucleotide
tcacttcttggctcaactcccacatggcc

SEQ ID NO: 332128 - DNA, 28 bp, Artificial Sequence
  Description of Artificial Sequence: Synthetic oligonucleotide
cacttcttggctcaactcccacatggcc

SEQ ID NO: 332129 - DNA, 28 bp, Artificial Sequence
  Description of Artificial Sequence: Synthetic oligonucleotide
acttcttggctcaactcccacatggccg

SEQ ID NO: 332130 - DNA, 27 bp, Artificial Sequence
  Description of Artificial Sequence: Synthetic oligonucleotide
cttcttggctcaactcccacatggccg

SEQ ID NO: 332131 - DNA, 28 bp, Artificial Sequence
  Description of Artificial Sequence: Synthetic oligonucleotide
ttcttggctcaactcccacatggccgtc

SEQ ID NO: 332132 - DNA, 27 bp, Artificial Sequence
  Description of Artificial Sequence: Synthetic oligonucleotide
tcttggctcaactcccacatggccgtc

SEQ ID NO: 332133 - DNA, 27 bp, Artificial Sequence
  Description of Artificial Sequence: Synthetic oligonucleotide
cttggctcaactcccacatggccgtct

SEQ ID NO: 332134 - DNA, 27 bp, Artificial Sequence
  Description of Artificial Sequence: Synthetic oligonucleotide
ttggctcaactcccacatggccgtctg

SEQ ID NO: 332135 - DNA, 26 bp, Artificial Sequence
  Description of Artificial Sequence: Synthetic oligonucleotide
tggctcaactcccacatggccgtctg

SEQ ID NO: 332136 - DNA, 25 bp, Artificial Sequence
  Description of Artificial Sequence: Synthetic oligonucleotide
ggctcaactcccacatggccgtctg

SEQ ID NO: 332137 - DNA, 27 bp, Artificial Sequence
  Description of Artificial Sequence: Synthetic oligonucleotide
gctcaactcccacatggccgtctgcta

SEQ ID NO: 332138 - DNA, 30 bp, Artificial Sequence
  Description of Artificial Sequence: Synthetic oligonucleotide
ctcaactcccacatggccgtctgctatttc

SEQ ID NO: 332139 - DNA, 30 bp, Artificial Sequence
  Description of Artificial Sequence: Synthetic oligonucleotide
tcaactcccacatggccgtctgctatttcg

SEQ ID NO: 332140 - DNA, 29 bp, Artificial Sequence
  Description of Artificial Sequence: Synthetic oligonucleotide
caactcccacatggccgtctgctatttcg

SEQ ID NO: 332141 - DNA, 30 bp, Artificial Sequence
  Description of Artificial Sequence: Synthetic oligonucleotide
aactcccacatggccgtctgctatttcgac

SEQ ID NO: 332142 - DNA, 29 bp, Artificial Sequence
  Description of Artificial Sequence: Synthetic oligonucleotide
actcccacatggccgtctgctatttcgac

SEQ ID NO: 332143 - DNA, 28 bp, Artificial Sequence
  Description of Artificial Sequence: Synthetic oligonucleotide
ctcccacatggccgtctgctatttcgac

SEQ ID NO: 332144 - DNA, 33 bp, Artificial Sequence
  Description of Artificial Sequence: Synthetic oligonucleotide
tcccacatggccgtctgctatttcgacttaatc

SEQ ID NO: 332145 - DNA, 32 bp, Artificial Sequence
  Description of Artificial Sequence: Synthetic oligonucleotide
cccacatggccgtctgctatttcgacttaatc

SEQ ID NO: 332146 - DNA, 33 bp, Artificial Sequence
  Description of Artificial Sequence: Synthetic oligonucleotide
ccacatggccgtctgctatttcgacttaatctg

SEQ ID NO: 332147 - DNA, 33 bp, Artificial Sequence
  Description of Artificial Sequence: Synthetic oligonucleotide
cacatggccgtctgctatttcgacttaatctgc

SEQ ID NO: 332148 - DNA, 34 bp, Artificial Sequence
  Description of Artificial Sequence: Synthetic oligonucleotide
acatggccgtctgctatttcgacttaatctgcag

SEQ ID NO: 332149 - DNA, 33 bp, Artificial Sequence
  Description of Artificial Sequence: Synthetic oligonucleotide
catggccgtctgctatttcgacttaatctgcag

SEQ ID NO: 332150 - DNA, 33 bp, Artificial Sequence
  Description of Artificial Sequence: Synthetic oligonucleotide
atggccgtctgctatttcgacttaatctgcagc

SEQ ID NO: 332151 - DNA, 32 bp, Artificial Sequence
  Description of Artificial Sequence: Synthetic oligonucleotide
tggccgtctgctatttcgacttaatctgcagc

SEQ ID NO: 332152 - DNA, 31 bp, Artificial Sequence
  Description of Artificial Sequence: Synthetic oligonucleotide
ggccgtctgctatttcgacttaatctgcagc

SEQ ID NO: 332153 - DNA, 33 bp, Artificial Sequence
  Description of Artificial Sequence: Synthetic oligonucleotide
gccgtctgctatttcgacttaatctgcagcttg

SEQ ID NO: 332154 - DNA, 33 bp, Artificial Sequence
  Description of Artificial Sequence: Synthetic oligonucleotide
ccgtctgctatttcgacttaatctgcagcttgg

SEQ ID NO: 332155 - DNA, 33 bp, Artificial Sequence
  Description of Artificial Sequence: Synthetic oligonucleotide
cgtctgctatttcgacttaatctgcagcttggg

SEQ ID NO: 332156 - DNA, 33 bp, Artificial Sequence
  Description of Artificial Sequence: Synthetic oligonucleotide
gtctgctatttcgacttaatctgcagcttgggc

SEQ ID NO: 332157 - DNA, 33 bp, Artificial Sequence
  Description of Artificial Sequence: Synthetic oligonucleotide
tctgctatttcgacttaatctgcagcttgggcc

SEQ ID NO: 332158 - DNA, 32 bp, Artificial Sequence
  Description of Artificial Sequence: Synthetic oligonucleotide
ctgctatttcgacttaatctgcagcttgggcc

SEQ ID NO: 332159 - DNA, 35 bp, Artificial Sequence
  Description of Artificial Sequence: Synthetic oligonucleotide
tgctatttcgacttaatctgcagcttgggccaaag

SEQ ID NO: 332160 - DNA, 34 bp, Artificial Sequence
  Description of Artificial Sequence: Synthetic oligonucleotide
gctatttcgacttaatctgcagcttgggccaaag

SEQ ID NO: 332161 - DNA, 34 bp, Artificial Sequence
  Description of Artificial Sequence: Synthetic oligonucleotide
ctatttcgacttaatctgcagcttgggccaaagg

SEQ ID NO: 332162 - DNA, 35 bp, Artificial Sequence
  Description of Artificial Sequence: Synthetic oligonucleotide
tatttcgacttaatctgcagcttgggccaaaggtg

SEQ ID NO: 332163 - DNA, 34 bp, Artificial Sequence
  Description of Artificial Sequence: Synthetic oligonucleotide
atttcgacttaatctgcagcttgggccaaaggtg

SEQ ID NO: 332164 - DNA, 33 bp, Artificial Sequence
  Description of Artificial Sequence: Synthetic oligonucleotide
tttcgacttaatctgcagcttgggccaaaggtg

SEQ ID NO: 332165 - DNA, 32 bp, Artificial Sequence
  Description of Artificial Sequence: Synthetic oligonucleotide
ttcgacttaatctgcagcttgggccaaaggtg

SEQ ID NO: 332166 - DNA, 31 bp, Artificial Sequence
  Description of Artificial Sequence: Synthetic oligonucleotide
tcgacttaatctgcagcttgggccaaaggtg

SEQ ID NO: 332167 - DNA, 30 bp, Artificial Sequence
  Description of Artificial Sequence: Synthetic oligonucleotide
cgacttaatctgcagcttgggccaaaggtg

SEQ ID NO: 332168 - DNA, 31 bp, Artificial Sequence
  Description of Artificial Sequence: Synthetic oligonucleotide
gacttaatctgcagcttgggccaaaggtgtg

SEQ ID NO: 332169 - DNA, 31 bp, Artificial Sequence
  Description of Artificial Sequence: Synthetic oligonucleotide
acttaatctgcagcttgggccaaaggtgtgc

SEQ ID NO: 332170 - DNA, 30 bp, Artificial Sequence
  Description of Artificial Sequence: Synthetic oligonucleotide
cttaatctgcagcttgggccaaaggtgtgc

SEQ ID NO: 332171 - DNA, 33 bp, Artificial Sequence
  Description of Artificial Sequence: Synthetic oligonucleotide
ttaatctgcagcttgggccaaaggtgtgctttg

SEQ ID NO: 332172 - DNA, 32 bp, Artificial Sequence
  Description of Artificial Sequence: Synthetic oligonucleotide
taatctgcagcttgggccaaaggtgtgctttg

SEQ ID NO: 332173 - DNA, 31 bp, Artificial Sequence
  Description of Artificial Sequence: Synthetic oligonucleotide
aatctgcagcttgggccaaaggtgtgctttg

SEQ ID NO: 332174 - DNA, 30 bp, Artificial Sequence
  Description of Artificial Sequence: Synthetic oligonucleotide
atctgcagcttgggccaaaggtgtgctttg

SEQ ID NO: 332175 - DNA, 29 bp, Artificial Sequence
  Description of Artificial Sequence: Synthetic oligonucleotide
tctgcagcttgggccaaaggtgtgctttg

SEQ ID NO: 332176 - DNA, 28 bp, Artificial Sequence
  Description of Artificial Sequence: Synthetic oligonucleotide
ctgcagcttgggccaaaggtgtgctttg

SEQ ID NO: 332177 - DNA, 29 bp, Artificial Sequence
  Description of Artificial Sequence: Synthetic oligonucleotide
tgcagcttgggccaaaggtgtgctttgtc

SEQ ID NO: 332178 - DNA, 28 bp, Artificial Sequence
  Description of Artificial Sequence: Synthetic oligonucleotide
gcagcttgggccaaaggtgtgctttgtc

SEQ ID NO: 332179 - DNA, 29 bp, Artificial Sequence
  Description of Artificial Sequence: Synthetic oligonucleotide
cagcttgggccaaaggtgtgctttgtctg

SEQ ID NO: 332180 - DNA, 30 bp, Artificial Sequence
  Description of Artificial Sequence: Synthetic oligonucleotide
agcttgggccaaaggtgtgctttgtctgag

SEQ ID NO: 332181 - DNA, 29 bp, Artificial Sequence
  Description of Artificial Sequence: Synthetic oligonucleotide
gcttgggccaaaggtgtgctttgtctgag

SEQ ID NO: 332182 - DNA, 31 bp, Artificial Sequence
  Description of Artificial Sequence: Synthetic oligonucleotide
cttgggccaaaggtgtgctttgtctgagatg

SEQ ID NO: 332183 - DNA, 33 bp, Artificial Sequence
  Description of Artificial Sequence: Synthetic oligonucleotide
ttgggccaaaggtgtgctttgtctgagatgaag

SEQ ID NO: 332184 - DNA, 32 bp, Artificial Sequence
  Description of Artificial Sequence: Synthetic oligonucleotide
tgggccaaaggtgtgctttgtctgagatgaag

SEQ ID NO: 332185 - DNA, 31 bp, Artificial Sequence
  Description of Artificial Sequence: Synthetic oligonucleotide
gggccaaaggtgtgctttgtctgagatgaag

SEQ ID NO: 332186 - DNA, 31 bp, Artificial Sequence
  Description of Artificial Sequence: Synthetic oligonucleotide
ggccaaaggtgtgctttgtctgagatgaagg

SEQ ID NO: 332187 - DNA, 31 bp, Artificial Sequence
  Description of Artificial Sequence: Synthetic oligonucleotide
gccaaaggtgtgctttgtctgagatgaaggg

SEQ ID NO: 332188 - DNA, 34 bp, Artificial Sequence
  Description of Artificial Sequence: Synthetic oligonucleotide
ccaaaggtgtgctttgtctgagatgaagggattc

SEQ ID NO: 332189 - DNA, 34 bp, Artificial Sequence
  Description of Artificial Sequence: Synthetic oligonucleotide
caaaggtgtgctttgtctgagatgaagggattcg

SEQ ID NO: 332190 - DNA, 34 bp, Artificial Sequence
  Description of Artificial Sequence: Synthetic oligonucleotide
aaaggtgtgctttgtctgagatgaagggattcgc

SEQ ID NO: 332191 - DNA, 33 bp, Artificial Sequence
  Description of Artificial Sequence: Synthetic oligonucleotide
aaggtgtgctttgtctgagatgaagggattcgc

SEQ ID NO: 332192 - DNA, 32 bp, Artificial Sequence
  Description of Artificial Sequence: Synthetic oligonucleotide
aggtgtgctttgtctgagatgaagggattcgc

SEQ ID NO: 332193 - DNA, 31 bp, Artificial Sequence
  Description of Artificial Sequence: Synthetic oligonucleotide
ggtgtgctttgtctgagatgaagggattcgc

SEQ ID NO: 332194 - DNA, 36 bp, Artificial Sequence
  Description of Artificial Sequence: Synthetic oligonucleotide
gtgtgctttgtctgagatgaagggattcgcttaatg

SEQ ID NO: 332195 - DNA, 36 bp, Artificial Sequence
  Description of Artificial Sequence: Synthetic oligonucleotide
tgtgctttgtctgagatgaagggattcgcttaatgg

SEQ ID NO: 332196 - DNA, 35 bp, Artificial Sequence
  Description of Artificial Sequence: Synthetic oligonucleotide
gtgctttgtctgagatgaagggattcgcttaatgg

SEQ ID NO: 332197 - DNA, 35 bp, Artificial Sequence
  Description of Artificial Sequence: Synthetic oligonucleotide
tgctttgtctgagatgaagggattcgcttaatggg

SEQ ID NO: 332198 - DNA, 34 bp, Artificial Sequence
  Description of Artificial Sequence: Synthetic oligonucleotide
gctttgtctgagatgaagggattcgcttaatggg

SEQ ID NO: 332199 - DNA, 34 bp, Artificial Sequence
  Description of Artificial Sequence: Synthetic oligonucleotide
ctttgtctgagatgaagggattcgcttaatgggc

SEQ ID NO: 332200 - DNA, 35 bp, Artificial Sequence
  Description of Artificial Sequence: Synthetic oligonucleotide
tttgtctgagatgaagggattcgcttaatgggcag

SEQ ID NO: 332201 - DNA, 34 bp, Artificial Sequence
  Description of Artificial Sequence: Synthetic oligonucleotide
ttgtctgagatgaagggattcgcttaatgggcag

SEQ ID NO: 332202 - DNA, 33 bp, Artificial Sequence
  Description of Artificial Sequence: Synthetic oligonucleotide
tgtctgagatgaagggattcgcttaatgggcag

SEQ ID NO: 332203 - DNA, 32 bp, Artificial Sequence
  Description of Artificial Sequence: Synthetic oligonucleotide
gtctgagatgaagggattcgcttaatgggcag

SEQ ID NO: 332204 - DNA, 34 bp, Artificial Sequence
  Description of Artificial Sequence: Synthetic oligonucleotide
tctgagatgaagggattcgcttaatgggcagttc

SEQ ID NO: 332205 - DNA, 33 bp, Artificial Sequence
  Description of Artificial Sequence: Synthetic oligonucleotide
ctgagatgaagggattcgcttaatgggcagttc

SEQ ID NO: 332206 - DNA, 33 bp, Artificial Sequence
  Description of Artificial Sequence: Synthetic oligonucleotide
tgagatgaagggattcgcttaatgggcagttcg

SEQ ID NO: 332207 - DNA, 32 bp, Artificial Sequence
  Description of Artificial Sequence: Synthetic oligonucleotide
gagatgaagggattcgcttaatgggcagttcg

SEQ ID NO: 332208 - DNA, 32 bp, Artificial Sequence
  Description of Artificial Sequence: Synthetic oligonucleotide
agatgaagggattcgcttaatgggcagttcgg

SEQ ID NO: 332209 - DNA, 31 bp, Artificial Sequence
  Description of Artificial Sequence: Synthetic oligonucleotide
gatgaagggattcgcttaatgggcagttcgg

SEQ ID NO: 332210 - DNA, 34 bp, Artificial Sequence
  Description of Artificial Sequence: Synthetic oligonucleotide
atgaagggattcgcttaatgggcagttcggttag

SEQ ID NO: 332211 - DNA, 33 bp, Artificial Sequence
  Description of Artificial Sequence: Synthetic oligonucleotide
tgaagggattcgcttaatgggcagttcggttag

SEQ ID NO: 332212 - DNA, 32 bp, Artificial Sequence
  Description of Artificial Sequence: Synthetic oligonucleotide
gaagggattcgcttaatgggcagttcggttag

SEQ ID NO: 332213 - DNA, 33 bp, Artificial Sequence
  Description of Artificial Sequence: Synthetic oligonucleotide
aagggattcgcttaatgggcagttcggttagtc

SEQ ID NO: 332214 - DNA, 32 bp, Artificial Sequence
  Description of Artificial Sequence: Synthetic oligonucleotide
agggattcgcttaatgggcagttcggttagtc

SEQ ID NO: 332215 - DNA, 31 bp, Artificial Sequence
  Description of Artificial Sequence: Synthetic oligonucleotide
gggattcgcttaatgggcagttcggttagtc

SEQ ID NO: 332216 - DNA, 34 bp, Artificial Sequence
  Description of Artificial Sequence: Synthetic oligonucleotide
ggattcgcttaatgggcagttcggttagtcatag

SEQ ID NO: 332217 - DNA, 35 bp, Artificial Sequence
  Description of Artificial Sequence: Synthetic oligonucleotide
gattcgcttaatgggcagttcggttagtcatagtg

SEQ ID NO: 332218 - DNA, 36 bp, Artificial Sequence
  Description of Artificial Sequence: Synthetic oligonucleotide
attcgcttaatgggcagttcggttagtcatagtgtc

SEQ ID NO: 332219 - DNA, 35 bp, Artificial Sequence
  Description of Artificial Sequence: Synthetic oligonucleotide
ttcgcttaatgggcagttcggttagtcatagtgtc

SEQ ID NO: 332220 - DNA, 34 bp, Artificial Sequence
  Description of Artificial Sequence: Synthetic oligonucleotide
tcgcttaatgggcagttcggttagtcatagtgtc

SEQ ID NO: 332221 - DNA, 33 bp, Artificial Sequence
  Description of Artificial Sequence: Synthetic oligonucleotide
cgcttaatgggcagttcggttagtcatagtgtc

SEQ ID NO: 332222 - DNA, 35 bp, Artificial Sequence
  Description of Artificial Sequence: Synthetic oligonucleotide
gcttaatgggcagttcggttagtcatagtgtcttg

SEQ ID NO: 332223 - DNA, 35 bp, Artificial Sequence
  Description of Artificial Sequence: Synthetic oligonucleotide
cttaatgggcagttcggttagtcatagtgtcttgg

SEQ ID NO: 332224 - DNA, 37 bp, Artificial Sequence
  Description of Artificial Sequence: Synthetic oligonucleotide
ttaatgggcagttcggttagtcatagtgtcttggatg

SEQ ID NO: 332225 - DNA, 36 bp, Artificial Sequence
  Description of Artificial Sequence: Synthetic oligonucleotide
taatgggcagttcggttagtcatagtgtcttggatg

SEQ ID NO: 332226 - DNA, 35 bp, Artificial Sequence
  Description of Artificial Sequence: Synthetic oligonucleotide
aatgggcagttcggttagtcatagtgtcttggatg

SEQ ID NO: 332227 - DNA, 34 bp, Artificial Sequence
  Description of Artificial Sequence: Synthetic oligonucleotide
atgggcagttcggttagtcatagtgtcttggatg

SEQ ID NO: 332228 - DNA, 33 bp, Artificial Sequence
  Description of Artificial Sequence: Synthetic oligonucleotide
tgggcagttcggttagtcatagtgtcttggatg

SEQ ID NO: 332229 - DNA, 32 bp, Artificial Sequence
  Description of Artificial Sequence: Synthetic oligonucleotide
gggcagttcggttagtcatagtgtcttggatg

SEQ ID NO: 332230 - DNA, 32 bp, Artificial Sequence
  Description of Artificial Sequence: Synthetic oligonucleotide
ggcagttcggttagtcatagtgtcttggatgg

SEQ ID NO: 332231 - DNA, 35 bp, Artificial Sequence
  Description of Artificial Sequence: Synthetic oligonucleotide
gcagttcggttagtcatagtgtcttggatggaatg

SEQ ID NO: 332232 - DNA, 36 bp, Artificial Sequence
  Description of Artificial Sequence: Synthetic oligonucleotide
cagttcggttagtcatagtgtcttggatggaatgag

SEQ ID NO: 332233 - DNA, 38 bp, Artificial Sequence
  Description of Artificial Sequence: Synthetic oligonucleotide
agttcggttagtcatagtgtcttggatggaatgagtag

SEQ ID NO: 332234 - DNA, 37 bp, Artificial Sequence
  Description of Artificial Sequence: Synthetic oligonucleotide
gttcggttagtcatagtgtcttggatggaatgagtag

SEQ ID NO: 332235 - DNA, 37 bp, Artificial Sequence
  Description of Artificial Sequence: Synthetic oligonucleotide
ttcggttagtcatagtgtcttggatggaatgagtagc

SEQ ID NO: 332236 - DNA, 36 bp, Artificial Sequence
  Description of Artificial Sequence: Synthetic oligonucleotide
tcggttagtcatagtgtcttggatggaatgagtagc

SEQ ID NO: 332237 - DNA, 35 bp, Artificial Sequence
  Description of Artificial Sequence: Synthetic oligonucleotide
cggttagtcatagtgtcttggatggaatgagtagc

SEQ ID NO: 332238 - DNA, 35 bp, Artificial Sequence
  Description of Artificial Sequence: Synthetic oligonucleotide
ggttagtcatagtgtcttggatggaatgagtagcc

SEQ ID NO: 332239 - DNA, 38 bp, Artificial Sequence
  Description of Artificial Sequence: Synthetic oligonucleotide
gttagtcatagtgtcttggatggaatgagtagcctttg

SEQ ID NO: 332240 - DNA, 38 bp, Artificial Sequence
  Description of Artificial Sequence: Synthetic oligonucleotide
ttagtcatagtgtcttggatggaatgagtagcctttgg

SEQ ID NO: 332241 - DNA, 37 bp, Artificial Sequence
  Description of Artificial Sequence: Synthetic oligonucleotide
tagtcatagtgtcttggatggaatgagtagcctttgg

SEQ ID NO: 332242 - DNA, 36 bp, Artificial Sequence
  Description of Artificial Sequence: Synthetic oligonucleotide
agtcatagtgtcttggatggaatgagtagcctttgg

SEQ ID NO: 332243 - DNA, 35 bp, Artificial Sequence
  Description of Artificial Sequence: Synthetic oligonucleotide
gtcatagtgtcttggatggaatgagtagcctttgg

SEQ ID NO: 332244 - DNA, 40 bp, Artificial Sequence
  Description of Artificial Sequence: Synthetic oligonucleotide
tcatagtgtcttggatggaatgagtagcctttggtataac

SEQ ID NO: 332245 - DNA, 39 bp, Artificial Sequence
  Description of Artificial Sequence: Synthetic oligonucleotide
catagtgtcttggatggaatgagtagcctttggtataac

SEQ ID NO: 332246 - DNA, 40 bp, Artificial Sequence
  Description of Artificial Sequence: Synthetic oligonucleotide
atagtgtcttggatggaatgagtagcctttggtataacag

SEQ ID NO: 332247 - DNA, 39 bp, Artificial Sequence
  Description of Artificial Sequence: Synthetic oligonucleotide
tagtgtcttggatggaatgagtagcctttggtataacag

SEQ ID NO: 332248 - DNA, 38 bp, Artificial Sequence
  Description of Artificial Sequence: Synthetic oligonucleotide
agtgtcttggatggaatgagtagcctttggtataacag

SEQ ID NO: 332249 - DNA, 37 bp, Artificial Sequence
  Description of Artificial Sequence: Synthetic oligonucleotide
gtgtcttggatggaatgagtagcctttggtataacag

SEQ ID NO: 332250 - DNA, 38 bp, Artificial Sequence
  Description of Artificial Sequence: Synthetic oligonucleotide
tgtcttggatggaatgagtagcctttggtataacagtg

SEQ ID NO: 332251 - DNA, 37 bp, Artificial Sequence
  Description of Artificial Sequence: Synthetic oligonucleotide
gtcttggatggaatgagtagcctttggtataacagtg

SEQ ID NO: 332252 - DNA, 39 bp, Artificial Sequence
  Description of Artificial Sequence: Synthetic oligonucleotide
tcttggatggaatgagtagcctttggtataacagtgatc

SEQ ID NO: 332253 - DNA, 38 bp, Artificial Sequence
  Description of Artificial Sequence: Synthetic oligonucleotide
cttggatggaatgagtagcctttggtataacagtgatc

SEQ ID NO: 332254 - DNA, 38 bp, Artificial Sequence
  Description of Artificial Sequence: Synthetic oligonucleotide
ttggatggaatgagtagcctttggtataacagtgatcc

SEQ ID NO: 332255 - DNA, 37 bp, Artificial Sequence
  Description of Artificial Sequence: Synthetic oligonucleotide
tggatggaatgagtagcctttggtataacagtgatcc

SEQ ID NO: 332256 - DNA, 36 bp, Artificial Sequence
  Description of Artificial Sequence: Synthetic oligonucleotide
ggatggaatgagtagcctttggtataacagtgatcc

SEQ ID NO: 332257 - DNA, 37 bp, Artificial Sequence
  Description of Artificial Sequence: Synthetic oligonucleotide
gatggaatgagtagcctttggtataacagtgatcctg

SEQ ID NO: 332258 - DNA, 38 bp, Artificial Sequence
  Description of Artificial Sequence: Synthetic oligonucleotide
atggaatgagtagcctttggtataacagtgatcctgtg

SEQ ID NO: 332259 - DNA, 37 bp, Artificial Sequence
  Description of Artificial Sequence: Synthetic oligonucleotide
tggaatgagtagcctttggtataacagtgatcctgtg

SEQ ID NO: 332260 - DNA, 36 bp, Artificial Sequence
  Description of Artificial Sequence: Synthetic oligonucleotide
ggaatgagtagcctttggtataacagtgatcctgtg

SEQ ID NO: 332261 - DNA, 37 bp, Artificial Sequence
  Description of Artificial Sequence: Synthetic oligonucleotide
gaatgagtagcctttggtataacagtgatcctgtgtg

SEQ ID NO: 332262 - DNA, 38 bp, Artificial Sequence
  Description of Artificial Sequence: Synthetic oligonucleotide
aatgagtagcctttggtataacagtgatcctgtgtgag

SEQ ID NO: 332263 - DNA, 37 bp, Artificial Sequence
  Description of Artificial Sequence: Synthetic oligonucleotide
atgagtagcctttggtataacagtgatcctgtgtgag

SEQ ID NO: 332264 - DNA, 36 bp, Artificial Sequence
  Description of Artificial Sequence: Synthetic oligonucleotide
tgagtagcctttggtataacagtgatcctgtgtgag

SEQ ID NO: 332265 - DNA, 35 bp, Artificial Sequence
  Description of Artificial Sequence: Synthetic oligonucleotide
gagtagcctttggtataacagtgatcctgtgtgag

SEQ ID NO: 332266 - DNA, 37 bp, Artificial Sequence
  Description of Artificial Sequence: Synthetic oligonucleotide
agtagcctttggtataacagtgatcctgtgtgagaac

SEQ ID NO: 332267 - DNA, 36 bp, Artificial Sequence
  Description of Artificial Sequence: Synthetic oligonucleotide
gtagcctttggtataacagtgatcctgtgtgagaac

SEQ ID NO: 332268 - DNA, 40 bp, Artificial Sequence
  Description of Artificial Sequence: Synthetic oligonucleotide
tagcctttggtataacagtgatcctgtgtgagaacatatc

SEQ ID NO: 332269 - DNA, 39 bp, Artificial Sequence
  Description of Artificial Sequence: Synthetic oligonucleotide
agcctttggtataacagtgatcctgtgtgagaacatatc

SEQ ID NO: 332270 - DNA, 38 bp, Artificial Sequence
  Description of Artificial Sequence: Synthetic oligonucleotide
gcctttggtataacagtgatcctgtgtgagaacatatc

SEQ ID NO: 332271 - DNA, 42 bp, Artificial Sequence
  Description of Artificial Sequence: Synthetic oligonucleotide
cctttggtataacagtgatcctgtgtgagaacatatcatttg

SEQ ID NO: 332272 - DNA, 43 bp, Artificial Sequence
  Description of Artificial Sequence: Synthetic oligonucleotide
ctttggtataacagtgatcctgtgtgagaacatatcatttgtc

SEQ ID NO: 332273 - DNA, 43 bp, Artificial Sequence
  Description of Artificial Sequence: Synthetic oligonucleotide
tttggtataacagtgatcctgtgtgagaacatatcatttgtcc

SEQ ID NO: 332274 - DNA, 42 bp, Artificial Sequence
  Description of Artificial Sequence: Synthetic oligonucleotide
ttggtataacagtgatcctgtgtgagaacatatcatttgtcc

SEQ ID NO: 332275 - DNA, 41 bp, Artificial Sequence
  Description of Artificial Sequence: Synthetic oligonucleotide
tggtataacagtgatcctgtgtgagaacatatcatttgtcc

SEQ ID NO: 332276 - DNA, 40 bp, Artificial Sequence
  Description of Artificial Sequence: Synthetic oligonucleotide
ggtataacagtgatcctgtgtgagaacatatcatttgtcc

SEQ ID NO: 332277 - DNA, 44 bp, Artificial Sequence
  Description of Artificial Sequence: Synthetic oligonucleotide
gtataacagtgatcctgtgtgagaacatatcatttgtccaattc

SEQ ID NO: 332278 - DNA, 44 bp, Artificial Sequence
  Description of Artificial Sequence: Synthetic oligonucleotide
tataacagtgatcctgtgtgagaacatatcatttgtccaattcc

SEQ ID NO: 332279 - DNA, 43 bp, Artificial Sequence
  Description of Artificial Sequence: Synthetic oligonucleotide
ataacagtgatcctgtgtgagaacatatcatttgtccaattcc

SEQ ID NO: 332280 - DNA, 42 bp, Artificial Sequence
  Description of Artificial Sequence: Synthetic oligonucleotide
taacagtgatcctgtgtgagaacatatcatttgtccaattcc

SEQ ID NO: 332281 - DNA, 41 bp, Artificial Sequence
  Description of Artificial Sequence: Synthetic oligonucleotide
aacagtgatcctgtgtgagaacatatcatttgtccaattcc

SEQ ID NO: 332282 - DNA, 40 bp, Artificial Sequence
  Description of Artificial Sequence: Synthetic oligonucleotide
acagtgatcctgtgtgagaacatatcatttgtccaattcc

SEQ ID NO: 332283 - DNA, 39 bp, Artificial Sequence
  Description of Artificial Sequence: Synthetic oligonucleotide
cagtgatcctgtgtgagaacatatcatttgtccaattcc

SEQ ID NO: 332284 - DNA, 40 bp, Artificial Sequence
  Description of Artificial Sequence: Synthetic oligonucleotide
agtgatcctgtgtgagaacatatcatttgtccaattcctc

SEQ ID NO: 332285 - DNA, 39 bp, Artificial Sequence
  Description of Artificial Sequence: Synthetic oligonucleotide
gtgatcctgtgtgagaacatatcatttgtccaattcctc

SEQ ID NO: 332286 - DNA, 39 bp, Artificial Sequence
  Description of Artificial Sequence: Synthetic oligonucleotide
tgatcctgtgtgagaacatatcatttgtccaattcctcc

SEQ ID NO: 332287 - DNA, 38 bp, Artificial Sequence
  Description of Artificial Sequence: Synthetic oligonucleotide
gatcctgtgtgagaacatatcatttgtccaattcctcc

SEQ ID NO: 332288 - DNA, 39 bp, Artificial Sequence
  Description of Artificial Sequence: Synthetic oligonucleotide
atcctgtgtgagaacatatcatttgtccaattcctccag

SEQ ID NO: 332289 - DNA, 38 bp, Artificial Sequence
  Description of Artificial Sequence: Synthetic oligonucleotide
tcctgtgtgagaacatatcatttgtccaattcctccag

SEQ ID NO: 332290 - DNA, 37 bp, Artificial Sequence
  Description of Artificial Sequence: Synthetic oligonucleotide
cctgtgtgagaacatatcatttgtccaattcctccag

SEQ ID NO: 332291 - DNA, 37 bp, Artificial Sequence
  Description of Artificial Sequence: Synthetic oligonucleotide
ctgtgtgagaacatatcatttgtccaattcctccagc

SEQ ID NO: 332292 - DNA, 40 bp, Artificial Sequence
  Description of Artificial Sequence: Synthetic oligonucleotide
tgtgtgagaacatatcatttgtccaattcctccagcaatc

SEQ ID NO: 332293 - DNA, 39 bp, Artificial Sequence
  Description of Artificial Sequence: Synthetic oligonucleotide
gtgtgagaacatatcatttgtccaattcctccagcaatc

SEQ ID NO: 332294 - DNA, 39 bp, Artificial Sequence
  Description of Artificial Sequence: Synthetic oligonucleotide
tgtgagaacatatcatttgtccaattcctccagcaatcc

SEQ ID NO: 332295 - DNA, 38 bp, Artificial Sequence
  Description of Artificial Sequence: Synthetic oligonucleotide
gtgagaacatatcatttgtccaattcctccagcaatcc

SEQ ID NO: 332296 - DNA, 43 bp, Artificial Sequence
  Description of Artificial Sequence: Synthetic oligonucleotide
tgagaacatatcatttgtccaattcctccagcaatccttaatc

SEQ ID NO: 332297 - DNA, 42 bp, Artificial Sequence
  Description of Artificial Sequence: Synthetic oligonucleotide
gagaacatatcatttgtccaattcctccagcaatccttaatc

SEQ ID NO: 332298 - DNA, 42 bp, Artificial Sequence
  Description of Artificial Sequence: Synthetic oligonucleotide
agaacatatcatttgtccaattcctccagcaatccttaatcg

SEQ ID NO: 332299 - DNA, 41 bp, Artificial Sequence
  Description of Artificial Sequence: Synthetic oligonucleotide
gaacatatcatttgtccaattcctccagcaatccttaatcg

SEQ ID NO: 332300 - DNA, 41 bp, Artificial Sequence
  Description of Artificial Sequence: Synthetic oligonucleotide
aacatatcatttgtccaattcctccagcaatccttaatcgg

SEQ ID NO: 332301 - DNA, 40 bp, Artificial Sequence
  Description of Artificial Sequence: Synthetic oligonucleotide
acatatcatttgtccaattcctccagcaatccttaatcgg

SEQ ID NO: 332302 - DNA, 39 bp, Artificial Sequence
  Description of Artificial Sequence: Synthetic oligonucleotide
catatcatttgtccaattcctccagcaatccttaatcgg

SEQ ID NO: 332303 - DNA, 40 bp, Artificial Sequence
  Description of Artificial Sequence: Synthetic oligonucleotide
atatcatttgtccaattcctccagcaatccttaatcggag

SEQ ID NO: 332304 - DNA, 39 bp, Artificial Sequence
  Description of Artificial Sequence: Synthetic oligonucleotide
tatcatttgtccaattcctccagcaatccttaatcggag

SEQ ID NO: 332305 - DNA, 38 bp, Artificial Sequence
  Description of Artificial Sequence: Synthetic oligonucleotide
atcatttgtccaattcctccagcaatccttaatcggag

SEQ ID NO: 332306 - DNA, 37 bp, Artificial Sequence
  Description of Artificial Sequence: Synthetic oligonucleotide
tcatttgtccaattcctccagcaatccttaatcggag

SEQ ID NO: 332307 - DNA, 36 bp, Artificial Sequence
  Description of Artificial Sequence: Synthetic oligonucleotide
catttgtccaattcctccagcaatccttaatcggag

SEQ ID NO: 332308 - DNA, 37 bp, Artificial Sequence
  Description of Artificial Sequence: Synthetic oligonucleotide
atttgtccaattcctccagcaatccttaatcggagac

SEQ ID NO: 332309 - DNA, 36 bp, Artificial Sequence
  Description of Artificial Sequence: Synthetic oligonucleotide
tttgtccaattcctccagcaatccttaatcggagac

SEQ ID NO: 332310 - DNA, 35 bp, Artificial Sequence
  Description of Artificial Sequence: Synthetic oligonucleotide
ttgtccaattcctccagcaatccttaatcggagac

SEQ ID NO: 332311 - DNA, 34 bp, Artificial Sequence
  Description of Artificial Sequence: Synthetic oligonucleotide
tgtccaattcctccagcaatccttaatcggagac

SEQ ID NO: 332312 - DNA, 33 bp, Artificial Sequence
  Description of Artificial Sequence: Synthetic oligonucleotide
gtccaattcctccagcaatccttaatcggagac

SEQ ID NO: 332313 - DNA, 34 bp, Artificial Sequence
  Description of Artificial Sequence: Synthetic oligonucleotide
tccaattcctccagcaatccttaatcggagacac

SEQ ID NO: 332314 - DNA, 33 bp, Artificial Sequence
  Description of Artificial Sequence: Synthetic oligonucleotide
ccaattcctccagcaatccttaatcggagacac

SEQ ID NO: 332315 - DNA, 34 bp, Artificial Sequence
  Description of Artificial Sequence: Synthetic oligonucleotide
caattcctccagcaatccttaatcggagacacag

SEQ ID NO: 332316 - DNA, 35 bp, Artificial Sequence
  Description of Artificial Sequence: Synthetic oligonucleotide
aattcctccagcaatccttaatcggagacacagag

SEQ ID NO: 332317 - DNA, 34 bp, Artificial Sequence
  Description of Artificial Sequence: Synthetic oligonucleotide
attcctccagcaatccttaatcggagacacagag

SEQ ID NO: 332318 - DNA, 33 bp, Artificial Sequence
  Description of Artificial Sequence: Synthetic oligonucleotide
ttcctccagcaatccttaatcggagacacagag

SEQ ID NO: 332319 - DNA, 32 bp, Artificial Sequence
  Description of Artificial Sequence: Synthetic oligonucleotide
tcctccagcaatccttaatcggagacacagag

SEQ ID NO: 332320 - DNA, 31 bp, Artificial Sequence
  Description of Artificial Sequence: Synthetic oligonucleotide
cctccagcaatccttaatcggagacacagag

SEQ ID NO: 332321 - DNA, 31 bp, Artificial Sequence
  Description of Artificial Sequence: Synthetic oligonucleotide
ctccagcaatccttaatcggagacacagagg

SEQ ID NO: 332322 - DNA, 33 bp, Artificial Sequence
  Description of Artificial Sequence: Synthetic oligonucleotide
tccagcaatccttaatcggagacacagaggaac

SEQ ID NO: 332323 - DNA, 32 bp, Artificial Sequence
  Description of Artificial Sequence: Synthetic oligonucleotide
ccagcaatccttaatcggagacacagaggaac

SEQ ID NO: 332324 - DNA, 33 bp, Artificial Sequence
  Description of Artificial Sequence: Synthetic oligonucleotide
cagcaatccttaatcggagacacagaggaactc

SEQ ID NO: 332325 - DNA, 33 bp, Artificial Sequence
  Description of Artificial Sequence: Synthetic oligonucleotide
agcaatccttaatcggagacacagaggaactcc

SEQ ID NO: 332326 - DNA, 32 bp, Artificial Sequence
  Description of Artificial Sequence: Synthetic oligonucleotide
gcaatccttaatcggagacacagaggaactcc

SEQ ID NO: 332327 - DNA, 32 bp, Artificial Sequence
  Description of Artificial Sequence: Synthetic oligonucleotide
caatccttaatcggagacacagaggaactccg

SEQ ID NO: 332328 - DNA, 33 bp, Artificial Sequence
  Description of Artificial Sequence: Synthetic oligonucleotide
aatccttaatcggagacacagaggaactccgtc

SEQ ID NO: 332329 - DNA, 32 bp, Artificial Sequence
  Description of Artificial Sequence: Synthetic oligonucleotide
atccttaatcggagacacagaggaactccgtc

SEQ ID NO: 332330 - DNA, 31 bp, Artificial Sequence
  Description of Artificial Sequence: Synthetic oligonucleotide
tccttaatcggagacacagaggaactccgtc

SEQ ID NO: 332331 - DNA, 30 bp, Artificial Sequence
  Description of Artificial Sequence: Synthetic oligonucleotide
ccttaatcggagacacagaggaactccgtc

SEQ ID NO: 332332 - DNA, 31 bp, Artificial Sequence
  Description of Artificial Sequence: Synthetic oligonucleotide
cttaatcggagacacagaggaactccgtctg

SEQ ID NO: 332333 - DNA, 31 bp, Artificial Sequence
  Description of Artificial Sequence: Synthetic oligonucleotide
ttaatcggagacacagaggaactccgtctgg

SEQ ID NO: 332334 - DNA, 30 bp, Artificial Sequence
  Description of Artificial Sequence: Synthetic oligonucleotide
taatcggagacacagaggaactccgtctgg

SEQ ID NO: 332335 - DNA, 29 bp, Artificial Sequence
  Description of Artificial Sequence: Synthetic oligonucleotide
aatcggagacacagaggaactccgtctgg

SEQ ID NO: 332336 - DNA, 28 bp, Artificial Sequence
  Description of Artificial Sequence: Synthetic oligonucleotide
atcggagacacagaggaactccgtctgg

SEQ ID NO: 332337 - DNA, 27 bp, Artificial Sequence
  Description of Artificial Sequence: Synthetic oligonucleotide
tcggagacacagaggaactccgtctgg

SEQ ID NO: 332338 - DNA, 27 bp, Artificial Sequence
  Description of Artificial Sequence: Synthetic oligonucleotide
cggagacacagaggaactccgtctgga

SEQ ID NO: 332339 - DNA, 27 bp, Artificial Sequence
  Description of Artificial Sequence: Synthetic oligonucleotide
ggagacacagaggaactccgtctggag

SEQ ID NO: 332340 - DNA, 32 bp, Artificial Sequence
  Description of Artificial Sequence: Synthetic oligonucleotide
gagacacagaggaactccgtctggagattttc

SEQ ID NO: 332341 - DNA, 32 bp, Artificial Sequence
  Description of Artificial Sequence: Synthetic oligonucleotide
agacacagaggaactccgtctggagattttcc

SEQ ID NO: 332342 - DNA, 31 bp, Artificial Sequence
  Description of Artificial Sequence: Synthetic oligonucleotide
gacacagaggaactccgtctggagattttcc

SEQ ID NO: 332343 - DNA, 31 bp, Artificial Sequence
  Description of Artificial Sequence: Synthetic oligonucleotide
acacagaggaactccgtctggagattttccc

SEQ ID NO: 332344 - DNA, 30 bp, Artificial Sequence
  Description of Artificial Sequence: Synthetic oligonucleotide
cacagaggaactccgtctggagattttccc

SEQ ID NO: 332345 - DNA, 33 bp, Artificial Sequence
  Description of Artificial Sequence: Synthetic oligonucleotide
acagaggaactccgtctggagattttccctatg

SEQ ID NO: 332346 - DNA, 32 bp, Artificial Sequence
  Description of Artificial Sequence: Synthetic oligonucleotide
cagaggaactccgtctggagattttccctatg

SEQ ID NO: 332347 - DNA, 32 bp, Artificial Sequence
  Description of Artificial Sequence: Synthetic oligonucleotide
agaggaactccgtctggagattttccctatgc

SEQ ID NO: 332348 - DNA, 31 bp, Artificial Sequence
  Description of Artificial Sequence: Synthetic oligonucleotide
gaggaactccgtctggagattttccctatgc

SEQ ID NO: 332349 - DNA, 35 bp, Artificial Sequence
  Description of Artificial Sequence: Synthetic oligonucleotide
aggaactccgtctggagattttccctatgcaaaag

SEQ ID NO: 332350 - DNA, 34 bp, Artificial Sequence
  Description of Artificial Sequence: Synthetic oligonucleotide
ggaactccgtctggagattttccctatgcaaaag

SEQ ID NO: 332351 - DNA, 40 bp, Artificial Sequence
  Description of Artificial Sequence: Synthetic oligonucleotide
gaactccgtctggagattttccctatgcaaaagaaatttc

SEQ ID NO: 332352 - DNA, 43 bp, Artificial Sequence
  Description of Artificial Sequence: Synthetic oligonucleotide
aactccgtctggagattttccctatgcaaaagaaatttcttac

SEQ ID NO: 332353 - DNA, 42 bp, Artificial Sequence
  Description of Artificial Sequence: Synthetic oligonucleotide
actccgtctggagattttccctatgcaaaagaaatttcttac

SEQ ID NO: 332354 - DNA, 41 bp, Artificial Sequence
  Description of Artificial Sequence: Synthetic oligonucleotide
ctccgtctggagattttccctatgcaaaagaaatttcttac

SEQ ID NO: 332355 - DNA, 42 bp, Artificial Sequence
  Description of Artificial Sequence: Synthetic oligonucleotide
tccgtctggagattttccctatgcaaaagaaatttcttacac

SEQ ID NO: 332356 - DNA, 41 bp, Artificial Sequence
  Description of Artificial Sequence: Synthetic oligonucleotide
ccgtctggagattttccctatgcaaaagaaatttcttacac

SEQ ID NO: 332357 - DNA, 43 bp, Artificial Sequence
  Description of Artificial Sequence: Synthetic oligonucleotide
cgtctggagattttccctatgcaaaagaaatttcttacacaag

SEQ ID NO: 332358 - DNA, 44 bp, Artificial Sequence
  Description of Artificial Sequence: Synthetic oligonucleotide
gtctggagattttccctatgcaaaagaaatttcttacacaagtg

SEQ ID NO: 332359 - DNA, 45 bp, Artificial Sequence
  Description of Artificial Sequence: Synthetic oligonucleotide
tctggagattttccctatgcaaaagaaatttcttacacaagtgac

SEQ ID NO: 332360 - DNA, 44 bp, Artificial Sequence
  Description of Artificial Sequence: Synthetic oligonucleotide
ctggagattttccctatgcaaaagaaatttcttacacaagtgac

SEQ ID NO: 332361 - DNA, 44 bp, Artificial Sequence
  Description of Artificial Sequence: Synthetic oligonucleotide
tggagattttccctatgcaaaagaaatttcttacacaagtgacc

SEQ ID NO: 332362 - DNA, 43 bp, Artificial Sequence
  Description of Artificial Sequence: Synthetic oligonucleotide
ggagattttccctatgcaaaagaaatttcttacacaagtgacc

SEQ ID NO: 332363 - DNA, 43 bp, Artificial Sequence
  Description of Artificial Sequence: Synthetic oligonucleotide
gagattttccctatgcaaaagaaatttcttacacaagtgaccc

SEQ ID NO: 332364 - DNA, 43 bp, Artificial Sequence
  Description of Artificial Sequence: Synthetic oligonucleotide
agattttccctatgcaaaagaaatttcttacacaagtgacccc

SEQ ID NO: 332365 - DNA, 42 bp, Artificial Sequence
  Description of Artificial Sequence: Synthetic oligonucleotide
gattttccctatgcaaaagaaatttcttacacaagtgacccc

SEQ ID NO: 332366 - DNA, 42 bp, Artificial Sequence
  Description of Artificial Sequence: Synthetic oligonucleotide
attttccctatgcaaaagaaatttcttacacaagtgaccccc

SEQ ID NO: 332367 - DNA, 41 bp, Artificial Sequence
  Description of Artificial Sequence: Synthetic oligonucleotide
ttttccctatgcaaaagaaatttcttacacaagtgaccccc

SEQ ID NO: 332368 - DNA, 40 bp, Artificial Sequence
  Description of Artificial Sequence: Synthetic oligonucleotide
tttccctatgcaaaagaaatttcttacacaagtgaccccc

SEQ ID NO: 332369 - DNA, 39 bp, Artificial Sequence
  Description of Artificial Sequence: Synthetic oligonucleotide
ttccctatgcaaaagaaatttcttacacaagtgaccccc

SEQ ID NO: 332370 - DNA, 38 bp, Artificial Sequence
  Description of Artificial Sequence: Synthetic oligonucleotide
tccctatgcaaaagaaatttcttacacaagtgaccccc

SEQ ID NO: 332371 - DNA, 37 bp, Artificial Sequence
  Description of Artificial Sequence: Synthetic oligonucleotide
ccctatgcaaaagaaatttcttacacaagtgaccccc

SEQ ID NO: 332372 - DNA, 38 bp, Artificial Sequence
  Description of Artificial Sequence: Synthetic oligonucleotide
cctatgcaaaagaaatttcttacacaagtgaccccctc

SEQ ID NO: 332373 - DNA, 38 bp, Artificial Sequence
  Description of Artificial Sequence: Synthetic oligonucleotide
ctatgcaaaagaaatttcttacacaagtgaccccctcc

SEQ ID NO: 332374 - DNA, 38 bp, Artificial Sequence
  Description of Artificial Sequence: Synthetic oligonucleotide
tatgcaaaagaaatttcttacacaagtgaccccctccc

SEQ ID NO: 332375 - DNA, 37 bp, Artificial Sequence
  Description of Artificial Sequence: Synthetic oligonucleotide
atgcaaaagaaatttcttacacaagtgaccccctccc

SEQ ID NO: 332376 - DNA, 36 bp, Artificial Sequence
  Description of Artificial Sequence: Synthetic oligonucleotide
tgcaaaagaaatttcttacacaagtgaccccctccc

SEQ ID NO: 332377 - DNA, 35 bp, Artificial Sequence
  Description of Artificial Sequence: Synthetic oligonucleotide
gcaaaagaaatttcttacacaagtgaccccctccc

SEQ ID NO: 332378 - DNA, 36 bp, Artificial Sequence
  Description of Artificial Sequence: Synthetic oligonucleotide
caaaagaaatttcttacacaagtgaccccctcccag

SEQ ID NO: 332379 - DNA, 37 bp, Artificial Sequence
  Description of Artificial Sequence: Synthetic oligonucleotide
aaaagaaatttcttacacaagtgaccccctcccagac

SEQ ID NO: 332380 - DNA, 36 bp, Artificial Sequence
  Description of Artificial Sequence: Synthetic oligonucleotide
aaagaaatttcttacacaagtgaccccctcccagac

SEQ ID NO: 332381 - DNA, 35 bp, Artificial Sequence
  Description of Artificial Sequence: Synthetic oligonucleotide
aagaaatttcttacacaagtgaccccctcccagac

SEQ ID NO: 332382 - DNA, 34 bp, Artificial Sequence
  Description of Artificial Sequence: Synthetic oligonucleotide
agaaatttcttacacaagtgaccccctcccagac

SEQ ID NO: 332383 - DNA, 33 bp, Artificial Sequence
  Description of Artificial Sequence: Synthetic oligonucleotide
gaaatttcttacacaagtgaccccctcccagac

SEQ ID NO: 332384 - DNA, 34 bp, Artificial Sequence
  Description of Artificial Sequence: Synthetic oligonucleotide
aaatttcttacacaagtgaccccctcccagacag

SEQ ID NO: 332385 - DNA, 33 bp, Artificial Sequence
  Description of Artificial Sequence: Synthetic oligonucleotide
aatttcttacacaagtgaccccctcccagacag

SEQ ID NO: 332386 - DNA, 32 bp, Artificial Sequence
  Description of Artificial Sequence: Synthetic oligonucleotide
atttcttacacaagtgaccccctcccagacag

SEQ ID NO: 332387 - DNA, 31 bp, Artificial Sequence
  Description of Artificial Sequence: Synthetic oligonucleotide
tttcttacacaagtgaccccctcccagacag

SEQ ID NO: 332388 - DNA, 30 bp, Artificial Sequence
  Description of Artificial Sequence: Synthetic oligonucleotide
ttcttacacaagtgaccccctcccagacag

SEQ ID NO: 332389 - DNA, 29 bp, Artificial Sequence
  Description of Artificial Sequence: Synthetic oligonucleotide
tcttacacaagtgaccccctcccagacag

SEQ ID NO: 332390 - DNA, 28 bp, Artificial Sequence
  Description of Artificial Sequence: Synthetic oligonucleotide
cttacacaagtgaccccctcccagacag

SEQ ID NO: 332391 - DNA, 29 bp, Artificial Sequence
  Description of Artificial Sequence: Synthetic oligonucleotide
ttacacaagtgaccccctcccagacagtg

SEQ ID NO: 332392 - DNA, 28 bp, Artificial Sequence
  Description of Artificial Sequence: Synthetic oligonucleotide
tacacaagtgaccccctcccagacagtg

SEQ ID NO: 332393 - DNA, 27 bp, Artificial Sequence
  Description of Artificial Sequence: Synthetic oligonucleotide
acacaagtgaccccctcccagacagtg

SEQ ID NO: 332394 - DNA, 26 bp, Artificial Sequence
  Description of Artificial Sequence: Synthetic oligonucleotide
cacaagtgaccccctcccagacagtg

SEQ ID NO: 332395 - DNA, 26 bp, Artificial Sequence
  Description of Artificial Sequence: Synthetic oligonucleotide
acaagtgaccccctcccagacagtgg

SEQ ID NO: 332396 - DNA, 25 bp, Artificial Sequence
  Description of Artificial Sequence: Synthetic oligonucleotide
caagtgaccccctcccagacagtgg

SEQ ID NO: 332397 - DNA, 27 bp, Artificial Sequence
  Description of Artificial Sequence: Synthetic oligonucleotide
aagtgaccccctcccagacagtgggat

SEQ ID NO: 332398 - DNA, 26 bp, Artificial Sequence
  Description of Artificial Sequence: Synthetic oligonucleotide
agtgaccccctcccagacagtgggat

SEQ ID NO: 332399 - DNA, 25 bp, Artificial Sequence
  Description of Artificial Sequence: Synthetic oligonucleotide
gtgaccccctcccagacagtgggat

SEQ ID NO: 332400 - DNA, 26 bp, Artificial Sequence
  Description of Artificial Sequence: Synthetic oligonucleotide
tgaccccctcccagacagtgggatga

SEQ ID NO: 332401 - DNA, 25 bp, Artificial Sequence
  Description of Artificial Sequence: Synthetic oligonucleotide
gaccccctcccagacagtgggatga

SEQ ID NO: 332402 - DNA, 25 bp, Artificial Sequence
  Description of Artificial Sequence: Synthetic oligonucleotide
accccctcccagacagtgggatgac

SEQ ID NO: 332403 - DNA, 24 bp, Artificial Sequence
  Description of Artificial Sequence: Synthetic oligonucleotide
ccccctcccagacagtgggatgac

SEQ ID NO: 332404 - DNA, 26 bp, Artificial Sequence
  Description of Artificial Sequence: Synthetic oligonucleotide
cccctcccagacagtgggatgaccat

SEQ ID NO: 332405 - DNA, 27 bp, Artificial Sequence
  Description of Artificial Sequence: Synthetic oligonucleotide
ccctcccagacagtgggatgaccatca

SEQ ID NO: 332406 - DNA, 28 bp, Artificial Sequence
  Description of Artificial Sequence: Synthetic oligonucleotide
cctcccagacagtgggatgaccatcaac

SEQ ID NO: 332407 - DNA, 28 bp, Artificial Sequence
  Description of Artificial Sequence: Synthetic oligonucleotide
ctcccagacagtgggatgaccatcaacc

SEQ ID NO: 332408 - DNA, 29 bp, Artificial Sequence
  Description of Artificial Sequence: Synthetic oligonucleotide
tcccagacagtgggatgaccatcaacctc

SEQ ID NO: 332409 - DNA, 28 bp, Artificial Sequence
  Description of Artificial Sequence: Synthetic oligonucleotide
cccagacagtgggatgaccatcaacctc

SEQ ID NO: 332410 - DNA, 31 bp, Artificial Sequence
  Description of Artificial Sequence: Synthetic oligonucleotide
ccagacagtgggatgaccatcaacctcaatg

SEQ ID NO: 332411 - DNA, 31 bp, Artificial Sequence
  Description of Artificial Sequence: Synthetic oligonucleotide
cagacagtgggatgaccatcaacctcaatgg

SEQ ID NO: 332412 - DNA, 31 bp, Artificial Sequence
  Description of Artificial Sequence: Synthetic oligonucleotide
agacagtgggatgaccatcaacctcaatggg

SEQ ID NO: 332413 - DNA, 30 bp, Artificial Sequence
  Description of Artificial Sequence: Synthetic oligonucleotide
gacagtgggatgaccatcaacctcaatggg

SEQ ID NO: 332414 - DNA, 30 bp, Artificial Sequence
  Description of Artificial Sequence: Synthetic oligonucleotide
acagtgggatgaccatcaacctcaatgggg

SEQ ID NO: 332415 - DNA, 29 bp, Artificial Sequence
  Description of Artificial Sequence: Synthetic oligonucleotide
cagtgggatgaccatcaacctcaatgggg

SEQ ID NO: 332416 - DNA, 30 bp, Artificial Sequence
  Description of Artificial Sequence: Synthetic oligonucleotide
agtgggatgaccatcaacctcaatggggag

SEQ ID NO: 332417 - DNA, 29 bp, Artificial Sequence
  Description of Artificial Sequence: Synthetic oligonucleotide
gtgggatgaccatcaacctcaatggggag

SEQ ID NO: 332418 - DNA, 30 bp, Artificial Sequence
  Description of Artificial Sequence: Synthetic oligonucleotide
tgggatgaccatcaacctcaatggggagag

SEQ ID NO: 332419 - DNA, 29 bp, Artificial Sequence
  Description of Artificial Sequence: Synthetic oligonucleotide
gggatgaccatcaacctcaatggggagag

SEQ ID NO: 332420 - DNA, 29 bp, Artificial Sequence
  Description of Artificial Sequence: Synthetic oligonucleotide
ggatgaccatcaacctcaatggggagagg

SEQ ID NO: 332421 - DNA, 30 bp, Artificial Sequence
  Description of Artificial Sequence: Synthetic oligonucleotide
gatgaccatcaacctcaatggggagaggac

SEQ ID NO: 332422 - DNA, 30 bp, Artificial Sequence
  Description of Artificial Sequence: Synthetic oligonucleotide
atgaccatcaacctcaatggggagaggacc

SEQ ID NO: 332423 - DNA, 29 bp, Artificial Sequence
  Description of Artificial Sequence: Synthetic oligonucleotide
tgaccatcaacctcaatggggagaggacc

SEQ ID NO: 332424 - DNA, 28 bp, Artificial Sequence
  Description of Artificial Sequence: Synthetic oligonucleotide
gaccatcaacctcaatggggagaggacc

SEQ ID NO: 332425 - DNA, 30 bp, Artificial Sequence
  Description of Artificial Sequence: Synthetic oligonucleotide
accatcaacctcaatggggagaggaccatc

SEQ ID NO: 332426 - DNA, 29 bp, Artificial Sequence
  Description of Artificial Sequence: Synthetic oligonucleotide
ccatcaacctcaatggggagaggaccatc

SEQ ID NO: 332427 - DNA, 29 bp, Artificial Sequence
  Description of Artificial Sequence: Synthetic oligonucleotide
catcaacctcaatggggagaggaccatcc

SEQ ID NO: 332428 - DNA, 29 bp, Artificial Sequence
  Description of Artificial Sequence: Synthetic oligonucleotide
atcaacctcaatggggagaggaccatccg

SEQ ID NO: 332429 - DNA, 28 bp, Artificial Sequence
  Description of Artificial Sequence: Synthetic oligonucleotide
tcaacctcaatggggagaggaccatccg

SEQ ID NO: 332430 - DNA, 27 bp, Artificial Sequence
  Description of Artificial Sequence: Synthetic oligonucleotide
caacctcaatggggagaggaccatccg

SEQ ID NO: 332431 - DNA, 27 bp, Artificial Sequence
  Description of Artificial Sequence: Synthetic oligonucleotide
aacctcaatggggagaggaccatccgc

SEQ ID NO: 332432 - DNA, 27 bp, Artificial Sequence
  Description of Artificial Sequence: Synthetic oligonucleotide
acctcaatggggagaggaccatccgca

SEQ ID NO: 332433 - DNA, 26 bp, Artificial Sequence
  Description of Artificial Sequence: Synthetic oligonucleotide
cctcaatggggagaggaccatccgca

SEQ ID NO: 332434 - DNA, 26 bp, Artificial Sequence
  Description of Artificial Sequence: Synthetic oligonucleotide
ctcaatggggagaggaccatccgcag

SEQ ID NO: 332435 - DNA, 27 bp, Artificial Sequence
  Description of Artificial Sequence: Synthetic oligonucleotide
tcaatggggagaggaccatccgcagca

SEQ ID NO: 332436 - DNA, 26 bp, Artificial Sequence
  Description of Artificial Sequence: Synthetic oligonucleotide
caatggggagaggaccatccgcagca

SEQ ID NO: 332437 - DNA, 27 bp, Artificial Sequence
  Description of Artificial Sequence: Synthetic oligonucleotide
aatggggagaggaccatccgcagcaca

SEQ ID NO: 332438 - DNA, 27 bp, Artificial Sequence
  Description of Artificial Sequence: Synthetic oligonucleotide
atggggagaggaccatccgcagcacaa

SEQ ID NO: 332439 - DNA, 26 bp, Artificial Sequence
  Description of Artificial Sequence: Synthetic oligonucleotide
tggggagaggaccatccgcagcacaa

SEQ ID NO: 332440 - DNA, 25 bp, Artificial Sequence
  Description of Artificial Sequence: Synthetic oligonucleotide
ggggagaggaccatccgcagcacaa

SEQ ID NO: 332441 - DNA, 26 bp, Artificial Sequence
  Description of Artificial Sequence: Synthetic oligonucleotide
gggagaggaccatccgcagcacaagt

SEQ ID NO: 332442 - DNA, 27 bp, Artificial Sequence
  Description of Artificial Sequence: Synthetic oligonucleotide
ggagaggaccatccgcagcacaagtgt

SEQ ID NO: 332443 - DNA, 27 bp, Artificial Sequence
  Description of Artificial Sequence: Synthetic oligonucleotide
gagaggaccatccgcagcacaagtgtc

SEQ ID NO: 332444 - DNA, 27 bp, Artificial Sequence
  Description of Artificial Sequence: Synthetic oligonucleotide
agaggaccatccgcagcacaagtgtcc

SEQ ID NO: 332445 - DNA, 26 bp, Artificial Sequence
  Description of Artificial Sequence: Synthetic oligonucleotide
gaggaccatccgcagcacaagtgtcc

SEQ ID NO: 332446 - DNA, 27 bp, Artificial Sequence
  Description of Artificial Sequence: Synthetic oligonucleotide
aggaccatccgcagcacaagtgtccct

SEQ ID NO: 332447 - DNA, 26 bp, Artificial Sequence
  Description of Artificial Sequence: Synthetic oligonucleotide
ggaccatccgcagcacaagtgtccct

SEQ ID NO: 332448 - DNA, 27 bp, Artificial Sequence
  Description of Artificial Sequence: Synthetic oligonucleotide
gaccatccgcagcacaagtgtccctca

SEQ ID NO: 332449 - DNA, 28 bp, Artificial Sequence
  Description of Artificial Sequence: Synthetic oligonucleotide
accatccgcagcacaagtgtccctcatg

SEQ ID NO: 332450 - DNA, 27 bp, Artificial Sequence
  Description of Artificial Sequence: Synthetic oligonucleotide
ccatccgcagcacaagtgtccctcatg

SEQ ID NO: 332451 - DNA, 27 bp, Artificial Sequence
  Description of Artificial Sequence: Synthetic oligonucleotide
catccgcagcacaagtgtccctcatgg

SEQ ID NO: 332452 - DNA, 27 bp, Artificial Sequence
  Description of Artificial Sequence: Synthetic oligonucleotide
atccgcagcacaagtgtccctcatggc

SEQ ID NO: 332453 - DNA, 27 bp, Artificial Sequence
  Description of Artificial Sequence: Synthetic oligonucleotide
tccgcagcacaagtgtccctcatggca

SEQ ID NO: 332454 - DNA, 27 bp, Artificial Sequence
  Description of Artificial Sequence: Synthetic oligonucleotide
ccgcagcacaagtgtccctcatggcaa

SEQ ID NO: 332455 - DNA, 28 bp, Artificial Sequence
  Description of Artificial Sequence: Synthetic oligonucleotide
cgcagcacaagtgtccctcatggcaatg

SEQ ID NO: 332456 - DNA, 28 bp, Artificial Sequence
  Description of Artificial Sequence: Synthetic oligonucleotide
gcagcacaagtgtccctcatggcaatgg

SEQ ID NO: 332457 - DNA, 28 bp, Artificial Sequence
  Description of Artificial Sequence: Synthetic oligonucleotide
cagcacaagtgtccctcatggcaatggg

SEQ ID NO: 332458 - DNA, 28 bp, Artificial Sequence
  Description of Artificial Sequence: Synthetic oligonucleotide
agcacaagtgtccctcatggcaatgggg

SEQ ID NO: 332459 - DNA, 27 bp, Artificial Sequence
  Description of Artificial Sequence: Synthetic oligonucleotide
gcacaagtgtccctcatggcaatgggg

SEQ ID NO: 332460 - DNA, 30 bp, Artificial Sequence
  Description of Artificial Sequence: Synthetic oligonucleotide
cacaagtgtccctcatggcaatggggttag

SEQ ID NO: 332461 - DNA, 30 bp, Artificial Sequence
  Description of Artificial Sequence: Synthetic oligonucleotide
acaagtgtccctcatggcaatggggttagg

SEQ ID NO: 332462 - DNA, 29 bp, Artificial Sequence
  Description of Artificial Sequence: Synthetic oligonucleotide
caagtgtccctcatggcaatggggttagg

SEQ ID NO: 332463 - DNA, 30 bp, Artificial Sequence
  Description of Artificial Sequence: Synthetic oligonucleotide
aagtgtccctcatggcaatggggttaggag

SEQ ID NO: 332464 - DNA, 29 bp, Artificial Sequence
  Description of Artificial Sequence: Synthetic oligonucleotide
agtgtccctcatggcaatggggttaggag

SEQ ID NO: 332465 - DNA, 28 bp, Artificial Sequence
  Description of Artificial Sequence: Synthetic oligonucleotide
gtgtccctcatggcaatggggttaggag

SEQ ID NO: 332466 - DNA, 28 bp, Artificial Sequence
  Description of Artificial Sequence: Synthetic oligonucleotide
tgtccctcatggcaatggggttaggagc

SEQ ID NO: 332467 - DNA, 27 bp, Artificial Sequence
  Description of Artificial Sequence: Synthetic oligonucleotide
gtccctcatggcaatggggttaggagc

SEQ ID NO: 332468 - DNA, 28 bp, Artificial Sequence
  Description of Artificial Sequence: Synthetic oligonucleotide
tccctcatggcaatggggttaggagcag

SEQ ID NO: 332469 - DNA, 27 bp, Artificial Sequence
  Description of Artificial Sequence: Synthetic oligonucleotide
ccctcatggcaatggggttaggagcag

SEQ ID NO: 332470 - DNA, 27 bp, Artificial Sequence
  Description of Artificial Sequence: Synthetic oligonucleotide
cctcatggcaatggggttaggagcagc

SEQ ID NO: 332471 - DNA, 27 bp, Artificial Sequence
  Description of Artificial Sequence: Synthetic oligonucleotide
ctcatggcaatggggttaggagcagcc

SEQ ID NO: 332472 - DNA, 27 bp, Artificial Sequence
  Description of Artificial Sequence: Synthetic oligonucleotide
tcatggcaatggggttaggagcagccg

SEQ ID NO: 332473 - DNA, 27 bp, Artificial Sequence
  Description of Artificial Sequence: Synthetic oligonucleotide
catggcaatggggttaggagcagccgt

SEQ ID NO: 332474 - DNA, 27 bp, Artificial Sequence
  Description of Artificial Sequence: Synthetic oligonucleotide
atggcaatggggttaggagcagccgtg

SEQ ID NO: 332475 - DNA, 26 bp, Artificial Sequence
  Description of Artificial Sequence: Synthetic oligonucleotide
tggcaatggggttaggagcagccgtg

SEQ ID NO: 332476 - DNA, 25 bp, Artificial Sequence
  Description of Artificial Sequence: Synthetic oligonucleotide
ggcaatggggttaggagcagccgtg

SEQ ID NO: 332477 - DNA, 25 bp, Artificial Sequence
  Description of Artificial Sequence: Synthetic oligonucleotide
gcaatggggttaggagcagccgtgc

SEQ ID NO: 332478 - DNA, 25 bp, Artificial Sequence
  Description of Artificial Sequence: Synthetic oligonucleotide
caatggggttaggagcagccgtgcc

SEQ ID NO: 332479 - DNA, 25 bp, Artificial Sequence
  Description of Artificial Sequence: Synthetic oligonucleotide
aatggggttaggagcagccgtgccc

SEQ ID NO: 332480 - DNA, 24 bp, Artificial Sequence
  Description of Artificial Sequence: Synthetic oligonucleotide
atggggttaggagcagccgtgccc

SEQ ID NO: 332481 - DNA, 23 bp, Artificial Sequence
  Description of Artificial Sequence: Synthetic oligonucleotide
tggggttaggagcagccgtgccc

SEQ ID NO: 332482 - DNA, 22 bp, Artificial Sequence
  Description of Artificial Sequence: Synthetic oligonucleotide
ggggttaggagcagccgtgccc

SEQ ID NO: 332483 - DNA, 23 bp, Artificial Sequence
  Description of Artificial Sequence: Synthetic oligonucleotide
gggttaggagcagccgtgcccct

SEQ ID NO: 332484 - DNA, 23 bp, Artificial Sequence
  Description of Artificial Sequence: Synthetic oligonucleotide
ggttaggagcagccgtgcccctc

SEQ ID NO: 332485 - DNA, 23 bp, Artificial Sequence
  Description of Artificial Sequence: Synthetic oligonucleotide
gttaggagcagccgtgcccctcg

SEQ ID NO: 332486 - DNA, 24 bp, Artificial Sequence
  Description of Artificial Sequence: Synthetic oligonucleotide
ttaggagcagccgtgcccctcggt

SEQ ID NO: 332487 - DNA, 23 bp, Artificial Sequence
  Description of Artificial Sequence: Synthetic oligonucleotide
taggagcagccgtgcccctcggt

SEQ ID NO: 332488 - DNA, 22 bp, Artificial Sequence
  Description of Artificial Sequence: Synthetic oligonucleotide
aggagcagccgtgcccctcggt

SEQ ID NO: 332489 - DNA, 21 bp, Artificial Sequence
  Description of Artificial Sequence: Synthetic oligonucleotide
ggagcagccgtgcccctcggt

SEQ ID NO: 332490 - DNA, 22 bp, Artificial Sequence
  Description of Artificial Sequence: Synthetic oligonucleotide
gagcagccgtgcccctcggtgt

SEQ ID NO: 332491 - DNA, 24 bp, Artificial Sequence
  Description of Artificial Sequence: Synthetic oligonucleotide
agcagccgtgcccctcggtgtgaa

SEQ ID NO: 332492 - DNA, 23 bp, Artificial Sequence
  Description of Artificial Sequence: Synthetic oligonucleotide
gcagccgtgcccctcggtgtgaa

SEQ ID NO: 332493 - DNA, 26 bp, Artificial Sequence
  Description of Artificial Sequence: Synthetic oligonucleotide
cagccgtgcccctcggtgtgaactta

SEQ ID NO: 332494 - DNA, 27 bp, Artificial Sequence
  Description of Artificial Sequence: Synthetic oligonucleotide
agccgtgcccctcggtgtgaacttact

SEQ ID NO: 332495 - DNA, 26 bp, Artificial Sequence
  Description of Artificial Sequence: Synthetic oligonucleotide
gccgtgcccctcggtgtgaacttact

SEQ ID NO: 332496 - DNA, 27 bp, Artificial Sequence
  Description of Artificial Sequence: Synthetic oligonucleotide
ccgtgcccctcggtgtgaacttactgt

SEQ ID NO: 332497 - DNA, 28 bp, Artificial Sequence
  Description of Artificial Sequence: Synthetic oligonucleotide
cgtgcccctcggtgtgaacttactgttc

SEQ ID NO: 332498 - DNA, 28 bp, Artificial Sequence
  Description of Artificial Sequence: Synthetic oligonucleotide
gtgcccctcggtgtgaacttactgttcg

SEQ ID NO: 332499 - DNA, 29 bp, Artificial Sequence
  Description of Artificial Sequence: Synthetic oligonucleotide
tgcccctcggtgtgaacttactgttcgtg

SEQ ID NO: 332500 - DNA, 28 bp, Artificial Sequence
  Description of Artificial Sequence: Synthetic oligonucleotide
gcccctcggtgtgaacttactgttcgtg

SEQ ID NO: 332501 - DNA, 28 bp, Artificial Sequence
  Description of Artificial Sequence: Synthetic oligonucleotide
cccctcggtgtgaacttactgttcgtgg

SEQ ID NO: 332502 - DNA, 29 bp, Artificial Sequence
  Description of Artificial Sequence: Synthetic oligonucleotide
ccctcggtgtgaacttactgttcgtggtg

SEQ ID NO: 332503 - DNA, 29 bp, Artificial Sequence
  Description of Artificial Sequence: Synthetic oligonucleotide
cctcggtgtgaacttactgttcgtggtgg

SEQ ID NO: 332504 - DNA, 30 bp, Artificial Sequence
  Description of Artificial Sequence: Synthetic oligonucleotide
ctcggtgtgaacttactgttcgtggtggtc

SEQ ID NO: 332505 - DNA, 31 bp, Artificial Sequence
  Description of Artificial Sequence: Synthetic oligonucleotide
tcggtgtgaacttactgttcgtggtggtcac

SEQ ID NO: 332506 - DNA, 30 bp, Artificial Sequence
  Description of Artificial Sequence: Synthetic oligonucleotide
cggtgtgaacttactgttcgtggtggtcac

SEQ ID NO: 332507 - DNA, 31 bp, Artificial Sequence
  Description of Artificial Sequence: Synthetic oligonucleotide
ggtgtgaacttactgttcgtggtggtcactg

SEQ ID NO: 332508 - DNA, 36 bp, Artificial Sequence
  Description of Artificial Sequence: Synthetic oligonucleotide
gtgtgaacttactgttcgtggtggtcactgaaaaac

SEQ ID NO: 332509 - DNA, 36 bp, Artificial Sequence
  Description of Artificial Sequence: Synthetic oligonucleotide
tgtgaacttactgttcgtggtggtcactgaaaaacc

SEQ ID NO: 332510 - DNA, 35 bp, Artificial Sequence
  Description of Artificial Sequence: Synthetic oligonucleotide
gtgaacttactgttcgtggtggtcactgaaaaacc

SEQ ID NO: 332511 - DNA, 35 bp, Artificial Sequence
  Description of Artificial Sequence: Synthetic oligonucleotide
tgaacttactgttcgtggtggtcactgaaaaaccc

SEQ ID NO: 332512 - DNA, 34 bp, Artificial Sequence
  Description of Artificial Sequence: Synthetic oligonucleotide
gaacttactgttcgtggtggtcactgaaaaaccc

SEQ ID NO: 332513 - DNA, 34 bp, Artificial Sequence
  Description of Artificial Sequence: Synthetic oligonucleotide
aacttactgttcgtggtggtcactgaaaaacccc

SEQ ID NO: 332514 - DNA, 33 bp, Artificial Sequence
  Description of Artificial Sequence: Synthetic oligonucleotide
acttactgttcgtggtggtcactgaaaaacccc

SEQ ID NO: 332515 - DNA, 32 bp, Artificial Sequence
  Description of Artificial Sequence: Synthetic oligonucleotide
cttactgttcgtggtggtcactgaaaaacccc

SEQ ID NO: 332516 - DNA, 33 bp, Artificial Sequence
  Description of Artificial Sequence: Synthetic oligonucleotide
ttactgttcgtggtggtcactgaaaaaccccac

SEQ ID NO: 332517 - DNA, 32 bp, Artificial Sequence
  Description of Artificial Sequence: Synthetic oligonucleotide
tactgttcgtggtggtcactgaaaaaccccac

SEQ ID NO: 332518 - DNA, 31 bp, Artificial Sequence
  Description of Artificial Sequence: Synthetic oligonucleotide
actgttcgtggtggtcactgaaaaaccccac

SEQ ID NO: 332519 - DNA, 30 bp, Artificial Sequence
  Description of Artificial Sequence: Synthetic oligonucleotide
ctgttcgtggtggtcactgaaaaaccccac

SEQ ID NO: 332520 - DNA, 31 bp, Artificial Sequence
  Description of Artificial Sequence: Synthetic oligonucleotide
tgttcgtggtggtcactgaaaaaccccacag

SEQ ID NO: 332521 - DNA, 30 bp, Artificial Sequence
  Description of Artificial Sequence: Synthetic oligonucleotide
gttcgtggtggtcactgaaaaaccccacag

SEQ ID NO: 332522 - DNA, 30 bp, Artificial Sequence
  Description of Artificial Sequence: Synthetic oligonucleotide
ttcgtggtggtcactgaaaaaccccacagc

SEQ ID NO: 332523 - DNA, 29 bp, Artificial Sequence
  Description of Artificial Sequence: Synthetic oligonucleotide
tcgtggtggtcactgaaaaaccccacagc

SEQ ID NO: 332524 - DNA, 28 bp, Artificial Sequence
  Description of Artificial Sequence: Synthetic oligonucleotide
cgtggtggtcactgaaaaaccccacagc

SEQ ID NO: 332525 - DNA, 29 bp, Artificial Sequence
  Description of Artificial Sequence: Synthetic oligonucleotide
gtggtggtcactgaaaaaccccacagcag

SEQ ID NO: 332526 - DNA, 32 bp, Artificial Sequence
  Description of Artificial Sequence: Synthetic oligonucleotide
tggtggtcactgaaaaaccccacagcagtttc

SEQ ID NO: 332527 - DNA, 31 bp, Artificial Sequence
  Description of Artificial Sequence: Synthetic oligonucleotide
ggtggtcactgaaaaaccccacagcagtttc

SEQ ID NO: 332528 - DNA, 31 bp, Artificial Sequence
  Description of Artificial Sequence: Synthetic oligonucleotide
gtggtcactgaaaaaccccacagcagtttcg

SEQ ID NO: 332529 - DNA, 35 bp, Artificial Sequence
  Description of Artificial Sequence: Synthetic oligonucleotide
tggtcactgaaaaaccccacagcagtttcgatttg

SEQ ID NO: 332530 - DNA, 34 bp, Artificial Sequence
  Description of Artificial Sequence: Synthetic oligonucleotide
ggtcactgaaaaaccccacagcagtttcgatttg

SEQ ID NO: 332531 - DNA, 34 bp, Artificial Sequence
  Description of Artificial Sequence: Synthetic oligonucleotide
gtcactgaaaaaccccacagcagtttcgatttgc

SEQ ID NO: 332532 - DNA, 34 bp, Artificial Sequence
  Description of Artificial Sequence: Synthetic oligonucleotide
tcactgaaaaaccccacagcagtttcgatttgcc

SEQ ID NO: 332533 - DNA, 33 bp, Artificial Sequence
  Description of Artificial Sequence: Synthetic oligonucleotide
cactgaaaaaccccacagcagtttcgatttgcc

SEQ ID NO: 332534 - DNA, 34 bp, Artificial Sequence
  Description of Artificial Sequence: Synthetic oligonucleotide
actgaaaaaccccacagcagtttcgatttgccag

SEQ ID NO: 332535 - DNA, 33 bp, Artificial Sequence
  Description of Artificial Sequence: Synthetic oligonucleotide
ctgaaaaaccccacagcagtttcgatttgccag

SEQ ID NO: 332536 - DNA, 34 bp, Artificial Sequence
  Description of Artificial Sequence: Synthetic oligonucleotide
tgaaaaaccccacagcagtttcgatttgccagac

SEQ ID NO: 332537 - DNA, 33 bp, Artificial Sequence
  Description of Artificial Sequence: Synthetic oligonucleotide
gaaaaaccccacagcagtttcgatttgccagac

SEQ ID NO: 332538 - DNA, 33 bp, Artificial Sequence
  Description of Artificial Sequence: Synthetic oligonucleotide
aaaaaccccacagcagtttcgatttgccagacc

SEQ ID NO: 332539 - DNA, 32 bp, Artificial Sequence
  Description of Artificial Sequence: Synthetic oligonucleotide
aaaaccccacagcagtttcgatttgccagacc

SEQ ID NO: 332540 - DNA, 31 bp, Artificial Sequence
  Description of Artificial Sequence: Synthetic oligonucleotide
aaaccccacagcagtttcgatttgccagacc

SEQ ID NO: 332541 - DNA, 30 bp, Artificial Sequence
  Description of Artificial Sequence: Synthetic oligonucleotide
aaccccacagcagtttcgatttgccagacc

SEQ ID NO: 332542 - DNA, 29 bp, Artificial Sequence
  Description of Artificial Sequence: Synthetic oligonucleotide
accccacagcagtttcgatttgccagacc

SEQ ID NO: 332543 - DNA, 28 bp, Artificial Sequence
  Description of Artificial Sequence: Synthetic oligonucleotide
ccccacagcagtttcgatttgccagacc

SEQ ID NO: 332544 - DNA, 30 bp, Artificial Sequence
  Description of Artificial Sequence: Synthetic oligonucleotide
cccacagcagtttcgatttgccagacctac

SEQ ID NO: 332545 - DNA, 30 bp, Artificial Sequence
  Description of Artificial Sequence: Synthetic oligonucleotide
ccacagcagtttcgatttgccagacctacg

SEQ ID NO: 332546 - DNA, 32 bp, Artificial Sequence
  Description of Artificial Sequence: Synthetic oligonucleotide
cacagcagtttcgatttgccagacctacgatc

SEQ ID NO: 332547 - DNA, 32 bp, Artificial Sequence
  Description of Artificial Sequence: Synthetic oligonucleotide
acagcagtttcgatttgccagacctacgatcg

SEQ ID NO: 332548 - DNA, 31 bp, Artificial Sequence
  Description of Artificial Sequence: Synthetic oligonucleotide
cagcagtttcgatttgccagacctacgatcg

SEQ ID NO: 332549 - DNA, 31 bp, Artificial Sequence
  Description of Artificial Sequence: Synthetic oligonucleotide
agcagtttcgatttgccagacctacgatcgc

SEQ ID NO: 332550 - DNA, 30 bp, Artificial Sequence
  Description of Artificial Sequence: Synthetic oligonucleotide
gcagtttcgatttgccagacctacgatcgc

SEQ ID NO: 332551 - DNA, 37 bp, Artificial Sequence
  Description of Artificial Sequence: Synthetic oligonucleotide
cagtttcgatttgccagacctacgatcgcaattaatg

SEQ ID NO: 332552 - DNA, 38 bp, Artificial Sequence
  Description of Artificial Sequence: Synthetic oligonucleotide
agtttcgatttgccagacctacgatcgcaattaatgtc

SEQ ID NO: 332553 - DNA, 37 bp, Artificial Sequence
  Description of Artificial Sequence: Synthetic oligonucleotide
gtttcgatttgccagacctacgatcgcaattaatgtc

SEQ ID NO: 332554 - DNA, 40 bp, Artificial Sequence
  Description of Artificial Sequence: Synthetic oligonucleotide
tttcgatttgccagacctacgatcgcaattaatgtctttg

SEQ ID NO: 332555 - DNA, 39 bp, Artificial Sequence
  Description of Artificial Sequence: Synthetic oligonucleotide
ttcgatttgccagacctacgatcgcaattaatgtctttg

SEQ ID NO: 332556 - DNA, 38 bp, Artificial Sequence
  Description of Artificial Sequence: Synthetic oligonucleotide
tcgatttgccagacctacgatcgcaattaatgtctttg

SEQ ID NO: 332557 - DNA, 37 bp, Artificial Sequence
  Description of Artificial Sequence: Synthetic oligonucleotide
cgatttgccagacctacgatcgcaattaatgtctttg

SEQ ID NO: 332558 - DNA, 38 bp, Artificial Sequence
  Description of Artificial Sequence: Synthetic oligonucleotide
gatttgccagacctacgatcgcaattaatgtctttgag

SEQ ID NO: 332559 - DNA, 41 bp, Artificial Sequence
  Description of Artificial Sequence: Synthetic oligonucleotide
atttgccagacctacgatcgcaattaatgtctttgagttac

SEQ ID NO: 332560 - DNA, 40 bp, Artificial Sequence
  Description of Artificial Sequence: Synthetic oligonucleotide
tttgccagacctacgatcgcaattaatgtctttgagttac

SEQ ID NO: 332561 - DNA, 39 bp, Artificial Sequence
  Description of Artificial Sequence: Synthetic oligonucleotide
ttgccagacctacgatcgcaattaatgtctttgagttac

SEQ ID NO: 332562 - DNA, 38 bp, Artificial Sequence
  Description of Artificial Sequence: Synthetic oligonucleotide
tgccagacctacgatcgcaattaatgtctttgagttac

SEQ ID NO: 332563 - DNA, 37 bp, Artificial Sequence
  Description of Artificial Sequence: Synthetic oligonucleotide
gccagacctacgatcgcaattaatgtctttgagttac

SEQ ID NO: 332564 - DNA, 37 bp, Artificial Sequence
  Description of Artificial Sequence: Synthetic oligonucleotide
ccagacctacgatcgcaattaatgtctttgagttacc

SEQ ID NO: 332565 - DNA, 38 bp, Artificial Sequence
  Description of Artificial Sequence: Synthetic oligonucleotide
cagacctacgatcgcaattaatgtctttgagttaccag

SEQ ID NO: 332566 - DNA, 39 bp, Artificial Sequence
  Description of Artificial Sequence: Synthetic oligonucleotide
agacctacgatcgcaattaatgtctttgagttaccagtc

SEQ ID NO: 332567 - DNA, 38 bp, Artificial Sequence
  Description of Artificial Sequence: Synthetic oligonucleotide
gacctacgatcgcaattaatgtctttgagttaccagtc

SEQ ID NO: 332568 - DNA, 38 bp, Artificial Sequence
  Description of Artificial Sequence: Synthetic oligonucleotide
acctacgatcgcaattaatgtctttgagttaccagtcg

SEQ ID NO: 332569 - DNA, 37 bp, Artificial Sequence
  Description of Artificial Sequence: Synthetic oligonucleotide
cctacgatcgcaattaatgtctttgagttaccagtcg

SEQ ID NO: 332570 - DNA, 37 bp, Artificial Sequence
  Description of Artificial Sequence: Synthetic oligonucleotide
ctacgatcgcaattaatgtctttgagttaccagtcgg

SEQ ID NO: 332571 - DNA, 37 bp, Artificial Sequence
  Description of Artificial Sequence: Synthetic oligonucleotide
tacgatcgcaattaatgtctttgagttaccagtcggg

SEQ ID NO: 332572 - DNA, 36 bp, Artificial Sequence
  Description of Artificial Sequence: Synthetic oligonucleotide
acgatcgcaattaatgtctttgagttaccagtcggg

SEQ ID NO: 332573 - DNA, 35 bp, Artificial Sequence
  Description of Artificial Sequence: Synthetic oligonucleotide
cgatcgcaattaatgtctttgagttaccagtcggg

SEQ ID NO: 332574 - DNA, 36 bp, Artificial Sequence
  Description of Artificial Sequence: Synthetic oligonucleotide
gatcgcaattaatgtctttgagttaccagtcgggtc

SEQ ID NO: 332575 - DNA, 38 bp, Artificial Sequence
  Description of Artificial Sequence: Synthetic oligonucleotide
atcgcaattaatgtctttgagttaccagtcgggtcatc

SEQ ID NO: 332576 - DNA, 37 bp, Artificial Sequence
  Description of Artificial Sequence: Synthetic oligonucleotide
tcgcaattaatgtctttgagttaccagtcgggtcatc

SEQ ID NO: 332577 - DNA, 36 bp, Artificial Sequence
  Description of Artificial Sequence: Synthetic oligonucleotide
cgcaattaatgtctttgagttaccagtcgggtcatc

SEQ ID NO: 332578 - DNA, 39 bp, Artificial Sequence
  Description of Artificial Sequence: Synthetic oligonucleotide
gcaattaatgtctttgagttaccagtcgggtcatctttg

SEQ ID NO: 332579 - DNA, 45 bp, Artificial Sequence
  Description of Artificial Sequence: Synthetic oligonucleotide
caattaatgtctttgagttaccagtcgggtcatctttgatttatg

SEQ ID NO: 332580 - DNA, 48 bp, Artificial Sequence
  Description of Artificial Sequence: Synthetic oligonucleotide
aattaatgtctttgagttaccagtcgggtcatctttgatttatgaatg

SEQ ID NO: 332581 - DNA, 47 bp, Artificial Sequence
  Description of Artificial Sequence: Synthetic oligonucleotide
attaatgtctttgagttaccagtcgggtcatctttgatttatgaatg

SEQ ID NO: 332582 - DNA, 46 bp, Artificial Sequence
  Description of Artificial Sequence: Synthetic oligonucleotide
ttaatgtctttgagttaccagtcgggtcatctttgatttatgaatg

SEQ ID NO: 332583 - DNA, 45 bp, Artificial Sequence
  Description of Artificial Sequence: Synthetic oligonucleotide
taatgtctttgagttaccagtcgggtcatctttgatttatgaatg

SEQ ID NO: 332584 - DNA, 44 bp, Artificial Sequence
  Description of Artificial Sequence: Synthetic oligonucleotide
aatgtctttgagttaccagtcgggtcatctttgatttatgaatg

SEQ ID NO: 332585 - DNA, 43 bp, Artificial Sequence
  Description of Artificial Sequence: Synthetic oligonucleotide
atgtctttgagttaccagtcgggtcatctttgatttatgaatg

SEQ ID NO: 332586 - DNA, 42 bp, Artificial Sequence
  Description of Artificial Sequence: Synthetic oligonucleotide
tgtctttgagttaccagtcgggtcatctttgatttatgaatg

SEQ ID NO: 332587 - DNA, 41 bp, Artificial Sequence
  Description of Artificial Sequence: Synthetic oligonucleotide
gtctttgagttaccagtcgggtcatctttgatttatgaatg

SEQ ID NO: 332588 - DNA, 41 bp, Artificial Sequence
  Description of Artificial Sequence: Synthetic oligonucleotide
tctttgagttaccagtcgggtcatctttgatttatgaatgg

SEQ ID NO: 332589 - DNA, 40 bp, Artificial Sequence
  Description of Artificial Sequence: Synthetic oligonucleotide
ctttgagttaccagtcgggtcatctttgatttatgaatgg

SEQ ID NO: 332590 - DNA, 40 bp, Artificial Sequence
  Description of Artificial Sequence: Synthetic oligonucleotide
tttgagttaccagtcgggtcatctttgatttatgaatggc

SEQ ID NO: 332591 - DNA, 39 bp, Artificial Sequence
  Description of Artificial Sequence: Synthetic oligonucleotide
ttgagttaccagtcgggtcatctttgatttatgaatggc

SEQ ID NO: 332592 - DNA, 38 bp, Artificial Sequence
  Description of Artificial Sequence: Synthetic oligonucleotide
tgagttaccagtcgggtcatctttgatttatgaatggc

SEQ ID NO: 332593 - DNA, 37 bp, Artificial Sequence
  Description of Artificial Sequence: Synthetic oligonucleotide
gagttaccagtcgggtcatctttgatttatgaatggc

SEQ ID NO: 332594 - DNA, 37 bp, Artificial Sequence
  Description of Artificial Sequence: Synthetic oligonucleotide
agttaccagtcgggtcatctttgatttatgaatggcg

SEQ ID NO: 332595 - DNA, 36 bp, Artificial Sequence
  Description of Artificial Sequence: Synthetic oligonucleotide
gttaccagtcgggtcatctttgatttatgaatggcg

SEQ ID NO: 332596 - DNA, 37 bp, Artificial Sequence
  Description of Artificial Sequence: Synthetic oligonucleotide
ttaccagtcgggtcatctttgatttatgaatggcgtc

SEQ ID NO: 332597 - DNA, 36 bp, Artificial Sequence
  Description of Artificial Sequence: Synthetic oligonucleotide
taccagtcgggtcatctttgatttatgaatggcgtc

SEQ ID NO: 332598 - DNA, 35 bp, Artificial Sequence
  Description of Artificial Sequence: Synthetic oligonucleotide
accagtcgggtcatctttgatttatgaatggcgtc

SEQ ID NO: 332599 - DNA, 34 bp, Artificial Sequence
  Description of Artificial Sequence: Synthetic oligonucleotide
ccagtcgggtcatctttgatttatgaatggcgtc

SEQ ID NO: 332600 - DNA, 34 bp, Artificial Sequence
  Description of Artificial Sequence: Synthetic oligonucleotide
cagtcgggtcatctttgatttatgaatggcgtcc

SEQ ID NO: 332601 - DNA, 35 bp, Artificial Sequence
  Description of Artificial Sequence: Synthetic oligonucleotide
agtcgggtcatctttgatttatgaatggcgtcctg

SEQ ID NO: 332602 - DNA, 34 bp, Artificial Sequence
  Description of Artificial Sequence: Synthetic oligonucleotide
gtcgggtcatctttgatttatgaatggcgtcctg

SEQ ID NO: 332603 - DNA, 34 bp, Artificial Sequence
  Description of Artificial Sequence: Synthetic oligonucleotide
tcgggtcatctttgatttatgaatggcgtcctgg

SEQ ID NO: 332604 - DNA, 33 bp, Artificial Sequence
  Description of Artificial Sequence: Synthetic oligonucleotide
cgggtcatctttgatttatgaatggcgtcctgg

SEQ ID NO: 332605 - DNA, 33 bp, Artificial Sequence
  Description of Artificial Sequence: Synthetic oligonucleotide
gggtcatctttgatttatgaatggcgtcctggg

SEQ ID NO: 332606 - DNA, 39 bp, Artificial Sequence
  Description of Artificial Sequence: Synthetic oligonucleotide
ggtcatctttgatttatgaatggcgtcctgggaattttg

SEQ ID NO: 332607 - DNA, 39 bp, Artificial Sequence
  Description of Artificial Sequence: Synthetic oligonucleotide
gtcatctttgatttatgaatggcgtcctgggaattttgg

SEQ ID NO: 332608 - DNA, 39 bp, Artificial Sequence
  Description of Artificial Sequence: Synthetic oligonucleotide
tcatctttgatttatgaatggcgtcctgggaattttggg

SEQ ID NO: 332609 - DNA, 38 bp, Artificial Sequence
  Description of Artificial Sequence: Synthetic oligonucleotide
catctttgatttatgaatggcgtcctgggaattttggg

SEQ ID NO: 332610 - DNA, 43 bp, Artificial Sequence
  Description of Artificial Sequence: Synthetic oligonucleotide
atctttgatttatgaatggcgtcctgggaattttgggataatg

SEQ ID NO: 332611 - DNA, 42 bp, Artificial Sequence
  Description of Artificial Sequence: Synthetic oligonucleotide
tctttgatttatgaatggcgtcctgggaattttgggataatg

SEQ ID NO: 332612 - DNA, 41 bp, Artificial Sequence
  Description of Artificial Sequence: Synthetic oligonucleotide
ctttgatttatgaatggcgtcctgggaattttgggataatg

SEQ ID NO: 332613 - DNA, 43 bp, Artificial Sequence
  Description of Artificial Sequence: Synthetic oligonucleotide
tttgatttatgaatggcgtcctgggaattttgggataatgttc

SEQ ID NO: 332614 - DNA, 42 bp, Artificial Sequence
  Description of Artificial Sequence: Synthetic oligonucleotide
ttgatttatgaatggcgtcctgggaattttgggataatgttc

SEQ ID NO: 332615 - DNA, 41 bp, Artificial Sequence
  Description of Artificial Sequence: Synthetic oligonucleotide
tgatttatgaatggcgtcctgggaattttgggataatgttc

SEQ ID NO: 332616 - DNA, 40 bp, Artificial Sequence
  Description of Artificial Sequence: Synthetic oligonucleotide
gatttatgaatggcgtcctgggaattttgggataatgttc

SEQ ID NO: 332617 - DNA, 41 bp, Artificial Sequence
  Description of Artificial Sequence: Synthetic oligonucleotide
atttatgaatggcgtcctgggaattttgggataatgttctc

SEQ ID NO: 332618 - DNA, 40 bp, Artificial Sequence
  Description of Artificial Sequence: Synthetic oligonucleotide
tttatgaatggcgtcctgggaattttgggataatgttctc

SEQ ID NO: 332619 - DNA, 39 bp, Artificial Sequence
  Description of Artificial Sequence: Synthetic oligonucleotide
ttatgaatggcgtcctgggaattttgggataatgttctc

SEQ ID NO: 332620 - DNA, 38 bp, Artificial Sequence
  Description of Artificial Sequence: Synthetic oligonucleotide
tatgaatggcgtcctgggaattttgggataatgttctc

SEQ ID NO: 332621 - DNA, 37 bp, Artificial Sequence
  Description of Artificial Sequence: Synthetic oligonucleotide
atgaatggcgtcctgggaattttgggataatgttctc

SEQ ID NO: 332622 - DNA, 36 bp, Artificial Sequence
  Description of Artificial Sequence: Synthetic oligonucleotide
tgaatggcgtcctgggaattttgggataatgttctc

SEQ ID NO: 332623 - DNA, 35 bp, Artificial Sequence
  Description of Artificial Sequence: Synthetic oligonucleotide
gaatggcgtcctgggaattttgggataatgttctc

SEQ ID NO: 332624 - DNA, 38 bp, Artificial Sequence
  Description of Artificial Sequence: Synthetic oligonucleotide
aatggcgtcctgggaattttgggataatgttctcaatc

SEQ ID NO: 332625 - DNA, 37 bp, Artificial Sequence
  Description of Artificial Sequence: Synthetic oligonucleotide
atggcgtcctgggaattttgggataatgttctcaatc

SEQ ID NO: 332626 - DNA, 36 bp, Artificial Sequence
  Description of Artificial Sequence: Synthetic oligonucleotide
tggcgtcctgggaattttgggataatgttctcaatc

SEQ ID NO: 332627 - DNA, 35 bp, Artificial Sequence
  Description of Artificial Sequence: Synthetic oligonucleotide
ggcgtcctgggaattttgggataatgttctcaatc

SEQ ID NO: 332628 - DNA, 36 bp, Artificial Sequence
  Description of Artificial Sequence: Synthetic oligonucleotide
gcgtcctgggaattttgggataatgttctcaatctc

SEQ ID NO: 332629 - DNA, 36 bp, Artificial Sequence
  Description of Artificial Sequence: Synthetic oligonucleotide
cgtcctgggaattttgggataatgttctcaatctcc

SEQ ID NO: 332630 - DNA, 37 bp, Artificial Sequence
  Description of Artificial Sequence: Synthetic oligonucleotide
gtcctgggaattttgggataatgttctcaatctcctg

SEQ ID NO: 332631 - DNA, 37 bp, Artificial Sequence
  Description of Artificial Sequence: Synthetic oligonucleotide
tcctgggaattttgggataatgttctcaatctcctgc

SEQ ID NO: 332632 - DNA, 36 bp, Artificial Sequence
  Description of Artificial Sequence: Synthetic oligonucleotide
cctgggaattttgggataatgttctcaatctcctgc

SEQ ID NO: 332633 - DNA, 36 bp, Artificial Sequence
  Description of Artificial Sequence: Synthetic oligonucleotide
ctgggaattttgggataatgttctcaatctcctgcg

SEQ ID NO: 332634 - DNA, 38 bp, Artificial Sequence
  Description of Artificial Sequence: Synthetic oligonucleotide
tgggaattttgggataatgttctcaatctcctgcgtag

SEQ ID NO: 332635 - DNA, 37 bp, Artificial Sequence
  Description of Artificial Sequence: Synthetic oligonucleotide
gggaattttgggataatgttctcaatctcctgcgtag

SEQ ID NO: 332636 - DNA, 41 bp, Artificial Sequence
  Description of Artificial Sequence: Synthetic oligonucleotide
ggaattttgggataatgttctcaatctcctgcgtagaaaac

SEQ ID NO: 332637 - DNA, 43 bp, Artificial Sequence
  Description of Artificial Sequence: Synthetic oligonucleotide
gaattttgggataatgttctcaatctcctgcgtagaaaactag

SEQ ID NO: 332638 - DNA, 43 bp, Artificial Sequence
  Description of Artificial Sequence: Synthetic oligonucleotide
aattttgggataatgttctcaatctcctgcgtagaaaactagg

SEQ ID NO: 332639 - DNA, 42 bp, Artificial Sequence
  Description of Artificial Sequence: Synthetic oligonucleotide
attttgggataatgttctcaatctcctgcgtagaaaactagg

SEQ ID NO: 332640 - DNA, 41 bp, Artificial Sequence
  Description of Artificial Sequence: Synthetic oligonucleotide
ttttgggataatgttctcaatctcctgcgtagaaaactagg

SEQ ID NO: 332641 - DNA, 40 bp, Artificial Sequence
  Description of Artificial Sequence: Synthetic oligonucleotide
tttgggataatgttctcaatctcctgcgtagaaaactagg

SEQ ID NO: 332642 - DNA, 39 bp, Artificial Sequence
  Description of Artificial Sequence: Synthetic oligonucleotide
ttgggataatgttctcaatctcctgcgtagaaaactagg

SEQ ID NO: 332643 - DNA, 38 bp, Artificial Sequence
  Description of Artificial Sequence: Synthetic oligonucleotide
tgggataatgttctcaatctcctgcgtagaaaactagg

SEQ ID NO: 332644 - DNA, 37 bp, Artificial Sequence
  Description of Artificial Sequence: Synthetic oligonucleotide
gggataatgttctcaatctcctgcgtagaaaactagg

SEQ ID NO: 332645 - DNA, 38 bp, Artificial Sequence
  Description of Artificial Sequence: Synthetic oligonucleotide
ggataatgttctcaatctcctgcgtagaaaactaggtc

SEQ ID NO: 332646 - DNA, 39 bp, Artificial Sequence
  Description of Artificial Sequence: Synthetic oligonucleotide
gataatgttctcaatctcctgcgtagaaaactaggtctg

SEQ ID NO: 332647 - DNA, 39 bp, Artificial Sequence
  Description of Artificial Sequence: Synthetic oligonucleotide
ataatgttctcaatctcctgcgtagaaaactaggtctgg

SEQ ID NO: 332648 - DNA, 38 bp, Artificial Sequence
  Description of Artificial Sequence: Synthetic oligonucleotide
taatgttctcaatctcctgcgtagaaaactaggtctgg

SEQ ID NO: 332649 - DNA, 37 bp, Artificial Sequence
  Description of Artificial Sequence: Synthetic oligonucleotide
aatgttctcaatctcctgcgtagaaaactaggtctgg

SEQ ID NO: 332650 - DNA, 36 bp, Artificial Sequence
  Description of Artificial Sequence: Synthetic oligonucleotide
atgttctcaatctcctgcgtagaaaactaggtctgg

SEQ ID NO: 332651 - DNA, 35 bp, Artificial Sequence
  Description of Artificial Sequence: Synthetic oligonucleotide
tgttctcaatctcctgcgtagaaaactaggtctgg

SEQ ID NO: 332652 - DNA, 34 bp, Artificial Sequence
  Description of Artificial Sequence: Synthetic oligonucleotide
gttctcaatctcctgcgtagaaaactaggtctgg

SEQ ID NO: 332653 - DNA, 35 bp, Artificial Sequence
  Description of Artificial Sequence: Synthetic oligonucleotide
ttctcaatctcctgcgtagaaaactaggtctggtc

SEQ ID NO: 332654 - DNA, 34 bp, Artificial Sequence
  Description of Artificial Sequence: Synthetic oligonucleotide
tctcaatctcctgcgtagaaaactaggtctggtc

SEQ ID NO: 332655 - DNA, 33 bp, Artificial Sequence
  Description of Artificial Sequence: Synthetic oligonucleotide
ctcaatctcctgcgtagaaaactaggtctggtc

SEQ ID NO: 332656 - DNA, 35 bp, Artificial Sequence
  Description of Artificial Sequence: Synthetic oligonucleotide
tcaatctcctgcgtagaaaactaggtctggtctag

SEQ ID NO: 332657 - DNA, 34 bp, Artificial Sequence
  Description of Artificial Sequence: Synthetic oligonucleotide
caatctcctgcgtagaaaactaggtctggtctag

SEQ ID NO: 332658 - DNA, 35 bp, Artificial Sequence
  Description of Artificial Sequence: Synthetic oligonucleotide
aatctcctgcgtagaaaactaggtctggtctagtg

SEQ ID NO: 332659 - DNA, 34 bp, Artificial Sequence
  Description of Artificial Sequence: Synthetic oligonucleotide
atctcctgcgtagaaaactaggtctggtctagtg

SEQ ID NO: 332660 - DNA, 33 bp, Artificial Sequence
  Description of Artificial Sequence: Synthetic oligonucleotide
tctcctgcgtagaaaactaggtctggtctagtg

SEQ ID NO: 332661 - DNA, 32 bp, Artificial Sequence
  Description of Artificial Sequence: Synthetic oligonucleotide
ctcctgcgtagaaaactaggtctggtctagtg

SEQ ID NO: 332662 - DNA, 34 bp, Artificial Sequence
  Description of Artificial Sequence: Synthetic oligonucleotide
tcctgcgtagaaaactaggtctggtctagtgttg

SEQ ID NO: 332663 - DNA, 33 bp, Artificial Sequence
  Description of Artificial Sequence: Synthetic oligonucleotide
cctgcgtagaaaactaggtctggtctagtgttg

SEQ ID NO: 332664 - DNA, 35 bp, Artificial Sequence
  Description of Artificial Sequence: Synthetic oligonucleotide
ctgcgtagaaaactaggtctggtctagtgttgaac

SEQ ID NO: 332665 - DNA, 36 bp, Artificial Sequence
  Description of Artificial Sequence: Synthetic oligonucleotide
tgcgtagaaaactaggtctggtctagtgttgaacac

SEQ ID NO: 332666 - DNA, 35 bp, Artificial Sequence
  Description of Artificial Sequence: Synthetic oligonucleotide
gcgtagaaaactaggtctggtctagtgttgaacac

SEQ ID NO: 332667 - DNA, 37 bp, Artificial Sequence
  Description of Artificial Sequence: Synthetic oligonucleotide
cgtagaaaactaggtctggtctagtgttgaacacaac

SEQ ID NO: 332668 - DNA, 38 bp, Artificial Sequence
  Description of Artificial Sequence: Synthetic oligonucleotide
gtagaaaactaggtctggtctagtgttgaacacaactg

SEQ ID NO: 332669 - DNA, 40 bp, Artificial Sequence
  Description of Artificial Sequence: Synthetic oligonucleotide
tagaaaactaggtctggtctagtgttgaacacaactgtac

SEQ ID NO: 332670 - DNA, 39 bp, Artificial Sequence
  Description of Artificial Sequence: Synthetic oligonucleotide
agaaaactaggtctggtctagtgttgaacacaactgtac

SEQ ID NO: 332671 - DNA, 38 bp, Artificial Sequence
  Description of Artificial Sequence: Synthetic oligonucleotide
gaaaactaggtctggtctagtgttgaacacaactgtac

SEQ ID NO: 332672 - DNA, 39 bp, Artificial Sequence
  Description of Artificial Sequence: Synthetic oligonucleotide
aaaactaggtctggtctagtgttgaacacaactgtacac

SEQ ID NO: 332673 - DNA, 38 bp, Artificial Sequence
  Description of Artificial Sequence: Synthetic oligonucleotide
aaactaggtctggtctagtgttgaacacaactgtacac

SEQ ID NO: 332674 - DNA, 37 bp, Artificial Sequence
  Description of Artificial Sequence: Synthetic oligonucleotide
aactaggtctggtctagtgttgaacacaactgtacac

SEQ ID NO: 332675 - DNA, 36 bp, Artificial Sequence
  Description of Artificial Sequence: Synthetic oligonucleotide
actaggtctggtctagtgttgaacacaactgtacac

SEQ ID NO: 332676 - DNA, 35 bp, Artificial Sequence
  Description of Artificial Sequence: Synthetic oligonucleotide
ctaggtctggtctagtgttgaacacaactgtacac

SEQ ID NO: 332677 - DNA, 35 bp, Artificial Sequence
  Description of Artificial Sequence: Synthetic oligonucleotide
taggtctggtctagtgttgaacacaactgtacacg

SEQ ID NO: 332678 - DNA, 34 bp, Artificial Sequence
  Description of Artificial Sequence: Synthetic oligonucleotide
aggtctggtctagtgttgaacacaactgtacacg

SEQ ID NO: 332679 - DNA, 33 bp, Artificial Sequence
  Description of Artificial Sequence: Synthetic oligonucleotide
ggtctggtctagtgttgaacacaactgtacacg

SEQ ID NO: 332680 - DNA, 38 bp, Artificial Sequence
  Description of Artificial Sequence: Synthetic oligonucleotide
gtctggtctagtgttgaacacaactgtacacgaaaatc

SEQ ID NO: 332681 - DNA, 40 bp, Artificial Sequence
  Description of Artificial Sequence: Synthetic oligonucleotide
tctggtctagtgttgaacacaactgtacacgaaaatcttg

SEQ ID NO: 332682 - DNA, 39 bp, Artificial Sequence
  Description of Artificial Sequence: Synthetic oligonucleotide
ctggtctagtgttgaacacaactgtacacgaaaatcttg

SEQ ID NO: 332683 - DNA, 40 bp, Artificial Sequence
  Description of Artificial Sequence: Synthetic oligonucleotide
tggtctagtgttgaacacaactgtacacgaaaatcttgtg

SEQ ID NO: 332684 - DNA, 39 bp, Artificial Sequence
  Description of Artificial Sequence: Synthetic oligonucleotide
ggtctagtgttgaacacaactgtacacgaaaatcttgtg

SEQ ID NO: 332685 - DNA, 39 bp, Artificial Sequence
  Description of Artificial Sequence: Synthetic oligonucleotide
gtctagtgttgaacacaactgtacacgaaaatcttgtgg

SEQ ID NO: 332686 - DNA, 40 bp, Artificial Sequence
  Description of Artificial Sequence: Synthetic oligonucleotide
tctagtgttgaacacaactgtacacgaaaatcttgtggac

SEQ ID NO: 332687 - DNA, 39 bp, Artificial Sequence
  Description of Artificial Sequence: Synthetic oligonucleotide
ctagtgttgaacacaactgtacacgaaaatcttgtggac

SEQ ID NO: 332688 - DNA, 39 bp, Artificial Sequence
  Description of Artificial Sequence: Synthetic oligonucleotide
tagtgttgaacacaactgtacacgaaaatcttgtggacc

SEQ ID NO: 332689 - DNA, 38 bp, Artificial Sequence
  Description of Artificial Sequence: Synthetic oligonucleotide
agtgttgaacacaactgtacacgaaaatcttgtggacc

SEQ ID NO: 332690 - DNA, 37 bp, Artificial Sequence
  Description of Artificial Sequence: Synthetic oligonucleotide
gtgttgaacacaactgtacacgaaaatcttgtggacc

SEQ ID NO: 332691 - DNA, 38 bp, Artificial Sequence
  Description of Artificial Sequence: Synthetic oligonucleotide
tgttgaacacaactgtacacgaaaatcttgtggacctg

SEQ ID NO: 332692 - DNA, 37 bp, Artificial Sequence
  Description of Artificial Sequence: Synthetic oligonucleotide
gttgaacacaactgtacacgaaaatcttgtggacctg

SEQ ID NO: 332693 - DNA, 37 bp, Artificial Sequence
  Description of Artificial Sequence: Synthetic oligonucleotide
ttgaacacaactgtacacgaaaatcttgtggacctgc

SEQ ID NO: 332694 - DNA, 36 bp, Artificial Sequence
  Description of Artificial Sequence: Synthetic oligonucleotide
tgaacacaactgtacacgaaaatcttgtggacctgc

SEQ ID NO: 332695 - DNA, 35 bp, Artificial Sequence
  Description of Artificial Sequence: Synthetic oligonucleotide
gaacacaactgtacacgaaaatcttgtggacctgc

SEQ ID NO: 332696 - DNA, 36 bp, Artificial Sequence
  Description of Artificial Sequence: Synthetic oligonucleotide
aacacaactgtacacgaaaatcttgtggacctgcac

SEQ ID NO: 332697 - DNA, 35 bp, Artificial Sequence
  Description of Artificial Sequence: Synthetic oligonucleotide
acacaactgtacacgaaaatcttgtggacctgcac

SEQ ID NO: 332698 - DNA, 34 bp, Artificial Sequence
  Description of Artificial Sequence: Synthetic oligonucleotide
cacaactgtacacgaaaatcttgtggacctgcac

SEQ ID NO: 332699 - DNA, 34 bp, Artificial Sequence
  Description of Artificial Sequence: Synthetic oligonucleotide
acaactgtacacgaaaatcttgtggacctgcacc

SEQ ID NO: 332700 - DNA, 33 bp, Artificial Sequence
  Description of Artificial Sequence: Synthetic oligonucleotide
caactgtacacgaaaatcttgtggacctgcacc

SEQ ID NO: 332701 - DNA, 34 bp, Artificial Sequence
  Description of Artificial Sequence: Synthetic oligonucleotide
aactgtacacgaaaatcttgtggacctgcaccag

SEQ ID NO: 332702 - DNA, 33 bp, Artificial Sequence
  Description of Artificial Sequence: Synthetic oligonucleotide
actgtacacgaaaatcttgtggacctgcaccag

SEQ ID NO: 332703 - DNA, 32 bp, Artificial Sequence
  Description of Artificial Sequence: Synthetic oligonucleotide
ctgtacacgaaaatcttgtggacctgcaccag

SEQ ID NO: 332704 - DNA, 34 bp, Artificial Sequence
  Description of Artificial Sequence: Synthetic oligonucleotide
tgtacacgaaaatcttgtggacctgcaccagaac

SEQ ID NO: 332705 - DNA, 33 bp, Artificial Sequence
  Description of Artificial Sequence: Synthetic oligonucleotide
gtacacgaaaatcttgtggacctgcaccagaac

SEQ ID NO: 332706 - DNA, 33 bp, Artificial Sequence
  Description of Artificial Sequence: Synthetic oligonucleotide
tacacgaaaatcttgtggacctgcaccagaacg

SEQ ID NO: 332707 - DNA, 32 bp, Artificial Sequence
  Description of Artificial Sequence: Synthetic oligonucleotide
acacgaaaatcttgtggacctgcaccagaacg

SEQ ID NO: 332708 - DNA, 31 bp, Artificial Sequence
  Description of Artificial Sequence: Synthetic oligonucleotide
cacgaaaatcttgtggacctgcaccagaacg

SEQ ID NO: 332709 - DNA, 31 bp, Artificial Sequence
  Description of Artificial Sequence: Synthetic oligonucleotide
acgaaaatcttgtggacctgcaccagaacgc

SEQ ID NO: 332710 - DNA, 30 bp, Artificial Sequence
  Description of Artificial Sequence: Synthetic oligonucleotide
cgaaaatcttgtggacctgcaccagaacgc

SEQ ID NO: 332711 - DNA, 32 bp, Artificial Sequence
  Description of Artificial Sequence: Synthetic oligonucleotide
gaaaatcttgtggacctgcaccagaacgcttc

SEQ ID NO: 332712 - DNA, 35 bp, Artificial Sequence
  Description of Artificial Sequence: Synthetic oligonucleotide
aaaatcttgtggacctgcaccagaacgcttcaatg

SEQ ID NO: 332713 - DNA, 34 bp, Artificial Sequence
  Description of Artificial Sequence: Synthetic oligonucleotide
aaatcttgtggacctgcaccagaacgcttcaatg

SEQ ID NO: 332714 - DNA, 33 bp, Artificial Sequence
  Description of Artificial Sequence: Synthetic oligonucleotide
aatcttgtggacctgcaccagaacgcttcaatg

SEQ ID NO: 332715 - DNA, 32 bp, Artificial Sequence
  Description of Artificial Sequence: Synthetic oligonucleotide
atcttgtggacctgcaccagaacgcttcaatg

SEQ ID NO: 332716 - DNA, 31 bp, Artificial Sequence
  Description of Artificial Sequence: Synthetic oligonucleotide
tcttgtggacctgcaccagaacgcttcaatg

SEQ ID NO: 332717 - DNA, 30 bp, Artificial Sequence
  Description of Artificial Sequence: Synthetic oligonucleotide
cttgtggacctgcaccagaacgcttcaatg

SEQ ID NO: 332718 - DNA, 30 bp, Artificial Sequence
  Description of Artificial Sequence: Synthetic oligonucleotide
ttgtggacctgcaccagaacgcttcaatgg

SEQ ID NO: 332719 - DNA, 29 bp, Artificial Sequence
  Description of Artificial Sequence: Synthetic oligonucleotide
tgtggacctgcaccagaacgcttcaatgg

SEQ ID NO: 332720 - DNA, 28 bp, Artificial Sequence
  Description of Artificial Sequence: Synthetic oligonucleotide
gtggacctgcaccagaacgcttcaatgg

SEQ ID NO: 332721 - DNA, 31 bp, Artificial Sequence
  Description of Artificial Sequence: Synthetic oligonucleotide
tggacctgcaccagaacgcttcaatggtatg

SEQ ID NO: 332722 - DNA, 30 bp, Artificial Sequence
  Description of Artificial Sequence: Synthetic oligonucleotide
ggacctgcaccagaacgcttcaatggtatg

SEQ ID NO: 332723 - DNA, 30 bp, Artificial Sequence
  Description of Artificial Sequence: Synthetic oligonucleotide
gacctgcaccagaacgcttcaatggtatgg

SEQ ID NO: 332724 - DNA, 31 bp, Artificial Sequence
  Description of Artificial Sequence: Synthetic oligonucleotide
acctgcaccagaacgcttcaatggtatggtg

SEQ ID NO: 332725 - DNA, 30 bp, Artificial Sequence
  Description of Artificial Sequence: Synthetic oligonucleotide
cctgcaccagaacgcttcaatggtatggtg

SEQ ID NO: 332726 - DNA, 30 bp, Artificial Sequence
  Description of Artificial Sequence: Synthetic oligonucleotide
ctgcaccagaacgcttcaatggtatggtgc

SEQ ID NO: 332727 - DNA, 37 bp, Artificial Sequence
  Description of Artificial Sequence: Synthetic oligonucleotide
tgcaccagaacgcttcaatggtatggtgcatttaaac

SEQ ID NO: 332728 - DNA, 36 bp, Artificial Sequence
  Description of Artificial Sequence: Synthetic oligonucleotide
gcaccagaacgcttcaatggtatggtgcatttaaac

SEQ ID NO: 332729 - DNA, 37 bp, Artificial Sequence
  Description of Artificial Sequence: Synthetic oligonucleotide
caccagaacgcttcaatggtatggtgcatttaaacac

SEQ ID NO: 332730 - DNA, 38 bp, Artificial Sequence
  Description of Artificial Sequence: Synthetic oligonucleotide
accagaacgcttcaatggtatggtgcatttaaacacag

SEQ ID NO: 332731 - DNA, 37 bp, Artificial Sequence
  Description of Artificial Sequence: Synthetic oligonucleotide
ccagaacgcttcaatggtatggtgcatttaaacacag

SEQ ID NO: 332732 - DNA, 40 bp, Artificial Sequence
  Description of Artificial Sequence: Synthetic oligonucleotide
cagaacgcttcaatggtatggtgcatttaaacacagttac

SEQ ID NO: 332733 - DNA, 41 bp, Artificial Sequence
  Description of Artificial Sequence: Synthetic oligonucleotide
agaacgcttcaatggtatggtgcatttaaacacagttacac

SEQ ID NO: 332734 - DNA, 40 bp, Artificial Sequence
  Description of Artificial Sequence: Synthetic oligonucleotide
gaacgcttcaatggtatggtgcatttaaacacagttacac

SEQ ID NO: 332735 - DNA, 41 bp, Artificial Sequence
  Description of Artificial Sequence: Synthetic oligonucleotide
aacgcttcaatggtatggtgcatttaaacacagttacacag

SEQ ID NO: 332736 - DNA, 40 bp, Artificial Sequence
  Description of Artificial Sequence: Synthetic oligonucleotide
acgcttcaatggtatggtgcatttaaacacagttacacag

SEQ ID NO: 332737 - DNA, 39 bp, Artificial Sequence
  Description of Artificial Sequence: Synthetic oligonucleotide
cgcttcaatggtatggtgcatttaaacacagttacacag

SEQ ID NO: 332738 - DNA, 42 bp, Artificial Sequence
  Description of Artificial Sequence: Synthetic oligonucleotide
gcttcaatggtatggtgcatttaaacacagttacacagttag

SEQ ID NO: 332739 - DNA, 42 bp, Artificial Sequence
  Description of Artificial Sequence: Synthetic oligonucleotide
cttcaatggtatggtgcatttaaacacagttacacagttagg

SEQ ID NO: 332740 - DNA, 44 bp, Artificial Sequence
  Description of Artificial Sequence: Synthetic oligonucleotide
ttcaatggtatggtgcatttaaacacagttacacagttaggatc

SEQ ID NO: 332741 - DNA, 43 bp, Artificial Sequence
  Description of Artificial Sequence: Synthetic oligonucleotide
tcaatggtatggtgcatttaaacacagttacacagttaggatc

SEQ ID NO: 332742 - DNA, 42 bp, Artificial Sequence
  Description of Artificial Sequence: Synthetic oligonucleotide
caatggtatggtgcatttaaacacagttacacagttaggatc

SEQ ID NO: 332743 - DNA, 44 bp, Artificial Sequence
  Description of Artificial Sequence: Synthetic oligonucleotide
aatggtatggtgcatttaaacacagttacacagttaggatcaac

SEQ ID NO: 332744 - DNA, 43 bp, Artificial Sequence
  Description of Artificial Sequence: Synthetic oligonucleotide
atggtatggtgcatttaaacacagttacacagttaggatcaac

SEQ ID NO: 332745 - DNA, 42 bp, Artificial Sequence
  Description of Artificial Sequence: Synthetic oligonucleotide
tggtatggtgcatttaaacacagttacacagttaggatcaac

SEQ ID NO: 332746 - DNA, 41 bp, Artificial Sequence
  Description of Artificial Sequence: Synthetic oligonucleotide
ggtatggtgcatttaaacacagttacacagttaggatcaac

SEQ ID NO: 332747 - DNA, 42 bp, Artificial Sequence
  Description of Artificial Sequence: Synthetic oligonucleotide
gtatggtgcatttaaacacagttacacagttaggatcaacac

SEQ ID NO: 332748 - DNA, 51 bp, Artificial Sequence
  Description of Artificial Sequence: Synthetic oligonucleotide
tatggtgcatttaaacacagttacacagttaggatcaacacttaattattg

SEQ ID NO: 332749 - DNA, 50 bp, Artificial Sequence
  Description of Artificial Sequence: Synthetic oligonucleotide
atggtgcatttaaacacagttacacagttaggatcaacacttaattattg

SEQ ID NO: 332750 - DNA, 49 bp, Artificial Sequence
  Description of Artificial Sequence: Synthetic oligonucleotide
tggtgcatttaaacacagttacacagttaggatcaacacttaattattg

SEQ ID NO: 332751 - DNA, 48 bp, Artificial Sequence
  Description of Artificial Sequence: Synthetic oligonucleotide
ggtgcatttaaacacagttacacagttaggatcaacacttaattattg

SEQ ID NO: 332752 - DNA, 50 bp, Artificial Sequence
  Description of Artificial Sequence: Synthetic oligonucleotide
gtgcatttaaacacagttacacagttaggatcaacacttaattattgttg

SEQ ID NO: 332753 - DNA, 54 bp, Artificial Sequence
  Description of Artificial Sequence: Synthetic oligonucleotide
tgcatttaaacacagttacacagttaggatcaacacttaattattgttgtaatg

SEQ ID NO: 332754 - DNA, 53 bp, Artificial Sequence
  Description of Artificial Sequence: Synthetic oligonucleotide
gcatttaaacacagttacacagttaggatcaacacttaattattgttgtaatg

SEQ ID NO: 332755 - DNA, 55 bp, Artificial Sequence
  Description of Artificial Sequence: Synthetic oligonucleotide
catttaaacacagttacacagttaggatcaacacttaattattgttgtaatgatg

SEQ ID NO: 332756 - DNA, 55 bp, Artificial Sequence
  Description of Artificial Sequence: Synthetic oligonucleotide
atttaaacacagttacacagttaggatcaacacttaattattgttgtaatgatgg

SEQ ID NO: 332757 - DNA, 54 bp, Artificial Sequence
  Description of Artificial Sequence: Synthetic oligonucleotide
tttaaacacagttacacagttaggatcaacacttaattattgttgtaatgatgg

SEQ ID NO: 332758 - DNA, 53 bp, Artificial Sequence
  Description of Artificial Sequence: Synthetic oligonucleotide
ttaaacacagttacacagttaggatcaacacttaattattgttgtaatgatgg

SEQ ID NO: 332759 - DNA, 52 bp, Artificial Sequence
  Description of Artificial Sequence: Synthetic oligonucleotide
taaacacagttacacagttaggatcaacacttaattattgttgtaatgatgg

SEQ ID NO: 332760 - DNA, 51 bp, Artificial Sequence
  Description of Artificial Sequence: Synthetic oligonucleotide
aaacacagttacacagttaggatcaacacttaattattgttgtaatgatgg

SEQ ID NO: 332761 - DNA, 50 bp, Artificial Sequence
  Description of Artificial Sequence: Synthetic oligonucleotide
aacacagttacacagttaggatcaacacttaattattgttgtaatgatgg

SEQ ID NO: 332762 - DNA, 49 bp, Artificial Sequence
  Description of Artificial Sequence: Synthetic oligonucleotide
acacagttacacagttaggatcaacacttaattattgttgtaatgatgg

SEQ ID NO: 332763 - DNA, 48 bp, Artificial Sequence
  Description of Artificial Sequence: Synthetic oligonucleotide
cacagttacacagttaggatcaacacttaattattgttgtaatgatgg

SEQ ID NO: 332764 - DNA, 48 bp, Artificial Sequence
  Description of Artificial Sequence: Synthetic oligonucleotide
acagttacacagttaggatcaacacttaattattgttgtaatgatggg

SEQ ID NO: 332765 - DNA, 47 bp, Artificial Sequence
  Description of Artificial Sequence: Synthetic oligonucleotide
cagttacacagttaggatcaacacttaattattgttgtaatgatggg

SEQ ID NO: 332766 - DNA, 50 bp, Artificial Sequence
  Description of Artificial Sequence: Synthetic oligonucleotide
agttacacagttaggatcaacacttaattattgttgtaatgatgggtttc

SEQ ID NO: 332767 - DNA, 49 bp, Artificial Sequence
  Description of Artificial Sequence: Synthetic oligonucleotide
gttacacagttaggatcaacacttaattattgttgtaatgatgggtttc

SEQ ID NO: 332768 - DNA, 49 bp, Artificial Sequence
  Description of Artificial Sequence: Synthetic oligonucleotide
ttacacagttaggatcaacacttaattattgttgtaatgatgggtttcg

SEQ ID NO: 332769 - DNA, 48 bp, Artificial Sequence
  Description of Artificial Sequence: Synthetic oligonucleotide
tacacagttaggatcaacacttaattattgttgtaatgatgggtttcg

SEQ ID NO: 332770 - DNA, 47 bp, Artificial Sequence
  Description of Artificial Sequence: Synthetic oligonucleotide
acacagttaggatcaacacttaattattgttgtaatgatgggtttcg

SEQ ID NO: 332771 - DNA, 46 bp, Artificial Sequence
  Description of Artificial Sequence: Synthetic oligonucleotide
cacagttaggatcaacacttaattattgttgtaatgatgggtttcg

SEQ ID NO: 332772 - DNA, 47 bp, Artificial Sequence
  Description of Artificial Sequence: Synthetic oligonucleotide
acagttaggatcaacacttaattattgttgtaatgatgggtttcgag

SEQ ID NO: 332773 - DNA, 46 bp, Artificial Sequence
  Description of Artificial Sequence: Synthetic oligonucleotide
cagttaggatcaacacttaattattgttgtaatgatgggtttcgag

SEQ ID NO: 332774 - DNA, 47 bp, Artificial Sequence
  Description of Artificial Sequence: Synthetic oligonucleotide
agttaggatcaacacttaattattgttgtaatgatgggtttcgagtc

SEQ ID NO: 332775 - DNA, 46 bp, Artificial Sequence
  Description of Artificial Sequence: Synthetic oligonucleotide
gttaggatcaacacttaattattgttgtaatgatgggtttcgagtc

SEQ ID NO: 332776 - DNA, 49 bp, Artificial Sequence
  Description of Artificial Sequence: Synthetic oligonucleotide
ttaggatcaacacttaattattgttgtaatgatgggtttcgagtcattg

SEQ ID NO: 332777 - DNA, 48 bp, Artificial Sequence
  Description of Artificial Sequence: Synthetic oligonucleotide
taggatcaacacttaattattgttgtaatgatgggtttcgagtcattg

SEQ ID NO: 332778 - DNA, 47 bp, Artificial Sequence
  Description of Artificial Sequence: Synthetic oligonucleotide
aggatcaacacttaattattgttgtaatgatgggtttcgagtcattg

SEQ ID NO: 332779 - DNA, 46 bp, Artificial Sequence
  Description of Artificial Sequence: Synthetic oligonucleotide
ggatcaacacttaattattgttgtaatgatgggtttcgagtcattg

SEQ ID NO: 332780 - DNA, 46 bp, Artificial Sequence
  Description of Artificial Sequence: Synthetic oligonucleotide
gatcaacacttaattattgttgtaatgatgggtttcgagtcattgg

SEQ ID NO: 332781 - DNA, 48 bp, Artificial Sequence
  Description of Artificial Sequence: Synthetic oligonucleotide
atcaacacttaattattgttgtaatgatgggtttcgagtcattggttg

SEQ ID NO: 332782 - DNA, 47 bp, Artificial Sequence
  Description of Artificial Sequence: Synthetic oligonucleotide
tcaacacttaattattgttgtaatgatgggtttcgagtcattggttg

SEQ ID NO: 332783 - DNA, 46 bp, Artificial Sequence
  Description of Artificial Sequence: Synthetic oligonucleotide
caacacttaattattgttgtaatgatgggtttcgagtcattggttg

SEQ ID NO: 332784 - DNA, 46 bp, Artificial Sequence
  Description of Artificial Sequence: Synthetic oligonucleotide
aacacttaattattgttgtaatgatgggtttcgagtcattggttgc

SEQ ID NO: 332785 - DNA, 45 bp, Artificial Sequence
  Description of Artificial Sequence: Synthetic oligonucleotide
acacttaattattgttgtaatgatgggtttcgagtcattggttgc

SEQ ID NO: 332786 - DNA, 44 bp, Artificial Sequence
  Description of Artificial Sequence: Synthetic oligonucleotide
cacttaattattgttgtaatgatgggtttcgagtcattggttgc

SEQ ID NO: 332787 - DNA, 44 bp, Artificial Sequence
  Description of Artificial Sequence: Synthetic oligonucleotide
acttaattattgttgtaatgatgggtttcgagtcattggttgcc

SEQ ID NO: 332788 - DNA, 43 bp, Artificial Sequence
  Description of Artificial Sequence: Synthetic oligonucleotide
cttaattattgttgtaatgatgggtttcgagtcattggttgcc

SEQ ID NO: 332789 - DNA, 43 bp, Artificial Sequence
  Description of Artificial Sequence: Synthetic oligonucleotide
ttaattattgttgtaatgatgggtttcgagtcattggttgccc

SEQ ID NO: 332790 - DNA, 42 bp, Artificial Sequence
  Description of Artificial Sequence: Synthetic oligonucleotide
taattattgttgtaatgatgggtttcgagtcattggttgccc

SEQ ID NO: 332791 - DNA, 41 bp, Artificial Sequence
  Description of Artificial Sequence: Synthetic oligonucleotide
aattattgttgtaatgatgggtttcgagtcattggttgccc

SEQ ID NO: 332792 - DNA, 40 bp, Artificial Sequence
  Description of Artificial Sequence: Synthetic oligonucleotide
attattgttgtaatgatgggtttcgagtcattggttgccc

SEQ ID NO: 332793 - DNA, 39 bp, Artificial Sequence
  Description of Artificial Sequence: Synthetic oligonucleotide
ttattgttgtaatgatgggtttcgagtcattggttgccc

SEQ ID NO: 332794 - DNA, 38 bp, Artificial Sequence
  Description of Artificial Sequence: Synthetic oligonucleotide
tattgttgtaatgatgggtttcgagtcattggttgccc

SEQ ID NO: 332795 - DNA, 37 bp, Artificial Sequence
  Description of Artificial Sequence: Synthetic oligonucleotide
attgttgtaatgatgggtttcgagtcattggttgccc

SEQ ID NO: 332796 - DNA, 36 bp, Artificial Sequence
  Description of Artificial Sequence: Synthetic oligonucleotide
ttgttgtaatgatgggtttcgagtcattggttgccc

SEQ ID NO: 332797 - DNA, 35 bp, Artificial Sequence
  Description of Artificial Sequence: Synthetic oligonucleotide
tgttgtaatgatgggtttcgagtcattggttgccc

SEQ ID NO: 332798 - DNA, 34 bp, Artificial Sequence
  Description of Artificial Sequence: Synthetic oligonucleotide
gttgtaatgatgggtttcgagtcattggttgccc

SEQ ID NO: 332799 - DNA, 36 bp, Artificial Sequence
  Description of Artificial Sequence: Synthetic oligonucleotide
ttgtaatgatgggtttcgagtcattggttgcccatc

SEQ ID NO: 332800 - DNA, 35 bp, Artificial Sequence
  Description of Artificial Sequence: Synthetic oligonucleotide
tgtaatgatgggtttcgagtcattggttgcccatc

SEQ ID NO: 332801 - DNA, 34 bp, Artificial Sequence
  Description of Artificial Sequence: Synthetic oligonucleotide
gtaatgatgggtttcgagtcattggttgcccatc

SEQ ID NO: 332802 - DNA, 36 bp, Artificial Sequence
  Description of Artificial Sequence: Synthetic oligonucleotide
taatgatgggtttcgagtcattggttgcccatctac

SEQ ID NO: 332803 - DNA, 35 bp, Artificial Sequence
  Description of Artificial Sequence: Synthetic oligonucleotide
aatgatgggtttcgagtcattggttgcccatctac

SEQ ID NO: 332804 - DNA, 34 bp, Artificial Sequence
  Description of Artificial Sequence: Synthetic oligonucleotide
atgatgggtttcgagtcattggttgcccatctac

SEQ ID NO: 332805 - DNA, 33 bp, Artificial Sequence
  Description of Artificial Sequence: Synthetic oligonucleotide
tgatgggtttcgagtcattggttgcccatctac

SEQ ID NO: 332806 - DNA, 32 bp, Artificial Sequence
  Description of Artificial Sequence: Synthetic oligonucleotide
gatgggtttcgagtcattggttgcccatctac

SEQ ID NO: 332807 - DNA, 34 bp, Artificial Sequence
  Description of Artificial Sequence: Synthetic oligonucleotide
atgggtttcgagtcattggttgcccatctacaac

SEQ ID NO: 332808 - DNA, 33 bp, Artificial Sequence
  Description of Artificial Sequence: Synthetic oligonucleotide
tgggtttcgagtcattggttgcccatctacaac

SEQ ID NO: 332809 - DNA, 32 bp, Artificial Sequence
  Description of Artificial Sequence: Synthetic oligonucleotide
gggtttcgagtcattggttgcccatctacaac

SEQ ID NO: 332810 - DNA, 34 bp, Artificial Sequence
  Description of Artificial Sequence: Synthetic oligonucleotide
ggtttcgagtcattggttgcccatctacaacttg

SEQ ID NO: 332811 - DNA, 35 bp, Artificial Sequence
  Description of Artificial Sequence: Synthetic oligonucleotide
gtttcgagtcattggttgcccatctacaacttgtc

SEQ ID NO: 332812 - DNA, 36 bp, Artificial Sequence
  Description of Artificial Sequence: Synthetic oligonucleotide
tttcgagtcattggttgcccatctacaacttgtctc

SEQ ID NO: 332813 - DNA, 35 bp, Artificial Sequence
  Description of Artificial Sequence: Synthetic oligonucleotide
ttcgagtcattggttgcccatctacaacttgtctc

SEQ ID NO: 332814 - DNA, 34 bp, Artificial Sequence
  Description of Artificial Sequence: Synthetic oligonucleotide
tcgagtcattggttgcccatctacaacttgtctc

SEQ ID NO: 332815 - DNA, 33 bp, Artificial Sequence
  Description of Artificial Sequence: Synthetic oligonucleotide
cgagtcattggttgcccatctacaacttgtctc

SEQ ID NO: 332816 - DNA, 33 bp, Artificial Sequence
  Description of Artificial Sequence: Synthetic oligonucleotide
gagtcattggttgcccatctacaacttgtctcc

SEQ ID NO: 332817 - DNA, 34 bp, Artificial Sequence
  Description of Artificial Sequence: Synthetic oligonucleotide
agtcattggttgcccatctacaacttgtctcctc

SEQ ID NO: 332818 - DNA, 33 bp, Artificial Sequence
  Description of Artificial Sequence: Synthetic oligonucleotide
gtcattggttgcccatctacaacttgtctcctc

SEQ ID NO: 332819 - DNA, 34 bp, Artificial Sequence
  Description of Artificial Sequence: Synthetic oligonucleotide
tcattggttgcccatctacaacttgtctcctctc

SEQ ID NO: 332820 - DNA, 33 bp, Artificial Sequence
  Description of Artificial Sequence: Synthetic oligonucleotide
cattggttgcccatctacaacttgtctcctctc

SEQ ID NO: 332821 - DNA, 34 bp, Artificial Sequence
  Description of Artificial Sequence: Synthetic oligonucleotide
attggttgcccatctacaacttgtctcctctcag

SEQ ID NO: 332822 - DNA, 33 bp, Artificial Sequence
  Description of Artificial Sequence: Synthetic oligonucleotide
ttggttgcccatctacaacttgtctcctctcag

SEQ ID NO: 332823 - DNA, 32 bp, Artificial Sequence
  Description of Artificial Sequence: Synthetic oligonucleotide
tggttgcccatctacaacttgtctcctctcag

SEQ ID NO: 332824 - DNA, 31 bp, Artificial Sequence
  Description of Artificial Sequence: Synthetic oligonucleotide
ggttgcccatctacaacttgtctcctctcag

SEQ ID NO: 332825 - DNA, 31 bp, Artificial Sequence
  Description of Artificial Sequence: Synthetic oligonucleotide
gttgcccatctacaacttgtctcctctcagg

SEQ ID NO: 332826 - DNA, 31 bp, Artificial Sequence
  Description of Artificial Sequence: Synthetic oligonucleotide
ttgcccatctacaacttgtctcctctcaggc

SEQ ID NO: 332827 - DNA, 30 bp, Artificial Sequence
  Description of Artificial Sequence: Synthetic oligonucleotide
tgcccatctacaacttgtctcctctcaggc

SEQ ID NO: 332828 - DNA, 29 bp, Artificial Sequence
  Description of Artificial Sequence: Synthetic oligonucleotide
gcccatctacaacttgtctcctctcaggc

SEQ ID NO: 332829 - DNA, 35 bp, Artificial Sequence
  Description of Artificial Sequence: Synthetic oligonucleotide
cccatctacaacttgtctcctctcaggcattaatg

SEQ ID NO: 332830 - DNA, 36 bp, Artificial Sequence
  Description of Artificial Sequence: Synthetic oligonucleotide
ccatctacaacttgtctcctctcaggcattaatgtc

SEQ ID NO: 332831 - DNA, 37 bp, Artificial Sequence
  Description of Artificial Sequence: Synthetic oligonucleotide
catctacaacttgtctcctctcaggcattaatgtcac

SEQ ID NO: 332832 - DNA, 39 bp, Artificial Sequence
  Description of Artificial Sequence: Synthetic oligonucleotide
atctacaacttgtctcctctcaggcattaatgtcacttg

SEQ ID NO: 332833 - DNA, 38 bp, Artificial Sequence
  Description of Artificial Sequence: Synthetic oligonucleotide
tctacaacttgtctcctctcaggcattaatgtcacttg

SEQ ID NO: 332834 - DNA, 37 bp, Artificial Sequence
  Description of Artificial Sequence: Synthetic oligonucleotide
ctacaacttgtctcctctcaggcattaatgtcacttg

SEQ ID NO: 332835 - DNA, 37 bp, Artificial Sequence
  Description of Artificial Sequence: Synthetic oligonucleotide
tacaacttgtctcctctcaggcattaatgtcacttgg

SEQ ID NO: 332836 - DNA, 36 bp, Artificial Sequence
  Description of Artificial Sequence: Synthetic oligonucleotide
acaacttgtctcctctcaggcattaatgtcacttgg

SEQ ID NO: 332837 - DNA, 35 bp, Artificial Sequence
  Description of Artificial Sequence: Synthetic oligonucleotide
caacttgtctcctctcaggcattaatgtcacttgg

SEQ ID NO: 332838 - DNA, 35 bp, Artificial Sequence
  Description of Artificial Sequence: Synthetic oligonucleotide
aacttgtctcctctcaggcattaatgtcacttggg

SEQ ID NO: 332839 - DNA, 34 bp, Artificial Sequence
  Description of Artificial Sequence: Synthetic oligonucleotide
acttgtctcctctcaggcattaatgtcacttggg

SEQ ID NO: 332840 - DNA, 33 bp, Artificial Sequence
  Description of Artificial Sequence: Synthetic oligonucleotide
cttgtctcctctcaggcattaatgtcacttggg

SEQ ID NO: 332841 - DNA, 37 bp, Artificial Sequence
  Description of Artificial Sequence: Synthetic oligonucleotide
ttgtctcctctcaggcattaatgtcacttgggataag

SEQ ID NO: 332842 - DNA, 36 bp, Artificial Sequence
  Description of Artificial Sequence: Synthetic oligonucleotide
tgtctcctctcaggcattaatgtcacttgggataag

SEQ ID NO: 332843 - DNA, 35 bp, Artificial Sequence
  Description of Artificial Sequence: Synthetic oligonucleotide
gtctcctctcaggcattaatgtcacttgggataag

SEQ ID NO: 332844 - DNA, 37 bp, Artificial Sequence
  Description of Artificial Sequence: Synthetic oligonucleotide
tctcctctcaggcattaatgtcacttgggataagtag

SEQ ID NO: 332845 - DNA, 36 bp, Artificial Sequence
  Description of Artificial Sequence: Synthetic oligonucleotide
ctcctctcaggcattaatgtcacttgggataagtag

SEQ ID NO: 332846 - DNA, 36 bp, Artificial Sequence
  Description of Artificial Sequence: Synthetic oligonucleotide
tcctctcaggcattaatgtcacttgggataagtagg

SEQ ID NO: 332847 - DNA, 35 bp, Artificial Sequence
  Description of Artificial Sequence: Synthetic oligonucleotide
cctctcaggcattaatgtcacttgggataagtagg

SEQ ID NO: 332848 - DNA, 35 bp, Artificial Sequence
  Description of Artificial Sequence: Synthetic oligonucleotide
ctctcaggcattaatgtcacttgggataagtaggc

SEQ ID NO: 332849 - DNA, 36 bp, Artificial Sequence
  Description of Artificial Sequence: Synthetic oligonucleotide
tctcaggcattaatgtcacttgggataagtaggcac

SEQ ID NO: 332850 - DNA, 35 bp, Artificial Sequence
  Description of Artificial Sequence: Synthetic oligonucleotide
ctcaggcattaatgtcacttgggataagtaggcac

SEQ ID NO: 332851 - DNA, 35 bp, Artificial Sequence
  Description of Artificial Sequence: Synthetic oligonucleotide
tcaggcattaatgtcacttgggataagtaggcacc

SEQ ID NO: 332852 - DNA, 34 bp, Artificial Sequence
  Description of Artificial Sequence: Synthetic oligonucleotide
caggcattaatgtcacttgggataagtaggcacc

SEQ ID NO: 332853 - DNA, 39 bp, Artificial Sequence
  Description of Artificial Sequence: Synthetic oligonucleotide
aggcattaatgtcacttgggataagtaggcacctaattg

SEQ ID NO: 332854 - DNA, 38 bp, Artificial Sequence
  Description of Artificial Sequence: Synthetic oligonucleotide
ggcattaatgtcacttgggataagtaggcacctaattg

SEQ ID NO: 332855 - DNA, 39 bp, Artificial Sequence
  Description of Artificial Sequence: Synthetic oligonucleotide
gcattaatgtcacttgggataagtaggcacctaattgtg

SEQ ID NO: 332856 - DNA, 40 bp, Artificial Sequence
  Description of Artificial Sequence: Synthetic oligonucleotide
cattaatgtcacttgggataagtaggcacctaattgtgag

SEQ ID NO: 332857 - DNA, 42 bp, Artificial Sequence
  Description of Artificial Sequence: Synthetic oligonucleotide
attaatgtcacttgggataagtaggcacctaattgtgagatg

SEQ ID NO: 332858 - DNA, 41 bp, Artificial Sequence
  Description of Artificial Sequence: Synthetic oligonucleotide
ttaatgtcacttgggataagtaggcacctaattgtgagatg

SEQ ID NO: 332859 - DNA, 40 bp, Artificial Sequence
  Description of Artificial Sequence: Synthetic oligonucleotide
taatgtcacttgggataagtaggcacctaattgtgagatg

SEQ ID NO: 332860 - DNA, 39 bp, Artificial Sequence
  Description of Artificial Sequence: Synthetic oligonucleotide
aatgtcacttgggataagtaggcacctaattgtgagatg

SEQ ID NO: 332861 - DNA, 38 bp, Artificial Sequence
  Description of Artificial Sequence: Synthetic oligonucleotide
atgtcacttgggataagtaggcacctaattgtgagatg

SEQ ID NO: 332862 - DNA, 37 bp, Artificial Sequence
  Description of Artificial Sequence: Synthetic oligonucleotide
tgtcacttgggataagtaggcacctaattgtgagatg

SEQ ID NO: 332863 - DNA, 36 bp, Artificial Sequence
  Description of Artificial Sequence: Synthetic oligonucleotide
gtcacttgggataagtaggcacctaattgtgagatg

SEQ ID NO: 332864 - DNA, 40 bp, Artificial Sequence
  Description of Artificial Sequence: Synthetic oligonucleotide
tcacttgggataagtaggcacctaattgtgagatgatatc

SEQ ID NO: 332865 - DNA, 39 bp, Artificial Sequence
  Description of Artificial Sequence: Synthetic oligonucleotide
cacttgggataagtaggcacctaattgtgagatgatatc

SEQ ID NO: 332866 - DNA, 41 bp, Artificial Sequence
  Description of Artificial Sequence: Synthetic oligonucleotide
acttgggataagtaggcacctaattgtgagatgatatcttg

SEQ ID NO: 332867 - DNA, 40 bp, Artificial Sequence
  Description of Artificial Sequence: Synthetic oligonucleotide
cttgggataagtaggcacctaattgtgagatgatatcttg

SEQ ID NO: 332868 - DNA, 41 bp, Artificial Sequence
  Description of Artificial Sequence: Synthetic oligonucleotide
ttgggataagtaggcacctaattgtgagatgatatcttgtc

SEQ ID NO: 332869 - DNA, 40 bp, Artificial Sequence
  Description of Artificial Sequence: Synthetic oligonucleotide
tgggataagtaggcacctaattgtgagatgatatcttgtc

SEQ ID NO: 332870 - DNA, 39 bp, Artificial Sequence
  Description of Artificial Sequence: Synthetic oligonucleotide
gggataagtaggcacctaattgtgagatgatatcttgtc

SEQ ID NO: 332871 - DNA, 40 bp, Artificial Sequence
  Description of Artificial Sequence: Synthetic oligonucleotide
ggataagtaggcacctaattgtgagatgatatcttgtcag

SEQ ID NO: 332872 - DNA, 40 bp, Artificial Sequence
  Description of Artificial Sequence: Synthetic oligonucleotide
gataagtaggcacctaattgtgagatgatatcttgtcagc

SEQ ID NO: 332873 - DNA, 40 bp, Artificial Sequence
  Description of Artificial Sequence: Synthetic oligonucleotide
ataagtaggcacctaattgtgagatgatatcttgtcagcc

SEQ ID NO: 332874 - DNA, 39 bp, Artificial Sequence
  Description of Artificial Sequence: Synthetic oligonucleotide
taagtaggcacctaattgtgagatgatatcttgtcagcc

SEQ ID NO: 332875 - DNA, 38 bp, Artificial Sequence
  Description of Artificial Sequence: Synthetic oligonucleotide
aagtaggcacctaattgtgagatgatatcttgtcagcc

SEQ ID NO: 332876 - DNA, 37 bp, Artificial Sequence
  Description of Artificial Sequence: Synthetic oligonucleotide
agtaggcacctaattgtgagatgatatcttgtcagcc

SEQ ID NO: 332877 - DNA, 36 bp, Artificial Sequence
  Description of Artificial Sequence: Synthetic oligonucleotide
gtaggcacctaattgtgagatgatatcttgtcagcc

SEQ ID NO: 332878 - DNA, 37 bp, Artificial Sequence
  Description of Artificial Sequence: Synthetic oligonucleotide
taggcacctaattgtgagatgatatcttgtcagccac

SEQ ID NO: 332879 - DNA, 36 bp, Artificial Sequence
  Description of Artificial Sequence: Synthetic oligonucleotide
aggcacctaattgtgagatgatatcttgtcagccac

SEQ ID NO: 332880 - DNA, 35 bp, Artificial Sequence
  Description of Artificial Sequence: Synthetic oligonucleotide
ggcacctaattgtgagatgatatcttgtcagccac

SEQ ID NO: 332881 - DNA, 35 bp, Artificial Sequence
  Description of Artificial Sequence: Synthetic oligonucleotide
gcacctaattgtgagatgatatcttgtcagccacc

SEQ ID NO: 332882 - DNA, 36 bp, Artificial Sequence
  Description of Artificial Sequence: Synthetic oligonucleotide
cacctaattgtgagatgatatcttgtcagccacctc

SEQ ID NO: 332883 - DNA, 36 bp, Artificial Sequence
  Description of Artificial Sequence: Synthetic oligonucleotide
acctaattgtgagatgatatcttgtcagccacctcg

SEQ ID NO: 332884 - DNA, 35 bp, Artificial Sequence
  Description of Artificial Sequence: Synthetic oligonucleotide
cctaattgtgagatgatatcttgtcagccacctcg

SEQ ID NO: 332885 - DNA, 37 bp, Artificial Sequence
  Description of Artificial Sequence: Synthetic oligonucleotide
ctaattgtgagatgatatcttgtcagccacctcgaac

SEQ ID NO: 332886 - DNA, 37 bp, Artificial Sequence
  Description of Artificial Sequence: Synthetic oligonucleotide
taattgtgagatgatatcttgtcagccacctcgaacc

SEQ ID NO: 332887 - DNA, 36 bp, Artificial Sequence
  Description of Artificial Sequence: Synthetic oligonucleotide
aattgtgagatgatatcttgtcagccacctcgaacc

SEQ ID NO: 332888 - DNA, 35 bp, Artificial Sequence
  Description of Artificial Sequence: Synthetic oligonucleotide
attgtgagatgatatcttgtcagccacctcgaacc

SEQ ID NO: 332889 - DNA, 34 bp, Artificial Sequence
  Description of Artificial Sequence: Synthetic oligonucleotide
ttgtgagatgatatcttgtcagccacctcgaacc

SEQ ID NO: 332890 - DNA, 33 bp, Artificial Sequence
  Description of Artificial Sequence: Synthetic oligonucleotide
tgtgagatgatatcttgtcagccacctcgaacc

SEQ ID NO: 332891 - DNA, 32 bp, Artificial Sequence
  Description of Artificial Sequence: Synthetic oligonucleotide
gtgagatgatatcttgtcagccacctcgaacc

SEQ ID NO: 332892 - DNA, 36 bp, Artificial Sequence
  Description of Artificial Sequence: Synthetic oligonucleotide
tgagatgatatcttgtcagccacctcgaaccatatc

SEQ ID NO: 332893 - DNA, 35 bp, Artificial Sequence
  Description of Artificial Sequence: Synthetic oligonucleotide
gagatgatatcttgtcagccacctcgaaccatatc

SEQ ID NO: 332894 - DNA, 35 bp, Artificial Sequence
  Description of Artificial Sequence: Synthetic oligonucleotide
agatgatatcttgtcagccacctcgaaccatatcg

SEQ ID NO: 332895 - DNA, 34 bp, Artificial Sequence
  Description of Artificial Sequence: Synthetic oligonucleotide
gatgatatcttgtcagccacctcgaaccatatcg

SEQ ID NO: 332896 - DNA, 37 bp, Artificial Sequence
  Description of Artificial Sequence: Synthetic oligonucleotide
atgatatcttgtcagccacctcgaaccatatcgaatg

SEQ ID NO: 332897 - DNA, 36 bp, Artificial Sequence
  Description of Artificial Sequence: Synthetic oligonucleotide
tgatatcttgtcagccacctcgaaccatatcgaatg

SEQ ID NO: 332898 - DNA, 35 bp, Artificial Sequence
  Description of Artificial Sequence: Synthetic oligonucleotide
gatatcttgtcagccacctcgaaccatatcgaatg

SEQ ID NO: 332899 - DNA, 35 bp, Artificial Sequence
  Description of Artificial Sequence: Synthetic oligonucleotide
atatcttgtcagccacctcgaaccatatcgaatgg

SEQ ID NO: 332900 - DNA, 34 bp, Artificial Sequence
  Description of Artificial Sequence: Synthetic oligonucleotide
tatcttgtcagccacctcgaaccatatcgaatgg

SEQ ID NO: 332901 - DNA, 33 bp, Artificial Sequence
  Description of Artificial Sequence: Synthetic oligonucleotide
atcttgtcagccacctcgaaccatatcgaatgg

SEQ ID NO: 332902 - DNA, 32 bp, Artificial Sequence
  Description of Artificial Sequence: Synthetic oligonucleotide
tcttgtcagccacctcgaaccatatcgaatgg

SEQ ID NO: 332903 - DNA, 31 bp, Artificial Sequence
  Description of Artificial Sequence: Synthetic oligonucleotide
cttgtcagccacctcgaaccatatcgaatgg

SEQ ID NO: 332904 - DNA, 32 bp, Artificial Sequence
  Description of Artificial Sequence: Synthetic oligonucleotide
ttgtcagccacctcgaaccatatcgaatggag

SEQ ID NO: 332905 - DNA, 31 bp, Artificial Sequence
  Description of Artificial Sequence: Synthetic oligonucleotide
tgtcagccacctcgaaccatatcgaatggag

SEQ ID NO: 332906 - DNA, 30 bp, Artificial Sequence
  Description of Artificial Sequence: Synthetic oligonucleotide
gtcagccacctcgaaccatatcgaatggag

SEQ ID NO: 332907 - DNA, 31 bp, Artificial Sequence
  Description of Artificial Sequence: Synthetic oligonucleotide
tcagccacctcgaaccatatcgaatggagac

SEQ ID NO: 332908 - DNA, 30 bp, Artificial Sequence
  Description of Artificial Sequence: Synthetic oligonucleotide
cagccacctcgaaccatatcgaatggagac

SEQ ID NO: 332909 - DNA, 32 bp, Artificial Sequence
  Description of Artificial Sequence: Synthetic oligonucleotide
agccacctcgaaccatatcgaatggagacatc

SEQ ID NO: 332910 - DNA, 31 bp, Artificial Sequence
  Description of Artificial Sequence: Synthetic oligonucleotide
gccacctcgaaccatatcgaatggagacatc

SEQ ID NO: 332911 - DNA, 33 bp, Artificial Sequence
  Description of Artificial Sequence: Synthetic oligonucleotide
ccacctcgaaccatatcgaatggagacatctac

SEQ ID NO: 332912 - DNA, 34 bp, Artificial Sequence
  Description of Artificial Sequence: Synthetic oligonucleotide
cacctcgaaccatatcgaatggagacatctacag

SEQ ID NO: 332913 - DNA, 34 bp, Artificial Sequence
  Description of Artificial Sequence: Synthetic oligonucleotide
acctcgaaccatatcgaatggagacatctacagc

SEQ ID NO: 332914 - DNA, 33 bp, Artificial Sequence
  Description of Artificial Sequence: Synthetic oligonucleotide
cctcgaaccatatcgaatggagacatctacagc

SEQ ID NO: 332915 - DNA, 35 bp, Artificial Sequence
  Description of Artificial Sequence: Synthetic oligonucleotide
ctcgaaccatatcgaatggagacatctacagcatc

SEQ ID NO: 332916 - DNA, 39 bp, Artificial Sequence
  Description of Artificial Sequence: Synthetic oligonucleotide
tcgaaccatatcgaatggagacatctacagcatcaatag

SEQ ID NO: 332917 - DNA, 38 bp, Artificial Sequence
  Description of Artificial Sequence: Synthetic oligonucleotide
cgaaccatatcgaatggagacatctacagcatcaatag

SEQ ID NO: 332918 - DNA, 40 bp, Artificial Sequence
  Description of Artificial Sequence: Synthetic oligonucleotide
gaaccatatcgaatggagacatctacagcatcaatagaac

SEQ ID NO: 332919 - DNA, 42 bp, Artificial Sequence
  Description of Artificial Sequence: Synthetic oligonucleotide
aaccatatcgaatggagacatctacagcatcaatagaacttc

SEQ ID NO: 332920 - DNA, 41 bp, Artificial Sequence
  Description of Artificial Sequence: Synthetic oligonucleotide
accatatcgaatggagacatctacagcatcaatagaacttc

SEQ ID NO: 332921 - DNA, 40 bp, Artificial Sequence
  Description of Artificial Sequence: Synthetic oligonucleotide
ccatatcgaatggagacatctacagcatcaatagaacttc

SEQ ID NO: 332922 - DNA, 44 bp, Artificial Sequence
  Description of Artificial Sequence: Synthetic oligonucleotide
catatcgaatggagacatctacagcatcaatagaacttcttttc

SEQ ID NO: 332923 - DNA, 45 bp, Artificial Sequence
  Description of Artificial Sequence: Synthetic oligonucleotide
atatcgaatggagacatctacagcatcaatagaacttcttttcac

SEQ ID NO: 332924 - DNA, 44 bp, Artificial Sequence
  Description of Artificial Sequence: Synthetic oligonucleotide
tatcgaatggagacatctacagcatcaatagaacttcttttcac

SEQ ID NO: 332925 - DNA, 43 bp, Artificial Sequence
  Description of Artificial Sequence: Synthetic oligonucleotide
atcgaatggagacatctacagcatcaatagaacttcttttcac

SEQ ID NO: 332926 - DNA, 42 bp, Artificial Sequence
  Description of Artificial Sequence: Synthetic oligonucleotide
tcgaatggagacatctacagcatcaatagaacttcttttcac

SEQ ID NO: 332927 - DNA, 41 bp, Artificial Sequence
  Description of Artificial Sequence: Synthetic oligonucleotide
cgaatggagacatctacagcatcaatagaacttcttttcac

SEQ ID NO: 332928 - DNA, 44 bp, Artificial Sequence
  Description of Artificial Sequence: Synthetic oligonucleotide
gaatggagacatctacagcatcaatagaacttcttttcactatg

SEQ ID NO: 332929 - DNA, 44 bp, Artificial Sequence
  Description of Artificial Sequence: Synthetic oligonucleotide
aatggagacatctacagcatcaatagaacttcttttcactatgg

SEQ ID NO: 332930 - DNA, 43 bp, Artificial Sequence
  Description of Artificial Sequence: Synthetic oligonucleotide
atggagacatctacagcatcaatagaacttcttttcactatgg

SEQ ID NO: 332931 - DNA, 42 bp, Artificial Sequence
  Description of Artificial Sequence: Synthetic oligonucleotide
tggagacatctacagcatcaatagaacttcttttcactatgg

SEQ ID NO: 332932 - DNA, 41 bp, Artificial Sequence
  Description of Artificial Sequence: Synthetic oligonucleotide
ggagacatctacagcatcaatagaacttcttttcactatgg

SEQ ID NO: 332933 - DNA, 43 bp, Artificial Sequence
  Description of Artificial Sequence: Synthetic oligonucleotide
gagacatctacagcatcaatagaacttcttttcactatggaac

SEQ ID NO: 332934 - DNA, 43 bp, Artificial Sequence
  Description of Artificial Sequence: Synthetic oligonucleotide
agacatctacagcatcaatagaacttcttttcactatggaacg

SEQ ID NO: 332935 - DNA, 42 bp, Artificial Sequence
  Description of Artificial Sequence: Synthetic oligonucleotide
gacatctacagcatcaatagaacttcttttcactatggaacg

SEQ ID NO: 332936 - DNA, 42 bp, Artificial Sequence
  Description of Artificial Sequence: Synthetic oligonucleotide
acatctacagcatcaatagaacttcttttcactatggaacgg

SEQ ID NO: 332937 - DNA, 41 bp, Artificial Sequence
  Description of Artificial Sequence: Synthetic oligonucleotide
catctacagcatcaatagaacttcttttcactatggaacgg

SEQ ID NO: 332938 - DNA, 42 bp, Artificial Sequence
  Description of Artificial Sequence: Synthetic oligonucleotide
atctacagcatcaatagaacttcttttcactatggaacggag

SEQ ID NO: 332939 - DNA, 41 bp, Artificial Sequence
  Description of Artificial Sequence: Synthetic oligonucleotide
tctacagcatcaatagaacttcttttcactatggaacggag

SEQ ID NO: 332940 - DNA, 40 bp, Artificial Sequence
  Description of Artificial Sequence: Synthetic oligonucleotide
ctacagcatcaatagaacttcttttcactatggaacggag

SEQ ID NO: 332941 - DNA, 40 bp, Artificial Sequence
  Description of Artificial Sequence: Synthetic oligonucleotide
tacagcatcaatagaacttcttttcactatggaacggagg

SEQ ID NO: 332942 - DNA, 39 bp, Artificial Sequence
  Description of Artificial Sequence: Synthetic oligonucleotide
acagcatcaatagaacttcttttcactatggaacggagg

SEQ ID NO: 332943 - DNA, 38 bp, Artificial Sequence
  Description of Artificial Sequence: Synthetic oligonucleotide
cagcatcaatagaacttcttttcactatggaacggagg

SEQ ID NO: 332944 - DNA, 41 bp, Artificial Sequence
  Description of Artificial Sequence: Synthetic oligonucleotide
agcatcaatagaacttcttttcactatggaacggaggtaac

SEQ ID NO: 332945 - DNA, 40 bp, Artificial Sequence
  Description of Artificial Sequence: Synthetic oligonucleotide
gcatcaatagaacttcttttcactatggaacggaggtaac

SEQ ID NO: 332946 - DNA, 43 bp, Artificial Sequence
  Description of Artificial Sequence: Synthetic oligonucleotide
catcaatagaacttcttttcactatggaacggaggtaacttag

SEQ ID NO: 332947 - DNA, 43 bp, Artificial Sequence
  Description of Artificial Sequence: Synthetic oligonucleotide
atcaatagaacttcttttcactatggaacggaggtaacttagc

SEQ ID NO: 332948 - DNA, 42 bp, Artificial Sequence
  Description of Artificial Sequence: Synthetic oligonucleotide
tcaatagaacttcttttcactatggaacggaggtaacttagc

SEQ ID NO: 332949 - DNA, 41 bp, Artificial Sequence
  Description of Artificial Sequence: Synthetic oligonucleotide
caatagaacttcttttcactatggaacggaggtaacttagc

SEQ ID NO: 332950 - DNA, 42 bp, Artificial Sequence
  Description of Artificial Sequence: Synthetic oligonucleotide
aatagaacttcttttcactatggaacggaggtaacttagcag

SEQ ID NO: 332951 - DNA, 41 bp, Artificial Sequence
  Description of Artificial Sequence: Synthetic oligonucleotide
atagaacttcttttcactatggaacggaggtaacttagcag

SEQ ID NO: 332952 - DNA, 40 bp, Artificial Sequence
  Description of Artificial Sequence: Synthetic oligonucleotide
tagaacttcttttcactatggaacggaggtaacttagcag

SEQ ID NO: 332953 - DNA, 39 bp, Artificial Sequence
  Description of Artificial Sequence: Synthetic oligonucleotide
agaacttcttttcactatggaacggaggtaacttagcag

SEQ ID NO: 332954 - DNA, 38 bp, Artificial Sequence
  Description of Artificial Sequence: Synthetic oligonucleotide
gaacttcttttcactatggaacggaggtaacttagcag

SEQ ID NO: 332955 - DNA, 39 bp, Artificial Sequence
  Description of Artificial Sequence: Synthetic oligonucleotide
aacttcttttcactatggaacggaggtaacttagcagtg

SEQ ID NO: 332956 - DNA, 38 bp, Artificial Sequence
  Description of Artificial Sequence: Synthetic oligonucleotide
acttcttttcactatggaacggaggtaacttagcagtg

SEQ ID NO: 332957 - DNA, 37 bp, Artificial Sequence
  Description of Artificial Sequence: Synthetic oligonucleotide
cttcttttcactatggaacggaggtaacttagcagtg

SEQ ID NO: 332958 - DNA, 37 bp, Artificial Sequence
  Description of Artificial Sequence: Synthetic oligonucleotide
ttcttttcactatggaacggaggtaacttagcagtgc

SEQ ID NO: 332959 - DNA, 36 bp, Artificial Sequence
  Description of Artificial Sequence: Synthetic oligonucleotide
tcttttcactatggaacggaggtaacttagcagtgc

SEQ ID NO: 332960 - DNA, 35 bp, Artificial Sequence
  Description of Artificial Sequence: Synthetic oligonucleotide
cttttcactatggaacggaggtaacttagcagtgc

SEQ ID NO: 332961 - DNA, 35 bp, Artificial Sequence
  Description of Artificial Sequence: Synthetic oligonucleotide
ttttcactatggaacggaggtaacttagcagtgcc

SEQ ID NO: 332962 - DNA, 34 bp, Artificial Sequence
  Description of Artificial Sequence: Synthetic oligonucleotide
tttcactatggaacggaggtaacttagcagtgcc

SEQ ID NO: 332963 - DNA, 33 bp, Artificial Sequence
  Description of Artificial Sequence: Synthetic oligonucleotide
ttcactatggaacggaggtaacttagcagtgcc

SEQ ID NO: 332964 - DNA, 32 bp, Artificial Sequence
  Description of Artificial Sequence: Synthetic oligonucleotide
tcactatggaacggaggtaacttagcagtgcc

SEQ ID NO: 332965 - DNA, 31 bp, Artificial Sequence
  Description of Artificial Sequence: Synthetic oligonucleotide
cactatggaacggaggtaacttagcagtgcc

SEQ ID NO: 332966 - DNA, 32 bp, Artificial Sequence
  Description of Artificial Sequence: Synthetic oligonucleotide
actatggaacggaggtaacttagcagtgccac

SEQ ID NO: 332967 - DNA, 31 bp, Artificial Sequence
  Description of Artificial Sequence: Synthetic oligonucleotide
ctatggaacggaggtaacttagcagtgccac

SEQ ID NO: 332968 - DNA, 32 bp, Artificial Sequence
  Description of Artificial Sequence: Synthetic oligonucleotide
tatggaacggaggtaacttagcagtgccactc

SEQ ID NO: 332969 - DNA, 31 bp, Artificial Sequence
  Description of Artificial Sequence: Synthetic oligonucleotide
atggaacggaggtaacttagcagtgccactc

SEQ ID NO: 332970 - DNA, 30 bp, Artificial Sequence
  Description of Artificial Sequence: Synthetic oligonucleotide
tggaacggaggtaacttagcagtgccactc

SEQ ID NO: 332971 - DNA, 29 bp, Artificial Sequence
  Description of Artificial Sequence: Synthetic oligonucleotide
ggaacggaggtaacttagcagtgccactc

SEQ ID NO: 332972 - DNA, 30 bp, Artificial Sequence
  Description of Artificial Sequence: Synthetic oligonucleotide
gaacggaggtaacttagcagtgccactctg

SEQ ID NO: 332973 - DNA, 30 bp, Artificial Sequence
  Description of Artificial Sequence: Synthetic oligonucleotide
aacggaggtaacttagcagtgccactctgg

SEQ ID NO: 332974 - DNA, 29 bp, Artificial Sequence
  Description of Artificial Sequence: Synthetic oligonucleotide
acggaggtaacttagcagtgccactctgg

SEQ ID NO: 332975 - DNA, 28 bp, Artificial Sequence
  Description of Artificial Sequence: Synthetic oligonucleotide
cggaggtaacttagcagtgccactctgg

SEQ ID NO: 332976 - DNA, 29 bp, Artificial Sequence
  Description of Artificial Sequence: Synthetic oligonucleotide
ggaggtaacttagcagtgccactctggac

SEQ ID NO: 332977 - DNA, 29 bp, Artificial Sequence
  Description of Artificial Sequence: Synthetic oligonucleotide
gaggtaacttagcagtgccactctggacc

SEQ ID NO: 332978 - DNA, 30 bp, Artificial Sequence
  Description of Artificial Sequence: Synthetic oligonucleotide
aggtaacttagcagtgccactctggaccag

SEQ ID NO: 332979 - DNA, 29 bp, Artificial Sequence
  Description of Artificial Sequence: Synthetic oligonucleotide
ggtaacttagcagtgccactctggaccag

SEQ ID NO: 332980 - DNA, 31 bp, Artificial Sequence
  Description of Artificial Sequence: Synthetic oligonucleotide
gtaacttagcagtgccactctggaccagttg

SEQ ID NO: 332981 - DNA, 31 bp, Artificial Sequence
  Description of Artificial Sequence: Synthetic oligonucleotide
taacttagcagtgccactctggaccagttgg

SEQ ID NO: 332982 - DNA, 30 bp, Artificial Sequence
  Description of Artificial Sequence: Synthetic oligonucleotide
aacttagcagtgccactctggaccagttgg

SEQ ID NO: 332983 - DNA, 29 bp, Artificial Sequence
  Description of Artificial Sequence: Synthetic oligonucleotide
acttagcagtgccactctggaccagttgg

SEQ ID NO: 332984 - DNA, 28 bp, Artificial Sequence
  Description of Artificial Sequence: Synthetic oligonucleotide
cttagcagtgccactctggaccagttgg

SEQ ID NO: 332985 - DNA, 29 bp, Artificial Sequence
  Description of Artificial Sequence: Synthetic oligonucleotide
ttagcagtgccactctggaccagttggag

SEQ ID NO: 332986 - DNA, 28 bp, Artificial Sequence
  Description of Artificial Sequence: Synthetic oligonucleotide
tagcagtgccactctggaccagttggag

SEQ ID NO: 332987 - DNA, 27 bp, Artificial Sequence
  Description of Artificial Sequence: Synthetic oligonucleotide
agcagtgccactctggaccagttggag

SEQ ID NO: 332988 - DNA, 27 bp, Artificial Sequence
  Description of Artificial Sequence: Synthetic oligonucleotide
gcagtgccactctggaccagttggaga

SEQ ID NO: 332989 - DNA, 28 bp, Artificial Sequence
  Description of Artificial Sequence: Synthetic oligonucleotide
cagtgccactctggaccagttggagaac

SEQ ID NO: 332990 - DNA, 29 bp, Artificial Sequence
  Description of Artificial Sequence: Synthetic oligonucleotide
agtgccactctggaccagttggagaacac

SEQ ID NO: 332991 - DNA, 28 bp, Artificial Sequence
  Description of Artificial Sequence: Synthetic oligonucleotide
gtgccactctggaccagttggagaacac

SEQ ID NO: 332992 - DNA, 28 bp, Artificial Sequence
  Description of Artificial Sequence: Synthetic oligonucleotide
tgccactctggaccagttggagaacacc

SEQ ID NO: 332993 - DNA, 27 bp, Artificial Sequence
  Description of Artificial Sequence: Synthetic oligonucleotide
gccactctggaccagttggagaacacc

SEQ ID NO: 332994 - DNA, 28 bp, Artificial Sequence
  Description of Artificial Sequence: Synthetic oligonucleotide
ccactctggaccagttggagaacacctg

SEQ ID NO: 332995 - DNA, 31 bp, Artificial Sequence
  Description of Artificial Sequence: Synthetic oligonucleotide
cactctggaccagttggagaacacctgtttg

SEQ ID NO: 332996 - DNA, 32 bp, Artificial Sequence
  Description of Artificial Sequence: Synthetic oligonucleotide
actctggaccagttggagaacacctgtttgag

SEQ ID NO: 332997 - DNA, 31 bp, Artificial Sequence
  Description of Artificial Sequence: Synthetic oligonucleotide
ctctggaccagttggagaacacctgtttgag

SEQ ID NO: 332998 - DNA, 31 bp, Artificial Sequence
  Description of Artificial Sequence: Synthetic oligonucleotide
tctggaccagttggagaacacctgtttgagg

SEQ ID NO: 332999 - DNA, 30 bp, Artificial Sequence
  Description of Artificial Sequence: Synthetic oligonucleotide
ctggaccagttggagaacacctgtttgagg

SEQ ID NO: 333000 - DNA, 32 bp, Artificial Sequence
  Description of Artificial Sequence: Synthetic oligonucleotide
tggaccagttggagaacacctgtttgaggttg

SEQ ID NO: 333001 - DNA, 31 bp, Artificial Sequence
  Description of Artificial Sequence: Synthetic oligonucleotide
ggaccagttggagaacacctgtttgaggttg

SEQ ID NO: 333002 - DNA, 32 bp, Artificial Sequence
  Description of Artificial Sequence: Synthetic oligonucleotide
gaccagttggagaacacctgtttgaggttgtg

SEQ ID NO: 333003 - DNA, 32 bp, Artificial Sequence
  Description of Artificial Sequence: Synthetic oligonucleotide
accagttggagaacacctgtttgaggttgtgg

SEQ ID NO: 333004 - DNA, 31 bp, Artificial Sequence
  Description of Artificial Sequence: Synthetic oligonucleotide
ccagttggagaacacctgtttgaggttgtgg

SEQ ID NO: 333005 - DNA, 31 bp, Artificial Sequence
  Description of Artificial Sequence: Synthetic oligonucleotide
cagttggagaacacctgtttgaggttgtggg

SEQ ID NO: 333006 - DNA, 32 bp, Artificial Sequence
  Description of Artificial Sequence: Synthetic oligonucleotide
agttggagaacacctgtttgaggttgtgggag

SEQ ID NO: 333007 - DNA, 31 bp, Artificial Sequence
  Description of Artificial Sequence: Synthetic oligonucleotide
gttggagaacacctgtttgaggttgtgggag

SEQ ID NO: 333008 - DNA, 33 bp, Artificial Sequence
  Description of Artificial Sequence: Synthetic oligonucleotide
ttggagaacacctgtttgaggttgtgggagtac

SEQ ID NO: 333009 - DNA, 32 bp, Artificial Sequence
  Description of Artificial Sequence: Synthetic oligonucleotide
tggagaacacctgtttgaggttgtgggagtac

SEQ ID NO: 333010 - DNA, 31 bp, Artificial Sequence
  Description of Artificial Sequence: Synthetic oligonucleotide
ggagaacacctgtttgaggttgtgggagtac

SEQ ID NO: 333011 - DNA, 31 bp, Artificial Sequence
  Description of Artificial Sequence: Synthetic oligonucleotide
gagaacacctgtttgaggttgtgggagtacg

SEQ ID NO: 333012 - DNA, 31 bp, Artificial Sequence
  Description of Artificial Sequence: Synthetic oligonucleotide
agaacacctgtttgaggttgtgggagtacgg

SEQ ID NO: 333013 - DNA, 30 bp, Artificial Sequence
  Description of Artificial Sequence: Synthetic oligonucleotide
gaacacctgtttgaggttgtgggagtacgg

SEQ ID NO: 333014 - DNA, 31 bp, Artificial Sequence
  Description of Artificial Sequence: Synthetic oligonucleotide
aacacctgtttgaggttgtgggagtacggtc

SEQ ID NO: 333015 - DNA, 30 bp, Artificial Sequence
  Description of Artificial Sequence: Synthetic oligonucleotide
acacctgtttgaggttgtgggagtacggtc

SEQ ID NO: 333016 - DNA, 29 bp, Artificial Sequence
  Description of Artificial Sequence: Synthetic oligonucleotide
cacctgtttgaggttgtgggagtacggtc

SEQ ID NO: 333017 - DNA, 37 bp, Artificial Sequence
  Description of Artificial Sequence: Synthetic oligonucleotide
acctgtttgaggttgtgggagtacggtcaatttattg

SEQ ID NO: 333018 - DNA, 36 bp, Artificial Sequence
  Description of Artificial Sequence: Synthetic oligonucleotide
cctgtttgaggttgtgggagtacggtcaatttattg

SEQ ID NO: 333019 - DNA, 36 bp, Artificial Sequence
  Description of Artificial Sequence: Synthetic oligonucleotide
ctgtttgaggttgtgggagtacggtcaatttattgc

SEQ ID NO: 333020 - DNA, 37 bp, Artificial Sequence
  Description of Artificial Sequence: Synthetic oligonucleotide
tgtttgaggttgtgggagtacggtcaatttattgcac

SEQ ID NO: 333021 - DNA, 36 bp, Artificial Sequence
  Description of Artificial Sequence: Synthetic oligonucleotide
gtttgaggttgtgggagtacggtcaatttattgcac

SEQ ID NO: 333022 - DNA, 36 bp, Artificial Sequence
  Description of Artificial Sequence: Synthetic oligonucleotide
tttgaggttgtgggagtacggtcaatttattgcacc

SEQ ID NO: 333023 - DNA, 35 bp, Artificial Sequence
  Description of Artificial Sequence: Synthetic oligonucleotide
ttgaggttgtgggagtacggtcaatttattgcacc

SEQ ID NO: 333024 - DNA, 34 bp, Artificial Sequence
  Description of Artificial Sequence: Synthetic oligonucleotide
tgaggttgtgggagtacggtcaatttattgcacc

SEQ ID NO: 333025 - DNA, 33 bp, Artificial Sequence
  Description of Artificial Sequence: Synthetic oligonucleotide
gaggttgtgggagtacggtcaatttattgcacc

SEQ ID NO: 333026 - DNA, 34 bp, Artificial Sequence
  Description of Artificial Sequence: Synthetic oligonucleotide
aggttgtgggagtacggtcaatttattgcacctg

SEQ ID NO: 333027 - DNA, 33 bp, Artificial Sequence
  Description of Artificial Sequence: Synthetic oligonucleotide
ggttgtgggagtacggtcaatttattgcacctg

SEQ ID NO: 333028 - DNA, 33 bp, Artificial Sequence
  Description of Artificial Sequence: Synthetic oligonucleotide
gttgtgggagtacggtcaatttattgcacctgc

SEQ ID NO: 333029 - DNA, 36 bp, Artificial Sequence
  Description of Artificial Sequence: Synthetic oligonucleotide
ttgtgggagtacggtcaatttattgcacctgcaaag

SEQ ID NO: 333030 - DNA, 35 bp, Artificial Sequence
  Description of Artificial Sequence: Synthetic oligonucleotide
tgtgggagtacggtcaatttattgcacctgcaaag

SEQ ID NO: 333031 - DNA, 34 bp, Artificial Sequence
  Description of Artificial Sequence: Synthetic oligonucleotide
gtgggagtacggtcaatttattgcacctgcaaag

SEQ ID NO: 333032 - DNA, 36 bp, Artificial Sequence
  Description of Artificial Sequence: Synthetic oligonucleotide
tgggagtacggtcaatttattgcacctgcaaagatg

SEQ ID NO: 333033 - DNA, 35 bp, Artificial Sequence
  Description of Artificial Sequence: Synthetic oligonucleotide
gggagtacggtcaatttattgcacctgcaaagatg

SEQ ID NO: 333034 - DNA, 37 bp, Artificial Sequence
  Description of Artificial Sequence: Synthetic oligonucleotide
ggagtacggtcaatttattgcacctgcaaagatgttc

SEQ ID NO: 333035 - DNA, 39 bp, Artificial Sequence
  Description of Artificial Sequence: Synthetic oligonucleotide
gagtacggtcaatttattgcacctgcaaagatgttcaag

SEQ ID NO: 333036 - DNA, 41 bp, Artificial Sequence
  Description of Artificial Sequence: Synthetic oligonucleotide
agtacggtcaatttattgcacctgcaaagatgttcaagttg

SEQ ID NO: 333037 - DNA, 40 bp, Artificial Sequence
  Description of Artificial Sequence: Synthetic oligonucleotide
gtacggtcaatttattgcacctgcaaagatgttcaagttg

SEQ ID NO: 333038 - DNA, 40 bp, Artificial Sequence
  Description of Artificial Sequence: Synthetic oligonucleotide
tacggtcaatttattgcacctgcaaagatgttcaagttgg

SEQ ID NO: 333039 - DNA, 39 bp, Artificial Sequence
  Description of Artificial Sequence: Synthetic oligonucleotide
acggtcaatttattgcacctgcaaagatgttcaagttgg

SEQ ID NO: 333040 - DNA, 38 bp, Artificial Sequence
  Description of Artificial Sequence: Synthetic oligonucleotide
cggtcaatttattgcacctgcaaagatgttcaagttgg

SEQ ID NO: 333041 - DNA, 39 bp, Artificial Sequence
  Description of Artificial Sequence: Synthetic oligonucleotide
ggtcaatttattgcacctgcaaagatgttcaagttggag

SEQ ID NO: 333042 - DNA, 42 bp, Artificial Sequence
  Description of Artificial Sequence: Synthetic oligonucleotide
gtcaatttattgcacctgcaaagatgttcaagttggagtttg

SEQ ID NO: 333043 - DNA, 42 bp, Artificial Sequence
  Description of Artificial Sequence: Synthetic oligonucleotide
tcaatttattgcacctgcaaagatgttcaagttggagtttgg

SEQ ID NO: 333044 - DNA, 41 bp, Artificial Sequence
  Description of Artificial Sequence: Synthetic oligonucleotide
caatttattgcacctgcaaagatgttcaagttggagtttgg

SEQ ID NO: 333045 - DNA, 42 bp, Artificial Sequence
  Description of Artificial Sequence: Synthetic oligonucleotide
aatttattgcacctgcaaagatgttcaagttggagtttggag

SEQ ID NO: 333046 - DNA, 41 bp, Artificial Sequence
  Description of Artificial Sequence: Synthetic oligonucleotide
atttattgcacctgcaaagatgttcaagttggagtttggag

SEQ ID NO: 333047 - DNA, 40 bp, Artificial Sequence
  Description of Artificial Sequence: Synthetic oligonucleotide
tttattgcacctgcaaagatgttcaagttggagtttggag

SEQ ID NO: 333048 - DNA, 39 bp, Artificial Sequence
  Description of Artificial Sequence: Synthetic oligonucleotide
ttattgcacctgcaaagatgttcaagttggagtttggag

SEQ ID NO: 333049 - DNA, 38 bp, Artificial Sequence
  Description of Artificial Sequence: Synthetic oligonucleotide
tattgcacctgcaaagatgttcaagttggagtttggag

SEQ ID NO: 333050 - DNA, 37 bp, Artificial Sequence
  Description of Artificial Sequence: Synthetic oligonucleotide
attgcacctgcaaagatgttcaagttggagtttggag

SEQ ID NO: 333051 - DNA, 36 bp, Artificial Sequence
  Description of Artificial Sequence: Synthetic oligonucleotide
ttgcacctgcaaagatgttcaagttggagtttggag

SEQ ID NO: 333052 - DNA, 35 bp, Artificial Sequence
  Description of Artificial Sequence: Synthetic oligonucleotide
tgcacctgcaaagatgttcaagttggagtttggag

SEQ ID NO: 333053 - DNA, 34 bp, Artificial Sequence
  Description of Artificial Sequence: Synthetic oligonucleotide
gcacctgcaaagatgttcaagttggagtttggag

SEQ ID NO: 333054 - DNA, 34 bp, Artificial Sequence
  Description of Artificial Sequence: Synthetic oligonucleotide
cacctgcaaagatgttcaagttggagtttggagc

SEQ ID NO: 333055 - DNA, 35 bp, Artificial Sequence
  Description of Artificial Sequence: Synthetic oligonucleotide
acctgcaaagatgttcaagttggagtttggagctg

SEQ ID NO: 333056 - DNA, 34 bp, Artificial Sequence
  Description of Artificial Sequence: Synthetic oligonucleotide
cctgcaaagatgttcaagttggagtttggagctg

SEQ ID NO: 333057 - DNA, 34 bp, Artificial Sequence
  Description of Artificial Sequence: Synthetic oligonucleotide
ctgcaaagatgttcaagttggagtttggagctgc

SEQ ID NO: 333058 - DNA, 34 bp, Artificial Sequence
  Description of Artificial Sequence: Synthetic oligonucleotide
tgcaaagatgttcaagttggagtttggagctgcc

SEQ ID NO: 333059 - DNA, 33 bp, Artificial Sequence
  Description of Artificial Sequence: Synthetic oligonucleotide
gcaaagatgttcaagttggagtttggagctgcc

SEQ ID NO: 333060 - DNA, 33 bp, Artificial Sequence
  Description of Artificial Sequence: Synthetic oligonucleotide
caaagatgttcaagttggagtttggagctgccc

SEQ ID NO: 333061 - DNA, 34 bp, Artificial Sequence
  Description of Artificial Sequence: Synthetic oligonucleotide
aaagatgttcaagttggagtttggagctgccctc

SEQ ID NO: 333062 - DNA, 33 bp, Artificial Sequence
  Description of Artificial Sequence: Synthetic oligonucleotide
aagatgttcaagttggagtttggagctgccctc

SEQ ID NO: 333063 - DNA, 32 bp, Artificial Sequence
  Description of Artificial Sequence: Synthetic oligonucleotide
agatgttcaagttggagtttggagctgccctc

SEQ ID NO: 333064 - DNA, 31 bp, Artificial Sequence
  Description of Artificial Sequence: Synthetic oligonucleotide
gatgttcaagttggagtttggagctgccctc

SEQ ID NO: 333065 - DNA, 31 bp, Artificial Sequence
  Description of Artificial Sequence: Synthetic oligonucleotide
atgttcaagttggagtttggagctgccctcc

SEQ ID NO: 333066 - DNA, 30 bp, Artificial Sequence
  Description of Artificial Sequence: Synthetic oligonucleotide
tgttcaagttggagtttggagctgccctcc

SEQ ID NO: 333067 - DNA, 29 bp, Artificial Sequence
  Description of Artificial Sequence: Synthetic oligonucleotide
gttcaagttggagtttggagctgccctcc

SEQ ID NO: 333068 - DNA, 29 bp, Artificial Sequence
  Description of Artificial Sequence: Synthetic oligonucleotide
ttcaagttggagtttggagctgccctccc

SEQ ID NO: 333069 - DNA, 28 bp, Artificial Sequence
  Description of Artificial Sequence: Synthetic oligonucleotide
tcaagttggagtttggagctgccctccc

SEQ ID NO: 333070 - DNA, 27 bp, Artificial Sequence
  Description of Artificial Sequence: Synthetic oligonucleotide
caagttggagtttggagctgccctccc

SEQ ID NO: 333071 - DNA, 27 bp, Artificial Sequence
  Description of Artificial Sequence: Synthetic oligonucleotide
aagttggagtttggagctgccctcccc

SEQ ID NO: 333072 - DNA, 26 bp, Artificial Sequence
  Description of Artificial Sequence: Synthetic oligonucleotide
agttggagtttggagctgccctcccc

SEQ ID NO: 333073 - DNA, 25 bp, Artificial Sequence
  Description of Artificial Sequence: Synthetic oligonucleotide
gttggagtttggagctgccctcccc

SEQ ID NO: 333074 - DNA, 26 bp, Artificial Sequence
  Description of Artificial Sequence: Synthetic oligonucleotide
ttggagtttggagctgccctccccgt

SEQ ID NO: 333075 - DNA, 25 bp, Artificial Sequence
  Description of Artificial Sequence: Synthetic oligonucleotide
tggagtttggagctgccctccccgt

SEQ ID NO: 333076 - DNA, 24 bp, Artificial Sequence
  Description of Artificial Sequence: Synthetic oligonucleotide
ggagtttggagctgccctccccgt

SEQ ID NO: 333077 - DNA, 24 bp, Artificial Sequence
  Description of Artificial Sequence: Synthetic oligonucleotide
gagtttggagctgccctccccgtc

SEQ ID NO: 333078 - DNA, 24 bp, Artificial Sequence
  Description of Artificial Sequence: Synthetic oligonucleotide
agtttggagctgccctccccgtcg

SEQ ID NO: 333079 - DNA, 23 bp, Artificial Sequence
  Description of Artificial Sequence: Synthetic oligonucleotide
gtttggagctgccctccccgtcg

SEQ ID NO: 333080 - DNA, 24 bp, Artificial Sequence
  Description of Artificial Sequence: Synthetic oligonucleotide
tttggagctgccctccccgtcggt

SEQ ID NO: 333081 - DNA, 23 bp, Artificial Sequence
  Description of Artificial Sequence: Synthetic oligonucleotide
ttggagctgccctccccgtcggt

SEQ ID NO: 333082 - DNA, 22 bp, Artificial Sequence
  Description of Artificial Sequence: Synthetic oligonucleotide
tggagctgccctccccgtcggt

SEQ ID NO: 333083 - DNA, 21 bp, Artificial Sequence
  Description of Artificial Sequence: Synthetic oligonucleotide
ggagctgccctccccgtcggt

SEQ ID NO: 333084 - DNA, 26 bp, Artificial Sequence
  Description of Artificial Sequence: Synthetic oligonucleotide
gagctgccctccccgtcggtgtatat

SEQ ID NO: 333085 - DNA, 27 bp, Artificial Sequence
  Description of Artificial Sequence: Synthetic oligonucleotide
agctgccctccccgtcggtgtatatct

SEQ ID NO: 333086 - DNA, 27 bp, Artificial Sequence
  Description of Artificial Sequence: Synthetic oligonucleotide
gctgccctccccgtcggtgtatatcta

SEQ ID NO: 333087 - DNA, 27 bp, Artificial Sequence
  Description of Artificial Sequence: Synthetic oligonucleotide
ctgccctccccgtcggtgtatatctac

SEQ ID NO: 333088 - DNA, 35 bp, Artificial Sequence
  Description of Artificial Sequence: Synthetic oligonucleotide
tgccctccccgtcggtgtatatctactaattaatg

SEQ ID NO: 333089 - DNA, 34 bp, Artificial Sequence
  Description of Artificial Sequence: Synthetic oligonucleotide
gccctccccgtcggtgtatatctactaattaatg

SEQ ID NO: 333090 - DNA, 34 bp, Artificial Sequence
  Description of Artificial Sequence: Synthetic oligonucleotide
ccctccccgtcggtgtatatctactaattaatgc

SEQ ID NO: 333091 - DNA, 35 bp, Artificial Sequence
  Description of Artificial Sequence: Synthetic oligonucleotide
cctccccgtcggtgtatatctactaattaatgcac

SEQ ID NO: 333092 - DNA, 36 bp, Artificial Sequence
  Description of Artificial Sequence: Synthetic oligonucleotide
ctccccgtcggtgtatatctactaattaatgcacag

SEQ ID NO: 333093 - DNA, 36 bp, Artificial Sequence
  Description of Artificial Sequence: Synthetic oligonucleotide
tccccgtcggtgtatatctactaattaatgcacagg

SEQ ID NO: 333094 - DNA, 35 bp, Artificial Sequence
  Description of Artificial Sequence: Synthetic oligonucleotide
ccccgtcggtgtatatctactaattaatgcacagg

SEQ ID NO: 333095 - DNA, 36 bp, Artificial Sequence
  Description of Artificial Sequence: Synthetic oligonucleotide
cccgtcggtgtatatctactaattaatgcacaggtc

SEQ ID NO: 333096 - DNA, 36 bp, Artificial Sequence
  Description of Artificial Sequence: Synthetic oligonucleotide
ccgtcggtgtatatctactaattaatgcacaggtcc

SEQ ID NO: 333097 - DNA, 37 bp, Artificial Sequence
  Description of Artificial Sequence: Synthetic oligonucleotide
cgtcggtgtatatctactaattaatgcacaggtccag

SEQ ID NO: 333098 - DNA, 39 bp, Artificial Sequence
  Description of Artificial Sequence: Synthetic oligonucleotide
gtcggtgtatatctactaattaatgcacaggtccagaag

SEQ ID NO: 333099 - DNA, 41 bp, Artificial Sequence
  Description of Artificial Sequence: Synthetic oligonucleotide
tcggtgtatatctactaattaatgcacaggtccagaagtag

SEQ ID NO: 333100 - DNA, 40 bp, Artificial Sequence
  Description of Artificial Sequence: Synthetic oligonucleotide
cggtgtatatctactaattaatgcacaggtccagaagtag

SEQ ID NO: 333101 - DNA, 45 bp, Artificial Sequence
  Description of Artificial Sequence: Synthetic oligonucleotide
ggtgtatatctactaattaatgcacaggtccagaagtagaaaatg

SEQ ID NO: 333102 - DNA, 45 bp, Artificial Sequence
  Description of Artificial Sequence: Synthetic oligonucleotide
gtgtatatctactaattaatgcacaggtccagaagtagaaaatgc

SEQ ID NO: 333103 - DNA, 50 bp, Artificial Sequence
  Description of Artificial Sequence: Synthetic oligonucleotide
tgtatatctactaattaatgcacaggtccagaagtagaaaatgcatttag

SEQ ID NO: 333104 - DNA, 49 bp, Artificial Sequence
  Description of Artificial Sequence: Synthetic oligonucleotide
gtatatctactaattaatgcacaggtccagaagtagaaaatgcatttag

SEQ ID NO: 333105 - DNA, 50 bp, Artificial Sequence
  Description of Artificial Sequence: Synthetic oligonucleotide
tatatctactaattaatgcacaggtccagaagtagaaaatgcatttagag

SEQ ID NO: 333106 - DNA, 49 bp, Artificial Sequence
  Description of Artificial Sequence: Synthetic oligonucleotide
atatctactaattaatgcacaggtccagaagtagaaaatgcatttagag

SEQ ID NO: 333107 - DNA, 48 bp, Artificial Sequence
  Description of Artificial Sequence: Synthetic oligonucleotide
tatctactaattaatgcacaggtccagaagtagaaaatgcatttagag

SEQ ID NO: 333108 - DNA, 47 bp, Artificial Sequence
  Description of Artificial Sequence: Synthetic oligonucleotide
atctactaattaatgcacaggtccagaagtagaaaatgcatttagag

SEQ ID NO: 333109 - DNA, 46 bp, Artificial Sequence
  Description of Artificial Sequence: Synthetic oligonucleotide
tctactaattaatgcacaggtccagaagtagaaaatgcatttagag

SEQ ID NO: 333110 - DNA, 45 bp, Artificial Sequence
  Description of Artificial Sequence: Synthetic oligonucleotide
ctactaattaatgcacaggtccagaagtagaaaatgcatttagag

SEQ ID NO: 333111 - DNA, 47 bp, Artificial Sequence
  Description of Artificial Sequence: Synthetic oligonucleotide
tactaattaatgcacaggtccagaagtagaaaatgcatttagagtac

SEQ ID NO: 333112 - DNA, 46 bp, Artificial Sequence
  Description of Artificial Sequence: Synthetic oligonucleotide
actaattaatgcacaggtccagaagtagaaaatgcatttagagtac

SEQ ID NO: 333113 - DNA, 45 bp, Artificial Sequence
  Description of Artificial Sequence: Synthetic oligonucleotide
ctaattaatgcacaggtccagaagtagaaaatgcatttagagtac

SEQ ID NO: 333114 - DNA, 45 bp, Artificial Sequence
  Description of Artificial Sequence: Synthetic oligonucleotide
taattaatgcacaggtccagaagtagaaaatgcatttagagtacg

SEQ ID NO: 333115 - DNA, 44 bp, Artificial Sequence
  Description of Artificial Sequence: Synthetic oligonucleotide
aattaatgcacaggtccagaagtagaaaatgcatttagagtacg

SEQ ID NO: 333116 - DNA, 43 bp, Artificial Sequence
  Description of Artificial Sequence: Synthetic oligonucleotide
attaatgcacaggtccagaagtagaaaatgcatttagagtacg

SEQ ID NO: 333117 - DNA, 42 bp, Artificial Sequence
  Description of Artificial Sequence: Synthetic oligonucleotide
ttaatgcacaggtccagaagtagaaaatgcatttagagtacg

SEQ ID NO: 333118 - DNA, 41 bp, Artificial Sequence
  Description of Artificial Sequence: Synthetic oligonucleotide
taatgcacaggtccagaagtagaaaatgcatttagagtacg

SEQ ID NO: 333119 - DNA, 40 bp, Artificial Sequence
  Description of Artificial Sequence: Synthetic oligonucleotide
aatgcacaggtccagaagtagaaaatgcatttagagtacg

SEQ ID NO: 333120 - DNA, 39 bp, Artificial Sequence
  Description of Artificial Sequence: Synthetic oligonucleotide
atgcacaggtccagaagtagaaaatgcatttagagtacg

SEQ ID NO: 333121 - DNA, 38 bp, Artificial Sequence
  Description of Artificial Sequence: Synthetic oligonucleotide
tgcacaggtccagaagtagaaaatgcatttagagtacg

SEQ ID NO: 333122 - DNA, 37 bp, Artificial Sequence
  Description of Artificial Sequence: Synthetic oligonucleotide
gcacaggtccagaagtagaaaatgcatttagagtacg

SEQ ID NO: 333123 - DNA, 38 bp, Artificial Sequence
  Description of Artificial Sequence: Synthetic oligonucleotide
cacaggtccagaagtagaaaatgcatttagagtacgag

SEQ ID NO: 333124 - DNA, 38 bp, Artificial Sequence
  Description of Artificial Sequence: Synthetic oligonucleotide
acaggtccagaagtagaaaatgcatttagagtacgagg

SEQ ID NO: 333125 - DNA, 37 bp, Artificial Sequence
  Description of Artificial Sequence: Synthetic oligonucleotide
caggtccagaagtagaaaatgcatttagagtacgagg

SEQ ID NO: 333126 - DNA, 40 bp, Artificial Sequence
  Description of Artificial Sequence: Synthetic oligonucleotide
aggtccagaagtagaaaatgcatttagagtacgaggaaac

SEQ ID NO: 333127 - DNA, 39 bp, Artificial Sequence
  Description of Artificial Sequence: Synthetic oligonucleotide
ggtccagaagtagaaaatgcatttagagtacgaggaaac

SEQ ID NO: 333128 - DNA, 40 bp, Artificial Sequence
  Description of Artificial Sequence: Synthetic oligonucleotide
gtccagaagtagaaaatgcatttagagtacgaggaaacag

SEQ ID NO: 333129 - DNA, 40 bp, Artificial Sequence
  Description of Artificial Sequence: Synthetic oligonucleotide
tccagaagtagaaaatgcatttagagtacgaggaaacagc

SEQ ID NO: 333130 - DNA, 39 bp, Artificial Sequence
  Description of Artificial Sequence: Synthetic oligonucleotide
ccagaagtagaaaatgcatttagagtacgaggaaacagc

SEQ ID NO: 333131 - DNA, 40 bp, Artificial Sequence
  Description of Artificial Sequence: Synthetic oligonucleotide
cagaagtagaaaatgcatttagagtacgaggaaacagcag

SEQ ID NO: 333132 - DNA, 43 bp, Artificial Sequence
  Description of Artificial Sequence: Synthetic oligonucleotide
agaagtagaaaatgcatttagagtacgaggaaacagcagtttc

SEQ ID NO: 333133 - DNA, 42 bp, Artificial Sequence
  Description of Artificial Sequence: Synthetic oligonucleotide
gaagtagaaaatgcatttagagtacgaggaaacagcagtttc

SEQ ID NO: 333134 - DNA, 46 bp, Artificial Sequence
  Description of Artificial Sequence: Synthetic oligonucleotide
aagtagaaaatgcatttagagtacgaggaaacagcagtttcttttc

SEQ ID NO: 333135 - DNA, 45 bp, Artificial Sequence
  Description of Artificial Sequence: Synthetic oligonucleotide
agtagaaaatgcatttagagtacgaggaaacagcagtttcttttc

SEQ ID NO: 333136 - DNA, 44 bp, Artificial Sequence
  Description of Artificial Sequence: Synthetic oligonucleotide
gtagaaaatgcatttagagtacgaggaaacagcagtttcttttc

SEQ ID NO: 333137 - DNA, 44 bp, Artificial Sequence
  Description of Artificial Sequence: Synthetic oligonucleotide
tagaaaatgcatttagagtacgaggaaacagcagtttcttttcc

SEQ ID NO: 333138 - DNA, 43 bp, Artificial Sequence
  Description of Artificial Sequence: Synthetic oligonucleotide
agaaaatgcatttagagtacgaggaaacagcagtttcttttcc

SEQ ID NO: 333139 - DNA, 42 bp, Artificial Sequence
  Description of Artificial Sequence: Synthetic oligonucleotide
gaaaatgcatttagagtacgaggaaacagcagtttcttttcc

SEQ ID NO: 333140 - DNA, 42 bp, Artificial Sequence
  Description of Artificial Sequence: Synthetic oligonucleotide
aaaatgcatttagagtacgaggaaacagcagtttcttttccc

SEQ ID NO: 333141 - DNA, 41 bp, Artificial Sequence
  Description of Artificial Sequence: Synthetic oligonucleotide
aaatgcatttagagtacgaggaaacagcagtttcttttccc

SEQ ID NO: 333142 - DNA, 40 bp, Artificial Sequence
  Description of Artificial Sequence: Synthetic oligonucleotide
aatgcatttagagtacgaggaaacagcagtttcttttccc

SEQ ID NO: 333143 - DNA, 39 bp, Artificial Sequence
  Description of Artificial Sequence: Synthetic oligonucleotide
atgcatttagagtacgaggaaacagcagtttcttttccc

SEQ ID NO: 333144 - DNA, 38 bp, Artificial Sequence
  Description of Artificial Sequence: Synthetic oligonucleotide
tgcatttagagtacgaggaaacagcagtttcttttccc

SEQ ID NO: 333145 - DNA, 37 bp, Artificial Sequence
  Description of Artificial Sequence: Synthetic oligonucleotide
gcatttagagtacgaggaaacagcagtttcttttccc

SEQ ID NO: 333146 - DNA, 38 bp, Artificial Sequence
  Description of Artificial Sequence: Synthetic oligonucleotide
catttagagtacgaggaaacagcagtttcttttccctc

SEQ ID NO: 333147 - DNA, 39 bp, Artificial Sequence
  Description of Artificial Sequence: Synthetic oligonucleotide
atttagagtacgaggaaacagcagtttcttttccctcac

SEQ ID NO: 333148 - DNA, 38 bp, Artificial Sequence
  Description of Artificial Sequence: Synthetic oligonucleotide
tttagagtacgaggaaacagcagtttcttttccctcac

SEQ ID NO: 333149 - DNA, 37 bp, Artificial Sequence
  Description of Artificial Sequence: Synthetic oligonucleotide
ttagagtacgaggaaacagcagtttcttttccctcac

SEQ ID NO: 333150 - DNA, 36 bp, Artificial Sequence
  Description of Artificial Sequence: Synthetic oligonucleotide
tagagtacgaggaaacagcagtttcttttccctcac

SEQ ID NO: 333151 - DNA, 35 bp, Artificial Sequence
  Description of Artificial Sequence: Synthetic oligonucleotide
agagtacgaggaaacagcagtttcttttccctcac

SEQ ID NO: 333152 - DNA, 34 bp, Artificial Sequence
  Description of Artificial Sequence: Synthetic oligonucleotide
gagtacgaggaaacagcagtttcttttccctcac

SEQ ID NO: 333153 - DNA, 35 bp, Artificial Sequence
  Description of Artificial Sequence: Synthetic oligonucleotide
agtacgaggaaacagcagtttcttttccctcactg

SEQ ID NO: 333154 - DNA, 34 bp, Artificial Sequence
  Description of Artificial Sequence: Synthetic oligonucleotide
gtacgaggaaacagcagtttcttttccctcactg

SEQ ID NO: 333155 - DNA, 35 bp, Artificial Sequence
  Description of Artificial Sequence: Synthetic oligonucleotide
tacgaggaaacagcagtttcttttccctcactgtg

SEQ ID NO: 333156 - DNA, 34 bp, Artificial Sequence
  Description of Artificial Sequence: Synthetic oligonucleotide
acgaggaaacagcagtttcttttccctcactgtg

SEQ ID NO: 333157 - DNA, 33 bp, Artificial Sequence
  Description of Artificial Sequence: Synthetic oligonucleotide
cgaggaaacagcagtttcttttccctcactgtg

SEQ ID NO: 333158 - DNA, 35 bp, Artificial Sequence
  Description of Artificial Sequence: Synthetic oligonucleotide
gaggaaacagcagtttcttttccctcactgtgatc

SEQ ID NO: 333159 - DNA, 37 bp, Artificial Sequence
  Description of Artificial Sequence: Synthetic oligonucleotide
aggaaacagcagtttcttttccctcactgtgatcatc

SEQ ID NO: 333160 - DNA, 36 bp, Artificial Sequence
  Description of Artificial Sequence: Synthetic oligonucleotide
ggaaacagcagtttcttttccctcactgtgatcatc

SEQ ID NO: 333161 - DNA, 37 bp, Artificial Sequence
  Description of Artificial Sequence: Synthetic oligonucleotide
gaaacagcagtttcttttccctcactgtgatcatcag

SEQ ID NO: 333162 - DNA, 42 bp, Artificial Sequence
  Description of Artificial Sequence: Synthetic oligonucleotide
aaacagcagtttcttttccctcactgtgatcatcagttttag

SEQ ID NO: 333163 - DNA, 41 bp, Artificial Sequence
  Description of Artificial Sequence: Synthetic oligonucleotide
aacagcagtttcttttccctcactgtgatcatcagttttag

SEQ ID NO: 333164 - DNA, 40 bp, Artificial Sequence
  Description of Artificial Sequence: Synthetic oligonucleotide
acagcagtttcttttccctcactgtgatcatcagttttag

SEQ ID NO: 333165 - DNA, 39 bp, Artificial Sequence
  Description of Artificial Sequence: Synthetic oligonucleotide
cagcagtttcttttccctcactgtgatcatcagttttag

SEQ ID NO: 333166 - DNA, 41 bp, Artificial Sequence
  Description of Artificial Sequence: Synthetic oligonucleotide
agcagtttcttttccctcactgtgatcatcagttttagatg

SEQ ID NO: 333167 - DNA, 40 bp, Artificial Sequence
  Description of Artificial Sequence: Synthetic oligonucleotide
gcagtttcttttccctcactgtgatcatcagttttagatg

SEQ ID NO: 333168 - DNA, 41 bp, Artificial Sequence
  Description of Artificial Sequence: Synthetic oligonucleotide
cagtttcttttccctcactgtgatcatcagttttagatgtg

SEQ ID NO: 333169 - DNA, 42 bp, Artificial Sequence
  Description of Artificial Sequence: Synthetic oligonucleotide
agtttcttttccctcactgtgatcatcagttttagatgtgag

SEQ ID NO: 333170 - DNA, 41 bp, Artificial Sequence
  Description of Artificial Sequence: Synthetic oligonucleotide
gtttcttttccctcactgtgatcatcagttttagatgtgag

SEQ ID NO: 333171 - DNA, 41 bp, Artificial Sequence
  Description of Artificial Sequence: Synthetic oligonucleotide
tttcttttccctcactgtgatcatcagttttagatgtgagc

SEQ ID NO: 333172 - DNA, 40 bp, Artificial Sequence
  Description of Artificial Sequence: Synthetic oligonucleotide
ttcttttccctcactgtgatcatcagttttagatgtgagc

SEQ ID NO: 333173 - DNA, 39 bp, Artificial Sequence
  Description of Artificial Sequence: Synthetic oligonucleotide
tcttttccctcactgtgatcatcagttttagatgtgagc

SEQ ID NO: 333174 - DNA, 38 bp, Artificial Sequence
  Description of Artificial Sequence: Synthetic oligonucleotide
cttttccctcactgtgatcatcagttttagatgtgagc

SEQ ID NO: 333175 - DNA, 38 bp, Artificial Sequence
  Description of Artificial Sequence: Synthetic oligonucleotide
ttttccctcactgtgatcatcagttttagatgtgagcc

SEQ ID NO: 333176 - DNA, 37 bp, Artificial Sequence
  Description of Artificial Sequence: Synthetic oligonucleotide
tttccctcactgtgatcatcagttttagatgtgagcc

SEQ ID NO: 333177 - DNA, 36 bp, Artificial Sequence
  Description of Artificial Sequence: Synthetic oligonucleotide
ttccctcactgtgatcatcagttttagatgtgagcc

SEQ ID NO: 333178 - DNA, 35 bp, Artificial Sequence
  Description of Artificial Sequence: Synthetic oligonucleotide
tccctcactgtgatcatcagttttagatgtgagcc

SEQ ID NO: 333179 - DNA, 34 bp, Artificial Sequence
  Description of Artificial Sequence: Synthetic oligonucleotide
ccctcactgtgatcatcagttttagatgtgagcc

SEQ ID NO: 333180 - DNA, 34 bp, Artificial Sequence
  Description of Artificial Sequence: Synthetic oligonucleotide
cctcactgtgatcatcagttttagatgtgagccc

SEQ ID NO: 333181 - DNA, 34 bp, Artificial Sequence
  Description of Artificial Sequence: Synthetic oligonucleotide
ctcactgtgatcatcagttttagatgtgagcccg

SEQ ID NO: 333182 - DNA, 34 bp, Artificial Sequence
  Description of Artificial Sequence: Synthetic oligonucleotide
tcactgtgatcatcagttttagatgtgagcccgg

SEQ ID NO: 333183 - DNA, 33 bp, Artificial Sequence
  Description of Artificial Sequence: Synthetic oligonucleotide
cactgtgatcatcagttttagatgtgagcccgg

SEQ ID NO: 333184 - DNA, 33 bp, Artificial Sequence
  Description of Artificial Sequence: Synthetic oligonucleotide
actgtgatcatcagttttagatgtgagcccggg

SEQ ID NO: 333185 - DNA, 32 bp, Artificial Sequence
  Description of Artificial Sequence: Synthetic oligonucleotide
ctgtgatcatcagttttagatgtgagcccggg

SEQ ID NO: 333186 - DNA, 35 bp, Artificial Sequence
  Description of Artificial Sequence: Synthetic oligonucleotide
tgtgatcatcagttttagatgtgagcccgggtatg

SEQ ID NO: 333187 - DNA, 34 bp, Artificial Sequence
  Description of Artificial Sequence: Synthetic oligonucleotide
gtgatcatcagttttagatgtgagcccgggtatg

SEQ ID NO: 333188 - DNA, 35 bp, Artificial Sequence
  Description of Artificial Sequence: Synthetic oligonucleotide
tgatcatcagttttagatgtgagcccgggtatgtc

SEQ ID NO: 333189 - DNA, 34 bp, Artificial Sequence
  Description of Artificial Sequence: Synthetic oligonucleotide
gatcatcagttttagatgtgagcccgggtatgtc

SEQ ID NO: 333190 - DNA, 36 bp, Artificial Sequence
  Description of Artificial Sequence: Synthetic oligonucleotide
atcatcagttttagatgtgagcccgggtatgtcatg

SEQ ID NO: 333191 - DNA, 35 bp, Artificial Sequence
  Description of Artificial Sequence: Synthetic oligonucleotide
tcatcagttttagatgtgagcccgggtatgtcatg

SEQ ID NO: 333192 - DNA, 34 bp, Artificial Sequence
  Description of Artificial Sequence: Synthetic oligonucleotide
catcagttttagatgtgagcccgggtatgtcatg

SEQ ID NO: 333193 - DNA, 34 bp, Artificial Sequence
  Description of Artificial Sequence: Synthetic oligonucleotide
atcagttttagatgtgagcccgggtatgtcatgg

SEQ ID NO: 333194 - DNA, 33 bp, Artificial Sequence
  Description of Artificial Sequence: Synthetic oligonucleotide
tcagttttagatgtgagcccgggtatgtcatgg

SEQ ID NO: 333195 - DNA, 32 bp, Artificial Sequence
  Description of Artificial Sequence: Synthetic oligonucleotide
cagttttagatgtgagcccgggtatgtcatgg

SEQ ID NO: 333196 - DNA, 34 bp, Artificial Sequence
  Description of Artificial Sequence: Synthetic oligonucleotide
agttttagatgtgagcccgggtatgtcatggttg

SEQ ID NO: 333197 - DNA, 33 bp, Artificial Sequence
  Description of Artificial Sequence: Synthetic oligonucleotide
gttttagatgtgagcccgggtatgtcatggttg

SEQ ID NO: 333198 - DNA, 33 bp, Artificial Sequence
  Description of Artificial Sequence: Synthetic oligonucleotide
ttttagatgtgagcccgggtatgtcatggttgg

SEQ ID NO: 333199 - DNA, 32 bp, Artificial Sequence
  Description of Artificial Sequence: Synthetic oligonucleotide
tttagatgtgagcccgggtatgtcatggttgg

SEQ ID NO: 333200 - DNA, 31 bp, Artificial Sequence
  Description of Artificial Sequence: Synthetic oligonucleotide
ttagatgtgagcccgggtatgtcatggttgg

SEQ ID NO: 333201 - DNA, 30 bp, Artificial Sequence
  Description of Artificial Sequence: Synthetic oligonucleotide
tagatgtgagcccgggtatgtcatggttgg

SEQ ID NO: 333202 - DNA, 29 bp, Artificial Sequence
  Description of Artificial Sequence: Synthetic oligonucleotide
agatgtgagcccgggtatgtcatggttgg

SEQ ID NO: 333203 - DNA, 28 bp, Artificial Sequence
  Description of Artificial Sequence: Synthetic oligonucleotide
gatgtgagcccgggtatgtcatggttgg

SEQ ID NO: 333204 - DNA, 28 bp, Artificial Sequence
  Description of Artificial Sequence: Synthetic oligonucleotide
atgtgagcccgggtatgtcatggttggg

SEQ ID NO: 333205 - DNA, 27 bp, Artificial Sequence
  Description of Artificial Sequence: Synthetic oligonucleotide
tgtgagcccgggtatgtcatggttggg

SEQ ID NO: 333206 - DNA, 27 bp, Artificial Sequence
  Description of Artificial Sequence: Synthetic oligonucleotide
gtgagcccgggtatgtcatggttgggt

SEQ ID NO: 333207 - DNA, 27 bp, Artificial Sequence
  Description of Artificial Sequence: Synthetic oligonucleotide
tgagcccgggtatgtcatggttgggtc

SEQ ID NO: 333208 - DNA, 26 bp, Artificial Sequence
  Description of Artificial Sequence: Synthetic oligonucleotide
gagcccgggtatgtcatggttgggtc

SEQ ID NO: 333209 - DNA, 26 bp, Artificial Sequence
  Description of Artificial Sequence: Synthetic oligonucleotide
agcccgggtatgtcatggttgggtcc

SEQ ID NO: 333210 - DNA, 25 bp, Artificial Sequence
  Description of Artificial Sequence: Synthetic oligonucleotide
gcccgggtatgtcatggttgggtcc

SEQ ID NO: 333211 - DNA, 26 bp, Artificial Sequence
  Description of Artificial Sequence: Synthetic oligonucleotide
cccgggtatgtcatggttgggtccca

SEQ ID NO: 333212 - DNA, 27 bp, Artificial Sequence
  Description of Artificial Sequence: Synthetic oligonucleotide
ccgggtatgtcatggttgggtcccact

SEQ ID NO: 333213 - DNA, 27 bp, Artificial Sequence
  Description of Artificial Sequence: Synthetic oligonucleotide
cgggtatgtcatggttgggtcccactc

SEQ ID NO: 333214 - DNA, 28 bp, Artificial Sequence
  Description of Artificial Sequence: Synthetic oligonucleotide
gggtatgtcatggttgggtcccactctg

SEQ ID NO: 333215 - DNA, 29 bp, Artificial Sequence
  Description of Artificial Sequence: Synthetic oligonucleotide
ggtatgtcatggttgggtcccactctgtg

SEQ ID NO: 333216 - DNA, 29 bp, Artificial Sequence
  Description of Artificial Sequence: Synthetic oligonucleotide
gtatgtcatggttgggtcccactctgtgc

SEQ ID NO: 333217 - DNA, 30 bp, Artificial Sequence
  Description of Artificial Sequence: Synthetic oligonucleotide
tatgtcatggttgggtcccactctgtgcag

SEQ ID NO: 333218 - DNA, 29 bp, Artificial Sequence
  Description of Artificial Sequence: Synthetic oligonucleotide
atgtcatggttgggtcccactctgtgcag

SEQ ID NO: 333219 - DNA, 28 bp, Artificial Sequence
  Description of Artificial Sequence: Synthetic oligonucleotide
tgtcatggttgggtcccactctgtgcag

SEQ ID NO: 333220 - DNA, 27 bp, Artificial Sequence
  Description of Artificial Sequence: Synthetic oligonucleotide
gtcatggttgggtcccactctgtgcag

SEQ ID NO: 333221 - DNA, 28 bp, Artificial Sequence
  Description of Artificial Sequence: Synthetic oligonucleotide
tcatggttgggtcccactctgtgcagtc

SEQ ID NO: 333222 - DNA, 27 bp, Artificial Sequence
  Description of Artificial Sequence: Synthetic oligonucleotide
catggttgggtcccactctgtgcagtc

SEQ ID NO: 333223 - DNA, 27 bp, Artificial Sequence
  Description of Artificial Sequence: Synthetic oligonucleotide
atggttgggtcccactctgtgcagtcc

SEQ ID NO: 333224 - DNA, 26 bp, Artificial Sequence
  Description of Artificial Sequence: Synthetic oligonucleotide
tggttgggtcccactctgtgcagtcc

SEQ ID NO: 333225 - DNA, 25 bp, Artificial Sequence
  Description of Artificial Sequence: Synthetic oligonucleotide
ggttgggtcccactctgtgcagtcc

SEQ ID NO: 333226 - DNA, 26 bp, Artificial Sequence
  Description of Artificial Sequence: Synthetic oligonucleotide
gttgggtcccactctgtgcagtccca

SEQ ID NO: 333227 - DNA, 27 bp, Artificial Sequence
  Description of Artificial Sequence: Synthetic oligonucleotide
ttgggtcccactctgtgcagtcccaga

SEQ ID NO: 333228 - DNA, 26 bp, Artificial Sequence
  Description of Artificial Sequence: Synthetic oligonucleotide
tgggtcccactctgtgcagtcccaga

SEQ ID NO: 333229 - DNA, 25 bp, Artificial Sequence
  Description of Artificial Sequence: Synthetic oligonucleotide
gggtcccactctgtgcagtcccaga

SEQ ID NO: 333230 - DNA, 25 bp, Artificial Sequence
  Description of Artificial Sequence: Synthetic oligonucleotide
ggtcccactctgtgcagtcccagac

SEQ ID NO: 333231 - DNA, 27 bp, Artificial Sequence
  Description of Artificial Sequence: Synthetic oligonucleotide
gtcccactctgtgcagtcccagaccaa

SEQ ID NO: 333232 - DNA, 28 bp, Artificial Sequence
  Description of Artificial Sequence: Synthetic oligonucleotide
tcccactctgtgcagtcccagaccaaag

SEQ ID NO: 333233 - DNA, 27 bp, Artificial Sequence
  Description of Artificial Sequence: Synthetic oligonucleotide
cccactctgtgcagtcccagaccaaag

SEQ ID NO: 333234 - DNA, 27 bp, Artificial Sequence
  Description of Artificial Sequence: Synthetic oligonucleotide
ccactctgtgcagtcccagaccaaagg

SEQ ID NO: 333235 - DNA, 27 bp, Artificial Sequence
  Description of Artificial Sequence: Synthetic oligonucleotide
cactctgtgcagtcccagaccaaaggc

SEQ ID NO: 333236 - DNA, 28 bp, Artificial Sequence
  Description of Artificial Sequence: Synthetic oligonucleotide
actctgtgcagtcccagaccaaaggcag

SEQ ID NO: 333237 - DNA, 27 bp, Artificial Sequence
  Description of Artificial Sequence: Synthetic oligonucleotide
ctctgtgcagtcccagaccaaaggcag

SEQ ID NO: 333238 - DNA, 29 bp, Artificial Sequence
  Description of Artificial Sequence: Synthetic oligonucleotide
tctgtgcagtcccagaccaaaggcagatg

SEQ ID NO: 333239 - DNA, 28 bp, Artificial Sequence
  Description of Artificial Sequence: Synthetic oligonucleotide
ctgtgcagtcccagaccaaaggcagatg

SEQ ID NO: 333240 - DNA, 28 bp, Artificial Sequence
  Description of Artificial Sequence: Synthetic oligonucleotide
tgtgcagtcccagaccaaaggcagatgg

SEQ ID NO: 333241 - DNA, 27 bp, Artificial Sequence
  Description of Artificial Sequence: Synthetic oligonucleotide
gtgcagtcccagaccaaaggcagatgg

SEQ ID NO: 333242 - DNA, 27 bp, Artificial Sequence
  Description of Artificial Sequence: Synthetic oligonucleotide
tgcagtcccagaccaaaggcagatggc

SEQ ID NO: 333243 - DNA, 26 bp, Artificial Sequence
  Description of Artificial Sequence: Synthetic oligonucleotide
gcagtcccagaccaaaggcagatggc

SEQ ID NO: 333244 - DNA, 26 bp, Artificial Sequence
  Description of Artificial Sequence: Synthetic oligonucleotide
cagtcccagaccaaaggcagatggcg

SEQ ID NO: 333245 - DNA, 26 bp, Artificial Sequence
  Description of Artificial Sequence: Synthetic oligonucleotide
agtcccagaccaaaggcagatggcgg

SEQ ID NO: 333246 - DNA, 25 bp, Artificial Sequence
  Description of Artificial Sequence: Synthetic oligonucleotide
gtcccagaccaaaggcagatggcgg

SEQ ID NO: 333247 - DNA, 25 bp, Artificial Sequence
  Description of Artificial Sequence: Synthetic oligonucleotide
tcccagaccaaaggcagatggcggc

SEQ ID NO: 333248 - DNA, 24 bp, Artificial Sequence
  Description of Artificial Sequence: Synthetic oligonucleotide
cccagaccaaaggcagatggcggc

SEQ ID NO: 333249 - DNA, 24 bp, Artificial Sequence
  Description of Artificial Sequence: Synthetic oligonucleotide
ccagaccaaaggcagatggcggcc

SEQ ID NO: 333250 - DNA, 26 bp, Artificial Sequence
  Description of Artificial Sequence: Synthetic oligonucleotide
cagaccaaaggcagatggcggcccaa

SEQ ID NO: 333251 - DNA, 26 bp, Artificial Sequence
  Description of Artificial Sequence: Synthetic oligonucleotide
agaccaaaggcagatggcggcccaag

SEQ ID NO: 333252 - DNA, 25 bp, Artificial Sequence
  Description of Artificial Sequence: Synthetic oligonucleotide
gaccaaaggcagatggcggcccaag

SEQ ID NO: 333253 - DNA, 26 bp, Artificial Sequence
  Description of Artificial Sequence: Synthetic oligonucleotide
accaaaggcagatggcggcccaagca

SEQ ID NO: 333254 - DNA, 25 bp, Artificial Sequence
  Description of Artificial Sequence: Synthetic oligonucleotide
ccaaaggcagatggcggcccaagca

SEQ ID NO: 333255 - DNA, 25 bp, Artificial Sequence
  Description of Artificial Sequence: Synthetic oligonucleotide
caaaggcagatggcggcccaagcag

SEQ ID NO: 333256 - DNA, 25 bp, Artificial Sequence
  Description of Artificial Sequence: Synthetic oligonucleotide
aaaggcagatggcggcccaagcagc

SEQ ID NO: 333257 - DNA, 24 bp, Artificial Sequence
  Description of Artificial Sequence: Synthetic oligonucleotide
aaggcagatggcggcccaagcagc

SEQ ID NO: 333258 - DNA, 23 bp, Artificial Sequence
  Description of Artificial Sequence: Synthetic oligonucleotide
aggcagatggcggcccaagcagc

SEQ ID NO: 333259 - DNA, 22 bp, Artificial Sequence
  Description of Artificial Sequence: Synthetic oligonucleotide
ggcagatggcggcccaagcagc

SEQ ID NO: 333260 - DNA, 23 bp, Artificial Sequence
  Description of Artificial Sequence: Synthetic oligonucleotide
gcagatggcggcccaagcagcca

SEQ ID NO: 333261 - DNA, 24 bp, Artificial Sequence
  Description of Artificial Sequence: Synthetic oligonucleotide
cagatggcggcccaagcagccaca

SEQ ID NO: 333262 - DNA, 25 bp, Artificial Sequence
  Description of Artificial Sequence: Synthetic oligonucleotide
agatggcggcccaagcagccacact

SEQ ID NO: 333263 - DNA, 24 bp, Artificial Sequence
  Description of Artificial Sequence: Synthetic oligonucleotide
gatggcggcccaagcagccacact

SEQ ID NO: 333264 - DNA, 24 bp, Artificial Sequence
  Description of Artificial Sequence: Synthetic oligonucleotide
atggcggcccaagcagccacactg

SEQ ID NO: 333265 - DNA, 23 bp, Artificial Sequence
  Description of Artificial Sequence: Synthetic oligonucleotide
tggcggcccaagcagccacactg

SEQ ID NO: 333266 - DNA, 22 bp, Artificial Sequence
  Description of Artificial Sequence: Synthetic oligonucleotide
ggcggcccaagcagccacactg

SEQ ID NO: 333267 - DNA, 23 bp, Artificial Sequence
  Description of Artificial Sequence: Synthetic oligonucleotide
gcggcccaagcagccacactggt

SEQ ID NO: 333268 - DNA, 23 bp, Artificial Sequence
  Description of Artificial Sequence: Synthetic oligonucleotide
cggcccaagcagccacactggtc

SEQ ID NO: 333269 - DNA, 24 bp, Artificial Sequence
  Description of Artificial Sequence: Synthetic oligonucleotide
ggcccaagcagccacactggtcca

SEQ ID NO: 333270 - DNA, 24 bp, Artificial Sequence
  Description of Artificial Sequence: Synthetic oligonucleotide
gcccaagcagccacactggtccag

SEQ ID NO: 333271 - DNA, 24 bp, Artificial Sequence
  Description of Artificial Sequence: Synthetic oligonucleotide
cccaagcagccacactggtccagg

SEQ ID NO: 333272 - DNA, 25 bp, Artificial Sequence
  Description of Artificial Sequence: Synthetic oligonucleotide
ccaagcagccacactggtccagggt

SEQ ID NO: 333273 - DNA, 26 bp, Artificial Sequence
  Description of Artificial Sequence: Synthetic oligonucleotide
caagcagccacactggtccagggtga

SEQ ID NO: 333274 - DNA, 27 bp, Artificial Sequence
  Description of Artificial Sequence: Synthetic oligonucleotide
aagcagccacactggtccagggtgagt

SEQ ID NO: 333275 - DNA, 26 bp, Artificial Sequence
  Description of Artificial Sequence: Synthetic oligonucleotide
agcagccacactggtccagggtgagt

SEQ ID NO: 333276 - DNA, 25 bp, Artificial Sequence
  Description of Artificial Sequence: Synthetic oligonucleotide
gcagccacactggtccagggtgagt

SEQ ID NO: 333277 - DNA, 26 bp, Artificial Sequence
  Description of Artificial Sequence: Synthetic oligonucleotide
cagccacactggtccagggtgagtca

SEQ ID NO: 333278 - DNA, 26 bp, Artificial Sequence
  Description of Artificial Sequence: Synthetic oligonucleotide
agccacactggtccagggtgagtcag

SEQ ID NO: 333279 - DNA, 25 bp, Artificial Sequence
  Description of Artificial Sequence: Synthetic oligonucleotide
gccacactggtccagggtgagtcag

SEQ ID NO: 333280 - DNA, 25 bp, Artificial Sequence
  Description of Artificial Sequence: Synthetic oligonucleotide
ccacactggtccagggtgagtcagc

SEQ ID NO: 333281 - DNA, 25 bp, Artificial Sequence
  Description of Artificial Sequence: Synthetic oligonucleotide
cacactggtccagggtgagtcagcc

SEQ ID NO: 333282 - DNA, 25 bp, Artificial Sequence
  Description of Artificial Sequence: Synthetic oligonucleotide
acactggtccagggtgagtcagccg

SEQ ID NO: 333283 - DNA, 24 bp, Artificial Sequence
  Description of Artificial Sequence: Synthetic oligonucleotide
cactggtccagggtgagtcagccg

SEQ ID NO: 333284 - DNA, 24 bp, Artificial Sequence
  Description of Artificial Sequence: Synthetic oligonucleotide
actggtccagggtgagtcagccgc

SEQ ID NO: 333285 - DNA, 23 bp, Artificial Sequence
  Description of Artificial Sequence: Synthetic oligonucleotide
ctggtccagggtgagtcagccgc

SEQ ID NO: 333286 - DNA, 24 bp, Artificial Sequence
  Description of Artificial Sequence: Synthetic oligonucleotide
tggtccagggtgagtcagccgcgt

SEQ ID NO: 333287 - DNA, 23 bp, Artificial Sequence
  Description of Artificial Sequence: Synthetic oligonucleotide
ggtccagggtgagtcagccgcgt

SEQ ID NO: 333288 - DNA, 23 bp, Artificial Sequence
  Description of Artificial Sequence: Synthetic oligonucleotide
gtccagggtgagtcagccgcgtc

SEQ ID NO: 333289 - DNA, 24 bp, Artificial Sequence
  Description of Artificial Sequence: Synthetic oligonucleotide
tccagggtgagtcagccgcgtcca

SEQ ID NO: 333290 - DNA, 23 bp, Artificial Sequence
  Description of Artificial Sequence: Synthetic oligonucleotide
ccagggtgagtcagccgcgtcca

SEQ ID NO: 333291 - DNA, 27 bp, Artificial Sequence
  Description of Artificial Sequence: Synthetic oligonucleotide
cagggtgagtcagccgcgtccagaaat

SEQ ID NO: 333292 - DNA, 27 bp, Artificial Sequence
  Description of Artificial Sequence: Synthetic oligonucleotide
agggtgagtcagccgcgtccagaaatg

SEQ ID NO: 333293 - DNA, 26 bp, Artificial Sequence
  Description of Artificial Sequence: Synthetic oligonucleotide
gggtgagtcagccgcgtccagaaatg

SEQ ID NO: 333294 - DNA, 27 bp, Artificial Sequence
  Description of Artificial Sequence: Synthetic oligonucleotide
ggtgagtcagccgcgtccagaaatgct

SEQ ID NO: 333295 - DNA, 27 bp, Artificial Sequence
  Description of Artificial Sequence: Synthetic oligonucleotide
gtgagtcagccgcgtccagaaatgctg

SEQ ID NO: 333296 - DNA, 27 bp, Artificial Sequence
  Description of Artificial Sequence: Synthetic oligonucleotide
tgagtcagccgcgtccagaaatgctgc

SEQ ID NO: 333297 - DNA, 27 bp, Artificial Sequence
  Description of Artificial Sequence: Synthetic oligonucleotide
gagtcagccgcgtccagaaatgctgca

SEQ ID NO: 333298 - DNA, 28 bp, Artificial Sequence
  Description of Artificial Sequence: Synthetic oligonucleotide
agtcagccgcgtccagaaatgctgcatg

SEQ ID NO: 333299 - DNA, 27 bp, Artificial Sequence
  Description of Artificial Sequence: Synthetic oligonucleotide
gtcagccgcgtccagaaatgctgcatg

SEQ ID NO: 333300 - DNA, 27 bp, Artificial Sequence
  Description of Artificial Sequence: Synthetic oligonucleotide
tcagccgcgtccagaaatgctgcatgg

SEQ ID NO: 333301 - DNA, 27 bp, Artificial Sequence
  Description of Artificial Sequence: Synthetic oligonucleotide
cagccgcgtccagaaatgctgcatggt

SEQ ID NO: 333302 - DNA, 27 bp, Artificial Sequence
  Description of Artificial Sequence: Synthetic oligonucleotide
agccgcgtccagaaatgctgcatggtc

SEQ ID NO: 333303 - DNA, 27 bp, Artificial Sequence
  Description of Artificial Sequence: Synthetic oligonucleotide
gccgcgtccagaaatgctgcatggtca

SEQ ID NO: 333304 - DNA, 27 bp, Artificial Sequence
  Description of Artificial Sequence: Synthetic oligonucleotide
ccgcgtccagaaatgctgcatggtcag

SEQ ID NO: 333305 - DNA, 27 bp, Artificial Sequence
  Description of Artificial Sequence: Synthetic oligonucleotide
cgcgtccagaaatgctgcatggtcagc

SEQ ID NO: 333306 - DNA, 30 bp, Artificial Sequence
  Description of Artificial Sequence: Synthetic oligonucleotide
gcgtccagaaatgctgcatggtcagcatac

SEQ ID NO: 333307 - DNA, 30 bp, Artificial Sequence
  Description of Artificial Sequence: Synthetic oligonucleotide
cgtccagaaatgctgcatggtcagcatacc

SEQ ID NO: 333308 - DNA, 30 bp, Artificial Sequence
  Description of Artificial Sequence: Synthetic oligonucleotide
gtccagaaatgctgcatggtcagcataccc

SEQ ID NO: 333309 - DNA, 33 bp, Artificial Sequence
  Description of Artificial Sequence: Synthetic oligonucleotide
tccagaaatgctgcatggtcagcatacccaaag

SEQ ID NO: 333310 - DNA, 32 bp, Artificial Sequence
  Description of Artificial Sequence: Synthetic oligonucleotide
ccagaaatgctgcatggtcagcatacccaaag

SEQ ID NO: 333311 - DNA, 32 bp, Artificial Sequence
  Description of Artificial Sequence: Synthetic oligonucleotide
cagaaatgctgcatggtcagcatacccaaagc

SEQ ID NO: 333312 - DNA, 32 bp, Artificial Sequence
  Description of Artificial Sequence: Synthetic oligonucleotide
agaaatgctgcatggtcagcatacccaaagcc

SEQ ID NO: 333313 - DNA, 31 bp, Artificial Sequence
  Description of Artificial Sequence: Synthetic oligonucleotide
gaaatgctgcatggtcagcatacccaaagcc

SEQ ID NO: 333314 - DNA, 33 bp, Artificial Sequence
  Description of Artificial Sequence: Synthetic oligonucleotide
aaatgctgcatggtcagcatacccaaagccatc

SEQ ID NO: 333315 - DNA, 32 bp, Artificial Sequence
  Description of Artificial Sequence: Synthetic oligonucleotide
aatgctgcatggtcagcatacccaaagccatc

SEQ ID NO: 333316 - DNA, 31 bp, Artificial Sequence
  Description of Artificial Sequence: Synthetic oligonucleotide
atgctgcatggtcagcatacccaaagccatc

SEQ ID NO: 333317 - DNA, 30 bp, Artificial Sequence
  Description of Artificial Sequence: Synthetic oligonucleotide
tgctgcatggtcagcatacccaaagccatc

SEQ ID NO: 333318 - DNA, 29 bp, Artificial Sequence
  Description of Artificial Sequence: Synthetic oligonucleotide
gctgcatggtcagcatacccaaagccatc

SEQ ID NO: 333319 - DNA, 30 bp, Artificial Sequence
  Description of Artificial Sequence: Synthetic oligonucleotide
ctgcatggtcagcatacccaaagccatcac

SEQ ID NO: 333320 - DNA, 30 bp, Artificial Sequence
  Description of Artificial Sequence: Synthetic oligonucleotide
tgcatggtcagcatacccaaagccatcacg

SEQ ID NO: 333321 - DNA, 29 bp, Artificial Sequence
  Description of Artificial Sequence: Synthetic oligonucleotide
gcatggtcagcatacccaaagccatcacg

SEQ ID NO: 333322 - DNA, 30 bp, Artificial Sequence
  Description of Artificial Sequence: Synthetic oligonucleotide
catggtcagcatacccaaagccatcacgac

SEQ ID NO: 333323 - DNA, 32 bp, Artificial Sequence
  Description of Artificial Sequence: Synthetic oligonucleotide
atggtcagcatacccaaagccatcacgacaac

SEQ ID NO: 333324 - DNA, 31 bp, Artificial Sequence
  Description of Artificial Sequence: Synthetic oligonucleotide
tggtcagcatacccaaagccatcacgacaac

SEQ ID NO: 333325 - DNA, 30 bp, Artificial Sequence
  Description of Artificial Sequence: Synthetic oligonucleotide
ggtcagcatacccaaagccatcacgacaac

SEQ ID NO: 333326 - DNA, 34 bp, Artificial Sequence
  Description of Artificial Sequence: Synthetic oligonucleotide
gtcagcatacccaaagccatcacgacaactttac

SEQ ID NO: 333327 - DNA, 35 bp, Artificial Sequence
  Description of Artificial Sequence: Synthetic oligonucleotide
tcagcatacccaaagccatcacgacaactttacac

SEQ ID NO: 333328 - DNA, 34 bp, Artificial Sequence
  Description of Artificial Sequence: Synthetic oligonucleotide
cagcatacccaaagccatcacgacaactttacac

SEQ ID NO: 333329 - DNA, 34 bp, Artificial Sequence
  Description of Artificial Sequence: Synthetic oligonucleotide
agcatacccaaagccatcacgacaactttacacc

SEQ ID NO: 333330 - DNA, 33 bp, Artificial Sequence
  Description of Artificial Sequence: Synthetic oligonucleotide
gcatacccaaagccatcacgacaactttacacc

SEQ ID NO: 333331 - DNA, 34 bp, Artificial Sequence
  Description of Artificial Sequence: Synthetic oligonucleotide
catacccaaagccatcacgacaactttacacctg

SEQ ID NO: 333332 - DNA, 34 bp, Artificial Sequence
  Description of Artificial Sequence: Synthetic oligonucleotide
atacccaaagccatcacgacaactttacacctgg

SEQ ID NO: 333333 - DNA, 33 bp, Artificial Sequence
  Description of Artificial Sequence: Synthetic oligonucleotide
tacccaaagccatcacgacaactttacacctgg

SEQ ID NO: 333334 - DNA, 32 bp, Artificial Sequence
  Description of Artificial Sequence: Synthetic oligonucleotide
acccaaagccatcacgacaactttacacctgg

SEQ ID NO: 333335 - DNA, 31 bp, Artificial Sequence
  Description of Artificial Sequence: Synthetic oligonucleotide
cccaaagccatcacgacaactttacacctgg

SEQ ID NO: 333336 - DNA, 31 bp, Artificial Sequence
  Description of Artificial Sequence: Synthetic oligonucleotide
ccaaagccatcacgacaactttacacctggg

SEQ ID NO: 333337 - DNA, 31 bp, Artificial Sequence
  Description of Artificial Sequence: Synthetic oligonucleotide
caaagccatcacgacaactttacacctgggc

SEQ ID NO: 333338 - DNA, 32 bp, Artificial Sequence
  Description of Artificial Sequence: Synthetic oligonucleotide
aaagccatcacgacaactttacacctgggctg

SEQ ID NO: 333339 - DNA, 31 bp, Artificial Sequence
  Description of Artificial Sequence: Synthetic oligonucleotide
aagccatcacgacaactttacacctgggctg

SEQ ID NO: 333340 - DNA, 30 bp, Artificial Sequence
  Description of Artificial Sequence: Synthetic oligonucleotide
agccatcacgacaactttacacctgggctg

SEQ ID NO: 333341 - DNA, 29 bp, Artificial Sequence
  Description of Artificial Sequence: Synthetic oligonucleotide
gccatcacgacaactttacacctgggctg

SEQ ID NO: 333342 - DNA, 29 bp, Artificial Sequence
  Description of Artificial Sequence: Synthetic oligonucleotide
ccatcacgacaactttacacctgggctgg

SEQ ID NO: 333343 - DNA, 31 bp, Artificial Sequence
  Description of Artificial Sequence: Synthetic oligonucleotide
catcacgacaactttacacctgggctggaag

SEQ ID NO: 333344 - DNA, 32 bp, Artificial Sequence
  Description of Artificial Sequence: Synthetic oligonucleotide
atcacgacaactttacacctgggctggaagtg

SEQ ID NO: 333345 - DNA, 31 bp, Artificial Sequence
  Description of Artificial Sequence: Synthetic oligonucleotide
tcacgacaactttacacctgggctggaagtg

SEQ ID NO: 333346 - DNA, 30 bp, Artificial Sequence
  Description of Artificial Sequence: Synthetic oligonucleotide
cacgacaactttacacctgggctggaagtg

SEQ ID NO: 333347 - DNA, 29 bp, Artificial Sequence
  Description of Artificial Sequence: Synthetic oligonucleotide
ctggaagtgttgtacagctgtcagcccag

SEQ ID NO: 333348 - DNA, 29 bp, Artificial Sequence
  Description of Artificial Sequence: Synthetic oligonucleotide
tggaagtgttgtacagctgtcagcccagc

SEQ ID NO: 333349 - DNA, 28 bp, Artificial Sequence
  Description of Artificial Sequence: Synthetic oligonucleotide
ggaagtgttgtacagctgtcagcccagc

SEQ ID NO: 333350 - DNA, 31 bp, Artificial Sequence
  Description of Artificial Sequence: Synthetic oligonucleotide
gaagtgttgtacagctgtcagcccagctttg

SEQ ID NO: 333351 - DNA, 32 bp, Artificial Sequence
  Description of Artificial Sequence: Synthetic oligonucleotide
aagtgttgtacagctgtcagcccagctttgac

SEQ ID NO: 333352 - DNA, 31 bp, Artificial Sequence
  Description of Artificial Sequence: Synthetic oligonucleotide
agtgttgtacagctgtcagcccagctttgac

SEQ ID NO: 333353 - DNA, 30 bp, Artificial Sequence
  Description of Artificial Sequence: Synthetic oligonucleotide
gtgttgtacagctgtcagcccagctttgac

SEQ ID NO: 333354 - DNA, 30 bp, Artificial Sequence
  Description of Artificial Sequence: Synthetic oligonucleotide
tgttgtacagctgtcagcccagctttgacc

SEQ ID NO: 333355 - DNA, 29 bp, Artificial Sequence
  Description of Artificial Sequence: Synthetic oligonucleotide
gttgtacagctgtcagcccagctttgacc

SEQ ID NO: 333356 - DNA, 30 bp, Artificial Sequence
  Description of Artificial Sequence: Synthetic oligonucleotide
ttgtacagctgtcagcccagctttgacctc

SEQ ID NO: 333357 - DNA, 29 bp, Artificial Sequence
  Description of Artificial Sequence: Synthetic oligonucleotide
tgtacagctgtcagcccagctttgacctc

SEQ ID NO: 333358 - DNA, 28 bp, Artificial Sequence
  Description of Artificial Sequence: Synthetic oligonucleotide
gtacagctgtcagcccagctttgacctc

SEQ ID NO: 333359 - DNA, 29 bp, Artificial Sequence
  Description of Artificial Sequence: Synthetic oligonucleotide
tacagctgtcagcccagctttgacctcag

SEQ ID NO: 333360 - DNA, 28 bp, Artificial Sequence
  Description of Artificial Sequence: Synthetic oligonucleotide
acagctgtcagcccagctttgacctcag

SEQ ID NO: 333361 - DNA, 27 bp, Artificial Sequence
  Description of Artificial Sequence: Synthetic oligonucleotide
cagctgtcagcccagctttgacctcag

SEQ ID NO: 333362 - DNA, 28 bp, Artificial Sequence
  Description of Artificial Sequence: Synthetic oligonucleotide
agctgtcagcccagctttgacctcagtg

SEQ ID NO: 333363 - DNA, 27 bp, Artificial Sequence
  Description of Artificial Sequence: Synthetic oligonucleotide
gctgtcagcccagctttgacctcagtg

SEQ ID NO: 333364 - DNA, 27 bp, Artificial Sequence
  Description of Artificial Sequence: Synthetic oligonucleotide
ctgtcagcccagctttgacctcagtgg

SEQ ID NO: 333365 - DNA, 27 bp, Artificial Sequence
  Description of Artificial Sequence: Synthetic oligonucleotide
tgtcagcccagctttgacctcagtggg

SEQ ID NO: 333366 - DNA, 26 bp, Artificial Sequence
  Description of Artificial Sequence: Synthetic oligonucleotide
gtcagcccagctttgacctcagtggg

SEQ ID NO: 333367 - DNA, 26 bp, Artificial Sequence
  Description of Artificial Sequence: Synthetic oligonucleotide
tcagcccagctttgacctcagtgggg

SEQ ID NO: 333368 - DNA, 25 bp, Artificial Sequence
  Description of Artificial Sequence: Synthetic oligonucleotide
cagcccagctttgacctcagtgggg

SEQ ID NO: 333369 - DNA, 26 bp, Artificial Sequence
  Description of Artificial Sequence: Synthetic oligonucleotide
agcccagctttgacctcagtggggct

SEQ ID NO: 333370 - DNA, 25 bp, Artificial Sequence
  Description of Artificial Sequence: Synthetic oligonucleotide
gcccagctttgacctcagtggggct

SEQ ID NO: 333371 - DNA, 25 bp, Artificial Sequence
  Description of Artificial Sequence: Synthetic oligonucleotide
cccagctttgacctcagtggggctg

SEQ ID NO: 333372 - DNA, 25 bp, Artificial Sequence
  Description of Artificial Sequence: Synthetic oligonucleotide
ccagctttgacctcagtggggctgc

SEQ ID NO: 333373 - DNA, 26 bp, Artificial Sequence
  Description of Artificial Sequence: Synthetic oligonucleotide
cagctttgacctcagtggggctgcga

SEQ ID NO: 333374 - DNA, 27 bp, Artificial Sequence
  Description of Artificial Sequence: Synthetic oligonucleotide
agctttgacctcagtggggctgcgact

SEQ ID NO: 333375 - DNA, 26 bp, Artificial Sequence
  Description of Artificial Sequence: Synthetic oligonucleotide
gctttgacctcagtggggctgcgact

SEQ ID NO: 333376 - DNA, 27 bp, Artificial Sequence
  Description of Artificial Sequence: Synthetic oligonucleotide
ctttgacctcagtggggctgcgactct

SEQ ID NO: 333377 - DNA, 27 bp, Artificial Sequence
  Description of Artificial Sequence: Synthetic oligonucleotide
tttgacctcagtggggctgcgactctg

SEQ ID NO: 333378 - DNA, 26 bp, Artificial Sequence
  Description of Artificial Sequence: Synthetic oligonucleotide
ttgacctcagtggggctgcgactctg

SEQ ID NO: 333379 - DNA, 25 bp, Artificial Sequence
  Description of Artificial Sequence: Synthetic oligonucleotide
tgacctcagtggggctgcgactctg

SEQ ID NO: 333380 - DNA, 24 bp, Artificial Sequence
  Description of Artificial Sequence: Synthetic oligonucleotide
gacctcagtggggctgcgactctg

SEQ ID NO: 333381 - DNA, 25 bp, Artificial Sequence
  Description of Artificial Sequence: Synthetic oligonucleotide
acctcagtggggctgcgactctgca

SEQ ID NO: 333382 - DNA, 24 bp, Artificial Sequence
  Description of Artificial Sequence: Synthetic oligonucleotide
cctcagtggggctgcgactctgca

SEQ ID NO: 333383 - DNA, 25 bp, Artificial Sequence
  Description of Artificial Sequence: Synthetic oligonucleotide
ctcagtggggctgcgactctgcact

SEQ ID NO: 333384 - DNA, 25 bp, Artificial Sequence
  Description of Artificial Sequence: Synthetic oligonucleotide
tcagtggggctgcgactctgcactc

SEQ ID NO: 333385 - DNA, 24 bp, Artificial Sequence
  Description of Artificial Sequence: Synthetic oligonucleotide
cagtggggctgcgactctgcactc

SEQ ID NO: 333386 - DNA, 25 bp, Artificial Sequence
  Description of Artificial Sequence: Synthetic oligonucleotide
agtggggctgcgactctgcactcca

SEQ ID NO: 333387 - DNA, 24 bp, Artificial Sequence
  Description of Artificial Sequence: Synthetic oligonucleotide
gtggggctgcgactctgcactcca

SEQ ID NO: 333388 - DNA, 24 bp, Artificial Sequence
  Description of Artificial Sequence: Synthetic oligonucleotide
tggggctgcgactctgcactccac

SEQ ID NO: 333389 - DNA, 23 bp, Artificial Sequence
  Description of Artificial Sequence: Synthetic oligonucleotide
ggggctgcgactctgcactccac

SEQ ID NO: 333390 - DNA, 23 bp, Artificial Sequence
  Description of Artificial Sequence: Synthetic oligonucleotide
gggctgcgactctgcactccacg

SEQ ID NO: 333391 - DNA, 23 bp, Artificial Sequence
  Description of Artificial Sequence: Synthetic oligonucleotide
ggctgcgactctgcactccacgc

SEQ ID NO: 333392 - DNA, 23 bp, Artificial Sequence
  Description of Artificial Sequence: Synthetic oligonucleotide
gctgcgactctgcactccacgcc

SEQ ID NO: 333393 - DNA, 23 bp, Artificial Sequence
  Description of Artificial Sequence: Synthetic oligonucleotide
ctgcgactctgcactccacgccc

SEQ ID NO: 333394 - DNA, 24 bp, Artificial Sequence
  Description of Artificial Sequence: Synthetic oligonucleotide
tgcgactctgcactccacgcccca

SEQ ID NO: 333395 - DNA, 23 bp, Artificial Sequence
  Description of Artificial Sequence: Synthetic oligonucleotide
gcgactctgcactccacgcccca

SEQ ID NO: 333396 - DNA, 23 bp, Artificial Sequence
  Description of Artificial Sequence: Synthetic oligonucleotide
cgactctgcactccacgccccac

SEQ ID NO: 333397 - DNA, 23 bp, Artificial Sequence
  Description of Artificial Sequence: Synthetic oligonucleotide
gactctgcactccacgccccacg

SEQ ID NO: 333398 - DNA, 24 bp, Artificial Sequence
  Description of Artificial Sequence: Synthetic oligonucleotide
actctgcactccacgccccacgga

SEQ ID NO: 333399 - DNA, 23 bp, Artificial Sequence
  Description of Artificial Sequence: Synthetic oligonucleotide
ctctgcactccacgccccacgga

SEQ ID NO: 333400 - DNA, 24 bp, Artificial Sequence
  Description of Artificial Sequence: Synthetic oligonucleotide
tctgcactccacgccccacggaga

SEQ ID NO: 333401 - DNA, 23 bp, Artificial Sequence
  Description of Artificial Sequence: Synthetic oligonucleotide
ctgcactccacgccccacggaga

SEQ ID NO: 333402 - DNA, 24 bp, Artificial Sequence
  Description of Artificial Sequence: Synthetic oligonucleotide
tgcactccacgccccacggagact

SEQ ID NO: 333403 - DNA, 23 bp, Artificial Sequence
  Description of Artificial Sequence: Synthetic oligonucleotide
gcactccacgccccacggagact

SEQ ID NO: 333404 - DNA, 23 bp, Artificial Sequence
  Description of Artificial Sequence: Synthetic oligonucleotide
cactccacgccccacggagactg

SEQ ID NO: 333405 - DNA, 24 bp, Artificial Sequence
  Description of Artificial Sequence: Synthetic oligonucleotide
actccacgccccacggagactggt

SEQ ID NO: 333406 - DNA, 23 bp, Artificial Sequence
  Description of Artificial Sequence: Synthetic oligonucleotide
ctccacgccccacggagactggt

SEQ ID NO: 333407 - DNA, 23 bp, Artificial Sequence
  Description of Artificial Sequence: Synthetic oligonucleotide
tccacgccccacggagactggtg

SEQ ID NO: 333408 - DNA, 22 bp, Artificial Sequence
  Description of Artificial Sequence: Synthetic oligonucleotide
ccacgccccacggagactggtg

SEQ ID NO: 333409 - DNA, 22 bp, Artificial Sequence
  Description of Artificial Sequence: Synthetic oligonucleotide
cacgccccacggagactggtgc

SEQ ID NO: 333410 - DNA, 22 bp, Artificial Sequence
  Description of Artificial Sequence: Synthetic oligonucleotide
acgccccacggagactggtgcc

SEQ ID NO: 333411 - DNA, 21 bp, Artificial Sequence
  Description of Artificial Sequence: Synthetic oligonucleotide
cgccccacggagactggtgcc

SEQ ID NO: 333412 - DNA, 22 bp, Artificial Sequence
  Description of Artificial Sequence: Synthetic oligonucleotide
gccccacggagactggtgccct

SEQ ID NO: 333413 - DNA, 24 bp, Artificial Sequence
  Description of Artificial Sequence: Synthetic oligonucleotide
ccccacggagactggtgccctgaa

SEQ ID NO: 333414 - DNA, 24 bp, Artificial Sequence
  Description of Artificial Sequence: Synthetic oligonucleotide
cccacggagactggtgccctgaag

SEQ ID NO: 333415 - DNA, 24 bp, Artificial Sequence
  Description of Artificial Sequence: Synthetic oligonucleotide
ccacggagactggtgccctgaagg

SEQ ID NO: 333416 - DNA, 24 bp, Artificial Sequence
  Description of Artificial Sequence: Synthetic oligonucleotide
cacggagactggtgccctgaaggc

SEQ ID NO: 333417 - DNA, 24 bp, Artificial Sequence
  Description of Artificial Sequence: Synthetic oligonucleotide
acggagactggtgccctgaaggcc

SEQ ID NO: 333418 - DNA, 23 bp, Artificial Sequence
  Description of Artificial Sequence: Synthetic oligonucleotide
cggagactggtgccctgaaggcc

SEQ ID NO: 333419 - DNA, 25 bp, Artificial Sequence
  Description of Artificial Sequence: Synthetic oligonucleotide
ggagactggtgccctgaaggcccta

SEQ ID NO: 333420 - DNA, 27 bp, Artificial Sequence
  Description of Artificial Sequence: Synthetic oligonucleotide
gagactggtgccctgaaggccctagat

SEQ ID NO: 333421 - DNA, 27 bp, Artificial Sequence
  Description of Artificial Sequence: Synthetic oligonucleotide
agactggtgccctgaaggccctagatg

SEQ ID NO: 333422 - DNA, 27 bp, Artificial Sequence
  Description of Artificial Sequence: Synthetic oligonucleotide
gactggtgccctgaaggccctagatga

SEQ ID NO: 333423 - DNA, 28 bp, Artificial Sequence
  Description of Artificial Sequence: Synthetic oligonucleotide
actggtgccctgaaggccctagatgaac

SEQ ID NO: 333424 - DNA, 27 bp, Artificial Sequence
  Description of Artificial Sequence: Synthetic oligonucleotide
ctggtgccctgaaggccctagatgaac

SEQ ID NO: 333425 - DNA, 28 bp, Artificial Sequence
  Description of Artificial Sequence: Synthetic oligonucleotide
tggtgccctgaaggccctagatgaacag

SEQ ID NO: 333426 - DNA, 27 bp, Artificial Sequence
  Description of Artificial Sequence: Synthetic oligonucleotide
ggtgccctgaaggccctagatgaacag

SEQ ID NO: 333427 - DNA, 28 bp, Artificial Sequence
  Description of Artificial Sequence: Synthetic oligonucleotide
gtgccctgaaggccctagatgaacagtg

SEQ ID NO: 333428 - DNA, 32 bp, Artificial Sequence
  Description of Artificial Sequence: Synthetic oligonucleotide
tgccctgaaggccctagatgaacagtgaaaac

SEQ ID NO: 333429 - DNA, 31 bp, Artificial Sequence
  Description of Artificial Sequence: Synthetic oligonucleotide
gccctgaaggccctagatgaacagtgaaaac

SEQ ID NO: 333430 - DNA, 31 bp, Artificial Sequence
  Description of Artificial Sequence: Synthetic oligonucleotide
ccctgaaggccctagatgaacagtgaaaacc

SEQ ID NO: 333431 - DNA, 32 bp, Artificial Sequence
  Description of Artificial Sequence: Synthetic oligonucleotide
cctgaaggccctagatgaacagtgaaaacctg

SEQ ID NO: 333432 - DNA, 33 bp, Artificial Sequence
  Description of Artificial Sequence: Synthetic oligonucleotide
ctgaaggccctagatgaacagtgaaaacctgtg

SEQ ID NO: 333433 - DNA, 35 bp, Artificial Sequence
  Description of Artificial Sequence: Synthetic oligonucleotide
tgaaggccctagatgaacagtgaaaacctgtgatg

SEQ ID NO: 333434 - DNA, 34 bp, Artificial Sequence
  Description of Artificial Sequence: Synthetic oligonucleotide
gaaggccctagatgaacagtgaaaacctgtgatg

SEQ ID NO: 333435 - DNA, 35 bp, Artificial Sequence
  Description of Artificial Sequence: Synthetic oligonucleotide
aaggccctagatgaacagtgaaaacctgtgatgtc

SEQ ID NO: 333436 - DNA, 34 bp, Artificial Sequence
  Description of Artificial Sequence: Synthetic oligonucleotide
aggccctagatgaacagtgaaaacctgtgatgtc

SEQ ID NO: 333437 - DNA, 33 bp, Artificial Sequence
  Description of Artificial Sequence: Synthetic oligonucleotide
ggccctagatgaacagtgaaaacctgtgatgtc

SEQ ID NO: 333438 - DNA, 35 bp, Artificial Sequence
  Description of Artificial Sequence: Synthetic oligonucleotide
gccctagatgaacagtgaaaacctgtgatgtcttc

SEQ ID NO: 333439 - DNA, 35 bp, Artificial Sequence
  Description of Artificial Sequence: Synthetic oligonucleotide
ccctagatgaacagtgaaaacctgtgatgtcttcc

SEQ ID NO: 333440 - DNA, 36 bp, Artificial Sequence
  Description of Artificial Sequence: Synthetic oligonucleotide
cctagatgaacagtgaaaacctgtgatgtcttcctg

SEQ ID NO: 333441 - DNA, 36 bp, Artificial Sequence
  Description of Artificial Sequence: Synthetic oligonucleotide
ctagatgaacagtgaaaacctgtgatgtcttcctgg

SEQ ID NO: 333442 - DNA, 36 bp, Artificial Sequence
  Description of Artificial Sequence: Synthetic oligonucleotide
tagatgaacagtgaaaacctgtgatgtcttcctggg

SEQ ID NO: 333443 - DNA, 35 bp, Artificial Sequence
  Description of Artificial Sequence: Synthetic oligonucleotide
agatgaacagtgaaaacctgtgatgtcttcctggg

SEQ ID NO: 333444 - DNA, 34 bp, Artificial Sequence
  Description of Artificial Sequence: Synthetic oligonucleotide
gatgaacagtgaaaacctgtgatgtcttcctggg

SEQ ID NO: 333445 - DNA, 34 bp, Artificial Sequence
  Description of Artificial Sequence: Synthetic oligonucleotide
atgaacagtgaaaacctgtgatgtcttcctgggg

SEQ ID NO: 333446 - DNA, 33 bp, Artificial Sequence
  Description of Artificial Sequence: Synthetic oligonucleotide
tgaacagtgaaaacctgtgatgtcttcctgggg

SEQ ID NO: 333447 - DNA, 32 bp, Artificial Sequence
  Description of Artificial Sequence: Synthetic oligonucleotide
gaacagtgaaaacctgtgatgtcttcctgggg

SEQ ID NO: 333448 - DNA, 32 bp, Artificial Sequence
  Description of Artificial Sequence: Synthetic oligonucleotide
aacagtgaaaacctgtgatgtcttcctggggc

SEQ ID NO: 333449 - DNA, 31 bp, Artificial Sequence
  Description of Artificial Sequence: Synthetic oligonucleotide
acagtgaaaacctgtgatgtcttcctggggc

SEQ ID NO: 333450 - DNA, 30 bp, Artificial Sequence
  Description of Artificial Sequence: Synthetic oligonucleotide
cagtgaaaacctgtgatgtcttcctggggc

SEQ ID NO: 333451 - DNA, 32 bp, Artificial Sequence
  Description of Artificial Sequence: Synthetic oligonucleotide
agtgaaaacctgtgatgtcttcctggggcaac

SEQ ID NO: 333452 - DNA, 31 bp, Artificial Sequence
  Description of Artificial Sequence: Synthetic oligonucleotide
gtgaaaacctgtgatgtcttcctggggcaac

SEQ ID NO: 333453 - DNA, 32 bp, Artificial Sequence
  Description of Artificial Sequence: Synthetic oligonucleotide
tgaaaacctgtgatgtcttcctggggcaactc

SEQ ID NO: 333454 - DNA, 31 bp, Artificial Sequence
  Description of Artificial Sequence: Synthetic oligonucleotide
gaaaacctgtgatgtcttcctggggcaactc

SEQ ID NO: 333455 - DNA, 31 bp, Artificial Sequence
  Description of Artificial Sequence: Synthetic oligonucleotide
aaaacctgtgatgtcttcctggggcaactcc

SEQ ID NO: 333456 - DNA, 30 bp, Artificial Sequence
  Description of Artificial Sequence: Synthetic oligonucleotide
aaacctgtgatgtcttcctggggcaactcc

SEQ ID NO: 333457 - DNA, 29 bp, Artificial Sequence
  Description of Artificial Sequence: Synthetic oligonucleotide
aacctgtgatgtcttcctggggcaactcc

SEQ ID NO: 333458 - DNA, 28 bp, Artificial Sequence
  Description of Artificial Sequence: Synthetic oligonucleotide
acctgtgatgtcttcctggggcaactcc

SEQ ID NO: 333459 - DNA, 27 bp, Artificial Sequence
  Description of Artificial Sequence: Synthetic oligonucleotide
cctgtgatgtcttcctggggcaactcc

SEQ ID NO: 333460 - DNA, 27 bp, Artificial Sequence
  Description of Artificial Sequence: Synthetic oligonucleotide
ctgtgatgtcttcctggggcaactccc

SEQ ID NO: 333461 - DNA, 28 bp, Artificial Sequence
  Description of Artificial Sequence: Synthetic oligonucleotide
tgtgatgtcttcctggggcaactccctg

SEQ ID NO: 333462 - DNA, 27 bp, Artificial Sequence
  Description of Artificial Sequence: Synthetic oligonucleotide
gtgatgtcttcctggggcaactccctg

SEQ ID NO: 333463 - DNA, 29 bp, Artificial Sequence
  Description of Artificial Sequence: Synthetic oligonucleotide
tgatgtcttcctggggcaactccctgatg

SEQ ID NO: 333464 - DNA, 28 bp, Artificial Sequence
  Description of Artificial Sequence: Synthetic oligonucleotide
gatgtcttcctggggcaactccctgatg

SEQ ID NO: 333465 - DNA, 28 bp, Artificial Sequence
  Description of Artificial Sequence: Synthetic oligonucleotide
atgtcttcctggggcaactccctgatgg

SEQ ID NO: 333466 - DNA, 27 bp, Artificial Sequence
  Description of Artificial Sequence: Synthetic oligonucleotide
tgtcttcctggggcaactccctgatgg

SEQ ID NO: 333467 - DNA, 26 bp, Artificial Sequence
  Description of Artificial Sequence: Synthetic oligonucleotide
gtcttcctggggcaactccctgatgg

SEQ ID NO: 333468 - DNA, 26 bp, Artificial Sequence
  Description of Artificial Sequence: Synthetic oligonucleotide
tcttcctggggcaactccctgatggc

SEQ ID NO: 333469 - DNA, 25 bp, Artificial Sequence
  Description of Artificial Sequence: Synthetic oligonucleotide
cttcctggggcaactccctgatggc

SEQ ID NO: 333470 - DNA, 25 bp, Artificial Sequence
  Description of Artificial Sequence: Synthetic oligonucleotide
ttcctggggcaactccctgatggcc

SEQ ID NO: 333471 - DNA, 24 bp, Artificial Sequence
  Description of Artificial Sequence: Synthetic oligonucleotide
tcctggggcaactccctgatggcc

SEQ ID NO: 333472 - DNA, 23 bp, Artificial Sequence
  Description of Artificial Sequence: Synthetic oligonucleotide
cctggggcaactccctgatggcc

SEQ ID NO: 333473 - DNA, 24 bp, Artificial Sequence
  Description of Artificial Sequence: Synthetic oligonucleotide
ctggggcaactccctgatggccgt

SEQ ID NO: 333474 - DNA, 25 bp, Artificial Sequence
  Description of Artificial Sequence: Synthetic oligonucleotide
tggggcaactccctgatggccgtga

SEQ ID NO: 333475 - DNA, 24 bp, Artificial Sequence
  Description of Artificial Sequence: Synthetic oligonucleotide
ggggcaactccctgatggccgtga

SEQ ID NO: 333476 - DNA, 24 bp, Artificial Sequence
  Description of Artificial Sequence: Synthetic oligonucleotide
gggcaactccctgatggccgtgag

SEQ ID NO: 333477 - DNA, 26 bp, Artificial Sequence
  Description of Artificial Sequence: Synthetic oligonucleotide
ggcaactccctgatggccgtgagcta

SEQ ID NO: 333478 - DNA, 27 bp, Artificial Sequence
  Description of Artificial Sequence: Synthetic oligonucleotide
gcaactccctgatggccgtgagctact

SEQ ID NO: 333479 - DNA, 28 bp, Artificial Sequence
  Description of Artificial Sequence: Synthetic oligonucleotide
caactccctgatggccgtgagctacttc

SEQ ID NO: 333480 - DNA, 28 bp, Artificial Sequence
  Description of Artificial Sequence: Synthetic oligonucleotide
aactccctgatggccgtgagctacttcc

SEQ ID NO: 333481 - DNA, 27 bp, Artificial Sequence
  Description of Artificial Sequence: Synthetic oligonucleotide
actccctgatggccgtgagctacttcc

SEQ ID NO: 333482 - DNA, 27 bp, Artificial Sequence
  Description of Artificial Sequence: Synthetic oligonucleotide
ctccctgatggccgtgagctacttcct

SEQ ID NO: 333483 - DNA, 27 bp, Artificial Sequence
  Description of Artificial Sequence: Synthetic oligonucleotide
tccctgatggccgtgagctacttcctc

SEQ ID NO: 333484 - DNA, 27 bp, Artificial Sequence
  Description of Artificial Sequence: Synthetic oligonucleotide
ccctgatggccgtgagctacttcctct

SEQ ID NO: 333485 - DNA, 31 bp, Artificial Sequence
  Description of Artificial Sequence: Synthetic oligonucleotide
cctgatggccgtgagctacttcctcttaatc

SEQ ID NO: 333486 - DNA, 32 bp, Artificial Sequence
  Description of Artificial Sequence: Synthetic oligonucleotide
ctgatggccgtgagctacttcctcttaatctc

SEQ ID NO: 333487 - DNA, 32 bp, Artificial Sequence
  Description of Artificial Sequence: Synthetic oligonucleotide
tgatggccgtgagctacttcctcttaatctcg

SEQ ID NO: 333488 - DNA, 31 bp, Artificial Sequence
  Description of Artificial Sequence: Synthetic oligonucleotide
gatggccgtgagctacttcctcttaatctcg

SEQ ID NO: 333489 - DNA, 32 bp, Artificial Sequence
  Description of Artificial Sequence: Synthetic oligonucleotide
atggccgtgagctacttcctcttaatctcgag

SEQ ID NO: 333490 - DNA, 31 bp, Artificial Sequence
  Description of Artificial Sequence: Synthetic oligonucleotide
tggccgtgagctacttcctcttaatctcgag

SEQ ID NO: 333491 - DNA, 30 bp, Artificial Sequence
  Description of Artificial Sequence: Synthetic oligonucleotide
ggccgtgagctacttcctcttaatctcgag

SEQ ID NO: 333492 - DNA, 30 bp, Artificial Sequence
  Description of Artificial Sequence: Synthetic oligonucleotide
gccgtgagctacttcctcttaatctcgagc

SEQ ID NO: 333493 - DNA, 32 bp, Artificial Sequence
  Description of Artificial Sequence: Synthetic oligonucleotide
ccgtgagctacttcctcttaatctcgagcttg

SEQ ID NO: 333494 - DNA, 32 bp, Artificial Sequence
  Description of Artificial Sequence: Synthetic oligonucleotide
cgtgagctacttcctcttaatctcgagcttgg

SEQ ID NO: 333495 - DNA, 32 bp, Artificial Sequence
  Description of Artificial Sequence: Synthetic oligonucleotide
gtgagctacttcctcttaatctcgagcttggg

SEQ ID NO: 333496 - DNA, 32 bp, Artificial Sequence
  Description of Artificial Sequence: Synthetic oligonucleotide
tgagctacttcctcttaatctcgagcttgggg

SEQ ID NO: 333497 - DNA, 31 bp, Artificial Sequence
  Description of Artificial Sequence: Synthetic oligonucleotide
gagctacttcctcttaatctcgagcttgggg

SEQ ID NO: 333498 - DNA, 31 bp, Artificial Sequence
  Description of Artificial Sequence: Synthetic oligonucleotide
agctacttcctcttaatctcgagcttggggg

SEQ ID NO: 333499 - DNA, 30 bp, Artificial Sequence
  Description of Artificial Sequence: Synthetic oligonucleotide
gctacttcctcttaatctcgagcttggggg

SEQ ID NO: 333500 - DNA, 33 bp, Artificial Sequence
  Description of Artificial Sequence: Synthetic oligonucleotide
ctacttcctcttaatctcgagcttgggggaaag

SEQ ID NO: 333501 - DNA, 33 bp, Artificial Sequence
  Description of Artificial Sequence: Synthetic oligonucleotide
tacttcctcttaatctcgagcttgggggaaagg

SEQ ID NO: 333502 - DNA, 32 bp, Artificial Sequence
  Description of Artificial Sequence: Synthetic oligonucleotide
acttcctcttaatctcgagcttgggggaaagg

SEQ ID NO: 333503 - DNA, 31 bp, Artificial Sequence
  Description of Artificial Sequence: Synthetic oligonucleotide
cttcctcttaatctcgagcttgggggaaagg

SEQ ID NO: 333504 - DNA, 32 bp, Artificial Sequence
  Description of Artificial Sequence: Synthetic oligonucleotide
ttcctcttaatctcgagcttgggggaaaggtg

SEQ ID NO: 333505 - DNA, 31 bp, Artificial Sequence
  Description of Artificial Sequence: Synthetic oligonucleotide
tcctcttaatctcgagcttgggggaaaggtg

SEQ ID NO: 333506 - DNA, 30 bp, Artificial Sequence
  Description of Artificial Sequence: Synthetic oligonucleotide
cctcttaatctcgagcttgggggaaaggtg

SEQ ID NO: 333507 - DNA, 31 bp, Artificial Sequence
  Description of Artificial Sequence: Synthetic oligonucleotide
ctcttaatctcgagcttgggggaaaggtgtc

SEQ ID NO: 333508 - DNA, 31 bp, Artificial Sequence
  Description of Artificial Sequence: Synthetic oligonucleotide
tcttaatctcgagcttgggggaaaggtgtcg

SEQ ID NO: 333509 - DNA, 30 bp, Artificial Sequence
  Description of Artificial Sequence: Synthetic oligonucleotide
cttaatctcgagcttgggggaaaggtgtcg

SEQ ID NO: 333510 - DNA, 33 bp, Artificial Sequence
  Description of Artificial Sequence: Synthetic oligonucleotide
ttaatctcgagcttgggggaaaggtgtcgtttg

SEQ ID NO: 333511 - DNA, 32 bp, Artificial Sequence
  Description of Artificial Sequence: Synthetic oligonucleotide
taatctcgagcttgggggaaaggtgtcgtttg

SEQ ID NO: 333512 - DNA, 31 bp, Artificial Sequence
  Description of Artificial Sequence: Synthetic oligonucleotide
aatctcgagcttgggggaaaggtgtcgtttg

SEQ ID NO: 333513 - DNA, 30 bp, Artificial Sequence
  Description of Artificial Sequence: Synthetic oligonucleotide
atctcgagcttgggggaaaggtgtcgtttg

SEQ ID NO: 333514 - DNA, 29 bp, Artificial Sequence
  Description of Artificial Sequence: Synthetic oligonucleotide
tctcgagcttgggggaaaggtgtcgtttg

SEQ ID NO: 333515 - DNA, 28 bp, Artificial Sequence
  Description of Artificial Sequence: Synthetic oligonucleotide
ctcgagcttgggggaaaggtgtcgtttg

SEQ ID NO: 333516 - DNA, 31 bp, Artificial Sequence
  Description of Artificial Sequence: Synthetic oligonucleotide
tcgagcttgggggaaaggtgtcgtttgtttg

SEQ ID NO: 333517 - DNA, 30 bp, Artificial Sequence
  Description of Artificial Sequence: Synthetic oligonucleotide
cgagcttgggggaaaggtgtcgtttgtttg

SEQ ID NO: 333518 - DNA, 30 bp, Artificial Sequence
  Description of Artificial Sequence: Synthetic oligonucleotide
gagcttgggggaaaggtgtcgtttgtttgc

SEQ ID NO: 333519 - DNA, 30 bp, Artificial Sequence
  Description of Artificial Sequence: Synthetic oligonucleotide
agcttgggggaaaggtgtcgtttgtttgcc

SEQ ID NO: 333520 - DNA, 29 bp, Artificial Sequence
  Description of Artificial Sequence: Synthetic oligonucleotide
gcttgggggaaaggtgtcgtttgtttgcc

SEQ ID NO: 333521 - DNA, 31 bp, Artificial Sequence
  Description of Artificial Sequence: Synthetic oligonucleotide
cttgggggaaaggtgtcgtttgtttgccatg

SEQ ID NO: 333522 - DNA, 33 bp, Artificial Sequence
  Description of Artificial Sequence: Synthetic oligonucleotide
ttgggggaaaggtgtcgtttgtttgccatgaag

SEQ ID NO: 333523 - DNA, 32 bp, Artificial Sequence
  Description of Artificial Sequence: Synthetic oligonucleotide
tgggggaaaggtgtcgtttgtttgccatgaag

SEQ ID NO: 333524 - DNA, 31 bp, Artificial Sequence
  Description of Artificial Sequence: Synthetic oligonucleotide
gggggaaaggtgtcgtttgtttgccatgaag

SEQ ID NO: 333525 - DNA, 31 bp, Artificial Sequence
  Description of Artificial Sequence: Synthetic oligonucleotide
ggggaaaggtgtcgtttgtttgccatgaagg

SEQ ID NO: 333526 - DNA, 31 bp, Artificial Sequence
  Description of Artificial Sequence: Synthetic oligonucleotide
gggaaaggtgtcgtttgtttgccatgaaggg

SEQ ID NO: 333527 - DNA, 33 bp, Artificial Sequence
  Description of Artificial Sequence: Synthetic oligonucleotide
ggaaaggtgtcgtttgtttgccatgaagggtac

SEQ ID NO: 333528 - DNA, 33 bp, Artificial Sequence
  Description of Artificial Sequence: Synthetic oligonucleotide
gaaaggtgtcgtttgtttgccatgaagggtacc

SEQ ID NO: 333529 - DNA, 33 bp, Artificial Sequence
  Description of Artificial Sequence: Synthetic oligonucleotide
aaaggtgtcgtttgtttgccatgaagggtaccg

SEQ ID NO: 333530 - DNA, 32 bp, Artificial Sequence
  Description of Artificial Sequence: Synthetic oligonucleotide
aaggtgtcgtttgtttgccatgaagggtaccg

SEQ ID NO: 333531 - DNA, 31 bp, Artificial Sequence
  Description of Artificial Sequence: Synthetic oligonucleotide
aggtgtcgtttgtttgccatgaagggtaccg

SEQ ID NO: 333532 - DNA, 30 bp, Artificial Sequence
  Description of Artificial Sequence: Synthetic oligonucleotide
ggtgtcgtttgtttgccatgaagggtaccg

SEQ ID NO: 333533 - DNA, 37 bp, Artificial Sequence
  Description of Artificial Sequence: Synthetic oligonucleotide
gtgtcgtttgtttgccatgaagggtaccgattaaatg

SEQ ID NO: 333534 - DNA, 37 bp, Artificial Sequence
  Description of Artificial Sequence: Synthetic oligonucleotide
tgtcgtttgtttgccatgaagggtaccgattaaatgg

SEQ ID NO: 333535 - DNA, 36 bp, Artificial Sequence
  Description of Artificial Sequence: Synthetic oligonucleotide
gtcgtttgtttgccatgaagggtaccgattaaatgg

SEQ ID NO: 333536 - DNA, 36 bp, Artificial Sequence
  Description of Artificial Sequence: Synthetic oligonucleotide
tcgtttgtttgccatgaagggtaccgattaaatggc

SEQ ID NO: 333537 - DNA, 35 bp, Artificial Sequence
  Description of Artificial Sequence: Synthetic oligonucleotide
cgtttgtttgccatgaagggtaccgattaaatggc

SEQ ID NO: 333538 - DNA, 36 bp, Artificial Sequence
  Description of Artificial Sequence: Synthetic oligonucleotide
gtttgtttgccatgaagggtaccgattaaatggcag

SEQ ID NO: 333539 - DNA, 36 bp, Artificial Sequence
  Description of Artificial Sequence: Synthetic oligonucleotide
tttgtttgccatgaagggtaccgattaaatggcagg

SEQ ID NO: 333540 - DNA, 35 bp, Artificial Sequence
  Description of Artificial Sequence: Synthetic oligonucleotide
ttgtttgccatgaagggtaccgattaaatggcagg

SEQ ID NO: 333541 - DNA, 34 bp, Artificial Sequence
  Description of Artificial Sequence: Synthetic oligonucleotide
tgtttgccatgaagggtaccgattaaatggcagg

SEQ ID NO: 333542 - DNA, 33 bp, Artificial Sequence
  Description of Artificial Sequence: Synthetic oligonucleotide
gtttgccatgaagggtaccgattaaatggcagg

SEQ ID NO: 333543 - DNA, 34 bp, Artificial Sequence
  Description of Artificial Sequence: Synthetic oligonucleotide
tttgccatgaagggtaccgattaaatggcaggtc

SEQ ID NO: 333544 - DNA, 33 bp, Artificial Sequence
  Description of Artificial Sequence: Synthetic oligonucleotide
ttgccatgaagggtaccgattaaatggcaggtc

SEQ ID NO: 333545 - DNA, 32 bp, Artificial Sequence
  Description of Artificial Sequence: Synthetic oligonucleotide
tgccatgaagggtaccgattaaatggcaggtc

SEQ ID NO: 333546 - DNA, 31 bp, Artificial Sequence
  Description of Artificial Sequence: Synthetic oligonucleotide
gccatgaagggtaccgattaaatggcaggtc

SEQ ID NO: 333547 - DNA, 32 bp, Artificial Sequence
  Description of Artificial Sequence: Synthetic oligonucleotide
ccatgaagggtaccgattaaatggcaggtctc

SEQ ID NO: 333548 - DNA, 32 bp, Artificial Sequence
  Description of Artificial Sequence: Synthetic oligonucleotide
catgaagggtaccgattaaatggcaggtctcc

SEQ ID NO: 333549 - DNA, 34 bp, Artificial Sequence
  Description of Artificial Sequence: Synthetic oligonucleotide
atgaagggtaccgattaaatggcaggtctcctag

SEQ ID NO: 333550 - DNA, 33 bp, Artificial Sequence
  Description of Artificial Sequence: Synthetic oligonucleotide
tgaagggtaccgattaaatggcaggtctcctag

SEQ ID NO: 333551 - DNA, 32 bp, Artificial Sequence
  Description of Artificial Sequence: Synthetic oligonucleotide
gaagggtaccgattaaatggcaggtctcctag

SEQ ID NO: 333552 - DNA, 33 bp, Artificial Sequence
  Description of Artificial Sequence: Synthetic oligonucleotide
aagggtaccgattaaatggcaggtctcctagtc

SEQ ID NO: 333553 - DNA, 32 bp, Artificial Sequence
  Description of Artificial Sequence: Synthetic oligonucleotide
agggtaccgattaaatggcaggtctcctagtc

SEQ ID NO: 333554 - DNA, 31 bp, Artificial Sequence
  Description of Artificial Sequence: Synthetic oligonucleotide
gggtaccgattaaatggcaggtctcctagtc

SEQ ID NO: 333555 - DNA, 34 bp, Artificial Sequence
  Description of Artificial Sequence: Synthetic oligonucleotide
ggtaccgattaaatggcaggtctcctagtcattc

SEQ ID NO: 333556 - DNA, 35 bp, Artificial Sequence
  Description of Artificial Sequence: Synthetic oligonucleotide
gtaccgattaaatggcaggtctcctagtcattctg

SEQ ID NO: 333557 - DNA, 36 bp, Artificial Sequence
  Description of Artificial Sequence: Synthetic oligonucleotide
taccgattaaatggcaggtctcctagtcattctgtc

SEQ ID NO: 333558 - DNA, 35 bp, Artificial Sequence
  Description of Artificial Sequence: Synthetic oligonucleotide
accgattaaatggcaggtctcctagtcattctgtc

SEQ ID NO: 333559 - DNA, 34 bp, Artificial Sequence
  Description of Artificial Sequence: Synthetic oligonucleotide
ccgattaaatggcaggtctcctagtcattctgtc

SEQ ID NO: 333560 - DNA, 36 bp, Artificial Sequence
  Description of Artificial Sequence: Synthetic oligonucleotide
cgattaaatggcaggtctcctagtcattctgtcttg

SEQ ID NO: 333561 - DNA, 36 bp, Artificial Sequence
  Description of Artificial Sequence: Synthetic oligonucleotide
gattaaatggcaggtctcctagtcattctgtcttgg

SEQ ID NO: 333562 - DNA, 36 bp, Artificial Sequence
  Description of Artificial Sequence: Synthetic oligonucleotide
attaaatggcaggtctcctagtcattctgtcttggc

SEQ ID NO: 333563 - DNA, 35 bp, Artificial Sequence
  Description of Artificial Sequence: Synthetic oligonucleotide
ttaaatggcaggtctcctagtcattctgtcttggc

SEQ ID NO: 333564 - DNA, 34 bp, Artificial Sequence
  Description of Artificial Sequence: Synthetic oligonucleotide
taaatggcaggtctcctagtcattctgtcttggc

SEQ ID NO: 333565 - DNA, 33 bp, Artificial Sequence
  Description of Artificial Sequence: Synthetic oligonucleotide
aaatggcaggtctcctagtcattctgtcttggc

SEQ ID NO: 333566 - DNA, 32 bp, Artificial Sequence
  Description of Artificial Sequence: Synthetic oligonucleotide
aatggcaggtctcctagtcattctgtcttggc

SEQ ID NO: 333567 - DNA, 31 bp, Artificial Sequence
  Description of Artificial Sequence: Synthetic oligonucleotide
atggcaggtctcctagtcattctgtcttggc

SEQ ID NO: 333568 - DNA, 30 bp, Artificial Sequence
  Description of Artificial Sequence: Synthetic oligonucleotide
tggcaggtctcctagtcattctgtcttggc

SEQ ID NO: 333569 - DNA, 29 bp, Artificial Sequence
  Description of Artificial Sequence: Synthetic oligonucleotide
ggcaggtctcctagtcattctgtcttggc

SEQ ID NO: 333570 - DNA, 30 bp, Artificial Sequence
  Description of Artificial Sequence: Synthetic oligonucleotide
gcaggtctcctagtcattctgtcttggcag

SEQ ID NO: 333571 - DNA, 30 bp, Artificial Sequence
  Description of Artificial Sequence: Synthetic oligonucleotide
caggtctcctagtcattctgtcttggcagg

SEQ ID NO: 333572 - DNA, 33 bp, Artificial Sequence
  Description of Artificial Sequence: Synthetic oligonucleotide
aggtctcctagtcattctgtcttggcaggaatg

SEQ ID NO: 333573 - DNA, 32 bp, Artificial Sequence
  Description of Artificial Sequence: Synthetic oligonucleotide
ggtctcctagtcattctgtcttggcaggaatg

SEQ ID NO: 333574 - DNA, 35 bp, Artificial Sequence
  Description of Artificial Sequence: Synthetic oligonucleotide
gtctcctagtcattctgtcttggcaggaatgaaac

SEQ ID NO: 333575 - DNA, 35 bp, Artificial Sequence
  Description of Artificial Sequence: Synthetic oligonucleotide
tctcctagtcattctgtcttggcaggaatgaaacc

SEQ ID NO: 333576 - DNA, 34 bp, Artificial Sequence
  Description of Artificial Sequence: Synthetic oligonucleotide
ctcctagtcattctgtcttggcaggaatgaaacc

SEQ ID NO: 333577 - DNA, 34 bp, Artificial Sequence
  Description of Artificial Sequence: Synthetic oligonucleotide
tcctagtcattctgtcttggcaggaatgaaaccc

SEQ ID NO: 333578 - DNA, 33 bp, Artificial Sequence
  Description of Artificial Sequence: Synthetic oligonucleotide
cctagtcattctgtcttggcaggaatgaaaccc

SEQ ID NO: 333579 - DNA, 33 bp, Artificial Sequence
  Description of Artificial Sequence: Synthetic oligonucleotide
ctagtcattctgtcttggcaggaatgaaacccc

SEQ ID NO: 333580 - DNA, 36 bp, Artificial Sequence
  Description of Artificial Sequence: Synthetic oligonucleotide
tagtcattctgtcttggcaggaatgaaacccctttg

SEQ ID NO: 333581 - DNA, 35 bp, Artificial Sequence
  Description of Artificial Sequence: Synthetic oligonucleotide
agtcattctgtcttggcaggaatgaaacccctttg

SEQ ID NO: 333582 - DNA, 34 bp, Artificial Sequence
  Description of Artificial Sequence: Synthetic oligonucleotide
gtcattctgtcttggcaggaatgaaacccctttg

SEQ ID NO: 333583 - DNA, 34 bp, Artificial Sequence
  Description of Artificial Sequence: Synthetic oligonucleotide
tcattctgtcttggcaggaatgaaacccctttgg

SEQ ID NO: 333584 - DNA, 33 bp, Artificial Sequence
  Description of Artificial Sequence: Synthetic oligonucleotide
cattctgtcttggcaggaatgaaacccctttgg

SEQ ID NO: 333585 - DNA, 37 bp, Artificial Sequence
  Description of Artificial Sequence: Synthetic oligonucleotide
attctgtcttggcaggaatgaaacccctttggattag

SEQ ID NO: 333586 - DNA, 36 bp, Artificial Sequence
  Description of Artificial Sequence: Synthetic oligonucleotide
ttctgtcttggcaggaatgaaacccctttggattag

SEQ ID NO: 333587 - DNA, 35 bp, Artificial Sequence
  Description of Artificial Sequence: Synthetic oligonucleotide
tctgtcttggcaggaatgaaacccctttggattag

SEQ ID NO: 333588 - DNA, 34 bp, Artificial Sequence
  Description of Artificial Sequence: Synthetic oligonucleotide
ctgtcttggcaggaatgaaacccctttggattag

SEQ ID NO: 333589 - DNA, 34 bp, Artificial Sequence
  Description of Artificial Sequence: Synthetic oligonucleotide
tgtcttggcaggaatgaaacccctttggattagc

SEQ ID NO: 333590 - DNA, 33 bp, Artificial Sequence
  Description of Artificial Sequence: Synthetic oligonucleotide
gtcttggcaggaatgaaacccctttggattagc

SEQ ID NO: 333591 - DNA, 34 bp, Artificial Sequence
  Description of Artificial Sequence: Synthetic oligonucleotide
tcttggcaggaatgaaacccctttggattagcag

SEQ ID NO: 333592 - DNA, 33 bp, Artificial Sequence
  Description of Artificial Sequence: Synthetic oligonucleotide
cttggcaggaatgaaacccctttggattagcag

SEQ ID NO: 333593 - DNA, 34 bp, Artificial Sequence
  Description of Artificial Sequence: Synthetic oligonucleotide
ttggcaggaatgaaacccctttggattagcagtg

SEQ ID NO: 333594 - DNA, 33 bp, Artificial Sequence
  Description of Artificial Sequence: Synthetic oligonucleotide
tggcaggaatgaaacccctttggattagcagtg

SEQ ID NO: 333595 - DNA, 32 bp, Artificial Sequence
  Description of Artificial Sequence: Synthetic oligonucleotide
ggcaggaatgaaacccctttggattagcagtg

SEQ ID NO: 333596 - DNA, 34 bp, Artificial Sequence
  Description of Artificial Sequence: Synthetic oligonucleotide
gcaggaatgaaacccctttggattagcagtgtac

SEQ ID NO: 333597 - DNA, 34 bp, Artificial Sequence
  Description of Artificial Sequence: Synthetic oligonucleotide
caggaatgaaacccctttggattagcagtgtacc

SEQ ID NO: 333598 - DNA, 35 bp, Artificial Sequence
  Description of Artificial Sequence: Synthetic oligonucleotide
aggaatgaaacccctttggattagcagtgtaccag

SEQ ID NO: 333599 - DNA, 34 bp, Artificial Sequence
  Description of Artificial Sequence: Synthetic oligonucleotide
ggaatgaaacccctttggattagcagtgtaccag

SEQ ID NO: 333600 - DNA, 35 bp, Artificial Sequence
  Description of Artificial Sequence: Synthetic oligonucleotide
gaatgaaacccctttggattagcagtgtaccagtg

SEQ ID NO: 333601 - DNA, 36 bp, Artificial Sequence
  Description of Artificial Sequence: Synthetic oligonucleotide
aatgaaacccctttggattagcagtgtaccagtgtg

SEQ ID NO: 333602 - DNA, 35 bp, Artificial Sequence
  Description of Artificial Sequence: Synthetic oligonucleotide
atgaaacccctttggattagcagtgtaccagtgtg

SEQ ID NO: 333603 - DNA, 34 bp, Artificial Sequence
  Description of Artificial Sequence: Synthetic oligonucleotide
tgaaacccctttggattagcagtgtaccagtgtg

SEQ ID NO: 333604 - DNA, 33 bp, Artificial Sequence
  Description of Artificial Sequence: Synthetic oligonucleotide
gaaacccctttggattagcagtgtaccagtgtg

SEQ ID NO: 333605 - DNA, 34 bp, Artificial Sequence
  Description of Artificial Sequence: Synthetic oligonucleotide
aaacccctttggattagcagtgtaccagtgtgtc

SEQ ID NO: 333606 - DNA, 33 bp, Artificial Sequence
  Description of Artificial Sequence: Synthetic oligonucleotide
aacccctttggattagcagtgtaccagtgtgtc

SEQ ID NO: 333607 - DNA, 32 bp, Artificial Sequence
  Description of Artificial Sequence: Synthetic oligonucleotide
acccctttggattagcagtgtaccagtgtgtc

SEQ ID NO: 333608 - DNA, 31 bp, Artificial Sequence
  Description of Artificial Sequence: Synthetic oligonucleotide
cccctttggattagcagtgtaccagtgtgtc

SEQ ID NO: 333609 - DNA, 33 bp, Artificial Sequence
  Description of Artificial Sequence: Synthetic oligonucleotide
ccctttggattagcagtgtaccagtgtgtcaac

SEQ ID NO: 333610 - DNA, 43 bp, Artificial Sequence
  Description of Artificial Sequence: Synthetic oligonucleotide
attagcagtgtaccagtgtgtcaacaaatctattgtccaaaac

SEQ ID NO: 333611 - DNA, 42 bp, Artificial Sequence
  Description of Artificial Sequence: Synthetic oligonucleotide
ttagcagtgtaccagtgtgtcaacaaatctattgtccaaaac

SEQ ID NO: 333612 - DNA, 41 bp, Artificial Sequence
  Description of Artificial Sequence: Synthetic oligonucleotide
tagcagtgtaccagtgtgtcaacaaatctattgtccaaaac

SEQ ID NO: 333613 - DNA, 40 bp, Artificial Sequence
  Description of Artificial Sequence: Synthetic oligonucleotide
agcagtgtaccagtgtgtcaacaaatctattgtccaaaac

SEQ ID NO: 333614 - DNA, 39 bp, Artificial Sequence
  Description of Artificial Sequence: Synthetic oligonucleotide
gcagtgtaccagtgtgtcaacaaatctattgtccaaaac

SEQ ID NO: 333615 - DNA, 39 bp, Artificial Sequence
  Description of Artificial Sequence: Synthetic oligonucleotide
cagtgtaccagtgtgtcaacaaatctattgtccaaaacc

SEQ ID NO: 333616 - DNA, 40 bp, Artificial Sequence
  Description of Artificial Sequence: Synthetic oligonucleotide
agtgtaccagtgtgtcaacaaatctattgtccaaaacctc

SEQ ID NO: 333617 - DNA, 39 bp, Artificial Sequence
  Description of Artificial Sequence: Synthetic oligonucleotide
gtgtaccagtgtgtcaacaaatctattgtccaaaacctc

SEQ ID NO: 333618 - DNA, 39 bp, Artificial Sequence
  Description of Artificial Sequence: Synthetic oligonucleotide
tgtaccagtgtgtcaacaaatctattgtccaaaacctcc

SEQ ID NO: 333619 - DNA, 38 bp, Artificial Sequence
  Description of Artificial Sequence: Synthetic oligonucleotide
gtaccagtgtgtcaacaaatctattgtccaaaacctcc

SEQ ID NO: 333620 - DNA, 39 bp, Artificial Sequence
  Description of Artificial Sequence: Synthetic oligonucleotide
taccagtgtgtcaacaaatctattgtccaaaacctccag

SEQ ID NO: 333621 - DNA, 38 bp, Artificial Sequence
  Description of Artificial Sequence: Synthetic oligonucleotide
accagtgtgtcaacaaatctattgtccaaaacctccag

SEQ ID NO: 333622 - DNA, 37 bp, Artificial Sequence
  Description of Artificial Sequence: Synthetic oligonucleotide
ccagtgtgtcaacaaatctattgtccaaaacctccag

SEQ ID NO: 333623 - DNA, 37 bp, Artificial Sequence
  Description of Artificial Sequence: Synthetic oligonucleotide
cagtgtgtcaacaaatctattgtccaaaacctccagc

SEQ ID NO: 333624 - DNA, 40 bp, Artificial Sequence
  Description of Artificial Sequence: Synthetic oligonucleotide
agtgtgtcaacaaatctattgtccaaaacctccagctttc

SEQ ID NO: 333625 - DNA, 39 bp, Artificial Sequence
  Description of Artificial Sequence: Synthetic oligonucleotide
gtgtgtcaacaaatctattgtccaaaacctccagctttc

SEQ ID NO: 333626 - DNA, 39 bp, Artificial Sequence
  Description of Artificial Sequence: Synthetic oligonucleotide
tgtgtcaacaaatctattgtccaaaacctccagctttcc

SEQ ID NO: 333627 - DNA, 38 bp, Artificial Sequence
  Description of Artificial Sequence: Synthetic oligonucleotide
gtgtcaacaaatctattgtccaaaacctccagctttcc

SEQ ID NO: 333628 - DNA, 43 bp, Artificial Sequence
  Description of Artificial Sequence: Synthetic oligonucleotide
tgtcaacaaatctattgtccaaaacctccagctttccttaatg

SEQ ID NO: 333629 - DNA, 42 bp, Artificial Sequence
  Description of Artificial Sequence: Synthetic oligonucleotide
gtcaacaaatctattgtccaaaacctccagctttccttaatg

SEQ ID NO: 333630 - DNA, 42 bp, Artificial Sequence
  Description of Artificial Sequence: Synthetic oligonucleotide
tcaacaaatctattgtccaaaacctccagctttccttaatgc

SEQ ID NO: 333631 - DNA, 41 bp, Artificial Sequence
  Description of Artificial Sequence: Synthetic oligonucleotide
caacaaatctattgtccaaaacctccagctttccttaatgc

SEQ ID NO: 333632 - DNA, 41 bp, Artificial Sequence
  Description of Artificial Sequence: Synthetic oligonucleotide
aacaaatctattgtccaaaacctccagctttccttaatgcg

SEQ ID NO: 333633 - DNA, 40 bp, Artificial Sequence
  Description of Artificial Sequence: Synthetic oligonucleotide
acaaatctattgtccaaaacctccagctttccttaatgcg

SEQ ID NO: 333634 - DNA, 39 bp, Artificial Sequence
  Description of Artificial Sequence: Synthetic oligonucleotide
caaatctattgtccaaaacctccagctttccttaatgcg

SEQ ID NO: 333635 - DNA, 40 bp, Artificial Sequence
  Description of Artificial Sequence: Synthetic oligonucleotide
aaatctattgtccaaaacctccagctttccttaatgcgag

SEQ ID NO: 333636 - DNA, 39 bp, Artificial Sequence
  Description of Artificial Sequence: Synthetic oligonucleotide
aatctattgtccaaaacctccagctttccttaatgcgag

SEQ ID NO: 333637 - DNA, 38 bp, Artificial Sequence
  Description of Artificial Sequence: Synthetic oligonucleotide
atctattgtccaaaacctccagctttccttaatgcgag

SEQ ID NO: 333638 - DNA, 37 bp, Artificial Sequence
  Description of Artificial Sequence: Synthetic oligonucleotide
tctattgtccaaaacctccagctttccttaatgcgag

SEQ ID NO: 333639 - DNA, 36 bp, Artificial Sequence
  Description of Artificial Sequence: Synthetic oligonucleotide
ctattgtccaaaacctccagctttccttaatgcgag

SEQ ID NO: 333640 - DNA, 37 bp, Artificial Sequence
  Description of Artificial Sequence: Synthetic oligonucleotide
tattgtccaaaacctccagctttccttaatgcgagac

SEQ ID NO: 333641 - DNA, 36 bp, Artificial Sequence
  Description of Artificial Sequence: Synthetic oligonucleotide
attgtccaaaacctccagctttccttaatgcgagac

SEQ ID NO: 333642 - DNA, 35 bp, Artificial Sequence
  Description of Artificial Sequence: Synthetic oligonucleotide
ttgtccaaaacctccagctttccttaatgcgagac

SEQ ID NO: 333643 - DNA, 34 bp, Artificial Sequence
  Description of Artificial Sequence: Synthetic oligonucleotide
tgtccaaaacctccagctttccttaatgcgagac

SEQ ID NO: 333644 - DNA, 33 bp, Artificial Sequence
  Description of Artificial Sequence: Synthetic oligonucleotide
gtccaaaacctccagctttccttaatgcgagac

SEQ ID NO: 333645 - DNA, 34 bp, Artificial Sequence
  Description of Artificial Sequence: Synthetic oligonucleotide
tccaaaacctccagctttccttaatgcgagacac

SEQ ID NO: 333646 - DNA, 33 bp, Artificial Sequence
  Description of Artificial Sequence: Synthetic oligonucleotide
ccaaaacctccagctttccttaatgcgagacac

SEQ ID NO: 333647 - DNA, 34 bp, Artificial Sequence
  Description of Artificial Sequence: Synthetic oligonucleotide
caaaacctccagctttccttaatgcgagacacac

SEQ ID NO: 333648 - DNA, 35 bp, Artificial Sequence
  Description of Artificial Sequence: Synthetic oligonucleotide
aaaacctccagctttccttaatgcgagacacactg

SEQ ID NO: 333649 - DNA, 34 bp, Artificial Sequence
  Description of Artificial Sequence: Synthetic oligonucleotide
aaacctccagctttccttaatgcgagacacactg

SEQ ID NO: 333650 - DNA, 33 bp, Artificial Sequence
  Description of Artificial Sequence: Synthetic oligonucleotide
aacctccagctttccttaatgcgagacacactg

SEQ ID NO: 333651 - DNA, 32 bp, Artificial Sequence
  Description of Artificial Sequence: Synthetic oligonucleotide
acctccagctttccttaatgcgagacacactg

SEQ ID NO: 333652 - DNA, 31 bp, Artificial Sequence
  Description of Artificial Sequence: Synthetic oligonucleotide
cctccagctttccttaatgcgagacacactg

SEQ ID NO: 333653 - DNA, 31 bp, Artificial Sequence
  Description of Artificial Sequence: Synthetic oligonucleotide
ctccagctttccttaatgcgagacacactgg

SEQ ID NO: 333654 - DNA, 33 bp, Artificial Sequence
  Description of Artificial Sequence: Synthetic oligonucleotide
tccagctttccttaatgcgagacacactggaac

SEQ ID NO: 333655 - DNA, 32 bp, Artificial Sequence
  Description of Artificial Sequence: Synthetic oligonucleotide
ccagctttccttaatgcgagacacactggaac

SEQ ID NO: 333656 - DNA, 33 bp, Artificial Sequence
  Description of Artificial Sequence: Synthetic oligonucleotide
cagctttccttaatgcgagacacactggaactc

SEQ ID NO: 333657 - DNA, 33 bp, Artificial Sequence
  Description of Artificial Sequence: Synthetic oligonucleotide
agctttccttaatgcgagacacactggaactcc

SEQ ID NO: 333658 - DNA, 32 bp, Artificial Sequence
  Description of Artificial Sequence: Synthetic oligonucleotide
gctttccttaatgcgagacacactggaactcc

SEQ ID NO: 333659 - DNA, 32 bp, Artificial Sequence
  Description of Artificial Sequence: Synthetic oligonucleotide
ctttccttaatgcgagacacactggaactccc

SEQ ID NO: 333660 - DNA, 35 bp, Artificial Sequence
  Description of Artificial Sequence: Synthetic oligonucleotide
tttccttaatgcgagacacactggaactcccattg

SEQ ID NO: 333661 - DNA, 34 bp, Artificial Sequence
  Description of Artificial Sequence: Synthetic oligonucleotide
ttccttaatgcgagacacactggaactcccattg

SEQ ID NO: 333662 - DNA, 33 bp, Artificial Sequence
  Description of Artificial Sequence: Synthetic oligonucleotide
tccttaatgcgagacacactggaactcccattg

SEQ ID NO: 333663 - DNA, 32 bp, Artificial Sequence
  Description of Artificial Sequence: Synthetic oligonucleotide
ccttaatgcgagacacactggaactcccattg

SEQ ID NO: 333664 - DNA, 32 bp, Artificial Sequence
  Description of Artificial Sequence: Synthetic oligonucleotide
cttaatgcgagacacactggaactcccattgg

SEQ ID NO: 333665 - DNA, 33 bp, Artificial Sequence
  Description of Artificial Sequence: Synthetic oligonucleotide
ttaatgcgagacacactggaactcccattggag

SEQ ID NO: 333666 - DNA, 32 bp, Artificial Sequence
  Description of Artificial Sequence: Synthetic oligonucleotide
taatgcgagacacactggaactcccattggag

SEQ ID NO: 333667 - DNA, 31 bp, Artificial Sequence
  Description of Artificial Sequence: Synthetic oligonucleotide
aatgcgagacacactggaactcccattggag

SEQ ID NO: 333668 - DNA, 30 bp, Artificial Sequence
  Description of Artificial Sequence: Synthetic oligonucleotide
atgcgagacacactggaactcccattggag

SEQ ID NO: 333669 - DNA, 29 bp, Artificial Sequence
  Description of Artificial Sequence: Synthetic oligonucleotide
tgcgagacacactggaactcccattggag

SEQ ID NO: 333670 - DNA, 28 bp, Artificial Sequence
  Description of Artificial Sequence: Synthetic oligonucleotide
gcgagacacactggaactcccattggag

SEQ ID NO: 333671 - DNA, 33 bp, Artificial Sequence
  Description of Artificial Sequence: Synthetic oligonucleotide
cgagacacactggaactcccattggagataatc

SEQ ID NO: 333672 - DNA, 33 bp, Artificial Sequence
  Description of Artificial Sequence: Synthetic oligonucleotide
gagacacactggaactcccattggagataatcc

SEQ ID NO: 333673 - DNA, 33 bp, Artificial Sequence
  Description of Artificial Sequence: Synthetic oligonucleotide
agacacactggaactcccattggagataatccc

SEQ ID NO: 333674 - DNA, 32 bp, Artificial Sequence
  Description of Artificial Sequence: Synthetic oligonucleotide
gacacactggaactcccattggagataatccc

SEQ ID NO: 333675 - DNA, 35 bp, Artificial Sequence
  Description of Artificial Sequence: Synthetic oligonucleotide
acacactggaactcccattggagataatccctatg

SEQ ID NO: 333676 - DNA, 34 bp, Artificial Sequence
  Description of Artificial Sequence: Synthetic oligonucleotide
cacactggaactcccattggagataatccctatg

SEQ ID NO: 333677 - DNA, 34 bp, Artificial Sequence
  Description of Artificial Sequence: Synthetic oligonucleotide
acactggaactcccattggagataatccctatgg

SEQ ID NO: 333678 - DNA, 33 bp, Artificial Sequence
  Description of Artificial Sequence: Synthetic oligonucleotide
cactggaactcccattggagataatccctatgg

SEQ ID NO: 333679 - DNA, 37 bp, Artificial Sequence
  Description of Artificial Sequence: Synthetic oligonucleotide
actggaactcccattggagataatccctatggtaaag

SEQ ID NO: 333680 - DNA, 36 bp, Artificial Sequence
  Description of Artificial Sequence: Synthetic oligonucleotide
ctggaactcccattggagataatccctatggtaaag

SEQ ID NO: 333681 - DNA, 42 bp, Artificial Sequence
  Description of Artificial Sequence: Synthetic oligonucleotide
tggaactcccattggagataatccctatggtaaagaaataac

SEQ ID NO: 333682 - DNA, 41 bp, Artificial Sequence
  Description of Artificial Sequence: Synthetic oligonucleotide
ggaactcccattggagataatccctatggtaaagaaataac

SEQ ID NO: 333683 - DNA, 44 bp, Artificial Sequence
  Description of Artificial Sequence: Synthetic oligonucleotide
gaactcccattggagataatccctatggtaaagaaataacttac

SEQ ID NO: 333684 - DNA, 44 bp, Artificial Sequence
  Description of Artificial Sequence: Synthetic oligonucleotide
aactcccattggagataatccctatggtaaagaaataacttacg

SEQ ID NO: 333685 - DNA, 43 bp, Artificial Sequence
  Description of Artificial Sequence: Synthetic oligonucleotide
actcccattggagataatccctatggtaaagaaataacttacg

SEQ ID NO: 333686 - DNA, 42 bp, Artificial Sequence
  Description of Artificial Sequence: Synthetic oligonucleotide
ctcccattggagataatccctatggtaaagaaataacttacg

SEQ ID NO: 333687 - DNA, 42 bp, Artificial Sequence
  Description of Artificial Sequence: Synthetic oligonucleotide
tcccattggagataatccctatggtaaagaaataacttacgc

SEQ ID NO: 333688 - DNA, 41 bp, Artificial Sequence
  Description of Artificial Sequence: Synthetic oligonucleotide
cccattggagataatccctatggtaaagaaataacttacgc

SEQ ID NO: 333689 - DNA, 43 bp, Artificial Sequence
  Description of Artificial Sequence: Synthetic oligonucleotide
ccattggagataatccctatggtaaagaaataacttacgcatc

SEQ ID NO: 333690 - DNA, 43 bp, Artificial Sequence
  Description of Artificial Sequence: Synthetic oligonucleotide
cattggagataatccctatggtaaagaaataacttacgcatcc

SEQ ID NO: 333691 - DNA, 43 bp, Artificial Sequence
  Description of Artificial Sequence: Synthetic oligonucleotide
attggagataatccctatggtaaagaaataacttacgcatccg

SEQ ID NO: 333692 - DNA, 42 bp, Artificial Sequence
  Description of Artificial Sequence: Synthetic oligonucleotide
ttggagataatccctatggtaaagaaataacttacgcatccg

SEQ ID NO: 333693 - DNA, 41 bp, Artificial Sequence
  Description of Artificial Sequence: Synthetic oligonucleotide
tggagataatccctatggtaaagaaataacttacgcatccg

SEQ ID NO: 333694 - DNA, 40 bp, Artificial Sequence
  Description of Artificial Sequence: Synthetic oligonucleotide
ggagataatccctatggtaaagaaataacttacgcatccg

SEQ ID NO: 333695 - DNA, 41 bp, Artificial Sequence
  Description of Artificial Sequence: Synthetic oligonucleotide
gagataatccctatggtaaagaaataacttacgcatccgac

SEQ ID NO: 333696 - DNA, 42 bp, Artificial Sequence
  Description of Artificial Sequence: Synthetic oligonucleotide
agataatccctatggtaaagaaataacttacgcatccgacac

SEQ ID NO: 333697 - DNA, 41 bp, Artificial Sequence
  Description of Artificial Sequence: Synthetic oligonucleotide
gataatccctatggtaaagaaataacttacgcatccgacac

SEQ ID NO: 333698 - DNA, 41 bp, Artificial Sequence
  Description of Artificial Sequence: Synthetic oligonucleotide
ataatccctatggtaaagaaataacttacgcatccgacacc

SEQ ID NO: 333699 - DNA, 40 bp, Artificial Sequence
  Description of Artificial Sequence: Synthetic oligonucleotide
taatccctatggtaaagaaataacttacgcatccgacacc

SEQ ID NO: 333700 - DNA, 39 bp, Artificial Sequence
  Description of Artificial Sequence: Synthetic oligonucleotide
aatccctatggtaaagaaataacttacgcatccgacacc

SEQ ID NO: 333701 - DNA, 38 bp, Artificial Sequence
  Description of Artificial Sequence: Synthetic oligonucleotide
atccctatggtaaagaaataacttacgcatccgacacc

SEQ ID NO: 333702 - DNA, 37 bp, Artificial Sequence
  Description of Artificial Sequence: Synthetic oligonucleotide
tccctatggtaaagaaataacttacgcatccgacacc

SEQ ID NO: 333703 - DNA, 36 bp, Artificial Sequence
  Description of Artificial Sequence: Synthetic oligonucleotide
ccctatggtaaagaaataacttacgcatccgacacc

SEQ ID NO: 333704 - DNA, 36 bp, Artificial Sequence
  Description of Artificial Sequence: Synthetic oligonucleotide
cctatggtaaagaaataacttacgcatccgacaccc

SEQ ID NO: 333705 - DNA, 37 bp, Artificial Sequence
  Description of Artificial Sequence: Synthetic oligonucleotide
ctatggtaaagaaataacttacgcatccgacacccag

SEQ ID NO: 333706 - DNA, 37 bp, Artificial Sequence
  Description of Artificial Sequence: Synthetic oligonucleotide
tatggtaaagaaataacttacgcatccgacacccagc

SEQ ID NO: 333707 - DNA, 36 bp, Artificial Sequence
  Description of Artificial Sequence: Synthetic oligonucleotide
atggtaaagaaataacttacgcatccgacacccagc

SEQ ID NO: 333708 - DNA, 35 bp, Artificial Sequence
  Description of Artificial Sequence: Synthetic oligonucleotide
tggtaaagaaataacttacgcatccgacacccagc

SEQ ID NO: 333709 - DNA, 34 bp, Artificial Sequence
  Description of Artificial Sequence: Synthetic oligonucleotide
ggtaaagaaataacttacgcatccgacacccagc

SEQ ID NO: 333710 - DNA, 34 bp, Artificial Sequence
  Description of Artificial Sequence: Synthetic oligonucleotide
gtaaagaaataacttacgcatccgacacccagcc

SEQ ID NO: 333711 - DNA, 35 bp, Artificial Sequence
  Description of Artificial Sequence: Synthetic oligonucleotide
taaagaaataacttacgcatccgacacccagccag

SEQ ID NO: 333712 - DNA, 34 bp, Artificial Sequence
  Description of Artificial Sequence: Synthetic oligonucleotide
aaagaaataacttacgcatccgacacccagccag

SEQ ID NO: 333713 - DNA, 33 bp, Artificial Sequence
  Description of Artificial Sequence: Synthetic oligonucleotide
aagaaataacttacgcatccgacacccagccag

SEQ ID NO: 333714 - DNA, 32 bp, Artificial Sequence
  Description of Artificial Sequence: Synthetic oligonucleotide
agaaataacttacgcatccgacacccagccag

SEQ ID NO: 333715 - DNA, 31 bp, Artificial Sequence
  Description of Artificial Sequence: Synthetic oligonucleotide
gaaataacttacgcatccgacacccagccag

SEQ ID NO: 333716 - DNA, 32 bp, Artificial Sequence
  Description of Artificial Sequence: Synthetic oligonucleotide
aaataacttacgcatccgacacccagccagac

SEQ ID NO: 333717 - DNA, 31 bp, Artificial Sequence
  Description of Artificial Sequence: Synthetic oligonucleotide
aataacttacgcatccgacacccagccagac

SEQ ID NO: 333718 - DNA, 30 bp, Artificial Sequence
  Description of Artificial Sequence: Synthetic oligonucleotide
ataacttacgcatccgacacccagccagac

SEQ ID NO: 333719 - DNA, 29 bp, Artificial Sequence
  Description of Artificial Sequence: Synthetic oligonucleotide
taacttacgcatccgacacccagccagac

SEQ ID NO: 333720 - DNA, 28 bp, Artificial Sequence
  Description of Artificial Sequence: Synthetic oligonucleotide
aacttacgcatccgacacccagccagac

SEQ ID NO: 333721 - DNA, 27 bp, Artificial Sequence
  Description of Artificial Sequence: Synthetic oligonucleotide
acttacgcatccgacacccagccagac

SEQ ID NO: 333722 - DNA, 27 bp, Artificial Sequence
  Description of Artificial Sequence: Synthetic oligonucleotide
cttacgcatccgacacccagccagaca

SEQ ID NO: 333723 - DNA, 27 bp, Artificial Sequence
  Description of Artificial Sequence: Synthetic oligonucleotide
ttacgcatccgacacccagccagacag

SEQ ID NO: 333724 - DNA, 27 bp, Artificial Sequence
  Description of Artificial Sequence: Synthetic oligonucleotide
tacgcatccgacacccagccagacaga

SEQ ID NO: 333725 - DNA, 26 bp, Artificial Sequence
  Description of Artificial Sequence: Synthetic oligonucleotide
acgcatccgacacccagccagacaga

SEQ ID NO: 333726 - DNA, 25 bp, Artificial Sequence
  Description of Artificial Sequence: Synthetic oligonucleotide
cgcatccgacacccagccagacaga

SEQ ID NO: 333727 - DNA, 25 bp, Artificial Sequence
  Description of Artificial Sequence: Synthetic oligonucleotide
gcatccgacacccagccagacagac

SEQ ID NO: 333728 - DNA, 25 bp, Artificial Sequence
  Description of Artificial Sequence: Synthetic oligonucleotide
catccgacacccagccagacagacg

SEQ ID NO: 333729 - DNA, 27 bp, Artificial Sequence
  Description of Artificial Sequence: Synthetic oligonucleotide
atccgacacccagccagacagacggat

SEQ ID NO: 333730 - DNA, 26 bp, Artificial Sequence
  Description of Artificial Sequence: Synthetic oligonucleotide
tccgacacccagccagacagacggat

SEQ ID NO: 333731 - DNA, 25 bp, Artificial Sequence
  Description of Artificial Sequence: Synthetic oligonucleotide
ccgacacccagccagacagacggat

SEQ ID NO: 333732 - DNA, 26 bp, Artificial Sequence
  Description of Artificial Sequence: Synthetic oligonucleotide
cgacacccagccagacagacggatga

SEQ ID NO: 333733 - DNA, 26 bp, Artificial Sequence
  Description of Artificial Sequence: Synthetic oligonucleotide
gacacccagccagacagacggatgac

SEQ ID NO: 333734 - DNA, 27 bp, Artificial Sequence
  Description of Artificial Sequence: Synthetic oligonucleotide
acacccagccagacagacggatgacct

SEQ ID NO: 333735 - DNA, 27 bp, Artificial Sequence
  Description of Artificial Sequence: Synthetic oligonucleotide
cacccagccagacagacggatgaccta

SEQ ID NO: 333736 - DNA, 27 bp, Artificial Sequence
  Description of Artificial Sequence: Synthetic oligonucleotide
acccagccagacagacggatgacctac

SEQ ID NO: 333737 - DNA, 27 bp, Artificial Sequence
  Description of Artificial Sequence: Synthetic oligonucleotide
cccagccagacagacggatgacctaca

SEQ ID NO: 333738 - DNA, 28 bp, Artificial Sequence
  Description of Artificial Sequence: Synthetic oligonucleotide
ccagccagacagacggatgacctacaac

SEQ ID NO: 333739 - DNA, 28 bp, Artificial Sequence
  Description of Artificial Sequence: Synthetic oligonucleotide
cagccagacagacggatgacctacaacc

SEQ ID NO: 333740 - DNA, 29 bp, Artificial Sequence
  Description of Artificial Sequence: Synthetic oligonucleotide
agccagacagacggatgacctacaacctc

SEQ ID NO: 333741 - DNA, 28 bp, Artificial Sequence
  Description of Artificial Sequence: Synthetic oligonucleotide
gccagacagacggatgacctacaacctc

SEQ ID NO: 333742 - DNA, 31 bp, Artificial Sequence
  Description of Artificial Sequence: Synthetic oligonucleotide
ccagacagacggatgacctacaacctcatag

SEQ ID NO: 333743 - DNA, 31 bp, Artificial Sequence
  Description of Artificial Sequence: Synthetic oligonucleotide
cagacagacggatgacctacaacctcatagg

SEQ ID NO: 333744 - DNA, 31 bp, Artificial Sequence
  Description of Artificial Sequence: Synthetic oligonucleotide
agacagacggatgacctacaacctcataggg

SEQ ID NO: 333745 - DNA, 30 bp, Artificial Sequence
  Description of Artificial Sequence: Synthetic oligonucleotide
gacagacggatgacctacaacctcataggg

SEQ ID NO: 333746 - DNA, 30 bp, Artificial Sequence
  Description of Artificial Sequence: Synthetic oligonucleotide
acagacggatgacctacaacctcatagggg

SEQ ID NO: 333747 - DNA, 29 bp, Artificial Sequence
  Description of Artificial Sequence: Synthetic oligonucleotide
cagacggatgacctacaacctcatagggg

SEQ ID NO: 333748 - DNA, 30 bp, Artificial Sequence
  Description of Artificial Sequence: Synthetic oligonucleotide
agacggatgacctacaacctcataggggag

SEQ ID NO: 333749 - DNA, 29 bp, Artificial Sequence
  Description of Artificial Sequence: Synthetic oligonucleotide
gacggatgacctacaacctcataggggag

SEQ ID NO: 333750 - DNA, 30 bp, Artificial Sequence
  Description of Artificial Sequence: Synthetic oligonucleotide
acggatgacctacaacctcataggggagag

SEQ ID NO: 333751 - DNA, 29 bp, Artificial Sequence
  Description of Artificial Sequence: Synthetic oligonucleotide
cggatgacctacaacctcataggggagag

SEQ ID NO: 333752 - DNA, 29 bp, Artificial Sequence
  Description of Artificial Sequence: Synthetic oligonucleotide
ggatgacctacaacctcataggggagagc

SEQ ID NO: 333753 - DNA, 30 bp, Artificial Sequence
  Description of Artificial Sequence: Synthetic oligonucleotide
gatgacctacaacctcataggggagagcac

SEQ ID NO: 333754 - DNA, 30 bp, Artificial Sequence
  Description of Artificial Sequence: Synthetic oligonucleotide
atgacctacaacctcataggggagagcacc

SEQ ID NO: 333755 - DNA, 29 bp, Artificial Sequence
  Description of Artificial Sequence: Synthetic oligonucleotide
tgacctacaacctcataggggagagcacc

SEQ ID NO: 333756 - DNA, 28 bp, Artificial Sequence
  Description of Artificial Sequence: Synthetic oligonucleotide
gacctacaacctcataggggagagcacc

SEQ ID NO: 333757 - DNA, 30 bp, Artificial Sequence
  Description of Artificial Sequence: Synthetic oligonucleotide
acctacaacctcataggggagagcaccatc

SEQ ID NO: 333758 - DNA, 29 bp, Artificial Sequence
  Description of Artificial Sequence: Synthetic oligonucleotide
cctacaacctcataggggagagcaccatc

SEQ ID NO: 333759 - DNA, 29 bp, Artificial Sequence
  Description of Artificial Sequence: Synthetic oligonucleotide
ctacaacctcataggggagagcaccatcc

SEQ ID NO: 333760 - DNA, 29 bp, Artificial Sequence
  Description of Artificial Sequence: Synthetic oligonucleotide
tacaacctcataggggagagcaccatccg

SEQ ID NO: 333761 - DNA, 28 bp, Artificial Sequence
  Description of Artificial Sequence: Synthetic oligonucleotide
acaacctcataggggagagcaccatccg

SEQ ID NO: 333762 - DNA, 27 bp, Artificial Sequence
  Description of Artificial Sequence: Synthetic oligonucleotide
caacctcataggggagagcaccatccg

SEQ ID NO: 333763 - DNA, 27 bp, Artificial Sequence
  Description of Artificial Sequence: Synthetic oligonucleotide
aacctcataggggagagcaccatccgc

SEQ ID NO: 333764 - DNA, 27 bp, Artificial Sequence
  Description of Artificial Sequence: Synthetic oligonucleotide
acctcataggggagagcaccatccgct

SEQ ID NO: 333765 - DNA, 26 bp, Artificial Sequence
  Description of Artificial Sequence: Synthetic oligonucleotide
cctcataggggagagcaccatccgct

SEQ ID NO: 333766 - DNA, 26 bp, Artificial Sequence
  Description of Artificial Sequence: Synthetic oligonucleotide
ctcataggggagagcaccatccgctc

SEQ ID NO: 333767 - DNA, 27 bp, Artificial Sequence
  Description of Artificial Sequence: Synthetic oligonucleotide
tcataggggagagcaccatccgctcca

SEQ ID NO: 333768 - DNA, 26 bp, Artificial Sequence
  Description of Artificial Sequence: Synthetic oligonucleotide
cataggggagagcaccatccgctcca

SEQ ID NO: 333769 - DNA, 27 bp, Artificial Sequence
  Description of Artificial Sequence: Synthetic oligonucleotide
ataggggagagcaccatccgctccaca

SEQ ID NO: 333770 - DNA, 27 bp, Artificial Sequence
  Description of Artificial Sequence: Synthetic oligonucleotide
taggggagagcaccatccgctccacaa

SEQ ID NO: 333771 - DNA, 26 bp, Artificial Sequence
  Description of Artificial Sequence: Synthetic oligonucleotide
aggggagagcaccatccgctccacaa

SEQ ID NO: 333772 - DNA, 25 bp, Artificial Sequence
  Description of Artificial Sequence: Synthetic oligonucleotide
ggggagagcaccatccgctccacaa

SEQ ID NO: 333773 - DNA, 26 bp, Artificial Sequence
  Description of Artificial Sequence: Synthetic oligonucleotide
gggagagcaccatccgctccacaagt

SEQ ID NO: 333774 - DNA, 27 bp, Artificial Sequence
  Description of Artificial Sequence: Synthetic oligonucleotide
ggagagcaccatccgctccacaagtga

SEQ ID NO: 333775 - DNA, 27 bp, Artificial Sequence
  Description of Artificial Sequence: Synthetic oligonucleotide
gagagcaccatccgctccacaagtgag

SEQ ID NO: 333776 - DNA, 27 bp, Artificial Sequence
  Description of Artificial Sequence: Synthetic oligonucleotide
agagcaccatccgctccacaagtgagc

SEQ ID NO: 333777 - DNA, 26 bp, Artificial Sequence
  Description of Artificial Sequence: Synthetic oligonucleotide
gagcaccatccgctccacaagtgagc

SEQ ID NO: 333778 - DNA, 27 bp, Artificial Sequence
  Description of Artificial Sequence: Synthetic oligonucleotide
agcaccatccgctccacaagtgagcct

SEQ ID NO: 333779 - DNA, 26 bp, Artificial Sequence
  Description of Artificial Sequence: Synthetic oligonucleotide
gcaccatccgctccacaagtgagcct

SEQ ID NO: 333780 - DNA, 27 bp, Artificial Sequence
  Description of Artificial Sequence: Synthetic oligonucleotide
caccatccgctccacaagtgagcctca

SEQ ID NO: 333781 - DNA, 28 bp, Artificial Sequence
  Description of Artificial Sequence: Synthetic oligonucleotide
accatccgctccacaagtgagcctcaag

SEQ ID NO: 333782 - DNA, 24 bp, Artificial Sequence
  Description of Artificial Sequence: Synthetic oligonucleotide
agcagcccagcccctcgcagtgaa

SEQ ID NO: 333783 - DNA, 23 bp, Artificial Sequence
  Description of Artificial Sequence: Synthetic oligonucleotide
gcagcccagcccctcgcagtgaa

SEQ ID NO: 333784 - DNA, 26 bp, Artificial Sequence
  Description of Artificial Sequence: Synthetic oligonucleotide
cagcccagcccctcgcagtgaacttt

SEQ ID NO: 333785 - DNA, 27 bp, Artificial Sequence
  Description of Artificial Sequence: Synthetic oligonucleotide
agcccagcccctcgcagtgaactttgt

SEQ ID NO: 333786 - DNA, 26 bp, Artificial Sequence
  Description of Artificial Sequence: Synthetic oligonucleotide
gcccagcccctcgcagtgaactttgt

SEQ ID NO: 333787 - DNA, 27 bp, Artificial Sequence
  Description of Artificial Sequence: Synthetic oligonucleotide
cccagcccctcgcagtgaactttgtgt

SEQ ID NO: 333788 - DNA, 28 bp, Artificial Sequence
  Description of Artificial Sequence: Synthetic oligonucleotide
ccagcccctcgcagtgaactttgtgttc

SEQ ID NO: 333789 - DNA, 28 bp, Artificial Sequence
  Description of Artificial Sequence: Synthetic oligonucleotide
cagcccctcgcagtgaactttgtgttcc

SEQ ID NO: 333790 - DNA, 29 bp, Artificial Sequence
  Description of Artificial Sequence: Synthetic oligonucleotide
agcccctcgcagtgaactttgtgttcctg

SEQ ID NO: 333791 - DNA, 28 bp, Artificial Sequence
  Description of Artificial Sequence: Synthetic oligonucleotide
gcccctcgcagtgaactttgtgttcctg

SEQ ID NO: 333792 - DNA, 28 bp, Artificial Sequence
  Description of Artificial Sequence: Synthetic oligonucleotide
cccctcgcagtgaactttgtgttcctgc

SEQ ID NO: 333793 - DNA, 29 bp, Artificial Sequence
  Description of Artificial Sequence: Synthetic oligonucleotide
ccctcgcagtgaactttgtgttcctgcag

SEQ ID NO: 333794 - DNA, 29 bp, Artificial Sequence
  Description of Artificial Sequence: Synthetic oligonucleotide
cctcgcagtgaactttgtgttcctgcagc

SEQ ID NO: 333795 - DNA, 29 bp, Artificial Sequence
  Description of Artificial Sequence: Synthetic oligonucleotide
ctcgcagtgaactttgtgttcctgcagcc

SEQ ID NO: 333796 - DNA, 30 bp, Artificial Sequence
  Description of Artificial Sequence: Synthetic oligonucleotide
tcgcagtgaactttgtgttcctgcagcctg

SEQ ID NO: 333797 - DNA, 29 bp, Artificial Sequence
  Description of Artificial Sequence: Synthetic oligonucleotide
cgcagtgaactttgtgttcctgcagcctg

SEQ ID NO: 333798 - DNA, 29 bp, Artificial Sequence
  Description of Artificial Sequence: Synthetic oligonucleotide
gcagtgaactttgtgttcctgcagcctgc

SEQ ID NO: 333799 - DNA, 29 bp, Artificial Sequence
  Description of Artificial Sequence: Synthetic oligonucleotide
cagtgaactttgtgttcctgcagcctgcc

SEQ ID NO: 333800 - DNA, 29 bp, Artificial Sequence
  Description of Artificial Sequence: Synthetic oligonucleotide
agtgaactttgtgttcctgcagcctgccc

SEQ ID NO: 333801 - DNA, 28 bp, Artificial Sequence
  Description of Artificial Sequence: Synthetic oligonucleotide
gtgaactttgtgttcctgcagcctgccc

SEQ ID NO: 333802 - DNA, 29 bp, Artificial Sequence
  Description of Artificial Sequence: Synthetic oligonucleotide
tgaactttgtgttcctgcagcctgcccag

SEQ ID NO: 333803 - DNA, 28 bp, Artificial Sequence
  Description of Artificial Sequence: Synthetic oligonucleotide
gaactttgtgttcctgcagcctgcccag

SEQ ID NO: 333804 - DNA, 30 bp, Artificial Sequence
  Description of Artificial Sequence: Synthetic oligonucleotide
aactttgtgttcctgcagcctgcccagatc

SEQ ID NO: 333805 - DNA, 29 bp, Artificial Sequence
  Description of Artificial Sequence: Synthetic oligonucleotide
actttgtgttcctgcagcctgcccagatc

SEQ ID NO: 333806 - DNA, 28 bp, Artificial Sequence
  Description of Artificial Sequence: Synthetic oligonucleotide
ctttgtgttcctgcagcctgcccagatc

SEQ ID NO: 333807 - DNA, 28 bp, Artificial Sequence
  Description of Artificial Sequence: Synthetic oligonucleotide
tttgtgttcctgcagcctgcccagatcc

SEQ ID NO: 333808 - DNA, 27 bp, Artificial Sequence
  Description of Artificial Sequence: Synthetic oligonucleotide
ttgtgttcctgcagcctgcccagatcc

SEQ ID NO: 333809 - DNA, 27 bp, Artificial Sequence
  Description of Artificial Sequence: Synthetic oligonucleotide
tgtgttcctgcagcctgcccagatcca

SEQ ID NO: 333810 - DNA, 26 bp, Artificial Sequence
  Description of Artificial Sequence: Synthetic oligonucleotide
gtgttcctgcagcctgcccagatcca

SEQ ID NO: 333811 - DNA, 26 bp, Artificial Sequence
  Description of Artificial Sequence: Synthetic oligonucleotide
tgttcctgcagcctgcccagatccac

SEQ ID NO: 333812 - DNA, 25 bp, Artificial Sequence
  Description of Artificial Sequence: Synthetic oligonucleotide
gttcctgcagcctgcccagatccac

SEQ ID NO: 333813 - DNA, 25 bp, Artificial Sequence
  Description of Artificial Sequence: Synthetic oligonucleotide
ttcctgcagcctgcccagatccacc

SEQ ID NO: 333814 - DNA, 24 bp, Artificial Sequence
  Description of Artificial Sequence: Synthetic oligonucleotide
tcctgcagcctgcccagatccacc

SEQ ID NO: 333815 - DNA, 23 bp, Artificial Sequence
  Description of Artificial Sequence: Synthetic oligonucleotide
cctgcagcctgcccagatccacc

SEQ ID NO: 333816 - DNA, 25 bp, Artificial Sequence
  Description of Artificial Sequence: Synthetic oligonucleotide
ctgcagcctgcccagatccacccat

SEQ ID NO: 333817 - DNA, 27 bp, Artificial Sequence
  Description of Artificial Sequence: Synthetic oligonucleotide
tgcagcctgcccagatccacccatgat

SEQ ID NO: 333818 - DNA, 26 bp, Artificial Sequence
  Description of Artificial Sequence: Synthetic oligonucleotide
gcagcctgcccagatccacccatgat

SEQ ID NO: 333819 - DNA, 26 bp, Artificial Sequence
  Description of Artificial Sequence: Synthetic oligonucleotide
cagcctgcccagatccacccatgatc

SEQ ID NO: 333820 - DNA, 27 bp, Artificial Sequence
  Description of Artificial Sequence: Synthetic oligonucleotide
agcctgcccagatccacccatgatcca

SEQ ID NO: 333821 - DNA, 27 bp, Artificial Sequence
  Description of Artificial Sequence: Synthetic oligonucleotide
gcctgcccagatccacccatgatccaa

SEQ ID NO: 333822 - DNA, 29 bp, Artificial Sequence
  Description of Artificial Sequence: Synthetic oligonucleotide
cctgcccagatccacccatgatccaaaag

SEQ ID NO: 333823 - DNA, 29 bp, Artificial Sequence
  Description of Artificial Sequence: Synthetic oligonucleotide
ctgcccagatccacccatgatccaaaagg

SEQ ID NO: 333824 - DNA, 29 bp, Artificial Sequence
  Description of Artificial Sequence: Synthetic oligonucleotide
tgcccagatccacccatgatccaaaaggg

SEQ ID NO: 333825 - DNA, 28 bp, Artificial Sequence
  Description of Artificial Sequence: Synthetic oligonucleotide
gcccagatccacccatgatccaaaaggg

SEQ ID NO: 333826 - DNA, 28 bp, Artificial Sequence
  Description of Artificial Sequence: Synthetic oligonucleotide
cccagatccacccatgatccaaaagggg

SEQ ID NO: 333827 - DNA, 28 bp, Artificial Sequence
  Description of Artificial Sequence: Synthetic oligonucleotide
ccagatccacccatgatccaaaaggggc

SEQ ID NO: 333828 - DNA, 32 bp, Artificial Sequence
  Description of Artificial Sequence: Synthetic oligonucleotide
cagatccacccatgatccaaaaggggcattac

SEQ ID NO: 333829 - DNA, 35 bp, Artificial Sequence
  Description of Artificial Sequence: Synthetic oligonucleotide
agatccacccatgatccaaaaggggcattactttg

SEQ ID NO: 333830 - DNA, 34 bp, Artificial Sequence
  Description of Artificial Sequence: Synthetic oligonucleotide
gatccacccatgatccaaaaggggcattactttg

SEQ ID NO: 333831 - DNA, 34 bp, Artificial Sequence
  Description of Artificial Sequence: Synthetic oligonucleotide
atccacccatgatccaaaaggggcattactttgg

SEQ ID NO: 333832 - DNA, 33 bp, Artificial Sequence
  Description of Artificial Sequence: Synthetic oligonucleotide
tccacccatgatccaaaaggggcattactttgg

SEQ ID NO: 333833 - DNA, 32 bp, Artificial Sequence
  Description of Artificial Sequence: Synthetic oligonucleotide
ccacccatgatccaaaaggggcattactttgg

SEQ ID NO: 333834 - DNA, 33 bp, Artificial Sequence
  Description of Artificial Sequence: Synthetic oligonucleotide
cacccatgatccaaaaggggcattactttggag

SEQ ID NO: 333835 - DNA, 33 bp, Artificial Sequence
  Description of Artificial Sequence: Synthetic oligonucleotide
acccatgatccaaaaggggcattactttggagg

SEQ ID NO: 333836 - DNA, 32 bp, Artificial Sequence
  Description of Artificial Sequence: Synthetic oligonucleotide
cccatgatccaaaaggggcattactttggagg

SEQ ID NO: 333837 - DNA, 33 bp, Artificial Sequence
  Description of Artificial Sequence: Synthetic oligonucleotide
ccatgatccaaaaggggcattactttggaggac

SEQ ID NO: 333838 - DNA, 34 bp, Artificial Sequence
  Description of Artificial Sequence: Synthetic oligonucleotide
catgatccaaaaggggcattactttggaggactc

SEQ ID NO: 333839 - DNA, 34 bp, Artificial Sequence
  Description of Artificial Sequence: Synthetic oligonucleotide
atgatccaaaaggggcattactttggaggactcg

SEQ ID NO: 333840 - DNA, 33 bp, Artificial Sequence
  Description of Artificial Sequence: Synthetic oligonucleotide
tgatccaaaaggggcattactttggaggactcg

SEQ ID NO: 333841 - DNA, 32 bp, Artificial Sequence
  Description of Artificial Sequence: Synthetic oligonucleotide
gatccaaaaggggcattactttggaggactcg

SEQ ID NO: 333842 - DNA, 35 bp, Artificial Sequence
  Description of Artificial Sequence: Synthetic oligonucleotide
atccaaaaggggcattactttggaggactcgtatc

SEQ ID NO: 333843 - DNA, 34 bp, Artificial Sequence
  Description of Artificial Sequence: Synthetic oligonucleotide
tccaaaaggggcattactttggaggactcgtatc

SEQ ID NO: 333844 - DNA, 33 bp, Artificial Sequence
  Description of Artificial Sequence: Synthetic oligonucleotide
ccaaaaggggcattactttggaggactcgtatc

SEQ ID NO: 333845 - DNA, 34 bp, Artificial Sequence
  Description of Artificial Sequence: Synthetic oligonucleotide
caaaaggggcattactttggaggactcgtatctc

SEQ ID NO: 333846 - DNA, 39 bp, Artificial Sequence
  Description of Artificial Sequence: Synthetic oligonucleotide
aaaaggggcattactttggaggactcgtatctctttatc

SEQ ID NO: 333847 - DNA, 38 bp, Artificial Sequence
  Description of Artificial Sequence: Synthetic oligonucleotide
aaaggggcattactttggaggactcgtatctctttatc

SEQ ID NO: 333848 - DNA, 37 bp, Artificial Sequence
  Description of Artificial Sequence: Synthetic oligonucleotide
aaggggcattactttggaggactcgtatctctttatc

SEQ ID NO: 333849 - DNA, 36 bp, Artificial Sequence
  Description of Artificial Sequence: Synthetic oligonucleotide
aggggcattactttggaggactcgtatctctttatc

SEQ ID NO: 333850 - DNA, 35 bp, Artificial Sequence
  Description of Artificial Sequence: Synthetic oligonucleotide
ggggcattactttggaggactcgtatctctttatc

SEQ ID NO: 333851 - DNA, 37 bp, Artificial Sequence
  Description of Artificial Sequence: Synthetic oligonucleotide
gggcattactttggaggactcgtatctctttatcttc

SEQ ID NO: 333852 - DNA, 37 bp, Artificial Sequence
  Description of Artificial Sequence: Synthetic oligonucleotide
ggcattactttggaggactcgtatctctttatcttcc

SEQ ID NO: 333853 - DNA, 38 bp, Artificial Sequence
  Description of Artificial Sequence: Synthetic oligonucleotide
gcattactttggaggactcgtatctctttatcttcctc

SEQ ID NO: 333854 - DNA, 38 bp, Artificial Sequence
  Description of Artificial Sequence: Synthetic oligonucleotide
cattactttggaggactcgtatctctttatcttcctcg

SEQ ID NO: 333855 - DNA, 38 bp, Artificial Sequence
  Description of Artificial Sequence: Synthetic oligonucleotide
attactttggaggactcgtatctctttatcttcctcgg

SEQ ID NO: 333856 - DNA, 37 bp, Artificial Sequence
  Description of Artificial Sequence: Synthetic oligonucleotide
ttactttggaggactcgtatctctttatcttcctcgg

SEQ ID NO: 333857 - DNA, 36 bp, Artificial Sequence
  Description of Artificial Sequence: Synthetic oligonucleotide
tactttggaggactcgtatctctttatcttcctcgg

SEQ ID NO: 333858 - DNA, 35 bp, Artificial Sequence
  Description of Artificial Sequence: Synthetic oligonucleotide
actttggaggactcgtatctctttatcttcctcgg

SEQ ID NO: 333859 - DNA, 34 bp, Artificial Sequence
  Description of Artificial Sequence: Synthetic oligonucleotide
ctttggaggactcgtatctctttatcttcctcgg

SEQ ID NO: 333860 - DNA, 36 bp, Artificial Sequence
  Description of Artificial Sequence: Synthetic oligonucleotide
tttggaggactcgtatctctttatcttcctcggatg

SEQ ID NO: 333861 - DNA, 35 bp, Artificial Sequence
  Description of Artificial Sequence: Synthetic oligonucleotide
ttggaggactcgtatctctttatcttcctcggatg

SEQ ID NO: 333862 - DNA, 34 bp, Artificial Sequence
  Description of Artificial Sequence: Synthetic oligonucleotide
tggaggactcgtatctctttatcttcctcggatg

SEQ ID NO: 333863 - DNA, 33 bp, Artificial Sequence
  Description of Artificial Sequence: Synthetic oligonucleotide
ggaggactcgtatctctttatcttcctcggatg

SEQ ID NO: 333864 - DNA, 34 bp, Artificial Sequence
  Description of Artificial Sequence: Synthetic oligonucleotide
gaggactcgtatctctttatcttcctcggatgac

SEQ ID NO: 333865 - DNA, 37 bp, Artificial Sequence
  Description of Artificial Sequence: Synthetic oligonucleotide
aggactcgtatctctttatcttcctcggatgacaaac

SEQ ID NO: 333866 - DNA, 36 bp, Artificial Sequence
  Description of Artificial Sequence: Synthetic oligonucleotide
ggactcgtatctctttatcttcctcggatgacaaac

SEQ ID NO: 333867 - DNA, 37 bp, Artificial Sequence
  Description of Artificial Sequence: Synthetic oligonucleotide
gactcgtatctctttatcttcctcggatgacaaacag

SEQ ID NO: 333868 - DNA, 37 bp, Artificial Sequence
  Description of Artificial Sequence: Synthetic oligonucleotide
actcgtatctctttatcttcctcggatgacaaacagc

SEQ ID NO: 333869 - DNA, 36 bp, Artificial Sequence
  Description of Artificial Sequence: Synthetic oligonucleotide
ctcgtatctctttatcttcctcggatgacaaacagc

SEQ ID NO: 333870 - DNA, 38 bp, Artificial Sequence
  Description of Artificial Sequence: Synthetic oligonucleotide
tcgtatctctttatcttcctcggatgacaaacagctac

SEQ ID NO: 333871 - DNA, 37 bp, Artificial Sequence
  Description of Artificial Sequence: Synthetic oligonucleotide
cgtatctctttatcttcctcggatgacaaacagctac

SEQ ID NO: 333872 - DNA, 41 bp, Artificial Sequence
  Description of Artificial Sequence: Synthetic oligonucleotide
gtatctctttatcttcctcggatgacaaacagctacatatg

SEQ ID NO: 333873 - DNA, 42 bp, Artificial Sequence
  Description of Artificial Sequence: Synthetic oligonucleotide
tatctctttatcttcctcggatgacaaacagctacatatgtg

SEQ ID NO: 333874 - DNA, 41 bp, Artificial Sequence
  Description of Artificial Sequence: Synthetic oligonucleotide
atctctttatcttcctcggatgacaaacagctacatatgtg

SEQ ID NO: 333875 - DNA, 40 bp, Artificial Sequence
  Description of Artificial Sequence: Synthetic oligonucleotide
tctctttatcttcctcggatgacaaacagctacatatgtg

SEQ ID NO: 333876 - DNA, 39 bp, Artificial Sequence
  Description of Artificial Sequence: Synthetic oligonucleotide
ctctttatcttcctcggatgacaaacagctacatatgtg

SEQ ID NO: 333877 - DNA, 40 bp, Artificial Sequence
  Description of Artificial Sequence: Synthetic oligonucleotide
tctttatcttcctcggatgacaaacagctacatatgtgac

SEQ ID NO: 333878 - DNA, 39 bp, Artificial Sequence
  Description of Artificial Sequence: Synthetic oligonucleotide
ctttatcttcctcggatgacaaacagctacatatgtgac

SEQ ID NO: 333879 - DNA, 39 bp, Artificial Sequence
  Description of Artificial Sequence: Synthetic oligonucleotide
tttatcttcctcggatgacaaacagctacatatgtgacc

SEQ ID NO: 333880 - DNA, 38 bp, Artificial Sequence
  Description of Artificial Sequence: Synthetic oligonucleotide
ttatcttcctcggatgacaaacagctacatatgtgacc

SEQ ID NO: 333881 - DNA, 37 bp, Artificial Sequence
  Description of Artificial Sequence: Synthetic oligonucleotide
tatcttcctcggatgacaaacagctacatatgtgacc

SEQ ID NO: 333882 - DNA, 36 bp, Artificial Sequence
  Description of Artificial Sequence: Synthetic oligonucleotide
atcttcctcggatgacaaacagctacatatgtgacc

SEQ ID NO: 333883 - DNA, 35 bp, Artificial Sequence
  Description of Artificial Sequence: Synthetic oligonucleotide
tcttcctcggatgacaaacagctacatatgtgacc

SEQ ID NO: 333884 - DNA, 34 bp, Artificial Sequence
  Description of Artificial Sequence: Synthetic oligonucleotide
cttcctcggatgacaaacagctacatatgtgacc

SEQ ID NO: 333885 - DNA, 34 bp, Artificial Sequence
  Description of Artificial Sequence: Synthetic oligonucleotide
ttcctcggatgacaaacagctacatatgtgaccc

SEQ ID NO: 333886 - DNA, 33 bp, Artificial Sequence
  Description of Artificial Sequence: Synthetic oligonucleotide
tcctcggatgacaaacagctacatatgtgaccc

SEQ ID NO: 333887 - DNA, 32 bp, Artificial Sequence
  Description of Artificial Sequence: Synthetic oligonucleotide
cctcggatgacaaacagctacatatgtgaccc

SEQ ID NO: 333888 - DNA, 32 bp, Artificial Sequence
  Description of Artificial Sequence: Synthetic oligonucleotide
ctcggatgacaaacagctacatatgtgacccc

SEQ ID NO: 333889 - DNA, 32 bp, Artificial Sequence
  Description of Artificial Sequence: Synthetic oligonucleotide
tcggatgacaaacagctacatatgtgaccccc

SEQ ID NO: 333890 - DNA, 31 bp, Artificial Sequence
  Description of Artificial Sequence: Synthetic oligonucleotide
cggatgacaaacagctacatatgtgaccccc

SEQ ID NO: 333891 - DNA, 31 bp, Artificial Sequence
  Description of Artificial Sequence: Synthetic oligonucleotide
ggatgacaaacagctacatatgtgacccccg

SEQ ID NO: 333892 - DNA, 31 bp, Artificial Sequence
  Description of Artificial Sequence: Synthetic oligonucleotide
gatgacaaacagctacatatgtgacccccgc

SEQ ID NO: 333893 - DNA, 33 bp, Artificial Sequence
  Description of Artificial Sequence: Synthetic oligonucleotide
atgacaaacagctacatatgtgacccccgctac

SEQ ID NO: 333894 - DNA, 32 bp, Artificial Sequence
  Description of Artificial Sequence: Synthetic oligonucleotide
tgacaaacagctacatatgtgacccccgctac

SEQ ID NO: 333895 - DNA, 31 bp, Artificial Sequence
  Description of Artificial Sequence: Synthetic oligonucleotide
gacaaacagctacatatgtgacccccgctac

SEQ ID NO: 333896 - DNA, 31 bp, Artificial Sequence
  Description of Artificial Sequence: Synthetic oligonucleotide
acaaacagctacatatgtgacccccgctacc

SEQ ID NO: 333897 - DNA, 30 bp, Artificial Sequence
  Description of Artificial Sequence: Synthetic oligonucleotide
caaacagctacatatgtgacccccgctacc

SEQ ID NO: 333898 - DNA, 31 bp, Artificial Sequence
  Description of Artificial Sequence: Synthetic oligonucleotide
aaacagctacatatgtgacccccgctacctg

SEQ ID NO: 333899 - DNA, 30 bp, Artificial Sequence
  Description of Artificial Sequence: Synthetic oligonucleotide
aacagctacatatgtgacccccgctacctg

SEQ ID NO: 333900 - DNA, 29 bp, Artificial Sequence
  Description of Artificial Sequence: Synthetic oligonucleotide
acagctacatatgtgacccccgctacctg

SEQ ID NO: 333901 - DNA, 28 bp, Artificial Sequence
  Description of Artificial Sequence: Synthetic oligonucleotide
cagctacatatgtgacccccgctacctg

SEQ ID NO: 333902 - DNA, 31 bp, Artificial Sequence
  Description of Artificial Sequence: Synthetic oligonucleotide
agctacatatgtgacccccgctacctgtaag

SEQ ID NO: 333903 - DNA, 30 bp, Artificial Sequence
  Description of Artificial Sequence: Synthetic oligonucleotide
gctacatatgtgacccccgctacctgtaag

SEQ ID NO: 333904 - DNA, 31 bp, Artificial Sequence
  Description of Artificial Sequence: Synthetic oligonucleotide
ctacatatgtgacccccgctacctgtaagtg

SEQ ID NO: 333905 - DNA, 31 bp, Artificial Sequence
  Description of Artificial Sequence: Synthetic oligonucleotide
tacatatgtgacccccgctacctgtaagtgg

SEQ ID NO: 333906 - DNA, 30 bp, Artificial Sequence
  Description of Artificial Sequence: Synthetic oligonucleotide
acatatgtgacccccgctacctgtaagtgg

SEQ ID NO: 333907 - DNA, 29 bp, Artificial Sequence
  Description of Artificial Sequence: Synthetic oligonucleotide
catatgtgacccccgctacctgtaagtgg

SEQ ID NO: 333908 - DNA, 29 bp, Artificial Sequence
  Description of Artificial Sequence: Synthetic oligonucleotide
atatgtgacccccgctacctgtaagtggg

SEQ ID NO: 333909 - DNA, 28 bp, Artificial Sequence
  Description of Artificial Sequence: Synthetic oligonucleotide
tatgtgacccccgctacctgtaagtggg

SEQ ID NO: 333910 - DNA, 27 bp, Artificial Sequence
  Description of Artificial Sequence: Synthetic oligonucleotide
atgtgacccccgctacctgtaagtggg

SEQ ID NO: 333911 - DNA, 27 bp, Artificial Sequence
  Description of Artificial Sequence: Synthetic oligonucleotide
tgtgacccccgctacctgtaagtggga

SEQ ID NO: 333912 - DNA, 27 bp, Artificial Sequence
  Description of Artificial Sequence: Synthetic oligonucleotide
gtgacccccgctacctgtaagtgggaa

SEQ ID NO: 333913 - DNA, 28 bp, Artificial Sequence
  Description of Artificial Sequence: Synthetic oligonucleotide
tgacccccgctacctgtaagtgggaaac

SEQ ID NO: 333914 - DNA, 27 bp, Artificial Sequence
  Description of Artificial Sequence: Synthetic oligonucleotide
gacccccgctacctgtaagtgggaaac

SEQ ID NO: 333915 - DNA, 27 bp, Artificial Sequence
  Description of Artificial Sequence: Synthetic oligonucleotide
acccccgctacctgtaagtgggaaacg

SEQ ID NO: 333916 - DNA, 26 bp, Artificial Sequence
  Description of Artificial Sequence: Synthetic oligonucleotide
cccccgctacctgtaagtgggaaacg

SEQ ID NO: 333917 - DNA, 26 bp, Artificial Sequence
  Description of Artificial Sequence: Synthetic oligonucleotide
ccccgctacctgtaagtgggaaacgg

SEQ ID NO: 333918 - DNA, 27 bp, Artificial Sequence
  Description of Artificial Sequence: Synthetic oligonucleotide
cccgctacctgtaagtgggaaacggct

SEQ ID NO: 333919 - DNA, 28 bp, Artificial Sequence
  Description of Artificial Sequence: Synthetic oligonucleotide
ccgctacctgtaagtgggaaacggcttc

SEQ ID NO: 333920 - DNA, 33 bp, Artificial Sequence
  Description of Artificial Sequence: Synthetic oligonucleotide
cgctacctgtaagtgggaaacggcttcattatc

SEQ ID NO: 333921 - DNA, 34 bp, Artificial Sequence
  Description of Artificial Sequence: Synthetic oligonucleotide
gctacctgtaagtgggaaacggcttcattatctg

SEQ ID NO: 333922 - DNA, 36 bp, Artificial Sequence
  Description of Artificial Sequence: Synthetic oligonucleotide
ctacctgtaagtgggaaacggcttcattatctgtac

SEQ ID NO: 333923 - DNA, 37 bp, Artificial Sequence
  Description of Artificial Sequence: Synthetic oligonucleotide
tacctgtaagtgggaaacggcttcattatctgtacag

SEQ ID NO: 333924 - DNA, 36 bp, Artificial Sequence
  Description of Artificial Sequence: Synthetic oligonucleotide
acctgtaagtgggaaacggcttcattatctgtacag

SEQ ID NO: 333925 - DNA, 35 bp, Artificial Sequence
  Description of Artificial Sequence: Synthetic oligonucleotide
cctgtaagtgggaaacggcttcattatctgtacag

SEQ ID NO: 333926 - DNA, 36 bp, Artificial Sequence
  Description of Artificial Sequence: Synthetic oligonucleotide
ctgtaagtgggaaacggcttcattatctgtacagtc

SEQ ID NO: 333927 - DNA, 36 bp, Artificial Sequence
  Description of Artificial Sequence: Synthetic oligonucleotide
tgtaagtgggaaacggcttcattatctgtacagtcc

SEQ ID NO: 333928 - DNA, 35 bp, Artificial Sequence
  Description of Artificial Sequence: Synthetic oligonucleotide
gtaagtgggaaacggcttcattatctgtacagtcc

SEQ ID NO: 333929 - DNA, 36 bp, Artificial Sequence
  Description of Artificial Sequence: Synthetic oligonucleotide
taagtgggaaacggcttcattatctgtacagtccag

SEQ ID NO: 333930 - DNA, 35 bp, Artificial Sequence
  Description of Artificial Sequence: Synthetic oligonucleotide
aagtgggaaacggcttcattatctgtacagtccag

SEQ ID NO: 333931 - DNA, 34 bp, Artificial Sequence
  Description of Artificial Sequence: Synthetic oligonucleotide
agtgggaaacggcttcattatctgtacagtccag

SEQ ID NO: 333932 - DNA, 33 bp, Artificial Sequence
  Description of Artificial Sequence: Synthetic oligonucleotide
gtgggaaacggcttcattatctgtacagtccag

SEQ ID NO: 333933 - DNA, 33 bp, Artificial Sequence
  Description of Artificial Sequence: Synthetic oligonucleotide
tgggaaacggcttcattatctgtacagtccagg

SEQ ID NO: 333934 - DNA, 32 bp, Artificial Sequence
  Description of Artificial Sequence: Synthetic oligonucleotide
gggaaacggcttcattatctgtacagtccagg

SEQ ID NO: 333935 - DNA, 32 bp, Artificial Sequence
  Description of Artificial Sequence: Synthetic oligonucleotide
ggaaacggcttcattatctgtacagtccaggg

SEQ ID NO: 333936 - DNA, 35 bp, Artificial Sequence
  Description of Artificial Sequence: Synthetic oligonucleotide
gaaacggcttcattatctgtacagtccagggaatg

SEQ ID NO: 333937 - DNA, 36 bp, Artificial Sequence
  Description of Artificial Sequence: Synthetic oligonucleotide
aaacggcttcattatctgtacagtccagggaatgtg

SEQ ID NO: 333938 - DNA, 35 bp, Artificial Sequence
  Description of Artificial Sequence: Synthetic oligonucleotide
aacggcttcattatctgtacagtccagggaatgtg

SEQ ID NO: 333939 - DNA, 34 bp, Artificial Sequence
  Description of Artificial Sequence: Synthetic oligonucleotide
acggcttcattatctgtacagtccagggaatgtg

SEQ ID NO: 333940 - DNA, 33 bp, Artificial Sequence
  Description of Artificial Sequence: Synthetic oligonucleotide
cggcttcattatctgtacagtccagggaatgtg

SEQ ID NO: 333941 - DNA, 33 bp, Artificial Sequence
  Description of Artificial Sequence: Synthetic oligonucleotide
ggcttcattatctgtacagtccagggaatgtgg

SEQ ID NO: 333942 - DNA, 34 bp, Artificial Sequence
  Description of Artificial Sequence: Synthetic oligonucleotide
gcttcattatctgtacagtccagggaatgtggag

SEQ ID NO: 333943 - DNA, 34 bp, Artificial Sequence
  Description of Artificial Sequence: Synthetic oligonucleotide
cttcattatctgtacagtccagggaatgtggagc

SEQ ID NO: 333944 - DNA, 34 bp, Artificial Sequence
  Description of Artificial Sequence: Synthetic oligonucleotide
ttcattatctgtacagtccagggaatgtggagcc

SEQ ID NO: 333945 - DNA, 33 bp, Artificial Sequence
  Description of Artificial Sequence: Synthetic oligonucleotide
tcattatctgtacagtccagggaatgtggagcc

SEQ ID NO: 333946 - DNA, 32 bp, Artificial Sequence
  Description of Artificial Sequence: Synthetic oligonucleotide
cattatctgtacagtccagggaatgtggagcc

SEQ ID NO: 333947 - DNA, 36 bp, Artificial Sequence
  Description of Artificial Sequence: Synthetic oligonucleotide
attatctgtacagtccagggaatgtggagccaaatg

SEQ ID NO: 333948 - DNA, 35 bp, Artificial Sequence
  Description of Artificial Sequence: Synthetic oligonucleotide
ttatctgtacagtccagggaatgtggagccaaatg

SEQ ID NO: 333949 - DNA, 34 bp, Artificial Sequence
  Description of Artificial Sequence: Synthetic oligonucleotide
tatctgtacagtccagggaatgtggagccaaatg

SEQ ID NO: 333950 - DNA, 33 bp, Artificial Sequence
  Description of Artificial Sequence: Synthetic oligonucleotide
atctgtacagtccagggaatgtggagccaaatg

SEQ ID NO: 333951 - DNA, 32 bp, Artificial Sequence
  Description of Artificial Sequence: Synthetic oligonucleotide
tctgtacagtccagggaatgtggagccaaatg

SEQ ID NO: 333952 - DNA, 31 bp, Artificial Sequence
  Description of Artificial Sequence: Synthetic oligonucleotide
ctgtacagtccagggaatgtggagccaaatg

SEQ ID NO: 333953 - DNA, 31 bp, Artificial Sequence
  Description of Artificial Sequence: Synthetic oligonucleotide
tgtacagtccagggaatgtggagccaaatgg

SEQ ID NO: 333954 - DNA, 30 bp, Artificial Sequence
  Description of Artificial Sequence: Synthetic oligonucleotide
gtacagtccagggaatgtggagccaaatgg

SEQ ID NO: 333955 - DNA, 32 bp, Artificial Sequence
  Description of Artificial Sequence: Synthetic oligonucleotide
tacagtccagggaatgtggagccaaatggatc

SEQ ID NO: 333956 - DNA, 31 bp, Artificial Sequence
  Description of Artificial Sequence: Synthetic oligonucleotide
acagtccagggaatgtggagccaaatggatc

SEQ ID NO: 333957 - DNA, 30 bp, Artificial Sequence
  Description of Artificial Sequence: Synthetic oligonucleotide
cagtccagggaatgtggagccaaatggatc

SEQ ID NO: 333958 - DNA, 36 bp, Artificial Sequence
  Description of Artificial Sequence: Synthetic oligonucleotide
agtccagggaatgtggagccaaatggatcatttttg

SEQ ID NO: 333959 - DNA, 35 bp, Artificial Sequence
  Description of Artificial Sequence: Synthetic oligonucleotide
gtccagggaatgtggagccaaatggatcatttttg

SEQ ID NO: 333960 - DNA, 35 bp, Artificial Sequence
  Description of Artificial Sequence: Synthetic oligonucleotide
tccagggaatgtggagccaaatggatcatttttgc

SEQ ID NO: 333961 - DNA, 34 bp, Artificial Sequence
  Description of Artificial Sequence: Synthetic oligonucleotide
ccagggaatgtggagccaaatggatcatttttgc

SEQ ID NO: 333962 - DNA, 37 bp, Artificial Sequence
  Description of Artificial Sequence: Synthetic oligonucleotide
cagggaatgtggagccaaatggatcatttttgcaaag

SEQ ID NO: 333963 - DNA, 39 bp, Artificial Sequence
  Description of Artificial Sequence: Synthetic oligonucleotide
agggaatgtggagccaaatggatcatttttgcaaagatg

SEQ ID NO: 333964 - DNA, 38 bp, Artificial Sequence
  Description of Artificial Sequence: Synthetic oligonucleotide
gggaatgtggagccaaatggatcatttttgcaaagatg

SEQ ID NO: 333965 - DNA, 44 bp, Artificial Sequence
  Description of Artificial Sequence: Synthetic oligonucleotide
ggaatgtggagccaaatggatcatttttgcaaagatgtaaattg

SEQ ID NO: 333966 - DNA, 46 bp, Artificial Sequence
  Description of Artificial Sequence: Synthetic oligonucleotide
gaatgtggagccaaatggatcatttttgcaaagatgtaaattgttg

SEQ ID NO: 333967 - DNA, 46 bp, Artificial Sequence
  Description of Artificial Sequence: Synthetic oligonucleotide
aatgtggagccaaatggatcatttttgcaaagatgtaaattgttgc

SEQ ID NO: 333968 - DNA, 45 bp, Artificial Sequence
  Description of Artificial Sequence: Synthetic oligonucleotide
atgtggagccaaatggatcatttttgcaaagatgtaaattgttgc

SEQ ID NO: 333969 - DNA, 44 bp, Artificial Sequence
  Description of Artificial Sequence: Synthetic oligonucleotide
tgtggagccaaatggatcatttttgcaaagatgtaaattgttgc

SEQ ID NO: 333970 - DNA, 43 bp, Artificial Sequence
  Description of Artificial Sequence: Synthetic oligonucleotide
gtggagccaaatggatcatttttgcaaagatgtaaattgttgc

SEQ ID NO: 333971 - DNA, 45 bp, Artificial Sequence
  Description of Artificial Sequence: Synthetic oligonucleotide
tggagccaaatggatcatttttgcaaagatgtaaattgttgcttc

SEQ ID NO: 333972 - DNA, 44 bp, Artificial Sequence
  Description of Artificial Sequence: Synthetic oligonucleotide
ggagccaaatggatcatttttgcaaagatgtaaattgttgcttc

SEQ ID NO: 333973 - DNA, 44 bp, Artificial Sequence
  Description of Artificial Sequence: Synthetic oligonucleotide
gagccaaatggatcatttttgcaaagatgtaaattgttgcttcc

SEQ ID NO: 333974 - DNA, 44 bp, Artificial Sequence
  Description of Artificial Sequence: Synthetic oligonucleotide
agccaaatggatcatttttgcaaagatgtaaattgttgcttccc

SEQ ID NO: 333975 - DNA, 43 bp, Artificial Sequence
  Description of Artificial Sequence: Synthetic oligonucleotide
gccaaatggatcatttttgcaaagatgtaaattgttgcttccc

SEQ ID NO: 333976 - DNA, 44 bp, Artificial Sequence
  Description of Artificial Sequence: Synthetic oligonucleotide
ccaaatggatcatttttgcaaagatgtaaattgttgcttcccac

SEQ ID NO: 333977 - DNA, 45 bp, Artificial Sequence
  Description of Artificial Sequence: Synthetic oligonucleotide
caaatggatcatttttgcaaagatgtaaattgttgcttcccacag

SEQ ID NO: 333978 - DNA, 50 bp, Artificial Sequence
  Description of Artificial Sequence: Synthetic oligonucleotide
aaatggatcatttttgcaaagatgtaaattgttgcttcccacagtttatg

SEQ ID NO: 333979 - DNA, 49 bp, Artificial Sequence
  Description of Artificial Sequence: Synthetic oligonucleotide
aatggatcatttttgcaaagatgtaaattgttgcttcccacagtttatg

SEQ ID NO: 333980 - DNA, 48 bp, Artificial Sequence
  Description of Artificial Sequence: Synthetic oligonucleotide
atggatcatttttgcaaagatgtaaattgttgcttcccacagtttatg

SEQ ID NO: 333981 - DNA, 47 bp, Artificial Sequence
  Description of Artificial Sequence: Synthetic oligonucleotide
tggatcatttttgcaaagatgtaaattgttgcttcccacagtttatg

SEQ ID NO: 333982 - DNA, 46 bp, Artificial Sequence
  Description of Artificial Sequence: Synthetic oligonucleotide
ggatcatttttgcaaagatgtaaattgttgcttcccacagtttatg

SEQ ID NO: 333983 - DNA, 49 bp, Artificial Sequence
  Description of Artificial Sequence: Synthetic oligonucleotide
gatcatttttgcaaagatgtaaattgttgcttcccacagtttatgaaag

SEQ ID NO: 333984 - DNA, 49 bp, Artificial Sequence
  Description of Artificial Sequence: Synthetic oligonucleotide
atcatttttgcaaagatgtaaattgttgcttcccacagtttatgaaagg

SEQ ID NO: 333985 - DNA, 48 bp, Artificial Sequence
  Description of Artificial Sequence: Synthetic oligonucleotide
tcatttttgcaaagatgtaaattgttgcttcccacagtttatgaaagg

SEQ ID NO: 333986 - DNA, 47 bp, Artificial Sequence
  Description of Artificial Sequence: Synthetic oligonucleotide
catttttgcaaagatgtaaattgttgcttcccacagtttatgaaagg

SEQ ID NO: 333987 - DNA, 50 bp, Artificial Sequence
  Description of Artificial Sequence: Synthetic oligonucleotide
atttttgcaaagatgtaaattgttgcttcccacagtttatgaaaggaatc

SEQ ID NO: 333988 - DNA, 49 bp, Artificial Sequence
  Description of Artificial Sequence: Synthetic oligonucleotide
tttttgcaaagatgtaaattgttgcttcccacagtttatgaaaggaatc

SEQ ID NO: 333989 - DNA, 48 bp, Artificial Sequence
  Description of Artificial Sequence: Synthetic oligonucleotide
ttttgcaaagatgtaaattgttgcttcccacagtttatgaaaggaatc

SEQ ID NO: 333990 - DNA, 47 bp, Artificial Sequence
  Description of Artificial Sequence: Synthetic oligonucleotide
tttgcaaagatgtaaattgttgcttcccacagtttatgaaaggaatc

SEQ ID NO: 333991 - DNA, 46 bp, Artificial Sequence
  Description of Artificial Sequence: Synthetic oligonucleotide
ttgcaaagatgtaaattgttgcttcccacagtttatgaaaggaatc

SEQ ID NO: 333992 - DNA, 45 bp, Artificial Sequence
  Description of Artificial Sequence: Synthetic oligonucleotide
tgcaaagatgtaaattgttgcttcccacagtttatgaaaggaatc

SEQ ID NO: 333993 - DNA, 44 bp, Artificial Sequence
  Description of Artificial Sequence: Synthetic oligonucleotide
gcaaagatgtaaattgttgcttcccacagtttatgaaaggaatc

SEQ ID NO: 333994 - DNA, 45 bp, Artificial Sequence
  Description of Artificial Sequence: Synthetic oligonucleotide
caaagatgtaaattgttgcttcccacagtttatgaaaggaatctc

SEQ ID NO: 333995 - DNA, 45 bp, Artificial Sequence
  Description of Artificial Sequence: Synthetic oligonucleotide
aaagatgtaaattgttgcttcccacagtttatgaaaggaatctcg

SEQ ID NO: 333996 - DNA, 44 bp, Artificial Sequence
  Description of Artificial Sequence: Synthetic oligonucleotide
aagatgtaaattgttgcttcccacagtttatgaaaggaatctcg

SEQ ID NO: 333997 - DNA, 43 bp, Artificial Sequence
  Description of Artificial Sequence: Synthetic oligonucleotide
agatgtaaattgttgcttcccacagtttatgaaaggaatctcg

SEQ ID NO: 333998 - DNA, 42 bp, Artificial Sequence
  Description of Artificial Sequence: Synthetic oligonucleotide
gatgtaaattgttgcttcccacagtttatgaaaggaatctcg

SEQ ID NO: 333999 - DNA, 44 bp, Artificial Sequence
  Description of Artificial Sequence: Synthetic oligonucleotide
atgtaaattgttgcttcccacagtttatgaaaggaatctcgtag

SEQ ID NO: 334000 - DNA, 43 bp, Artificial Sequence
  Description of Artificial Sequence: Synthetic oligonucleotide
tgtaaattgttgcttcccacagtttatgaaaggaatctcgtag

SEQ ID NO: 334001 - DNA, 42 bp, Artificial Sequence
  Description of Artificial Sequence: Synthetic oligonucleotide
gtaaattgttgcttcccacagtttatgaaaggaatctcgtag

SEQ ID NO: 334002 - DNA, 42 bp, Artificial Sequence
  Description of Artificial Sequence: Synthetic oligonucleotide
taaattgttgcttcccacagtttatgaaaggaatctcgtagg

SEQ ID NO: 334003 - DNA, 41 bp, Artificial Sequence
  Description of Artificial Sequence: Synthetic oligonucleotide
aaattgttgcttcccacagtttatgaaaggaatctcgtagg

SEQ ID NO: 334004 - DNA, 40 bp, Artificial Sequence
  Description of Artificial Sequence: Synthetic oligonucleotide
aattgttgcttcccacagtttatgaaaggaatctcgtagg

SEQ ID NO: 334005 - DNA, 39 bp, Artificial Sequence
  Description of Artificial Sequence: Synthetic oligonucleotide
attgttgcttcccacagtttatgaaaggaatctcgtagg

SEQ ID NO: 334006 - DNA, 38 bp, Artificial Sequence
  Description of Artificial Sequence: Synthetic oligonucleotide
ttgttgcttcccacagtttatgaaaggaatctcgtagg

SEQ ID NO: 334007 - DNA, 37 bp, Artificial Sequence
  Description of Artificial Sequence: Synthetic oligonucleotide
tgttgcttcccacagtttatgaaaggaatctcgtagg

SEQ ID NO: 334008 - DNA, 36 bp, Artificial Sequence
  Description of Artificial Sequence: Synthetic oligonucleotide
gttgcttcccacagtttatgaaaggaatctcgtagg

SEQ ID NO: 334009 - DNA, 37 bp, Artificial Sequence
  Description of Artificial Sequence: Synthetic oligonucleotide
ttgcttcccacagtttatgaaaggaatctcgtaggag

SEQ ID NO: 334010 - DNA, 36 bp, Artificial Sequence
  Description of Artificial Sequence: Synthetic oligonucleotide
tgcttcccacagtttatgaaaggaatctcgtaggag

SEQ ID NO: 334011 - DNA, 35 bp, Artificial Sequence
  Description of Artificial Sequence: Synthetic oligonucleotide
gcttcccacagtttatgaaaggaatctcgtaggag

SEQ ID NO: 334012 - DNA, 38 bp, Artificial Sequence
  Description of Artificial Sequence: Synthetic oligonucleotide
cttcccacagtttatgaaaggaatctcgtaggagttag

SEQ ID NO: 334013 - DNA, 42 bp, Artificial Sequence
  Description of Artificial Sequence: Synthetic oligonucleotide
ttcccacagtttatgaaaggaatctcgtaggagttagtaatg

SEQ ID NO: 334014 - DNA, 41 bp, Artificial Sequence
  Description of Artificial Sequence: Synthetic oligonucleotide
tcccacagtttatgaaaggaatctcgtaggagttagtaatg

SEQ ID NO: 334015 - DNA, 40 bp, Artificial Sequence
  Description of Artificial Sequence: Synthetic oligonucleotide
cccacagtttatgaaaggaatctcgtaggagttagtaatg

SEQ ID NO: 334016 - DNA, 46 bp, Artificial Sequence
  Description of Artificial Sequence: Synthetic oligonucleotide
ccacagtttatgaaaggaatctcgtaggagttagtaatgaaaaatg

SEQ ID NO: 334017 - DNA, 51 bp, Artificial Sequence
  Description of Artificial Sequence: Synthetic oligonucleotide
cacagtttatgaaaggaatctcgtaggagttagtaatgaaaaatgtatatc

SEQ ID NO: 334018 - DNA, 52 bp, Artificial Sequence
  Description of Artificial Sequence: Synthetic oligonucleotide
acagtttatgaaaggaatctcgtaggagttagtaatgaaaaatgtatatcac

SEQ ID NO: 334019 - DNA, 51 bp, Artificial Sequence
  Description of Artificial Sequence: Synthetic oligonucleotide
cagtttatgaaaggaatctcgtaggagttagtaatgaaaaatgtatatcac

SEQ ID NO: 334020 - DNA, 54 bp, Artificial Sequence
  Description of Artificial Sequence: Synthetic oligonucleotide
agtttatgaaaggaatctcgtaggagttagtaatgaaaaatgtatatcacaatg

SEQ ID NO: 334021 - DNA, 53 bp, Artificial Sequence
  Description of Artificial Sequence: Synthetic oligonucleotide
gtttatgaaaggaatctcgtaggagttagtaatgaaaaatgtatatcacaatg

SEQ ID NO: 334022 - DNA, 53 bp, Artificial Sequence
  Description of Artificial Sequence: Synthetic oligonucleotide
tttatgaaaggaatctcgtaggagttagtaatgaaaaatgtatatcacaatgg

SEQ ID NO: 334023 - DNA, 52 bp, Artificial Sequence
  Description of Artificial Sequence: Synthetic oligonucleotide
ttatgaaaggaatctcgtaggagttagtaatgaaaaatgtatatcacaatgg

SEQ ID NO: 334024 - DNA, 51 bp, Artificial Sequence
  Description of Artificial Sequence: Synthetic oligonucleotide
tatgaaaggaatctcgtaggagttagtaatgaaaaatgtatatcacaatgg

SEQ ID NO: 334025 - DNA, 50 bp, Artificial Sequence
  Description of Artificial Sequence: Synthetic oligonucleotide
atgaaaggaatctcgtaggagttagtaatgaaaaatgtatatcacaatgg

SEQ ID NO: 334026 - DNA, 49 bp, Artificial Sequence
  Description of Artificial Sequence: Synthetic oligonucleotide
tgaaaggaatctcgtaggagttagtaatgaaaaatgtatatcacaatgg

SEQ ID NO: 334027 - DNA, 48 bp, Artificial Sequence
  Description of Artificial Sequence: Synthetic oligonucleotide
gaaaggaatctcgtaggagttagtaatgaaaaatgtatatcacaatgg

SEQ ID NO: 334028 - DNA, 49 bp, Artificial Sequence
  Description of Artificial Sequence: Synthetic oligonucleotide
aaaggaatctcgtaggagttagtaatgaaaaatgtatatcacaatggag

SEQ ID NO: 334029 - DNA, 48 bp, Artificial Sequence
  Description of Artificial Sequence: Synthetic oligonucleotide
aaggaatctcgtaggagttagtaatgaaaaatgtatatcacaatggag

SEQ ID NO: 334030 - DNA, 47 bp, Artificial Sequence
  Description of Artificial Sequence: Synthetic oligonucleotide
aggaatctcgtaggagttagtaatgaaaaatgtatatcacaatggag

SEQ ID NO: 334031 - DNA, 46 bp, Artificial Sequence
  Description of Artificial Sequence: Synthetic oligonucleotide
ggaatctcgtaggagttagtaatgaaaaatgtatatcacaatggag

SEQ ID NO: 334032 - DNA, 51 bp, Artificial Sequence
  Description of Artificial Sequence: Synthetic oligonucleotide
gaatctcgtaggagttagtaatgaaaaatgtatatcacaatggagattttg

SEQ ID NO: 334033 - DNA, 52 bp, Artificial Sequence
  Description of Artificial Sequence: Synthetic oligonucleotide
aatctcgtaggagttagtaatgaaaaatgtatatcacaatggagattttgtg

SEQ ID NO: 334034 - DNA, 51 bp, Artificial Sequence
  Description of Artificial Sequence: Synthetic oligonucleotide
atctcgtaggagttagtaatgaaaaatgtatatcacaatggagattttgtg

SEQ ID NO: 334035 - DNA, 50 bp, Artificial Sequence
  Description of Artificial Sequence: Synthetic oligonucleotide
tctcgtaggagttagtaatgaaaaatgtatatcacaatggagattttgtg

SEQ ID NO: 334036 - DNA, 49 bp, Artificial Sequence
  Description of Artificial Sequence: Synthetic oligonucleotide
ctcgtaggagttagtaatgaaaaatgtatatcacaatggagattttgtg

SEQ ID NO: 334037 - DNA, 50 bp, Artificial Sequence
  Description of Artificial Sequence: Synthetic oligonucleotide
tcgtaggagttagtaatgaaaaatgtatatcacaatggagattttgtgac

SEQ ID NO: 334038 - DNA, 49 bp, Artificial Sequence
  Description of Artificial Sequence: Synthetic oligonucleotide
cgtaggagttagtaatgaaaaatgtatatcacaatggagattttgtgac

SEQ ID NO: 334039 - DNA, 52 bp, Artificial Sequence
  Description of Artificial Sequence: Synthetic oligonucleotide
gtaggagttagtaatgaaaaatgtatatcacaatggagattttgtgactttc

SEQ ID NO: 334040 - DNA, 54 bp, Artificial Sequence
  Description of Artificial Sequence: Synthetic oligonucleotide
taggagttagtaatgaaaaatgtatatcacaatggagattttgtgactttcaag

SEQ ID NO: 334041 - DNA, 53 bp, Artificial Sequence
  Description of Artificial Sequence: Synthetic oligonucleotide
aggagttagtaatgaaaaatgtatatcacaatggagattttgtgactttcaag

SEQ ID NO: 334042 - DNA, 52 bp, Artificial Sequence
  Description of Artificial Sequence: Synthetic oligonucleotide
ggagttagtaatgaaaaatgtatatcacaatggagattttgtgactttcaag

SEQ ID NO: 334043 - DNA, 53 bp, Artificial Sequence
  Description of Artificial Sequence: Synthetic oligonucleotide
gagttagtaatgaaaaatgtatatcacaatggagattttgtgactttcaagtg

SEQ ID NO: 334044 - DNA, 54 bp, Artificial Sequence
  Description of Artificial Sequence: Synthetic oligonucleotide
agttagtaatgaaaaatgtatatcacaatggagattttgtgactttcaagtgtg

SEQ ID NO: 334045 - DNA, 53 bp, Artificial Sequence
  Description of Artificial Sequence: Synthetic oligonucleotide
gttagtaatgaaaaatgtatatcacaatggagattttgtgactttcaagtgtg

SEQ ID NO: 334046 - DNA, 55 bp, Artificial Sequence
  Description of Artificial Sequence: Synthetic oligonucleotide
ttagtaatgaaaaatgtatatcacaatggagattttgtgactttcaagtgtgaac

SEQ ID NO: 334047 - DNA, 54 bp, Artificial Sequence
  Description of Artificial Sequence: Synthetic oligonucleotide
tagtaatgaaaaatgtatatcacaatggagattttgtgactttcaagtgtgaac

SEQ ID NO: 334048 - DNA, 53 bp, Artificial Sequence
  Description of Artificial Sequence: Synthetic oligonucleotide
agtaatgaaaaatgtatatcacaatggagattttgtgactttcaagtgtgaac

SEQ ID NO: 334049 - DNA, 52 bp, Artificial Sequence
  Description of Artificial Sequence: Synthetic oligonucleotide
gtaatgaaaaatgtatatcacaatggagattttgtgactttcaagtgtgaac

SEQ ID NO: 334050 - DNA, 54 bp, Artificial Sequence
  Description of Artificial Sequence: Synthetic oligonucleotide
taatgaaaaatgtatatcacaatggagattttgtgactttcaagtgtgaacatg

SEQ ID NO: 334051 - DNA, 53 bp, Artificial Sequence
  Description of Artificial Sequence: Synthetic oligonucleotide
aatgaaaaatgtatatcacaatggagattttgtgactttcaagtgtgaacatg

SEQ ID NO: 334052 - DNA, 52 bp, Artificial Sequence
  Description of Artificial Sequence: Synthetic oligonucleotide
atgaaaaatgtatatcacaatggagattttgtgactttcaagtgtgaacatg

SEQ ID NO: 334053 - DNA, 51 bp, Artificial Sequence
  Description of Artificial Sequence: Synthetic oligonucleotide
tgaaaaatgtatatcacaatggagattttgtgactttcaagtgtgaacatg

SEQ ID NO: 334054 - DNA, 50 bp, Artificial Sequence
  Description of Artificial Sequence: Synthetic oligonucleotide
gaaaaatgtatatcacaatggagattttgtgactttcaagtgtgaacatg

SEQ ID NO: 334055 - DNA, 50 bp, Artificial Sequence
  Description of Artificial Sequence: Synthetic oligonucleotide
aaaaatgtatatcacaatggagattttgtgactttcaagtgtgaacatgg

SEQ ID NO: 334056 - DNA, 49 bp, Artificial Sequence
  Description of Artificial Sequence: Synthetic oligonucleotide
aaaatgtatatcacaatggagattttgtgactttcaagtgtgaacatgg

SEQ ID NO: 334057 - DNA, 48 bp, Artificial Sequence
  Description of Artificial Sequence: Synthetic oligonucleotide
aaatgtatatcacaatggagattttgtgactttcaagtgtgaacatgg

SEQ ID NO: 334058 - DNA, 47 bp, Artificial Sequence
  Description of Artificial Sequence: Synthetic oligonucleotide
aatgtatatcacaatggagattttgtgactttcaagtgtgaacatgg

SEQ ID NO: 334059 - DNA, 46 bp, Artificial Sequence
  Description of Artificial Sequence: Synthetic oligonucleotide
atgtatatcacaatggagattttgtgactttcaagtgtgaacatgg

SEQ ID NO: 334060 - DNA, 45 bp, Artificial Sequence
  Description of Artificial Sequence: Synthetic oligonucleotide
tgtatatcacaatggagattttgtgactttcaagtgtgaacatgg

SEQ ID NO: 334061 - DNA, 44 bp, Artificial Sequence
  Description of Artificial Sequence: Synthetic oligonucleotide
gtatatcacaatggagattttgtgactttcaagtgtgaacatgg

SEQ ID NO: 334062 - DNA, 44 bp, Artificial Sequence
  Description of Artificial Sequence: Synthetic oligonucleotide
tatatcacaatggagattttgtgactttcaagtgtgaacatggg

SEQ ID NO: 334063 - DNA, 43 bp, Artificial Sequence
  Description of Artificial Sequence: Synthetic oligonucleotide
atatcacaatggagattttgtgactttcaagtgtgaacatggg

SEQ ID NO: 334064 - DNA, 42 bp, Artificial Sequence
  Description of Artificial Sequence: Synthetic oligonucleotide
tatcacaatggagattttgtgactttcaagtgtgaacatggg

SEQ ID NO: 334065 - DNA, 41 bp, Artificial Sequence
  Description of Artificial Sequence: Synthetic oligonucleotide
atcacaatggagattttgtgactttcaagtgtgaacatggg

SEQ ID NO: 334066 - DNA, 40 bp, Artificial Sequence
  Description of Artificial Sequence: Synthetic oligonucleotide
tcacaatggagattttgtgactttcaagtgtgaacatggg

SEQ ID NO: 334067 - DNA, 39 bp, Artificial Sequence
  Description of Artificial Sequence: Synthetic oligonucleotide
cacaatggagattttgtgactttcaagtgtgaacatggg

SEQ ID NO: 334068 - DNA, 43 bp, Artificial Sequence
  Description of Artificial Sequence: Synthetic oligonucleotide
acaatggagattttgtgactttcaagtgtgaacatgggtatag

SEQ ID NO: 334069 - DNA, 42 bp, Artificial Sequence
  Description of Artificial Sequence: Synthetic oligonucleotide
caatggagattttgtgactttcaagtgtgaacatgggtatag

SEQ ID NO: 334070 - DNA, 43 bp, Artificial Sequence
  Description of Artificial Sequence: Synthetic oligonucleotide
aatggagattttgtgactttcaagtgtgaacatgggtatagtc

SEQ ID NO: 334071 - DNA, 42 bp, Artificial Sequence
  Description of Artificial Sequence: Synthetic oligonucleotide
atggagattttgtgactttcaagtgtgaacatgggtatagtc

SEQ ID NO: 334072 - DNA, 41 bp, Artificial Sequence
  Description of Artificial Sequence: Synthetic oligonucleotide
tggagattttgtgactttcaagtgtgaacatgggtatagtc

SEQ ID NO: 334073 - DNA, 40 bp, Artificial Sequence
  Description of Artificial Sequence: Synthetic oligonucleotide
ggagattttgtgactttcaagtgtgaacatgggtatagtc

SEQ ID NO: 334074 - DNA, 41 bp, Artificial Sequence
  Description of Artificial Sequence: Synthetic oligonucleotide
gagattttgtgactttcaagtgtgaacatgggtatagtctg

SEQ ID NO: 334075 - DNA, 41 bp, Artificial Sequence
  Description of Artificial Sequence: Synthetic oligonucleotide
agattttgtgactttcaagtgtgaacatgggtatagtctgg

SEQ ID NO: 334076 - DNA, 40 bp, Artificial Sequence
  Description of Artificial Sequence: Synthetic oligonucleotide
gattttgtgactttcaagtgtgaacatgggtatagtctgg

SEQ ID NO: 334077 - DNA, 42 bp, Artificial Sequence
  Description of Artificial Sequence: Synthetic oligonucleotide
attttgtgactttcaagtgtgaacatgggtatagtctggaag

SEQ ID NO: 334078 - DNA, 41 bp, Artificial Sequence
  Description of Artificial Sequence: Synthetic oligonucleotide
ttttgtgactttcaagtgtgaacatgggtatagtctggaag

SEQ ID NO: 334079 - DNA, 40 bp, Artificial Sequence
  Description of Artificial Sequence: Synthetic oligonucleotide
tttgtgactttcaagtgtgaacatgggtatagtctggaag

SEQ ID NO: 334080 - DNA, 39 bp, Artificial Sequence
  Description of Artificial Sequence: Synthetic oligonucleotide
ttgtgactttcaagtgtgaacatgggtatagtctggaag

SEQ ID NO: 334081 - DNA, 38 bp, Artificial Sequence
  Description of Artificial Sequence: Synthetic oligonucleotide
tgtgactttcaagtgtgaacatgggtatagtctggaag

SEQ ID NO: 334082 - DNA, 37 bp, Artificial Sequence
  Description of Artificial Sequence: Synthetic oligonucleotide
gtgactttcaagtgtgaacatgggtatagtctggaag

SEQ ID NO: 334083 - DNA, 37 bp, Artificial Sequence
  Description of Artificial Sequence: Synthetic oligonucleotide
tgactttcaagtgtgaacatgggtatagtctggaagg

SEQ ID NO: 334084 - DNA, 36 bp, Artificial Sequence
  Description of Artificial Sequence: Synthetic oligonucleotide
gactttcaagtgtgaacatgggtatagtctggaagg

SEQ ID NO: 334085 - DNA, 36 bp, Artificial Sequence
  Description of Artificial Sequence: Synthetic oligonucleotide
actttcaagtgtgaacatgggtatagtctggaaggg

SEQ ID NO: 334086 - DNA, 35 bp, Artificial Sequence
  Description of Artificial Sequence: Synthetic oligonucleotide
ctttcaagtgtgaacatgggtatagtctggaaggg

SEQ ID NO: 334087 - DNA, 36 bp, Artificial Sequence
  Description of Artificial Sequence: Synthetic oligonucleotide
tttcaagtgtgaacatgggtatagtctggaagggag

SEQ ID NO: 334088 - DNA, 35 bp, Artificial Sequence
  Description of Artificial Sequence: Synthetic oligonucleotide
ttcaagtgtgaacatgggtatagtctggaagggag

SEQ ID NO: 334089 - DNA, 34 bp, Artificial Sequence
  Description of Artificial Sequence: Synthetic oligonucleotide
tcaagtgtgaacatgggtatagtctggaagggag

SEQ ID NO: 334090 - DNA, 33 bp, Artificial Sequence
  Description of Artificial Sequence: Synthetic oligonucleotide
caagtgtgaacatgggtatagtctggaagggag

SEQ ID NO: 334091 - DNA, 34 bp, Artificial Sequence
  Description of Artificial Sequence: Synthetic oligonucleotide
aagtgtgaacatgggtatagtctggaagggagtc

SEQ ID NO: 334092 - DNA, 33 bp, Artificial Sequence
  Description of Artificial Sequence: Synthetic oligonucleotide
agtgtgaacatgggtatagtctggaagggagtc

SEQ ID NO: 334093 - DNA, 32 bp, Artificial Sequence
  Description of Artificial Sequence: Synthetic oligonucleotide
gtgtgaacatgggtatagtctggaagggagtc

SEQ ID NO: 334094 - DNA, 32 bp, Artificial Sequence
  Description of Artificial Sequence: Synthetic oligonucleotide
tgtgaacatgggtatagtctggaagggagtcc

SEQ ID NO: 334095 - DNA, 31 bp, Artificial Sequence
  Description of Artificial Sequence: Synthetic oligonucleotide
gtgaacatgggtatagtctggaagggagtcc

SEQ ID NO: 334096 - DNA, 31 bp, Artificial Sequence
  Description of Artificial Sequence: Synthetic oligonucleotide
tgaacatgggtatagtctggaagggagtccc

SEQ ID NO: 334097 - DNA, 30 bp, Artificial Sequence
  Description of Artificial Sequence: Synthetic oligonucleotide
gaacatgggtatagtctggaagggagtccc

SEQ ID NO: 334098 - DNA, 31 bp, Artificial Sequence
  Description of Artificial Sequence: Synthetic oligonucleotide
aacatgggtatagtctggaagggagtccctg

SEQ ID NO: 334099 - DNA, 30 bp, Artificial Sequence
  Description of Artificial Sequence: Synthetic oligonucleotide
acatgggtatagtctggaagggagtccctg

SEQ ID NO: 334100 - DNA, 29 bp, Artificial Sequence
  Description of Artificial Sequence: Synthetic oligonucleotide
catgggtatagtctggaagggagtccctg

SEQ ID NO: 334101 - DNA, 29 bp, Artificial Sequence
  Description of Artificial Sequence: Synthetic oligonucleotide
atgggtatagtctggaagggagtccctgg

SEQ ID NO: 334102 - DNA, 28 bp, Artificial Sequence
  Description of Artificial Sequence: Synthetic oligonucleotide
tgggtatagtctggaagggagtccctgg

SEQ ID NO: 334103 - DNA, 27 bp, Artificial Sequence
  Description of Artificial Sequence: Synthetic oligonucleotide
gggtatagtctggaagggagtccctgg

SEQ ID NO: 334104 - DNA, 28 bp, Artificial Sequence
  Description of Artificial Sequence: Synthetic oligonucleotide
ggtatagtctggaagggagtccctggtg

SEQ ID NO: 334105 - DNA, 28 bp, Artificial Sequence
  Description of Artificial Sequence: Synthetic oligonucleotide
gtatagtctggaagggagtccctggtgc

SEQ ID NO: 334106 - DNA, 28 bp, Artificial Sequence
  Description of Artificial Sequence: Synthetic oligonucleotide
tatagtctggaagggagtccctggtgcc

SEQ ID NO: 334107 - DNA, 27 bp, Artificial Sequence
  Description of Artificial Sequence: Synthetic oligonucleotide
atagtctggaagggagtccctggtgcc

SEQ ID NO: 334108 - DNA, 27 bp, Artificial Sequence
  Description of Artificial Sequence: Synthetic oligonucleotide
tagtctggaagggagtccctggtgcca

SEQ ID NO: 334109 - DNA, 26 bp, Artificial Sequence
  Description of Artificial Sequence: Synthetic oligonucleotide
agtctggaagggagtccctggtgcca

SEQ ID NO: 334110 - DNA, 25 bp, Artificial Sequence
  Description of Artificial Sequence: Synthetic oligonucleotide
gtctggaagggagtccctggtgcca

SEQ ID NO: 334111 - DNA, 26 bp, Artificial Sequence
  Description of Artificial Sequence: Synthetic oligonucleotide
tctggaagggagtccctggtgccagt

SEQ ID NO: 334112 - DNA, 25 bp, Artificial Sequence
  Description of Artificial Sequence: Synthetic oligonucleotide
ctggaagggagtccctggtgccagt

SEQ ID NO: 334113 - DNA, 25 bp, Artificial Sequence
  Description of Artificial Sequence: Synthetic oligonucleotide
tggaagggagtccctggtgccagtg

SEQ ID NO: 334114 - DNA, 24 bp, Artificial Sequence
  Description of Artificial Sequence: Synthetic oligonucleotide
ggaagggagtccctggtgccagtg

SEQ ID NO: 334115 - DNA, 24 bp, Artificial Sequence
  Description of Artificial Sequence: Synthetic oligonucleotide
gaagggagtccctggtgccagtgc

SEQ ID NO: 334116 - DNA, 25 bp, Artificial Sequence
  Description of Artificial Sequence: Synthetic oligonucleotide
aagggagtccctggtgccagtgcct

SEQ ID NO: 334117 - DNA, 24 bp, Artificial Sequence
  Description of Artificial Sequence: Synthetic oligonucleotide
agggagtccctggtgccagtgcct

SEQ ID NO: 334118 - DNA, 23 bp, Artificial Sequence
  Description of Artificial Sequence: Synthetic oligonucleotide
gggagtccctggtgccagtgcct

SEQ ID NO: 334119 - DNA, 23 bp, Artificial Sequence
  Description of Artificial Sequence: Synthetic oligonucleotide
ggagtccctggtgccagtgcctg

SEQ ID NO: 334120 - DNA, 23 bp, Artificial Sequence
  Description of Artificial Sequence: Synthetic oligonucleotide
gagtccctggtgccagtgcctgg

SEQ ID NO: 334121 - DNA, 23 bp, Artificial Sequence
  Description of Artificial Sequence: Synthetic oligonucleotide
agtccctggtgccagtgcctggc

SEQ ID NO: 334122 - DNA, 22 bp, Artificial Sequence
  Description of Artificial Sequence: Synthetic oligonucleotide
gtccctggtgccagtgcctggc

SEQ ID NO: 334123 - DNA, 22 bp, Artificial Sequence
  Description of Artificial Sequence: Synthetic oligonucleotide
tccctggtgccagtgcctggcg

SEQ ID NO: 334124 - DNA, 21 bp, Artificial Sequence
  Description of Artificial Sequence: Synthetic oligonucleotide
ccctggtgccagtgcctggcg

SEQ ID NO: 334125 - DNA, 23 bp, Artificial Sequence
  Description of Artificial Sequence: Synthetic oligonucleotide
cctggtgccagtgcctggcggat

SEQ ID NO: 334126 - DNA, 24 bp, Artificial Sequence
  Description of Artificial Sequence: Synthetic oligonucleotide
ctggtgccagtgcctggcggatga

SEQ ID NO: 334127 - DNA, 25 bp, Artificial Sequence
  Description of Artificial Sequence: Synthetic oligonucleotide
tggtgccagtgcctggcggatgaga

SEQ ID NO: 334128 - DNA, 24 bp, Artificial Sequence
  Description of Artificial Sequence: Synthetic oligonucleotide
ggtgccagtgcctggcggatgaga

SEQ ID NO: 334129 - DNA, 26 bp, Artificial Sequence
  Description of Artificial Sequence: Synthetic oligonucleotide
gtgccagtgcctggcggatgagagat

SEQ ID NO: 334130 - DNA, 26 bp, Artificial Sequence
  Description of Artificial Sequence: Synthetic oligonucleotide
tgccagtgcctggcggatgagagatg

SEQ ID NO: 334131 - DNA, 25 bp, Artificial Sequence
  Description of Artificial Sequence: Synthetic oligonucleotide
gccagtgcctggcggatgagagatg

SEQ ID NO: 334132 - DNA, 25 bp, Artificial Sequence
  Description of Artificial Sequence: Synthetic oligonucleotide
ccagtgcctggcggatgagagatgg

SEQ ID NO: 334133 - DNA, 26 bp, Artificial Sequence
  Description of Artificial Sequence: Synthetic oligonucleotide
cagtgcctggcggatgagagatggga

SEQ ID NO: 334134 - DNA, 26 bp, Artificial Sequence
  Description of Artificial Sequence: Synthetic oligonucleotide
agtgcctggcggatgagagatgggac

SEQ ID NO: 334135 - DNA, 25 bp, Artificial Sequence
  Description of Artificial Sequence: Synthetic oligonucleotide
gtgcctggcggatgagagatgggac

SEQ ID NO: 334136 - DNA, 25 bp, Artificial Sequence
  Description of Artificial Sequence: Synthetic oligonucleotide
tgcctggcggatgagagatgggacg

SEQ ID NO: 334137 - DNA, 24 bp, Artificial Sequence
  Description of Artificial Sequence: Synthetic oligonucleotide
gcctggcggatgagagatgggacg

SEQ ID NO: 334138 - DNA, 25 bp, Artificial Sequence
  Description of Artificial Sequence: Synthetic oligonucleotide
cctggcggatgagagatgggacgct

SEQ ID NO: 334139 - DNA, 25 bp, Artificial Sequence
  Description of Artificial Sequence: Synthetic oligonucleotide
ctggcggatgagagatgggacgctc

SEQ ID NO: 334140 - DNA, 26 bp, Artificial Sequence
  Description of Artificial Sequence: Synthetic oligonucleotide
tggcggatgagagatgggacgctcct

SEQ ID NO: 334141 - DNA, 25 bp, Artificial Sequence
  Description of Artificial Sequence: Synthetic oligonucleotide
ggcggatgagagatgggacgctcct

SEQ ID NO: 334142 - DNA, 26 bp, Artificial Sequence
  Description of Artificial Sequence: Synthetic oligonucleotide
gcggatgagagatgggacgctcctct

SEQ ID NO: 334143 - DNA, 26 bp, Artificial Sequence
  Description of Artificial Sequence: Synthetic oligonucleotide
cggatgagagatgggacgctcctctg

SEQ ID NO: 334144 - DNA, 26 bp, Artificial Sequence
  Description of Artificial Sequence: Synthetic oligonucleotide
ggatgagagatgggacgctcctctgg

SEQ ID NO: 334145 - DNA, 26 bp, Artificial Sequence
  Description of Artificial Sequence: Synthetic oligonucleotide
gatgagagatgggacgctcctctggg

SEQ ID NO: 334146 - DNA, 27 bp, Artificial Sequence
  Description of Artificial Sequence: Synthetic oligonucleotide
atgagagatgggacgctcctctgggca

SEQ ID NO: 334147 - DNA, 27 bp, Artificial Sequence
  Description of Artificial Sequence: Synthetic oligonucleotide
tgagagatgggacgctcctctgggcaa

SEQ ID NO: 334148 - DNA, 27 bp, Artificial Sequence
  Description of Artificial Sequence: Synthetic oligonucleotide
gagagatgggacgctcctctgggcaaa

SEQ ID NO: 334149 - DNA, 28 bp, Artificial Sequence
  Description of Artificial Sequence: Synthetic oligonucleotide
agagatgggacgctcctctgggcaaatg

SEQ ID NO: 334150 - DNA, 27 bp, Artificial Sequence
  Description of Artificial Sequence: Synthetic oligonucleotide
gagatgggacgctcctctgggcaaatg

SEQ ID NO: 334151 - DNA, 29 bp, Artificial Sequence
  Description of Artificial Sequence: Synthetic oligonucleotide
agatgggacgctcctctgggcaaatgtac

SEQ ID NO: 334152 - DNA, 28 bp, Artificial Sequence
  Description of Artificial Sequence: Synthetic oligonucleotide
gatgggacgctcctctgggcaaatgtac

SEQ ID NO: 334153 - DNA, 28 bp, Artificial Sequence
  Description of Artificial Sequence: Synthetic oligonucleotide
atgggacgctcctctgggcaaatgtacg

SEQ ID NO: 334154 - DNA, 27 bp, Artificial Sequence
  Description of Artificial Sequence: Synthetic oligonucleotide
tgggacgctcctctgggcaaatgtacg

SEQ ID NO: 334155 - DNA, 27 bp, Artificial Sequence
  Description of Artificial Sequence: Synthetic oligonucleotide
gggacgctcctctgggcaaatgtacgt

SEQ ID NO: 334156 - DNA, 27 bp, Artificial Sequence
  Description of Artificial Sequence: Synthetic oligonucleotide
ggacgctcctctgggcaaatgtacgtc

SEQ ID NO: 334157 - DNA, 28 bp, Artificial Sequence
  Description of Artificial Sequence: Synthetic oligonucleotide
gacgctcctctgggcaaatgtacgtctc

SEQ ID NO: 334158 - DNA, 28 bp, Artificial Sequence
  Description of Artificial Sequence: Synthetic oligonucleotide
acgctcctctgggcaaatgtacgtctcg

SEQ ID NO: 334159 - DNA, 27 bp, Artificial Sequence
  Description of Artificial Sequence: Synthetic oligonucleotide
cgctcctctgggcaaatgtacgtctcg

SEQ ID NO: 334160 - DNA, 29 bp, Artificial Sequence
  Description of Artificial Sequence: Synthetic oligonucleotide
gctcctctgggcaaatgtacgtctcgtac

SEQ ID NO: 334161 - DNA, 30 bp, Artificial Sequence
  Description of Artificial Sequence: Synthetic oligonucleotide
ctcctctgggcaaatgtacgtctcgtacag

SEQ ID NO: 334162 - DNA, 32 bp, Artificial Sequence
  Description of Artificial Sequence: Synthetic oligonucleotide
tcctctgggcaaatgtacgtctcgtacagatg

SEQ ID NO: 334163 - DNA, 31 bp, Artificial Sequence
  Description of Artificial Sequence: Synthetic oligonucleotide
cctctgggcaaatgtacgtctcgtacagatg

SEQ ID NO: 334164 - DNA, 33 bp, Artificial Sequence
  Description of Artificial Sequence: Synthetic oligonucleotide
ctctgggcaaatgtacgtctcgtacagatgatg

SEQ ID NO: 334165 - DNA, 33 bp, Artificial Sequence
  Description of Artificial Sequence: Synthetic oligonucleotide
tctgggcaaatgtacgtctcgtacagatgatgc

SEQ ID NO: 334166 - DNA, 32 bp, Artificial Sequence
  Description of Artificial Sequence: Synthetic oligonucleotide
ctgggcaaatgtacgtctcgtacagatgatgc

SEQ ID NO: 334167 - DNA, 33 bp, Artificial Sequence
  Description of Artificial Sequence: Synthetic oligonucleotide
tgggcaaatgtacgtctcgtacagatgatgctc

SEQ ID NO: 334168 - DNA, 32 bp, Artificial Sequence
  Description of Artificial Sequence: Synthetic oligonucleotide
gggcaaatgtacgtctcgtacagatgatgctc

SEQ ID NO: 334169 - DNA, 33 bp, Artificial Sequence
  Description of Artificial Sequence: Synthetic oligonucleotide
ggcaaatgtacgtctcgtacagatgatgctcac

SEQ ID NO: 334170 - DNA, 36 bp, Artificial Sequence
  Description of Artificial Sequence: Synthetic oligonucleotide
gcaaatgtacgtctcgtacagatgatgctcacatag

SEQ ID NO: 334171 - DNA, 38 bp, Artificial Sequence
  Description of Artificial Sequence: Synthetic oligonucleotide
caaatgtacgtctcgtacagatgatgctcacatagttg

SEQ ID NO: 334172 - DNA, 38 bp, Artificial Sequence
  Description of Artificial Sequence: Synthetic oligonucleotide
aaatgtacgtctcgtacagatgatgctcacatagttgg

SEQ ID NO: 334173 - DNA, 37 bp, Artificial Sequence
  Description of Artificial Sequence: Synthetic oligonucleotide
aatgtacgtctcgtacagatgatgctcacatagttgg

SEQ ID NO: 334174 - DNA, 36 bp, Artificial Sequence
  Description of Artificial Sequence: Synthetic oligonucleotide
atgtacgtctcgtacagatgatgctcacatagttgg

SEQ ID NO: 334175 - DNA, 35 bp, Artificial Sequence
  Description of Artificial Sequence: Synthetic oligonucleotide
tgtacgtctcgtacagatgatgctcacatagttgg

SEQ ID NO: 334176 - DNA, 34 bp, Artificial Sequence
  Description of Artificial Sequence: Synthetic oligonucleotide
gtacgtctcgtacagatgatgctcacatagttgg

SEQ ID NO: 334177 - DNA, 34 bp, Artificial Sequence
  Description of Artificial Sequence: Synthetic oligonucleotide
tacgtctcgtacagatgatgctcacatagttggg

SEQ ID NO: 334178 - DNA, 33 bp, Artificial Sequence
  Description of Artificial Sequence: Synthetic oligonucleotide
acgtctcgtacagatgatgctcacatagttggg

SEQ ID NO: 334179 - DNA, 32 bp, Artificial Sequence
  Description of Artificial Sequence: Synthetic oligonucleotide
cgtctcgtacagatgatgctcacatagttggg

SEQ ID NO: 334180 - DNA, 33 bp, Artificial Sequence
  Description of Artificial Sequence: Synthetic oligonucleotide
gtctcgtacagatgatgctcacatagttgggac

SEQ ID NO: 334181 - DNA, 38 bp, Artificial Sequence
  Description of Artificial Sequence: Synthetic oligonucleotide
tctcgtacagatgatgctcacatagttgggactttatc

SEQ ID NO: 334182 - DNA, 37 bp, Artificial Sequence
  Description of Artificial Sequence: Synthetic oligonucleotide
ctcgtacagatgatgctcacatagttgggactttatc

SEQ ID NO: 334183 - DNA, 38 bp, Artificial Sequence
  Description of Artificial Sequence: Synthetic oligonucleotide
tcgtacagatgatgctcacatagttgggactttatctc

SEQ ID NO: 334184 - DNA, 37 bp, Artificial Sequence
  Description of Artificial Sequence: Synthetic oligonucleotide
cgtacagatgatgctcacatagttgggactttatctc

SEQ ID NO: 334185 - DNA, 37 bp, Artificial Sequence
  Description of Artificial Sequence: Synthetic oligonucleotide
gtacagatgatgctcacatagttgggactttatctcg

SEQ ID NO: 334186 - DNA, 39 bp, Artificial Sequence
  Description of Artificial Sequence: Synthetic oligonucleotide
tacagatgatgctcacatagttgggactttatctcgtac

SEQ ID NO: 334187 - DNA, 38 bp, Artificial Sequence
  Description of Artificial Sequence: Synthetic oligonucleotide
acagatgatgctcacatagttgggactttatctcgtac

SEQ ID NO: 334188 - DNA, 37 bp, Artificial Sequence
  Description of Artificial Sequence: Synthetic oligonucleotide
cagatgatgctcacatagttgggactttatctcgtac

SEQ ID NO: 334189 - DNA, 37 bp, Artificial Sequence
  Description of Artificial Sequence: Synthetic oligonucleotide
agatgatgctcacatagttgggactttatctcgtacg

SEQ ID NO: 334190 - DNA, 36 bp, Artificial Sequence
  Description of Artificial Sequence: Synthetic oligonucleotide
gatgatgctcacatagttgggactttatctcgtacg

SEQ ID NO: 334191 - DNA, 38 bp, Artificial Sequence
  Description of Artificial Sequence: Synthetic oligonucleotide
atgatgctcacatagttgggactttatctcgtacgatc

SEQ ID NO: 334192 - DNA, 37 bp, Artificial Sequence
  Description of Artificial Sequence: Synthetic oligonucleotide
tgatgctcacatagttgggactttatctcgtacgatc

SEQ ID NO: 334193 - DNA, 36 bp, Artificial Sequence
  Description of Artificial Sequence: Synthetic oligonucleotide
gatgctcacatagttgggactttatctcgtacgatc

SEQ ID NO: 334194 - DNA, 38 bp, Artificial Sequence
  Description of Artificial Sequence: Synthetic oligonucleotide
atgctcacatagttgggactttatctcgtacgatctac

SEQ ID NO: 334195 - DNA, 37 bp, Artificial Sequence
  Description of Artificial Sequence: Synthetic oligonucleotide
tgctcacatagttgggactttatctcgtacgatctac

SEQ ID NO: 334196 - DNA, 36 bp, Artificial Sequence
  Description of Artificial Sequence: Synthetic oligonucleotide
gctcacatagttgggactttatctcgtacgatctac

SEQ ID NO: 334197 - DNA, 45 bp, Artificial Sequence
  Description of Artificial Sequence: Synthetic oligonucleotide
ctcacatagttgggactttatctcgtacgatctactttatttttc

SEQ ID NO: 334198 - DNA, 46 bp, Artificial Sequence
  Description of Artificial Sequence: Synthetic oligonucleotide
tcacatagttgggactttatctcgtacgatctactttatttttctc

SEQ ID NO: 334199 - DNA, 45 bp, Artificial Sequence
  Description of Artificial Sequence: Synthetic oligonucleotide
cacatagttgggactttatctcgtacgatctactttatttttctc

SEQ ID NO: 334200 - DNA, 47 bp, Artificial Sequence
  Description of Artificial Sequence: Synthetic oligonucleotide
acatagttgggactttatctcgtacgatctactttatttttctcatc

SEQ ID NO: 334201 - DNA, 46 bp, Artificial Sequence
  Description of Artificial Sequence: Synthetic oligonucleotide
catagttgggactttatctcgtacgatctactttatttttctcatc

SEQ ID NO: 334202 - DNA, 51 bp, Artificial Sequence
  Description of Artificial Sequence: Synthetic oligonucleotide
atagttgggactttatctcgtacgatctactttatttttctcatcattatc

SEQ ID NO: 334203 - DNA, 50 bp, Artificial Sequence
  Description of Artificial Sequence: Synthetic oligonucleotide
tagttgggactttatctcgtacgatctactttatttttctcatcattatc

SEQ ID NO: 334204 - DNA, 49 bp, Artificial Sequence
  Description of Artificial Sequence: Synthetic oligonucleotide
agttgggactttatctcgtacgatctactttatttttctcatcattatc

SEQ ID NO: 334205 - DNA, 48 bp, Artificial Sequence
  Description of Artificial Sequence: Synthetic oligonucleotide
gttgggactttatctcgtacgatctactttatttttctcatcattatc

SEQ ID NO: 334206 - DNA, 48 bp, Artificial Sequence
  Description of Artificial Sequence: Synthetic oligonucleotide
ttgggactttatctcgtacgatctactttatttttctcatcattatcc

SEQ ID NO: 334207 - DNA, 47 bp, Artificial Sequence
  Description of Artificial Sequence: Synthetic oligonucleotide
tgggactttatctcgtacgatctactttatttttctcatcattatcc

SEQ ID NO: 334208 - DNA, 46 bp, Artificial Sequence
  Description of Artificial Sequence: Synthetic oligonucleotide
gggactttatctcgtacgatctactttatttttctcatcattatcc

SEQ ID NO: 334209 - DNA, 47 bp, Artificial Sequence
  Description of Artificial Sequence: Synthetic oligonucleotide
ggactttatctcgtacgatctactttatttttctcatcattatcctc

SEQ ID NO: 334210 - DNA, 48 bp, Artificial Sequence
  Description of Artificial Sequence: Synthetic oligonucleotide
gactttatctcgtacgatctactttatttttctcatcattatcctctc

SEQ ID NO: 334211 - DNA, 50 bp, Artificial Sequence
  Description of Artificial Sequence: Synthetic oligonucleotide
actttatctcgtacgatctactttatttttctcatcattatcctctcttc

SEQ ID NO: 334212 - DNA, 49 bp, Artificial Sequence
  Description of Artificial Sequence: Synthetic oligonucleotide
ctttatctcgtacgatctactttatttttctcatcattatcctctcttc

SEQ ID NO: 334213 - DNA, 49 bp, Artificial Sequence
  Description of Artificial Sequence: Synthetic oligonucleotide
tttatctcgtacgatctactttatttttctcatcattatcctctcttcg

SEQ ID NO: 334214 - DNA, 48 bp, Artificial Sequence
  Description of Artificial Sequence: Synthetic oligonucleotide
ttatctcgtacgatctactttatttttctcatcattatcctctcttcg

SEQ ID NO: 334215 - DNA, 47 bp, Artificial Sequence
  Description of Artificial Sequence: Synthetic oligonucleotide
tatctcgtacgatctactttatttttctcatcattatcctctcttcg

SEQ ID NO: 334216 - DNA, 46 bp, Artificial Sequence
  Description of Artificial Sequence: Synthetic oligonucleotide
atctcgtacgatctactttatttttctcatcattatcctctcttcg

SEQ ID NO: 334217 - DNA, 45 bp, Artificial Sequence
  Description of Artificial Sequence: Synthetic oligonucleotide
tctcgtacgatctactttatttttctcatcattatcctctcttcg

SEQ ID NO: 334218 - DNA, 44 bp, Artificial Sequence
  Description of Artificial Sequence: Synthetic oligonucleotide
ctcgtacgatctactttatttttctcatcattatcctctcttcg

SEQ ID NO: 334219 - DNA, 50 bp, Artificial Sequence
  Description of Artificial Sequence: Synthetic oligonucleotide
tcgtacgatctactttatttttctcatcattatcctctcttcgataattc

SEQ ID NO: 334220 - DNA, 49 bp, Artificial Sequence
  Description of Artificial Sequence: Synthetic oligonucleotide
cgtacgatctactttatttttctcatcattatcctctcttcgataattc

SEQ ID NO: 334221 - DNA, 53 bp, Artificial Sequence
  Description of Artificial Sequence: Synthetic oligonucleotide
gtacgatctactttatttttctcatcattatcctctcttcgataattcttaag

SEQ ID NO: 334222 - DNA, 53 bp, Artificial Sequence
  Description of Artificial Sequence: Synthetic oligonucleotide
tacgatctactttatttttctcatcattatcctctcttcgataattcttaagc

SEQ ID NO: 334223 - DNA, 52 bp, Artificial Sequence
  Description of Artificial Sequence: Synthetic oligonucleotide
acgatctactttatttttctcatcattatcctctcttcgataattcttaagc

SEQ ID NO: 334224 - DNA, 51 bp, Artificial Sequence
  Description of Artificial Sequence: Synthetic oligonucleotide
cgatctactttatttttctcatcattatcctctcttcgataattcttaagc

SEQ ID NO: 334225 - DNA, 52 bp, Artificial Sequence
  Description of Artificial Sequence: Synthetic oligonucleotide
gatctactttatttttctcatcattatcctctcttcgataattcttaagcac

SEQ ID NO: 334226 - DNA, 53 bp, Artificial Sequence
  Description of Artificial Sequence: Synthetic oligonucleotide
atctactttatttttctcatcattatcctctcttcgataattcttaagcacag

SEQ ID NO: 334227 - DNA, 52 bp, Artificial Sequence
  Description of Artificial Sequence: Synthetic oligonucleotide
tctactttatttttctcatcattatcctctcttcgataattcttaagcacag

SEQ ID NO: 334228 - DNA, 51 bp, Artificial Sequence
  Description of Artificial Sequence: Synthetic oligonucleotide
ctactttatttttctcatcattatcctctcttcgataattcttaagcacag

SEQ ID NO: 334229 - DNA, 55 bp, Artificial Sequence
  Description of Artificial Sequence: Synthetic oligonucleotide
tactttatttttctcatcattatcctctcttcgataattcttaagcacagataag

SEQ ID NO: 334230 - DNA, 54 bp, Artificial Sequence
  Description of Artificial Sequence: Synthetic oligonucleotide
actttatttttctcatcattatcctctcttcgataattcttaagcacagataag

SEQ ID NO: 334231 - DNA, 53 bp, Artificial Sequence
  Description of Artificial Sequence: Synthetic oligonucleotide
ctttatttttctcatcattatcctctcttcgataattcttaagcacagataag

SEQ ID NO: 334232 - DNA, 53 bp, Artificial Sequence
  Description of Artificial Sequence: Synthetic oligonucleotide
tttatttttctcatcattatcctctcttcgataattcttaagcacagataagg

SEQ ID NO: 334233 - DNA, 52 bp, Artificial Sequence
  Description of Artificial Sequence: Synthetic oligonucleotide
ttatttttctcatcattatcctctcttcgataattcttaagcacagataagg

SEQ ID NO: 334234 - DNA, 51 bp, Artificial Sequence
  Description of Artificial Sequence: Synthetic oligonucleotide
tatttttctcatcattatcctctcttcgataattcttaagcacagataagg

SEQ ID NO: 334235 - DNA, 50 bp, Artificial Sequence
  Description of Artificial Sequence: Synthetic oligonucleotide
atttttctcatcattatcctctcttcgataattcttaagcacagataagg

SEQ ID NO: 334236 - DNA, 49 bp, Artificial Sequence
  Description of Artificial Sequence: Synthetic oligonucleotide
tttttctcatcattatcctctcttcgataattcttaagcacagataagg

SEQ ID NO: 334237 - DNA, 48 bp, Artificial Sequence
  Description of Artificial Sequence: Synthetic oligonucleotide
ttttctcatcattatcctctcttcgataattcttaagcacagataagg

SEQ ID NO: 334238 - DNA, 47 bp, Artificial Sequence
  Description of Artificial Sequence: Synthetic oligonucleotide
tttctcatcattatcctctcttcgataattcttaagcacagataagg

SEQ ID NO: 334239 - DNA, 46 bp, Artificial Sequence
  Description of Artificial Sequence: Synthetic oligonucleotide
ttctcatcattatcctctcttcgataattcttaagcacagataagg

SEQ ID NO: 334240 - DNA, 45 bp, Artificial Sequence
  Description of Artificial Sequence: Synthetic oligonucleotide
tctcatcattatcctctcttcgataattcttaagcacagataagg

SEQ ID NO: 334241 - DNA, 44 bp, Artificial Sequence
  Description of Artificial Sequence: Synthetic oligonucleotide
ctcatcattatcctctcttcgataattcttaagcacagataagg

SEQ ID NO: 334242 - DNA, 44 bp, Artificial Sequence
  Description of Artificial Sequence: Synthetic oligonucleotide
tcatcattatcctctcttcgataattcttaagcacagataaggc

SEQ ID NO: 334243 - DNA, 43 bp, Artificial Sequence
  Description of Artificial Sequence: Synthetic oligonucleotide
catcattatcctctcttcgataattcttaagcacagataaggc

SEQ ID NO: 334244 - DNA, 49 bp, Artificial Sequence
  Description of Artificial Sequence: Synthetic oligonucleotide
atcattatcctctcttcgataattcttaagcacagataaggcaatattg

SEQ ID NO: 334245 - DNA, 48 bp, Artificial Sequence
  Description of Artificial Sequence: Synthetic oligonucleotide
tcattatcctctcttcgataattcttaagcacagataaggcaatattg

SEQ ID NO: 334246 - DNA, 47 bp, Artificial Sequence
  Description of Artificial Sequence: Synthetic oligonucleotide
cattatcctctcttcgataattcttaagcacagataaggcaatattg

SEQ ID NO: 334247 - DNA, 47 bp, Artificial Sequence
  Description of Artificial Sequence: Synthetic oligonucleotide
attatcctctcttcgataattcttaagcacagataaggcaatattgc

SEQ ID NO: 334248 - DNA, 46 bp, Artificial Sequence
  Description of Artificial Sequence: Synthetic oligonucleotide
ttatcctctcttcgataattcttaagcacagataaggcaatattgc

SEQ ID NO: 334249 - DNA, 45 bp, Artificial Sequence
  Description of Artificial Sequence: Synthetic oligonucleotide
tatcctctcttcgataattcttaagcacagataaggcaatattgc

SEQ ID NO: 334250 - DNA, 44 bp, Artificial Sequence
  Description of Artificial Sequence: Synthetic oligonucleotide
atcctctcttcgataattcttaagcacagataaggcaatattgc

SEQ ID NO: 334251 - DNA, 43 bp, Artificial Sequence
  Description of Artificial Sequence: Synthetic oligonucleotide
tcctctcttcgataattcttaagcacagataaggcaatattgc

SEQ ID NO: 334252 - DNA, 42 bp, Artificial Sequence
  Description of Artificial Sequence: Synthetic oligonucleotide
cctctcttcgataattcttaagcacagataaggcaatattgc

SEQ ID NO: 334253 - DNA, 43 bp, Artificial Sequence
  Description of Artificial Sequence: Synthetic oligonucleotide
ctctcttcgataattcttaagcacagataaggcaatattgcac

SEQ ID NO: 334254 - DNA, 45 bp, Artificial Sequence
  Description of Artificial Sequence: Synthetic oligonucleotide
tctcttcgataattcttaagcacagataaggcaatattgcacatg

SEQ ID NO: 334255 - DNA, 44 bp, Artificial Sequence
  Description of Artificial Sequence: Synthetic oligonucleotide
ctcttcgataattcttaagcacagataaggcaatattgcacatg

SEQ ID NO: 334256 - DNA, 48 bp, Artificial Sequence
  Description of Artificial Sequence: Synthetic oligonucleotide
tcttcgataattcttaagcacagataaggcaatattgcacatgataac

SEQ ID NO: 334257 - DNA, 47 bp, Artificial Sequence
  Description of Artificial Sequence: Synthetic oligonucleotide
cttcgataattcttaagcacagataaggcaatattgcacatgataac

SEQ ID NO: 334258 - DNA, 47 bp, Artificial Sequence
  Description of Artificial Sequence: Synthetic oligonucleotide
ttcgataattcttaagcacagataaggcaatattgcacatgataacc

SEQ ID NO: 334259 - DNA, 46 bp, Artificial Sequence
  Description of Artificial Sequence: Synthetic oligonucleotide
tcgataattcttaagcacagataaggcaatattgcacatgataacc

SEQ ID NO: 334260 - DNA, 45 bp, Artificial Sequence
  Description of Artificial Sequence: Synthetic oligonucleotide
cgataattcttaagcacagataaggcaatattgcacatgataacc

SEQ ID NO: 334261 - DNA, 45 bp, Artificial Sequence
  Description of Artificial Sequence: Synthetic oligonucleotide
gataattcttaagcacagataaggcaatattgcacatgataaccc

SEQ ID NO: 334262 - DNA, 49 bp, Artificial Sequence
  Description of Artificial Sequence: Synthetic oligonucleotide
ataattcttaagcacagataaggcaatattgcacatgataaccctaaac

SEQ ID NO: 334263 - DNA, 48 bp, Artificial Sequence
  Description of Artificial Sequence: Synthetic oligonucleotide
taattcttaagcacagataaggcaatattgcacatgataaccctaaac

SEQ ID NO: 334264 - DNA, 47 bp, Artificial Sequence
  Description of Artificial Sequence: Synthetic oligonucleotide
aattcttaagcacagataaggcaatattgcacatgataaccctaaac

SEQ ID NO: 334265 - DNA, 46 bp, Artificial Sequence
  Description of Artificial Sequence: Synthetic oligonucleotide
attcttaagcacagataaggcaatattgcacatgataaccctaaac

SEQ ID NO: 334266 - DNA, 45 bp, Artificial Sequence
  Description of Artificial Sequence: Synthetic oligonucleotide
ttcttaagcacagataaggcaatattgcacatgataaccctaaac

SEQ ID NO: 334267 - DNA, 44 bp, Artificial Sequence
  Description of Artificial Sequence: Synthetic oligonucleotide
tcttaagcacagataaggcaatattgcacatgataaccctaaac

SEQ ID NO: 334268 - DNA, 43 bp, Artificial Sequence
  Description of Artificial Sequence: Synthetic oligonucleotide
cttaagcacagataaggcaatattgcacatgataaccctaaac

SEQ ID NO: 334269 - DNA, 45 bp, Artificial Sequence
  Description of Artificial Sequence: Synthetic oligonucleotide
ttaagcacagataaggcaatattgcacatgataaccctaaacaag

SEQ ID NO: 334270 - DNA, 44 bp, Artificial Sequence
  Description of Artificial Sequence: Synthetic oligonucleotide
taagcacagataaggcaatattgcacatgataaccctaaacaag

SEQ ID NO: 334271 - DNA, 43 bp, Artificial Sequence
  Description of Artificial Sequence: Synthetic oligonucleotide
aagcacagataaggcaatattgcacatgataaccctaaacaag

SEQ ID NO: 334272 - DNA, 42 bp, Artificial Sequence
  Description of Artificial Sequence: Synthetic oligonucleotide
agcacagataaggcaatattgcacatgataaccctaaacaag

SEQ ID NO: 334273 - DNA, 41 bp, Artificial Sequence
  Description of Artificial Sequence: Synthetic oligonucleotide
gcacagataaggcaatattgcacatgataaccctaaacaag

SEQ ID NO: 334274 - DNA, 42 bp, Artificial Sequence
  Description of Artificial Sequence: Synthetic oligonucleotide
cacagataaggcaatattgcacatgataaccctaaacaagtg

SEQ ID NO: 334275 - DNA, 42 bp, Artificial Sequence
  Description of Artificial Sequence: Synthetic oligonucleotide
acagataaggcaatattgcacatgataaccctaaacaagtgg

SEQ ID NO: 334276 - DNA, 41 bp, Artificial Sequence
  Description of Artificial Sequence: Synthetic oligonucleotide
cagataaggcaatattgcacatgataaccctaaacaagtgg

SEQ ID NO: 334277 - DNA, 41 bp, Artificial Sequence
  Description of Artificial Sequence: Synthetic oligonucleotide
agataaggcaatattgcacatgataaccctaaacaagtggc

SEQ ID NO: 334278 - DNA, 40 bp, Artificial Sequence
  Description of Artificial Sequence: Synthetic oligonucleotide
gataaggcaatattgcacatgataaccctaaacaagtggc

SEQ ID NO: 334279 - DNA, 43 bp, Artificial Sequence
  Description of Artificial Sequence: Synthetic oligonucleotide
ataaggcaatattgcacatgataaccctaaacaagtggctaac

SEQ ID NO: 334280 - DNA, 42 bp, Artificial Sequence
  Description of Artificial Sequence: Synthetic oligonucleotide
taaggcaatattgcacatgataaccctaaacaagtggctaac

SEQ ID NO: 334281 - DNA, 41 bp, Artificial Sequence
  Description of Artificial Sequence: Synthetic oligonucleotide
aaggcaatattgcacatgataaccctaaacaagtggctaac

SEQ ID NO: 334282 - DNA, 40 bp, Artificial Sequence
  Description of Artificial Sequence: Synthetic oligonucleotide
aggcaatattgcacatgataaccctaaacaagtggctaac

SEQ ID NO: 334283 - DNA, 39 bp, Artificial Sequence
  Description of Artificial Sequence: Synthetic oligonucleotide
ggcaatattgcacatgataaccctaaacaagtggctaac

SEQ ID NO: 334284 - DNA, 39 bp, Artificial Sequence
  Description of Artificial Sequence: Synthetic oligonucleotide
gcaatattgcacatgataaccctaaacaagtggctaacc

SEQ ID NO: 334285 - DNA, 44 bp, Artificial Sequence
  Description of Artificial Sequence: Synthetic oligonucleotide
caatattgcacatgataaccctaaacaagtggctaaccatttac

SEQ ID NO: 334286 - DNA, 47 bp, Artificial Sequence
  Description of Artificial Sequence: Synthetic oligonucleotide
aatattgcacatgataaccctaaacaagtggctaaccatttacaatc

SEQ ID NO: 334287 - DNA, 46 bp, Artificial Sequence
  Description of Artificial Sequence: Synthetic oligonucleotide
atattgcacatgataaccctaaacaagtggctaaccatttacaatc

SEQ ID NO: 334288 - DNA, 45 bp, Artificial Sequence
  Description of Artificial Sequence: Synthetic oligonucleotide
tattgcacatgataaccctaaacaagtggctaaccatttacaatc

SEQ ID NO: 334289 - DNA, 44 bp, Artificial Sequence
  Description of Artificial Sequence: Synthetic oligonucleotide
attgcacatgataaccctaaacaagtggctaaccatttacaatc

SEQ ID NO: 334290 - DNA, 43 bp, Artificial Sequence
  Description of Artificial Sequence: Synthetic oligonucleotide
ttgcacatgataaccctaaacaagtggctaaccatttacaatc

SEQ ID NO: 334291 - DNA, 42 bp, Artificial Sequence
  Description of Artificial Sequence: Synthetic oligonucleotide
tgcacatgataaccctaaacaagtggctaaccatttacaatc

SEQ ID NO: 334292 - DNA, 41 bp, Artificial Sequence
  Description of Artificial Sequence: Synthetic oligonucleotide
gcacatgataaccctaaacaagtggctaaccatttacaatc

SEQ ID NO: 334293 - DNA, 42 bp, Artificial Sequence
  Description of Artificial Sequence: Synthetic oligonucleotide
cacatgataaccctaaacaagtggctaaccatttacaatctc

SEQ ID NO: 334294 - DNA, 44 bp, Artificial Sequence
  Description of Artificial Sequence: Synthetic oligonucleotide
acatgataaccctaaacaagtggctaaccatttacaatctcaag

SEQ ID NO: 334295 - DNA, 43 bp, Artificial Sequence
  Description of Artificial Sequence: Synthetic oligonucleotide
catgataaccctaaacaagtggctaaccatttacaatctcaag

SEQ ID NO: 334296 - DNA, 43 bp, Artificial Sequence
  Description of Artificial Sequence: Synthetic oligonucleotide
atgataaccctaaacaagtggctaaccatttacaatctcaagg

SEQ ID NO: 334297 - DNA, 42 bp, Artificial Sequence
  Description of Artificial Sequence: Synthetic oligonucleotide
tgataaccctaaacaagtggctaaccatttacaatctcaagg

SEQ ID NO: 334298 - DNA, 41 bp, Artificial Sequence
  Description of Artificial Sequence: Synthetic oligonucleotide
gataaccctaaacaagtggctaaccatttacaatctcaagg

SEQ ID NO: 334299 - DNA, 42 bp, Artificial Sequence
  Description of Artificial Sequence: Synthetic oligonucleotide
ataaccctaaacaagtggctaaccatttacaatctcaaggac

SEQ ID NO: 334300 - DNA, 41 bp, Artificial Sequence
  Description of Artificial Sequence: Synthetic oligonucleotide
taaccctaaacaagtggctaaccatttacaatctcaaggac

SEQ ID NO: 334301 - DNA, 40 bp, Artificial Sequence
  Description of Artificial Sequence: Synthetic oligonucleotide
aaccctaaacaagtggctaaccatttacaatctcaaggac

SEQ ID NO: 334302 - DNA, 39 bp, Artificial Sequence
  Description of Artificial Sequence: Synthetic oligonucleotide
accctaaacaagtggctaaccatttacaatctcaaggac

SEQ ID NO: 334303 - DNA, 38 bp, Artificial Sequence
  Description of Artificial Sequence: Synthetic oligonucleotide
ccctaaacaagtggctaaccatttacaatctcaaggac

SEQ ID NO: 334304 - DNA, 38 bp, Artificial Sequence
  Description of Artificial Sequence: Synthetic oligonucleotide
cctaaacaagtggctaaccatttacaatctcaaggacg

SEQ ID NO: 334305 - DNA, 38 bp, Artificial Sequence
  Description of Artificial Sequence: Synthetic oligonucleotide
ctaaacaagtggctaaccatttacaatctcaaggacgc

SEQ ID NO: 334306 - DNA, 39 bp, Artificial Sequence
  Description of Artificial Sequence: Synthetic oligonucleotide
taaacaagtggctaaccatttacaatctcaaggacgcag

SEQ ID NO: 334307 - DNA, 38 bp, Artificial Sequence
  Description of Artificial Sequence: Synthetic oligonucleotide
aaacaagtggctaaccatttacaatctcaaggacgcag

SEQ ID NO: 334308 - DNA, 37 bp, Artificial Sequence
  Description of Artificial Sequence: Synthetic oligonucleotide
aacaagtggctaaccatttacaatctcaaggacgcag

SEQ ID NO: 334309 - DNA, 36 bp, Artificial Sequence
  Description of Artificial Sequence: Synthetic oligonucleotide
acaagtggctaaccatttacaatctcaaggacgcag

SEQ ID NO: 334310 - DNA, 35 bp, Artificial Sequence
  Description of Artificial Sequence: Synthetic oligonucleotide
caagtggctaaccatttacaatctcaaggacgcag

SEQ ID NO: 334311 - DNA, 35 bp, Artificial Sequence
  Description of Artificial Sequence: Synthetic oligonucleotide
aagtggctaaccatttacaatctcaaggacgcagc

SEQ ID NO: 334312 - DNA, 34 bp, Artificial Sequence
  Description of Artificial Sequence: Synthetic oligonucleotide
agtggctaaccatttacaatctcaaggacgcagc

SEQ ID NO: 334313 - DNA, 33 bp, Artificial Sequence
  Description of Artificial Sequence: Synthetic oligonucleotide
gtggctaaccatttacaatctcaaggacgcagc

SEQ ID NO: 334314 - DNA, 34 bp, Artificial Sequence
  Description of Artificial Sequence: Synthetic oligonucleotide
tggctaaccatttacaatctcaaggacgcagcag

SEQ ID NO: 334315 - DNA, 33 bp, Artificial Sequence
  Description of Artificial Sequence: Synthetic oligonucleotide
ggctaaccatttacaatctcaaggacgcagcag

SEQ ID NO: 334316 - DNA, 33 bp, Artificial Sequence
  Description of Artificial Sequence: Synthetic oligonucleotide
gctaaccatttacaatctcaaggacgcagcagc

SEQ ID NO: 334317 - DNA, 33 bp, Artificial Sequence
  Description of Artificial Sequence: Synthetic oligonucleotide
ctaaccatttacaatctcaaggacgcagcagcg

SEQ ID NO: 334318 - DNA, 35 bp, Artificial Sequence
  Description of Artificial Sequence: Synthetic oligonucleotide
taaccatttacaatctcaaggacgcagcagcgatc

SEQ ID NO: 334319 - DNA, 34 bp, Artificial Sequence
  Description of Artificial Sequence: Synthetic oligonucleotide
aaccatttacaatctcaaggacgcagcagcgatc

SEQ ID NO: 334320 - DNA, 33 bp, Artificial Sequence
  Description of Artificial Sequence: Synthetic oligonucleotide
accatttacaatctcaaggacgcagcagcgatc

SEQ ID NO: 334321 - DNA, 32 bp, Artificial Sequence
  Description of Artificial Sequence: Synthetic oligonucleotide
ccatttacaatctcaaggacgcagcagcgatc

SEQ ID NO: 334322 - DNA, 34 bp, Artificial Sequence
  Description of Artificial Sequence: Synthetic oligonucleotide
catttacaatctcaaggacgcagcagcgatcatc

SEQ ID NO: 334323 - DNA, 34 bp, Artificial Sequence
  Description of Artificial Sequence: Synthetic oligonucleotide
atttacaatctcaaggacgcagcagcgatcatcc

SEQ ID NO: 334324 - DNA, 33 bp, Artificial Sequence
  Description of Artificial Sequence: Synthetic oligonucleotide
tttacaatctcaaggacgcagcagcgatcatcc

SEQ ID NO: 334325 - DNA, 32 bp, Artificial Sequence
  Description of Artificial Sequence: Synthetic oligonucleotide
ttacaatctcaaggacgcagcagcgatcatcc

SEQ ID NO: 334326 - DNA, 31 bp, Artificial Sequence
  Description of Artificial Sequence: Synthetic oligonucleotide
tacaatctcaaggacgcagcagcgatcatcc

SEQ ID NO: 334327 - DNA, 30 bp, Artificial Sequence
  Description of Artificial Sequence: Synthetic oligonucleotide
acaatctcaaggacgcagcagcgatcatcc

SEQ ID NO: 334328 - DNA, 29 bp, Artificial Sequence
  Description of Artificial Sequence: Synthetic oligonucleotide
caatctcaaggacgcagcagcgatcatcc

SEQ ID NO: 334329 - DNA, 29 bp, Artificial Sequence
  Description of Artificial Sequence: Synthetic oligonucleotide
aatctcaaggacgcagcagcgatcatccc

SEQ ID NO: 334330 - DNA, 28 bp, Artificial Sequence
  Description of Artificial Sequence: Synthetic oligonucleotide
atctcaaggacgcagcagcgatcatccc

SEQ ID NO: 334331 - DNA, 27 bp, Artificial Sequence
  Description of Artificial Sequence: Synthetic oligonucleotide
tctcaaggacgcagcagcgatcatccc

SEQ ID NO: 334332 - DNA, 26 bp, Artificial Sequence
  Description of Artificial Sequence: Synthetic oligonucleotide
ctcaaggacgcagcagcgatcatccc

SEQ ID NO: 334333 - DNA, 26 bp, Artificial Sequence
  Description of Artificial Sequence: Synthetic oligonucleotide
tcaaggacgcagcagcgatcatcccc

SEQ ID NO: 334334 - DNA, 25 bp, Artificial Sequence
  Description of Artificial Sequence: Synthetic oligonucleotide
caaggacgcagcagcgatcatcccc

SEQ ID NO: 334335 - DNA, 27 bp, Artificial Sequence
  Description of Artificial Sequence: Synthetic oligonucleotide
aaggacgcagcagcgatcatccccgta

SEQ ID NO: 334336 - DNA, 26 bp, Artificial Sequence
  Description of Artificial Sequence: Synthetic oligonucleotide
aggacgcagcagcgatcatccccgta

SEQ ID NO: 334337 - DNA, 25 bp, Artificial Sequence
  Description of Artificial Sequence: Synthetic oligonucleotide
ggacgcagcagcgatcatccccgta

SEQ ID NO: 334338 - DNA, 26 bp, Artificial Sequence
  Description of Artificial Sequence: Synthetic oligonucleotide
gacgcagcagcgatcatccccgtact

SEQ ID NO: 334339 - DNA, 27 bp, Artificial Sequence
  Description of Artificial Sequence: Synthetic oligonucleotide
acgcagcagcgatcatccccgtactct

SEQ ID NO: 334340 - DNA, 26 bp, Artificial Sequence
  Description of Artificial Sequence: Synthetic oligonucleotide
cgcagcagcgatcatccccgtactct

SEQ ID NO: 334341 - DNA, 26 bp, Artificial Sequence
  Description of Artificial Sequence: Synthetic oligonucleotide
gcagcagcgatcatccccgtactctg

SEQ ID NO: 334342 - DNA, 27 bp, Artificial Sequence
  Description of Artificial Sequence: Synthetic oligonucleotide
cagcagcgatcatccccgtactctgca

SEQ ID NO: 334343 - DNA, 29 bp, Artificial Sequence
  Description of Artificial Sequence: Synthetic oligonucleotide
agcagcgatcatccccgtactctgcaatc

SEQ ID NO: 334344 - DNA, 28 bp, Artificial Sequence
  Description of Artificial Sequence: Synthetic oligonucleotide
gcagcgatcatccccgtactctgcaatc

SEQ ID NO: 334345 - DNA, 32 bp, Artificial Sequence
  Description of Artificial Sequence: Synthetic oligonucleotide
cagcgatcatccccgtactctgcaatcaaatg

SEQ ID NO: 334346 - DNA, 34 bp, Artificial Sequence
  Description of Artificial Sequence: Synthetic oligonucleotide
agcgatcatccccgtactctgcaatcaaatgaag

SEQ ID NO: 334347 - DNA, 33 bp, Artificial Sequence
  Description of Artificial Sequence: Synthetic oligonucleotide
gcgatcatccccgtactctgcaatcaaatgaag

SEQ ID NO: 334348 - DNA, 39 bp, Artificial Sequence
  Description of Artificial Sequence: Synthetic oligonucleotide
cgatcatccccgtactctgcaatcaaatgaagtaaatag

SEQ ID NO: 334349 - DNA, 39 bp, Artificial Sequence
  Description of Artificial Sequence: Synthetic oligonucleotide
gatcatccccgtactctgcaatcaaatgaagtaaatagc

SEQ ID NO: 334350 - DNA, 40 bp, Artificial Sequence
  Description of Artificial Sequence: Synthetic oligonucleotide
atcatccccgtactctgcaatcaaatgaagtaaatagcag

SEQ ID NO: 334351 - DNA, 39 bp, Artificial Sequence
  Description of Artificial Sequence: Synthetic oligonucleotide
tcatccccgtactctgcaatcaaatgaagtaaatagcag

SEQ ID NO: 334352 - DNA, 38 bp, Artificial Sequence
  Description of Artificial Sequence: Synthetic oligonucleotide
catccccgtactctgcaatcaaatgaagtaaatagcag

SEQ ID NO: 334353 - DNA, 38 bp, Artificial Sequence
  Description of Artificial Sequence: Synthetic oligonucleotide
atccccgtactctgcaatcaaatgaagtaaatagcagc

SEQ ID NO: 334354 - DNA, 37 bp, Artificial Sequence
  Description of Artificial Sequence: Synthetic oligonucleotide
tccccgtactctgcaatcaaatgaagtaaatagcagc

SEQ ID NO: 334355 - DNA, 36 bp, Artificial Sequence
  Description of Artificial Sequence: Synthetic oligonucleotide
ccccgtactctgcaatcaaatgaagtaaatagcagc

SEQ ID NO: 334356 - DNA, 36 bp, Artificial Sequence
  Description of Artificial Sequence: Synthetic oligonucleotide
cccgtactctgcaatcaaatgaagtaaatagcagcg

SEQ ID NO: 334357 - DNA, 37 bp, Artificial Sequence
  Description of Artificial Sequence: Synthetic oligonucleotide
ccgtactctgcaatcaaatgaagtaaatagcagcgtc

SEQ ID NO: 334358 - DNA, 37 bp, Artificial Sequence
  Description of Artificial Sequence: Synthetic oligonucleotide
cgtactctgcaatcaaatgaagtaaatagcagcgtcc

SEQ ID NO: 334359 - DNA, 39 bp, Artificial Sequence
  Description of Artificial Sequence: Synthetic oligonucleotide
gtactctgcaatcaaatgaagtaaatagcagcgtccttc

SEQ ID NO: 334360 - DNA, 39 bp, Artificial Sequence
  Description of Artificial Sequence: Synthetic oligonucleotide
tactctgcaatcaaatgaagtaaatagcagcgtccttcc

SEQ ID NO: 334361 - DNA, 38 bp, Artificial Sequence
  Description of Artificial Sequence: Synthetic oligonucleotide
actctgcaatcaaatgaagtaaatagcagcgtccttcc

SEQ ID NO: 334362 - DNA, 37 bp, Artificial Sequence
  Description of Artificial Sequence: Synthetic oligonucleotide
ctctgcaatcaaatgaagtaaatagcagcgtccttcc

SEQ ID NO: 334363 - DNA, 39 bp, Artificial Sequence
  Description of Artificial Sequence: Synthetic oligonucleotide
tctgcaatcaaatgaagtaaatagcagcgtccttcctag

SEQ ID NO: 334364 - DNA, 38 bp, Artificial Sequence
  Description of Artificial Sequence: Synthetic oligonucleotide
ctgcaatcaaatgaagtaaatagcagcgtccttcctag

SEQ ID NO: 334365 - DNA, 25 bp, Artificial Sequence
  Description of Artificial Sequence: Synthetic oligonucleotide
atggatcccgtgggtgcaggcaagc

SEQ ID NO: 334366 - DNA, 24 bp, Artificial Sequence
  Description of Artificial Sequence: Synthetic oligonucleotide
tggatcccgtgggtgcaggcaagc

SEQ ID NO: 334367 - DNA, 23 bp, Artificial Sequence
  Description of Artificial Sequence: Synthetic oligonucleotide
ggatcccgtgggtgcaggcaagc

SEQ ID NO: 334368 - DNA, 24 bp, Artificial Sequence
  Description of Artificial Sequence: Synthetic oligonucleotide
gatcccgtgggtgcaggcaagcca

SEQ ID NO: 334369 - DNA, 27 bp, Artificial Sequence
  Description of Artificial Sequence: Synthetic oligonucleotide
atcccgtgggtgcaggcaagccacatt

SEQ ID NO: 334370 - DNA, 26 bp, Artificial Sequence
  Description of Artificial Sequence: Synthetic oligonucleotide
tcccgtgggtgcaggcaagccacatt

SEQ ID NO: 334371 - DNA, 25 bp, Artificial Sequence
  Description of Artificial Sequence: Synthetic oligonucleotide
cccgtgggtgcaggcaagccacatt

SEQ ID NO: 334372 - DNA, 25 bp, Artificial Sequence
  Description of Artificial Sequence: Synthetic oligonucleotide
ccgtgggtgcaggcaagccacattg

SEQ ID NO: 334373 - DNA, 25 bp, Artificial Sequence
  Description of Artificial Sequence: Synthetic oligonucleotide
cgtgggtgcaggcaagccacattgg

SEQ ID NO: 334374 - DNA, 25 bp, Artificial Sequence
  Description of Artificial Sequence: Synthetic oligonucleotide
gtgggtgcaggcaagccacattggc

SEQ ID NO: 334375 - DNA, 27 bp, Artificial Sequence
  Description of Artificial Sequence: Synthetic oligonucleotide
tgggtgcaggcaagccacattggccat

SEQ ID NO: 334376 - DNA, 26 bp, Artificial Sequence
  Description of Artificial Sequence: Synthetic oligonucleotide
gggtgcaggcaagccacattggccat

SEQ ID NO: 334377 - DNA, 26 bp, Artificial Sequence
  Description of Artificial Sequence: Synthetic oligonucleotide
ggtgcaggcaagccacattggccatg

SEQ ID NO: 334378 - DNA, 26 bp, Artificial Sequence
  Description of Artificial Sequence: Synthetic oligonucleotide
gtgcaggcaagccacattggccatgg

SEQ ID NO: 334379 - DNA, 26 bp, Artificial Sequence
  Description of Artificial Sequence: Synthetic oligonucleotide
tgcaggcaagccacattggccatggg

SEQ ID NO: 334380 - DNA, 25 bp, Artificial Sequence
  Description of Artificial Sequence: Synthetic oligonucleotide
gcaggcaagccacattggccatggg

SEQ ID NO: 334381 - DNA, 25 bp, Artificial Sequence
  Description of Artificial Sequence: Synthetic oligonucleotide
caggcaagccacattggccatgggg

SEQ ID NO: 334382 - DNA, 25 bp, Artificial Sequence
  Description of Artificial Sequence: Synthetic oligonucleotide
aggcaagccacattggccatggggc

SEQ ID NO: 334383 - DNA, 24 bp, Artificial Sequence
  Description of Artificial Sequence: Synthetic oligonucleotide
ggcaagccacattggccatggggc

SEQ ID NO: 334384 - DNA, 24 bp, Artificial Sequence
  Description of Artificial Sequence: Synthetic oligonucleotide
gcaagccacattggccatggggcc

SEQ ID NO: 334385 - DNA, 24 bp, Artificial Sequence
  Description of Artificial Sequence: Synthetic oligonucleotide
caagccacattggccatggggccg

SEQ ID NO: 334386 - DNA, 25 bp, Artificial Sequence
  Description of Artificial Sequence: Synthetic oligonucleotide
aagccacattggccatggggccgct

SEQ ID NO: 334387 - DNA, 24 bp, Artificial Sequence
  Description of Artificial Sequence: Synthetic oligonucleotide
agccacattggccatggggccgct

SEQ ID NO: 334388 - DNA, 23 bp, Artificial Sequence
  Description of Artificial Sequence: Synthetic oligonucleotide
gccacattggccatggggccgct

SEQ ID NO: 334389 - DNA, 24 bp, Artificial Sequence
  Description of Artificial Sequence: Synthetic oligonucleotide
ccacattggccatggggccgctgt

SEQ ID NO: 334390 - DNA, 25 bp, Artificial Sequence
  Description of Artificial Sequence: Synthetic oligonucleotide
cacattggccatggggccgctgtca

SEQ ID NO: 334391 - DNA, 25 bp, Artificial Sequence
  Description of Artificial Sequence: Synthetic oligonucleotide
acattggccatggggccgctgtcag

SEQ ID NO: 334392 - DNA, 24 bp, Artificial Sequence
  Description of Artificial Sequence: Synthetic oligonucleotide
cattggccatggggccgctgtcag

SEQ ID NO: 334393 - DNA, 24 bp, Artificial Sequence
  Description of Artificial Sequence: Synthetic oligonucleotide
attggccatggggccgctgtcagg

SEQ ID NO: 334394 - DNA, 23 bp, Artificial Sequence
  Description of Artificial Sequence: Synthetic oligonucleotide
ttggccatggggccgctgtcagg

SEQ ID NO: 334395 - DNA, 22 bp, Artificial Sequence
  Description of Artificial Sequence: Synthetic oligonucleotide
tggccatggggccgctgtcagg

SEQ ID NO: 334396 - DNA, 21 bp, Artificial Sequence
  Description of Artificial Sequence: Synthetic oligonucleotide
ggccatggggccgctgtcagg

SEQ ID NO: 334397 - DNA, 21 bp, Artificial Sequence
  Description of Artificial Sequence: Synthetic oligonucleotide
gccatggggccgctgtcaggc

SEQ ID NO: 334398 - DNA, 21 bp, Artificial Sequence
  Description of Artificial Sequence: Synthetic oligonucleotide
ccatggggccgctgtcaggcc

SEQ ID NO: 334399 - DNA, 21 bp, Artificial Sequence
  Description of Artificial Sequence: Synthetic oligonucleotide
catggggccgctgtcaggccg

SEQ ID NO: 334400 - DNA, 22 bp, Artificial Sequence
  Description of Artificial Sequence: Synthetic oligonucleotide
atggggccgctgtcaggccgca

SEQ ID NO: 334401 - DNA, 21 bp, Artificial Sequence
  Description of Artificial Sequence: Synthetic oligonucleotide
tggggccgctgtcaggccgca

SEQ ID NO: 334402 - DNA, 20 bp, Artificial Sequence
  Description of Artificial Sequence: Synthetic oligonucleotide
ggggccgctgtcaggccgca

SEQ ID NO: 334403 - DNA, 21 bp, Artificial Sequence
  Description of Artificial Sequence: Synthetic oligonucleotide
gggccgctgtcaggccgcact

SEQ ID NO: 334404 - DNA, 21 bp, Artificial Sequence
  Description of Artificial Sequence: Synthetic oligonucleotide
ggccgctgtcaggccgcactc

SEQ ID NO: 334405 - DNA, 26 bp, Artificial Sequence
  Description of Artificial Sequence: Synthetic oligonucleotide
gccgctgtcaggccgcactcctattt

SEQ ID NO: 334406 - DNA, 27 bp, Artificial Sequence
  Description of Artificial Sequence: Synthetic oligonucleotide
ccgctgtcaggccgcactcctatttca

SEQ ID NO: 334407 - DNA, 27 bp, Artificial Sequence
  Description of Artificial Sequence: Synthetic oligonucleotide
cgctgtcaggccgcactcctatttcag

SEQ ID NO: 334408 - DNA, 27 bp, Artificial Sequence
  Description of Artificial Sequence: Synthetic oligonucleotide
gctgtcaggccgcactcctatttcagg

SEQ ID NO: 334409 - DNA, 28 bp, Artificial Sequence
  Description of Artificial Sequence: Synthetic oligonucleotide
ctgtcaggccgcactcctatttcaggtg

SEQ ID NO: 334410 - DNA, 28 bp, Artificial Sequence
  Description of Artificial Sequence: Synthetic oligonucleotide
tgtcaggccgcactcctatttcaggtgc

SEQ ID NO: 334411 - DNA, 27 bp, Artificial Sequence
  Description of Artificial Sequence: Synthetic oligonucleotide
gtcaggccgcactcctatttcaggtgc

SEQ ID NO: 334412 - DNA, 28 bp, Artificial Sequence
  Description of Artificial Sequence: Synthetic oligonucleotide
tcaggccgcactcctatttcaggtgctg

SEQ ID NO: 334413 - DNA, 27 bp, Artificial Sequence
  Description of Artificial Sequence: Synthetic oligonucleotide
caggccgcactcctatttcaggtgctg

SEQ ID NO: 334414 - DNA, 27 bp, Artificial Sequence
  Description of Artificial Sequence: Synthetic oligonucleotide
aggccgcactcctatttcaggtgctgg

SEQ ID NO: 334415 - DNA, 27 bp, Artificial Sequence
  Description of Artificial Sequence: Synthetic oligonucleotide
ggccgcactcctatttcaggtgctggt

SEQ ID NO: 334416 - DNA, 27 bp, Artificial Sequence
  Description of Artificial Sequence: Synthetic oligonucleotide
gccgcactcctatttcaggtgctggtg

SEQ ID NO: 334417 - DNA, 27 bp, Artificial Sequence
  Description of Artificial Sequence: Synthetic oligonucleotide
ccgcactcctatttcaggtgctggtgg

SEQ ID NO: 334418 - DNA, 27 bp, Artificial Sequence
  Description of Artificial Sequence: Synthetic oligonucleotide
cgcactcctatttcaggtgctggtggg

SEQ ID NO: 334419 - DNA, 28 bp, Artificial Sequence
  Description of Artificial Sequence: Synthetic oligonucleotide
gcactcctatttcaggtgctggtgggtg

SEQ ID NO: 334420 - DNA, 29 bp, Artificial Sequence
  Description of Artificial Sequence: Synthetic oligonucleotide
cactcctatttcaggtgctggtgggtgtg

SEQ ID NO: 334421 - DNA, 30 bp, Artificial Sequence
  Description of Artificial Sequence: Synthetic oligonucleotide
actcctatttcaggtgctggtgggtgtgtg

SEQ ID NO: 334422 - DNA, 29 bp, Artificial Sequence
  Description of Artificial Sequence: Synthetic oligonucleotide
ctcctatttcaggtgctggtgggtgtgtg

SEQ ID NO: 334423 - DNA, 32 bp, Artificial Sequence
  Description of Artificial Sequence: Synthetic oligonucleotide
tcctatttcaggtgctggtgggtgtgtgtttg

SEQ ID NO: 334424 - DNA, 31 bp, Artificial Sequence
  Description of Artificial Sequence: Synthetic oligonucleotide
cctatttcaggtgctggtgggtgtgtgtttg

SEQ ID NO: 334425 - DNA, 33 bp, Artificial Sequence
  Description of Artificial Sequence: Synthetic oligonucleotide
ctatttcaggtgctggtgggtgtgtgtttgttc

SEQ ID NO: 334426 - DNA, 34 bp, Artificial Sequence
  Description of Artificial Sequence: Synthetic oligonucleotide
tatttcaggtgctggtgggtgtgtgtttgttctc

SEQ ID NO: 334427 - DNA, 33 bp, Artificial Sequence
  Description of Artificial Sequence: Synthetic oligonucleotide
atttcaggtgctggtgggtgtgtgtttgttctc

SEQ ID NO: 334428 - DNA, 32 bp, Artificial Sequence
  Description of Artificial Sequence: Synthetic oligonucleotide
tttcaggtgctggtgggtgtgtgtttgttctc

SEQ ID NO: 334429 - DNA, 31 bp, Artificial Sequence
  Description of Artificial Sequence: Synthetic oligonucleotide
ttcaggtgctggtgggtgtgtgtttgttctc

SEQ ID NO: 334430 - DNA, 30 bp, Artificial Sequence
  Description of Artificial Sequence: Synthetic oligonucleotide
tcaggtgctggtgggtgtgtgtttgttctc

SEQ ID NO: 334431 - DNA, 29 bp, Artificial Sequence
  Description of Artificial Sequence: Synthetic oligonucleotide
caggtgctggtgggtgtgtgtttgttctc

SEQ ID NO: 334432 - DNA, 29 bp, Artificial Sequence
  Description of Artificial Sequence: Synthetic oligonucleotide
aggtgctggtgggtgtgtgtttgttctcc

SEQ ID NO: 334433 - DNA, 28 bp, Artificial Sequence
  Description of Artificial Sequence: Synthetic oligonucleotide
ggtgctggtgggtgtgtgtttgttctcc

SEQ ID NO: 334434 - DNA, 30 bp, Artificial Sequence
  Description of Artificial Sequence: Synthetic oligonucleotide
gtgctggtgggtgtgtgtttgttctcctac

SEQ ID NO: 334435 - DNA, 30 bp, Artificial Sequence
  Description of Artificial Sequence: Synthetic oligonucleotide
tgctggtgggtgtgtgtttgttctcctacg

SEQ ID NO: 334436 - DNA, 29 bp, Artificial Sequence
  Description of Artificial Sequence: Synthetic oligonucleotide
gctggtgggtgtgtgtttgttctcctacg

SEQ ID NO: 334437 - DNA, 30 bp, Artificial Sequence
  Description of Artificial Sequence: Synthetic oligonucleotide
ctggtgggtgtgtgtttgttctcctacgtg

SEQ ID NO: 334438 - DNA, 30 bp, Artificial Sequence
  Description of Artificial Sequence: Synthetic oligonucleotide
tggtgggtgtgtgtttgttctcctacgtgc

SEQ ID NO: 334439 - DNA, 29 bp, Artificial Sequence
  Description of Artificial Sequence: Synthetic oligonucleotide
ggtgggtgtgtgtttgttctcctacgtgc

SEQ ID NO: 334440 - DNA, 29 bp, Artificial Sequence
  Description of Artificial Sequence: Synthetic oligonucleotide
gtgggtgtgtgtttgttctcctacgtgcg

SEQ ID NO: 334441 - DNA, 30 bp, Artificial Sequence
  Description of Artificial Sequence: Synthetic oligonucleotide
tgggtgtgtgtttgttctcctacgtgcgtg

SEQ ID NO: 334442 - DNA, 29 bp, Artificial Sequence
  Description of Artificial Sequence: Synthetic oligonucleotide
gggtgtgtgtttgttctcctacgtgcgtg

SEQ ID NO: 334443 - DNA, 30 bp, Artificial Sequence
  Description of Artificial Sequence: Synthetic oligonucleotide
ggtgtgtgtttgttctcctacgtgcgtgtg

SEQ ID NO: 334444 - DNA, 31 bp, Artificial Sequence
  Description of Artificial Sequence: Synthetic oligonucleotide
gtgtgtgtttgttctcctacgtgcgtgtgtg

SEQ ID NO: 334445 - DNA, 31 bp, Artificial Sequence
  Description of Artificial Sequence: Synthetic oligonucleotide
tgtgtgtttgttctcctacgtgcgtgtgtgc

SEQ ID NO: 334446 - DNA, 30 bp, Artificial Sequence
  Description of Artificial Sequence: Synthetic oligonucleotide
gtgtgtttgttctcctacgtgcgtgtgtgc

SEQ ID NO: 334447 - DNA, 30 bp, Artificial Sequence
  Description of Artificial Sequence: Synthetic oligonucleotide
tgtgtttgttctcctacgtgcgtgtgtgcc

SEQ ID NO: 334448 - DNA, 29 bp, Artificial Sequence
  Description of Artificial Sequence: Synthetic oligonucleotide
gtgtttgttctcctacgtgcgtgtgtgcc

SEQ ID NO: 334449 - DNA, 29 bp, Artificial Sequence
  Description of Artificial Sequence: Synthetic oligonucleotide
tgtttgttctcctacgtgcgtgtgtgccg

SEQ ID NO: 334450 - DNA, 28 bp, Artificial Sequence
  Description of Artificial Sequence: Synthetic oligonucleotide
gtttgttctcctacgtgcgtgtgtgccg

SEQ ID NO: 334451 - DNA, 29 bp, Artificial Sequence
  Description of Artificial Sequence: Synthetic oligonucleotide
tttgttctcctacgtgcgtgtgtgccgag

SEQ ID NO: 334452 - DNA, 28 bp, Artificial Sequence
  Description of Artificial Sequence: Synthetic oligonucleotide
ttgttctcctacgtgcgtgtgtgccgag

SEQ ID NO: 334453 - DNA, 27 bp, Artificial Sequence
  Description of Artificial Sequence: Synthetic oligonucleotide
tgttctcctacgtgcgtgtgtgccgag

SEQ ID NO: 334454 - DNA, 27 bp, Artificial Sequence
  Description of Artificial Sequence: Synthetic oligonucleotide
gttctcctacgtgcgtgtgtgccgaga

SEQ ID NO: 334455 - DNA, 27 bp, Artificial Sequence
  Description of Artificial Sequence: Synthetic oligonucleotide
ttctcctacgtgcgtgtgtgccgagac

SEQ ID NO: 334456 - DNA, 26 bp, Artificial Sequence
  Description of Artificial Sequence: Synthetic oligonucleotide
tctcctacgtgcgtgtgtgccgagac

SEQ ID NO: 334457 - DNA, 25 bp, Artificial Sequence
  Description of Artificial Sequence: Synthetic oligonucleotide
ctcctacgtgcgtgtgtgccgagac

SEQ ID NO: 334458 - DNA, 27 bp, Artificial Sequence
  Description of Artificial Sequence: Synthetic oligonucleotide
tcctacgtgcgtgtgtgccgagacgaa

SEQ ID NO: 334459 - DNA, 26 bp, Artificial Sequence
  Description of Artificial Sequence: Synthetic oligonucleotide
cctacgtgcgtgtgtgccgagacgaa

SEQ ID NO: 334460 - DNA, 26 bp, Artificial Sequence
  Description of Artificial Sequence: Synthetic oligonucleotide
ctacgtgcgtgtgtgccgagacgaag

SEQ ID NO: 334461 - DNA, 26 bp, Artificial Sequence
  Description of Artificial Sequence: Synthetic oligonucleotide
tacgtgcgtgtgtgccgagacgaagc

SEQ ID NO: 334462 - DNA, 25 bp, Artificial Sequence
  Description of Artificial Sequence: Synthetic oligonucleotide
acgtgcgtgtgtgccgagacgaagc

SEQ ID NO: 334463 - DNA, 24 bp, Artificial Sequence
  Description of Artificial Sequence: Synthetic oligonucleotide
cgtgcgtgtgtgccgagacgaagc

SEQ ID NO: 334464 - DNA, 25 bp, Artificial Sequence
  Description of Artificial Sequence: Synthetic oligonucleotide
gtgcgtgtgtgccgagacgaagcca

SEQ ID NO: 334465 - DNA, 26 bp, Artificial Sequence
  Description of Artificial Sequence: Synthetic oligonucleotide
tgcgtgtgtgccgagacgaagccact

SEQ ID NO: 334466 - DNA, 25 bp, Artificial Sequence
  Description of Artificial Sequence: Synthetic oligonucleotide
gcgtgtgtgccgagacgaagccact

SEQ ID NO: 334467 - DNA, 25 bp, Artificial Sequence
  Description of Artificial Sequence: Synthetic oligonucleotide
cgtgtgtgccgagacgaagccactg

SEQ ID NO: 334468 - DNA, 27 bp, Artificial Sequence
  Description of Artificial Sequence: Synthetic oligonucleotide
gtgtgtgccgagacgaagccactggaa

SEQ ID NO: 334469 - DNA, 27 bp, Artificial Sequence
  Description of Artificial Sequence: Synthetic oligonucleotide
tgtgtgccgagacgaagccactggaac

SEQ ID NO: 334470 - DNA, 26 bp, Artificial Sequence
  Description of Artificial Sequence: Synthetic oligonucleotide
gtgtgccgagacgaagccactggaac

SEQ ID NO: 334471 - DNA, 26 bp, Artificial Sequence
  Description of Artificial Sequence: Synthetic oligonucleotide
tgtgccgagacgaagccactggaacc

SEQ ID NO: 334472 - DNA, 25 bp, Artificial Sequence
  Description of Artificial Sequence: Synthetic oligonucleotide
gtgccgagacgaagccactggaacc

SEQ ID NO: 334473 - DNA, 25 bp, Artificial Sequence
  Description of Artificial Sequence: Synthetic oligonucleotide
tgccgagacgaagccactggaaccc

SEQ ID NO: 334474 - DNA, 24 bp, Artificial Sequence
  Description of Artificial Sequence: Synthetic oligonucleotide
gccgagacgaagccactggaaccc

SEQ ID NO: 334475 - DNA, 26 bp, Artificial Sequence
  Description of Artificial Sequence: Synthetic oligonucleotide
ccgagacgaagccactggaaccccta

SEQ ID NO: 334476 - DNA, 26 bp, Artificial Sequence
  Description of Artificial Sequence: Synthetic oligonucleotide
cgagacgaagccactggaacccctag

SEQ ID NO: 334477 - DNA, 26 bp, Artificial Sequence
  Description of Artificial Sequence: Synthetic oligonucleotide
gagacgaagccactggaacccctagg

SEQ ID NO: 334478 - DNA, 26 bp, Artificial Sequence
  Description of Artificial Sequence: Synthetic oligonucleotide
agacgaagccactggaacccctaggg

SEQ ID NO: 334479 - DNA, 25 bp, Artificial Sequence
  Description of Artificial Sequence: Synthetic oligonucleotide
gacgaagccactggaacccctaggg

SEQ ID NO: 334480 - DNA, 26 bp, Artificial Sequence
  Description of Artificial Sequence: Synthetic oligonucleotide
acgaagccactggaacccctaggggt

SEQ ID NO: 334481 - DNA, 25 bp, Artificial Sequence
  Description of Artificial Sequence: Synthetic oligonucleotide
cgaagccactggaacccctaggggt

SEQ ID NO: 334482 - DNA, 25 bp, Artificial Sequence
  Description of Artificial Sequence: Synthetic oligonucleotide
gaagccactggaacccctaggggtc

SEQ ID NO: 334483 - DNA, 25 bp, Artificial Sequence
  Description of Artificial Sequence: Synthetic oligonucleotide
aagccactggaacccctaggggtcc

SEQ ID NO: 334484 - DNA, 24 bp, Artificial Sequence
  Description of Artificial Sequence: Synthetic oligonucleotide
agccactggaacccctaggggtcc

SEQ ID NO: 334485 - DNA, 23 bp, Artificial Sequence
  Description of Artificial Sequence: Synthetic oligonucleotide
gccactggaacccctaggggtcc

SEQ ID NO: 334486 - DNA, 24 bp, Artificial Sequence
  Description of Artificial Sequence: Synthetic oligonucleotide
ccactggaacccctaggggtccca

SEQ ID NO: 334487 - DNA, 25 bp, Artificial Sequence
  Description of Artificial Sequence: Synthetic oligonucleotide
cactggaacccctaggggtcccagt

SEQ ID NO: 334488 - DNA, 25 bp, Artificial Sequence
  Description of Artificial Sequence: Synthetic oligonucleotide
actggaacccctaggggtcccagtg

SEQ ID NO: 334489 - DNA, 24 bp, Artificial Sequence
  Description of Artificial Sequence: Synthetic oligonucleotide
ctggaacccctaggggtcccagtg

SEQ ID NO: 334490 - DNA, 24 bp, Artificial Sequence
  Description of Artificial Sequence: Synthetic oligonucleotide
tggaacccctaggggtcccagtgg

SEQ ID NO: 334491 - DNA, 23 bp, Artificial Sequence
  Description of Artificial Sequence: Synthetic oligonucleotide
ggaacccctaggggtcccagtgg

SEQ ID NO: 334492 - DNA, 24 bp, Artificial Sequence
  Description of Artificial Sequence: Synthetic oligonucleotide
gaacccctaggggtcccagtggct

SEQ ID NO: 334493 - DNA, 24 bp, Artificial Sequence
  Description of Artificial Sequence: Synthetic oligonucleotide
aacccctaggggtcccagtggctc

SEQ ID NO: 334494 - DNA, 23 bp, Artificial Sequence
  Description of Artificial Sequence: Synthetic oligonucleotide
acccctaggggtcccagtggctc

SEQ ID NO: 334495 - DNA, 22 bp, Artificial Sequence
  Description of Artificial Sequence: Synthetic oligonucleotide
cccctaggggtcccagtggctc

SEQ ID NO: 334496 - DNA, 23 bp, Artificial Sequence
  Description of Artificial Sequence: Synthetic oligonucleotide
ccctaggggtcccagtggctcct

SEQ ID NO: 334497 - DNA, 23 bp, Artificial Sequence
  Description of Artificial Sequence: Synthetic oligonucleotide
cctaggggtcccagtggctcctc

SEQ ID NO: 334498 - DNA, 23 bp, Artificial Sequence
  Description of Artificial Sequence: Synthetic oligonucleotide
ctaggggtcccagtggctcctcc

SEQ ID NO: 334499 - DNA, 23 bp, Artificial Sequence
  Description of Artificial Sequence: Synthetic oligonucleotide
taggggtcccagtggctcctccc

SEQ ID NO: 334500 - DNA, 22 bp, Artificial Sequence
  Description of Artificial Sequence: Synthetic oligonucleotide
aggggtcccagtggctcctccc

SEQ ID NO: 334501 - DNA, 21 bp, Artificial Sequence
  Description of Artificial Sequence: Synthetic oligonucleotide
ggggtcccagtggctcctccc

SEQ ID NO: 334502 - DNA, 22 bp, Artificial Sequence
  Description of Artificial Sequence: Synthetic oligonucleotide
gggtcccagtggctcctcccga

SEQ ID NO: 334503 - DNA, 23 bp, Artificial Sequence
  Description of Artificial Sequence: Synthetic oligonucleotide
ggtcccagtggctcctcccgaga

SEQ ID NO: 334504 - DNA, 23 bp, Artificial Sequence
  Description of Artificial Sequence: Synthetic oligonucleotide
gtcccagtggctcctcccgagag

SEQ ID NO: 334505 - DNA, 24 bp, Artificial Sequence
  Description of Artificial Sequence: Synthetic oligonucleotide
tcccagtggctcctcccgagagga

SEQ ID NO: 334506 - DNA, 23 bp, Artificial Sequence
  Description of Artificial Sequence: Synthetic oligonucleotide
cccagtggctcctcccgagagga

SEQ ID NO: 334507 - DNA, 24 bp, Artificial Sequence
  Description of Artificial Sequence: Synthetic oligonucleotide
ccagtggctcctcccgagaggaca

SEQ ID NO: 334508 - DNA, 24 bp, Artificial Sequence
  Description of Artificial Sequence: Synthetic oligonucleotide
cagtggctcctcccgagaggacac

SEQ ID NO: 334509 - DNA, 25 bp, Artificial Sequence
  Description of Artificial Sequence: Synthetic oligonucleotide
agtggctcctcccgagaggacacca

SEQ ID NO: 334510 - DNA, 24 bp, Artificial Sequence
  Description of Artificial Sequence: Synthetic oligonucleotide
gtggctcctcccgagaggacacca

SEQ ID NO: 334511 - DNA, 25 bp, Artificial Sequence
  Description of Artificial Sequence: Synthetic oligonucleotide
tggctcctcccgagaggacaccagt

SEQ ID NO: 334512 - DNA, 24 bp, Artificial Sequence
  Description of Artificial Sequence: Synthetic oligonucleotide
ggctcctcccgagaggacaccagt

SEQ ID NO: 334513 - DNA, 24 bp, Artificial Sequence
  Description of Artificial Sequence: Synthetic oligonucleotide
gctcctcccgagaggacaccagtc

SEQ ID NO: 334514 - DNA, 24 bp, Artificial Sequence
  Description of Artificial Sequence: Synthetic oligonucleotide
ctcctcccgagaggacaccagtcc

SEQ ID NO: 334515 - DNA, 25 bp, Artificial Sequence
  Description of Artificial Sequence: Synthetic oligonucleotide
tcctcccgagaggacaccagtccca

SEQ ID NO: 334516 - DNA, 24 bp, Artificial Sequence
  Description of Artificial Sequence: Synthetic oligonucleotide
cctcccgagaggacaccagtccca

SEQ ID NO: 334517 - DNA, 24 bp, Artificial Sequence
  Description of Artificial Sequence: Synthetic oligonucleotide
ctcccgagaggacaccagtcccac

SEQ ID NO: 334518 - DNA, 24 bp, Artificial Sequence
  Description of Artificial Sequence: Synthetic oligonucleotide
tcccgagaggacaccagtcccacc

SEQ ID NO: 334519 - DNA, 23 bp, Artificial Sequence
  Description of Artificial Sequence: Synthetic oligonucleotide
cccgagaggacaccagtcccacc

SEQ ID NO: 334520 - DNA, 23 bp, Artificial Sequence
  Description of Artificial Sequence: Synthetic oligonucleotide
ccgagaggacaccagtcccaccc

SEQ ID NO: 334521 - DNA, 23 bp, Artificial Sequence
  Description of Artificial Sequence: Synthetic oligonucleotide
cgagaggacaccagtcccacccg

SEQ ID NO: 334522 - DNA, 23 bp, Artificial Sequence
  Description of Artificial Sequence: Synthetic oligonucleotide
gagaggacaccagtcccacccgg

SEQ ID NO: 334523 - DNA, 23 bp, Artificial Sequence
  Description of Artificial Sequence: Synthetic oligonucleotide
agaggacaccagtcccacccggc

SEQ ID NO: 334524 - DNA, 22 bp, Artificial Sequence
  Description of Artificial Sequence: Synthetic oligonucleotide
gaggacaccagtcccacccggc

SEQ ID NO: 334525 - DNA, 22 bp, Artificial Sequence
  Description of Artificial Sequence: Synthetic oligonucleotide
aggacaccagtcccacccggcc

SEQ ID NO: 334526 - DNA, 21 bp, Artificial Sequence
  Description of Artificial Sequence: Synthetic oligonucleotide
ggacaccagtcccacccggcc

SEQ ID NO: 334527 - DNA, 22 bp, Artificial Sequence
  Description of Artificial Sequence: Synthetic oligonucleotide
gacaccagtcccacccggccca

SEQ ID NO: 334528 - DNA, 22 bp, Artificial Sequence
  Description of Artificial Sequence: Synthetic oligonucleotide
acaccagtcccacccggcccac

SEQ ID NO: 334529 - DNA, 21 bp, Artificial Sequence
  Description of Artificial Sequence: Synthetic oligonucleotide
caccagtcccacccggcccac

SEQ ID NO: 334530 - DNA, 21 bp, Artificial Sequence
  Description of Artificial Sequence: Synthetic oligonucleotide
accagtcccacccggcccacc

SEQ ID NO: 334531 - DNA, 20 bp, Artificial Sequence
  Description of Artificial Sequence: Synthetic oligonucleotide
ccagtcccacccggcccacc

SEQ ID NO: 334532 - DNA, 21 bp, Artificial Sequence
  Description of Artificial Sequence: Synthetic oligonucleotide
cagtcccacccggcccaccct

SEQ ID NO: 334533 - DNA, 21 bp, Artificial Sequence
  Description of Artificial Sequence: Synthetic oligonucleotide
agtcccacccggcccaccctc

SEQ ID NO: 334534 - DNA, 20 bp, Artificial Sequence
  Description of Artificial Sequence: Synthetic oligonucleotide
gtcccacccggcccaccctc

SEQ ID NO: 334535 - DNA, 21 bp, Artificial Sequence
  Description of Artificial Sequence: Synthetic oligonucleotide
tcccacccggcccaccctcgt

SEQ ID NO: 334536 - DNA, 20 bp, Artificial Sequence
  Description of Artificial Sequence: Synthetic oligonucleotide
cccacccggcccaccctcgt

SEQ ID NO: 334537 - DNA, 22 bp, Artificial Sequence
  Description of Artificial Sequence: Synthetic oligonucleotide
ccacccggcccaccctcgtgat

SEQ ID NO: 334538 - DNA, 22 bp, Artificial Sequence
  Description of Artificial Sequence: Synthetic oligonucleotide
cacccggcccaccctcgtgatc

SEQ ID NO: 334539 - DNA, 23 bp, Artificial Sequence
  Description of Artificial Sequence: Synthetic oligonucleotide
acccggcccaccctcgtgatcct

SEQ ID NO: 334540 - DNA, 22 bp, Artificial Sequence
  Description of Artificial Sequence: Synthetic oligonucleotide
cccggcccaccctcgtgatcct

SEQ ID NO: 334541 - DNA, 22 bp, Artificial Sequence
  Description of Artificial Sequence: Synthetic oligonucleotide
ccggcccaccctcgtgatcctg

SEQ ID NO: 334542 - DNA, 25 bp, Artificial Sequence
  Description of Artificial Sequence: Synthetic oligonucleotide
cggcccaccctcgtgatcctgcaat

SEQ ID NO: 334543 - DNA, 25 bp, Artificial Sequence
  Description of Artificial Sequence: Synthetic oligonucleotide
ggcccaccctcgtgatcctgcaatg

SEQ ID NO: 334544 - DNA, 26 bp, Artificial Sequence
  Description of Artificial Sequence: Synthetic oligonucleotide
gcccaccctcgtgatcctgcaatgga

SEQ ID NO: 334545 - DNA, 27 bp, Artificial Sequence
  Description of Artificial Sequence: Synthetic oligonucleotide
cccaccctcgtgatcctgcaatggaca

SEQ ID NO: 334546 - DNA, 28 bp, Artificial Sequence
  Description of Artificial Sequence: Synthetic oligonucleotide
ccaccctcgtgatcctgcaatggacatg

SEQ ID NO: 334547 - DNA, 28 bp, Artificial Sequence
  Description of Artificial Sequence: Synthetic oligonucleotide
caccctcgtgatcctgcaatggacatgc

SEQ ID NO: 334548 - DNA, 28 bp, Artificial Sequence
  Description of Artificial Sequence: Synthetic oligonucleotide
accctcgtgatcctgcaatggacatgcc

SEQ ID NO: 334549 - DNA, 27 bp, Artificial Sequence
  Description of Artificial Sequence: Synthetic oligonucleotide
ccctcgtgatcctgcaatggacatgcc

SEQ ID NO: 334550 - DNA, 27 bp, Artificial Sequence
  Description of Artificial Sequence: Synthetic oligonucleotide
cctcgtgatcctgcaatggacatgccc

SEQ ID NO: 334551 - DNA, 30 bp, Artificial Sequence
  Description of Artificial Sequence: Synthetic oligonucleotide
ctcgtgatcctgcaatggacatgccctttc

SEQ ID NO: 334552 - DNA, 30 bp, Artificial Sequence
  Description of Artificial Sequence: Synthetic oligonucleotide
tcgtgatcctgcaatggacatgccctttcc

SEQ ID NO: 334553 - DNA, 29 bp, Artificial Sequence
  Description of Artificial Sequence: Synthetic oligonucleotide
cgtgatcctgcaatggacatgccctttcc

SEQ ID NO: 334554 - DNA, 30 bp, Artificial Sequence
  Description of Artificial Sequence: Synthetic oligonucleotide
gtgatcctgcaatggacatgccctttccac

SEQ ID NO: 334555 - DNA, 32 bp, Artificial Sequence
  Description of Artificial Sequence: Synthetic oligonucleotide
tgatcctgcaatggacatgccctttccacttc

SEQ ID NO: 334556 - DNA, 31 bp, Artificial Sequence
  Description of Artificial Sequence: Synthetic oligonucleotide
gatcctgcaatggacatgccctttccacttc

SEQ ID NO: 334557 - DNA, 31 bp, Artificial Sequence
  Description of Artificial Sequence: Synthetic oligonucleotide
atcctgcaatggacatgccctttccacttcc

SEQ ID NO: 334558 - DNA, 30 bp, Artificial Sequence
  Description of Artificial Sequence: Synthetic oligonucleotide
tcctgcaatggacatgccctttccacttcc

SEQ ID NO: 334559 - DNA, 29 bp, Artificial Sequence
  Description of Artificial Sequence: Synthetic oligonucleotide
cctgcaatggacatgccctttccacttcc

SEQ ID NO: 334560 - DNA, 29 bp, Artificial Sequence
  Description of Artificial Sequence: Synthetic oligonucleotide
ctgcaatggacatgccctttccacttccc

SEQ ID NO: 334561 - DNA, 30 bp, Artificial Sequence
  Description of Artificial Sequence: Synthetic oligonucleotide
tgcaatggacatgccctttccacttccctg

SEQ ID NO: 334562 - DNA, 29 bp, Artificial Sequence
  Description of Artificial Sequence: Synthetic oligonucleotide
gcaatggacatgccctttccacttccctg

SEQ ID NO: 334563 - DNA, 30 bp, Artificial Sequence
  Description of Artificial Sequence: Synthetic oligonucleotide
caatggacatgccctttccacttccctgtg

SEQ ID NO: 334564 - DNA, 30 bp, Artificial Sequence
  Description of Artificial Sequence: Synthetic oligonucleotide
aatggacatgccctttccacttccctgtgg

SEQ ID NO: 334565 - DNA, 29 bp, Artificial Sequence
  Description of Artificial Sequence: Synthetic oligonucleotide
atggacatgccctttccacttccctgtgg

SEQ ID NO: 334566 - DNA, 28 bp, Artificial Sequence
  Description of Artificial Sequence: Synthetic oligonucleotide
tggacatgccctttccacttccctgtgg

SEQ ID NO: 334567 - DNA, 27 bp, Artificial Sequence
  Description of Artificial Sequence: Synthetic oligonucleotide
ggacatgccctttccacttccctgtgg

SEQ ID NO: 334568 - DNA, 27 bp, Artificial Sequence
  Description of Artificial Sequence: Synthetic oligonucleotide
gacatgccctttccacttccctgtggg

SEQ ID NO: 334569 - DNA, 28 bp, Artificial Sequence
  Description of Artificial Sequence: Synthetic oligonucleotide
acatgccctttccacttccctgtgggtc

SEQ ID NO: 334570 - DNA, 27 bp, Artificial Sequence
  Description of Artificial Sequence: Synthetic oligonucleotide
catgccctttccacttccctgtgggtc

SEQ ID NO: 334571 - DNA, 28 bp, Artificial Sequence
  Description of Artificial Sequence: Synthetic oligonucleotide
atgccctttccacttccctgtgggtctg

SEQ ID NO: 334572 - DNA, 27 bp, Artificial Sequence
  Description of Artificial Sequence: Synthetic oligonucleotide
tgccctttccacttccctgtgggtctg

SEQ ID NO: 334573 - DNA, 27 bp, Artificial Sequence
  Description of Artificial Sequence: Synthetic oligonucleotide
gccctttccacttccctgtgggtctgt

SEQ ID NO: 334574 - DNA, 27 bp, Artificial Sequence
  Description of Artificial Sequence: Synthetic oligonucleotide
ccctttccacttccctgtgggtctgtc

SEQ ID NO: 334575 - DNA, 27 bp, Artificial Sequence
  Description of Artificial Sequence: Synthetic oligonucleotide
cctttccacttccctgtgggtctgtcc

SEQ ID NO: 334576 - DNA, 27 bp, Artificial Sequence
  Description of Artificial Sequence: Synthetic oligonucleotide
ctttccacttccctgtgggtctgtccc

SEQ ID NO: 334577 - DNA, 27 bp, Artificial Sequence
  Description of Artificial Sequence: Synthetic oligonucleotide
tttccacttccctgtgggtctgtcccg

SEQ ID NO: 334578 - DNA, 26 bp, Artificial Sequence
  Description of Artificial Sequence: Synthetic oligonucleotide
ttccacttccctgtgggtctgtcccg

SEQ ID NO: 334579 - DNA, 25 bp, Artificial Sequence
  Description of Artificial Sequence: Synthetic oligonucleotide
tccacttccctgtgggtctgtcccg

SEQ ID NO: 334580 - DNA, 24 bp, Artificial Sequence
  Description of Artificial Sequence: Synthetic oligonucleotide
ccacttccctgtgggtctgtcccg

SEQ ID NO: 334581 - DNA, 25 bp, Artificial Sequence
  Description of Artificial Sequence: Synthetic oligonucleotide
cacttccctgtgggtctgtcccggt

SEQ ID NO: 334582 - DNA, 27 bp, Artificial Sequence
  Description of Artificial Sequence: Synthetic oligonucleotide
acttccctgtgggtctgtcccggtgtt

SEQ ID NO: 334583 - DNA, 26 bp, Artificial Sequence
  Description of Artificial Sequence: Synthetic oligonucleotide
cttccctgtgggtctgtcccggtgtt

SEQ ID NO: 334584 - DNA, 27 bp, Artificial Sequence
  Description of Artificial Sequence: Synthetic oligonucleotide
ttccctgtgggtctgtcccggtgttca

SEQ ID NO: 334585 - DNA, 26 bp, Artificial Sequence
  Description of Artificial Sequence: Synthetic oligonucleotide
tccctgtgggtctgtcccggtgttca

SEQ ID NO: 334586 - DNA, 25 bp, Artificial Sequence
  Description of Artificial Sequence: Synthetic oligonucleotide
ccctgtgggtctgtcccggtgttca

SEQ ID NO: 334587 - DNA, 26 bp, Artificial Sequence
  Description of Artificial Sequence: Synthetic oligonucleotide
cctgtgggtctgtcccggtgttcaga

SEQ ID NO: 334588 - DNA, 27 bp, Artificial Sequence
  Description of Artificial Sequence: Synthetic oligonucleotide
ctgtgggtctgtcccggtgttcagagt

SEQ ID NO: 334589 - DNA, 28 bp, Artificial Sequence
  Description of Artificial Sequence: Synthetic oligonucleotide
tgtgggtctgtcccggtgttcagagttg

SEQ ID NO: 334590 - DNA, 27 bp, Artificial Sequence
  Description of Artificial Sequence: Synthetic oligonucleotide
gtgggtctgtcccggtgttcagagttg

SEQ ID NO: 334591 - DNA, 27 bp, Artificial Sequence
  Description of Artificial Sequence: Synthetic oligonucleotide
tgggtctgtcccggtgttcagagttgg

SEQ ID NO: 334592 - DNA, 27 bp, Artificial Sequence
  Description of Artificial Sequence: Synthetic oligonucleotide
gggtctgtcccggtgttcagagttggt

SEQ ID NO: 334593 - DNA, 27 bp, Artificial Sequence
  Description of Artificial Sequence: Synthetic oligonucleotide
ggtctgtcccggtgttcagagttggtg

SEQ ID NO: 334594 - DNA, 27 bp, Artificial Sequence
  Description of Artificial Sequence: Synthetic oligonucleotide
gtctgtcccggtgttcagagttggtgc

SEQ ID NO: 334595 - DNA, 27 bp, Artificial Sequence
  Description of Artificial Sequence: Synthetic oligonucleotide
tctgtcccggtgttcagagttggtgcc

SEQ ID NO: 334596 - DNA, 26 bp, Artificial Sequence
  Description of Artificial Sequence: Synthetic oligonucleotide
ctgtcccggtgttcagagttggtgcc

SEQ ID NO: 334597 - DNA, 26 bp, Artificial Sequence
  Description of Artificial Sequence: Synthetic oligonucleotide
tgtcccggtgttcagagttggtgccc

SEQ ID NO: 334598 - DNA, 25 bp, Artificial Sequence
  Description of Artificial Sequence: Synthetic oligonucleotide
gtcccggtgttcagagttggtgccc

SEQ ID NO: 334599 - DNA, 25 bp, Artificial Sequence
  Description of Artificial Sequence: Synthetic oligonucleotide
tcccggtgttcagagttggtgcccg

SEQ ID NO: 334600 - DNA, 24 bp, Artificial Sequence
  Description of Artificial Sequence: Synthetic oligonucleotide
cccggtgttcagagttggtgcccg

SEQ ID NO: 334601 - DNA, 24 bp, Artificial Sequence
  Description of Artificial Sequence: Synthetic oligonucleotide
ccggtgttcagagttggtgcccgc

SEQ ID NO: 334602 - DNA, 25 bp, Artificial Sequence
  Description of Artificial Sequence: Synthetic oligonucleotide
cggtgttcagagttggtgcccgcca

SEQ ID NO: 334603 - DNA, 26 bp, Artificial Sequence
  Description of Artificial Sequence: Synthetic oligonucleotide
ggtgttcagagttggtgcccgccaca

SEQ ID NO: 334604 - DNA, 26 bp, Artificial Sequence
  Description of Artificial Sequence: Synthetic oligonucleotide
gtgttcagagttggtgcccgccacag

SEQ ID NO: 334605 - DNA, 26 bp, Artificial Sequence
  Description of Artificial Sequence: Synthetic oligonucleotide
tgttcagagttggtgcccgccacagc

SEQ ID NO: 334606 - DNA, 25 bp, Artificial Sequence
  Description of Artificial Sequence: Synthetic oligonucleotide
gttcagagttggtgcccgccacagc

SEQ ID NO: 334607 - DNA, 25 bp, Artificial Sequence
  Description of Artificial Sequence: Synthetic oligonucleotide
ttcagagttggtgcccgccacagcc

SEQ ID NO: 334608 - DNA, 24 bp, Artificial Sequence
  Description of Artificial Sequence: Synthetic oligonucleotide
tcagagttggtgcccgccacagcc

SEQ ID NO: 334609 - DNA, 23 bp, Artificial Sequence
  Description of Artificial Sequence: Synthetic oligonucleotide
cagagttggtgcccgccacagcc

SEQ ID NO: 334610 - DNA, 24 bp, Artificial Sequence
  Description of Artificial Sequence: Synthetic oligonucleotide
agagttggtgcccgccacagccga

SEQ ID NO: 334611 - DNA, 23 bp, Artificial Sequence
  Description of Artificial Sequence: Synthetic oligonucleotide
gagttggtgcccgccacagccga

SEQ ID NO: 334612 - DNA, 24 bp, Artificial Sequence
  Description of Artificial Sequence: Synthetic oligonucleotide
agttggtgcccgccacagccgagt

SEQ ID NO: 334613 - DNA, 23 bp, Artificial Sequence
  Description of Artificial Sequence: Synthetic oligonucleotide
gttggtgcccgccacagccgagt

SEQ ID NO: 334614 - DNA, 23 bp, Artificial Sequence
  Description of Artificial Sequence: Synthetic oligonucleotide
ttggtgcccgccacagccgagtg

SEQ ID NO: 334615 - DNA, 22 bp, Artificial Sequence
  Description of Artificial Sequence: Synthetic oligonucleotide
tggtgcccgccacagccgagtg

SEQ ID NO: 334616 - DNA, 21 bp, Artificial Sequence
  Description of Artificial Sequence: Synthetic oligonucleotide
ggtgcccgccacagccgagtg

SEQ ID NO: 334617 - DNA, 21 bp, Artificial Sequence
  Description of Artificial Sequence: Synthetic oligonucleotide
gtgcccgccacagccgagtgc

SEQ ID NO: 334618 - DNA, 22 bp, Artificial Sequence
  Description of Artificial Sequence: Synthetic oligonucleotide
tgcccgccacagccgagtgcca

SEQ ID NO: 334619 - DNA, 21 bp, Artificial Sequence
  Description of Artificial Sequence: Synthetic oligonucleotide
gcccgccacagccgagtgcca

SEQ ID NO: 334620 - DNA, 23 bp, Artificial Sequence
  Description of Artificial Sequence: Synthetic oligonucleotide
cccgccacagccgagtgccacat

SEQ ID NO: 334621 - DNA, 24 bp, Artificial Sequence
  Description of Artificial Sequence: Synthetic oligonucleotide
ccgccacagccgagtgccacatct

SEQ ID NO: 334622 - DNA, 25 bp, Artificial Sequence
  Description of Artificial Sequence: Synthetic oligonucleotide
cgccacagccgagtgccacatctct

SEQ ID NO: 334623 - DNA, 25 bp, Artificial Sequence
  Description of Artificial Sequence: Synthetic oligonucleotide
gccacagccgagtgccacatctctg

SEQ ID NO: 334624 - DNA, 25 bp, Artificial Sequence
  Description of Artificial Sequence: Synthetic oligonucleotide
ccacagccgagtgccacatctctgc

SEQ ID NO: 334625 - DNA, 25 bp, Artificial Sequence
  Description of Artificial Sequence: Synthetic oligonucleotide
cacagccgagtgccacatctctgcc

SEQ ID NO: 334626 - DNA, 26 bp, Artificial Sequence
  Description of Artificial Sequence: Synthetic oligonucleotide
acagccgagtgccacatctctgccga

SEQ ID NO: 334627 - DNA, 25 bp, Artificial Sequence
  Description of Artificial Sequence: Synthetic oligonucleotide
cagccgagtgccacatctctgccga

SEQ ID NO: 334628 - DNA, 25 bp, Artificial Sequence
  Description of Artificial Sequence: Synthetic oligonucleotide
agccgagtgccacatctctgccgac

SEQ ID NO: 334629 - DNA, 24 bp, Artificial Sequence
  Description of Artificial Sequence: Synthetic oligonucleotide
gccgagtgccacatctctgccgac

SEQ ID NO: 334630 - DNA, 24 bp, Artificial Sequence
  Description of Artificial Sequence: Synthetic oligonucleotide
ccgagtgccacatctctgccgacc

SEQ ID NO: 334631 - DNA, 24 bp, Artificial Sequence
  Description of Artificial Sequence: Synthetic oligonucleotide
cgagtgccacatctctgccgaccc

SEQ ID NO: 334632 - DNA, 26 bp, Artificial Sequence
  Description of Artificial Sequence: Synthetic oligonucleotide
gagtgccacatctctgccgaccccaa

SEQ ID NO: 334633 - DNA, 26 bp, Artificial Sequence
  Description of Artificial Sequence: Synthetic oligonucleotide
agtgccacatctctgccgaccccaag

SEQ ID NO: 334634 - DNA, 25 bp, Artificial Sequence
  Description of Artificial Sequence: Synthetic oligonucleotide
gtgccacatctctgccgaccccaag

SEQ ID NO: 334635 - DNA, 26 bp, Artificial Sequence
  Description of Artificial Sequence: Synthetic oligonucleotide
tgccacatctctgccgaccccaaggt

SEQ ID NO: 334636 - DNA, 25 bp, Artificial Sequence
  Description of Artificial Sequence: Synthetic oligonucleotide
gccacatctctgccgaccccaaggt

SEQ ID NO: 334637 - DNA, 27 bp, Artificial Sequence
  Description of Artificial Sequence: Synthetic oligonucleotide
ccacatctctgccgaccccaaggtgta

SEQ ID NO: 334638 - DNA, 27 bp, Artificial Sequence
  Description of Artificial Sequence: Synthetic oligonucleotide
cacatctctgccgaccccaaggtgtag

SEQ ID NO: 334639 - DNA, 27 bp, Artificial Sequence
  Description of Artificial Sequence: Synthetic oligonucleotide
acatctctgccgaccccaaggtgtagc

SEQ ID NO: 334640 - DNA, 26 bp, Artificial Sequence
  Description of Artificial Sequence: Synthetic oligonucleotide
catctctgccgaccccaaggtgtagc

SEQ ID NO: 334641 - DNA, 27 bp, Artificial Sequence
  Description of Artificial Sequence: Synthetic oligonucleotide
atctctgccgaccccaaggtgtagcca

SEQ ID NO: 334642 - DNA, 26 bp, Artificial Sequence
  Description of Artificial Sequence: Synthetic oligonucleotide
tctctgccgaccccaaggtgtagcca

SEQ ID NO: 334643 - DNA, 25 bp, Artificial Sequence
  Description of Artificial Sequence: Synthetic oligonucleotide
ctctgccgaccccaaggtgtagcca

SEQ ID NO: 334644 - DNA, 26 bp, Artificial Sequence
  Description of Artificial Sequence: Synthetic oligonucleotide
tctgccgaccccaaggtgtagccaca

SEQ ID NO: 334645 - DNA, 25 bp, Artificial Sequence
  Description of Artificial Sequence: Synthetic oligonucleotide
ctgccgaccccaaggtgtagccaca

SEQ ID NO: 334646 - DNA, 25 bp, Artificial Sequence
  Description of Artificial Sequence: Synthetic oligonucleotide
tgccgaccccaaggtgtagccacag

SEQ ID NO: 334647 - DNA, 24 bp, Artificial Sequence
  Description of Artificial Sequence: Synthetic oligonucleotide
gccgaccccaaggtgtagccacag

SEQ ID NO: 334648 - DNA, 24 bp, Artificial Sequence
  Description of Artificial Sequence: Synthetic oligonucleotide
ccgaccccaaggtgtagccacagg

SEQ ID NO: 334649 - DNA, 25 bp, Artificial Sequence
  Description of Artificial Sequence: Synthetic oligonucleotide
cgaccccaaggtgtagccacaggca

SEQ ID NO: 334650 - DNA, 26 bp, Artificial Sequence
  Description of Artificial Sequence: Synthetic oligonucleotide
gaccccaaggtgtagccacaggcaca

SEQ ID NO: 334651 - DNA, 27 bp, Artificial Sequence
  Description of Artificial Sequence: Synthetic oligonucleotide
accccaaggtgtagccacaggcacaca

SEQ ID NO: 334652 - DNA, 26 bp, Artificial Sequence
  Description of Artificial Sequence: Synthetic oligonucleotide
ccccaaggtgtagccacaggcacaca

SEQ ID NO: 334653 - DNA, 26 bp, Artificial Sequence
  Description of Artificial Sequence: Synthetic oligonucleotide
cccaaggtgtagccacaggcacacac

SEQ ID NO: 334654 - DNA, 26 bp, Artificial Sequence
  Description of Artificial Sequence: Synthetic oligonucleotide
ccaaggtgtagccacaggcacacacg

SEQ ID NO: 334655 - DNA, 27 bp, Artificial Sequence
  Description of Artificial Sequence: Synthetic oligonucleotide
caaggtgtagccacaggcacacacggt

SEQ ID NO: 334656 - DNA, 27 bp, Artificial Sequence
  Description of Artificial Sequence: Synthetic oligonucleotide
aaggtgtagccacaggcacacacggtc

SEQ ID NO: 334657 - DNA, 27 bp, Artificial Sequence
  Description of Artificial Sequence: Synthetic oligonucleotide
aggtgtagccacaggcacacacggtca

SEQ ID NO: 334658 - DNA, 27 bp, Artificial Sequence
  Description of Artificial Sequence: Synthetic oligonucleotide
ggtgtagccacaggcacacacggtcaa

SEQ ID NO: 334659 - DNA, 27 bp, Artificial Sequence
  Description of Artificial Sequence: Synthetic oligonucleotide
gtgtagccacaggcacacacggtcaac

SEQ ID NO: 334660 - DNA, 27 bp, Artificial Sequence
  Description of Artificial Sequence: Synthetic oligonucleotide
tgtagccacaggcacacacggtcaacg

SEQ ID NO: 334661 - DNA, 27 bp, Artificial Sequence
  Description of Artificial Sequence: Synthetic oligonucleotide
gtagccacaggcacacacggtcaacgt

SEQ ID NO: 334662 - DNA, 27 bp, Artificial Sequence
  Description of Artificial Sequence: Synthetic oligonucleotide
tagccacaggcacacacggtcaacgtg

SEQ ID NO: 334663 - DNA, 26 bp, Artificial Sequence
  Description of Artificial Sequence: Synthetic oligonucleotide
agccacaggcacacacggtcaacgtg

SEQ ID NO: 334664 - DNA, 25 bp, Artificial Sequence
  Description of Artificial Sequence: Synthetic oligonucleotide
gccacaggcacacacggtcaacgtg

SEQ ID NO: 334665 - DNA, 26 bp, Artificial Sequence
  Description of Artificial Sequence: Synthetic oligonucleotide
ccacaggcacacacggtcaacgtgca

SEQ ID NO: 334666 - DNA, 26 bp, Artificial Sequence
  Description of Artificial Sequence: Synthetic oligonucleotide
cacaggcacacacggtcaacgtgcac

SEQ ID NO: 334667 - DNA, 27 bp, Artificial Sequence
  Description of Artificial Sequence: Synthetic oligonucleotide
acaggcacacacggtcaacgtgcacca

SEQ ID NO: 334668 - DNA, 26 bp, Artificial Sequence
  Description of Artificial Sequence: Synthetic oligonucleotide
caggcacacacggtcaacgtgcacca

SEQ ID NO: 334669 - DNA, 27 bp, Artificial Sequence
  Description of Artificial Sequence: Synthetic oligonucleotide
aggcacacacggtcaacgtgcaccagt

SEQ ID NO: 334670 - DNA, 26 bp, Artificial Sequence
  Description of Artificial Sequence: Synthetic oligonucleotide
ggcacacacggtcaacgtgcaccagt

SEQ ID NO: 334671 - DNA, 26 bp, Artificial Sequence
  Description of Artificial Sequence: Synthetic oligonucleotide
gcacacacggtcaacgtgcaccagtg

SEQ ID NO: 334672 - DNA, 26 bp, Artificial Sequence
  Description of Artificial Sequence: Synthetic oligonucleotide
cacacacggtcaacgtgcaccagtgg

SEQ ID NO: 334673 - DNA, 27 bp, Artificial Sequence
  Description of Artificial Sequence: Synthetic oligonucleotide
acacacggtcaacgtgcaccagtggga

SEQ ID NO: 334674 - DNA, 27 bp, Artificial Sequence
  Description of Artificial Sequence: Synthetic oligonucleotide
cacacggtcaacgtgcaccagtgggat

SEQ ID NO: 334675 - DNA, 29 bp, Artificial Sequence
  Description of Artificial Sequence: Synthetic oligonucleotide
acacggtcaacgtgcaccagtgggatatc

SEQ ID NO: 334676 - DNA, 28 bp, Artificial Sequence
  Description of Artificial Sequence: Synthetic oligonucleotide
cacggtcaacgtgcaccagtgggatatc

SEQ ID NO: 334677 - DNA, 30 bp, Artificial Sequence
  Description of Artificial Sequence: Synthetic oligonucleotide
acggtcaacgtgcaccagtgggatatcttg

SEQ ID NO: 334678 - DNA, 29 bp, Artificial Sequence
  Description of Artificial Sequence: Synthetic oligonucleotide
cggtcaacgtgcaccagtgggatatcttg

SEQ ID NO: 334679 - DNA, 30 bp, Artificial Sequence
  Description of Artificial Sequence: Synthetic oligonucleotide
ggtcaacgtgcaccagtgggatatcttgtc

SEQ ID NO: 334680 - DNA, 30 bp, Artificial Sequence
  Description of Artificial Sequence: Synthetic oligonucleotide
gtcaacgtgcaccagtgggatatcttgtcc

SEQ ID NO: 334681 - DNA, 32 bp, Artificial Sequence
  Description of Artificial Sequence: Synthetic oligonucleotide
tcaacgtgcaccagtgggatatcttgtccaac

SEQ ID NO: 334682 - DNA, 31 bp, Artificial Sequence
  Description of Artificial Sequence: Synthetic oligonucleotide
caacgtgcaccagtgggatatcttgtccaac

SEQ ID NO: 334683 - DNA, 31 bp, Artificial Sequence
  Description of Artificial Sequence: Synthetic oligonucleotide
aacgtgcaccagtgggatatcttgtccaacc

SEQ ID NO: 334684 - DNA, 30 bp, Artificial Sequence
  Description of Artificial Sequence: Synthetic oligonucleotide
acgtgcaccagtgggatatcttgtccaacc

SEQ ID NO: 334685 - DNA, 29 bp, Artificial Sequence
  Description of Artificial Sequence: Synthetic oligonucleotide
cgtgcaccagtgggatatcttgtccaacc

SEQ ID NO: 334686 - DNA, 29 bp, Artificial Sequence
  Description of Artificial Sequence: Synthetic oligonucleotide
gtgcaccagtgggatatcttgtccaaccg

SEQ ID NO: 334687 - DNA, 32 bp, Artificial Sequence
  Description of Artificial Sequence: Synthetic oligonucleotide
tgcaccagtgggatatcttgtccaaccgtaag

SEQ ID NO: 334688 - DNA, 31 bp, Artificial Sequence
  Description of Artificial Sequence: Synthetic oligonucleotide
gcaccagtgggatatcttgtccaaccgtaag

SEQ ID NO: 334689 - DNA, 32 bp, Artificial Sequence
  Description of Artificial Sequence: Synthetic oligonucleotide
caccagtgggatatcttgtccaaccgtaagtc

SEQ ID NO: 334690 - DNA, 33 bp, Artificial Sequence
  Description of Artificial Sequence: Synthetic oligonucleotide
accagtgggatatcttgtccaaccgtaagtcac

SEQ ID NO: 334691 - DNA, 32 bp, Artificial Sequence
  Description of Artificial Sequence: Synthetic oligonucleotide
ccagtgggatatcttgtccaaccgtaagtcac

SEQ ID NO: 334692 - DNA, 32 bp, Artificial Sequence
  Description of Artificial Sequence: Synthetic oligonucleotide
cagtgggatatcttgtccaaccgtaagtcacg

SEQ ID NO: 334693 - DNA, 32 bp, Artificial Sequence
  Description of Artificial Sequence: Synthetic oligonucleotide
agtgggatatcttgtccaaccgtaagtcacgg

SEQ ID NO: 334694 - DNA, 31 bp, Artificial Sequence
  Description of Artificial Sequence: Synthetic oligonucleotide
gtgggatatcttgtccaaccgtaagtcacgg

SEQ ID NO: 334695 - DNA, 31 bp, Artificial Sequence
  Description of Artificial Sequence: Synthetic oligonucleotide
tgggatatcttgtccaaccgtaagtcacggc

SEQ ID NO: 334696 - DNA, 30 bp, Artificial Sequence
  Description of Artificial Sequence: Synthetic oligonucleotide
gggatatcttgtccaaccgtaagtcacggc

SEQ ID NO: 334697 - DNA, 31 bp, Artificial Sequence
  Description of Artificial Sequence: Synthetic oligonucleotide
ggatatcttgtccaaccgtaagtcacggctc

SEQ ID NO: 334698 - DNA, 31 bp, Artificial Sequence
  Description of Artificial Sequence: Synthetic oligonucleotide
gatatcttgtccaaccgtaagtcacggctcc

SEQ ID NO: 334699 - DNA, 31 bp, Artificial Sequence
  Description of Artificial Sequence: Synthetic oligonucleotide
atatcttgtccaaccgtaagtcacggctccc

SEQ ID NO: 334700 - DNA, 30 bp, Artificial Sequence
  Description of Artificial Sequence: Synthetic oligonucleotide
tatcttgtccaaccgtaagtcacggctccc

SEQ ID NO: 334701 - DNA, 29 bp, Artificial Sequence
  Description of Artificial Sequence: Synthetic oligonucleotide
atcttgtccaaccgtaagtcacggctccc

SEQ ID NO: 334702 - DNA, 28 bp, Artificial Sequence
  Description of Artificial Sequence: Synthetic oligonucleotide
tcttgtccaaccgtaagtcacggctccc

SEQ ID NO: 334703 - DNA, 27 bp, Artificial Sequence
  Description of Artificial Sequence: Synthetic oligonucleotide
cttgtccaaccgtaagtcacggctccc

SEQ ID NO: 334704 - DNA, 28 bp, Artificial Sequence
  Description of Artificial Sequence: Synthetic oligonucleotide
ttgtccaaccgtaagtcacggctcccac

SEQ ID NO: 334705 - DNA, 27 bp, Artificial Sequence
  Description of Artificial Sequence: Synthetic oligonucleotide
tgtccaaccgtaagtcacggctcccac

SEQ ID NO: 334706 - DNA, 26 bp, Artificial Sequence
  Description of Artificial Sequence: Synthetic oligonucleotide
gtccaaccgtaagtcacggctcccac

SEQ ID NO: 334707 - DNA, 27 bp, Artificial Sequence
  Description of Artificial Sequence: Synthetic oligonucleotide
tccaaccgtaagtcacggctcccacct

SEQ ID NO: 334708 - DNA, 27 bp, Artificial Sequence
  Description of Artificial Sequence: Synthetic oligonucleotide
ccaaccgtaagtcacggctcccaccta

SEQ ID NO: 334709 - DNA, 27 bp, Artificial Sequence
  Description of Artificial Sequence: Synthetic oligonucleotide
caaccgtaagtcacggctcccacctac

SEQ ID NO: 334710 - DNA, 27 bp, Artificial Sequence
  Description of Artificial Sequence: Synthetic oligonucleotide
aaccgtaagtcacggctcccacctacc

SEQ ID NO: 334711 - DNA, 26 bp, Artificial Sequence
  Description of Artificial Sequence: Synthetic oligonucleotide
accgtaagtcacggctcccacctacc

SEQ ID NO: 334712 - DNA, 25 bp, Artificial Sequence
  Description of Artificial Sequence: Synthetic oligonucleotide
ccgtaagtcacggctcccacctacc

SEQ ID NO: 334713 - DNA, 25 bp, Artificial Sequence
  Description of Artificial Sequence: Synthetic oligonucleotide
cgtaagtcacggctcccacctaccc

SEQ ID NO: 334714 - DNA, 25 bp, Artificial Sequence
  Description of Artificial Sequence: Synthetic oligonucleotide
gtaagtcacggctcccacctacccc

SEQ ID NO: 334715 - DNA, 26 bp, Artificial Sequence
  Description of Artificial Sequence: Synthetic oligonucleotide
taagtcacggctcccacctaccccga

SEQ ID NO: 334716 - DNA, 25 bp, Artificial Sequence
  Description of Artificial Sequence: Synthetic oligonucleotide
aagtcacggctcccacctaccccga

SEQ ID NO: 334717 - DNA, 24 bp, Artificial Sequence
  Description of Artificial Sequence: Synthetic oligonucleotide
agtcacggctcccacctaccccga

SEQ ID NO: 334718 - DNA, 23 bp, Artificial Sequence
  Description of Artificial Sequence: Synthetic oligonucleotide
gtcacggctcccacctaccccga

SEQ ID NO: 334719 - DNA, 23 bp, Artificial Sequence
  Description of Artificial Sequence: Synthetic oligonucleotide
tcacggctcccacctaccccgag

SEQ ID NO: 334720 - DNA, 22 bp, Artificial Sequence
  Description of Artificial Sequence: Synthetic oligonucleotide
cacggctcccacctaccccgag

SEQ ID NO: 334721 - DNA, 22 bp, Artificial Sequence
  Description of Artificial Sequence: Synthetic oligonucleotide
acggctcccacctaccccgagg

SEQ ID NO: 334722 - DNA, 21 bp, Artificial Sequence
  Description of Artificial Sequence: Synthetic oligonucleotide
cggctcccacctaccccgagg

SEQ ID NO: 334723 - DNA, 21 bp, Artificial Sequence
  Description of Artificial Sequence: Synthetic oligonucleotide
ggctcccacctaccccgaggc

SEQ ID NO: 334724 - DNA, 21 bp, Artificial Sequence
  Description of Artificial Sequence: Synthetic oligonucleotide
gctcccacctaccccgaggcg

SEQ ID NO: 334725 - DNA, 21 bp, Artificial Sequence
  Description of Artificial Sequence: Synthetic oligonucleotide
ctcccacctaccccgaggcgg

SEQ ID NO: 334726 - DNA, 22 bp, Artificial Sequence
  Description of Artificial Sequence: Synthetic oligonucleotide
tcccacctaccccgaggcggca

SEQ ID NO: 334727 - DNA, 21 bp, Artificial Sequence
  Description of Artificial Sequence: Synthetic oligonucleotide
cccacctaccccgaggcggca

SEQ ID NO: 334728 - DNA, 21 bp, Artificial Sequence
  Description of Artificial Sequence: Synthetic oligonucleotide
ccacctaccccgaggcggcag

SEQ ID NO: 334729 - DNA, 21 bp, Artificial Sequence
  Description of Artificial Sequence: Synthetic oligonucleotide
cacctaccccgaggcggcagg

SEQ ID NO: 334730 - DNA, 21 bp, Artificial Sequence
  Description of Artificial Sequence: Synthetic oligonucleotide
acctaccccgaggcggcaggg

SEQ ID NO: 334731 - DNA, 20 bp, Artificial Sequence
  Description of Artificial Sequence: Synthetic oligonucleotide
cctaccccgaggcggcaggg

SEQ ID NO: 334732 - DNA, 20 bp, Artificial Sequence
  Description of Artificial Sequence: Synthetic oligonucleotide
ctaccccgaggcggcagggg

SEQ ID NO: 334733 - DNA, 21 bp, Artificial Sequence
  Description of Artificial Sequence: Synthetic oligonucleotide
taccccgaggcggcaggggca

SEQ ID NO: 334734 - DNA, 20 bp, Artificial Sequence
  Description of Artificial Sequence: Synthetic oligonucleotide
accccgaggcggcaggggca

SEQ ID NO: 334735 - DNA, 20 bp, Artificial Sequence
  Description of Artificial Sequence: Synthetic oligonucleotide
ccccgaggcggcaggggcat

SEQ ID NO: 334736 - DNA, 20 bp, Artificial Sequence
  Description of Artificial Sequence: Synthetic oligonucleotide
cccgaggcggcaggggcact

SEQ ID NO: 334737 - DNA, 20 bp, Artificial Sequence
  Description of Artificial Sequence: Synthetic oligonucleotide
ccgaggcggcaggggcacct

SEQ ID NO: 334738 - DNA, 20 bp, Artificial Sequence
  Description of Artificial Sequence: Synthetic oligonucleotide
cgaggcggcaggggcaccgt

SEQ ID NO: 334739 - DNA, 20 bp, Artificial Sequence
  Description of Artificial Sequence: Synthetic oligonucleotide
gaggcggcaggggcaccgct

SEQ ID NO: 334740 - DNA, 20 bp, Artificial Sequence
  Description of Artificial Sequence: Synthetic oligonucleotide
aggcggcaggggcaccgctg

SEQ ID NO: 334741 - DNA, 20 bp, Artificial Sequence
  Description of Artificial Sequence: Synthetic oligonucleotide
ggcggcaggggcaccgctgt

SEQ ID NO: 334742 - DNA, 21 bp, Artificial Sequence
  Description of Artificial Sequence: Synthetic oligonucleotide
gcggcaggggcaccgctggat

SEQ ID NO: 334743 - DNA, 22 bp, Artificial Sequence
  Description of Artificial Sequence: Synthetic oligonucleotide
cggcaggggcaccgctggatca

SEQ ID NO: 334744 - DNA, 22 bp, Artificial Sequence
  Description of Artificial Sequence: Synthetic oligonucleotide
ggcaggggcaccgctggatcag

SEQ ID NO: 334745 - DNA, 24 bp, Artificial Sequence
  Description of Artificial Sequence: Synthetic oligonucleotide
gcaggggcaccgctggatcaggtt

SEQ ID NO: 334746 - DNA, 26 bp, Artificial Sequence
  Description of Artificial Sequence: Synthetic oligonucleotide
caggggcaccgctggatcaggttcaa

SEQ ID NO: 334747 - DNA, 27 bp, Artificial Sequence
  Description of Artificial Sequence: Synthetic oligonucleotide
aggggcaccgctggatcaggttcaact

SEQ ID NO: 334748 - DNA, 27 bp, Artificial Sequence
  Description of Artificial Sequence: Synthetic oligonucleotide
ggggcaccgctggatcaggttcaacta

SEQ ID NO: 334749 - DNA, 27 bp, Artificial Sequence
  Description of Artificial Sequence: Synthetic oligonucleotide
gggcaccgctggatcaggttcaactag

SEQ ID NO: 334750 - DNA, 27 bp, Artificial Sequence
  Description of Artificial Sequence: Synthetic oligonucleotide
ggcaccgctggatcaggttcaactagg

SEQ ID NO: 334751 - DNA, 28 bp, Artificial Sequence
  Description of Artificial Sequence: Synthetic oligonucleotide
gcaccgctggatcaggttcaactaggag

SEQ ID NO: 334752 - DNA, 28 bp, Artificial Sequence
  Description of Artificial Sequence: Synthetic oligonucleotide
caccgctggatcaggttcaactaggagc

SEQ ID NO: 334753 - DNA, 28 bp, Artificial Sequence
  Description of Artificial Sequence: Synthetic oligonucleotide
accgctggatcaggttcaactaggagcc

SEQ ID NO: 334754 - DNA, 27 bp, Artificial Sequence
  Description of Artificial Sequence: Synthetic oligonucleotide
ccgctggatcaggttcaactaggagcc

SEQ ID NO: 334755 - DNA, 28 bp, Artificial Sequence
  Description of Artificial Sequence: Synthetic oligonucleotide
cgctggatcaggttcaactaggagccac

SEQ ID NO: 334756 - DNA, 28 bp, Artificial Sequence
  Description of Artificial Sequence: Synthetic oligonucleotide
gctggatcaggttcaactaggagccacc

SEQ ID NO: 334757 - DNA, 28 bp, Artificial Sequence
  Description of Artificial Sequence: Synthetic oligonucleotide
ctggatcaggttcaactaggagccaccg

SEQ ID NO: 334758 - DNA, 28 bp, Artificial Sequence
  Description of Artificial Sequence: Synthetic oligonucleotide
tggatcaggttcaactaggagccaccgc

SEQ ID NO: 334759 - DNA, 27 bp, Artificial Sequence
  Description of Artificial Sequence: Synthetic oligonucleotide
ggatcaggttcaactaggagccaccgc

SEQ ID NO: 334760 - DNA, 27 bp, Artificial Sequence
  Description of Artificial Sequence: Synthetic oligonucleotide
gatcaggttcaactaggagccaccgcc

SEQ ID NO: 334761 - DNA, 30 bp, Artificial Sequence
  Description of Artificial Sequence: Synthetic oligonucleotide
atcaggttcaactaggagccaccgcctaac

SEQ ID NO: 334762 - DNA, 29 bp, Artificial Sequence
  Description of Artificial Sequence: Synthetic oligonucleotide
tcaggttcaactaggagccaccgcctaac

SEQ ID NO: 334763 - DNA, 28 bp, Artificial Sequence
  Description of Artificial Sequence: Synthetic oligonucleotide
caggttcaactaggagccaccgcctaac

SEQ ID NO: 334764 - DNA, 29 bp, Artificial Sequence
  Description of Artificial Sequence: Synthetic oligonucleotide
aggttcaactaggagccaccgcctaactg

SEQ ID NO: 334765 - DNA, 28 bp, Artificial Sequence
  Description of Artificial Sequence: Synthetic oligonucleotide
ggttcaactaggagccaccgcctaactg

SEQ ID NO: 334766 - DNA, 28 bp, Artificial Sequence
  Description of Artificial Sequence: Synthetic oligonucleotide
gttcaactaggagccaccgcctaactgc

SEQ ID NO: 334767 - DNA, 28 bp, Artificial Sequence
  Description of Artificial Sequence: Synthetic oligonucleotide
ttcaactaggagccaccgcctaactgcg

SEQ ID NO: 334768 - DNA, 27 bp, Artificial Sequence
  Description of Artificial Sequence: Synthetic oligonucleotide
tcaactaggagccaccgcctaactgcg

SEQ ID NO: 334769 - DNA, 27 bp, Artificial Sequence
  Description of Artificial Sequence: Synthetic oligonucleotide
caactaggagccaccgcctaactgcga

SEQ ID NO: 334770 - DNA, 27 bp, Artificial Sequence
  Description of Artificial Sequence: Synthetic oligonucleotide
aactaggagccaccgcctaactgcgag

SEQ ID NO: 334771 - DNA, 26 bp, Artificial Sequence
  Description of Artificial Sequence: Synthetic oligonucleotide
actaggagccaccgcctaactgcgag

SEQ ID NO: 334772 - DNA, 25 bp, Artificial Sequence
  Description of Artificial Sequence: Synthetic oligonucleotide
ctaggagccaccgcctaactgcgag

SEQ ID NO: 334773 - DNA, 26 bp, Artificial Sequence
  Description of Artificial Sequence: Synthetic oligonucleotide
taggagccaccgcctaactgcgagca

SEQ ID NO: 334774 - DNA, 25 bp, Artificial Sequence
  Description of Artificial Sequence: Synthetic oligonucleotide
aggagccaccgcctaactgcgagca

SEQ ID NO: 334775 - DNA, 24 bp, Artificial Sequence
  Description of Artificial Sequence: Synthetic oligonucleotide
ggagccaccgcctaactgcgagca

SEQ ID NO: 334776 - DNA, 24 bp, Artificial Sequence
  Description of Artificial Sequence: Synthetic oligonucleotide
gagccaccgcctaactgcgagcac

SEQ ID NO: 334777 - DNA, 25 bp, Artificial Sequence
  Description of Artificial Sequence: Synthetic oligonucleotide
agccaccgcctaactgcgagcacct

SEQ ID NO: 334778 - DNA, 24 bp, Artificial Sequence
  Description of Artificial Sequence: Synthetic oligonucleotide
gccaccgcctaactgcgagcacct

SEQ ID NO: 334779 - DNA, 24 bp, Artificial Sequence
  Description of Artificial Sequence: Synthetic oligonucleotide
ccaccgcctaactgcgagcacctg

SEQ ID NO: 334780 - DNA, 26 bp, Artificial Sequence
  Description of Artificial Sequence: Synthetic oligonucleotide
caccgcctaactgcgagcacctggta

SEQ ID NO: 334781 - DNA, 26 bp, Artificial Sequence
  Description of Artificial Sequence: Synthetic oligonucleotide
accgcctaactgcgagcacctggtag

SEQ ID NO: 334782 - DNA, 25 bp, Artificial Sequence
  Description of Artificial Sequence: Synthetic oligonucleotide
ccgcctaactgcgagcacctggtag

SEQ ID NO: 334783 - DNA, 25 bp, Artificial Sequence
  Description of Artificial Sequence: Synthetic oligonucleotide
cgcctaactgcgagcacctggtagc

SEQ ID NO: 334784 - DNA, 25 bp, Artificial Sequence
  Description of Artificial Sequence: Synthetic oligonucleotide
gcctaactgcgagcacctggtagcc

SEQ ID NO: 334785 - DNA, 26 bp, Artificial Sequence
  Description of Artificial Sequence: Synthetic oligonucleotide
cctaactgcgagcacctggtagccct

SEQ ID NO: 334786 - DNA, 26 bp, Artificial Sequence
  Description of Artificial Sequence: Synthetic oligonucleotide
ctaactgcgagcacctggtagccctg

SEQ ID NO: 334787 - DNA, 27 bp, Artificial Sequence
  Description of Artificial Sequence: Synthetic oligonucleotide
taactgcgagcacctggtagccctgga

SEQ ID NO: 334788 - DNA, 26 bp, Artificial Sequence
  Description of Artificial Sequence: Synthetic oligonucleotide
aactgcgagcacctggtagccctgga

SEQ ID NO: 334789 - DNA, 25 bp, Artificial Sequence
  Description of Artificial Sequence: Synthetic oligonucleotide
actgcgagcacctggtagccctgga

SEQ ID NO: 334790 - DNA, 24 bp, Artificial Sequence
  Description of Artificial Sequence: Synthetic oligonucleotide
ctgcgagcacctggtagccctgga

SEQ ID NO: 334791 - DNA, 25 bp, Artificial Sequence
  Description of Artificial Sequence: Synthetic oligonucleotide
tgcgagcacctggtagccctggaga

SEQ ID NO: 334792 - DNA, 24 bp, Artificial Sequence
  Description of Artificial Sequence: Synthetic oligonucleotide
gcgagcacctggtagccctggaga

SEQ ID NO: 334793 - DNA, 27 bp, Artificial Sequence
  Description of Artificial Sequence: Synthetic oligonucleotide
cgagcacctggtagccctggagagata

SEQ ID NO: 334794 - DNA, 27 bp, Artificial Sequence
  Description of Artificial Sequence: Synthetic oligonucleotide
gagcacctggtagccctggagagatac

SEQ ID NO: 334795 - DNA, 29 bp, Artificial Sequence
  Description of Artificial Sequence: Synthetic oligonucleotide
agcacctggtagccctggagagatacttc

SEQ ID NO: 334796 - DNA, 28 bp, Artificial Sequence
  Description of Artificial Sequence: Synthetic oligonucleotide
gcacctggtagccctggagagatacttc

SEQ ID NO: 334797 - DNA, 31 bp, Artificial Sequence
  Description of Artificial Sequence: Synthetic oligonucleotide
cacctggtagccctggagagatacttctatc

SEQ ID NO: 334798 - DNA, 32 bp, Artificial Sequence
  Description of Artificial Sequence: Synthetic oligonucleotide
acctggtagccctggagagatacttctatctc

SEQ ID NO: 334799 - DNA, 31 bp, Artificial Sequence
  Description of Artificial Sequence: Synthetic oligonucleotide
cctggtagccctggagagatacttctatctc

SEQ ID NO: 334800 - DNA, 32 bp, Artificial Sequence
  Description of Artificial Sequence: Synthetic oligonucleotide
ctggtagccctggagagatacttctatctcac

SEQ ID NO: 334801 - DNA, 32 bp, Artificial Sequence
  Description of Artificial Sequence: Synthetic oligonucleotide
tggtagccctggagagatacttctatctcacc

SEQ ID NO: 334802 - DNA, 31 bp, Artificial Sequence
  Description of Artificial Sequence: Synthetic oligonucleotide
ggtagccctggagagatacttctatctcacc

SEQ ID NO: 334803 - DNA, 33 bp, Artificial Sequence
  Description of Artificial Sequence: Synthetic oligonucleotide
gtagccctggagagatacttctatctcaccaag

SEQ ID NO: 334804 - DNA, 34 bp, Artificial Sequence
  Description of Artificial Sequence: Synthetic oligonucleotide
tagccctggagagatacttctatctcaccaagtc

SEQ ID NO: 334805 - DNA, 33 bp, Artificial Sequence
  Description of Artificial Sequence: Synthetic oligonucleotide
agccctggagagatacttctatctcaccaagtc

SEQ ID NO: 334806 - DNA, 32 bp, Artificial Sequence
  Description of Artificial Sequence: Synthetic oligonucleotide
gccctggagagatacttctatctcaccaagtc

SEQ ID NO: 334807 - DNA, 32 bp, Artificial Sequence
  Description of Artificial Sequence: Synthetic oligonucleotide
ccctggagagatacttctatctcaccaagtcc

SEQ ID NO: 334808 - DNA, 34 bp, Artificial Sequence
  Description of Artificial Sequence: Synthetic oligonucleotide
cctggagagatacttctatctcaccaagtcctac

SEQ ID NO: 334809 - DNA, 34 bp, Artificial Sequence
  Description of Artificial Sequence: Synthetic oligonucleotide
ctggagagatacttctatctcaccaagtcctacc

SEQ ID NO: 334810 - DNA, 34 bp, Artificial Sequence
  Description of Artificial Sequence: Synthetic oligonucleotide
tggagagatacttctatctcaccaagtcctaccg

SEQ ID NO: 334811 - DNA, 33 bp, Artificial Sequence
  Description of Artificial Sequence: Synthetic oligonucleotide
ggagagatacttctatctcaccaagtcctaccg

SEQ ID NO: 334812 - DNA, 33 bp, Artificial Sequence
  Description of Artificial Sequence: Synthetic oligonucleotide
gagagatacttctatctcaccaagtcctaccgg

SEQ ID NO: 334813 - DNA, 34 bp, Artificial Sequence
  Description of Artificial Sequence: Synthetic oligonucleotide
agagatacttctatctcaccaagtcctaccggag

SEQ ID NO: 334814 - DNA, 33 bp, Artificial Sequence
  Description of Artificial Sequence: Synthetic oligonucleotide
gagatacttctatctcaccaagtcctaccggag

SEQ ID NO: 334815 - DNA, 33 bp, Artificial Sequence
  Description of Artificial Sequence: Synthetic oligonucleotide
agatacttctatctcaccaagtcctaccggagc

SEQ ID NO: 334816 - DNA, 32 bp, Artificial Sequence
  Description of Artificial Sequence: Synthetic oligonucleotide
gatacttctatctcaccaagtcctaccggagc

SEQ ID NO: 334817 - DNA, 32 bp, Artificial Sequence
  Description of Artificial Sequence: Synthetic oligonucleotide
atacttctatctcaccaagtcctaccggagcg

SEQ ID NO: 334818 - DNA, 31 bp, Artificial Sequence
  Description of Artificial Sequence: Synthetic oligonucleotide
tacttctatctcaccaagtcctaccggagcg

SEQ ID NO: 334819 - DNA, 30 bp, Artificial Sequence
  Description of Artificial Sequence: Synthetic oligonucleotide
acttctatctcaccaagtcctaccggagcg

SEQ ID NO: 334820 - DNA, 29 bp, Artificial Sequence
  Description of Artificial Sequence: Synthetic oligonucleotide
cttctatctcaccaagtcctaccggagcg

SEQ ID NO: 334821 - DNA, 30 bp, Artificial Sequence
  Description of Artificial Sequence: Synthetic oligonucleotide
ttctatctcaccaagtcctaccggagcgac

SEQ ID NO: 334822 - DNA, 29 bp, Artificial Sequence
  Description of Artificial Sequence: Synthetic oligonucleotide
tctatctcaccaagtcctaccggagcgac

SEQ ID NO: 334823 - DNA, 28 bp, Artificial Sequence
  Description of Artificial Sequence: Synthetic oligonucleotide
ctatctcaccaagtcctaccggagcgac

SEQ ID NO: 334824 - DNA, 29 bp, Artificial Sequence
  Description of Artificial Sequence: Synthetic oligonucleotide
tatctcaccaagtcctaccggagcgactc

SEQ ID NO: 334825 - DNA, 28 bp, Artificial Sequence
  Description of Artificial Sequence: Synthetic oligonucleotide
atctcaccaagtcctaccggagcgactc

SEQ ID NO: 334826 - DNA, 27 bp, Artificial Sequence
  Description of Artificial Sequence: Synthetic oligonucleotide
tctcaccaagtcctaccggagcgactc

SEQ ID NO: 334827 - DNA, 26 bp, Artificial Sequence
  Description of Artificial Sequence: Synthetic oligonucleotide
ctcaccaagtcctaccggagcgactc

SEQ ID NO: 334828 - DNA, 26 bp, Artificial Sequence
  Description of Artificial Sequence: Synthetic oligonucleotide
tcaccaagtcctaccggagcgactcc

SEQ ID NO: 334829 - DNA, 25 bp, Artificial Sequence
  Description of Artificial Sequence: Synthetic oligonucleotide
caccaagtcctaccggagcgactcc

SEQ ID NO: 334830 - DNA, 26 bp, Artificial Sequence
  Description of Artificial Sequence: Synthetic oligonucleotide
accaagtcctaccggagcgactccca

SEQ ID NO: 334831 - DNA, 25 bp, Artificial Sequence
  Description of Artificial Sequence: Synthetic oligonucleotide
ccaagtcctaccggagcgactccca

SEQ ID NO: 334832 - DNA, 27 bp, Artificial Sequence
  Description of Artificial Sequence: Synthetic oligonucleotide
caagtcctaccggagcgactcccacat

SEQ ID NO: 334833 - DNA, 27 bp, Artificial Sequence
  Description of Artificial Sequence: Synthetic oligonucleotide
aagtcctaccggagcgactcccacatc

SEQ ID NO: 334834 - DNA, 27 bp, Artificial Sequence
  Description of Artificial Sequence: Synthetic oligonucleotide
agtcctaccggagcgactcccacatct

SEQ ID NO: 334835 - DNA, 27 bp, Artificial Sequence
  Description of Artificial Sequence: Synthetic oligonucleotide
gtcctaccggagcgactcccacatctt

SEQ ID NO: 334836 - DNA, 27 bp, Artificial Sequence
  Description of Artificial Sequence: Synthetic oligonucleotide
tcctaccggagcgactcccacatcttc

SEQ ID NO: 334837 - DNA, 27 bp, Artificial Sequence
  Description of Artificial Sequence: Synthetic oligonucleotide
cctaccggagcgactcccacatcttca

SEQ ID NO: 334838 - DNA, 27 bp, Artificial Sequence
  Description of Artificial Sequence: Synthetic oligonucleotide
ctaccggagcgactcccacatcttcag

SEQ ID NO: 334839 - DNA, 27 bp, Artificial Sequence
  Description of Artificial Sequence: Synthetic oligonucleotide
taccggagcgactcccacatcttcagg

SEQ ID NO: 334840 - DNA, 26 bp, Artificial Sequence
  Description of Artificial Sequence: Synthetic oligonucleotide
accggagcgactcccacatcttcagg

SEQ ID NO: 334841 - DNA, 25 bp, Artificial Sequence
  Description of Artificial Sequence: Synthetic oligonucleotide
ccggagcgactcccacatcttcagg

SEQ ID NO: 334842 - DNA, 25 bp, Artificial Sequence
  Description of Artificial Sequence: Synthetic oligonucleotide
cggagcgactcccacatcttcaggc

SEQ ID NO: 334843 - DNA, 25 bp, Artificial Sequence
  Description of Artificial Sequence: Synthetic oligonucleotide
ggagcgactcccacatcttcaggcc

SEQ ID NO: 334844 - DNA, 27 bp, Artificial Sequence
  Description of Artificial Sequence: Synthetic oligonucleotide
gagcgactcccacatcttcaggcccta

SEQ ID NO: 334845 - DNA, 27 bp, Artificial Sequence
  Description of Artificial Sequence: Synthetic oligonucleotide
agcgactcccacatcttcaggccctac

SEQ ID NO: 334846 - DNA, 26 bp, Artificial Sequence
  Description of Artificial Sequence: Synthetic oligonucleotide
gcgactcccacatcttcaggccctac

SEQ ID NO: 334847 - DNA, 26 bp, Artificial Sequence
  Description of Artificial Sequence: Synthetic oligonucleotide
cgactcccacatcttcaggccctacg

SEQ ID NO: 334848 - DNA, 26 bp, Artificial Sequence
  Description of Artificial Sequence: Synthetic oligonucleotide
gactcccacatcttcaggccctacgg

SEQ ID NO: 334849 - DNA, 27 bp, Artificial Sequence
  Description of Artificial Sequence: Synthetic oligonucleotide
actcccacatcttcaggccctacgggt

SEQ ID NO: 334850 - DNA, 26 bp, Artificial Sequence
  Description of Artificial Sequence: Synthetic oligonucleotide
ctcccacatcttcaggccctacgggt

SEQ ID NO: 334851 - DNA, 26 bp, Artificial Sequence
  Description of Artificial Sequence: Synthetic oligonucleotide
tcccacatcttcaggccctacgggtg

SEQ ID NO: 334852 - DNA, 25 bp, Artificial Sequence
  Description of Artificial Sequence: Synthetic oligonucleotide
cccacatcttcaggccctacgggtg

SEQ ID NO: 334853 - DNA, 25 bp, Artificial Sequence
  Description of Artificial Sequence: Synthetic oligonucleotide
ccacatcttcaggccctacgggtgg

SEQ ID NO: 334854 - DNA, 26 bp, Artificial Sequence
  Description of Artificial Sequence: Synthetic oligonucleotide
cacatcttcaggccctacgggtggct

SEQ ID NO: 334855 - DNA, 26 bp, Artificial Sequence
  Description of Artificial Sequence: Synthetic oligonucleotide
acatcttcaggccctacgggtggctg

SEQ ID NO: 334856 - DNA, 25 bp, Artificial Sequence
  Description of Artificial Sequence: Synthetic oligonucleotide
catcttcaggccctacgggtggctg

SEQ ID NO: 334857 - DNA, 26 bp, Artificial Sequence
  Description of Artificial Sequence: Synthetic oligonucleotide
atcttcaggccctacgggtggctgga

SEQ ID NO: 334858 - DNA, 25 bp, Artificial Sequence
  Description of Artificial Sequence: Synthetic oligonucleotide
tcttcaggccctacgggtggctgga

SEQ ID NO: 334859 - DNA, 24 bp, Artificial Sequence
  Description of Artificial Sequence: Synthetic oligonucleotide
cttcaggccctacgggtggctgga

SEQ ID NO: 334860 - DNA, 24 bp, Artificial Sequence
  Description of Artificial Sequence: Synthetic oligonucleotide
ttcaggccctacgggtggctggag

SEQ ID NO: 334861 - DNA, 23 bp, Artificial Sequence
  Description of Artificial Sequence: Synthetic oligonucleotide
tcaggccctacgggtggctggag

SEQ ID NO: 334862 - DNA, 22 bp, Artificial Sequence
  Description of Artificial Sequence: Synthetic oligonucleotide
caggccctacgggtggctggag

SEQ ID NO: 334863 - DNA, 22 bp, Artificial Sequence
  Description of Artificial Sequence: Synthetic oligonucleotide
aggccctacgggtggctggagg

SEQ ID NO: 334864 - DNA, 21 bp, Artificial Sequence
  Description of Artificial Sequence: Synthetic oligonucleotide
ggccctacgggtggctggagg

SEQ ID NO: 334865 - DNA, 21 bp, Artificial Sequence
  Description of Artificial Sequence: Synthetic oligonucleotide
gccctacgggtggctggaggc

SEQ ID NO: 334866 - DNA, 22 bp, Artificial Sequence
  Description of Artificial Sequence: Synthetic oligonucleotide
ccctacgggtggctggaggcgt

SEQ ID NO: 334867 - DNA, 22 bp, Artificial Sequence
  Description of Artificial Sequence: Synthetic oligonucleotide
cctacgggtggctggaggcgtg

SEQ ID NO: 334868 - DNA, 23 bp, Artificial Sequence
  Description of Artificial Sequence: Synthetic oligonucleotide
ctacgggtggctggaggcgtggt

SEQ ID NO: 334869 - DNA, 23 bp, Artificial Sequence
  Description of Artificial Sequence: Synthetic oligonucleotide
tacgggtggctggaggcgtggtc

SEQ ID NO: 334870 - DNA, 22 bp, Artificial Sequence
  Description of Artificial Sequence: Synthetic oligonucleotide
acgggtggctggaggcgtggtc

SEQ ID NO: 334871 - DNA, 21 bp, Artificial Sequence
  Description of Artificial Sequence: Synthetic oligonucleotide
cgggtggctggaggcgtggtc

SEQ ID NO: 334872 - DNA, 21 bp, Artificial Sequence
  Description of Artificial Sequence: Synthetic oligonucleotide
gggtggctggaggcgtggtcc

SEQ ID NO: 334873 - DNA, 21 bp, Artificial Sequence
  Description of Artificial Sequence: Synthetic oligonucleotide
ggtggctggaggcgtggtccg

SEQ ID NO: 334874 - DNA, 21 bp, Artificial Sequence
  Description of Artificial Sequence: Synthetic oligonucleotide
gtggctggaggcgtggtccgc

SEQ ID NO: 334875 - DNA, 21 bp, Artificial Sequence
  Description of Artificial Sequence: Synthetic oligonucleotide
tggctggaggcgtggtccgcc

SEQ ID NO: 334876 - DNA, 20 bp, Artificial Sequence
  Description of Artificial Sequence: Synthetic oligonucleotide
ggctggaggcgtggtccgcc

SEQ ID NO: 334877 - DNA, 21 bp, Artificial Sequence
  Description of Artificial Sequence: Synthetic oligonucleotide
gctggaggcgtggtccgccca

SEQ ID NO: 334878 - DNA, 21 bp, Artificial Sequence
  Description of Artificial Sequence: Synthetic oligonucleotide
ctggaggcgtggtccgcccag

SEQ ID NO: 334879 - DNA, 21 bp, Artificial Sequence
  Description of Artificial Sequence: Synthetic oligonucleotide
tggaggcgtggtccgcccagc

SEQ ID NO: 334880 - DNA, 20 bp, Artificial Sequence
  Description of Artificial Sequence: Synthetic oligonucleotide
ggaggcgtggtccgcccagc

SEQ ID NO: 334881 - DNA, 21 bp, Artificial Sequence
  Description of Artificial Sequence: Synthetic oligonucleotide
gaggcgtggtccgcccagcct

SEQ ID NO: 334882 - DNA, 21 bp, Artificial Sequence
  Description of Artificial Sequence: Synthetic oligonucleotide
aggcgtggtccgcccagcctg

SEQ ID NO: 334883 - DNA, 20 bp, Artificial Sequence
  Description of Artificial Sequence: Synthetic oligonucleotide
ggcgtggtccgcccagcctg

SEQ ID NO: 334884 - DNA, 20 bp, Artificial Sequence
  Description of Artificial Sequence: Synthetic oligonucleotide
gcgtggtccgcccagcctgc

SEQ ID NO: 334885 - DNA, 20 bp, Artificial Sequence
  Description of Artificial Sequence: Synthetic oligonucleotide
cgtggtccgcccagcctgcg

SEQ ID NO: 334886 - DNA, 21 bp, Artificial Sequence
  Description of Artificial Sequence: Synthetic oligonucleotide
gtggtccgcccagcctgcgca

SEQ ID NO: 334887 - DNA, 21 bp, Artificial Sequence
  Description of Artificial Sequence: Synthetic oligonucleotide
tggtccgcccagcctgcgcac

SEQ ID NO: 334888 - DNA, 20 bp, Artificial Sequence
  Description of Artificial Sequence: Synthetic oligonucleotide
ggtccgcccagcctgcgcac

SEQ ID NO: 334889 - DNA, 20 bp, Artificial Sequence
  Description of Artificial Sequence: Synthetic oligonucleotide
gtccgcccagcctgcgcacc

SEQ ID NO: 334890 - DNA, 21 bp, Artificial Sequence
  Description of Artificial Sequence: Synthetic oligonucleotide
tccgcccagcctgcgcaccca

SEQ ID NO: 334891 - DNA, 20 bp, Artificial Sequence
  Description of Artificial Sequence: Synthetic oligonucleotide
ccgcccagcctgcgcaccca

SEQ ID NO: 334892 - DNA, 20 bp, Artificial Sequence
  Description of Artificial Sequence: Synthetic oligonucleotide
cgcccagcctgcgcacccac

SEQ ID NO: 334893 - DNA, 20 bp, Artificial Sequence
  Description of Artificial Sequence: Synthetic oligonucleotide
gcccagcctgcgcacccacc

SEQ ID NO: 334894 - DNA, 20 bp, Artificial Sequence
  Description of Artificial Sequence: Synthetic oligonucleotide
cccagcctgcgcacccaccg

SEQ ID NO: 334895 - DNA, 21 bp, Artificial Sequence
  Description of Artificial Sequence: Synthetic oligonucleotide
ccagcctgcgcacccaccggt

SEQ ID NO: 334896 - DNA, 23 bp, Artificial Sequence
  Description of Artificial Sequence: Synthetic oligonucleotide
cagcctgcgcacccaccggtcaa

SEQ ID NO: 334897 - DNA, 23 bp, Artificial Sequence
  Description of Artificial Sequence: Synthetic oligonucleotide
agcctgcgcacccaccggtcaac

SEQ ID NO: 334898 - DNA, 22 bp, Artificial Sequence
  Description of Artificial Sequence: Synthetic oligonucleotide
gcctgcgcacccaccggtcaac

SEQ ID NO: 334899 - DNA, 23 bp, Artificial Sequence
  Description of Artificial Sequence: Synthetic oligonucleotide
cctgcgcacccaccggtcaacct

SEQ ID NO: 334900 - DNA, 24 bp, Artificial Sequence
  Description of Artificial Sequence: Synthetic oligonucleotide
ctgcgcacccaccggtcaacctct

SEQ ID NO: 334901 - DNA, 24 bp, Artificial Sequence
  Description of Artificial Sequence: Synthetic oligonucleotide
tgcgcacccaccggtcaacctctg

SEQ ID NO: 334902 - DNA, 23 bp, Artificial Sequence
  Description of Artificial Sequence: Synthetic oligonucleotide
gcgcacccaccggtcaacctctg

SEQ ID NO: 334903 - DNA, 23 bp, Artificial Sequence
  Description of Artificial Sequence: Synthetic oligonucleotide
cgcacccaccggtcaacctctgg

SEQ ID NO: 334904 - DNA, 23 bp, Artificial Sequence
  Description of Artificial Sequence: Synthetic oligonucleotide
gcacccaccggtcaacctctggg

SEQ ID NO: 334905 - DNA, 23 bp, Artificial Sequence
  Description of Artificial Sequence: Synthetic oligonucleotide
cacccaccggtcaacctctgggc

SEQ ID NO: 334906 - DNA, 25 bp, Artificial Sequence
  Description of Artificial Sequence: Synthetic oligonucleotide
acccaccggtcaacctctgggccaa

SEQ ID NO: 334907 - DNA, 24 bp, Artificial Sequence
  Description of Artificial Sequence: Synthetic oligonucleotide
cccaccggtcaacctctgggccaa

SEQ ID NO: 334908 - DNA, 25 bp, Artificial Sequence
  Description of Artificial Sequence: Synthetic oligonucleotide
ccaccggtcaacctctgggccaaga

SEQ ID NO: 334909 - DNA, 25 bp, Artificial Sequence
  Description of Artificial Sequence: Synthetic oligonucleotide
caccggtcaacctctgggccaagac

SEQ ID NO: 334910 - DNA, 25 bp, Artificial Sequence
  Description of Artificial Sequence: Synthetic oligonucleotide
accggtcaacctctgggccaagacg

SEQ ID NO: 334911 - DNA, 24 bp, Artificial Sequence
  Description of Artificial Sequence: Synthetic oligonucleotide
ccggtcaacctctgggccaagacg

SEQ ID NO: 334912 - DNA, 25 bp, Artificial Sequence
  Description of Artificial Sequence: Synthetic oligonucleotide
cggtcaacctctgggccaagacgga

SEQ ID NO: 334913 - DNA, 25 bp, Artificial Sequence
  Description of Artificial Sequence: Synthetic oligonucleotide
ggtcaacctctgggccaagacggag

SEQ ID NO: 334914 - DNA, 26 bp, Artificial Sequence
  Description of Artificial Sequence: Synthetic oligonucleotide
gtcaacctctgggccaagacggagct

SEQ ID NO: 334915 - DNA, 26 bp, Artificial Sequence
  Description of Artificial Sequence: Synthetic oligonucleotide
tcaacctctgggccaagacggagctg

SEQ ID NO: 334916 - DNA, 25 bp, Artificial Sequence
  Description of Artificial Sequence: Synthetic oligonucleotide
caacctctgggccaagacggagctg

SEQ ID NO: 334917 - DNA, 26 bp, Artificial Sequence
  Description of Artificial Sequence: Synthetic oligonucleotide
aacctctgggccaagacggagctggt

SEQ ID NO: 334918 - DNA, 25 bp, Artificial Sequence
  Description of Artificial Sequence: Synthetic oligonucleotide
acctctgggccaagacggagctggt

SEQ ID NO: 334919 - DNA, 24 bp, Artificial Sequence
  Description of Artificial Sequence: Synthetic oligonucleotide
cctctgggccaagacggagctggt

SEQ ID NO: 334920 - DNA, 24 bp, Artificial Sequence
  Description of Artificial Sequence: Synthetic oligonucleotide
ctctgggccaagacggagctggtg

SEQ ID NO: 334921 - DNA, 24 bp, Artificial Sequence
  Description of Artificial Sequence: Synthetic oligonucleotide
tctgggccaagacggagctggtgc

SEQ ID NO: 334922 - DNA, 23 bp, Artificial Sequence
  Description of Artificial Sequence: Synthetic oligonucleotide
ctgggccaagacggagctggtgc

SEQ ID NO: 334923 - DNA, 23 bp, Artificial Sequence
  Description of Artificial Sequence: Synthetic oligonucleotide
tgggccaagacggagctggtgcc

SEQ ID NO: 334924 - DNA, 22 bp, Artificial Sequence
  Description of Artificial Sequence: Synthetic oligonucleotide
gggccaagacggagctggtgcc

SEQ ID NO: 334925 - DNA, 23 bp, Artificial Sequence
  Description of Artificial Sequence: Synthetic oligonucleotide
ggccaagacggagctggtgccct

SEQ ID NO: 334926 - DNA, 23 bp, Artificial Sequence
  Description of Artificial Sequence: Synthetic oligonucleotide
gccaagacggagctggtgccctg

SEQ ID NO: 334927 - DNA, 23 bp, Artificial Sequence
  Description of Artificial Sequence: Synthetic oligonucleotide
ccaagacggagctggtgccctgg

SEQ ID NO: 334928 - DNA, 23 bp, Artificial Sequence
  Description of Artificial Sequence: Synthetic oligonucleotide
caagacggagctggtgccctggg

SEQ ID NO: 334929 - DNA, 23 bp, Artificial Sequence
  Description of Artificial Sequence: Synthetic oligonucleotide
aagacggagctggtgccctgggc

SEQ ID NO: 334930 - DNA, 22 bp, Artificial Sequence
  Description of Artificial Sequence: Synthetic oligonucleotide
agacggagctggtgccctgggc

SEQ ID NO: 334931 - DNA, 21 bp, Artificial Sequence
  Description of Artificial Sequence: Synthetic oligonucleotide
gacggagctggtgccctgggc

SEQ ID NO: 334932 - DNA, 21 bp, Artificial Sequence
  Description of Artificial Sequence: Synthetic oligonucleotide
acggagctggtgccctgggcg

SEQ ID NO: 334933 - DNA, 20 bp, Artificial Sequence
  Description of Artificial Sequence: Synthetic oligonucleotide
cggagctggtgccctgggcg

SEQ ID NO: 334934 - DNA, 21 bp, Artificial Sequence
  Description of Artificial Sequence: Synthetic oligonucleotide
ggagctggtgccctgggcgga

SEQ ID NO: 334935 - DNA, 22 bp, Artificial Sequence
  Description of Artificial Sequence: Synthetic oligonucleotide
gagctggtgccctgggcggagt

SEQ ID NO: 334936 - DNA, 22 bp, Artificial Sequence
  Description of Artificial Sequence: Synthetic oligonucleotide
agctggtgccctgggcggagtc

SEQ ID NO: 334937 - DNA, 21 bp, Artificial Sequence
  Description of Artificial Sequence: Synthetic oligonucleotide
gctggtgccctgggcggagtc

SEQ ID NO: 334938 - DNA, 23 bp, Artificial Sequence
  Description of Artificial Sequence: Synthetic oligonucleotide
ctggtgccctgggcggagtccaa

SEQ ID NO: 334939 - DNA, 24 bp, Artificial Sequence
  Description of Artificial Sequence: Synthetic oligonucleotide
tggtgccctgggcggagtccaact

SEQ ID NO: 334940 - DNA, 23 bp, Artificial Sequence
  Description of Artificial Sequence: Synthetic oligonucleotide
ggtgccctgggcggagtccaact

SEQ ID NO: 334941 - DNA, 23 bp, Artificial Sequence
  Description of Artificial Sequence: Synthetic oligonucleotide
gtgccctgggcggagtccaactg

SEQ ID NO: 334942 - DNA, 25 bp, Artificial Sequence
  Description of Artificial Sequence: Synthetic oligonucleotide
tgccctgggcggagtccaactgcaa

SEQ ID NO: 334943 - DNA, 24 bp, Artificial Sequence
  Description of Artificial Sequence: Synthetic oligonucleotide
gccctgggcggagtccaactgcaa

SEQ ID NO: 334944 - DNA, 24 bp, Artificial Sequence
  Description of Artificial Sequence: Synthetic oligonucleotide
ccctgggcggagtccaactgcaag

SEQ ID NO: 334945 - DNA, 24 bp, Artificial Sequence
  Description of Artificial Sequence: Synthetic oligonucleotide
cctgggcggagtccaactgcaagc

SEQ ID NO: 334946 - DNA, 24 bp, Artificial Sequence
  Description of Artificial Sequence: Synthetic oligonucleotide
ctgggcggagtccaactgcaagcc

SEQ ID NO: 334947 - DNA, 24 bp, Artificial Sequence
  Description of Artificial Sequence: Synthetic oligonucleotide
tgggcggagtccaactgcaagccg

SEQ ID NO: 334948 - DNA, 23 bp, Artificial Sequence
  Description of Artificial Sequence: Synthetic oligonucleotide
gggcggagtccaactgcaagccg

SEQ ID NO: 334949 - DNA, 24 bp, Artificial Sequence
  Description of Artificial Sequence: Synthetic oligonucleotide
ggcggagtccaactgcaagccgga

SEQ ID NO: 334950 - DNA, 25 bp, Artificial Sequence
  Description of Artificial Sequence: Synthetic oligonucleotide
gcggagtccaactgcaagccggaca

SEQ ID NO: 334951 - DNA, 26 bp, Artificial Sequence
  Description of Artificial Sequence: Synthetic oligonucleotide
cggagtccaactgcaagccggacaca

SEQ ID NO: 334952 - DNA, 26 bp, Artificial Sequence
  Description of Artificial Sequence: Synthetic oligonucleotide
ggagtccaactgcaagccggacacag

SEQ ID NO: 334953 - DNA, 26 bp, Artificial Sequence
  Description of Artificial Sequence: Synthetic oligonucleotide
gagtccaactgcaagccggacacagc

SEQ ID NO: 334954 - DNA, 27 bp, Artificial Sequence
  Description of Artificial Sequence: Synthetic oligonucleotide
agtccaactgcaagccggacacagcca

SEQ ID NO: 334955 - DNA, 26 bp, Artificial Sequence
  Description of Artificial Sequence: Synthetic oligonucleotide
gtccaactgcaagccggacacagcca

SEQ ID NO: 334956 - DNA, 26 bp, Artificial Sequence
  Description of Artificial Sequence: Synthetic oligonucleotide
tccaactgcaagccggacacagccag

SEQ ID NO: 334957 - DNA, 25 bp, Artificial Sequence
  Description of Artificial Sequence: Synthetic oligonucleotide
ccaactgcaagccggacacagccag

SEQ ID NO: 334958 - DNA, 25 bp, Artificial Sequence
  Description of Artificial Sequence: Synthetic oligonucleotide
caactgcaagccggacacagccagg

SEQ ID NO: 334959 - DNA, 26 bp, Artificial Sequence
  Description of Artificial Sequence: Synthetic oligonucleotide
aactgcaagccggacacagccaggga

SEQ ID NO: 334960 - DNA, 25 bp, Artificial Sequence
  Description of Artificial Sequence: Synthetic oligonucleotide
actgcaagccggacacagccaggga

SEQ ID NO: 334961 - DNA, 24 bp, Artificial Sequence
  Description of Artificial Sequence: Synthetic oligonucleotide
ctgcaagccggacacagccaggga

SEQ ID NO: 334962 - DNA, 24 bp, Artificial Sequence
  Description of Artificial Sequence: Synthetic oligonucleotide
tgcaagccggacacagccagggag

SEQ ID NO: 334963 - DNA, 23 bp, Artificial Sequence
  Description of Artificial Sequence: Synthetic oligonucleotide
gcaagccggacacagccagggag

SEQ ID NO: 334964 - DNA, 23 bp, Artificial Sequence
  Description of Artificial Sequence: Synthetic oligonucleotide
caagccggacacagccagggagc

SEQ ID NO: 334965 - DNA, 23 bp, Artificial Sequence
  Description of Artificial Sequence: Synthetic oligonucleotide
aagccggacacagccagggagcg

SEQ ID NO: 334966 - DNA, 22 bp, Artificial Sequence
  Description of Artificial Sequence: Synthetic oligonucleotide
agccggacacagccagggagcg

SEQ ID NO: 334967 - DNA, 21 bp, Artificial Sequence
  Description of Artificial Sequence: Synthetic oligonucleotide
gccggacacagccagggagcg

SEQ ID NO: 334968 - DNA, 23 bp, Artificial Sequence
  Description of Artificial Sequence: Synthetic oligonucleotide
ccggacacagccagggagcgcta

SEQ ID NO: 334969 - DNA, 25 bp, Artificial Sequence
  Description of Artificial Sequence: Synthetic oligonucleotide
cggacacagccagggagcgctacta

SEQ ID NO: 334970 - DNA, 25 bp, Artificial Sequence
  Description of Artificial Sequence: Synthetic oligonucleotide
ggacacagccagggagcgctactag

SEQ ID NO: 334971 - DNA, 26 bp, Artificial Sequence
  Description of Artificial Sequence: Synthetic oligonucleotide
gacacagccagggagcgctactagca

SEQ ID NO: 334972 - DNA, 27 bp, Artificial Sequence
  Description of Artificial Sequence: Synthetic oligonucleotide
acacagccagggagcgctactagcaga

SEQ ID NO: 334973 - DNA, 26 bp, Artificial Sequence
  Description of Artificial Sequence: Synthetic oligonucleotide
cacagccagggagcgctactagcaga

SEQ ID NO: 334974 - DNA, 26 bp, Artificial Sequence
  Description of Artificial Sequence: Synthetic oligonucleotide
acagccagggagcgctactagcagag

SEQ ID NO: 334975 - DNA, 25 bp, Artificial Sequence
  Description of Artificial Sequence: Synthetic oligonucleotide
cagccagggagcgctactagcagag

SEQ ID NO: 334976 - DNA, 25 bp, Artificial Sequence
  Description of Artificial Sequence: Synthetic oligonucleotide
agccagggagcgctactagcagagc

SEQ ID NO: 334977 - DNA, 24 bp, Artificial Sequence
  Description of Artificial Sequence: Synthetic oligonucleotide
gccagggagcgctactagcagagc

SEQ ID NO: 334978 - DNA, 25 bp, Artificial Sequence
  Description of Artificial Sequence: Synthetic oligonucleotide
ccagggagcgctactagcagagcct

SEQ ID NO: 334979 - DNA, 25 bp, Artificial Sequence
  Description of Artificial Sequence: Synthetic oligonucleotide
cagggagcgctactagcagagcctg

SEQ ID NO: 334980 - DNA, 26 bp, Artificial Sequence
  Description of Artificial Sequence: Synthetic oligonucleotide
agggagcgctactagcagagcctgga

SEQ ID NO: 334981 - DNA, 25 bp, Artificial Sequence
  Description of Artificial Sequence: Synthetic oligonucleotide
gggagcgctactagcagagcctgga

SEQ ID NO: 334982 - DNA, 25 bp, Artificial Sequence
  Description of Artificial Sequence: Synthetic oligonucleotide
ggagcgctactagcagagcctggag

SEQ ID NO: 334983 - DNA, 25 bp, Artificial Sequence
  Description of Artificial Sequence: Synthetic oligonucleotide
gagcgctactagcagagcctggagg

SEQ ID NO: 334984 - DNA, 26 bp, Artificial Sequence
  Description of Artificial Sequence: Synthetic oligonucleotide
agcgctactagcagagcctggaggct

SEQ ID NO: 334985 - DNA, 25 bp, Artificial Sequence
  Description of Artificial Sequence: Synthetic oligonucleotide
gcgctactagcagagcctggaggct

SEQ ID NO: 334986 - DNA, 27 bp, Artificial Sequence
  Description of Artificial Sequence: Synthetic oligonucleotide
cgctactagcagagcctggaggctcat

SEQ ID NO: 334987 - DNA, 27 bp, Artificial Sequence
  Description of Artificial Sequence: Synthetic oligonucleotide
gctactagcagagcctggaggctcatc

SEQ ID NO: 334988 - DNA, 28 bp, Artificial Sequence
  Description of Artificial Sequence: Synthetic oligonucleotide
ctactagcagagcctggaggctcatcac

SEQ ID NO: 334989 - DNA, 30 bp, Artificial Sequence
  Description of Artificial Sequence: Synthetic oligonucleotide
tactagcagagcctggaggctcatcacaag

SEQ ID NO: 334990 - DNA, 29 bp, Artificial Sequence
  Description of Artificial Sequence: Synthetic oligonucleotide
actagcagagcctggaggctcatcacaag

SEQ ID NO: 334991 - DNA, 28 bp, Artificial Sequence
  Description of Artificial Sequence: Synthetic oligonucleotide
ctagcagagcctggaggctcatcacaag

SEQ ID NO: 334992 - DNA, 28 bp, Artificial Sequence
  Description of Artificial Sequence: Synthetic oligonucleotide
tagcagagcctggaggctcatcacaagg

SEQ ID NO: 334993 - DNA, 27 bp, Artificial Sequence
  Description of Artificial Sequence: Synthetic oligonucleotide
agcagagcctggaggctcatcacaagg

SEQ ID NO: 334994 - DNA, 27 bp, Artificial Sequence
  Description of Artificial Sequence: Synthetic oligonucleotide
gcagagcctggaggctcatcacaaggt

SEQ ID NO: 334995 - DNA, 27 bp, Artificial Sequence
  Description of Artificial Sequence: Synthetic oligonucleotide
cagagcctggaggctcatcacaaggtg

SEQ ID NO: 334996 - DNA, 27 bp, Artificial Sequence
  Description of Artificial Sequence: Synthetic oligonucleotide
agagcctggaggctcatcacaaggtgg

SEQ ID NO: 334997 - DNA, 27 bp, Artificial Sequence
  Description of Artificial Sequence: Synthetic oligonucleotide
gagcctggaggctcatcacaaggtgga

SEQ ID NO: 334998 - DNA, 27 bp, Artificial Sequence
  Description of Artificial Sequence: Synthetic oligonucleotide
agcctggaggctcatcacaaggtggag

SEQ ID NO: 334999 - DNA, 26 bp, Artificial Sequence
  Description of Artificial Sequence: Synthetic oligonucleotide
gcctggaggctcatcacaaggtggag

SEQ ID NO: 335000 - DNA, 27 bp, Artificial Sequence
  Description of Artificial Sequence: Synthetic oligonucleotide
cctggaggctcatcacaaggtggaggt

SEQ ID NO: 335001 - DNA, 27 bp, Artificial Sequence
  Description of Artificial Sequence: Synthetic oligonucleotide
ctggaggctcatcacaaggtggaggtg

SEQ ID NO: 335002 - DNA, 29 bp, Artificial Sequence
  Description of Artificial Sequence: Synthetic oligonucleotide
tggaggctcatcacaaggtggaggtgtac

SEQ ID NO: 335003 - DNA, 28 bp, Artificial Sequence
  Description of Artificial Sequence: Synthetic oligonucleotide
ggaggctcatcacaaggtggaggtgtac

SEQ ID NO: 335004 - DNA, 28 bp, Artificial Sequence
  Description of Artificial Sequence: Synthetic oligonucleotide
gaggctcatcacaaggtggaggtgtacg

SEQ ID NO: 335005 - DNA, 28 bp, Artificial Sequence
  Description of Artificial Sequence: Synthetic oligonucleotide
aggctcatcacaaggtggaggtgtacgg

SEQ ID NO: 335006 - DNA, 27 bp, Artificial Sequence
  Description of Artificial Sequence: Synthetic oligonucleotide
ggctcatcacaaggtggaggtgtacgg

SEQ ID NO: 335007 - DNA, 28 bp, Artificial Sequence
  Description of Artificial Sequence: Synthetic oligonucleotide
gctcatcacaaggtggaggtgtacggag

SEQ ID NO: 335008 - DNA, 28 bp, Artificial Sequence
  Description of Artificial Sequence: Synthetic oligonucleotide
ctcatcacaaggtggaggtgtacggagg

SEQ ID NO: 335009 - DNA, 28 bp, Artificial Sequence
  Description of Artificial Sequence: Synthetic oligonucleotide
tcatcacaaggtggaggtgtacggaggc

SEQ ID NO: 335010 - DNA, 27 bp, Artificial Sequence
  Description of Artificial Sequence: Synthetic oligonucleotide
catcacaaggtggaggtgtacggaggc

SEQ ID NO: 335011 - DNA, 28 bp, Artificial Sequence
  Description of Artificial Sequence: Synthetic oligonucleotide
atcacaaggtggaggtgtacggaggctc

SEQ ID NO: 335012 - DNA, 27 bp, Artificial Sequence
  Description of Artificial Sequence: Synthetic oligonucleotide
tcacaaggtggaggtgtacggaggctc

SEQ ID NO: 335013 - DNA, 26 bp, Artificial Sequence
  Description of Artificial Sequence: Synthetic oligonucleotide
cacaaggtggaggtgtacggaggctc

SEQ ID NO: 335014 - DNA, 26 bp, Artificial Sequence
  Description of Artificial Sequence: Synthetic oligonucleotide
acaaggtggaggtgtacggaggctcc

SEQ ID NO: 335015 - DNA, 25 bp, Artificial Sequence
  Description of Artificial Sequence: Synthetic oligonucleotide
caaggtggaggtgtacggaggctcc

SEQ ID NO: 335016 - DNA, 26 bp, Artificial Sequence
  Description of Artificial Sequence: Synthetic oligonucleotide
aaggtggaggtgtacggaggctccca

SEQ ID NO: 335017 - DNA, 25 bp, Artificial Sequence
  Description of Artificial Sequence: Synthetic oligonucleotide
aggtggaggtgtacggaggctccca

SEQ ID NO: 335018 - DNA, 24 bp, Artificial Sequence
  Description of Artificial Sequence: Synthetic oligonucleotide
ggtggaggtgtacggaggctccca

SEQ ID NO: 335019 - DNA, 26 bp, Artificial Sequence
  Description of Artificial Sequence: Synthetic oligonucleotide
gtggaggtgtacggaggctcccacat

SEQ ID NO: 335020 - DNA, 26 bp, Artificial Sequence
  Description of Artificial Sequence: Synthetic oligonucleotide
tggaggtgtacggaggctcccacatg

SEQ ID NO: 335021 - DNA, 25 bp, Artificial Sequence
  Description of Artificial Sequence: Synthetic oligonucleotide
ggaggtgtacggaggctcccacatg

SEQ ID NO: 335022 - DNA, 25 bp, Artificial Sequence
  Description of Artificial Sequence: Synthetic oligonucleotide
gaggtgtacggaggctcccacatgc

SEQ ID NO: 335023 - DNA, 25 bp, Artificial Sequence
  Description of Artificial Sequence: Synthetic oligonucleotide
aggtgtacggaggctcccacatgcc

SEQ ID NO: 335024 - DNA, 24 bp, Artificial Sequence
  Description of Artificial Sequence: Synthetic oligonucleotide
ggtgtacggaggctcccacatgcc

SEQ ID NO: 335025 - DNA, 24 bp, Artificial Sequence
  Description of Artificial Sequence: Synthetic oligonucleotide
gtgtacggaggctcccacatgccc

SEQ ID NO: 335026 - DNA, 25 bp, Artificial Sequence
  Description of Artificial Sequence: Synthetic oligonucleotide
tgtacggaggctcccacatgcccct

SEQ ID NO: 335027 - DNA, 24 bp, Artificial Sequence
  Description of Artificial Sequence: Synthetic oligonucleotide
gtacggaggctcccacatgcccct

SEQ ID NO: 335028 - DNA, 24 bp, Artificial Sequence
  Description of Artificial Sequence: Synthetic oligonucleotide
tacggaggctcccacatgcccctg

SEQ ID NO: 335029 - DNA, 23 bp, Artificial Sequence
  Description of Artificial Sequence: Synthetic oligonucleotide
acggaggctcccacatgcccctg

SEQ ID NO: 335030 - DNA, 22 bp, Artificial Sequence
  Description of Artificial Sequence: Synthetic oligonucleotide
cggaggctcccacatgcccctg

SEQ ID NO: 335031 - DNA, 22 bp, Artificial Sequence
  Description of Artificial Sequence: Synthetic oligonucleotide
ggaggctcccacatgcccctgc

SEQ ID NO: 335032 - DNA, 22 bp, Artificial Sequence
  Description of Artificial Sequence: Synthetic oligonucleotide
gaggctcccacatgcccctgcc

SEQ ID NO: 335033 - DNA, 24 bp, Artificial Sequence
  Description of Artificial Sequence: Synthetic oligonucleotide
aggctcccacatgcccctgccgaa

SEQ ID NO: 335034 - DNA, 23 bp, Artificial Sequence
  Description of Artificial Sequence: Synthetic oligonucleotide
ggctcccacatgcccctgccgaa

SEQ ID NO: 335035 - DNA, 23 bp, Artificial Sequence
  Description of Artificial Sequence: Synthetic oligonucleotide
gctcccacatgcccctgccgaag

SEQ ID NO: 335036 - DNA, 23 bp, Artificial Sequence
  Description of Artificial Sequence: Synthetic oligonucleotide
ctcccacatgcccctgccgaagg

SEQ ID NO: 335037 - DNA, 23 bp, Artificial Sequence
  Description of Artificial Sequence: Synthetic oligonucleotide
tcccacatgcccctgccgaaggg

SEQ ID NO: 335038 - DNA, 22 bp, Artificial Sequence
  Description of Artificial Sequence: Synthetic oligonucleotide
cccacatgcccctgccgaaggg

SEQ ID NO: 335039 - DNA, 23 bp, Artificial Sequence
  Description of Artificial Sequence: Synthetic oligonucleotide
ccacatgcccctgccgaagggga

SEQ ID NO: 335040 - DNA, 23 bp, Artificial Sequence
  Description of Artificial Sequence: Synthetic oligonucleotide
cacatgcccctgccgaaggggac

SEQ ID NO: 335041 - DNA, 25 bp, Artificial Sequence
  Description of Artificial Sequence: Synthetic oligonucleotide
acatgcccctgccgaaggggacctt

SEQ ID NO: 335042 - DNA, 24 bp, Artificial Sequence
  Description of Artificial Sequence: Synthetic oligonucleotide
catgcccctgccgaaggggacctt

SEQ ID NO: 335043 - DNA, 26 bp, Artificial Sequence
  Description of Artificial Sequence: Synthetic oligonucleotide
atgcccctgccgaaggggaccttgat

SEQ ID NO: 335044 - DNA, 25 bp, Artificial Sequence
  Description of Artificial Sequence: Synthetic oligonucleotide
tgcccctgccgaaggggaccttgat

SEQ ID NO: 335045 - DNA, 24 bp, Artificial Sequence
  Description of Artificial Sequence: Synthetic oligonucleotide
gcccctgccgaaggggaccttgat

SEQ ID NO: 335046 - DNA, 24 bp, Artificial Sequence
  Description of Artificial Sequence: Synthetic oligonucleotide
cccctgccgaaggggaccttgatg

SEQ ID NO: 335047 - DNA, 25 bp, Artificial Sequence
  Description of Artificial Sequence: Synthetic oligonucleotide
ccctgccgaaggggaccttgatgga

SEQ ID NO: 335048 - DNA, 26 bp, Artificial Sequence
  Description of Artificial Sequence: Synthetic oligonucleotide
cctgccgaaggggaccttgatggaga

SEQ ID NO: 335049 - DNA, 26 bp, Artificial Sequence
  Description of Artificial Sequence: Synthetic oligonucleotide
ctgccgaaggggaccttgatggagag

SEQ ID NO: 335050 - DNA, 26 bp, Artificial Sequence
  Description of Artificial Sequence: Synthetic oligonucleotide
tgccgaaggggaccttgatggagagg

SEQ ID NO: 335051 - DNA, 25 bp, Artificial Sequence
  Description of Artificial Sequence: Synthetic oligonucleotide
gccgaaggggaccttgatggagagg

SEQ ID NO: 335052 - DNA, 26 bp, Artificial Sequence
  Description of Artificial Sequence: Synthetic oligonucleotide
ccgaaggggaccttgatggagaggct

SEQ ID NO: 335053 - DNA, 27 bp, Artificial Sequence
  Description of Artificial Sequence: Synthetic oligonucleotide
cgaaggggaccttgatggagaggctgt

SEQ ID NO: 335054 - DNA, 27 bp, Artificial Sequence
  Description of Artificial Sequence: Synthetic oligonucleotide
gaaggggaccttgatggagaggctgtc

SEQ ID NO: 335055 - DNA, 27 bp, Artificial Sequence
  Description of Artificial Sequence: Synthetic oligonucleotide
aaggggaccttgatggagaggctgtcc

SEQ ID NO: 335056 - DNA, 26 bp, Artificial Sequence
  Description of Artificial Sequence: Synthetic oligonucleotide
aggggaccttgatggagaggctgtcc

SEQ ID NO: 335057 - DNA, 25 bp, Artificial Sequence
  Description of Artificial Sequence: Synthetic oligonucleotide
ggggaccttgatggagaggctgtcc

SEQ ID NO: 335058 - DNA, 25 bp, Artificial Sequence
  Description of Artificial Sequence: Synthetic oligonucleotide
gggaccttgatggagaggctgtccc

SEQ ID NO: 335059 - DNA, 25 bp, Artificial Sequence
  Description of Artificial Sequence: Synthetic oligonucleotide
ggaccttgatggagaggctgtcccg

SEQ ID NO: 335060 - DNA, 27 bp, Artificial Sequence
  Description of Artificial Sequence: Synthetic oligonucleotide
gaccttgatggagaggctgtcccgcta

SEQ ID NO: 335061 - DNA, 27 bp, Artificial Sequence
  Description of Artificial Sequence: Synthetic oligonucleotide
accttgatggagaggctgtcccgctac

SEQ ID NO: 335062 - DNA, 27 bp, Artificial Sequence
  Description of Artificial Sequence: Synthetic oligonucleotide
ccttgatggagaggctgtcccgctaca

SEQ ID NO: 335063 - DNA, 28 bp, Artificial Sequence
  Description of Artificial Sequence: Synthetic oligonucleotide
cttgatggagaggctgtcccgctacaag

SEQ ID NO: 335064 - DNA, 30 bp, Artificial Sequence
  Description of Artificial Sequence: Synthetic oligonucleotide
ttgatggagaggctgtcccgctacaagttc

SEQ ID NO: 335065 - DNA, 29 bp, Artificial Sequence
  Description of Artificial Sequence: Synthetic oligonucleotide
tgatggagaggctgtcccgctacaagttc

SEQ ID NO: 335066 - DNA, 28 bp, Artificial Sequence
  Description of Artificial Sequence: Synthetic oligonucleotide
gatggagaggctgtcccgctacaagttc

SEQ ID NO: 335067 - DNA, 30 bp, Artificial Sequence
  Description of Artificial Sequence: Synthetic oligonucleotide
atggagaggctgtcccgctacaagttcaac

SEQ ID NO: 335068 - DNA, 29 bp, Artificial Sequence
  Description of Artificial Sequence: Synthetic oligonucleotide
tggagaggctgtcccgctacaagttcaac

SEQ ID NO: 335069 - DNA, 28 bp, Artificial Sequence
  Description of Artificial Sequence: Synthetic oligonucleotide
ggagaggctgtcccgctacaagttcaac

SEQ ID NO: 335070 - DNA, 28 bp, Artificial Sequence
  Description of Artificial Sequence: Synthetic oligonucleotide
gagaggctgtcccgctacaagttcaacc

SEQ ID NO: 335071 - DNA, 29 bp, Artificial Sequence
  Description of Artificial Sequence: Synthetic oligonucleotide
agaggctgtcccgctacaagttcaacctg

SEQ ID NO: 335072 - DNA, 28 bp, Artificial Sequence
  Description of Artificial Sequence: Synthetic oligonucleotide
gaggctgtcccgctacaagttcaacctg

SEQ ID NO: 335073 - DNA, 28 bp, Artificial Sequence
  Description of Artificial Sequence: Synthetic oligonucleotide
aggctgtcccgctacaagttcaacctgg

SEQ ID NO: 335074 - DNA, 27 bp, Artificial Sequence
  Description of Artificial Sequence: Synthetic oligonucleotide
ggctgtcccgctacaagttcaacctgg

SEQ ID NO: 335075 - DNA, 27 bp, Artificial Sequence
  Description of Artificial Sequence: Synthetic oligonucleotide
gctgtcccgctacaagttcaacctggc

SEQ ID NO: 335076 - DNA, 27 bp, Artificial Sequence
  Description of Artificial Sequence: Synthetic oligonucleotide
ctgtcccgctacaagttcaacctggcc

SEQ ID NO: 335077 - DNA, 29 bp, Artificial Sequence
  Description of Artificial Sequence: Synthetic oligonucleotide
tgtcccgctacaagttcaacctggcctac

SEQ ID NO: 335078 - DNA, 28 bp, Artificial Sequence
  Description of Artificial Sequence: Synthetic oligonucleotide
gtcccgctacaagttcaacctggcctac

SEQ ID NO: 335079 - DNA, 28 bp, Artificial Sequence
  Description of Artificial Sequence: Synthetic oligonucleotide
tcccgctacaagttcaacctggcctacg

SEQ ID NO: 335080 - DNA, 27 bp, Artificial Sequence
  Description of Artificial Sequence: Synthetic oligonucleotide
cccgctacaagttcaacctggcctacg

SEQ ID NO: 335081 - DNA, 28 bp, Artificial Sequence
  Description of Artificial Sequence: Synthetic oligonucleotide
ccgctacaagttcaacctggcctacgag

SEQ ID NO: 335082 - DNA, 30 bp, Artificial Sequence
  Description of Artificial Sequence: Synthetic oligonucleotide
cgctacaagttcaacctggcctacgagaac

SEQ ID NO: 335083 - DNA, 31 bp, Artificial Sequence
  Description of Artificial Sequence: Synthetic oligonucleotide
gctacaagttcaacctggcctacgagaactc

SEQ ID NO: 335084 - DNA, 31 bp, Artificial Sequence
  Description of Artificial Sequence: Synthetic oligonucleotide
ctacaagttcaacctggcctacgagaactcg

SEQ ID NO: 335085 - DNA, 33 bp, Artificial Sequence
  Description of Artificial Sequence: Synthetic oligonucleotide
tacaagttcaacctggcctacgagaactcgttg

SEQ ID NO: 335086 - DNA, 32 bp, Artificial Sequence
  Description of Artificial Sequence: Synthetic oligonucleotide
acaagttcaacctggcctacgagaactcgttg

SEQ ID NO: 335087 - DNA, 31 bp, Artificial Sequence
  Description of Artificial Sequence: Synthetic oligonucleotide
caagttcaacctggcctacgagaactcgttg

SEQ ID NO: 335088 - DNA, 31 bp, Artificial Sequence
  Description of Artificial Sequence: Synthetic oligonucleotide
aagttcaacctggcctacgagaactcgttgc

SEQ ID NO: 335089 - DNA, 30 bp, Artificial Sequence
  Description of Artificial Sequence: Synthetic oligonucleotide
agttcaacctggcctacgagaactcgttgc

SEQ ID NO: 335090 - DNA, 29 bp, Artificial Sequence
  Description of Artificial Sequence: Synthetic oligonucleotide
gttcaacctggcctacgagaactcgttgc

SEQ ID NO: 335091 - DNA, 30 bp, Artificial Sequence
  Description of Artificial Sequence: Synthetic oligonucleotide
ttcaacctggcctacgagaactcgttgcac

SEQ ID NO: 335092 - DNA, 29 bp, Artificial Sequence
  Description of Artificial Sequence: Synthetic oligonucleotide
tcaacctggcctacgagaactcgttgcac

SEQ ID NO: 335093 - DNA, 28 bp, Artificial Sequence
  Description of Artificial Sequence: Synthetic oligonucleotide
caacctggcctacgagaactcgttgcac

SEQ ID NO: 335094 - DNA, 28 bp, Artificial Sequence
  Description of Artificial Sequence: Synthetic oligonucleotide
aacctggcctacgagaactcgttgcacc

SEQ ID NO: 335095 - DNA, 27 bp, Artificial Sequence
  Description of Artificial Sequence: Synthetic oligonucleotide
acctggcctacgagaactcgttgcacc

SEQ ID NO: 335096 - DNA, 26 bp, Artificial Sequence
  Description of Artificial Sequence: Synthetic oligonucleotide
cctggcctacgagaactcgttgcacc

SEQ ID NO: 335097 - DNA, 26 bp, Artificial Sequence
  Description of Artificial Sequence: Synthetic oligonucleotide
ctggcctacgagaactcgttgcaccc

SEQ ID NO: 335098 - DNA, 26 bp, Artificial Sequence
  Description of Artificial Sequence: Synthetic oligonucleotide
tggcctacgagaactcgttgcacccc

SEQ ID NO: 335099 - DNA, 25 bp, Artificial Sequence
  Description of Artificial Sequence: Synthetic oligonucleotide
ggcctacgagaactcgttgcacccc

SEQ ID NO: 335100 - DNA, 26 bp, Artificial Sequence
  Description of Artificial Sequence: Synthetic oligonucleotide
gcctacgagaactcgttgcaccccca

SEQ ID NO: 335101 - DNA, 27 bp, Artificial Sequence
  Description of Artificial Sequence: Synthetic oligonucleotide
cctacgagaactcgttgcacccccact

SEQ ID NO: 335102 - DNA, 28 bp, Artificial Sequence
  Description of Artificial Sequence: Synthetic oligonucleotide
ctacgagaactcgttgcacccccactac

SEQ ID NO: 335103 - DNA, 30 bp, Artificial Sequence
  Description of Artificial Sequence: Synthetic oligonucleotide
tacgagaactcgttgcacccccactacatc

SEQ ID NO: 335104 - DNA, 29 bp, Artificial Sequence
  Description of Artificial Sequence: Synthetic oligonucleotide
acgagaactcgttgcacccccactacatc

SEQ ID NO: 335105 - DNA, 28 bp, Artificial Sequence
  Description of Artificial Sequence: Synthetic oligonucleotide
cgagaactcgttgcacccccactacatc

SEQ ID NO: 335106 - DNA, 29 bp, Artificial Sequence
  Description of Artificial Sequence: Synthetic oligonucleotide
gagaactcgttgcacccccactacatcag

SEQ ID NO: 335107 - DNA, 29 bp, Artificial Sequence
  Description of Artificial Sequence: Synthetic oligonucleotide
agaactcgttgcacccccactacatcagc

SEQ ID NO: 335108 - DNA, 28 bp, Artificial Sequence
  Description of Artificial Sequence: Synthetic oligonucleotide
gaactcgttgcacccccactacatcagc

SEQ ID NO: 335109 - DNA, 28 bp, Artificial Sequence
  Description of Artificial Sequence: Synthetic oligonucleotide
aactcgttgcacccccactacatcagcg

SEQ ID NO: 335110 - DNA, 27 bp, Artificial Sequence
  Description of Artificial Sequence: Synthetic oligonucleotide
actcgttgcacccccactacatcagcg

SEQ ID NO: 335111 - DNA, 27 bp, Artificial Sequence
  Description of Artificial Sequence: Synthetic oligonucleotide
ctcgttgcacccccactacatcagcga

SEQ ID NO: 335112 - DNA, 27 bp, Artificial Sequence
  Description of Artificial Sequence: Synthetic oligonucleotide
tcgttgcacccccactacatcagcgag

SEQ ID NO: 335113 - DNA, 27 bp, Artificial Sequence
  Description of Artificial Sequence: Synthetic oligonucleotide
cgttgcacccccactacatcagcgaga

SEQ ID NO: 335114 - DNA, 28 bp, Artificial Sequence
  Description of Artificial Sequence: Synthetic oligonucleotide
gttgcacccccactacatcagcgagaag

SEQ ID NO: 335115 - DNA, 28 bp, Artificial Sequence
  Description of Artificial Sequence: Synthetic oligonucleotide
ttgcacccccactacatcagcgagaagc

SEQ ID NO: 335116 - DNA, 27 bp, Artificial Sequence
  Description of Artificial Sequence: Synthetic oligonucleotide
tgcacccccactacatcagcgagaagc

SEQ ID NO: 335117 - DNA, 27 bp, Artificial Sequence
  Description of Artificial Sequence: Synthetic oligonucleotide
gcacccccactacatcagcgagaagct

SEQ ID NO: 335118 - DNA, 27 bp, Artificial Sequence
  Description of Artificial Sequence: Synthetic oligonucleotide
cacccccactacatcagcgagaagctc

SEQ ID NO: 335119 - DNA, 28 bp, Artificial Sequence
  Description of Artificial Sequence: Synthetic oligonucleotide
acccccactacatcagcgagaagctctg

SEQ ID NO: 335120 - DNA, 27 bp, Artificial Sequence
  Description of Artificial Sequence: Synthetic oligonucleotide
cccccactacatcagcgagaagctctg

SEQ ID NO: 335121 - DNA, 27 bp, Artificial Sequence
  Description of Artificial Sequence: Synthetic oligonucleotide
ccccactacatcagcgagaagctctgg

SEQ ID NO: 335122 - DNA, 28 bp, Artificial Sequence
  Description of Artificial Sequence: Synthetic oligonucleotide
cccactacatcagcgagaagctctggag

SEQ ID NO: 335123 - DNA, 28 bp, Artificial Sequence
  Description of Artificial Sequence: Synthetic oligonucleotide
ccactacatcagcgagaagctctggagg

SEQ ID NO: 335124 - DNA, 30 bp, Artificial Sequence
  Description of Artificial Sequence: Synthetic oligonucleotide
cactacatcagcgagaagctctggaggaac

SEQ ID NO: 335125 - DNA, 30 bp, Artificial Sequence
  Description of Artificial Sequence: Synthetic oligonucleotide
actacatcagcgagaagctctggaggaacc

SEQ ID NO: 335126 - DNA, 29 bp, Artificial Sequence
  Description of Artificial Sequence: Synthetic oligonucleotide
ctacatcagcgagaagctctggaggaacc

SEQ ID NO: 335127 - DNA, 29 bp, Artificial Sequence
  Description of Artificial Sequence: Synthetic oligonucleotide
tacatcagcgagaagctctggaggaaccc

SEQ ID NO: 335128 - DNA, 28 bp, Artificial Sequence
  Description of Artificial Sequence: Synthetic oligonucleotide
acatcagcgagaagctctggaggaaccc

SEQ ID NO: 335129 - DNA, 27 bp, Artificial Sequence
  Description of Artificial Sequence: Synthetic oligonucleotide
catcagcgagaagctctggaggaaccc

SEQ ID NO: 335130 - DNA, 27 bp, Artificial Sequence
  Description of Artificial Sequence: Synthetic oligonucleotide
atcagcgagaagctctggaggaacccc

SEQ ID NO: 335131 - DNA, 26 bp, Artificial Sequence
  Description of Artificial Sequence: Synthetic oligonucleotide
tcagcgagaagctctggaggaacccc

SEQ ID NO: 335132 - DNA, 25 bp, Artificial Sequence
  Description of Artificial Sequence: Synthetic oligonucleotide
cagcgagaagctctggaggaacccc

SEQ ID NO: 335133 - DNA, 26 bp, Artificial Sequence
  Description of Artificial Sequence: Synthetic oligonucleotide
agcgagaagctctggaggaaccccct

SEQ ID NO: 335134 - DNA, 25 bp, Artificial Sequence
  Description of Artificial Sequence: Synthetic oligonucleotide
gcgagaagctctggaggaaccccct

SEQ ID NO: 335135 - DNA, 25 bp, Artificial Sequence
  Description of Artificial Sequence: Synthetic oligonucleotide
cgagaagctctggaggaaccccctg

SEQ ID NO: 335136 - DNA, 26 bp, Artificial Sequence
  Description of Artificial Sequence: Synthetic oligonucleotide
gagaagctctggaggaaccccctgga

SEQ ID NO: 335137 - DNA, 26 bp, Artificial Sequence
  Description of Artificial Sequence: Synthetic oligonucleotide
agaagctctggaggaaccccctggag

SEQ ID NO: 335138 - DNA, 25 bp, Artificial Sequence
  Description of Artificial Sequence: Synthetic oligonucleotide
gaagctctggaggaaccccctggag

SEQ ID NO: 335139 - DNA, 25 bp, Artificial Sequence
  Description of Artificial Sequence: Synthetic oligonucleotide
aagctctggaggaaccccctggagg

SEQ ID NO: 335140 - DNA, 24 bp, Artificial Sequence
  Description of Artificial Sequence: Synthetic oligonucleotide
agctctggaggaaccccctggagg

SEQ ID NO: 335141 - DNA, 23 bp, Artificial Sequence
  Description of Artificial Sequence: Synthetic oligonucleotide
gctctggaggaaccccctggagg

SEQ ID NO: 335142 - DNA, 23 bp, Artificial Sequence
  Description of Artificial Sequence: Synthetic oligonucleotide
ctctggaggaaccccctggaggg

SEQ ID NO: 335143 - DNA, 24 bp, Artificial Sequence
  Description of Artificial Sequence: Synthetic oligonucleotide
tctggaggaaccccctggagggct

SEQ ID NO: 335144 - DNA, 23 bp, Artificial Sequence
  Description of Artificial Sequence: Synthetic oligonucleotide
ctggaggaaccccctggagggct

SEQ ID NO: 335145 - DNA, 23 bp, Artificial Sequence
  Description of Artificial Sequence: Synthetic oligonucleotide
tggaggaaccccctggagggctg

SEQ ID NO: 335146 - DNA, 22 bp, Artificial Sequence
  Description of Artificial Sequence: Synthetic oligonucleotide
ggaggaaccccctggagggctg

SEQ ID NO: 335147 - DNA, 22 bp, Artificial Sequence
  Description of Artificial Sequence: Synthetic oligonucleotide
gaggaaccccctggagggctgg

SEQ ID NO: 335148 - DNA, 22 bp, Artificial Sequence
  Description of Artificial Sequence: Synthetic oligonucleotide
aggaaccccctggagggctggg

SEQ ID NO: 335149 - DNA, 21 bp, Artificial Sequence
  Description of Artificial Sequence: Synthetic oligonucleotide
ggaaccccctggagggctggg

SEQ ID NO: 335150 - DNA, 21 bp, Artificial Sequence
  Description of Artificial Sequence: Synthetic oligonucleotide
gaaccccctggagggctgggc

SEQ ID NO: 335151 - DNA, 21 bp, Artificial Sequence
  Description of Artificial Sequence: Synthetic oligonucleotide
aaccccctggagggctgggcc

SEQ ID NO: 335152 - DNA, 20 bp, Artificial Sequence
  Description of Artificial Sequence: Synthetic oligonucleotide
accccctggagggctgggcc

SEQ ID NO: 335153 - DNA, 20 bp, Artificial Sequence
  Description of Artificial Sequence: Synthetic oligonucleotide
ccccctggagggctgggcct

SEQ ID NO: 335154 - DNA, 20 bp, Artificial Sequence
  Description of Artificial Sequence: Synthetic oligonucleotide
cccctggagggctgggccgt

SEQ ID NO: 335155 - DNA, 20 bp, Artificial Sequence
  Description of Artificial Sequence: Synthetic oligonucleotide
ccctggagggctgggccgtc

SEQ ID NO: 335156 - DNA, 20 bp, Artificial Sequence
  Description of Artificial Sequence: Synthetic oligonucleotide
cctggagggctgggccgtcc

SEQ ID NO: 335157 - DNA, 20 bp, Artificial Sequence
  Description of Artificial Sequence: Synthetic oligonucleotide
ctggagggctgggccgtccc

SEQ ID NO: 335158 - DNA, 20 bp, Artificial Sequence
  Description of Artificial Sequence: Synthetic oligonucleotide
tggagggctgggccgtcccc

SEQ ID NO: 335159 - DNA, 20 bp, Artificial Sequence
  Description of Artificial Sequence: Synthetic oligonucleotide
ggagggctgggccgtcccct

SEQ ID NO: 335160 - DNA, 20 bp, Artificial Sequence
  Description of Artificial Sequence: Synthetic oligonucleotide
gagggctgggccgtccccgt

SEQ ID NO: 335161 - DNA, 20 bp, Artificial Sequence
  Description of Artificial Sequence: Synthetic oligonucleotide
agggctgggccgtccccgtg

SEQ ID NO: 335162 - DNA, 20 bp, Artificial Sequence
  Description of Artificial Sequence: Synthetic oligonucleotide
gggctgggccgtccccgtgt

SEQ ID NO: 335163 - DNA, 20 bp, Artificial Sequence
  Description of Artificial Sequence: Synthetic oligonucleotide
ggctgggccgtccccgtggt

SEQ ID NO: 335164 - DNA, 20 bp, Artificial Sequence
  Description of Artificial Sequence: Synthetic oligonucleotide
gctgggccgtccccgtggtg

SEQ ID NO: 335165 - DNA, 21 bp, Artificial Sequence
  Description of Artificial Sequence: Synthetic oligonucleotide
ctgggccgtccccgtggtggt

SEQ ID NO: 335166 - DNA, 21 bp, Artificial Sequence
  Description of Artificial Sequence: Synthetic oligonucleotide
tgggccgtccccgtggtggtg

SEQ ID NO: 335167 - DNA, 20 bp, Artificial Sequence
  Description of Artificial Sequence: Synthetic oligonucleotide
gggccgtccccgtggtggtg

SEQ ID NO: 335168 - DNA, 20 bp, Artificial Sequence
  Description of Artificial Sequence: Synthetic oligonucleotide
ggccgtccccgtggtggtgg

SEQ ID NO: 335169 - DNA, 20 bp, Artificial Sequence
  Description of Artificial Sequence: Synthetic oligonucleotide
gccgtccccgtggtggtggg

SEQ ID NO: 335170 - DNA, 20 bp, Artificial Sequence
  Description of Artificial Sequence: Synthetic oligonucleotide
ccgtccccgtggtggtgggc

SEQ ID NO: 335171 - DNA, 20 bp, Artificial Sequence
  Description of Artificial Sequence: Synthetic oligonucleotide
cgtccccgtggtggtgggcc

SEQ ID NO: 335172 - DNA, 20 bp, Artificial Sequence
  Description of Artificial Sequence: Synthetic oligonucleotide
gtccccgtggtggtgggccc

SEQ ID NO: 335173 - DNA, 21 bp, Artificial Sequence
  Description of Artificial Sequence: Synthetic oligonucleotide
tccccgtggtggtgggcccca

SEQ ID NO: 335174 - DNA, 20 bp, Artificial Sequence
  Description of Artificial Sequence: Synthetic oligonucleotide
ccccgtggtggtgggcccca

SEQ ID NO: 335175 - DNA, 20 bp, Artificial Sequence
  Description of Artificial Sequence: Synthetic oligonucleotide
cccgtggtggtgggccccac

SEQ ID NO: 335176 - DNA, 21 bp, Artificial Sequence
  Description of Artificial Sequence: Synthetic oligonucleotide
ccgtggtggtgggccccacca

SEQ ID NO: 335177 - DNA, 23 bp, Artificial Sequence
  Description of Artificial Sequence: Synthetic oligonucleotide
cgtggtggtgggccccaccagaa

SEQ ID NO: 335178 - DNA, 23 bp, Artificial Sequence
  Description of Artificial Sequence: Synthetic oligonucleotide
gtggtggtgggccccaccagaag

SEQ ID NO: 335179 - DNA, 25 bp, Artificial Sequence
  Description of Artificial Sequence: Synthetic oligonucleotide
tggtggtgggccccaccagaagcaa

SEQ ID NO: 335180 - DNA, 24 bp, Artificial Sequence
  Description of Artificial Sequence: Synthetic oligonucleotide
ggtggtgggccccaccagaagcaa

SEQ ID NO: 335181 - DNA, 26 bp, Artificial Sequence
  Description of Artificial Sequence: Synthetic oligonucleotide
gtggtgggccccaccagaagcaagta

SEQ ID NO: 335182 - DNA, 26 bp, Artificial Sequence
  Description of Artificial Sequence: Synthetic oligonucleotide
tggtgggccccaccagaagcaagtac

SEQ ID NO: 335183 - DNA, 25 bp, Artificial Sequence
  Description of Artificial Sequence: Synthetic oligonucleotide
ggtgggccccaccagaagcaagtac

SEQ ID NO: 335184 - DNA, 26 bp, Artificial Sequence
  Description of Artificial Sequence: Synthetic oligonucleotide
gtgggccccaccagaagcaagtacga

SEQ ID NO: 335185 - DNA, 27 bp, Artificial Sequence
  Description of Artificial Sequence: Synthetic oligonucleotide
tgggccccaccagaagcaagtacgaga

SEQ ID NO: 335186 - DNA, 26 bp, Artificial Sequence
  Description of Artificial Sequence: Synthetic oligonucleotide
gggccccaccagaagcaagtacgaga

SEQ ID NO: 335187 - DNA, 26 bp, Artificial Sequence
  Description of Artificial Sequence: Synthetic oligonucleotide
ggccccaccagaagcaagtacgagag

SEQ ID NO: 335188 - DNA, 27 bp, Artificial Sequence
  Description of Artificial Sequence: Synthetic oligonucleotide
gccccaccagaagcaagtacgagagga

SEQ ID NO: 335189 - DNA, 28 bp, Artificial Sequence
  Description of Artificial Sequence: Synthetic oligonucleotide
ccccaccagaagcaagtacgagaggatc

SEQ ID NO: 335190 - DNA, 28 bp, Artificial Sequence
  Description of Artificial Sequence: Synthetic oligonucleotide
cccaccagaagcaagtacgagaggatcc

SEQ ID NO: 335191 - DNA, 29 bp, Artificial Sequence
  Description of Artificial Sequence: Synthetic oligonucleotide
ccaccagaagcaagtacgagaggatcctg

SEQ ID NO: 335192 - DNA, 29 bp, Artificial Sequence
  Description of Artificial Sequence: Synthetic oligonucleotide
caccagaagcaagtacgagaggatcctgc

SEQ ID NO: 335193 - DNA, 29 bp, Artificial Sequence
  Description of Artificial Sequence: Synthetic oligonucleotide
accagaagcaagtacgagaggatcctgcc

SEQ ID NO: 335194 - DNA, 28 bp, Artificial Sequence
  Description of Artificial Sequence: Synthetic oligonucleotide
ccagaagcaagtacgagaggatcctgcc

SEQ ID NO: 335195 - DNA, 29 bp, Artificial Sequence
  Description of Artificial Sequence: Synthetic oligonucleotide
cagaagcaagtacgagaggatcctgccac

SEQ ID NO: 335196 - DNA, 29 bp, Artificial Sequence
  Description of Artificial Sequence: Synthetic oligonucleotide
agaagcaagtacgagaggatcctgccacg

SEQ ID NO: 335197 - DNA, 28 bp, Artificial Sequence
  Description of Artificial Sequence: Synthetic oligonucleotide
gaagcaagtacgagaggatcctgccacg

SEQ ID NO: 335198 - DNA, 28 bp, Artificial Sequence
  Description of Artificial Sequence: Synthetic oligonucleotide
aagcaagtacgagaggatcctgccacgc

SEQ ID NO: 335199 - DNA, 27 bp, Artificial Sequence
  Description of Artificial Sequence: Synthetic oligonucleotide
agcaagtacgagaggatcctgccacgc

SEQ ID NO: 335200 - DNA, 26 bp, Artificial Sequence
  Description of Artificial Sequence: Synthetic oligonucleotide
gcaagtacgagaggatcctgccacgc

SEQ ID NO: 335201 - DNA, 27 bp, Artificial Sequence
  Description of Artificial Sequence: Synthetic oligonucleotide
caagtacgagaggatcctgccacgcga

SEQ ID NO: 335202 - DNA, 27 bp, Artificial Sequence
  Description of Artificial Sequence: Synthetic oligonucleotide
aagtacgagaggatcctgccacgcgac

SEQ ID NO: 335203 - DNA, 26 bp, Artificial Sequence
  Description of Artificial Sequence: Synthetic oligonucleotide
agtacgagaggatcctgccacgcgac

SEQ ID NO: 335204 - DNA, 25 bp, Artificial Sequence
  Description of Artificial Sequence: Synthetic oligonucleotide
gtacgagaggatcctgccacgcgac

SEQ ID NO: 335205 - DNA, 25 bp, Artificial Sequence
  Description of Artificial Sequence: Synthetic oligonucleotide
tacgagaggatcctgccacgcgacg

SEQ ID NO: 335206 - DNA, 24 bp, Artificial Sequence
  Description of Artificial Sequence: Synthetic oligonucleotide
acgagaggatcctgccacgcgacg

SEQ ID NO: 335207 - DNA, 23 bp, Artificial Sequence
  Description of Artificial Sequence: Synthetic oligonucleotide
cgagaggatcctgccacgcgacg

SEQ ID NO: 335208 - DNA, 23 bp, Artificial Sequence
  Description of Artificial Sequence: Synthetic oligonucleotide
gagaggatcctgccacgcgacgc

SEQ ID NO: 335209 - DNA, 25 bp, Artificial Sequence
  Description of Artificial Sequence: Synthetic oligonucleotide
agaggatcctgccacgcgacgcctt

SEQ ID NO: 335210 - DNA, 24 bp, Artificial Sequence
  Description of Artificial Sequence: Synthetic oligonucleotide
gaggatcctgccacgcgacgcctt

SEQ ID NO: 335211 - DNA, 26 bp, Artificial Sequence
  Description of Artificial Sequence: Synthetic oligonucleotide
aggatcctgccacgcgacgccttgat

SEQ ID NO: 335212 - DNA, 25 bp, Artificial Sequence
  Description of Artificial Sequence: Synthetic oligonucleotide
ggatcctgccacgcgacgccttgat

SEQ ID NO: 335213 - DNA, 25 bp, Artificial Sequence
  Description of Artificial Sequence: Synthetic oligonucleotide
gatcctgccacgcgacgccttgatc

SEQ ID NO: 335214 - DNA, 26 bp, Artificial Sequence
  Description of Artificial Sequence: Synthetic oligonucleotide
atcctgccacgcgacgccttgatcca

SEQ ID NO: 335215 - DNA, 25 bp, Artificial Sequence
  Description of Artificial Sequence: Synthetic oligonucleotide
tcctgccacgcgacgccttgatcca

SEQ ID NO: 335216 - DNA, 24 bp, Artificial Sequence
  Description of Artificial Sequence: Synthetic oligonucleotide
cctgccacgcgacgccttgatcca

SEQ ID NO: 335217 - DNA, 24 bp, Artificial Sequence
  Description of Artificial Sequence: Synthetic oligonucleotide
ctgccacgcgacgccttgatccac

SEQ ID NO: 335218 - DNA, 25 bp, Artificial Sequence
  Description of Artificial Sequence: Synthetic oligonucleotide
tgccacgcgacgccttgatccacgt

SEQ ID NO: 335219 - DNA, 24 bp, Artificial Sequence
  Description of Artificial Sequence: Synthetic oligonucleotide
gccacgcgacgccttgatccacgt

SEQ ID NO: 335220 - DNA, 24 bp, Artificial Sequence
  Description of Artificial Sequence: Synthetic oligonucleotide
ccacgcgacgccttgatccacgtg

SEQ ID NO: 335221 - DNA, 25 bp, Artificial Sequence
  Description of Artificial Sequence: Synthetic oligonucleotide
cacgcgacgccttgatccacgtgca

SEQ ID NO: 335222 - DNA, 25 bp, Artificial Sequence
  Description of Artificial Sequence: Synthetic oligonucleotide
acgcgacgccttgatccacgtgcac

SEQ ID NO: 335223 - DNA, 24 bp, Artificial Sequence
  Description of Artificial Sequence: Synthetic oligonucleotide
cgcgacgccttgatccacgtgcac

SEQ ID NO: 335224 - DNA, 25 bp, Artificial Sequence
  Description of Artificial Sequence: Synthetic oligonucleotide
gcgacgccttgatccacgtgcacga

SEQ ID NO: 335225 - DNA, 27 bp, Artificial Sequence
  Description of Artificial Sequence: Synthetic oligonucleotide
cgacgccttgatccacgtgcacgactt

SEQ ID NO: 335226 - DNA, 27 bp, Artificial Sequence
  Description of Artificial Sequence: Synthetic oligonucleotide
gacgccttgatccacgtgcacgacttc

SEQ ID NO: 335227 - DNA, 27 bp, Artificial Sequence
  Description of Artificial Sequence: Synthetic oligonucleotide
acgccttgatccacgtgcacgacttcc

SEQ ID NO: 335228 - DNA, 27 bp, Artificial Sequence
  Description of Artificial Sequence: Synthetic oligonucleotide
cgccttgatccacgtgcacgacttcct

SEQ ID NO: 335229 - DNA, 27 bp, Artificial Sequence
  Description of Artificial Sequence: Synthetic oligonucleotide
gccttgatccacgtgcacgacttcctg

SEQ ID NO: 335230 - DNA, 28 bp, Artificial Sequence
  Description of Artificial Sequence: Synthetic oligonucleotide
ccttgatccacgtgcacgacttcctgag

SEQ ID NO: 335231 - DNA, 28 bp, Artificial Sequence
  Description of Artificial Sequence: Synthetic oligonucleotide
cttgatccacgtgcacgacttcctgagc

SEQ ID NO: 335232 - DNA, 28 bp, Artificial Sequence
  Description of Artificial Sequence: Synthetic oligonucleotide
ttgatccacgtgcacgacttcctgagcc

SEQ ID NO: 335233 - DNA, 27 bp, Artificial Sequence
  Description of Artificial Sequence: Synthetic oligonucleotide
tgatccacgtgcacgacttcctgagcc

SEQ ID NO: 335234 - DNA, 26 bp, Artificial Sequence
  Description of Artificial Sequence: Synthetic oligonucleotide
gatccacgtgcacgacttcctgagcc

SEQ ID NO: 335235 - DNA, 26 bp, Artificial Sequence
  Description of Artificial Sequence: Synthetic oligonucleotide
atccacgtgcacgacttcctgagccc

SEQ ID NO: 335236 - DNA, 25 bp, Artificial Sequence
  Description of Artificial Sequence: Synthetic oligonucleotide
tccacgtgcacgacttcctgagccc

SEQ ID NO: 335237 - DNA, 24 bp, Artificial Sequence
  Description of Artificial Sequence: Synthetic oligonucleotide
ccacgtgcacgacttcctgagccc

SEQ ID NO: 335238 - DNA, 26 bp, Artificial Sequence
  Description of Artificial Sequence: Synthetic oligonucleotide
cacgtgcacgacttcctgagccccaa

SEQ ID NO: 335239 - DNA, 26 bp, Artificial Sequence
  Description of Artificial Sequence: Synthetic oligonucleotide
acgtgcacgacttcctgagccccaac

SEQ ID NO: 335240 - DNA, 25 bp, Artificial Sequence
  Description of Artificial Sequence: Synthetic oligonucleotide
cgtgcacgacttcctgagccccaac

SEQ ID NO: 335241 - DNA, 26 bp, Artificial Sequence
  Description of Artificial Sequence: Synthetic oligonucleotide
gtgcacgacttcctgagccccaacga

SEQ ID NO: 335242 - DNA, 26 bp, Artificial Sequence
  Description of Artificial Sequence: Synthetic oligonucleotide
tgcacgacttcctgagccccaacgac

SEQ ID NO: 335243 - DNA, 25 bp, Artificial Sequence
  Description of Artificial Sequence: Synthetic oligonucleotide
gcacgacttcctgagccccaacgac

SEQ ID NO: 335244 - DNA, 26 bp, Artificial Sequence
  Description of Artificial Sequence: Synthetic oligonucleotide
cacgacttcctgagccccaacgacct

SEQ ID NO: 335245 - DNA, 26 bp, Artificial Sequence
  Description of Artificial Sequence: Synthetic oligonucleotide
acgacttcctgagccccaacgacctg

SEQ ID NO: 335246 - DNA, 25 bp, Artificial Sequence
  Description of Artificial Sequence: Synthetic oligonucleotide
cgacttcctgagccccaacgacctg

SEQ ID NO: 335247 - DNA, 25 bp, Artificial Sequence
  Description of Artificial Sequence: Synthetic oligonucleotide
gacttcctgagccccaacgacctgg

SEQ ID NO: 335248 - DNA, 25 bp, Artificial Sequence
  Description of Artificial Sequence: Synthetic oligonucleotide
acttcctgagccccaacgacctggc

SEQ ID NO: 335249 - DNA, 24 bp, Artificial Sequence
  Description of Artificial Sequence: Synthetic oligonucleotide
cttcctgagccccaacgacctggc

SEQ ID NO: 335250 - DNA, 24 bp, Artificial Sequence
  Description of Artificial Sequence: Synthetic oligonucleotide
ttcctgagccccaacgacctggcc

SEQ ID NO: 335251 - DNA, 23 bp, Artificial Sequence
  Description of Artificial Sequence: Synthetic oligonucleotide
tcctgagccccaacgacctggcc

SEQ ID NO: 335252 - DNA, 22 bp, Artificial Sequence
  Description of Artificial Sequence: Synthetic oligonucleotide
cctgagccccaacgacctggcc

SEQ ID NO: 335253 - DNA, 22 bp, Artificial Sequence
  Description of Artificial Sequence: Synthetic oligonucleotide
ctgagccccaacgacctggccg

SEQ ID NO: 335254 - DNA, 22 bp, Artificial Sequence
  Description of Artificial Sequence: Synthetic oligonucleotide
tgagccccaacgacctggccgg

SEQ ID NO: 335255 - DNA, 21 bp, Artificial Sequence
  Description of Artificial Sequence: Synthetic oligonucleotide
gagccccaacgacctggccgg

SEQ ID NO: 335256 - DNA, 23 bp, Artificial Sequence
  Description of Artificial Sequence: Synthetic oligonucleotide
agccccaacgacctggccgggta

SEQ ID NO: 335257 - DNA, 22 bp, Artificial Sequence
  Description of Artificial Sequence: Synthetic oligonucleotide
gccccaacgacctggccgggta

SEQ ID NO: 335258 - DNA, 22 bp, Artificial Sequence
  Description of Artificial Sequence: Synthetic oligonucleotide
ccccaacgacctggccgggtac

SEQ ID NO: 335259 - DNA, 23 bp, Artificial Sequence
  Description of Artificial Sequence: Synthetic oligonucleotide
cccaacgacctggccgggtacct

SEQ ID NO: 335260 - DNA, 23 bp, Artificial Sequence
  Description of Artificial Sequence: Synthetic oligonucleotide
ccaacgacctggccgggtacctg

SEQ ID NO: 335261 - DNA, 24 bp, Artificial Sequence
  Description of Artificial Sequence: Synthetic oligonucleotide
caacgacctggccgggtacctgct

SEQ ID NO: 335262 - DNA, 24 bp, Artificial Sequence
  Description of Artificial Sequence: Synthetic oligonucleotide
aacgacctggccgggtacctgctg

SEQ ID NO: 335263 - DNA, 23 bp, Artificial Sequence
  Description of Artificial Sequence: Synthetic oligonucleotide
acgacctggccgggtacctgctg

SEQ ID NO: 335264 - DNA, 22 bp, Artificial Sequence
  Description of Artificial Sequence: Synthetic oligonucleotide
cgacctggccgggtacctgctg

SEQ ID NO: 335265 - DNA, 23 bp, Artificial Sequence
  Description of Artificial Sequence: Synthetic oligonucleotide
gacctggccgggtacctgctgga

SEQ ID NO: 335266 - DNA, 23 bp, Artificial Sequence
  Description of Artificial Sequence: Synthetic oligonucleotide
acctggccgggtacctgctggag

SEQ ID NO: 335267 - DNA, 22 bp, Artificial Sequence
  Description of Artificial Sequence: Synthetic oligonucleotide
cctggccgggtacctgctggag

SEQ ID NO: 335268 - DNA, 23 bp, Artificial Sequence
  Description of Artificial Sequence: Synthetic oligonucleotide
ctggccgggtacctgctggagct

SEQ ID NO: 335269 - DNA, 23 bp, Artificial Sequence
  Description of Artificial Sequence: Synthetic oligonucleotide
tggccgggtacctgctggagctg

SEQ ID NO: 335270 - DNA, 22 bp, Artificial Sequence
  Description of Artificial Sequence: Synthetic oligonucleotide
ggccgggtacctgctggagctg

SEQ ID NO: 335271 - DNA, 23 bp, Artificial Sequence
  Description of Artificial Sequence: Synthetic oligonucleotide
gccgggtacctgctggagctgga

SEQ ID NO: 335272 - DNA, 25 bp, Artificial Sequence
  Description of Artificial Sequence: Synthetic oligonucleotide
ccgggtacctgctggagctggagaa

SEQ ID NO: 335273 - DNA, 25 bp, Artificial Sequence
  Description of Artificial Sequence: Synthetic oligonucleotide
cgggtacctgctggagctggagaag

SEQ ID NO: 335274 - DNA, 26 bp, Artificial Sequence
  Description of Artificial Sequence: Synthetic oligonucleotide
gggtacctgctggagctggagaagga

SEQ ID NO: 335275 - DNA, 26 bp, Artificial Sequence
  Description of Artificial Sequence: Synthetic oligonucleotide
ggtacctgctggagctggagaaggac

SEQ ID NO: 335276 - DNA, 27 bp, Artificial Sequence
  Description of Artificial Sequence: Synthetic oligonucleotide
gtacctgctggagctggagaaggacca

SEQ ID NO: 335277 - DNA, 27 bp, Artificial Sequence
  Description of Artificial Sequence: Synthetic oligonucleotide
tacctgctggagctggagaaggaccac

SEQ ID NO: 335278 - DNA, 26 bp, Artificial Sequence
  Description of Artificial Sequence: Synthetic oligonucleotide
acctgctggagctggagaaggaccac

SEQ ID NO: 335279 - DNA, 25 bp, Artificial Sequence
  Description of Artificial Sequence: Synthetic oligonucleotide
cctgctggagctggagaaggaccac

SEQ ID NO: 335280 - DNA, 25 bp, Artificial Sequence
  Description of Artificial Sequence: Synthetic oligonucleotide
ctgctggagctggagaaggaccacc

SEQ ID NO: 335281 - DNA, 25 bp, Artificial Sequence
  Description of Artificial Sequence: Synthetic oligonucleotide
tgctggagctggagaaggaccaccc

SEQ ID NO: 335282 - DNA, 24 bp, Artificial Sequence
  Description of Artificial Sequence: Synthetic oligonucleotide
gctggagctggagaaggaccaccc

SEQ ID NO: 335283 - DNA, 24 bp, Artificial Sequence
  Description of Artificial Sequence: Synthetic oligonucleotide
ctggagctggagaaggaccacccc

SEQ ID NO: 335284 - DNA, 24 bp, Artificial Sequence
  Description of Artificial Sequence: Synthetic oligonucleotide
tggagctggagaaggaccaccccc

SEQ ID NO: 335285 - DNA, 23 bp, Artificial Sequence
  Description of Artificial Sequence: Synthetic oligonucleotide
ggagctggagaaggaccaccccc

SEQ ID NO: 335286 - DNA, 23 bp, Artificial Sequence
  Description of Artificial Sequence: Synthetic oligonucleotide
gagctggagaaggaccacccccg

SEQ ID NO: 335287 - DNA, 25 bp, Artificial Sequence
  Description of Artificial Sequence: Synthetic oligonucleotide
agctggagaaggaccacccccgcta

SEQ ID NO: 335288 - DNA, 24 bp, Artificial Sequence
  Description of Artificial Sequence: Synthetic oligonucleotide
gctggagaaggaccacccccgcta

SEQ ID NO: 335289 - DNA, 24 bp, Artificial Sequence
  Description of Artificial Sequence: Synthetic oligonucleotide
ctggagaaggaccacccccgctac

SEQ ID NO: 335290 - DNA, 25 bp, Artificial Sequence
  Description of Artificial Sequence: Synthetic oligonucleotide
tggagaaggaccacccccgctacca

SEQ ID NO: 335291 - DNA, 24 bp, Artificial Sequence
  Description of Artificial Sequence: Synthetic oligonucleotide
ggagaaggaccacccccgctacca

SEQ ID NO: 335292 - DNA, 25 bp, Artificial Sequence
  Description of Artificial Sequence: Synthetic oligonucleotide
gagaaggaccacccccgctaccaga

SEQ ID NO: 335293 - DNA, 25 bp, Artificial Sequence
  Description of Artificial Sequence: Synthetic oligonucleotide
agaaggaccacccccgctaccagag

SEQ ID NO: 335294 - DNA, 24 bp, Artificial Sequence
  Description of Artificial Sequence: Synthetic oligonucleotide
gaaggaccacccccgctaccagag

SEQ ID NO: 335295 - DNA, 26 bp, Artificial Sequence
  Description of Artificial Sequence: Synthetic oligonucleotide
aaggaccacccccgctaccagagcta

SEQ ID NO: 335296 - DNA, 25 bp, Artificial Sequence
  Description of Artificial Sequence: Synthetic oligonucleotide
aggaccacccccgctaccagagcta

SEQ ID NO: 335297 - DNA, 24 bp, Artificial Sequence
  Description of Artificial Sequence: Synthetic oligonucleotide
ggaccacccccgctaccagagcta

SEQ ID NO: 335298 - DNA, 27 bp, Artificial Sequence
  Description of Artificial Sequence: Synthetic oligonucleotide
gaccacccccgctaccagagctactta

SEQ ID NO: 335299 - DNA, 27 bp, Artificial Sequence
  Description of Artificial Sequence: Synthetic oligonucleotide
accacccccgctaccagagctacttac

SEQ ID NO: 335300 - DNA, 26 bp, Artificial Sequence
  Description of Artificial Sequence: Synthetic oligonucleotide
ccacccccgctaccagagctacttac

SEQ ID NO: 335301 - DNA, 26 bp, Artificial Sequence
  Description of Artificial Sequence: Synthetic oligonucleotide
cacccccgctaccagagctacttacg

SEQ ID NO: 335302 - DNA, 27 bp, Artificial Sequence
  Description of Artificial Sequence: Synthetic oligonucleotide
acccccgctaccagagctacttacgct

SEQ ID NO: 335303 - DNA, 26 bp, Artificial Sequence
  Description of Artificial Sequence: Synthetic oligonucleotide
cccccgctaccagagctacttacgct

SEQ ID NO: 335304 - DNA, 26 bp, Artificial Sequence
  Description of Artificial Sequence: Synthetic oligonucleotide
ccccgctaccagagctacttacgctg

SEQ ID NO: 335305 - DNA, 26 bp, Artificial Sequence
  Description of Artificial Sequence: Synthetic oligonucleotide
cccgctaccagagctacttacgctgg

SEQ ID NO: 335306 - DNA, 26 bp, Artificial Sequence
  Description of Artificial Sequence: Synthetic oligonucleotide
ccgctaccagagctacttacgctggc

SEQ ID NO: 335307 - DNA, 26 bp, Artificial Sequence
  Description of Artificial Sequence: Synthetic oligonucleotide
cgctaccagagctacttacgctggcg

SEQ ID NO: 335308 - DNA, 26 bp, Artificial Sequence
  Description of Artificial Sequence: Synthetic oligonucleotide
gctaccagagctacttacgctggcgg

SEQ ID NO: 335309 - DNA, 27 bp, Artificial Sequence
  Description of Artificial Sequence: Synthetic oligonucleotide
ctaccagagctacttacgctggcggca

SEQ ID NO: 335310 - DNA, 27 bp, Artificial Sequence
  Description of Artificial Sequence: Synthetic oligonucleotide
taccagagctacttacgctggcggcag

SEQ ID NO: 335311 - DNA, 27 bp, Artificial Sequence
  Description of Artificial Sequence: Synthetic oligonucleotide
accagagctacttacgctggcggcaga

SEQ ID NO: 335312 - DNA, 26 bp, Artificial Sequence
  Description of Artificial Sequence: Synthetic oligonucleotide
ccagagctacttacgctggcggcaga

SEQ ID NO: 335313 - DNA, 26 bp, Artificial Sequence
  Description of Artificial Sequence: Synthetic oligonucleotide
cagagctacttacgctggcggcagac

SEQ ID NO: 335314 - DNA, 26 bp, Artificial Sequence
  Description of Artificial Sequence: Synthetic oligonucleotide
agagctacttacgctggcggcagacg

SEQ ID NO: 335315 - DNA, 25 bp, Artificial Sequence
  Description of Artificial Sequence: Synthetic oligonucleotide
gagctacttacgctggcggcagacg

SEQ ID NO: 335316 - DNA, 26 bp, Artificial Sequence
  Description of Artificial Sequence: Synthetic oligonucleotide
agctacttacgctggcggcagacgct

SEQ ID NO: 335317 - DNA, 25 bp, Artificial Sequence
  Description of Artificial Sequence: Synthetic oligonucleotide
gctacttacgctggcggcagacgct

SEQ ID NO: 335318 - DNA, 25 bp, Artificial Sequence
  Description of Artificial Sequence: Synthetic oligonucleotide
ctacttacgctggcggcagacgctg

SEQ ID NO: 335319 - DNA, 25 bp, Artificial Sequence
  Description of Artificial Sequence: Synthetic oligonucleotide
tacttacgctggcggcagacgctgc

SEQ ID NO: 335320 - DNA, 24 bp, Artificial Sequence
  Description of Artificial Sequence: Synthetic oligonucleotide
acttacgctggcggcagacgctgc

SEQ ID NO: 335321 - DNA, 23 bp, Artificial Sequence
  Description of Artificial Sequence: Synthetic oligonucleotide
cttacgctggcggcagacgctgc

SEQ ID NO: 335322 - DNA, 23 bp, Artificial Sequence
  Description of Artificial Sequence: Synthetic oligonucleotide
ttacgctggcggcagacgctgcc

SEQ ID NO: 335323 - DNA, 22 bp, Artificial Sequence
  Description of Artificial Sequence: Synthetic oligonucleotide
tacgctggcggcagacgctgcc

SEQ ID NO: 335324 - DNA, 21 bp, Artificial Sequence
  Description of Artificial Sequence: Synthetic oligonucleotide
acgctggcggcagacgctgcc

SEQ ID NO: 335325 - DNA, 20 bp, Artificial Sequence
  Description of Artificial Sequence: Synthetic oligonucleotide
cgctggcggcagacgctgcc

SEQ ID NO: 335326 - DNA, 20 bp, Artificial Sequence
  Description of Artificial Sequence: Synthetic oligonucleotide
gctggcggcagacgctgccg

SEQ ID NO: 335327 - DNA, 20 bp, Artificial Sequence
  Description of Artificial Sequence: Synthetic oligonucleotide
ctggcggcagacgctgccgc

SEQ ID NO: 335328 - DNA, 21 bp, Artificial Sequence
  Description of Artificial Sequence: Synthetic oligonucleotide
tggcggcagacgctgccgcct

SEQ ID NO: 335329 - DNA, 20 bp, Artificial Sequence
  Description of Artificial Sequence: Synthetic oligonucleotide
ggcggcagacgctgccgcct

SEQ ID NO: 335330 - DNA, 20 bp, Artificial Sequence
  Description of Artificial Sequence: Synthetic oligonucleotide
gcggcagacgctgccgcctc

SEQ ID NO: 335331 - DNA, 20 bp, Artificial Sequence
  Description of Artificial Sequence: Synthetic oligonucleotide
cggcagacgctgccgcctcg

SEQ ID NO: 335332 - DNA, 21 bp, Artificial Sequence
  Description of Artificial Sequence: Synthetic oligonucleotide
ggcagacgctgccgcctcgct

SEQ ID NO: 335333 - DNA, 21 bp, Artificial Sequence
  Description of Artificial Sequence: Synthetic oligonucleotide
gcagacgctgccgcctcgctc

SEQ ID NO: 335334 - DNA, 23 bp, Artificial Sequence
  Description of Artificial Sequence: Synthetic oligonucleotide
cagacgctgccgcctcgctcgtt

SEQ ID NO: 335335 - DNA, 24 bp, Artificial Sequence
  Description of Artificial Sequence: Synthetic oligonucleotide
agacgctgccgcctcgctcgttca

SEQ ID NO: 335336 - DNA, 23 bp, Artificial Sequence
  Description of Artificial Sequence: Synthetic oligonucleotide
gacgctgccgcctcgctcgttca

SEQ ID NO: 335337 - DNA, 23 bp, Artificial Sequence
  Description of Artificial Sequence: Synthetic oligonucleotide
acgctgccgcctcgctcgttcag

SEQ ID NO: 335338 - DNA, 22 bp, Artificial Sequence
  Description of Artificial Sequence: Synthetic oligonucleotide
cgctgccgcctcgctcgttcag

SEQ ID NO: 335339 - DNA, 23 bp, Artificial Sequence
  Description of Artificial Sequence: Synthetic oligonucleotide
gctgccgcctcgctcgttcagct

SEQ ID NO: 335340 - DNA, 23 bp, Artificial Sequence
  Description of Artificial Sequence: Synthetic oligonucleotide
ctgccgcctcgctcgttcagctg

SEQ ID NO: 335341 - DNA, 23 bp, Artificial Sequence
  Description of Artificial Sequence: Synthetic oligonucleotide
tgccgcctcgctcgttcagctgg

SEQ ID NO: 335342 - DNA, 22 bp, Artificial Sequence
  Description of Artificial Sequence: Synthetic oligonucleotide
gccgcctcgctcgttcagctgg

SEQ ID NO: 335343 - DNA, 22 bp, Artificial Sequence
  Description of Artificial Sequence: Synthetic oligonucleotide
ccgcctcgctcgttcagctggc

SEQ ID NO: 335344 - DNA, 23 bp, Artificial Sequence
  Description of Artificial Sequence: Synthetic oligonucleotide
cgcctcgctcgttcagctggcca

SEQ ID NO: 335345 - DNA, 24 bp, Artificial Sequence
  Description of Artificial Sequence: Synthetic oligonucleotide
gcctcgctcgttcagctggccact

SEQ ID NO: 335346 - DNA, 24 bp, Artificial Sequence
  Description of Artificial Sequence: Synthetic oligonucleotide
cctcgctcgttcagctggccactg

SEQ ID NO: 335347 - DNA, 27 bp, Artificial Sequence
  Description of Artificial Sequence: Synthetic oligonucleotide
ctcgctcgttcagctggccactggatt

SEQ ID NO: 335348 - DNA, 28 bp, Artificial Sequence
  Description of Artificial Sequence: Synthetic oligonucleotide
tcgctcgttcagctggccactggattac

SEQ ID NO: 335349 - DNA, 27 bp, Artificial Sequence
  Description of Artificial Sequence: Synthetic oligonucleotide
cgctcgttcagctggccactggattac

SEQ ID NO: 335350 - DNA, 28 bp, Artificial Sequence
  Description of Artificial Sequence: Synthetic oligonucleotide
gctcgttcagctggccactggattactg

SEQ ID NO: 335351 - DNA, 28 bp, Artificial Sequence
  Description of Artificial Sequence: Synthetic oligonucleotide
ctcgttcagctggccactggattactgc

SEQ ID NO: 335352 - DNA, 30 bp, Artificial Sequence
  Description of Artificial Sequence: Synthetic oligonucleotide
tcgttcagctggccactggattactgcaag

SEQ ID NO: 335353 - DNA, 29 bp, Artificial Sequence
  Description of Artificial Sequence: Synthetic oligonucleotide
cgttcagctggccactggattactgcaag

SEQ ID NO: 335354 - DNA, 29 bp, Artificial Sequence
  Description of Artificial Sequence: Synthetic oligonucleotide
gttcagctggccactggattactgcaagg

SEQ ID NO: 335355 - DNA, 29 bp, Artificial Sequence
  Description of Artificial Sequence: Synthetic oligonucleotide
ttcagctggccactggattactgcaaggc

SEQ ID NO: 335356 - DNA, 28 bp, Artificial Sequence
  Description of Artificial Sequence: Synthetic oligonucleotide
tcagctggccactggattactgcaaggc

SEQ ID NO: 335357 - DNA, 27 bp, Artificial Sequence
  Description of Artificial Sequence: Synthetic oligonucleotide
cagctggccactggattactgcaaggc

SEQ ID NO: 335358 - DNA, 27 bp, Artificial Sequence
  Description of Artificial Sequence: Synthetic oligonucleotide
agctggccactggattactgcaaggcg

SEQ ID NO: 335359 - DNA, 27 bp, Artificial Sequence
  Description of Artificial Sequence: Synthetic oligonucleotide
gctggccactggattactgcaaggcgt

SEQ ID NO: 335360 - DNA, 27 bp, Artificial Sequence
  Description of Artificial Sequence: Synthetic oligonucleotide
ctggccactggattactgcaaggcgtg

SEQ ID NO: 335361 - DNA, 27 bp, Artificial Sequence
  Description of Artificial Sequence: Synthetic oligonucleotide
tggccactggattactgcaaggcgtgc

SEQ ID NO: 335362 - DNA, 27 bp, Artificial Sequence
  Description of Artificial Sequence: Synthetic oligonucleotide
ggccactggattactgcaaggcgtgct

SEQ ID NO: 335363 - DNA, 27 bp, Artificial Sequence
  Description of Artificial Sequence: Synthetic oligonucleotide
gccactggattactgcaaggcgtgctg

SEQ ID NO: 335364 - DNA, 27 bp, Artificial Sequence
  Description of Artificial Sequence: Synthetic oligonucleotide
ccactggattactgcaaggcgtgctgg

SEQ ID NO: 335365 - DNA, 30 bp, Artificial Sequence
  Description of Artificial Sequence: Synthetic oligonucleotide
cactggattactgcaaggcgtgctggaaag

SEQ ID NO: 335366 - DNA, 31 bp, Artificial Sequence
  Description of Artificial Sequence: Synthetic oligonucleotide
actggattactgcaaggcgtgctggaaagtg

SEQ ID NO: 335367 - DNA, 30 bp, Artificial Sequence
  Description of Artificial Sequence: Synthetic oligonucleotide
ctggattactgcaaggcgtgctggaaagtg

SEQ ID NO: 335368 - DNA, 30 bp, Artificial Sequence
  Description of Artificial Sequence: Synthetic oligonucleotide
tggattactgcaaggcgtgctggaaagtgc

SEQ ID NO: 335369 - DNA, 29 bp, Artificial Sequence
  Description of Artificial Sequence: Synthetic oligonucleotide
ggattactgcaaggcgtgctggaaagtgc

SEQ ID NO: 335370 - DNA, 30 bp, Artificial Sequence
  Description of Artificial Sequence: Synthetic oligonucleotide
gattactgcaaggcgtgctggaaagtgcag

SEQ ID NO: 335371 - DNA, 30 bp, Artificial Sequence
  Description of Artificial Sequence: Synthetic oligonucleotide
attactgcaaggcgtgctggaaagtgcagc

SEQ ID NO: 335372 - DNA, 29 bp, Artificial Sequence
  Description of Artificial Sequence: Synthetic oligonucleotide
ttactgcaaggcgtgctggaaagtgcagc

SEQ ID NO: 335373 - DNA, 28 bp, Artificial Sequence
  Description of Artificial Sequence: Synthetic oligonucleotide
tactgcaaggcgtgctggaaagtgcagc

SEQ ID NO: 335374 - DNA, 27 bp, Artificial Sequence
  Description of Artificial Sequence: Synthetic oligonucleotide
actgcaaggcgtgctggaaagtgcagc

SEQ ID NO: 335375 - DNA, 27 bp, Artificial Sequence
  Description of Artificial Sequence: Synthetic oligonucleotide
ctgcaaggcgtgctggaaagtgcagca

SEQ ID NO: 335376 - DNA, 27 bp, Artificial Sequence
  Description of Artificial Sequence: Synthetic oligonucleotide
tgcaaggcgtgctggaaagtgcagcag

SEQ ID NO: 335377 - DNA, 26 bp, Artificial Sequence
  Description of Artificial Sequence: Synthetic oligonucleotide
gcaaggcgtgctggaaagtgcagcag

SEQ ID NO: 335378 - DNA, 27 bp, Artificial Sequence
  Description of Artificial Sequence: Synthetic oligonucleotide
caaggcgtgctggaaagtgcagcaggt

SEQ ID NO: 335379 - DNA, 29 bp, Artificial Sequence
  Description of Artificial Sequence: Synthetic oligonucleotide
aaggcgtgctggaaagtgcagcaggtatc

SEQ ID NO: 335380 - DNA, 28 bp, Artificial Sequence
  Description of Artificial Sequence: Synthetic oligonucleotide
aggcgtgctggaaagtgcagcaggtatc

SEQ ID NO: 335381 - DNA, 27 bp, Artificial Sequence
  Description of Artificial Sequence: Synthetic oligonucleotide
ggcgtgctggaaagtgcagcaggtatc

SEQ ID NO: 335382 - DNA, 27 bp, Artificial Sequence
  Description of Artificial Sequence: Synthetic oligonucleotide
gcgtgctggaaagtgcagcaggtatcc

SEQ ID NO: 335383 - DNA, 28 bp, Artificial Sequence
  Description of Artificial Sequence: Synthetic oligonucleotide
cgtgctggaaagtgcagcaggtatccag

SEQ ID NO: 335384 - DNA, 28 bp, Artificial Sequence
  Description of Artificial Sequence: Synthetic oligonucleotide
gtgctggaaagtgcagcaggtatccagg

SEQ ID NO: 335385 - DNA, 30 bp, Artificial Sequence
  Description of Artificial Sequence: Synthetic oligonucleotide
tgctggaaagtgcagcaggtatccaggtag

SEQ ID NO: 335386 - DNA, 29 bp, Artificial Sequence
  Description of Artificial Sequence: Synthetic oligonucleotide
gctggaaagtgcagcaggtatccaggtag

SEQ ID NO: 335387 - DNA, 29 bp, Artificial Sequence
  Description of Artificial Sequence: Synthetic oligonucleotide
ctggaaagtgcagcaggtatccaggtagc

SEQ ID NO: 335388 - DNA, 30 bp, Artificial Sequence
  Description of Artificial Sequence: Synthetic oligonucleotide
tggaaagtgcagcaggtatccaggtagcag

SEQ ID NO: 335389 - DNA, 29 bp, Artificial Sequence
  Description of Artificial Sequence: Synthetic oligonucleotide
ggaaagtgcagcaggtatccaggtagcag

SEQ ID NO: 335390 - DNA, 30 bp, Artificial Sequence
  Description of Artificial Sequence: Synthetic oligonucleotide
gaaagtgcagcaggtatccaggtagcagac

SEQ ID NO: 335391 - DNA, 30 bp, Artificial Sequence
  Description of Artificial Sequence: Synthetic oligonucleotide
aaagtgcagcaggtatccaggtagcagacg

SEQ ID NO: 335392 - DNA, 29 bp, Artificial Sequence
  Description of Artificial Sequence: Synthetic oligonucleotide
aagtgcagcaggtatccaggtagcagacg

SEQ ID NO: 335393 - DNA, 28 bp, Artificial Sequence
  Description of Artificial Sequence: Synthetic oligonucleotide
agtgcagcaggtatccaggtagcagacg

SEQ ID NO: 335394 - DNA, 27 bp, Artificial Sequence
  Description of Artificial Sequence: Synthetic oligonucleotide
gtgcagcaggtatccaggtagcagacg

SEQ ID NO: 335395 - DNA, 27 bp, Artificial Sequence
  Description of Artificial Sequence: Synthetic oligonucleotide
tgcagcaggtatccaggtagcagacgg

SEQ ID NO: 335396 - DNA, 27 bp, Artificial Sequence
  Description of Artificial Sequence: Synthetic oligonucleotide
gcagcaggtatccaggtagcagacggt

SEQ ID NO: 335397 - DNA, 27 bp, Artificial Sequence
  Description of Artificial Sequence: Synthetic oligonucleotide
cagcaggtatccaggtagcagacggtg

SEQ ID NO: 335398 - DNA, 27 bp, Artificial Sequence
  Description of Artificial Sequence: Synthetic oligonucleotide
agcaggtatccaggtagcagacggtgg

SEQ ID NO: 335399 - DNA, 26 bp, Artificial Sequence
  Description of Artificial Sequence: Synthetic oligonucleotide
gcaggtatccaggtagcagacggtgg

SEQ ID NO: 335400 - DNA, 26 bp, Artificial Sequence
  Description of Artificial Sequence: Synthetic oligonucleotide
caggtatccaggtagcagacggtggg

SEQ ID NO: 335401 - DNA, 27 bp, Artificial Sequence
  Description of Artificial Sequence: Synthetic oligonucleotide
aggtatccaggtagcagacggtgggca

SEQ ID NO: 335402 - DNA, 26 bp, Artificial Sequence
  Description of Artificial Sequence: Synthetic oligonucleotide
ggtatccaggtagcagacggtgggca

SEQ ID NO: 335403 - DNA, 26 bp, Artificial Sequence
  Description of Artificial Sequence: Synthetic oligonucleotide
gtatccaggtagcagacggtgggcag

SEQ ID NO: 335404 - DNA, 27 bp, Artificial Sequence
  Description of Artificial Sequence: Synthetic oligonucleotide
tatccaggtagcagacggtgggcagca

SEQ ID NO: 335405 - DNA, 27 bp, Artificial Sequence
  Description of Artificial Sequence: Synthetic oligonucleotide
atccaggtagcagacggtgggcagcat

SEQ ID NO: 335406 - DNA, 27 bp, Artificial Sequence
  Description of Artificial Sequence: Synthetic oligonucleotide
tccaggtagcagacggtgggcagcata

SEQ ID NO: 335407 - DNA, 26 bp, Artificial Sequence
  Description of Artificial Sequence: Synthetic oligonucleotide
ccaggtagcagacggtgggcagcata

SEQ ID NO: 335408 - DNA, 26 bp, Artificial Sequence
  Description of Artificial Sequence: Synthetic oligonucleotide
caggtagcagacggtgggcagcatag

SEQ ID NO: 335409 - DNA, 26 bp, Artificial Sequence
  Description of Artificial Sequence: Synthetic oligonucleotide
aggtagcagacggtgggcagcatagg

SEQ ID NO: 335410 - DNA, 25 bp, Artificial Sequence
  Description of Artificial Sequence: Synthetic oligonucleotide
ggtagcagacggtgggcagcatagg

SEQ ID NO: 335411 - DNA, 25 bp, Artificial Sequence
  Description of Artificial Sequence: Synthetic oligonucleotide
gtagcagacggtgggcagcataggg

SEQ ID NO: 335412 - DNA, 25 bp, Artificial Sequence
  Description of Artificial Sequence: Synthetic oligonucleotide
tagcagacggtgggcagcatagggg

SEQ ID NO: 335413 - DNA, 24 bp, Artificial Sequence
  Description of Artificial Sequence: Synthetic oligonucleotide
agcagacggtgggcagcatagggg

SEQ ID NO: 335414 - DNA, 23 bp, Artificial Sequence
  Description of Artificial Sequence: Synthetic oligonucleotide
gcagacggtgggcagcatagggg

SEQ ID NO: 335415 - DNA, 25 bp, Artificial Sequence
  Description of Artificial Sequence: Synthetic oligonucleotide
cagacggtgggcagcataggggctt

SEQ ID NO: 335416 - DNA, 25 bp, Artificial Sequence
  Description of Artificial Sequence: Synthetic oligonucleotide
agacggtgggcagcataggggcttg

SEQ ID NO: 335417 - DNA, 24 bp, Artificial Sequence
  Description of Artificial Sequence: Synthetic oligonucleotide
gacggtgggcagcataggggcttg

SEQ ID NO: 335418 - DNA, 26 bp, Artificial Sequence
  Description of Artificial Sequence: Synthetic oligonucleotide
acggtgggcagcataggggcttggtt

SEQ ID NO: 335419 - DNA, 25 bp, Artificial Sequence
  Description of Artificial Sequence: Synthetic oligonucleotide
cggtgggcagcataggggcttggtt

SEQ ID NO: 335420 - DNA, 26 bp, Artificial Sequence
  Description of Artificial Sequence: Synthetic oligonucleotide
ggtgggcagcataggggcttggttga

SEQ ID NO: 335421 - DNA, 26 bp, Artificial Sequence
  Description of Artificial Sequence: Synthetic oligonucleotide
gtgggcagcataggggcttggttgac

SEQ ID NO: 335422 - DNA, 27 bp, Artificial Sequence
  Description of Artificial Sequence: Synthetic oligonucleotide
tgggcagcataggggcttggttgacct

SEQ ID NO: 335423 - DNA, 26 bp, Artificial Sequence
  Description of Artificial Sequence: Synthetic oligonucleotide
gggcagcataggggcttggttgacct

SEQ ID NO: 335424 - DNA, 27 bp, Artificial Sequence
  Description of Artificial Sequence: Synthetic oligonucleotide
ggcagcataggggcttggttgacctga

SEQ ID NO: 335425 - DNA, 21 bp, Artificial Sequence
  Description of Artificial Sequence: Synthetic oligonucleotide
atggagcccgcggacgcacgg

SEQ ID NO: 335426 - DNA, 20 bp, Artificial Sequence
  Description of Artificial Sequence: Synthetic oligonucleotide
tggagcccgcggacgcacgg

SEQ ID NO: 335427 - DNA, 20 bp, Artificial Sequence
  Description of Artificial Sequence: Synthetic oligonucleotide
ggagcccgcggacgcacggt

SEQ ID NO: 335428 - DNA, 20 bp, Artificial Sequence
  Description of Artificial Sequence: Synthetic oligonucleotide
gagcccgcggacgcacgggt

SEQ ID NO: 335429 - DNA, 20 bp, Artificial Sequence
  Description of Artificial Sequence: Synthetic oligonucleotide
agcccgcggacgcacgggct

SEQ ID NO: 335430 - DNA, 20 bp, Artificial Sequence
  Description of Artificial Sequence: Synthetic oligonucleotide
gcccgcggacgcacgggctt

SEQ ID NO: 335431 - DNA, 20 bp, Artificial Sequence
  Description of Artificial Sequence: Synthetic oligonucleotide
cccgcggacgcacgggcctt

SEQ ID NO: 335432 - DNA, 20 bp, Artificial Sequence
  Description of Artificial Sequence: Synthetic oligonucleotide
ccgcggacgcacgggcccat

SEQ ID NO: 335433 - DNA, 20 bp, Artificial Sequence
  Description of Artificial Sequence: Synthetic oligonucleotide
cgcggacgcacgggcccagt

SEQ ID NO: 335434 - DNA, 20 bp, Artificial Sequence
  Description of Artificial Sequence: Synthetic oligonucleotide
gcggacgcacgggcccaggt

SEQ ID NO: 335435 - DNA, 20 bp, Artificial Sequence
  Description of Artificial Sequence: Synthetic oligonucleotide
cggacgcacgggcccaggct

SEQ ID NO: 335436 - DNA, 20 bp, Artificial Sequence
  Description of Artificial Sequence: Synthetic oligonucleotide
ggacgcacgggcccaggcct

SEQ ID NO: 335437 - DNA, 20 bp, Artificial Sequence
  Description of Artificial Sequence: Synthetic oligonucleotide
gacgcacgggcccaggccct

SEQ ID NO: 335438 - DNA, 20 bp, Artificial Sequence
  Description of Artificial Sequence: Synthetic oligonucleotide
acgcacgggcccaggcccgt

SEQ ID NO: 335439 - DNA, 20 bp, Artificial Sequence
  Description of Artificial Sequence: Synthetic oligonucleotide
cgcacgggcccaggcccgtt

SEQ ID NO: 335440 - DNA, 20 bp, Artificial Sequence
  Description of Artificial Sequence: Synthetic oligonucleotide
gcacgggcccaggcccgctt

SEQ ID NO: 335441 - DNA, 20 bp, Artificial Sequence
  Description of Artificial Sequence: Synthetic oligonucleotide
cacgggcccaggcccgcgtt

SEQ ID NO: 335442 - DNA, 20 bp, Artificial Sequence
  Description of Artificial Sequence: Synthetic oligonucleotide
acgggcccaggcccgcggtt

SEQ ID NO: 335443 - DNA, 20 bp, Artificial Sequence
  Description of Artificial Sequence: Synthetic oligonucleotide
cgggcccaggcccgcggttt

SEQ ID NO: 335444 - DNA, 20 bp, Artificial Sequence
  Description of Artificial Sequence: Synthetic oligonucleotide
gggcccaggcccgcgggttt

SEQ ID NO: 335445 - DNA, 20 bp, Artificial Sequence
  Description of Artificial Sequence: Synthetic oligonucleotide
ggcccaggcccgcggggttt

SEQ ID NO: 335446 - DNA, 20 bp, Artificial Sequence
  Description of Artificial Sequence: Synthetic oligonucleotide
gcccaggcccgcggggcttt

SEQ ID NO: 335447 - DNA, 20 bp, Artificial Sequence
  Description of Artificial Sequence: Synthetic oligonucleotide
cccaggcccgcggggccttt

SEQ ID NO: 335448 - DNA, 20 bp, Artificial Sequence
  Description of Artificial Sequence: Synthetic oligonucleotide
ccaggcccgcggggccgttt

SEQ ID NO: 335449 - DNA, 20 bp, Artificial Sequence
  Description of Artificial Sequence: Synthetic oligonucleotide
caggcccgcggggccgcttt

SEQ ID NO: 335450 - DNA, 20 bp, Artificial Sequence
  Description of Artificial Sequence: Synthetic oligonucleotide
aggcccgcggggccgcgttt

SEQ ID NO: 335451 - DNA, 20 bp, Artificial Sequence
  Description of Artificial Sequence: Synthetic oligonucleotide
ggcccgcggggccgcgtttt

SEQ ID NO: 335452 - DNA, 20 bp, Artificial Sequence
  Description of Artificial Sequence: Synthetic oligonucleotide
gcccgcggggccgcgctttt

SEQ ID NO: 335453 - DNA, 20 bp, Artificial Sequence
  Description of Artificial Sequence: Synthetic oligonucleotide
cccgcggggccgcgcgtttt

SEQ ID NO: 335454 - DNA, 20 bp, Artificial Sequence
  Description of Artificial Sequence: Synthetic oligonucleotide
ccgcggggccgcgcggtttt

SEQ ID NO: 335455 - DNA, 20 bp, Artificial Sequence
  Description of Artificial Sequence: Synthetic oligonucleotide
cgcggggccgcgcggctttt

SEQ ID NO: 335456 - DNA, 20 bp, Artificial Sequence
  Description of Artificial Sequence: Synthetic oligonucleotide
gcggggccgcgcggctgttt

SEQ ID NO: 335457 - DNA, 20 bp, Artificial Sequence
  Description of Artificial Sequence: Synthetic oligonucleotide
cggggccgcgcggctgcatt

SEQ ID NO: 335458 - DNA, 20 bp, Artificial Sequence
  Description of Artificial Sequence: Synthetic oligonucleotide
ggggccgcgcggctgcagtt

SEQ ID NO: 335459 - DNA, 20 bp, Artificial Sequence
  Description of Artificial Sequence: Synthetic oligonucleotide
gggccgcgcggctgcagttg

SEQ ID NO: 335460 - DNA, 21 bp, Artificial Sequence
  Description of Artificial Sequence: Synthetic oligonucleotide
ggccgcgcggctgcagttgct

SEQ ID NO: 335461 - DNA, 21 bp, Artificial Sequence
  Description of Artificial Sequence: Synthetic oligonucleotide
gccgcgcggctgcagttgctc

SEQ ID NO: 335462 - DNA, 21 bp, Artificial Sequence
  Description of Artificial Sequence: Synthetic oligonucleotide
ccgcgcggctgcagttgctcg

SEQ ID NO: 335463 - DNA, 22 bp, Artificial Sequence
  Description of Artificial Sequence: Synthetic oligonucleotide
cgcgcggctgcagttgctcgct

SEQ ID NO: 335464 - DNA, 23 bp, Artificial Sequence
  Description of Artificial Sequence: Synthetic oligonucleotide
gcgcggctgcagttgctcgctgt

SEQ ID NO: 335465 - DNA, 23 bp, Artificial Sequence
  Description of Artificial Sequence: Synthetic oligonucleotide
cgcggctgcagttgctcgctgtc

SEQ ID NO: 335466 - DNA, 24 bp, Artificial Sequence
  Description of Artificial Sequence: Synthetic oligonucleotide
gcggctgcagttgctcgctgtcct

SEQ ID NO: 335467 - DNA, 24 bp, Artificial Sequence
  Description of Artificial Sequence: Synthetic oligonucleotide
cggctgcagttgctcgctgtcctg

SEQ ID NO: 335468 - DNA, 25 bp, Artificial Sequence
  Description of Artificial Sequence: Synthetic oligonucleotide
ggctgcagttgctcgctgtcctgct

SEQ ID NO: 335469 - DNA, 25 bp, Artificial Sequence
  Description of Artificial Sequence: Synthetic oligonucleotide
gctgcagttgctcgctgtcctgctg

SEQ ID NO: 335470 - DNA, 25 bp, Artificial Sequence
  Description of Artificial Sequence: Synthetic oligonucleotide
ctgcagttgctcgctgtcctgctgc

SEQ ID NO: 335471 - DNA, 25 bp, Artificial Sequence
  Description of Artificial Sequence: Synthetic oligonucleotide
tgcagttgctcgctgtcctgctgcc

SEQ ID NO: 335472 - DNA, 24 bp, Artificial Sequence
  Description of Artificial Sequence: Synthetic oligonucleotide
gcagttgctcgctgtcctgctgcc

SEQ ID NO: 335473 - DNA, 24 bp, Artificial Sequence
  Description of Artificial Sequence: Synthetic oligonucleotide
cagttgctcgctgtcctgctgccg

SEQ ID NO: 335474 - DNA, 24 bp, Artificial Sequence
  Description of Artificial Sequence: Synthetic oligonucleotide
agttgctcgctgtcctgctgccgg

SEQ ID NO: 335475 - DNA, 23 bp, Artificial Sequence
  Description of Artificial Sequence: Synthetic oligonucleotide
gttgctcgctgtcctgctgccgg

SEQ ID NO: 335476 - DNA, 23 bp, Artificial Sequence
  Description of Artificial Sequence: Synthetic oligonucleotide
ttgctcgctgtcctgctgccggc

SEQ ID NO: 335477 - DNA, 22 bp, Artificial Sequence
  Description of Artificial Sequence: Synthetic oligonucleotide
tgctcgctgtcctgctgccggc

SEQ ID NO: 335478 - DNA, 21 bp, Artificial Sequence
  Description of Artificial Sequence: Synthetic oligonucleotide
gctcgctgtcctgctgccggc

SEQ ID NO: 335479 - DNA, 21 bp, Artificial Sequence
  Description of Artificial Sequence: Synthetic oligonucleotide
ctcgctgtcctgctgccggcg

SEQ ID NO: 335480 - DNA, 22 bp, Artificial Sequence
  Description of Artificial Sequence: Synthetic oligonucleotide
tcgctgtcctgctgccggcgca

SEQ ID NO: 335481 - DNA, 21 bp, Artificial Sequence
  Description of Artificial Sequence: Synthetic oligonucleotide
cgctgtcctgctgccggcgca

SEQ ID NO: 335482 - DNA, 21 bp, Artificial Sequence
  Description of Artificial Sequence: Synthetic oligonucleotide
gctgtcctgctgccggcgcac

SEQ ID NO: 335483 - DNA, 21 bp, Artificial Sequence
  Description of Artificial Sequence: Synthetic oligonucleotide
ctgtcctgctgccggcgcacc

SEQ ID NO: 335484 - DNA, 22 bp, Artificial Sequence
  Description of Artificial Sequence: Synthetic oligonucleotide
tgtcctgctgccggcgcaccga

SEQ ID NO: 335485 - DNA, 21 bp, Artificial Sequence
  Description of Artificial Sequence: Synthetic oligonucleotide
gtcctgctgccggcgcaccga

SEQ ID NO: 335486 - DNA, 23 bp, Artificial Sequence
  Description of Artificial Sequence: Synthetic oligonucleotide
tcctgctgccggcgcaccgagat

SEQ ID NO: 335487 - DNA, 22 bp, Artificial Sequence
  Description of Artificial Sequence: Synthetic oligonucleotide
cctgctgccggcgcaccgagat

SEQ ID NO: 335488 - DNA, 22 bp, Artificial Sequence
  Description of Artificial Sequence: Synthetic oligonucleotide
ctgctgccggcgcaccgagatg

SEQ ID NO: 335489 - DNA, 22 bp, Artificial Sequence
  Description of Artificial Sequence: Synthetic oligonucleotide
tgctgccggcgcaccgagatgc

SEQ ID NO: 335490 - DNA, 21 bp, Artificial Sequence
  Description of Artificial Sequence: Synthetic oligonucleotide
gctgccggcgcaccgagatgc

SEQ ID NO: 335491 - DNA, 21 bp, Artificial Sequence
  Description of Artificial Sequence: Synthetic oligonucleotide
ctgccggcgcaccgagatgcc

SEQ ID NO: 335492 - DNA, 22 bp, Artificial Sequence
  Description of Artificial Sequence: Synthetic oligonucleotide
tgccggcgcaccgagatgccca

SEQ ID NO: 335493 - DNA, 21 bp, Artificial Sequence
  Description of Artificial Sequence: Synthetic oligonucleotide
gccggcgcaccgagatgccca

SEQ ID NO: 335494 - DNA, 21 bp, Artificial Sequence
  Description of Artificial Sequence: Synthetic oligonucleotide
ccggcgcaccgagatgcccac

SEQ ID NO: 335495 - DNA, 21 bp, Artificial Sequence
  Description of Artificial Sequence: Synthetic oligonucleotide
cggcgcaccgagatgcccacg

SEQ ID NO: 335496 - DNA, 21 bp, Artificial Sequence
  Description of Artificial Sequence: Synthetic oligonucleotide
ggcgcaccgagatgcccacgc

SEQ ID NO: 335497 - DNA, 21 bp, Artificial Sequence
  Description of Artificial Sequence: Synthetic oligonucleotide
gcgcaccgagatgcccacgcg

SEQ ID NO: 335498 - DNA, 22 bp, Artificial Sequence
  Description of Artificial Sequence: Synthetic oligonucleotide
cgcaccgagatgcccacgcgga

SEQ ID NO: 335499 - DNA, 22 bp, Artificial Sequence
  Description of Artificial Sequence: Synthetic oligonucleotide
gcaccgagatgcccacgcggag

SEQ ID NO: 335500 - DNA, 23 bp, Artificial Sequence
  Description of Artificial Sequence: Synthetic oligonucleotide
caccgagatgcccacgcggaggt

SEQ ID NO: 335501 - DNA, 23 bp, Artificial Sequence
  Description of Artificial Sequence: Synthetic oligonucleotide
accgagatgcccacgcggaggtg

SEQ ID NO: 335502 - DNA, 22 bp, Artificial Sequence
  Description of Artificial Sequence: Synthetic oligonucleotide
ccgagatgcccacgcggaggtg

SEQ ID NO: 335503 - DNA, 22 bp, Artificial Sequence
  Description of Artificial Sequence: Synthetic oligonucleotide
cgagatgcccacgcggaggtgg

SEQ ID NO: 335504 - DNA, 22 bp, Artificial Sequence
  Description of Artificial Sequence: Synthetic oligonucleotide
gagatgcccacgcggaggtggg

SEQ ID NO: 335505 - DNA, 24 bp, Artificial Sequence
  Description of Artificial Sequence: Synthetic oligonucleotide
agatgcccacgcggaggtgggctt

SEQ ID NO: 335506 - DNA, 23 bp, Artificial Sequence
  Description of Artificial Sequence: Synthetic oligonucleotide
gatgcccacgcggaggtgggctt

SEQ ID NO: 335507 - DNA, 24 bp, Artificial Sequence
  Description of Artificial Sequence: Synthetic oligonucleotide
atgcccacgcggaggtgggcttgt

SEQ ID NO: 335508 - DNA, 23 bp, Artificial Sequence
  Description of Artificial Sequence: Synthetic oligonucleotide
tgcccacgcggaggtgggcttgt

SEQ ID NO: 335509 - DNA, 22 bp, Artificial Sequence
  Description of Artificial Sequence: Synthetic oligonucleotide
gcccacgcggaggtgggcttgt

SEQ ID NO: 335510 - DNA, 23 bp, Artificial Sequence
  Description of Artificial Sequence: Synthetic oligonucleotide
cccacgcggaggtgggcttgtct

SEQ ID NO: 335511 - DNA, 25 bp, Artificial Sequence
  Description of Artificial Sequence: Synthetic oligonucleotide
ccacgcggaggtgggcttgtctgaa

SEQ ID NO: 335512 - DNA, 25 bp, Artificial Sequence
  Description of Artificial Sequence: Synthetic oligonucleotide
cacgcggaggtgggcttgtctgaac

SEQ ID NO: 335513 - DNA, 25 bp, Artificial Sequence
  Description of Artificial Sequence: Synthetic oligonucleotide
acgcggaggtgggcttgtctgaacc

SEQ ID NO: 335514 - DNA, 24 bp, Artificial Sequence
  Description of Artificial Sequence: Synthetic oligonucleotide
cgcggaggtgggcttgtctgaacc

SEQ ID NO: 335515 - DNA, 24 bp, Artificial Sequence
  Description of Artificial Sequence: Synthetic oligonucleotide
gcggaggtgggcttgtctgaaccc

SEQ ID NO: 335516 - DNA, 24 bp, Artificial Sequence
  Description of Artificial Sequence: Synthetic oligonucleotide
cggaggtgggcttgtctgaacccc

SEQ ID NO: 335517 - DNA, 24 bp, Artificial Sequence
  Description of Artificial Sequence: Synthetic oligonucleotide
ggaggtgggcttgtctgaaccccc

SEQ ID NO: 335518 - DNA, 24 bp, Artificial Sequence
  Description of Artificial Sequence: Synthetic oligonucleotide
gaggtgggcttgtctgaacccccg

SEQ ID NO: 335519 - DNA, 25 bp, Artificial Sequence
  Description of Artificial Sequence: Synthetic oligonucleotide
aggtgggcttgtctgaacccccgct

SEQ ID NO: 335520 - DNA, 24 bp, Artificial Sequence
  Description of Artificial Sequence: Synthetic oligonucleotide
ggtgggcttgtctgaacccccgct

SEQ ID NO: 335521 - DNA, 24 bp, Artificial Sequence
  Description of Artificial Sequence: Synthetic oligonucleotide
gtgggcttgtctgaacccccgctc

SEQ ID NO: 335522 - DNA, 25 bp, Artificial Sequence
  Description of Artificial Sequence: Synthetic oligonucleotide
tgggcttgtctgaacccccgctcgt

SEQ ID NO: 335523 - DNA, 24 bp, Artificial Sequence
  Description of Artificial Sequence: Synthetic oligonucleotide
gggcttgtctgaacccccgctcgt

SEQ ID NO: 335524 - DNA, 24 bp, Artificial Sequence
  Description of Artificial Sequence: Synthetic oligonucleotide
ggcttgtctgaacccccgctcgtg

SEQ ID NO: 335525 - DNA, 25 bp, Artificial Sequence
  Description of Artificial Sequence: Synthetic oligonucleotide
gcttgtctgaacccccgctcgtgga

SEQ ID NO: 335526 - DNA, 25 bp, Artificial Sequence
  Description of Artificial Sequence: Synthetic oligonucleotide
cttgtctgaacccccgctcgtggag

SEQ ID NO: 335527 - DNA, 26 bp, Artificial Sequence
  Description of Artificial Sequence: Synthetic oligonucleotide
ttgtctgaacccccgctcgtggaggt

SEQ ID NO: 335528 - DNA, 25 bp, Artificial Sequence
  Description of Artificial Sequence: Synthetic oligonucleotide
tgtctgaacccccgctcgtggaggt

SEQ ID NO: 335529 - DNA, 24 bp, Artificial Sequence
  Description of Artificial Sequence: Synthetic oligonucleotide
gtctgaacccccgctcgtggaggt

SEQ ID NO: 335530 - DNA, 26 bp, Artificial Sequence
  Description of Artificial Sequence: Synthetic oligonucleotide
tctgaacccccgctcgtggaggtgtt

SEQ ID NO: 335531 - DNA, 25 bp, Artificial Sequence
  Description of Artificial Sequence: Synthetic oligonucleotide
ctgaacccccgctcgtggaggtgtt

SEQ ID NO: 335532 - DNA, 25 bp, Artificial Sequence
  Description of Artificial Sequence: Synthetic oligonucleotide
tgaacccccgctcgtggaggtgttg

SEQ ID NO: 335533 - DNA, 24 bp, Artificial Sequence
  Description of Artificial Sequence: Synthetic oligonucleotide
gaacccccgctcgtggaggtgttg

SEQ ID NO: 335534 - DNA, 24 bp, Artificial Sequence
  Description of Artificial Sequence: Synthetic oligonucleotide
aacccccgctcgtggaggtgttgc

SEQ ID NO: 335535 - DNA, 23 bp, Artificial Sequence
  Description of Artificial Sequence: Synthetic oligonucleotide
acccccgctcgtggaggtgttgc

SEQ ID NO: 335536 - DNA, 22 bp, Artificial Sequence
  Description of Artificial Sequence: Synthetic oligonucleotide
cccccgctcgtggaggtgttgc

SEQ ID NO: 335537 - DNA, 23 bp, Artificial Sequence
  Description of Artificial Sequence: Synthetic oligonucleotide
ccccgctcgtggaggtgttgcga

SEQ ID NO: 335538 - DNA, 23 bp, Artificial Sequence
  Description of Artificial Sequence: Synthetic oligonucleotide
cccgctcgtggaggtgttgcgag

SEQ ID NO: 335539 - DNA, 26 bp, Artificial Sequence
  Description of Artificial Sequence: Synthetic oligonucleotide
ccgctcgtggaggtgttgcgaggaat

SEQ ID NO: 335540 - DNA, 27 bp, Artificial Sequence
  Description of Artificial Sequence: Synthetic oligonucleotide
cgctcgtggaggtgttgcgaggaatgt

SEQ ID NO: 335541 - DNA, 27 bp, Artificial Sequence
  Description of Artificial Sequence: Synthetic oligonucleotide
gctcgtggaggtgttgcgaggaatgtc

SEQ ID NO: 335542 - DNA, 28 bp, Artificial Sequence
  Description of Artificial Sequence: Synthetic oligonucleotide
ctcgtggaggtgttgcgaggaatgtctg

SEQ ID NO: 335543 - DNA, 29 bp, Artificial Sequence
  Description of Artificial Sequence: Synthetic oligonucleotide
tcgtggaggtgttgcgaggaatgtctgtc

SEQ ID NO: 335544 - DNA, 28 bp, Artificial Sequence
  Description of Artificial Sequence: Synthetic oligonucleotide
cgtggaggtgttgcgaggaatgtctgtc

SEQ ID NO: 335545 - DNA, 31 bp, Artificial Sequence
  Description of Artificial Sequence: Synthetic oligonucleotide
gtggaggtgttgcgaggaatgtctgtcatac

SEQ ID NO: 335546 - DNA, 32 bp, Artificial Sequence
  Description of Artificial Sequence: Synthetic oligonucleotide
tggaggtgttgcgaggaatgtctgtcatactg

SEQ ID NO: 335547 - DNA, 31 bp, Artificial Sequence
  Description of Artificial Sequence: Synthetic oligonucleotide
ggaggtgttgcgaggaatgtctgtcatactg

SEQ ID NO: 335548 - DNA, 31 bp, Artificial Sequence
  Description of Artificial Sequence: Synthetic oligonucleotide
gaggtgttgcgaggaatgtctgtcatactgg

SEQ ID NO: 335549 - DNA, 32 bp, Artificial Sequence
  Description of Artificial Sequence: Synthetic oligonucleotide
aggtgttgcgaggaatgtctgtcatactggac

SEQ ID NO: 335550 - DNA, 31 bp, Artificial Sequence
  Description of Artificial Sequence: Synthetic oligonucleotide
ggtgttgcgaggaatgtctgtcatactggac

SEQ ID NO: 335551 - DNA, 32 bp, Artificial Sequence
  Description of Artificial Sequence: Synthetic oligonucleotide
gtgttgcgaggaatgtctgtcatactggactg

SEQ ID NO: 335552 - DNA, 32 bp, Artificial Sequence
  Description of Artificial Sequence: Synthetic oligonucleotide
tgttgcgaggaatgtctgtcatactggactgc

SEQ ID NO: 335553 - DNA, 31 bp, Artificial Sequence
  Description of Artificial Sequence: Synthetic oligonucleotide
gttgcgaggaatgtctgtcatactggactgc

SEQ ID NO: 335554 - DNA, 32 bp, Artificial Sequence
  Description of Artificial Sequence: Synthetic oligonucleotide
ttgcgaggaatgtctgtcatactggactgctc

SEQ ID NO: 335555 - DNA, 31 bp, Artificial Sequence
  Description of Artificial Sequence: Synthetic oligonucleotide
tgcgaggaatgtctgtcatactggactgctc

SEQ ID NO: 335556 - DNA, 30 bp, Artificial Sequence
  Description of Artificial Sequence: Synthetic oligonucleotide
gcgaggaatgtctgtcatactggactgctc

SEQ ID NO: 335557 - DNA, 30 bp, Artificial Sequence
  Description of Artificial Sequence: Synthetic oligonucleotide
cgaggaatgtctgtcatactggactgctcc

SEQ ID NO: 335558 - DNA, 30 bp, Artificial Sequence
  Description of Artificial Sequence: Synthetic oligonucleotide
gaggaatgtctgtcatactggactgctccc

SEQ ID NO: 335559 - DNA, 30 bp, Artificial Sequence
  Description of Artificial Sequence: Synthetic oligonucleotide
aggaatgtctgtcatactggactgctcccc

SEQ ID NO: 335560 - DNA, 29 bp, Artificial Sequence
  Description of Artificial Sequence: Synthetic oligonucleotide
ggaatgtctgtcatactggactgctcccc

SEQ ID NO: 335561 - DNA, 31 bp, Artificial Sequence
  Description of Artificial Sequence: Synthetic oligonucleotide
gaatgtctgtcatactggactgctcccctac

SEQ ID NO: 335562 - DNA, 31 bp, Artificial Sequence
  Description of Artificial Sequence: Synthetic oligonucleotide
aatgtctgtcatactggactgctcccctacg

SEQ ID NO: 335563 - DNA, 30 bp, Artificial Sequence
  Description of Artificial Sequence: Synthetic oligonucleotide
atgtctgtcatactggactgctcccctacg

SEQ ID NO: 335564 - DNA, 29 bp, Artificial Sequence
  Description of Artificial Sequence: Synthetic oligonucleotide
tgtctgtcatactggactgctcccctacg

SEQ ID NO: 335565 - DNA, 28 bp, Artificial Sequence
  Description of Artificial Sequence: Synthetic oligonucleotide
gtctgtcatactggactgctcccctacg

SEQ ID NO: 335566 - DNA, 28 bp, Artificial Sequence
  Description of Artificial Sequence: Synthetic oligonucleotide
tctgtcatactggactgctcccctacgg

SEQ ID NO: 335567 - DNA, 27 bp, Artificial Sequence
  Description of Artificial Sequence: Synthetic oligonucleotide
ctgtcatactggactgctcccctacgg

SEQ ID NO: 335568 - DNA, 27 bp, Artificial Sequence
  Description of Artificial Sequence: Synthetic oligonucleotide
tgtcatactggactgctcccctacggc

SEQ ID NO: 335569 - DNA, 27 bp, Artificial Sequence
  Description of Artificial Sequence: Synthetic oligonucleotide
gtcatactggactgctcccctacggca

SEQ ID NO: 335570 - DNA, 28 bp, Artificial Sequence
  Description of Artificial Sequence: Synthetic oligonucleotide
tcatactggactgctcccctacggcaac

SEQ ID NO: 335571 - DNA, 27 bp, Artificial Sequence
  Description of Artificial Sequence: Synthetic oligonucleotide
catactggactgctcccctacggcaac

SEQ ID NO: 335572 - DNA, 27 bp, Artificial Sequence
  Description of Artificial Sequence: Synthetic oligonucleotide
atactggactgctcccctacggcaacc

SEQ ID NO: 335573 - DNA, 26 bp, Artificial Sequence
  Description of Artificial Sequence: Synthetic oligonucleotide
tactggactgctcccctacggcaacc

SEQ ID NO: 335574 - DNA, 25 bp, Artificial Sequence
  Description of Artificial Sequence: Synthetic oligonucleotide
actggactgctcccctacggcaacc

SEQ ID NO: 335575 - DNA, 24 bp, Artificial Sequence
  Description of Artificial Sequence: Synthetic oligonucleotide
ctggactgctcccctacggcaacc

SEQ ID NO: 335576 - DNA, 25 bp, Artificial Sequence
  Description of Artificial Sequence: Synthetic oligonucleotide
tggactgctcccctacggcaaccca

SEQ ID NO: 335577 - DNA, 24 bp, Artificial Sequence
  Description of Artificial Sequence: Synthetic oligonucleotide
ggactgctcccctacggcaaccca

SEQ ID NO: 335578 - DNA, 24 bp, Artificial Sequence
  Description of Artificial Sequence: Synthetic oligonucleotide
gactgctcccctacggcaacccac

SEQ ID NO: 335579 - DNA, 25 bp, Artificial Sequence
  Description of Artificial Sequence: Synthetic oligonucleotide
actgctcccctacggcaacccacga

SEQ ID NO: 335580 - DNA, 24 bp, Artificial Sequence
  Description of Artificial Sequence: Synthetic oligonucleotide
ctgctcccctacggcaacccacga

SEQ ID NO: 335581 - DNA, 24 bp, Artificial Sequence
  Description of Artificial Sequence: Synthetic oligonucleotide
tgctcccctacggcaacccacgag

SEQ ID NO: 335582 - DNA, 23 bp, Artificial Sequence
  Description of Artificial Sequence: Synthetic oligonucleotide
gctcccctacggcaacccacgag

SEQ ID NO: 335583 - DNA, 27 bp, Artificial Sequence
  Description of Artificial Sequence: Synthetic oligonucleotide
ctcccctacggcaacccacgagcatta

SEQ ID NO: 335584 - DNA, 30 bp, Artificial Sequence
  Description of Artificial Sequence: Synthetic oligonucleotide
tcccctacggcaacccacgagcattatatg

SEQ ID NO: 335585 - DNA, 29 bp, Artificial Sequence
  Description of Artificial Sequence: Synthetic oligonucleotide
cccctacggcaacccacgagcattatatg

SEQ ID NO: 335586 - DNA, 29 bp, Artificial Sequence
  Description of Artificial Sequence: Synthetic oligonucleotide
ccctacggcaacccacgagcattatatgg

SEQ ID NO: 335587 - DNA, 30 bp, Artificial Sequence
  Description of Artificial Sequence: Synthetic oligonucleotide
cctacggcaacccacgagcattatatggtg

SEQ ID NO: 335588 - DNA, 30 bp, Artificial Sequence
  Description of Artificial Sequence: Synthetic oligonucleotide
ctacggcaacccacgagcattatatggtgg

SEQ ID NO: 335589 - DNA, 33 bp, Artificial Sequence
  Description of Artificial Sequence: Synthetic oligonucleotide
tacggcaacccacgagcattatatggtggaatg

SEQ ID NO: 335590 - DNA, 32 bp, Artificial Sequence
  Description of Artificial Sequence: Synthetic oligonucleotide
acggcaacccacgagcattatatggtggaatg

SEQ ID NO: 335591 - DNA, 31 bp, Artificial Sequence
  Description of Artificial Sequence: Synthetic oligonucleotide
cggcaacccacgagcattatatggtggaatg

SEQ ID NO: 335592 - DNA, 31 bp, Artificial Sequence
  Description of Artificial Sequence: Synthetic oligonucleotide
ggcaacccacgagcattatatggtggaatgg

SEQ ID NO: 335593 - DNA, 33 bp, Artificial Sequence
  Description of Artificial Sequence: Synthetic oligonucleotide
gcaacccacgagcattatatggtggaatggtac

SEQ ID NO: 335594 - DNA, 33 bp, Artificial Sequence
  Description of Artificial Sequence: Synthetic oligonucleotide
caacccacgagcattatatggtggaatggtacc

SEQ ID NO: 335595 - DNA, 36 bp, Artificial Sequence
  Description of Artificial Sequence: Synthetic oligonucleotide
aacccacgagcattatatggtggaatggtaccttac

SEQ ID NO: 335596 - DNA, 35 bp, Artificial Sequence
  Description of Artificial Sequence: Synthetic oligonucleotide
acccacgagcattatatggtggaatggtaccttac

SEQ ID NO: 335597 - DNA, 34 bp, Artificial Sequence
  Description of Artificial Sequence: Synthetic oligonucleotide
cccacgagcattatatggtggaatggtaccttac

SEQ ID NO: 335598 - DNA, 34 bp, Artificial Sequence
  Description of Artificial Sequence: Synthetic oligonucleotide
ccacgagcattatatggtggaatggtaccttacc

SEQ ID NO: 335599 - DNA, 34 bp, Artificial Sequence
  Description of Artificial Sequence: Synthetic oligonucleotide
cacgagcattatatggtggaatggtaccttaccg

SEQ ID NO: 335600 - DNA, 35 bp, Artificial Sequence
  Description of Artificial Sequence: Synthetic oligonucleotide
acgagcattatatggtggaatggtaccttaccgag

SEQ ID NO: 335601 - DNA, 34 bp, Artificial Sequence
  Description of Artificial Sequence: Synthetic oligonucleotide
cgagcattatatggtggaatggtaccttaccgag

SEQ ID NO: 335602 - DNA, 34 bp, Artificial Sequence
  Description of Artificial Sequence: Synthetic oligonucleotide
gagcattatatggtggaatggtaccttaccgagc

SEQ ID NO: 335603 - DNA, 34 bp, Artificial Sequence
  Description of Artificial Sequence: Synthetic oligonucleotide
agcattatatggtggaatggtaccttaccgagcg

SEQ ID NO: 335604 - DNA, 33 bp, Artificial Sequence
  Description of Artificial Sequence: Synthetic oligonucleotide
gcattatatggtggaatggtaccttaccgagcg

SEQ ID NO: 335605 - DNA, 33 bp, Artificial Sequence
  Description of Artificial Sequence: Synthetic oligonucleotide
cattatatggtggaatggtaccttaccgagcgc

SEQ ID NO: 335606 - DNA, 34 bp, Artificial Sequence
  Description of Artificial Sequence: Synthetic oligonucleotide
attatatggtggaatggtaccttaccgagcgctc

SEQ ID NO: 335607 - DNA, 33 bp, Artificial Sequence
  Description of Artificial Sequence: Synthetic oligonucleotide
ttatatggtggaatggtaccttaccgagcgctc

SEQ ID NO: 335608 - DNA, 32 bp, Artificial Sequence
  Description of Artificial Sequence: Synthetic oligonucleotide
tatatggtggaatggtaccttaccgagcgctc

SEQ ID NO: 335609 - DNA, 31 bp, Artificial Sequence
  Description of Artificial Sequence: Synthetic oligonucleotide
atatggtggaatggtaccttaccgagcgctc

SEQ ID NO: 335610 - DNA, 30 bp, Artificial Sequence
  Description of Artificial Sequence: Synthetic oligonucleotide
tatggtggaatggtaccttaccgagcgctc

SEQ ID NO: 335611 - DNA, 29 bp, Artificial Sequence
  Description of Artificial Sequence: Synthetic oligonucleotide
atggtggaatggtaccttaccgagcgctc

SEQ ID NO: 335612 - DNA, 28 bp, Artificial Sequence
  Description of Artificial Sequence: Synthetic oligonucleotide
tggtggaatggtaccttaccgagcgctc

SEQ ID NO: 335613 - DNA, 27 bp, Artificial Sequence
  Description of Artificial Sequence: Synthetic oligonucleotide
ggtggaatggtaccttaccgagcgctc

SEQ ID NO: 335614 - DNA, 27 bp, Artificial Sequence
  Description of Artificial Sequence: Synthetic oligonucleotide
gtggaatggtaccttaccgagcgctcg

SEQ ID NO: 335615 - DNA, 27 bp, Artificial Sequence
  Description of Artificial Sequence: Synthetic oligonucleotide
tggaatggtaccttaccgagcgctcgg

SEQ ID NO: 335616 - DNA, 26 bp, Artificial Sequence
  Description of Artificial Sequence: Synthetic oligonucleotide
ggaatggtaccttaccgagcgctcgg

SEQ ID NO: 335617 - DNA, 27 bp, Artificial Sequence
  Description of Artificial Sequence: Synthetic oligonucleotide
gaatggtaccttaccgagcgctcggga

SEQ ID NO: 335618 - DNA, 27 bp, Artificial Sequence
  Description of Artificial Sequence: Synthetic oligonucleotide
aatggtaccttaccgagcgctcgggac

SEQ ID NO: 335619 - DNA, 26 bp, Artificial Sequence
  Description of Artificial Sequence: Synthetic oligonucleotide
atggtaccttaccgagcgctcgggac

SEQ ID NO: 335620 - DNA, 25 bp, Artificial Sequence
  Description of Artificial Sequence: Synthetic oligonucleotide
tggtaccttaccgagcgctcgggac

SEQ ID NO: 335621 - DNA, 24 bp, Artificial Sequence
  Description of Artificial Sequence: Synthetic oligonucleotide
ggtaccttaccgagcgctcgggac

SEQ ID NO: 335622 - DNA, 25 bp, Artificial Sequence
  Description of Artificial Sequence: Synthetic oligonucleotide
gtaccttaccgagcgctcgggacct

SEQ ID NO: 335623 - DNA, 25 bp, Artificial Sequence
  Description of Artificial Sequence: Synthetic oligonucleotide
taccttaccgagcgctcgggacctc

SEQ ID NO: 335624 - DNA, 24 bp, Artificial Sequence
  Description of Artificial Sequence: Synthetic oligonucleotide
accttaccgagcgctcgggacctc

SEQ ID NO: 335625 - DNA, 23 bp, Artificial Sequence
  Description of Artificial Sequence: Synthetic oligonucleotide
ccttaccgagcgctcgggacctc

SEQ ID NO: 335626 - DNA, 23 bp, Artificial Sequence
  Description of Artificial Sequence: Synthetic oligonucleotide
cttaccgagcgctcgggacctcg

SEQ ID NO: 335627 - DNA, 23 bp, Artificial Sequence
  Description of Artificial Sequence: Synthetic oligonucleotide
ttaccgagcgctcgggacctcgc

SEQ ID NO: 335628 - DNA, 22 bp, Artificial Sequence
  Description of Artificial Sequence: Synthetic oligonucleotide
taccgagcgctcgggacctcgc

SEQ ID NO: 335629 - DNA, 21 bp, Artificial Sequence
  Description of Artificial Sequence: Synthetic oligonucleotide
accgagcgctcgggacctcgc

SEQ ID NO: 335630 - DNA, 20 bp, Artificial Sequence
  Description of Artificial Sequence: Synthetic oligonucleotide
ccgagcgctcgggacctcgc

SEQ ID NO: 335631 - DNA, 20 bp, Artificial Sequence
  Description of Artificial Sequence: Synthetic oligonucleotide
cgagcgctcgggacctcgcc

SEQ ID NO: 335632 - DNA, 20 bp, Artificial Sequence
  Description of Artificial Sequence: Synthetic oligonucleotide
gagcgctcgggacctcgccc

SEQ ID NO: 335633 - DNA, 20 bp, Artificial Sequence
  Description of Artificial Sequence: Synthetic oligonucleotide
agcgctcgggacctcgcccc

SEQ ID NO: 335634 - DNA, 20 bp, Artificial Sequence
  Description of Artificial Sequence: Synthetic oligonucleotide
gcgctcgggacctcgcccct

SEQ ID NO: 335635 - DNA, 20 bp, Artificial Sequence
  Description of Artificial Sequence: Synthetic oligonucleotide
cgctcgggacctcgccccct

SEQ ID NO: 335636 - DNA, 20 bp, Artificial Sequence
  Description of Artificial Sequence: Synthetic oligonucleotide
gctcgggacctcgcccccct

SEQ ID NO: 335637 - DNA, 20 bp, Artificial Sequence
  Description of Artificial Sequence: Synthetic oligonucleotide
ctcgggacctcgccccccct

SEQ ID NO: 335638 - DNA, 21 bp, Artificial Sequence
  Description of Artificial Sequence: Synthetic oligonucleotide
tcgggacctcgccccccccta

SEQ ID NO: 335639 - DNA, 20 bp, Artificial Sequence
  Description of Artificial Sequence: Synthetic oligonucleotide
cgggacctcgccccccccta

SEQ ID NO: 335640 - DNA, 20 bp, Artificial Sequence
  Description of Artificial Sequence: Synthetic oligonucleotide
gggacctcgcccccccctag

SEQ ID NO: 335641 - DNA, 20 bp, Artificial Sequence
  Description of Artificial Sequence: Synthetic oligonucleotide
ggacctcgcccccccctagc

SEQ ID NO: 335642 - DNA, 21 bp, Artificial Sequence
  Description of Artificial Sequence: Synthetic oligonucleotide
gacctcgcccccccctagcct

SEQ ID NO: 335643 - DNA, 21 bp, Artificial Sequence
  Description of Artificial Sequence: Synthetic oligonucleotide
acctcgcccccccctagcctc

SEQ ID NO: 335644 - DNA, 20 bp, Artificial Sequence
  Description of Artificial Sequence: Synthetic oligonucleotide
cctcgcccccccctagcctc

SEQ ID NO: 335645 - DNA, 20 bp, Artificial Sequence
  Description of Artificial Sequence: Synthetic oligonucleotide
ctcgcccccccctagcctcc

SEQ ID NO: 335646 - DNA, 20 bp, Artificial Sequence
  Description of Artificial Sequence: Synthetic oligonucleotide
tcgcccccccctagcctccg

SEQ ID NO: 335647 - DNA, 20 bp, Artificial Sequence
  Description of Artificial Sequence: Synthetic oligonucleotide
cgcccccccctagcctccgt

SEQ ID NO: 335648 - DNA, 20 bp, Artificial Sequence
  Description of Artificial Sequence: Synthetic oligonucleotide
gcccccccctagcctccgct

SEQ ID NO: 335649 - DNA, 21 bp, Artificial Sequence
  Description of Artificial Sequence: Synthetic oligonucleotide
cccccccctagcctccgctga

SEQ ID NO: 335650 - DNA, 23 bp, Artificial Sequence
  Description of Artificial Sequence: Synthetic oligonucleotide
ccccccctagcctccgctgagat

SEQ ID NO: 335651 - DNA, 23 bp, Artificial Sequence
  Description of Artificial Sequence: Synthetic oligonucleotide
cccccctagcctccgctgagatg

SEQ ID NO: 335652 - DNA, 24 bp, Artificial Sequence
  Description of Artificial Sequence: Synthetic oligonucleotide
ccccctagcctccgctgagatgga

SEQ ID NO: 335653 - DNA, 24 bp, Artificial Sequence
  Description of Artificial Sequence: Synthetic oligonucleotide
cccctagcctccgctgagatggag

SEQ ID NO: 335654 - DNA, 24 bp, Artificial Sequence
  Description of Artificial Sequence: Synthetic oligonucleotide
ccctagcctccgctgagatggagg

SEQ ID NO: 335655 - DNA, 24 bp, Artificial Sequence
  Description of Artificial Sequence: Synthetic oligonucleotide
cctagcctccgctgagatggaggg

SEQ ID NO: 335656 - DNA, 25 bp, Artificial Sequence
  Description of Artificial Sequence: Synthetic oligonucleotide
ctagcctccgctgagatggagggct

SEQ ID NO: 335657 - DNA, 26 bp, Artificial Sequence
  Description of Artificial Sequence: Synthetic oligonucleotide
tagcctccgctgagatggagggctct

SEQ ID NO: 335658 - DNA, 25 bp, Artificial Sequence
  Description of Artificial Sequence: Synthetic oligonucleotide
agcctccgctgagatggagggctct

SEQ ID NO: 335659 - DNA, 24 bp, Artificial Sequence
  Description of Artificial Sequence: Synthetic oligonucleotide
gcctccgctgagatggagggctct

SEQ ID NO: 335660 - DNA, 25 bp, Artificial Sequence
  Description of Artificial Sequence: Synthetic oligonucleotide
cctccgctgagatggagggctctgt

SEQ ID NO: 335661 - DNA, 25 bp, Artificial Sequence
  Description of Artificial Sequence: Synthetic oligonucleotide
ctccgctgagatggagggctctgtg

SEQ ID NO: 335662 - DNA, 26 bp, Artificial Sequence
  Description of Artificial Sequence: Synthetic oligonucleotide
tccgctgagatggagggctctgtgct

SEQ ID NO: 335663 - DNA, 25 bp, Artificial Sequence
  Description of Artificial Sequence: Synthetic oligonucleotide
ccgctgagatggagggctctgtgct

SEQ ID NO: 335664 - DNA, 25 bp, Artificial Sequence
  Description of Artificial Sequence: Synthetic oligonucleotide
cgctgagatggagggctctgtgctc

SEQ ID NO: 335665 - DNA, 26 bp, Artificial Sequence
  Description of Artificial Sequence: Synthetic oligonucleotide
gctgagatggagggctctgtgctcca

SEQ ID NO: 335666 - DNA, 26 bp, Artificial Sequence
  Description of Artificial Sequence: Synthetic oligonucleotide
ctgagatggagggctctgtgctccag

SEQ ID NO: 335667 - DNA, 27 bp, Artificial Sequence
  Description of Artificial Sequence: Synthetic oligonucleotide
tgagatggagggctctgtgctccaggt

SEQ ID NO: 335668 - DNA, 26 bp, Artificial Sequence
  Description of Artificial Sequence: Synthetic oligonucleotide
gagatggagggctctgtgctccaggt

SEQ ID NO: 335669 - DNA, 27 bp, Artificial Sequence
  Description of Artificial Sequence: Synthetic oligonucleotide
agatggagggctctgtgctccaggtga

SEQ ID NO: 335670 - DNA, 26 bp, Artificial Sequence
  Description of Artificial Sequence: Synthetic oligonucleotide
gatggagggctctgtgctccaggtga

SEQ ID NO: 335671 - DNA, 27 bp, Artificial Sequence
  Description of Artificial Sequence: Synthetic oligonucleotide
atggagggctctgtgctccaggtgaca

SEQ ID NO: 335672 - DNA, 27 bp, Artificial Sequence
  Description of Artificial Sequence: Synthetic oligonucleotide
tggagggctctgtgctccaggtgacaa

SEQ ID NO: 335673 - DNA, 27 bp, Artificial Sequence
  Description of Artificial Sequence: Synthetic oligonucleotide
ggagggctctgtgctccaggtgacaat

SEQ ID NO: 335674 - DNA, 27 bp, Artificial Sequence
  Description of Artificial Sequence: Synthetic oligonucleotide
gagggctctgtgctccaggtgacaatg

SEQ ID NO: 335675 - DNA, 27 bp, Artificial Sequence
  Description of Artificial Sequence: Synthetic oligonucleotide
agggctctgtgctccaggtgacaatgc

SEQ ID NO: 335676 - DNA, 27 bp, Artificial Sequence
  Description of Artificial Sequence: Synthetic oligonucleotide
gggctctgtgctccaggtgacaatgca

SEQ ID NO: 335677 - DNA, 27 bp, Artificial Sequence
  Description of Artificial Sequence: Synthetic oligonucleotide
ggctctgtgctccaggtgacaatgcac

SEQ ID NO: 335678 - DNA, 27 bp, Artificial Sequence
  Description of Artificial Sequence: Synthetic oligonucleotide
gctctgtgctccaggtgacaatgcacc

SEQ ID NO: 335679 - DNA, 28 bp, Artificial Sequence
  Description of Artificial Sequence: Synthetic oligonucleotide
ctctgtgctccaggtgacaatgcaccac

SEQ ID NO: 335680 - DNA, 29 bp, Artificial Sequence
  Description of Artificial Sequence: Synthetic oligonucleotide
tctgtgctccaggtgacaatgcaccacac

SEQ ID NO: 335681 - DNA, 28 bp, Artificial Sequence
  Description of Artificial Sequence: Synthetic oligonucleotide
ctgtgctccaggtgacaatgcaccacac

SEQ ID NO: 335682 - DNA, 28 bp, Artificial Sequence
  Description of Artificial Sequence: Synthetic oligonucleotide
tgtgctccaggtgacaatgcaccacacc

SEQ ID NO: 335683 - DNA, 27 bp, Artificial Sequence
  Description of Artificial Sequence: Synthetic oligonucleotide
gtgctccaggtgacaatgcaccacacc

SEQ ID NO: 335684 - DNA, 27 bp, Artificial Sequence
  Description of Artificial Sequence: Synthetic oligonucleotide
tgctccaggtgacaatgcaccacaccc

SEQ ID NO: 335685 - DNA, 26 bp, Artificial Sequence
  Description of Artificial Sequence: Synthetic oligonucleotide
gctccaggtgacaatgcaccacaccc

SEQ ID NO: 335686 - DNA, 26 bp, Artificial Sequence
  Description of Artificial Sequence: Synthetic oligonucleotide
ctccaggtgacaatgcaccacacccg

SEQ ID NO: 335687 - DNA, 26 bp, Artificial Sequence
  Description of Artificial Sequence: Synthetic oligonucleotide
tccaggtgacaatgcaccacacccgg

SEQ ID NO: 335688 - DNA, 25 bp, Artificial Sequence
  Description of Artificial Sequence: Synthetic oligonucleotide
ccaggtgacaatgcaccacacccgg

SEQ ID NO: 335689 - DNA, 25 bp, Artificial Sequence
  Description of Artificial Sequence: Synthetic oligonucleotide
caggtgacaatgcaccacacccggg

SEQ ID NO: 335690 - DNA, 25 bp, Artificial Sequence
  Description of Artificial Sequence: Synthetic oligonucleotide
aggtgacaatgcaccacacccgggc

SEQ ID NO: 335691 - DNA, 24 bp, Artificial Sequence
  Description of Artificial Sequence: Synthetic oligonucleotide
ggtgacaatgcaccacacccgggc

SEQ ID NO: 335692 - DNA, 24 bp, Artificial Sequence
  Description of Artificial Sequence: Synthetic oligonucleotide
gtgacaatgcaccacacccgggcc

SEQ ID NO: 335693 - DNA, 24 bp, Artificial Sequence
  Description of Artificial Sequence: Synthetic oligonucleotide
tgacaatgcaccacacccgggccc

SEQ ID NO: 335694 - DNA, 23 bp, Artificial Sequence
  Description of Artificial Sequence: Synthetic oligonucleotide
gacaatgcaccacacccgggccc

SEQ ID NO: 335695 - DNA, 23 bp, Artificial Sequence
  Description of Artificial Sequence: Synthetic oligonucleotide
acaatgcaccacacccgggcccg

SEQ ID NO: 335696 - DNA, 22 bp, Artificial Sequence
  Description of Artificial Sequence: Synthetic oligonucleotide
caatgcaccacacccgggcccg

SEQ ID NO: 335697 - DNA, 23 bp, Artificial Sequence
  Description of Artificial Sequence: Synthetic oligonucleotide
aatgcaccacacccgggcccgca

SEQ ID NO: 335698 - DNA, 22 bp, Artificial Sequence
  Description of Artificial Sequence: Synthetic oligonucleotide
atgcaccacacccgggcccgca

SEQ ID NO: 335699 - DNA, 21 bp, Artificial Sequence
  Description of Artificial Sequence: Synthetic oligonucleotide
tgcaccacacccgggcccgca

SEQ ID NO: 335700 - DNA, 20 bp, Artificial Sequence
  Description of Artificial Sequence: Synthetic oligonucleotide
gcaccacacccgggcccgca

SEQ ID NO: 335701 - DNA, 21 bp, Artificial Sequence
  Description of Artificial Sequence: Synthetic oligonucleotide
caccacacccgggcccgcagt

SEQ ID NO: 335702 - DNA, 21 bp, Artificial Sequence
  Description of Artificial Sequence: Synthetic oligonucleotide
accacacccgggcccgcagtc

SEQ ID NO: 335703 - DNA, 20 bp, Artificial Sequence
  Description of Artificial Sequence: Synthetic oligonucleotide
ccacacccgggcccgcagtc

SEQ ID NO: 335704 - DNA, 20 bp, Artificial Sequence
  Description of Artificial Sequence: Synthetic oligonucleotide
cacacccgggcccgcagtcc

SEQ ID NO: 335705 - DNA, 20 bp, Artificial Sequence
  Description of Artificial Sequence: Synthetic oligonucleotide
acacccgggcccgcagtccg

SEQ ID NO: 335706 - DNA, 20 bp, Artificial Sequence
  Description of Artificial Sequence: Synthetic oligonucleotide
cacccgggcccgcagtccgt

SEQ ID NO: 335707 - DNA, 20 bp, Artificial Sequence
  Description of Artificial Sequence: Synthetic oligonucleotide
acccgggcccgcagtccgct

SEQ ID NO: 335708 - DNA, 20 bp, Artificial Sequence
  Description of Artificial Sequence: Synthetic oligonucleotide
cccgggcccgcagtccgctt

SEQ ID NO: 335709 - DNA, 21 bp, Artificial Sequence
  Description of Artificial Sequence: Synthetic oligonucleotide
ccgggcccgcagtccgccata

SEQ ID NO: 335710 - DNA, 21 bp, Artificial Sequence
  Description of Artificial Sequence: Synthetic oligonucleotide
cgggcccgcagtccgccatac

SEQ ID NO: 335711 - DNA, 22 bp, Artificial Sequence
  Description of Artificial Sequence: Synthetic oligonucleotide
gggcccgcagtccgccatacca

SEQ ID NO: 335712 - DNA, 22 bp, Artificial Sequence
  Description of Artificial Sequence: Synthetic oligonucleotide
ggcccgcagtccgccataccag

SEQ ID NO: 335713 - DNA, 23 bp, Artificial Sequence
  Description of Artificial Sequence: Synthetic oligonucleotide
gcccgcagtccgccataccaggt

SEQ ID NO: 335714 - DNA, 23 bp, Artificial Sequence
  Description of Artificial Sequence: Synthetic oligonucleotide
cccgcagtccgccataccaggtg

SEQ ID NO: 335715 - DNA, 24 bp, Artificial Sequence
  Description of Artificial Sequence: Synthetic oligonucleotide
ccgcagtccgccataccaggtgga

SEQ ID NO: 335716 - DNA, 25 bp, Artificial Sequence
  Description of Artificial Sequence: Synthetic oligonucleotide
cgcagtccgccataccaggtggact

SEQ ID NO: 335717 - DNA, 25 bp, Artificial Sequence
  Description of Artificial Sequence: Synthetic oligonucleotide
gcagtccgccataccaggtggactc

SEQ ID NO: 335718 - DNA, 25 bp, Artificial Sequence
  Description of Artificial Sequence: Synthetic oligonucleotide
cagtccgccataccaggtggactcc

SEQ ID NO: 335719 - DNA, 26 bp, Artificial Sequence
  Description of Artificial Sequence: Synthetic oligonucleotide
agtccgccataccaggtggactccct

SEQ ID NO: 335720 - DNA, 25 bp, Artificial Sequence
  Description of Artificial Sequence: Synthetic oligonucleotide
gtccgccataccaggtggactccct

SEQ ID NO: 335721 - DNA, 25 bp, Artificial Sequence
  Description of Artificial Sequence: Synthetic oligonucleotide
tccgccataccaggtggactccctg

SEQ ID NO: 335722 - DNA, 24 bp, Artificial Sequence
  Description of Artificial Sequence: Synthetic oligonucleotide
ccgccataccaggtggactccctg

SEQ ID NO: 335723 - DNA, 24 bp, Artificial Sequence
  Description of Artificial Sequence: Synthetic oligonucleotide
cgccataccaggtggactccctgg

SEQ ID NO: 335724 - DNA, 24 bp, Artificial Sequence
  Description of Artificial Sequence: Synthetic oligonucleotide
gccataccaggtggactccctggg

SEQ ID NO: 335725 - DNA, 24 bp, Artificial Sequence
  Description of Artificial Sequence: Synthetic oligonucleotide
ccataccaggtggactccctgggg

SEQ ID NO: 335726 - DNA, 24 bp, Artificial Sequence
  Description of Artificial Sequence: Synthetic oligonucleotide
cataccaggtggactccctggggc

SEQ ID NO: 335727 - DNA, 24 bp, Artificial Sequence
  Description of Artificial Sequence: Synthetic oligonucleotide
ataccaggtggactccctggggcg

SEQ ID NO: 335728 - DNA, 23 bp, Artificial Sequence
  Description of Artificial Sequence: Synthetic oligonucleotide
taccaggtggactccctggggcg

SEQ ID NO: 335729 - DNA, 22 bp, Artificial Sequence
  Description of Artificial Sequence: Synthetic oligonucleotide
accaggtggactccctggggcg

SEQ ID NO: 335730 - DNA, 21 bp, Artificial Sequence
  Description of Artificial Sequence: Synthetic oligonucleotide
ccaggtggactccctggggcg

SEQ ID NO: 335731 - DNA, 21 bp, Artificial Sequence
  Description of Artificial Sequence: Synthetic oligonucleotide
caggtggactccctggggcgc

SEQ ID NO: 335732 - DNA, 22 bp, Artificial Sequence
  Description of Artificial Sequence: Synthetic oligonucleotide
aggtggactccctggggcgcct

SEQ ID NO: 335733 - DNA, 21 bp, Artificial Sequence
  Description of Artificial Sequence: Synthetic oligonucleotide
ggtggactccctggggcgcct

SEQ ID NO: 335734 - DNA, 21 bp, Artificial Sequence
  Description of Artificial Sequence: Synthetic oligonucleotide
gtggactccctggggcgcctc

SEQ ID NO: 335735 - DNA, 22 bp, Artificial Sequence
  Description of Artificial Sequence: Synthetic oligonucleotide
tggactccctggggcgcctcgt

SEQ ID NO: 335736 - DNA, 21 bp, Artificial Sequence
  Description of Artificial Sequence: Synthetic oligonucleotide
ggactccctggggcgcctcgt

SEQ ID NO: 335737 - DNA, 21 bp, Artificial Sequence
  Description of Artificial Sequence: Synthetic oligonucleotide
gactccctggggcgcctcgtg

SEQ ID NO: 335738 - DNA, 22 bp, Artificial Sequence
  Description of Artificial Sequence: Synthetic oligonucleotide
actccctggggcgcctcgtgct

SEQ ID NO: 335739 - DNA, 21 bp, Artificial Sequence
  Description of Artificial Sequence: Synthetic oligonucleotide
ctccctggggcgcctcgtgct

SEQ ID NO: 335740 - DNA, 21 bp, Artificial Sequence
  Description of Artificial Sequence: Synthetic oligonucleotide
tccctggggcgcctcgtgctg

SEQ ID NO: 335741 - DNA, 20 bp, Artificial Sequence
  Description of Artificial Sequence: Synthetic oligonucleotide
ccctggggcgcctcgtgctg

SEQ ID NO: 335742 - DNA, 20 bp, Artificial Sequence
  Description of Artificial Sequence: Synthetic oligonucleotide
cctggggcgcctcgtgctgg

SEQ ID NO: 335743 - DNA, 21 bp, Artificial Sequence
  Description of Artificial Sequence: Synthetic oligonucleotide
ctggggcgcctcgtgctggct

SEQ ID NO: 335744 - DNA, 22 bp, Artificial Sequence
  Description of Artificial Sequence: Synthetic oligonucleotide
tggggcgcctcgtgctggctca

SEQ ID NO: 335745 - DNA, 21 bp, Artificial Sequence
  Description of Artificial Sequence: Synthetic oligonucleotide
ggggcgcctcgtgctggctca

SEQ ID NO: 335746 - DNA, 21 bp, Artificial Sequence
  Description of Artificial Sequence: Synthetic oligonucleotide
gggcgcctcgtgctggctcag

SEQ ID NO: 335747 - DNA, 21 bp, Artificial Sequence
  Description of Artificial Sequence: Synthetic oligonucleotide
ggcgcctcgtgctggctcagg

SEQ ID NO: 335748 - DNA, 21 bp, Artificial Sequence
  Description of Artificial Sequence: Synthetic oligonucleotide
gcgcctcgtgctggctcaggc

SEQ ID NO: 335749 - DNA, 21 bp, Artificial Sequence
  Description of Artificial Sequence: Synthetic oligonucleotide
cgcctcgtgctggctcaggcc

SEQ ID NO: 335750 - DNA, 22 bp, Artificial Sequence
  Description of Artificial Sequence: Synthetic oligonucleotide
gcctcgtgctggctcaggccca

SEQ ID NO: 335751 - DNA, 22 bp, Artificial Sequence
  Description of Artificial Sequence: Synthetic oligonucleotide
cctcgtgctggctcaggcccag

SEQ ID NO: 335752 - DNA, 23 bp, Artificial Sequence
  Description of Artificial Sequence: Synthetic oligonucleotide
ctcgtgctggctcaggcccagga

SEQ ID NO: 335753 - DNA, 23 bp, Artificial Sequence
  Description of Artificial Sequence: Synthetic oligonucleotide
tcgtgctggctcaggcccaggag

SEQ ID NO: 335754 - DNA, 22 bp, Artificial Sequence
  Description of Artificial Sequence: Synthetic oligonucleotide
cgtgctggctcaggcccaggag

SEQ ID NO: 335755 - DNA, 22 bp, Artificial Sequence
  Description of Artificial Sequence: Synthetic oligonucleotide
gtgctggctcaggcccaggagg

SEQ ID NO: 335756 - DNA, 22 bp, Artificial Sequence
  Description of Artificial Sequence: Synthetic oligonucleotide
tgctggctcaggcccaggaggg

SEQ ID NO: 335757 - DNA, 21 bp, Artificial Sequence
  Description of Artificial Sequence: Synthetic oligonucleotide
gctggctcaggcccaggaggg

SEQ ID NO: 335758 - DNA, 21 bp, Artificial Sequence
  Description of Artificial Sequence: Synthetic oligonucleotide
ctggctcaggcccaggagggc

SEQ ID NO: 335759 - DNA, 22 bp, Artificial Sequence
  Description of Artificial Sequence: Synthetic oligonucleotide
tggctcaggcccaggagggcga

SEQ ID NO: 335760 - DNA, 21 bp, Artificial Sequence
  Description of Artificial Sequence: Synthetic oligonucleotide
ggctcaggcccaggagggcga

SEQ ID NO: 335761 - DNA, 21 bp, Artificial Sequence
  Description of Artificial Sequence: Synthetic oligonucleotide
gctcaggcccaggagggcgac

SEQ ID NO: 335762 - DNA, 22 bp, Artificial Sequence
  Description of Artificial Sequence: Synthetic oligonucleotide
ctcaggcccaggagggcgacga

SEQ ID NO: 335763 - DNA, 22 bp, Artificial Sequence
  Description of Artificial Sequence: Synthetic oligonucleotide
tcaggcccaggagggcgacgac

SEQ ID NO: 335764 - DNA, 21 bp, Artificial Sequence
  Description of Artificial Sequence: Synthetic oligonucleotide
caggcccaggagggcgacgac

SEQ ID NO: 335765 - DNA, 21 bp, Artificial Sequence
  Description of Artificial Sequence: Synthetic oligonucleotide
aggcccaggagggcgacgacc

SEQ ID NO: 335766 - DNA, 20 bp, Artificial Sequence
  Description of Artificial Sequence: Synthetic oligonucleotide
ggcccaggagggcgacgacc

SEQ ID NO: 335767 - DNA, 21 bp, Artificial Sequence
  Description of Artificial Sequence: Synthetic oligonucleotide
gcccaggagggcgacgaccga

SEQ ID NO: 335768 - DNA, 22 bp, Artificial Sequence
  Description of Artificial Sequence: Synthetic oligonucleotide
cccaggagggcgacgaccgaga

SEQ ID NO: 335769 - DNA, 24 bp, Artificial Sequence
  Description of Artificial Sequence: Synthetic oligonucleotide
ccaggagggcgacgaccgagacta

SEQ ID NO: 335770 - DNA, 24 bp, Artificial Sequence
  Description of Artificial Sequence: Synthetic oligonucleotide
caggagggcgacgaccgagactac

SEQ ID NO: 335771 - DNA, 25 bp, Artificial Sequence
  Description of Artificial Sequence: Synthetic oligonucleotide
aggagggcgacgaccgagactacct

SEQ ID NO: 335772 - DNA, 24 bp, Artificial Sequence
  Description of Artificial Sequence: Synthetic oligonucleotide
ggagggcgacgaccgagactacct

SEQ ID NO: 335773 - DNA, 25 bp, Artificial Sequence
  Description of Artificial Sequence: Synthetic oligonucleotide
gagggcgacgaccgagactacctgt

SEQ ID NO: 335774 - DNA, 25 bp, Artificial Sequence
  Description of Artificial Sequence: Synthetic oligonucleotide
agggcgacgaccgagactacctgtg

SEQ ID NO: 335775 - DNA, 24 bp, Artificial Sequence
  Description of Artificial Sequence: Synthetic oligonucleotide
gggcgacgaccgagactacctgtg

SEQ ID NO: 335776 - DNA, 24 bp, Artificial Sequence
  Description of Artificial Sequence: Synthetic oligonucleotide
ggcgacgaccgagactacctgtgc

SEQ ID NO: 335777 - DNA, 25 bp, Artificial Sequence
  Description of Artificial Sequence: Synthetic oligonucleotide
gcgacgaccgagactacctgtgcgt

SEQ ID NO: 335778 - DNA, 25 bp, Artificial Sequence
  Description of Artificial Sequence: Synthetic oligonucleotide
cgacgaccgagactacctgtgcgtg

SEQ ID NO: 335779 - DNA, 26 bp, Artificial Sequence
  Description of Artificial Sequence: Synthetic oligonucleotide
gacgaccgagactacctgtgcgtgga

SEQ ID NO: 335780 - DNA, 27 bp, Artificial Sequence
  Description of Artificial Sequence: Synthetic oligonucleotide
acgaccgagactacctgtgcgtggaga

SEQ ID NO: 335781 - DNA, 26 bp, Artificial Sequence
  Description of Artificial Sequence: Synthetic oligonucleotide
cgaccgagactacctgtgcgtggaga

SEQ ID NO: 335782 - DNA, 26 bp, Artificial Sequence
  Description of Artificial Sequence: Synthetic oligonucleotide
gaccgagactacctgtgcgtggagag

SEQ ID NO: 335783 - DNA, 26 bp, Artificial Sequence
  Description of Artificial Sequence: Synthetic oligonucleotide
accgagactacctgtgcgtggagagg

SEQ ID NO: 335784 - DNA, 25 bp, Artificial Sequence
  Description of Artificial Sequence: Synthetic oligonucleotide
ccgagactacctgtgcgtggagagg

SEQ ID NO: 335785 - DNA, 25 bp, Artificial Sequence
  Description of Artificial Sequence: Synthetic oligonucleotide
cgagactacctgtgcgtggagaggg

SEQ ID NO: 335786 - DNA, 26 bp, Artificial Sequence
  Description of Artificial Sequence: Synthetic oligonucleotide
gagactacctgtgcgtggagagggca

SEQ ID NO: 335787 - DNA, 26 bp, Artificial Sequence
  Description of Artificial Sequence: Synthetic oligonucleotide
agactacctgtgcgtggagagggcag

SEQ ID NO: 335788 - DNA, 25 bp, Artificial Sequence
  Description of Artificial Sequence: Synthetic oligonucleotide
gactacctgtgcgtggagagggcag

SEQ ID NO: 335789 - DNA, 25 bp, Artificial Sequence
  Description of Artificial Sequence: Synthetic oligonucleotide
actacctgtgcgtggagagggcagg

SEQ ID NO: 335790 - DNA, 24 bp, Artificial Sequence
  Description of Artificial Sequence: Synthetic oligonucleotide
ctacctgtgcgtggagagggcagg

SEQ ID NO: 335791 - DNA, 24 bp, Artificial Sequence
  Description of Artificial Sequence: Synthetic oligonucleotide
tacctgtgcgtggagagggcaggc

SEQ ID NO: 335792 - DNA, 23 bp, Artificial Sequence
  Description of Artificial Sequence: Synthetic oligonucleotide
acctgtgcgtggagagggcaggc

SEQ ID NO: 335793 - DNA, 22 bp, Artificial Sequence
  Description of Artificial Sequence: Synthetic oligonucleotide
cctgtgcgtggagagggcaggc

SEQ ID NO: 335794 - DNA, 22 bp, Artificial Sequence
  Description of Artificial Sequence: Synthetic oligonucleotide
ctgtgcgtggagagggcaggcg

SEQ ID NO: 335795 - DNA, 22 bp, Artificial Sequence
  Description of Artificial Sequence: Synthetic oligonucleotide
tgtgcgtggagagggcaggcgc

SEQ ID NO: 335796 - DNA, 21 bp, Artificial Sequence
  Description of Artificial Sequence: Synthetic oligonucleotide
gtgcgtggagagggcaggcgc

SEQ ID NO: 335797 - DNA, 21 bp, Artificial Sequence
  Description of Artificial Sequence: Synthetic oligonucleotide
tgcgtggagagggcaggcgcg

SEQ ID NO: 335798 - DNA, 20 bp, Artificial Sequence
  Description of Artificial Sequence: Synthetic oligonucleotide
gcgtggagagggcaggcgcg

SEQ ID NO: 335799 - DNA, 20 bp, Artificial Sequence
  Description of Artificial Sequence: Synthetic oligonucleotide
cgtggagagggcaggcgcgg

SEQ ID NO: 335800 - DNA, 21 bp, Artificial Sequence
  Description of Artificial Sequence: Synthetic oligonucleotide
gtggagagggcaggcgcggca

SEQ ID NO: 335801 - DNA, 21 bp, Artificial Sequence
  Description of Artificial Sequence: Synthetic oligonucleotide
tggagagggcaggcgcggcag

SEQ ID NO: 335802 - DNA, 20 bp, Artificial Sequence
  Description of Artificial Sequence: Synthetic oligonucleotide
ggagagggcaggcgcggcag

SEQ ID NO: 335803 - DNA, 20 bp, Artificial Sequence
  Description of Artificial Sequence: Synthetic oligonucleotide
gagagggcaggcgcggcagg

SEQ ID NO: 335804 - DNA, 21 bp, Artificial Sequence
  Description of Artificial Sequence: Synthetic oligonucleotide
agagggcaggcgcggcaggct

SEQ ID NO: 335805 - DNA, 20 bp, Artificial Sequence
  Description of Artificial Sequence: Synthetic oligonucleotide
gagggcaggcgcggcaggct

SEQ ID NO: 335806 - DNA, 21 bp, Artificial Sequence
  Description of Artificial Sequence: Synthetic oligonucleotide
agggcaggcgcggcaggctct

SEQ ID NO: 335807 - DNA, 20 bp, Artificial Sequence
  Description of Artificial Sequence: Synthetic oligonucleotide
gggcaggcgcggcaggctct

SEQ ID NO: 335808 - DNA, 20 bp, Artificial Sequence
  Description of Artificial Sequence: Synthetic oligonucleotide
ggcaggcgcggcaggctctg

SEQ ID NO: 335809 - DNA, 21 bp, Artificial Sequence
  Description of Artificial Sequence: Synthetic oligonucleotide
gcaggcgcggcaggctctgct

SEQ ID NO: 335810 - DNA, 22 bp, Artificial Sequence
  Description of Artificial Sequence: Synthetic oligonucleotide
caggcgcggcaggctctgctga

SEQ ID NO: 335811 - DNA, 22 bp, Artificial Sequence
  Description of Artificial Sequence: Synthetic oligonucleotide
aggcgcggcaggctctgctgag

SEQ ID NO: 335812 - DNA, 21 bp, Artificial Sequence
  Description of Artificial Sequence: Synthetic oligonucleotide
ggcgcggcaggctctgctgag

SEQ ID NO: 335813 - DNA, 21 bp, Artificial Sequence
  Description of Artificial Sequence: Synthetic oligonucleotide
gcgcggcaggctctgctgagg

SEQ ID NO: 335814 - DNA, 21 bp, Artificial Sequence
  Description of Artificial Sequence: Synthetic oligonucleotide
cgcggcaggctctgctgaggg

SEQ ID NO: 335815 - DNA, 22 bp, Artificial Sequence
  Description of Artificial Sequence: Synthetic oligonucleotide
gcggcaggctctgctgagggca

SEQ ID NO: 335816 - DNA, 23 bp, Artificial Sequence
  Description of Artificial Sequence: Synthetic oligonucleotide
cggcaggctctgctgagggcact

SEQ ID NO: 335817 - DNA, 23 bp, Artificial Sequence
  Description of Artificial Sequence: Synthetic oligonucleotide
ggcaggctctgctgagggcactg

SEQ ID NO: 335818 - DNA, 23 bp, Artificial Sequence
  Description of Artificial Sequence: Synthetic oligonucleotide
gcaggctctgctgagggcactgc

SEQ ID NO: 335819 - DNA, 23 bp, Artificial Sequence
  Description of Artificial Sequence: Synthetic oligonucleotide
caggctctgctgagggcactgcg

SEQ ID NO: 335820 - DNA, 23 bp, Artificial Sequence
  Description of Artificial Sequence: Synthetic oligonucleotide
aggctctgctgagggcactgcgc

SEQ ID NO: 335821 - DNA, 22 bp, Artificial Sequence
  Description of Artificial Sequence: Synthetic oligonucleotide
ggctctgctgagggcactgcgc

SEQ ID NO: 335822 - DNA, 22 bp, Artificial Sequence
  Description of Artificial Sequence: Synthetic oligonucleotide
gctctgctgagggcactgcgcg

SEQ ID NO: 335823 - DNA, 22 bp, Artificial Sequence
  Description of Artificial Sequence: Synthetic oligonucleotide
ctctgctgagggcactgcgcgc

SEQ ID NO: 335824 - DNA, 23 bp, Artificial Sequence
  Description of Artificial Sequence: Synthetic oligonucleotide
tctgctgagggcactgcgcgcct

SEQ ID NO: 335825 - DNA, 22 bp, Artificial Sequence
  Description of Artificial Sequence: Synthetic oligonucleotide
ctgctgagggcactgcgcgcct

SEQ ID NO: 335826 - DNA, 24 bp, Artificial Sequence
  Description of Artificial Sequence: Synthetic oligonucleotide
tgctgagggcactgcgcgcctcaa

SEQ ID NO: 335827 - DNA, 23 bp, Artificial Sequence
  Description of Artificial Sequence: Synthetic oligonucleotide
gctgagggcactgcgcgcctcaa

SEQ ID NO: 335828 - DNA, 23 bp, Artificial Sequence
  Description of Artificial Sequence: Synthetic oligonucleotide
ctgagggcactgcgcgcctcaac

SEQ ID NO: 335829 - DNA, 24 bp, Artificial Sequence
  Description of Artificial Sequence: Synthetic oligonucleotide
tgagggcactgcgcgcctcaacgt

SEQ ID NO: 335830 - DNA, 23 bp, Artificial Sequence
  Description of Artificial Sequence: Synthetic oligonucleotide
gagggcactgcgcgcctcaacgt

SEQ ID NO: 335831 - DNA, 26 bp, Artificial Sequence
  Description of Artificial Sequence: Synthetic oligonucleotide
agggcactgcgcgcctcaacgtgatt

SEQ ID NO: 335832 - DNA, 25 bp, Artificial Sequence
  Description of Artificial Sequence: Synthetic oligonucleotide
gggcactgcgcgcctcaacgtgatt

SEQ ID NO: 335833 - DNA, 25 bp, Artificial Sequence
  Description of Artificial Sequence: Synthetic oligonucleotide
ggcactgcgcgcctcaacgtgattg

SEQ ID NO: 335834 - DNA, 27 bp, Artificial Sequence
  Description of Artificial Sequence: Synthetic oligonucleotide
gcactgcgcgcctcaacgtgattgcaa

SEQ ID NO: 335835 - DNA, 28 bp, Artificial Sequence
  Description of Artificial Sequence: Synthetic oligonucleotide
cactgcgcgcctcaacgtgattgcaaag

SEQ ID NO: 335836 - DNA, 28 bp, Artificial Sequence
  Description of Artificial Sequence: Synthetic oligonucleotide
actgcgcgcctcaacgtgattgcaaagc

SEQ ID NO: 335837 - DNA, 27 bp, Artificial Sequence
  Description of Artificial Sequence: Synthetic oligonucleotide
ctgcgcgcctcaacgtgattgcaaagc

SEQ ID NO: 335838 - DNA, 27 bp, Artificial Sequence
  Description of Artificial Sequence: Synthetic oligonucleotide
tgcgcgcctcaacgtgattgcaaagcg

SEQ ID NO: 335839 - DNA, 27 bp, Artificial Sequence
  Description of Artificial Sequence: Synthetic oligonucleotide
gcgcgcctcaacgtgattgcaaagcga

SEQ ID NO: 335840 - DNA, 27 bp, Artificial Sequence
  Description of Artificial Sequence: Synthetic oligonucleotide
cgcgcctcaacgtgattgcaaagcgag

SEQ ID NO: 335841 - DNA, 28 bp, Artificial Sequence
  Description of Artificial Sequence: Synthetic oligonucleotide
gcgcctcaacgtgattgcaaagcgagag

SEQ ID NO: 335842 - DNA, 28 bp, Artificial Sequence
  Description of Artificial Sequence: Synthetic oligonucleotide
cgcctcaacgtgattgcaaagcgagagg

SEQ ID NO: 335843 - DNA, 28 bp, Artificial Sequence
  Description of Artificial Sequence: Synthetic oligonucleotide
gcctcaacgtgattgcaaagcgagaggc

SEQ ID NO: 335844 - DNA, 28 bp, Artificial Sequence
  Description of Artificial Sequence: Synthetic oligonucleotide
cctcaacgtgattgcaaagcgagaggcc

SEQ ID NO: 335845 - DNA, 29 bp, Artificial Sequence
  Description of Artificial Sequence: Synthetic oligonucleotide
ctcaacgtgattgcaaagcgagaggccac

SEQ ID NO: 335846 - DNA, 30 bp, Artificial Sequence
  Description of Artificial Sequence: Synthetic oligonucleotide
tcaacgtgattgcaaagcgagaggccacag

SEQ ID NO: 335847 - DNA, 29 bp, Artificial Sequence
  Description of Artificial Sequence: Synthetic oligonucleotide
caacgtgattgcaaagcgagaggccacag

SEQ ID NO: 335848 - DNA, 30 bp, Artificial Sequence
  Description of Artificial Sequence: Synthetic oligonucleotide
aacgtgattgcaaagcgagaggccacagag

SEQ ID NO: 335849 - DNA, 29 bp, Artificial Sequence
  Description of Artificial Sequence: Synthetic oligonucleotide
acgtgattgcaaagcgagaggccacagag

SEQ ID NO: 335850 - DNA, 28 bp, Artificial Sequence
  Description of Artificial Sequence: Synthetic oligonucleotide
cgtgattgcaaagcgagaggccacagag

SEQ ID NO: 335851 - DNA, 28 bp, Artificial Sequence
  Description of Artificial Sequence: Synthetic oligonucleotide
gtgattgcaaagcgagaggccacagagg

SEQ ID NO: 335852 - DNA, 29 bp, Artificial Sequence
  Description of Artificial Sequence: Synthetic oligonucleotide
tgattgcaaagcgagaggccacagaggtc

SEQ ID NO: 335853 - DNA, 28 bp, Artificial Sequence
  Description of Artificial Sequence: Synthetic oligonucleotide
gattgcaaagcgagaggccacagaggtc

SEQ ID NO: 335854 - DNA, 29 bp, Artificial Sequence
  Description of Artificial Sequence: Synthetic oligonucleotide
attgcaaagcgagaggccacagaggtctc

SEQ ID NO: 335855 - DNA, 28 bp, Artificial Sequence
  Description of Artificial Sequence: Synthetic oligonucleotide
ttgcaaagcgagaggccacagaggtctc

SEQ ID NO: 335856 - DNA, 27 bp, Artificial Sequence
  Description of Artificial Sequence: Synthetic oligonucleotide
tgcaaagcgagaggccacagaggtctc

SEQ ID NO: 335857 - DNA, 26 bp, Artificial Sequence
  Description of Artificial Sequence: Synthetic oligonucleotide
gcaaagcgagaggccacagaggtctc

SEQ ID NO: 335858 - DNA, 26 bp, Artificial Sequence
  Description of Artificial Sequence: Synthetic oligonucleotide
caaagcgagaggccacagaggtctcc

SEQ ID NO: 335859 - DNA, 26 bp, Artificial Sequence
  Description of Artificial Sequence: Synthetic oligonucleotide
aaagcgagaggccacagaggtctccg

SEQ ID NO: 335860 - DNA, 25 bp, Artificial Sequence
  Description of Artificial Sequence: Synthetic oligonucleotide
aagcgagaggccacagaggtctccg

SEQ ID NO: 335861 - DNA, 24 bp, Artificial Sequence
  Description of Artificial Sequence: Synthetic oligonucleotide
agcgagaggccacagaggtctccg

SEQ ID NO: 335862 - DNA, 23 bp, Artificial Sequence
  Description of Artificial Sequence: Synthetic oligonucleotide
gcgagaggccacagaggtctccg

SEQ ID NO: 335863 - DNA, 23 bp, Artificial Sequence
  Description of Artificial Sequence: Synthetic oligonucleotide
cgagaggccacagaggtctccgc

SEQ ID NO: 335864 - DNA, 25 bp, Artificial Sequence
  Description of Artificial Sequence: Synthetic oligonucleotide
gagaggccacagaggtctccgccaa

SEQ ID NO: 335865 - DNA, 27 bp, Artificial Sequence
  Description of Artificial Sequence: Synthetic oligonucleotide
agaggccacagaggtctccgccaacaa

SEQ ID NO: 335866 - DNA, 27 bp, Artificial Sequence
  Description of Artificial Sequence: Synthetic oligonucleotide
gaggccacagaggtctccgccaacaaa

SEQ ID NO: 335867 - DNA, 27 bp, Artificial Sequence
  Description of Artificial Sequence: Synthetic oligonucleotide
aggccacagaggtctccgccaacaaag

SEQ ID NO: 335868 - DNA, 26 bp, Artificial Sequence
  Description of Artificial Sequence: Synthetic oligonucleotide
ggccacagaggtctccgccaacaaag

SEQ ID NO: 335869 - DNA, 26 bp, Artificial Sequence
  Description of Artificial Sequence: Synthetic oligonucleotide
gccacagaggtctccgccaacaaagc

SEQ ID NO: 335870 - DNA, 27 bp, Artificial Sequence
  Description of Artificial Sequence: Synthetic oligonucleotide
ccacagaggtctccgccaacaaagcga

SEQ ID NO: 335871 - DNA, 27 bp, Artificial Sequence
  Description of Artificial Sequence: Synthetic oligonucleotide
cacagaggtctccgccaacaaagcgac

SEQ ID NO: 335872 - DNA, 28 bp, Artificial Sequence
  Description of Artificial Sequence: Synthetic oligonucleotide
acagaggtctccgccaacaaagcgacac

SEQ ID NO: 335873 - DNA, 27 bp, Artificial Sequence
  Description of Artificial Sequence: Synthetic oligonucleotide
cagaggtctccgccaacaaagcgacac

SEQ ID NO: 335874 - DNA, 28 bp, Artificial Sequence
  Description of Artificial Sequence: Synthetic oligonucleotide
agaggtctccgccaacaaagcgacactg

SEQ ID NO: 335875 - DNA, 27 bp, Artificial Sequence
  Description of Artificial Sequence: Synthetic oligonucleotide
gaggtctccgccaacaaagcgacactg

SEQ ID NO: 335876 - DNA, 28 bp, Artificial Sequence
  Description of Artificial Sequence: Synthetic oligonucleotide
aggtctccgccaacaaagcgacactgtc

SEQ ID NO: 335877 - DNA, 27 bp, Artificial Sequence
  Description of Artificial Sequence: Synthetic oligonucleotide
ggtctccgccaacaaagcgacactgtc

SEQ ID NO: 335878 - DNA, 28 bp, Artificial Sequence
  Description of Artificial Sequence: Synthetic oligonucleotide
gtctccgccaacaaagcgacactgtcag

SEQ ID NO: 335879 - DNA, 29 bp, Artificial Sequence
  Description of Artificial Sequence: Synthetic oligonucleotide
tctccgccaacaaagcgacactgtcagtg

SEQ ID NO: 335880 - DNA, 28 bp, Artificial Sequence
  Description of Artificial Sequence: Synthetic oligonucleotide
ctccgccaacaaagcgacactgtcagtg

SEQ ID NO: 335881 - DNA, 30 bp, Artificial Sequence
  Description of Artificial Sequence: Synthetic oligonucleotide
tccgccaacaaagcgacactgtcagtgatg

SEQ ID NO: 335882 - DNA, 29 bp, Artificial Sequence
  Description of Artificial Sequence: Synthetic oligonucleotide
ccgccaacaaagcgacactgtcagtgatg

SEQ ID NO: 335883 - DNA, 29 bp, Artificial Sequence
  Description of Artificial Sequence: Synthetic oligonucleotide
cgccaacaaagcgacactgtcagtgatgg

SEQ ID NO: 335884 - DNA, 30 bp, Artificial Sequence
  Description of Artificial Sequence: Synthetic oligonucleotide
gccaacaaagcgacactgtcagtgatggag

SEQ ID NO: 335885 - DNA, 30 bp, Artificial Sequence
  Description of Artificial Sequence: Synthetic oligonucleotide
ccaacaaagcgacactgtcagtgatggagc

SEQ ID NO: 335886 - DNA, 31 bp, Artificial Sequence
  Description of Artificial Sequence: Synthetic oligonucleotide
caacaaagcgacactgtcagtgatggagcac

SEQ ID NO: 335887 - DNA, 32 bp, Artificial Sequence
  Description of Artificial Sequence: Synthetic oligonucleotide
aacaaagcgacactgtcagtgatggagcactc

SEQ ID NO: 335888 - DNA, 31 bp, Artificial Sequence
  Description of Artificial Sequence: Synthetic oligonucleotide
acaaagcgacactgtcagtgatggagcactc

SEQ ID NO: 335889 - DNA, 30 bp, Artificial Sequence
  Description of Artificial Sequence: Synthetic oligonucleotide
caaagcgacactgtcagtgatggagcactc

SEQ ID NO: 335890 - DNA, 31 bp, Artificial Sequence
  Description of Artificial Sequence: Synthetic oligonucleotide
aaagcgacactgtcagtgatggagcactctg

SEQ ID NO: 335891 - DNA, 30 bp, Artificial Sequence
  Description of Artificial Sequence: Synthetic oligonucleotide
aagcgacactgtcagtgatggagcactctg

SEQ ID NO: 335892 - DNA, 29 bp, Artificial Sequence
  Description of Artificial Sequence: Synthetic oligonucleotide
agcgacactgtcagtgatggagcactctg

SEQ ID NO: 335893 - DNA, 28 bp, Artificial Sequence
  Description of Artificial Sequence: Synthetic oligonucleotide
gcgacactgtcagtgatggagcactctg

SEQ ID NO: 335894 - DNA, 28 bp, Artificial Sequence
  Description of Artificial Sequence: Synthetic oligonucleotide
cgacactgtcagtgatggagcactctgc

SEQ ID NO: 335895 - DNA, 28 bp, Artificial Sequence
  Description of Artificial Sequence: Synthetic oligonucleotide
gacactgtcagtgatggagcactctgcc

SEQ ID NO: 335896 - DNA, 28 bp, Artificial Sequence
  Description of Artificial Sequence: Synthetic oligonucleotide
acactgtcagtgatggagcactctgccc

SEQ ID NO: 335897 - DNA, 27 bp, Artificial Sequence
  Description of Artificial Sequence: Synthetic oligonucleotide
cactgtcagtgatggagcactctgccc

SEQ ID NO: 335898 - DNA, 28 bp, Artificial Sequence
  Description of Artificial Sequence: Synthetic oligonucleotide
actgtcagtgatggagcactctgccctg

SEQ ID NO: 335899 - DNA, 27 bp, Artificial Sequence
  Description of Artificial Sequence: Synthetic oligonucleotide
ctgtcagtgatggagcactctgccctg

SEQ ID NO: 335900 - DNA, 27 bp, Artificial Sequence
  Description of Artificial Sequence: Synthetic oligonucleotide
tgtcagtgatggagcactctgccctgg

SEQ ID NO: 335901 - DNA, 27 bp, Artificial Sequence
  Description of Artificial Sequence: Synthetic oligonucleotide
gtcagtgatggagcactctgccctgga

SEQ ID NO: 335902 - DNA, 27 bp, Artificial Sequence
  Description of Artificial Sequence: Synthetic oligonucleotide
tcagtgatggagcactctgccctggag

SEQ ID NO: 335903 - DNA, 27 bp, Artificial Sequence
  Description of Artificial Sequence: Synthetic oligonucleotide
cagtgatggagcactctgccctggaga

SEQ ID NO: 335904 - DNA, 28 bp, Artificial Sequence
  Description of Artificial Sequence: Synthetic oligonucleotide
agtgatggagcactctgccctggagatc

SEQ ID NO: 335905 - DNA, 27 bp, Artificial Sequence
  Description of Artificial Sequence: Synthetic oligonucleotide
gtgatggagcactctgccctggagatc

SEQ ID NO: 335906 - DNA, 27 bp, Artificial Sequence
  Description of Artificial Sequence: Synthetic oligonucleotide
tgatggagcactctgccctggagatcg

SEQ ID NO: 335907 - DNA, 26 bp, Artificial Sequence
  Description of Artificial Sequence: Synthetic oligonucleotide
gatggagcactctgccctggagatcg

SEQ ID NO: 335908 - DNA, 26 bp, Artificial Sequence
  Description of Artificial Sequence: Synthetic oligonucleotide
atggagcactctgccctggagatcgc

SEQ ID NO: 335909 - DNA, 25 bp, Artificial Sequence
  Description of Artificial Sequence: Synthetic oligonucleotide
tggagcactctgccctggagatcgc

SEQ ID NO: 335910 - DNA, 24 bp, Artificial Sequence
  Description of Artificial Sequence: Synthetic oligonucleotide
ggagcactctgccctggagatcgc

SEQ ID NO: 335911 - DNA, 25 bp, Artificial Sequence
  Description of Artificial Sequence: Synthetic oligonucleotide
gagcactctgccctggagatcgcga

SEQ ID NO: 335912 - DNA, 25 bp, Artificial Sequence
  Description of Artificial Sequence: Synthetic oligonucleotide
agcactctgccctggagatcgcgac

SEQ ID NO: 335913 - DNA, 24 bp, Artificial Sequence
  Description of Artificial Sequence: Synthetic oligonucleotide
gcactctgccctggagatcgcgac

SEQ ID NO: 335914 - DNA, 25 bp, Artificial Sequence
  Description of Artificial Sequence: Synthetic oligonucleotide
cactctgccctggagatcgcgacct

SEQ ID NO: 335915 - DNA, 25 bp, Artificial Sequence
  Description of Artificial Sequence: Synthetic oligonucleotide
actctgccctggagatcgcgacctg

SEQ ID NO: 335916 - DNA, 24 bp, Artificial Sequence
  Description of Artificial Sequence: Synthetic oligonucleotide
ctctgccctggagatcgcgacctg

SEQ ID NO: 335917 - DNA, 26 bp, Artificial Sequence
  Description of Artificial Sequence: Synthetic oligonucleotide
tctgccctggagatcgcgacctgcaa

SEQ ID NO: 335918 - DNA, 25 bp, Artificial Sequence
  Description of Artificial Sequence: Synthetic oligonucleotide
ctgccctggagatcgcgacctgcaa

SEQ ID NO: 335919 - DNA, 26 bp, Artificial Sequence
  Description of Artificial Sequence: Synthetic oligonucleotide
tgccctggagatcgcgacctgcaact

SEQ ID NO: 335920 - DNA, 25 bp, Artificial Sequence
  Description of Artificial Sequence: Synthetic oligonucleotide
gccctggagatcgcgacctgcaact

SEQ ID NO: 335921 - DNA, 25 bp, Artificial Sequence
  Description of Artificial Sequence: Synthetic oligonucleotide
ccctggagatcgcgacctgcaactg

SEQ ID NO: 335922 - DNA, 25 bp, Artificial Sequence
  Description of Artificial Sequence: Synthetic oligonucleotide
cctggagatcgcgacctgcaactgc

SEQ ID NO: 335923 - DNA, 25 bp, Artificial Sequence
  Description of Artificial Sequence: Synthetic oligonucleotide
ctggagatcgcgacctgcaactgcc

SEQ ID NO: 335924 - DNA, 25 bp, Artificial Sequence
  Description of Artificial Sequence: Synthetic oligonucleotide
tggagatcgcgacctgcaactgccg

SEQ ID NO: 335925 - DNA, 24 bp, Artificial Sequence
  Description of Artificial Sequence: Synthetic oligonucleotide
ggagatcgcgacctgcaactgccg

SEQ ID NO: 335926 - DNA, 26 bp, Artificial Sequence
  Description of Artificial Sequence: Synthetic oligonucleotide
gagatcgcgacctgcaactgccggaa

SEQ ID NO: 335927 - DNA, 26 bp, Artificial Sequence
  Description of Artificial Sequence: Synthetic oligonucleotide
agatcgcgacctgcaactgccggaac

SEQ ID NO: 335928 - DNA, 25 bp, Artificial Sequence
  Description of Artificial Sequence: Synthetic oligonucleotide
gatcgcgacctgcaactgccggaac

SEQ ID NO: 335929 - DNA, 25 bp, Artificial Sequence
  Description of Artificial Sequence: Synthetic oligonucleotide
atcgcgacctgcaactgccggaacg

SEQ ID NO: 335930 - DNA, 24 bp, Artificial Sequence
  Description of Artificial Sequence: Synthetic oligonucleotide
tcgcgacctgcaactgccggaacg

SEQ ID NO: 335931 - DNA, 23 bp, Artificial Sequence
  Description of Artificial Sequence: Synthetic oligonucleotide
cgcgacctgcaactgccggaacg

SEQ ID NO: 335932 - DNA, 23 bp, Artificial Sequence
  Description of Artificial Sequence: Synthetic oligonucleotide
gcgacctgcaactgccggaacgc

SEQ ID NO: 335933 - DNA, 25 bp, Artificial Sequence
  Description of Artificial Sequence: Synthetic oligonucleotide
cgacctgcaactgccggaacgcgaa

SEQ ID NO: 335934 - DNA, 25 bp, Artificial Sequence
  Description of Artificial Sequence: Synthetic oligonucleotide
gacctgcaactgccggaacgcgaac

SEQ ID NO: 335935 - DNA, 25 bp, Artificial Sequence
  Description of Artificial Sequence: Synthetic oligonucleotide
acctgcaactgccggaacgcgaacc

SEQ ID NO: 335936 - DNA, 24 bp, Artificial Sequence
  Description of Artificial Sequence: Synthetic oligonucleotide
cctgcaactgccggaacgcgaacc

SEQ ID NO: 335937 - DNA, 24 bp, Artificial Sequence
  Description of Artificial Sequence: Synthetic oligonucleotide
ctgcaactgccggaacgcgaaccc

SEQ ID NO: 335938 - DNA, 24 bp, Artificial Sequence
  Description of Artificial Sequence: Synthetic oligonucleotide
tgcaactgccggaacgcgaacccg

SEQ ID NO: 335939 - DNA, 23 bp, Artificial Sequence
  Description of Artificial Sequence: Synthetic oligonucleotide
gcaactgccggaacgcgaacccg

SEQ ID NO: 335940 - DNA, 23 bp, Artificial Sequence
  Description of Artificial Sequence: Synthetic oligonucleotide
caactgccggaacgcgaacccgg

SEQ ID NO: 335941 - DNA, 23 bp, Artificial Sequence
  Description of Artificial Sequence: Synthetic oligonucleotide
aactgccggaacgcgaacccggc

SEQ ID NO: 335942 - DNA, 22 bp, Artificial Sequence
  Description of Artificial Sequence: Synthetic oligonucleotide
actgccggaacgcgaacccggc

SEQ ID NO: 335943 - DNA, 21 bp, Artificial Sequence
  Description of Artificial Sequence: Synthetic oligonucleotide
ctgccggaacgcgaacccggc

SEQ ID NO: 335944 - DNA, 21 bp, Artificial Sequence
  Description of Artificial Sequence: Synthetic oligonucleotide
tgccggaacgcgaacccggcg

SEQ ID NO: 335945 - DNA, 20 bp, Artificial Sequence
  Description of Artificial Sequence: Synthetic oligonucleotide
gccggaacgcgaacccggcg

SEQ ID NO: 335946 - DNA, 20 bp, Artificial Sequence
  Description of Artificial Sequence: Synthetic oligonucleotide
ccggaacgcgaacccggcgc

SEQ ID NO: 335947 - DNA, 20 bp, Artificial Sequence
  Description of Artificial Sequence: Synthetic oligonucleotide
cggaacgcgaacccggcgcc

SEQ ID NO: 335948 - DNA, 22 bp, Artificial Sequence
  Description of Artificial Sequence: Synthetic oligonucleotide
ggaacgcgaacccggcgcccaa

SEQ ID NO: 335949 - DNA, 24 bp, Artificial Sequence
  Description of Artificial Sequence: Synthetic oligonucleotide
gaacgcgaacccggcgcccaagat

SEQ ID NO: 335950 - DNA, 25 bp, Artificial Sequence
  Description of Artificial Sequence: Synthetic oligonucleotide
aacgcgaacccggcgcccaagatct

SEQ ID NO: 335951 - DNA, 24 bp, Artificial Sequence
  Description of Artificial Sequence: Synthetic oligonucleotide
acgcgaacccggcgcccaagatct

SEQ ID NO: 335952 - DNA, 23 bp, Artificial Sequence
  Description of Artificial Sequence: Synthetic oligonucleotide
cgcgaacccggcgcccaagatct

SEQ ID NO: 335953 - DNA, 23 bp, Artificial Sequence
  Description of Artificial Sequence: Synthetic oligonucleotide
gcgaacccggcgcccaagatctc

SEQ ID NO: 335954 - DNA, 24 bp, Artificial Sequence
  Description of Artificial Sequence: Synthetic oligonucleotide
cgaacccggcgcccaagatctcgt

SEQ ID NO: 335955 - DNA, 24 bp, Artificial Sequence
  Description of Artificial Sequence: Synthetic oligonucleotide
gaacccggcgcccaagatctcgtg

SEQ ID NO: 335956 - DNA, 27 bp, Artificial Sequence
  Description of Artificial Sequence: Synthetic oligonucleotide
aacccggcgcccaagatctcgtggtat

SEQ ID NO: 335957 - DNA, 26 bp, Artificial Sequence
  Description of Artificial Sequence: Synthetic oligonucleotide
acccggcgcccaagatctcgtggtat

SEQ ID NO: 335958 - DNA, 25 bp, Artificial Sequence
  Description of Artificial Sequence: Synthetic oligonucleotide
cccggcgcccaagatctcgtggtat

SEQ ID NO: 335959 - DNA, 25 bp, Artificial Sequence
  Description of Artificial Sequence: Synthetic oligonucleotide
ccggcgcccaagatctcgtggtatc

SEQ ID NO: 335960 - DNA, 25 bp, Artificial Sequence
  Description of Artificial Sequence: Synthetic oligonucleotide
cggcgcccaagatctcgtggtatcc

SEQ ID NO: 335961 - DNA, 27 bp, Artificial Sequence
  Description of Artificial Sequence: Synthetic oligonucleotide
ggcgcccaagatctcgtggtatcccaa

SEQ ID NO: 335962 - DNA, 27 bp, Artificial Sequence
  Description of Artificial Sequence: Synthetic oligonucleotide
gcgcccaagatctcgtggtatcccaac

SEQ ID NO: 335963 - DNA, 27 bp, Artificial Sequence
  Description of Artificial Sequence: Synthetic oligonucleotide
cgcccaagatctcgtggtatcccaacg

SEQ ID NO: 335964 - DNA, 27 bp, Artificial Sequence
  Description of Artificial Sequence: Synthetic oligonucleotide
gcccaagatctcgtggtatcccaacgg

SEQ ID NO: 335965 - DNA, 27 bp, Artificial Sequence
  Description of Artificial Sequence: Synthetic oligonucleotide
cccaagatctcgtggtatcccaacggg

SEQ ID NO: 335966 - DNA, 27 bp, Artificial Sequence
  Description of Artificial Sequence: Synthetic oligonucleotide
ccaagatctcgtggtatcccaacgggc

SEQ ID NO: 335967 - DNA, 28 bp, Artificial Sequence
  Description of Artificial Sequence: Synthetic oligonucleotide
caagatctcgtggtatcccaacgggcac

SEQ ID NO: 335968 - DNA, 28 bp, Artificial Sequence
  Description of Artificial Sequence: Synthetic oligonucleotide
aagatctcgtggtatcccaacgggcacc

SEQ ID NO: 335969 - DNA, 27 bp, Artificial Sequence
  Description of Artificial Sequence: Synthetic oligonucleotide
agatctcgtggtatcccaacgggcacc

SEQ ID NO: 335970 - DNA, 26 bp, Artificial Sequence
  Description of Artificial Sequence: Synthetic oligonucleotide
gatctcgtggtatcccaacgggcacc

SEQ ID NO: 335971 - DNA, 26 bp, Artificial Sequence
  Description of Artificial Sequence: Synthetic oligonucleotide
atctcgtggtatcccaacgggcaccg

SEQ ID NO: 335972 - DNA, 25 bp, Artificial Sequence
  Description of Artificial Sequence: Synthetic oligonucleotide
tctcgtggtatcccaacgggcaccg

SEQ ID NO: 335973 - DNA, 24 bp, Artificial Sequence
  Description of Artificial Sequence: Synthetic oligonucleotide
ctcgtggtatcccaacgggcaccg

SEQ ID NO: 335974 - DNA, 24 bp, Artificial Sequence
  Description of Artificial Sequence: Synthetic oligonucleotide
tcgtggtatcccaacgggcaccgc

SEQ ID NO: 335975 - DNA, 23 bp, Artificial Sequence
  Description of Artificial Sequence: Synthetic oligonucleotide
cgtggtatcccaacgggcaccgc

SEQ ID NO: 335976 - DNA, 24 bp, Artificial Sequence
  Description of Artificial Sequence: Synthetic oligonucleotide
gtggtatcccaacgggcaccgcct

SEQ ID NO: 335977 - DNA, 24 bp, Artificial Sequence
  Description of Artificial Sequence: Synthetic oligonucleotide
tggtatcccaacgggcaccgcctg

SEQ ID NO: 335978 - DNA, 23 bp, Artificial Sequence
  Description of Artificial Sequence: Synthetic oligonucleotide
ggtatcccaacgggcaccgcctg

SEQ ID NO: 335979 - DNA, 24 bp, Artificial Sequence
  Description of Artificial Sequence: Synthetic oligonucleotide
gtatcccaacgggcaccgcctgga

SEQ ID NO: 335980 - DNA, 24 bp, Artificial Sequence
  Description of Artificial Sequence: Synthetic oligonucleotide
tatcccaacgggcaccgcctggag

SEQ ID NO: 335981 - DNA, 23 bp, Artificial Sequence
  Description of Artificial Sequence: Synthetic oligonucleotide
atcccaacgggcaccgcctggag

SEQ ID NO: 335982 - DNA, 22 bp, Artificial Sequence
  Description of Artificial Sequence: Synthetic oligonucleotide
tcccaacgggcaccgcctggag

SEQ ID NO: 335983 - DNA, 21 bp, Artificial Sequence
  Description of Artificial Sequence: Synthetic oligonucleotide
cccaacgggcaccgcctggag

SEQ ID NO: 335984 - DNA, 22 bp, Artificial Sequence
  Description of Artificial Sequence: Synthetic oligonucleotide
ccaacgggcaccgcctggagct

SEQ ID NO: 335985 - DNA, 22 bp, Artificial Sequence
  Description of Artificial Sequence: Synthetic oligonucleotide
caacgggcaccgcctggagctg

SEQ ID NO: 335986 - DNA, 22 bp, Artificial Sequence
  Description of Artificial Sequence: Synthetic oligonucleotide
aacgggcaccgcctggagctgc

SEQ ID NO: 335987 - DNA, 21 bp, Artificial Sequence
  Description of Artificial Sequence: Synthetic oligonucleotide
acgggcaccgcctggagctgc

SEQ ID NO: 335988 - DNA, 20 bp, Artificial Sequence
  Description of Artificial Sequence: Synthetic oligonucleotide
cgggcaccgcctggagctgc

SEQ ID NO: 335989 - DNA, 20 bp, Artificial Sequence
  Description of Artificial Sequence: Synthetic oligonucleotide
gggcaccgcctggagctgcc

SEQ ID NO: 335990 - DNA, 20 bp, Artificial Sequence
  Description of Artificial Sequence: Synthetic oligonucleotide
ggcaccgcctggagctgccc

SEQ ID NO: 335991 - DNA, 22 bp, Artificial Sequence
  Description of Artificial Sequence: Synthetic oligonucleotide
gcaccgcctggagctgcccgta

SEQ ID NO: 335992 - DNA, 23 bp, Artificial Sequence
  Description of Artificial Sequence: Synthetic oligonucleotide
caccgcctggagctgcccgtagt

SEQ ID NO: 335993 - DNA, 25 bp, Artificial Sequence
  Description of Artificial Sequence: Synthetic oligonucleotide
accgcctggagctgcccgtagtgat

SEQ ID NO: 335994 - DNA, 24 bp, Artificial Sequence
  Description of Artificial Sequence: Synthetic oligonucleotide
ccgcctggagctgcccgtagtgat

SEQ ID NO: 335995 - DNA, 26 bp, Artificial Sequence
  Description of Artificial Sequence: Synthetic oligonucleotide
cgcctggagctgcccgtagtgatgaa

SEQ ID NO: 335996 - DNA, 26 bp, Artificial Sequence
  Description of Artificial Sequence: Synthetic oligonucleotide
gcctggagctgcccgtagtgatgaac

SEQ ID NO: 335997 - DNA, 26 bp, Artificial Sequence
  Description of Artificial Sequence: Synthetic oligonucleotide
cctggagctgcccgtagtgatgaacc

SEQ ID NO: 335998 - DNA, 27 bp, Artificial Sequence
  Description of Artificial Sequence: Synthetic oligonucleotide
ctggagctgcccgtagtgatgaaccct

SEQ ID NO: 335999 - DNA, 27 bp, Artificial Sequence
  Description of Artificial Sequence: Synthetic oligonucleotide
tggagctgcccgtagtgatgaaccctg

SEQ ID NO: 336000 - DNA, 27 bp, Artificial Sequence
  Description of Artificial Sequence: Synthetic oligonucleotide
ggagctgcccgtagtgatgaaccctga

SEQ ID NO: 336001 - DNA, 27 bp, Artificial Sequence
  Description of Artificial Sequence: Synthetic oligonucleotide
gagctgcccgtagtgatgaaccctgag

SEQ ID NO: 336002 - DNA, 27 bp, Artificial Sequence
  Description of Artificial Sequence: Synthetic oligonucleotide
agctgcccgtagtgatgaaccctgagg

SEQ ID NO: 336003 - DNA, 26 bp, Artificial Sequence
  Description of Artificial Sequence: Synthetic oligonucleotide
gctgcccgtagtgatgaaccctgagg

SEQ ID NO: 336004 - DNA, 26 bp, Artificial Sequence
  Description of Artificial Sequence: Synthetic oligonucleotide
ctgcccgtagtgatgaaccctgaggg

SEQ ID NO: 336005 - DNA, 27 bp, Artificial Sequence
  Description of Artificial Sequence: Synthetic oligonucleotide
tgcccgtagtgatgaaccctgagggct

SEQ ID NO: 336006 - DNA, 27 bp, Artificial Sequence
  Description of Artificial Sequence: Synthetic oligonucleotide
gcccgtagtgatgaaccctgagggcta

SEQ ID NO: 336007 - DNA, 27 bp, Artificial Sequence
  Description of Artificial Sequence: Synthetic oligonucleotide
cccgtagtgatgaaccctgagggctac

SEQ ID NO: 336008 - DNA, 29 bp, Artificial Sequence
  Description of Artificial Sequence: Synthetic oligonucleotide
ccgtagtgatgaaccctgagggctacttg

SEQ ID NO: 336009 - DNA, 30 bp, Artificial Sequence
  Description of Artificial Sequence: Synthetic oligonucleotide
cgtagtgatgaaccctgagggctacttgac

SEQ ID NO: 336010 - DNA, 30 bp, Artificial Sequence
  Description of Artificial Sequence: Synthetic oligonucleotide
gtagtgatgaaccctgagggctacttgacc

SEQ ID NO: 336011 - DNA, 31 bp, Artificial Sequence
  Description of Artificial Sequence: Synthetic oligonucleotide
tagtgatgaaccctgagggctacttgaccag

SEQ ID NO: 336012 - DNA, 30 bp, Artificial Sequence
  Description of Artificial Sequence: Synthetic oligonucleotide
agtgatgaaccctgagggctacttgaccag

SEQ ID NO: 336013 - DNA, 29 bp, Artificial Sequence
  Description of Artificial Sequence: Synthetic oligonucleotide
gtgatgaaccctgagggctacttgaccag

SEQ ID NO: 336014 - DNA, 29 bp, Artificial Sequence
  Description of Artificial Sequence: Synthetic oligonucleotide
tgatgaaccctgagggctacttgaccagc

SEQ ID NO: 336015 - DNA, 28 bp, Artificial Sequence
  Description of Artificial Sequence: Synthetic oligonucleotide
gatgaaccctgagggctacttgaccagc

SEQ ID NO: 336016 - DNA, 28 bp, Artificial Sequence
  Description of Artificial Sequence: Synthetic oligonucleotide
atgaaccctgagggctacttgaccagcc

SEQ ID NO: 336017 - DNA, 27 bp, Artificial Sequence
  Description of Artificial Sequence: Synthetic oligonucleotide
tgaaccctgagggctacttgaccagcc

SEQ ID NO: 336018 - DNA, 26 bp, Artificial Sequence
  Description of Artificial Sequence: Synthetic oligonucleotide
gaaccctgagggctacttgaccagcc

SEQ ID NO: 336019 - DNA, 26 bp, Artificial Sequence
  Description of Artificial Sequence: Synthetic oligonucleotide
aaccctgagggctacttgaccagccc

SEQ ID NO: 336020 - DNA, 25 bp, Artificial Sequence
  Description of Artificial Sequence: Synthetic oligonucleotide
accctgagggctacttgaccagccc

SEQ ID NO: 336021 - DNA, 24 bp, Artificial Sequence
  Description of Artificial Sequence: Synthetic oligonucleotide
ccctgagggctacttgaccagccc

SEQ ID NO: 336022 - DNA, 25 bp, Artificial Sequence
  Description of Artificial Sequence: Synthetic oligonucleotide
cctgagggctacttgaccagcccca

SEQ ID NO: 336023 - DNA, 25 bp, Artificial Sequence
  Description of Artificial Sequence: Synthetic oligonucleotide
ctgagggctacttgaccagccccac

SEQ ID NO: 336024 - DNA, 25 bp, Artificial Sequence
  Description of Artificial Sequence: Synthetic oligonucleotide
tgagggctacttgaccagccccacg

SEQ ID NO: 336025 - DNA, 24 bp, Artificial Sequence
  Description of Artificial Sequence: Synthetic oligonucleotide
gagggctacttgaccagccccacg

SEQ ID NO: 336026 - DNA, 25 bp, Artificial Sequence
  Description of Artificial Sequence: Synthetic oligonucleotide
agggctacttgaccagccccacggt

SEQ ID NO: 336027 - DNA, 24 bp, Artificial Sequence
  Description of Artificial Sequence: Synthetic oligonucleotide
gggctacttgaccagccccacggt

SEQ ID NO: 336028 - DNA, 24 bp, Artificial Sequence
  Description of Artificial Sequence: Synthetic oligonucleotide
ggctacttgaccagccccacggtc

SEQ ID NO: 336029 - DNA, 24 bp, Artificial Sequence
  Description of Artificial Sequence: Synthetic oligonucleotide
gctacttgaccagccccacggtcc

SEQ ID NO: 336030 - DNA, 24 bp, Artificial Sequence
  Description of Artificial Sequence: Synthetic oligonucleotide
ctacttgaccagccccacggtccg

SEQ ID NO: 336031 - DNA, 24 bp, Artificial Sequence
  Description of Artificial Sequence: Synthetic oligonucleotide
tacttgaccagccccacggtccgc

SEQ ID NO: 336032 - DNA, 23 bp, Artificial Sequence
  Description of Artificial Sequence: Synthetic oligonucleotide
acttgaccagccccacggtccgc

SEQ ID NO: 336033 - DNA, 22 bp, Artificial Sequence
  Description of Artificial Sequence: Synthetic oligonucleotide
cttgaccagccccacggtccgc

SEQ ID NO: 336034 - DNA, 23 bp, Artificial Sequence
  Description of Artificial Sequence: Synthetic oligonucleotide
ttgaccagccccacggtccgcga

SEQ ID NO: 336035 - DNA, 22 bp, Artificial Sequence
  Description of Artificial Sequence: Synthetic oligonucleotide
tgaccagccccacggtccgcga

SEQ ID NO: 336036 - DNA, 21 bp, Artificial Sequence
  Description of Artificial Sequence: Synthetic oligonucleotide
gaccagccccacggtccgcga

SEQ ID NO: 336037 - DNA, 21 bp, Artificial Sequence
  Description of Artificial Sequence: Synthetic oligonucleotide
accagccccacggtccgcgag

SEQ ID NO: 336038 - DNA, 20 bp, Artificial Sequence
  Description of Artificial Sequence: Synthetic oligonucleotide
ccagccccacggtccgcgag

SEQ ID NO: 336039 - DNA, 20 bp, Artificial Sequence
  Description of Artificial Sequence: Synthetic oligonucleotide
cagccccacggtccgcgagg

SEQ ID NO: 336040 - DNA, 20 bp, Artificial Sequence
  Description of Artificial Sequence: Synthetic oligonucleotide
agccccacggtccgcgaggc

SEQ ID NO: 336041 - DNA, 20 bp, Artificial Sequence
  Description of Artificial Sequence: Synthetic oligonucleotide
gccccacggtccgcgaggct

SEQ ID NO: 336042 - DNA, 20 bp, Artificial Sequence
  Description of Artificial Sequence: Synthetic oligonucleotide
ccccacggtccgcgaggcct

SEQ ID NO: 336043 - DNA, 20 bp, Artificial Sequence
  Description of Artificial Sequence: Synthetic oligonucleotide
cccacggtccgcgaggcctc

SEQ ID NO: 336044 - DNA, 20 bp, Artificial Sequence
  Description of Artificial Sequence: Synthetic oligonucleotide
ccacggtccgcgaggcctcg

SEQ ID NO: 336045 - DNA, 20 bp, Artificial Sequence
  Description of Artificial Sequence: Synthetic oligonucleotide
cacggtccgcgaggcctcgc

SEQ ID NO: 336046 - DNA, 20 bp, Artificial Sequence
  Description of Artificial Sequence: Synthetic oligonucleotide
acggtccgcgaggcctcgcg

SEQ ID NO: 336047 - DNA, 20 bp, Artificial Sequence
  Description of Artificial Sequence: Synthetic oligonucleotide
cggtccgcgaggcctcgcgt

SEQ ID NO: 336048 - DNA, 20 bp, Artificial Sequence
  Description of Artificial Sequence: Synthetic oligonucleotide
ggtccgcgaggcctcgcgct

SEQ ID NO: 336049 - DNA, 20 bp, Artificial Sequence
  Description of Artificial Sequence: Synthetic oligonucleotide
gtccgcgaggcctcgcgcct

SEQ ID NO: 336050 - DNA, 20 bp, Artificial Sequence
  Description of Artificial Sequence: Synthetic oligonucleotide
tccgcgaggcctcgcgcctg

SEQ ID NO: 336051 - DNA, 20 bp, Artificial Sequence
  Description of Artificial Sequence: Synthetic oligonucleotide
ccgcgaggcctcgcgcctgt

SEQ ID NO: 336052 - DNA, 20 bp, Artificial Sequence
  Description of Artificial Sequence: Synthetic oligonucleotide
cgcgaggcctcgcgcctgct

SEQ ID NO: 336053 - DNA, 21 bp, Artificial Sequence
  Description of Artificial Sequence: Synthetic oligonucleotide
gcgaggcctcgcgcctgctct

SEQ ID NO: 336054 - DNA, 21 bp, Artificial Sequence
  Description of Artificial Sequence: Synthetic oligonucleotide
cgaggcctcgcgcctgctctg

SEQ ID NO: 336055 - DNA, 21 bp, Artificial Sequence
  Description of Artificial Sequence: Synthetic oligonucleotide
gaggcctcgcgcctgctctgc

SEQ ID NO: 336056 - DNA, 22 bp, Artificial Sequence
  Description of Artificial Sequence: Synthetic oligonucleotide
aggcctcgcgcctgctctgcct

SEQ ID NO: 336057 - DNA, 21 bp, Artificial Sequence
  Description of Artificial Sequence: Synthetic oligonucleotide
ggcctcgcgcctgctctgcct

SEQ ID NO: 336058 - DNA, 22 bp, Artificial Sequence
  Description of Artificial Sequence: Synthetic oligonucleotide
gcctcgcgcctgctctgcctca

SEQ ID NO: 336059 - DNA, 22 bp, Artificial Sequence
  Description of Artificial Sequence: Synthetic oligonucleotide
cctcgcgcctgctctgcctcac

SEQ ID NO: 336060 - DNA, 23 bp, Artificial Sequence
  Description of Artificial Sequence: Synthetic oligonucleotide
ctcgcgcctgctctgcctcacca

SEQ ID NO: 336061 - DNA, 23 bp, Artificial Sequence
  Description of Artificial Sequence: Synthetic oligonucleotide
tcgcgcctgctctgcctcaccag

SEQ ID NO: 336062 - DNA, 22 bp, Artificial Sequence
  Description of Artificial Sequence: Synthetic oligonucleotide
cgcgcctgctctgcctcaccag

SEQ ID NO: 336063 - DNA, 23 bp, Artificial Sequence
  Description of Artificial Sequence: Synthetic oligonucleotide
gcgcctgctctgcctcaccagga

SEQ ID NO: 336064 - DNA, 23 bp, Artificial Sequence
  Description of Artificial Sequence: Synthetic oligonucleotide
cgcctgctctgcctcaccaggac

SEQ ID NO: 336065 - DNA, 23 bp, Artificial Sequence
  Description of Artificial Sequence: Synthetic oligonucleotide
gcctgctctgcctcaccaggacc

SEQ ID NO: 336066 - DNA, 24 bp, Artificial Sequence
  Description of Artificial Sequence: Synthetic oligonucleotide
cctgctctgcctcaccaggaccct

SEQ ID NO: 336067 - DNA, 26 bp, Artificial Sequence
  Description of Artificial Sequence: Synthetic oligonucleotide
ctgctctgcctcaccaggaccctcta

SEQ ID NO: 336068 - DNA, 26 bp, Artificial Sequence
  Description of Artificial Sequence: Synthetic oligonucleotide
tgctctgcctcaccaggaccctctac

SEQ ID NO: 336069 - DNA, 25 bp, Artificial Sequence
  Description of Artificial Sequence: Synthetic oligonucleotide
gctctgcctcaccaggaccctctac

SEQ ID NO: 336070 - DNA, 26 bp, Artificial Sequence
  Description of Artificial Sequence: Synthetic oligonucleotide
ctctgcctcaccaggaccctctacgt

SEQ ID NO: 336071 - DNA, 26 bp, Artificial Sequence
  Description of Artificial Sequence: Synthetic oligonucleotide
tctgcctcaccaggaccctctacgtg

SEQ ID NO: 336072 - DNA, 25 bp, Artificial Sequence
  Description of Artificial Sequence: Synthetic oligonucleotide
ctgcctcaccaggaccctctacgtg

SEQ ID NO: 336073 - DNA, 25 bp, Artificial Sequence
  Description of Artificial Sequence: Synthetic oligonucleotide
tgcctcaccaggaccctctacgtgc

SEQ ID NO: 336074 - DNA, 24 bp, Artificial Sequence
  Description of Artificial Sequence: Synthetic oligonucleotide
gcctcaccaggaccctctacgtgc

SEQ ID NO: 336075 - DNA, 24 bp, Artificial Sequence
  Description of Artificial Sequence: Synthetic oligonucleotide
cctcaccaggaccctctacgtgcg

SEQ ID NO: 336076 - DNA, 24 bp, Artificial Sequence
  Description of Artificial Sequence: Synthetic oligonucleotide
ctcaccaggaccctctacgtgcgg

SEQ ID NO: 336077 - DNA, 25 bp, Artificial Sequence
  Description of Artificial Sequence: Synthetic oligonucleotide
tcaccaggaccctctacgtgcggct

SEQ ID NO: 336078 - DNA, 24 bp, Artificial Sequence
  Description of Artificial Sequence: Synthetic oligonucleotide
caccaggaccctctacgtgcggct

SEQ ID NO: 336079 - DNA, 24 bp, Artificial Sequence
  Description of Artificial Sequence: Synthetic oligonucleotide
accaggaccctctacgtgcggctc

SEQ ID NO: 336080 - DNA, 23 bp, Artificial Sequence
  Description of Artificial Sequence: Synthetic oligonucleotide
ccaggaccctctacgtgcggctc

SEQ ID NO: 336081 - DNA, 23 bp, Artificial Sequence
  Description of Artificial Sequence: Synthetic oligonucleotide
caggaccctctacgtgcggctcc

SEQ ID NO: 336082 - DNA, 23 bp, Artificial Sequence
  Description of Artificial Sequence: Synthetic oligonucleotide
aggaccctctacgtgcggctccc

SEQ ID NO: 336083 - DNA, 22 bp, Artificial Sequence
  Description of Artificial Sequence: Synthetic oligonucleotide
ggaccctctacgtgcggctccc

SEQ ID NO: 336084 - DNA, 24 bp, Artificial Sequence
  Description of Artificial Sequence: Synthetic oligonucleotide
gaccctctacgtgcggctccccaa

SEQ ID NO: 336085 - DNA, 24 bp, Artificial Sequence
  Description of Artificial Sequence: Synthetic oligonucleotide
accctctacgtgcggctccccaag

SEQ ID NO: 336086 - DNA, 23 bp, Artificial Sequence
  Description of Artificial Sequence: Synthetic oligonucleotide
ccctctacgtgcggctccccaag

SEQ ID NO: 336087 - DNA, 25 bp, Artificial Sequence
  Description of Artificial Sequence: Synthetic oligonucleotide
cctctacgtgcggctccccaaggat

SEQ ID NO: 336088 - DNA, 26 bp, Artificial Sequence
  Description of Artificial Sequence: Synthetic oligonucleotide
ctctacgtgcggctccccaaggatga

SEQ ID NO: 336089 - DNA, 26 bp, Artificial Sequence
  Description of Artificial Sequence: Synthetic oligonucleotide
tctacgtgcggctccccaaggatgag

SEQ ID NO: 336090 - DNA, 25 bp, Artificial Sequence
  Description of Artificial Sequence: Synthetic oligonucleotide
ctacgtgcggctccccaaggatgag

SEQ ID NO: 336091 - DNA, 25 bp, Artificial Sequence
  Description of Artificial Sequence: Synthetic oligonucleotide
tacgtgcggctccccaaggatgagc

SEQ ID NO: 336092 - DNA, 24 bp, Artificial Sequence
  Description of Artificial Sequence: Synthetic oligonucleotide
acgtgcggctccccaaggatgagc

SEQ ID NO: 336093 - DNA, 23 bp, Artificial Sequence
  Description of Artificial Sequence: Synthetic oligonucleotide
cgtgcggctccccaaggatgagc

SEQ ID NO: 336094 - DNA, 24 bp, Artificial Sequence
  Description of Artificial Sequence: Synthetic oligonucleotide
gtgcggctccccaaggatgagcga

SEQ ID NO: 336095 - DNA, 25 bp, Artificial Sequence
  Description of Artificial Sequence: Synthetic oligonucleotide
tgcggctccccaaggatgagcgaga

SEQ ID NO: 336096 - DNA, 24 bp, Artificial Sequence
  Description of Artificial Sequence: Synthetic oligonucleotide
gcggctccccaaggatgagcgaga

SEQ ID NO: 336097 - DNA, 24 bp, Artificial Sequence
  Description of Artificial Sequence: Synthetic oligonucleotide
cggctccccaaggatgagcgagac

SEQ ID NO: 336098 - DNA, 24 bp, Artificial Sequence
  Description of Artificial Sequence: Synthetic oligonucleotide
ggctccccaaggatgagcgagacg

SEQ ID NO: 336099 - DNA, 24 bp, Artificial Sequence
  Description of Artificial Sequence: Synthetic oligonucleotide
gctccccaaggatgagcgagacgc

SEQ ID NO: 336100 - DNA, 25 bp, Artificial Sequence
  Description of Artificial Sequence: Synthetic oligonucleotide
ctccccaaggatgagcgagacgcct

SEQ ID NO: 336101 - DNA, 25 bp, Artificial Sequence
  Description of Artificial Sequence: Synthetic oligonucleotide
tccccaaggatgagcgagacgcctg

SEQ ID NO: 336102 - DNA, 24 bp, Artificial Sequence
  Description of Artificial Sequence: Synthetic oligonucleotide
ccccaaggatgagcgagacgcctg

SEQ ID NO: 336103 - DNA, 26 bp, Artificial Sequence
  Description of Artificial Sequence: Synthetic oligonucleotide
cccaaggatgagcgagacgcctgctt

SEQ ID NO: 336104 - DNA, 26 bp, Artificial Sequence
  Description of Artificial Sequence: Synthetic oligonucleotide
ccaaggatgagcgagacgcctgcttc

SEQ ID NO: 336105 - DNA, 27 bp, Artificial Sequence
  Description of Artificial Sequence: Synthetic oligonucleotide
caaggatgagcgagacgcctgcttcca

SEQ ID NO: 336106 - DNA, 27 bp, Artificial Sequence
  Description of Artificial Sequence: Synthetic oligonucleotide
aaggatgagcgagacgcctgcttccac

SEQ ID NO: 336107 - DNA, 27 bp, Artificial Sequence
  Description of Artificial Sequence: Synthetic oligonucleotide
aggatgagcgagacgcctgcttccact

SEQ ID NO: 336108 - DNA, 26 bp, Artificial Sequence
  Description of Artificial Sequence: Synthetic oligonucleotide
ggatgagcgagacgcctgcttccact

SEQ ID NO: 336109 - DNA, 26 bp, Artificial Sequence
  Description of Artificial Sequence: Synthetic oligonucleotide
gatgagcgagacgcctgcttccactc

SEQ ID NO: 336110 - DNA, 26 bp, Artificial Sequence
  Description of Artificial Sequence: Synthetic oligonucleotide
atgagcgagacgcctgcttccactcc

SEQ ID NO: 336111 - DNA, 25 bp, Artificial Sequence
  Description of Artificial Sequence: Synthetic oligonucleotide
tgagcgagacgcctgcttccactcc

SEQ ID NO: 336112 - DNA, 24 bp, Artificial Sequence
  Description of Artificial Sequence: Synthetic oligonucleotide
gagcgagacgcctgcttccactcc

SEQ ID NO: 336113 - DNA, 24 bp, Artificial Sequence
  Description of Artificial Sequence: Synthetic oligonucleotide
agcgagacgcctgcttccactccg

SEQ ID NO: 336114 - DNA, 23 bp, Artificial Sequence
  Description of Artificial Sequence: Synthetic oligonucleotide
gcgagacgcctgcttccactccg

SEQ ID NO: 336115 - DNA, 23 bp, Artificial Sequence
  Description of Artificial Sequence: Synthetic oligonucleotide
cgagacgcctgcttccactccgc

SEQ ID NO: 336116 - DNA, 23 bp, Artificial Sequence
  Description of Artificial Sequence: Synthetic oligonucleotide
gagacgcctgcttccactccgcc

SEQ ID NO: 336117 - DNA, 23 bp, Artificial Sequence
  Description of Artificial Sequence: Synthetic oligonucleotide
agacgcctgcttccactccgccg

SEQ ID NO: 336118 - DNA, 22 bp, Artificial Sequence
  Description of Artificial Sequence: Synthetic oligonucleotide
gacgcctgcttccactccgccg

SEQ ID NO: 336119 - DNA, 22 bp, Artificial Sequence
  Description of Artificial Sequence: Synthetic oligonucleotide
acgcctgcttccactccgccgc

SEQ ID NO: 336120 - DNA, 21 bp, Artificial Sequence
  Description of Artificial Sequence: Synthetic oligonucleotide
cgcctgcttccactccgccgc

SEQ ID NO: 336121 - DNA, 21 bp, Artificial Sequence
  Description of Artificial Sequence: Synthetic oligonucleotide
gcctgcttccactccgccgcc

SEQ ID NO: 336122 - DNA, 22 bp, Artificial Sequence
  Description of Artificial Sequence: Synthetic oligonucleotide
cctgcttccactccgccgccca

SEQ ID NO: 336123 - DNA, 24 bp, Artificial Sequence
  Description of Artificial Sequence: Synthetic oligonucleotide
ctgcttccactccgccgcccagta

SEQ ID NO: 336124 - DNA, 25 bp, Artificial Sequence
  Description of Artificial Sequence: Synthetic oligonucleotide
tgcttccactccgccgcccagtaca

SEQ ID NO: 336125 - DNA, 24 bp, Artificial Sequence
  Description of Artificial Sequence: Synthetic oligonucleotide
gcttccactccgccgcccagtaca

SEQ ID NO: 336126 - DNA, 24 bp, Artificial Sequence
  Description of Artificial Sequence: Synthetic oligonucleotide
cttccactccgccgcccagtacag

SEQ ID NO: 336127 - DNA, 24 bp, Artificial Sequence
  Description of Artificial Sequence: Synthetic oligonucleotide
ttccactccgccgcccagtacagc

SEQ ID NO: 336128 - DNA, 23 bp, Artificial Sequence
  Description of Artificial Sequence: Synthetic oligonucleotide
tccactccgccgcccagtacagc

SEQ ID NO: 336129 - DNA, 22 bp, Artificial Sequence
  Description of Artificial Sequence: Synthetic oligonucleotide
ccactccgccgcccagtacagc

SEQ ID NO: 336130 - DNA, 23 bp, Artificial Sequence
  Description of Artificial Sequence: Synthetic oligonucleotide
cactccgccgcccagtacagcct

SEQ ID NO: 336131 - DNA, 23 bp, Artificial Sequence
  Description of Artificial Sequence: Synthetic oligonucleotide
actccgccgcccagtacagcctg

SEQ ID NO: 336132 - DNA, 22 bp, Artificial Sequence
  Description of Artificial Sequence: Synthetic oligonucleotide
ctccgccgcccagtacagcctg

SEQ ID NO: 336133 - DNA, 22 bp, Artificial Sequence
  Description of Artificial Sequence: Synthetic oligonucleotide
tccgccgcccagtacagcctgg

SEQ ID NO: 336134 - DNA, 21 bp, Artificial Sequence
  Description of Artificial Sequence: Synthetic oligonucleotide
ccgccgcccagtacagcctgg

SEQ ID NO: 336135 - DNA, 21 bp, Artificial Sequence
  Description of Artificial Sequence: Synthetic oligonucleotide
cgccgcccagtacagcctggc

SEQ ID NO: 336136 - DNA, 21 bp, Artificial Sequence
  Description of Artificial Sequence: Synthetic oligonucleotide
gccgcccagtacagcctggcc

SEQ ID NO: 336137 - DNA, 22 bp, Artificial Sequence
  Description of Artificial Sequence: Synthetic oligonucleotide
ccgcccagtacagcctggccga

SEQ ID NO: 336138 - DNA, 22 bp, Artificial Sequence
  Description of Artificial Sequence: Synthetic oligonucleotide
cgcccagtacagcctggccgag

SEQ ID NO: 336139 - DNA, 22 bp, Artificial Sequence
  Description of Artificial Sequence: Synthetic oligonucleotide
gcccagtacagcctggccgagg

SEQ ID NO: 336140 - DNA, 22 bp, Artificial Sequence
  Description of Artificial Sequence: Synthetic oligonucleotide
cccagtacagcctggccgaggg

SEQ ID NO: 336141 - DNA, 22 bp, Artificial Sequence
  Description of Artificial Sequence: Synthetic oligonucleotide
ccagtacagcctggccgagggc

SEQ ID NO: 336142 - DNA, 22 bp, Artificial Sequence
  Description of Artificial Sequence: Synthetic oligonucleotide
cagtacagcctggccgagggcc

SEQ ID NO: 336143 - DNA, 22 bp, Artificial Sequence
  Description of Artificial Sequence: Synthetic oligonucleotide
agtacagcctggccgagggccc

SEQ ID NO: 336144 - DNA, 21 bp, Artificial Sequence
  Description of Artificial Sequence: Synthetic oligonucleotide
gtacagcctggccgagggccc

SEQ ID NO: 336145 - DNA, 21 bp, Artificial Sequence
  Description of Artificial Sequence: Synthetic oligonucleotide
tacagcctggccgagggcccc

SEQ ID NO: 336146 - DNA, 20 bp, Artificial Sequence
  Description of Artificial Sequence: Synthetic oligonucleotide
acagcctggccgagggcccc

SEQ ID NO: 336147 - DNA, 20 bp, Artificial Sequence
  Description of Artificial Sequence: Synthetic oligonucleotide
cagcctggccgagggcccct

SEQ ID NO: 336148 - DNA, 20 bp, Artificial Sequence
  Description of Artificial Sequence: Synthetic oligonucleotide
agcctggccgagggccccca

SEQ ID NO: 336149 - DNA, 20 bp, Artificial Sequence
  Description of Artificial Sequence: Synthetic oligonucleotide
gcctggccgagggcccccat

SEQ ID NO: 336150 - DNA, 20 bp, Artificial Sequence
  Description of Artificial Sequence: Synthetic oligonucleotide
cctggccgagggcccccact

SEQ ID NO: 336151 - DNA, 20 bp, Artificial Sequence
  Description of Artificial Sequence: Synthetic oligonucleotide
ctggccgagggcccccacgt

SEQ ID NO: 336152 - DNA, 20 bp, Artificial Sequence
  Description of Artificial Sequence: Synthetic oligonucleotide
tggccgagggcccccacggt

SEQ ID NO: 336153 - DNA, 20 bp, Artificial Sequence
  Description of Artificial Sequence: Synthetic oligonucleotide
ggccgagggcccccacggtt

SEQ ID NO: 336154 - DNA, 20 bp, Artificial Sequence
  Description of Artificial Sequence: Synthetic oligonucleotide
gccgagggcccccacggctt

SEQ ID NO: 336155 - DNA, 20 bp, Artificial Sequence
  Description of Artificial Sequence: Synthetic oligonucleotide
ccgagggcccccacggcctt

SEQ ID NO: 336156 - DNA, 20 bp, Artificial Sequence
  Description of Artificial Sequence: Synthetic oligonucleotide
cgagggcccccacggccgtt

SEQ ID NO: 336157 - DNA, 20 bp, Artificial Sequence
  Description of Artificial Sequence: Synthetic oligonucleotide
gagggcccccacggccggtt

SEQ ID NO: 336158 - DNA, 20 bp, Artificial Sequence
  Description of Artificial Sequence: Synthetic oligonucleotide
agggcccccacggccggctt

SEQ ID NO: 336159 - DNA, 20 bp, Artificial Sequence
  Description of Artificial Sequence: Synthetic oligonucleotide
gggcccccacggccggcttt

SEQ ID NO: 336160 - DNA, 20 bp, Artificial Sequence
  Description of Artificial Sequence: Synthetic oligonucleotide
ggcccccacggccggctgtt

SEQ ID NO: 336161 - DNA, 20 bp, Artificial Sequence
  Description of Artificial Sequence: Synthetic oligonucleotide
gcccccacggccggctggat

SEQ ID NO: 336162 - DNA, 20 bp, Artificial Sequence
  Description of Artificial Sequence: Synthetic oligonucleotide
cccccacggccggctggaca

SEQ ID NO: 336163 - DNA, 20 bp, Artificial Sequence
  Description of Artificial Sequence: Synthetic oligonucleotide
ccccacggccggctggacag

SEQ ID NO: 336164 - DNA, 20 bp, Artificial Sequence
  Description of Artificial Sequence: Synthetic oligonucleotide
cccacggccggctggacagc

SEQ ID NO: 336165 - DNA, 20 bp, Artificial Sequence
  Description of Artificial Sequence: Synthetic oligonucleotide
ccacggccggctggacagcg

SEQ ID NO: 336166 - DNA, 20 bp, Artificial Sequence
  Description of Artificial Sequence: Synthetic oligonucleotide
cacggccggctggacagcgc

SEQ ID NO: 336167 - DNA, 21 bp, Artificial Sequence
  Description of Artificial Sequence: Synthetic oligonucleotide
acggccggctggacagcgcca

SEQ ID NO: 336168 - DNA, 20 bp, Artificial Sequence
  Description of Artificial Sequence: Synthetic oligonucleotide
cggccggctggacagcgcca

SEQ ID NO: 336169 - DNA, 20 bp, Artificial Sequence
  Description of Artificial Sequence: Synthetic oligonucleotide
ggccggctggacagcgccac

SEQ ID NO: 336170 - DNA, 22 bp, Artificial Sequence
  Description of Artificial Sequence: Synthetic oligonucleotide
gccggctggacagcgccacctt

SEQ ID NO: 336171 - DNA, 22 bp, Artificial Sequence
  Description of Artificial Sequence: Synthetic oligonucleotide
ccggctggacagcgccaccttc

SEQ ID NO: 336172 - DNA, 23 bp, Artificial Sequence
  Description of Artificial Sequence: Synthetic oligonucleotide
cggctggacagcgccaccttcct

SEQ ID NO: 336173 - DNA, 23 bp, Artificial Sequence
  Description of Artificial Sequence: Synthetic oligonucleotide
ggctggacagcgccaccttcctc

SEQ ID NO: 336174 - DNA, 24 bp, Artificial Sequence
  Description of Artificial Sequence: Synthetic oligonucleotide
gctggacagcgccaccttcctcct

SEQ ID NO: 336175 - DNA, 25 bp, Artificial Sequence
  Description of Artificial Sequence: Synthetic oligonucleotide
ctggacagcgccaccttcctcctca

SEQ ID NO: 336176 - DNA, 25 bp, Artificial Sequence
  Description of Artificial Sequence: Synthetic oligonucleotide
tggacagcgccaccttcctcctcac

SEQ ID NO: 336177 - DNA, 24 bp, Artificial Sequence
  Description of Artificial Sequence: Synthetic oligonucleotide
ggacagcgccaccttcctcctcac

SEQ ID NO: 336178 - DNA, 24 bp, Artificial Sequence
  Description of Artificial Sequence: Synthetic oligonucleotide
gacagcgccaccttcctcctcacc

SEQ ID NO: 336179 - DNA, 25 bp, Artificial Sequence
  Description of Artificial Sequence: Synthetic oligonucleotide
acagcgccaccttcctcctcaccct

SEQ ID NO: 336180 - DNA, 24 bp, Artificial Sequence
  Description of Artificial Sequence: Synthetic oligonucleotide
cagcgccaccttcctcctcaccct

SEQ ID NO: 336181 - DNA, 24 bp, Artificial Sequence
  Description of Artificial Sequence: Synthetic oligonucleotide
agcgccaccttcctcctcaccctc

SEQ ID NO: 336182 - DNA, 23 bp, Artificial Sequence
  Description of Artificial Sequence: Synthetic oligonucleotide
gcgccaccttcctcctcaccctc

SEQ ID NO: 336183 - DNA, 24 bp, Artificial Sequence
  Description of Artificial Sequence: Synthetic oligonucleotide
cgccaccttcctcctcaccctcca

SEQ ID NO: 336184 - DNA, 27 bp, Artificial Sequence
  Description of Artificial Sequence: Synthetic oligonucleotide
gccaccttcctcctcaccctccactat

SEQ ID NO: 336185 - DNA, 27 bp, Artificial Sequence
  Description of Artificial Sequence: Synthetic oligonucleotide
ccaccttcctcctcaccctccactatc

SEQ ID NO: 336186 - DNA, 27 bp, Artificial Sequence
  Description of Artificial Sequence: Synthetic oligonucleotide
caccttcctcctcaccctccactatcc

SEQ ID NO: 336187 - DNA, 27 bp, Artificial Sequence
  Description of Artificial Sequence: Synthetic oligonucleotide
accttcctcctcaccctccactatccc

SEQ ID NO: 336188 - DNA, 27 bp, Artificial Sequence
  Description of Artificial Sequence: Synthetic oligonucleotide
ccttcctcctcaccctccactatccct

SEQ ID NO: 336189 - DNA, 27 bp, Artificial Sequence
  Description of Artificial Sequence: Synthetic oligonucleotide
cttcctcctcaccctccactatccctc

SEQ ID NO: 336190 - DNA, 27 bp, Artificial Sequence
  Description of Artificial Sequence: Synthetic oligonucleotide
ttcctcctcaccctccactatccctcg

SEQ ID NO: 336191 - DNA, 26 bp, Artificial Sequence
  Description of Artificial Sequence: Synthetic oligonucleotide
tcctcctcaccctccactatccctcg

SEQ ID NO: 336192 - DNA, 25 bp, Artificial Sequence
  Description of Artificial Sequence: Synthetic oligonucleotide
cctcctcaccctccactatccctcg

SEQ ID NO: 336193 - DNA, 26 bp, Artificial Sequence
  Description of Artificial Sequence: Synthetic oligonucleotide
ctcctcaccctccactatccctcgga

SEQ ID NO: 336194 - DNA, 26 bp, Artificial Sequence
  Description of Artificial Sequence: Synthetic oligonucleotide
tcctcaccctccactatccctcggag

SEQ ID NO: 336195 - DNA, 25 bp, Artificial Sequence
  Description of Artificial Sequence: Synthetic oligonucleotide
cctcaccctccactatccctcggag

SEQ ID NO: 336196 - DNA, 26 bp, Artificial Sequence
  Description of Artificial Sequence: Synthetic oligonucleotide
ctcaccctccactatccctcggagca

SEQ ID NO: 336197 - DNA, 26 bp, Artificial Sequence
  Description of Artificial Sequence: Synthetic oligonucleotide
tcaccctccactatccctcggagcac

SEQ ID NO: 336198 - DNA, 25 bp, Artificial Sequence
  Description of Artificial Sequence: Synthetic oligonucleotide
caccctccactatccctcggagcac

SEQ ID NO: 336199 - DNA, 26 bp, Artificial Sequence
  Description of Artificial Sequence: Synthetic oligonucleotide
accctccactatccctcggagcacga

SEQ ID NO: 336200 - DNA, 25 bp, Artificial Sequence
  Description of Artificial Sequence: Synthetic oligonucleotide
ccctccactatccctcggagcacga

SEQ ID NO: 336201 - DNA, 25 bp, Artificial Sequence
  Description of Artificial Sequence: Synthetic oligonucleotide
cctccactatccctcggagcacgag

SEQ ID NO: 336202 - DNA, 26 bp, Artificial Sequence
  Description of Artificial Sequence: Synthetic oligonucleotide
ctccactatccctcggagcacgagca

SEQ ID NO: 336203 - DNA, 27 bp, Artificial Sequence
  Description of Artificial Sequence: Synthetic oligonucleotide
tccactatccctcggagcacgagcagt

SEQ ID NO: 336204 - DNA, 27 bp, Artificial Sequence
  Description of Artificial Sequence: Synthetic oligonucleotide
ccactatccctcggagcacgagcagtt

SEQ ID NO: 336205 - DNA, 27 bp, Artificial Sequence
  Description of Artificial Sequence: Synthetic oligonucleotide
cactatccctcggagcacgagcagttc

SEQ ID NO: 336206 - DNA, 28 bp, Artificial Sequence
  Description of Artificial Sequence: Synthetic oligonucleotide
actatccctcggagcacgagcagttctg

SEQ ID NO: 336207 - DNA, 27 bp, Artificial Sequence
  Description of Artificial Sequence: Synthetic oligonucleotide
ctatccctcggagcacgagcagttctg

SEQ ID NO: 336208 - DNA, 27 bp, Artificial Sequence
  Description of Artificial Sequence: Synthetic oligonucleotide
tatccctcggagcacgagcagttctgc

SEQ ID NO: 336209 - DNA, 26 bp, Artificial Sequence
  Description of Artificial Sequence: Synthetic oligonucleotide
atccctcggagcacgagcagttctgc

SEQ ID NO: 336210 - DNA, 25 bp, Artificial Sequence
  Description of Artificial Sequence: Synthetic oligonucleotide
tccctcggagcacgagcagttctgc

SEQ ID NO: 336211 - DNA, 24 bp, Artificial Sequence
  Description of Artificial Sequence: Synthetic oligonucleotide
ccctcggagcacgagcagttctgc

SEQ ID NO: 336212 - DNA, 25 bp, Artificial Sequence
  Description of Artificial Sequence: Synthetic oligonucleotide
cctcggagcacgagcagttctgcgt

SEQ ID NO: 336213 - DNA, 25 bp, Artificial Sequence
  Description of Artificial Sequence: Synthetic oligonucleotide
ctcggagcacgagcagttctgcgtg

SEQ ID NO: 336214 - DNA, 25 bp, Artificial Sequence
  Description of Artificial Sequence: Synthetic oligonucleotide
tcggagcacgagcagttctgcgtgg

SEQ ID NO: 336215 - DNA, 24 bp, Artificial Sequence
  Description of Artificial Sequence: Synthetic oligonucleotide
cggagcacgagcagttctgcgtgg

SEQ ID NO: 336216 - DNA, 24 bp, Artificial Sequence
  Description of Artificial Sequence: Synthetic oligonucleotide
ggagcacgagcagttctgcgtggg

SEQ ID NO: 336217 - DNA, 25 bp, Artificial Sequence
  Description of Artificial Sequence: Synthetic oligonucleotide
gagcacgagcagttctgcgtgggca

SEQ ID NO: 336218 - DNA, 25 bp, Artificial Sequence
  Description of Artificial Sequence: Synthetic oligonucleotide
agcacgagcagttctgcgtgggcag

SEQ ID NO: 336219 - DNA, 24 bp, Artificial Sequence
  Description of Artificial Sequence: Synthetic oligonucleotide
gcacgagcagttctgcgtgggcag

SEQ ID NO: 336220 - DNA, 24 bp, Artificial Sequence
  Description of Artificial Sequence: Synthetic oligonucleotide
cacgagcagttctgcgtgggcagc

SEQ ID NO: 336221 - DNA, 24 bp, Artificial Sequence
  Description of Artificial Sequence: Synthetic oligonucleotide
acgagcagttctgcgtgggcagcg

SEQ ID NO: 336222 - DNA, 23 bp, Artificial Sequence
  Description of Artificial Sequence: Synthetic oligonucleotide
cgagcagttctgcgtgggcagcg

SEQ ID NO: 336223 - DNA, 23 bp, Artificial Sequence
  Description of Artificial Sequence: Synthetic oligonucleotide
gagcagttctgcgtgggcagcgc

SEQ ID NO: 336224 - DNA, 24 bp, Artificial Sequence
  Description of Artificial Sequence: Synthetic oligonucleotide
agcagttctgcgtgggcagcgcgt

SEQ ID NO: 336225 - DNA, 23 bp, Artificial Sequence
  Description of Artificial Sequence: Synthetic oligonucleotide
gcagttctgcgtgggcagcgcgt

SEQ ID NO: 336226 - DNA, 23 bp, Artificial Sequence
  Description of Artificial Sequence: Synthetic oligonucleotide
cagttctgcgtgggcagcgcgtc

SEQ ID NO: 336227 - DNA, 24 bp, Artificial Sequence
  Description of Artificial Sequence: Synthetic oligonucleotide
agttctgcgtgggcagcgcgtcca

SEQ ID NO: 336228 - DNA, 23 bp, Artificial Sequence
  Description of Artificial Sequence: Synthetic oligonucleotide
gttctgcgtgggcagcgcgtcca

SEQ ID NO: 336229 - DNA, 23 bp, Artificial Sequence
  Description of Artificial Sequence: Synthetic oligonucleotide
ttctgcgtgggcagcgcgtccac

SEQ ID NO: 336230 - DNA, 22 bp, Artificial Sequence
  Description of Artificial Sequence: Synthetic oligonucleotide
tctgcgtgggcagcgcgtccac

SEQ ID NO: 336231 - DNA, 21 bp, Artificial Sequence
  Description of Artificial Sequence: Synthetic oligonucleotide
ctgcgtgggcagcgcgtccac

SEQ ID NO: 336232 - DNA, 21 bp, Artificial Sequence
  Description of Artificial Sequence: Synthetic oligonucleotide
tgcgtgggcagcgcgtccacc

SEQ ID NO: 336233 - DNA, 20 bp, Artificial Sequence
  Description of Artificial Sequence: Synthetic oligonucleotide
gcgtgggcagcgcgtccacc

SEQ ID NO: 336234 - DNA, 20 bp, Artificial Sequence
  Description of Artificial Sequence: Synthetic oligonucleotide
cgtgggcagcgcgtccaccc

SEQ ID NO: 336235 - DNA, 21 bp, Artificial Sequence
  Description of Artificial Sequence: Synthetic oligonucleotide
gtgggcagcgcgtccacccga

SEQ ID NO: 336236 - DNA, 21 bp, Artificial Sequence
  Description of Artificial Sequence: Synthetic oligonucleotide
tgggcagcgcgtccacccgag

SEQ ID NO: 336237 - DNA, 20 bp, Artificial Sequence
  Description of Artificial Sequence: Synthetic oligonucleotide
gggcagcgcgtccacccgag

SEQ ID NO: 336238 - DNA, 21 bp, Artificial Sequence
  Description of Artificial Sequence: Synthetic oligonucleotide
ggcagcgcgtccacccgagca

SEQ ID NO: 336239 - DNA, 21 bp, Artificial Sequence
  Description of Artificial Sequence: Synthetic oligonucleotide
gcagcgcgtccacccgagcag

SEQ ID NO: 336240 - DNA, 21 bp, Artificial Sequence
  Description of Artificial Sequence: Synthetic oligonucleotide
cagcgcgtccacccgagcagg

SEQ ID NO: 336241 - DNA, 22 bp, Artificial Sequence
  Description of Artificial Sequence: Synthetic oligonucleotide
agcgcgtccacccgagcaggct

SEQ ID NO: 336242 - DNA, 21 bp, Artificial Sequence
  Description of Artificial Sequence: Synthetic oligonucleotide
gcgcgtccacccgagcaggct

SEQ ID NO: 336243 - DNA, 21 bp, Artificial Sequence
  Description of Artificial Sequence: Synthetic oligonucleotide
cgcgtccacccgagcaggctg

SEQ ID NO: 336244 - DNA, 21 bp, Artificial Sequence
  Description of Artificial Sequence: Synthetic oligonucleotide
gcgtccacccgagcaggctgc

SEQ ID NO: 336245 - DNA, 23 bp, Artificial Sequence
  Description of Artificial Sequence: Synthetic oligonucleotide
cgtccacccgagcaggctgcgta

SEQ ID NO: 336246 - DNA, 23 bp, Artificial Sequence
  Description of Artificial Sequence: Synthetic oligonucleotide
gtccacccgagcaggctgcgtac

SEQ ID NO: 336247 - DNA, 23 bp, Artificial Sequence
  Description of Artificial Sequence: Synthetic oligonucleotide
tccacccgagcaggctgcgtacg

SEQ ID NO: 336248 - DNA, 22 bp, Artificial Sequence
  Description of Artificial Sequence: Synthetic oligonucleotide
ccacccgagcaggctgcgtacg

SEQ ID NO: 336249 - DNA, 22 bp, Artificial Sequence
  Description of Artificial Sequence: Synthetic oligonucleotide
cacccgagcaggctgcgtacgc

SEQ ID NO: 336250 - DNA, 23 bp, Artificial Sequence
  Description of Artificial Sequence: Synthetic oligonucleotide
acccgagcaggctgcgtacgcga

SEQ ID NO: 336251 - DNA, 22 bp, Artificial Sequence
  Description of Artificial Sequence: Synthetic oligonucleotide
cccgagcaggctgcgtacgcga

SEQ ID NO: 336252 - DNA, 22 bp, Artificial Sequence
  Description of Artificial Sequence: Synthetic oligonucleotide
ccgagcaggctgcgtacgcgag

SEQ ID NO: 336253 - DNA, 22 bp, Artificial Sequence
  Description of Artificial Sequence: Synthetic oligonucleotide
cgagcaggctgcgtacgcgagc

SEQ ID NO: 336254 - DNA, 23 bp, Artificial Sequence
  Description of Artificial Sequence: Synthetic oligonucleotide
gagcaggctgcgtacgcgagcgt

SEQ ID NO: 336255 - DNA, 24 bp, Artificial Sequence
  Description of Artificial Sequence: Synthetic oligonucleotide
agcaggctgcgtacgcgagcgtga

SEQ ID NO: 336256 - DNA, 23 bp, Artificial Sequence
  Description of Artificial Sequence: Synthetic oligonucleotide
gcaggctgcgtacgcgagcgtga

SEQ ID NO: 336257 - DNA, 24 bp, Artificial Sequence
  Description of Artificial Sequence: Synthetic oligonucleotide
caggctgcgtacgcgagcgtgaca

SEQ ID NO: 336258 - DNA, 25 bp, Artificial Sequence
  Description of Artificial Sequence: Synthetic oligonucleotide
aggctgcgtacgcgagcgtgacact

SEQ ID NO: 336259 - DNA, 24 bp, Artificial Sequence
  Description of Artificial Sequence: Synthetic oligonucleotide
ggctgcgtacgcgagcgtgacact

SEQ ID NO: 336260 - DNA, 25 bp, Artificial Sequence
  Description of Artificial Sequence: Synthetic oligonucleotide
gctgcgtacgcgagcgtgacactga

SEQ ID NO: 336261 - DNA, 25 bp, Artificial Sequence
  Description of Artificial Sequence: Synthetic oligonucleotide
ctgcgtacgcgagcgtgacactgac

SEQ ID NO: 336262 - DNA, 26 bp, Artificial Sequence
  Description of Artificial Sequence: Synthetic oligonucleotide
tgcgtacgcgagcgtgacactgacca

SEQ ID NO: 336263 - DNA, 25 bp, Artificial Sequence
  Description of Artificial Sequence: Synthetic oligonucleotide
gcgtacgcgagcgtgacactgacca

SEQ ID NO: 336264 - DNA, 25 bp, Artificial Sequence
  Description of Artificial Sequence: Synthetic oligonucleotide
cgtacgcgagcgtgacactgaccag

SEQ ID NO: 336265 - DNA, 26 bp, Artificial Sequence
  Description of Artificial Sequence: Synthetic oligonucleotide
gtacgcgagcgtgacactgaccagct

SEQ ID NO: 336266 - DNA, 26 bp, Artificial Sequence
  Description of Artificial Sequence: Synthetic oligonucleotide
tacgcgagcgtgacactgaccagctg

SEQ ID NO: 336267 - DNA, 25 bp, Artificial Sequence
  Description of Artificial Sequence: Synthetic oligonucleotide
acgcgagcgtgacactgaccagctg

SEQ ID NO: 336268 - DNA, 24 bp, Artificial Sequence
  Description of Artificial Sequence: Synthetic oligonucleotide
cgcgagcgtgacactgaccagctg

SEQ ID NO: 336269 - DNA, 25 bp, Artificial Sequence
  Description of Artificial Sequence: Synthetic oligonucleotide
gcgagcgtgacactgaccagctgct

SEQ ID NO: 336270 - DNA, 26 bp, Artificial Sequence
  Description of Artificial Sequence: Synthetic oligonucleotide
cgagcgtgacactgaccagctgctgt

SEQ ID NO: 336271 - DNA, 26 bp, Artificial Sequence
  Description of Artificial Sequence: Synthetic oligonucleotide
gagcgtgacactgaccagctgctgtg

SEQ ID NO: 336272 - DNA, 26 bp, Artificial Sequence
  Description of Artificial Sequence: Synthetic oligonucleotide
agcgtgacactgaccagctgctgtgc

SEQ ID NO: 336273 - DNA, 25 bp, Artificial Sequence
  Description of Artificial Sequence: Synthetic oligonucleotide
gcgtgacactgaccagctgctgtgc

SEQ ID NO: 336274 - DNA, 25 bp, Artificial Sequence
  Description of Artificial Sequence: Synthetic oligonucleotide
cgtgacactgaccagctgctgtgcc

SEQ ID NO: 336275 - DNA, 25 bp, Artificial Sequence
  Description of Artificial Sequence: Synthetic oligonucleotide
gtgacactgaccagctgctgtgccg

SEQ ID NO: 336276 - DNA, 25 bp, Artificial Sequence
  Description of Artificial Sequence: Synthetic oligonucleotide
tgacactgaccagctgctgtgccgg

SEQ ID NO: 336277 - DNA, 24 bp, Artificial Sequence
  Description of Artificial Sequence: Synthetic oligonucleotide
gacactgaccagctgctgtgccgg

SEQ ID NO: 336278 - DNA, 24 bp, Artificial Sequence
  Description of Artificial Sequence: Synthetic oligonucleotide
acactgaccagctgctgtgccggg

SEQ ID NO: 336279 - DNA, 23 bp, Artificial Sequence
  Description of Artificial Sequence: Synthetic oligonucleotide
cactgaccagctgctgtgccggg

SEQ ID NO: 336280 - DNA, 23 bp, Artificial Sequence
  Description of Artificial Sequence: Synthetic oligonucleotide
actgaccagctgctgtgccgggg

SEQ ID NO: 336281 - DNA, 22 bp, Artificial Sequence
  Description of Artificial Sequence: Synthetic oligonucleotide
ctgaccagctgctgtgccgggg

SEQ ID NO: 336282 - DNA, 22 bp, Artificial Sequence
  Description of Artificial Sequence: Synthetic oligonucleotide
tgaccagctgctgtgccggggg

SEQ ID NO: 336283 - DNA, 21 bp, Artificial Sequence
  Description of Artificial Sequence: Synthetic oligonucleotide
gaccagctgctgtgccggggg

SEQ ID NO: 336284 - DNA, 22 bp, Artificial Sequence
  Description of Artificial Sequence: Synthetic oligonucleotide
accagctgctgtgccgggggca

SEQ ID NO: 336285 - DNA, 21 bp, Artificial Sequence
  Description of Artificial Sequence: Synthetic oligonucleotide
ccagctgctgtgccgggggca

SEQ ID NO: 336286 - DNA, 21 bp, Artificial Sequence
  Description of Artificial Sequence: Synthetic oligonucleotide
cagctgctgtgccgggggcac

SEQ ID NO: 336287 - DNA, 21 bp, Artificial Sequence
  Description of Artificial Sequence: Synthetic oligonucleotide
agctgctgtgccgggggcacg

SEQ ID NO: 336288 - DNA, 20 bp, Artificial Sequence
  Description of Artificial Sequence: Synthetic oligonucleotide
gctgctgtgccgggggcacg

SEQ ID NO: 336289 - DNA, 20 bp, Artificial Sequence
  Description of Artificial Sequence: Synthetic oligonucleotide
ctgctgtgccgggggcacgg

SEQ ID NO: 336290 - DNA, 21 bp, Artificial Sequence
  Description of Artificial Sequence: Synthetic oligonucleotide
tgctgtgccgggggcacggca

SEQ ID NO: 336291 - DNA, 20 bp, Artificial Sequence
  Description of Artificial Sequence: Synthetic oligonucleotide
gctgtgccgggggcacggca

SEQ ID NO: 336292 - DNA, 20 bp, Artificial Sequence
  Description of Artificial Sequence: Synthetic oligonucleotide
ctgtgccgggggcacggcag

SEQ ID NO: 336293 - DNA, 20 bp, Artificial Sequence
  Description of Artificial Sequence: Synthetic oligonucleotide
tgtgccgggggcacggcagc

SEQ ID NO: 336294 - DNA, 20 bp, Artificial Sequence
  Description of Artificial Sequence: Synthetic oligonucleotide
gtgccgggggcacggcagct

SEQ ID NO: 336295 - DNA, 20 bp, Artificial Sequence
  Description of Artificial Sequence: Synthetic oligonucleotide
tgccgggggcacggcagcct

SEQ ID NO: 336296 - DNA, 20 bp, Artificial Sequence
  Description of Artificial Sequence: Synthetic oligonucleotide
gccgggggcacggcagcctt

SEQ ID NO: 336297 - DNA, 20 bp, Artificial Sequence
  Description of Artificial Sequence: Synthetic oligonucleotide
ccgggggcacggcagccgtt

SEQ ID NO: 336298 - DNA, 20 bp, Artificial Sequence
  Description of Artificial Sequence: Synthetic oligonucleotide
cgggggcacggcagccgcat

SEQ ID NO: 336299 - DNA, 20 bp, Artificial Sequence
  Description of Artificial Sequence: Synthetic oligonucleotide
gggggcacggcagccgcagt

SEQ ID NO: 336300 - DNA, 20 bp, Artificial Sequence
  Description of Artificial Sequence: Synthetic oligonucleotide
ggggcacggcagccgcagct

SEQ ID NO: 336301 - DNA, 20 bp, Artificial Sequence
  Description of Artificial Sequence: Synthetic oligonucleotide
gggcacggcagccgcagcct

SEQ ID NO: 336302 - DNA, 20 bp, Artificial Sequence
  Description of Artificial Sequence: Synthetic oligonucleotide
ggcacggcagccgcagccct

SEQ ID NO: 336303 - DNA, 20 bp, Artificial Sequence
  Description of Artificial Sequence: Synthetic oligonucleotide
gcacggcagccgcagcccgt

SEQ ID NO: 336304 - DNA, 20 bp, Artificial Sequence
  Description of Artificial Sequence: Synthetic oligonucleotide
cacggcagccgcagcccgga

SEQ ID NO: 336305 - DNA, 24 bp, Artificial Sequence
  Description of Artificial Sequence: Synthetic oligonucleotide
acggcagccgcagcccggactata

SEQ ID NO: 336306 - DNA, 23 bp, Artificial Sequence
  Description of Artificial Sequence: Synthetic oligonucleotide
cggcagccgcagcccggactata

SEQ ID NO: 336307 - DNA, 23 bp, Artificial Sequence
  Description of Artificial Sequence: Synthetic oligonucleotide
ggcagccgcagcccggactatac

SEQ ID NO: 336308 - DNA, 23 bp, Artificial Sequence
  Description of Artificial Sequence: Synthetic oligonucleotide
gcagccgcagcccggactatacg

SEQ ID NO: 336309 - DNA, 27 bp, Artificial Sequence
  Description of Artificial Sequence: Synthetic oligonucleotide
cagccgcagcccggactatacgcttat

SEQ ID NO: 336310 - DNA, 27 bp, Artificial Sequence
  Description of Artificial Sequence: Synthetic oligonucleotide
agccgcagcccggactatacgcttatc

SEQ ID NO: 336311 - DNA, 26 bp, Artificial Sequence
  Description of Artificial Sequence: Synthetic oligonucleotide
gccgcagcccggactatacgcttatc

SEQ ID NO: 336312 - DNA, 26 bp, Artificial Sequence
  Description of Artificial Sequence: Synthetic oligonucleotide
ccgcagcccggactatacgcttatcc

SEQ ID NO: 336313 - DNA, 26 bp, Artificial Sequence
  Description of Artificial Sequence: Synthetic oligonucleotide
cgcagcccggactatacgcttatccg

SEQ ID NO: 336314 - DNA, 26 bp, Artificial Sequence
  Description of Artificial Sequence: Synthetic oligonucleotide
gcagcccggactatacgcttatccgc

SEQ ID NO: 336315 - DNA, 27 bp, Artificial Sequence
  Description of Artificial Sequence: Synthetic oligonucleotide
cagcccggactatacgcttatccgcct

SEQ ID NO: 336316 - DNA, 28 bp, Artificial Sequence
  Description of Artificial Sequence: Synthetic oligonucleotide
agcccggactatacgcttatccgccttc

SEQ ID NO: 336317 - DNA, 27 bp, Artificial Sequence
  Description of Artificial Sequence: Synthetic oligonucleotide
gcccggactatacgcttatccgccttc

SEQ ID NO: 336318 - DNA, 28 bp, Artificial Sequence
  Description of Artificial Sequence: Synthetic oligonucleotide
cccggactatacgcttatccgccttctg

SEQ ID NO: 336319 - DNA, 28 bp, Artificial Sequence
  Description of Artificial Sequence: Synthetic oligonucleotide
ccggactatacgcttatccgccttctgg

SEQ ID NO: 336320 - DNA, 30 bp, Artificial Sequence
  Description of Artificial Sequence: Synthetic oligonucleotide
cggactatacgcttatccgccttctggatg

SEQ ID NO: 336321 - DNA, 31 bp, Artificial Sequence
  Description of Artificial Sequence: Synthetic oligonucleotide
ggactatacgcttatccgccttctggatgag

SEQ ID NO: 336322 - DNA, 31 bp, Artificial Sequence
  Description of Artificial Sequence: Synthetic oligonucleotide
gactatacgcttatccgccttctggatgagc

SEQ ID NO: 336323 - DNA, 32 bp, Artificial Sequence
  Description of Artificial Sequence: Synthetic oligonucleotide
actatacgcttatccgccttctggatgagcac

SEQ ID NO: 336324 - DNA, 31 bp, Artificial Sequence
  Description of Artificial Sequence: Synthetic oligonucleotide
ctatacgcttatccgccttctggatgagcac

SEQ ID NO: 336325 - DNA, 31 bp, Artificial Sequence
  Description of Artificial Sequence: Synthetic oligonucleotide
tatacgcttatccgccttctggatgagcacg

SEQ ID NO: 336326 - DNA, 30 bp, Artificial Sequence
  Description of Artificial Sequence: Synthetic oligonucleotide
atacgcttatccgccttctggatgagcacg

SEQ ID NO: 336327 - DNA, 29 bp, Artificial Sequence
  Description of Artificial Sequence: Synthetic oligonucleotide
tacgcttatccgccttctggatgagcacg

SEQ ID NO: 336328 - DNA, 28 bp, Artificial Sequence
  Description of Artificial Sequence: Synthetic oligonucleotide
acgcttatccgccttctggatgagcacg

SEQ ID NO: 336329 - DNA, 27 bp, Artificial Sequence
  Description of Artificial Sequence: Synthetic oligonucleotide
cgcttatccgccttctggatgagcacg

SEQ ID NO: 336330 - DNA, 28 bp, Artificial Sequence
  Description of Artificial Sequence: Synthetic oligonucleotide
gcttatccgccttctggatgagcacgag

SEQ ID NO: 336331 - DNA, 28 bp, Artificial Sequence
  Description of Artificial Sequence: Synthetic oligonucleotide
cttatccgccttctggatgagcacgagg

SEQ ID NO: 336332 - DNA, 30 bp, Artificial Sequence
  Description of Artificial Sequence: Synthetic oligonucleotide
ttatccgccttctggatgagcacgaggaag

SEQ ID NO: 336333 - DNA, 29 bp, Artificial Sequence
  Description of Artificial Sequence: Synthetic oligonucleotide
tatccgccttctggatgagcacgaggaag

SEQ ID NO: 336334 - DNA, 28 bp, Artificial Sequence
  Description of Artificial Sequence: Synthetic oligonucleotide
atccgccttctggatgagcacgaggaag

SEQ ID NO: 336335 - DNA, 27 bp, Artificial Sequence
  Description of Artificial Sequence: Synthetic oligonucleotide
tccgccttctggatgagcacgaggaag

SEQ ID NO: 336336 - DNA, 27 bp, Artificial Sequence
  Description of Artificial Sequence: Synthetic oligonucleotide
ccgccttctggatgagcacgaggaagt

SEQ ID NO: 336337 - DNA, 27 bp, Artificial Sequence
  Description of Artificial Sequence: Synthetic oligonucleotide
cgccttctggatgagcacgaggaagtg

SEQ ID NO: 336338 - DNA, 27 bp, Artificial Sequence
  Description of Artificial Sequence: Synthetic oligonucleotide
gccttctggatgagcacgaggaagtgg

SEQ ID NO: 336339 - DNA, 28 bp, Artificial Sequence
  Description of Artificial Sequence: Synthetic oligonucleotide
ccttctggatgagcacgaggaagtggtg

SEQ ID NO: 336340 - DNA, 31 bp, Artificial Sequence
  Description of Artificial Sequence: Synthetic oligonucleotide
cttctggatgagcacgaggaagtggtgaatg

SEQ ID NO: 336341 - DNA, 32 bp, Artificial Sequence
  Description of Artificial Sequence: Synthetic oligonucleotide
ttctggatgagcacgaggaagtggtgaatgtg

SEQ ID NO: 336342 - DNA, 31 bp, Artificial Sequence
  Description of Artificial Sequence: Synthetic oligonucleotide
tctggatgagcacgaggaagtggtgaatgtg

SEQ ID NO: 336343 - DNA, 30 bp, Artificial Sequence
  Description of Artificial Sequence: Synthetic oligonucleotide
ctggatgagcacgaggaagtggtgaatgtg

SEQ ID NO: 336344 - DNA, 33 bp, Artificial Sequence
  Description of Artificial Sequence: Synthetic oligonucleotide
tggatgagcacgaggaagtggtgaatgtgattc

SEQ ID NO: 336345 - DNA, 32 bp, Artificial Sequence
  Description of Artificial Sequence: Synthetic oligonucleotide
ggatgagcacgaggaagtggtgaatgtgattc

SEQ ID NO: 336346 - DNA, 33 bp, Artificial Sequence
  Description of Artificial Sequence: Synthetic oligonucleotide
gatgagcacgaggaagtggtgaatgtgattctc

SEQ ID NO: 336347 - DNA, 33 bp, Artificial Sequence
  Description of Artificial Sequence: Synthetic oligonucleotide
atgagcacgaggaagtggtgaatgtgattctcg

SEQ ID NO: 336348 - DNA, 32 bp, Artificial Sequence
  Description of Artificial Sequence: Synthetic oligonucleotide
tgagcacgaggaagtggtgaatgtgattctcg

SEQ ID NO: 336349 - DNA, 31 bp, Artificial Sequence
  Description of Artificial Sequence: Synthetic oligonucleotide
gagcacgaggaagtggtgaatgtgattctcg

SEQ ID NO: 336350 - DNA, 32 bp, Artificial Sequence
  Description of Artificial Sequence: Synthetic oligonucleotide
agcacgaggaagtggtgaatgtgattctcgag

SEQ ID NO: 336351 - DNA, 31 bp, Artificial Sequence
  Description of Artificial Sequence: Synthetic oligonucleotide
gcacgaggaagtggtgaatgtgattctcgag

SEQ ID NO: 336352 - DNA, 31 bp, Artificial Sequence
  Description of Artificial Sequence: Synthetic oligonucleotide
cacgaggaagtggtgaatgtgattctcgagg

SEQ ID NO: 336353 - DNA, 31 bp, Artificial Sequence
  Description of Artificial Sequence: Synthetic oligonucleotide
acgaggaagtggtgaatgtgattctcgaggg

SEQ ID NO: 336354 - DNA, 30 bp, Artificial Sequence
  Description of Artificial Sequence: Synthetic oligonucleotide
cgaggaagtggtgaatgtgattctcgaggg

SEQ ID NO: 336355 - DNA, 30 bp, Artificial Sequence
  Description of Artificial Sequence: Synthetic oligonucleotide
gaggaagtggtgaatgtgattctcgagggc

SEQ ID NO: 336356 - DNA, 32 bp, Artificial Sequence
  Description of Artificial Sequence: Synthetic oligonucleotide
aggaagtggtgaatgtgattctcgagggcaac

SEQ ID NO: 336357 - DNA, 31 bp, Artificial Sequence
  Description of Artificial Sequence: Synthetic oligonucleotide
ggaagtggtgaatgtgattctcgagggcaac

SEQ ID NO: 336358 - DNA, 33 bp, Artificial Sequence
  Description of Artificial Sequence: Synthetic oligonucleotide
gaagtggtgaatgtgattctcgagggcaacttg

SEQ ID NO: 336359 - DNA, 34 bp, Artificial Sequence
  Description of Artificial Sequence: Synthetic oligonucleotide
aagtggtgaatgtgattctcgagggcaacttgac

SEQ ID NO: 336360 - DNA, 33 bp, Artificial Sequence
  Description of Artificial Sequence: Synthetic oligonucleotide
agtggtgaatgtgattctcgagggcaacttgac

SEQ ID NO: 336361 - DNA, 32 bp, Artificial Sequence
  Description of Artificial Sequence: Synthetic oligonucleotide
gtggtgaatgtgattctcgagggcaacttgac

SEQ ID NO: 336362 - DNA, 32 bp, Artificial Sequence
  Description of Artificial Sequence: Synthetic oligonucleotide
tggtgaatgtgattctcgagggcaacttgacc

SEQ ID NO: 336363 - DNA, 31 bp, Artificial Sequence
  Description of Artificial Sequence: Synthetic oligonucleotide
ggtgaatgtgattctcgagggcaacttgacc

SEQ ID NO: 336364 - DNA, 31 bp, Artificial Sequence
  Description of Artificial Sequence: Synthetic oligonucleotide
gtgaatgtgattctcgagggcaacttgaccg

SEQ ID NO: 336365 - DNA, 32 bp, Artificial Sequence
  Description of Artificial Sequence: Synthetic oligonucleotide
tgaatgtgattctcgagggcaacttgaccgtg

SEQ ID NO: 336366 - DNA, 31 bp, Artificial Sequence
  Description of Artificial Sequence: Synthetic oligonucleotide
gaatgtgattctcgagggcaacttgaccgtg

SEQ ID NO: 336367 - DNA, 31 bp, Artificial Sequence
  Description of Artificial Sequence: Synthetic oligonucleotide
aatgtgattctcgagggcaacttgaccgtgg

SEQ ID NO: 336368 - DNA, 30 bp, Artificial Sequence
  Description of Artificial Sequence: Synthetic oligonucleotide
atgtgattctcgagggcaacttgaccgtgg

SEQ ID NO: 336369 - DNA, 29 bp, Artificial Sequence
  Description of Artificial Sequence: Synthetic oligonucleotide
tgtgattctcgagggcaacttgaccgtgg

SEQ ID NO: 336370 - DNA, 28 bp, Artificial Sequence
  Description of Artificial Sequence: Synthetic oligonucleotide
gtgattctcgagggcaacttgaccgtgg

SEQ ID NO: 336371 - DNA, 29 bp, Artificial Sequence
  Description of Artificial Sequence: Synthetic oligonucleotide
tgattctcgagggcaacttgaccgtggag

SEQ ID NO: 336372 - DNA, 28 bp, Artificial Sequence
  Description of Artificial Sequence: Synthetic oligonucleotide
gattctcgagggcaacttgaccgtggag

SEQ ID NO: 336373 - DNA, 28 bp, Artificial Sequence
  Description of Artificial Sequence: Synthetic oligonucleotide
attctcgagggcaacttgaccgtggagg

SEQ ID NO: 336374 - DNA, 27 bp, Artificial Sequence
  Description of Artificial Sequence: Synthetic oligonucleotide
ttctcgagggcaacttgaccgtggagg

SEQ ID NO: 336375 - DNA, 26 bp, Artificial Sequence
  Description of Artificial Sequence: Synthetic oligonucleotide
tctcgagggcaacttgaccgtggagg

SEQ ID NO: 336376 - DNA, 25 bp, Artificial Sequence
  Description of Artificial Sequence: Synthetic oligonucleotide
ctcgagggcaacttgaccgtggagg

SEQ ID NO: 336377 - DNA, 26 bp, Artificial Sequence
  Description of Artificial Sequence: Synthetic oligonucleotide
tcgagggcaacttgaccgtggaggga

SEQ ID NO: 336378 - DNA, 25 bp, Artificial Sequence
  Description of Artificial Sequence: Synthetic oligonucleotide
cgagggcaacttgaccgtggaggga

SEQ ID NO: 336379 - DNA, 26 bp, Artificial Sequence
  Description of Artificial Sequence: Synthetic oligonucleotide
gagggcaacttgaccgtggagggaga

SEQ ID NO: 336380 - DNA, 27 bp, Artificial Sequence
  Description of Artificial Sequence: Synthetic oligonucleotide
agggcaacttgaccgtggagggagaga

SEQ ID NO: 336381 - DNA, 26 bp, Artificial Sequence
  Description of Artificial Sequence: Synthetic oligonucleotide
gggcaacttgaccgtggagggagaga

SEQ ID NO: 336382 - DNA, 26 bp, Artificial Sequence
  Description of Artificial Sequence: Synthetic oligonucleotide
ggcaacttgaccgtggagggagagac

SEQ ID NO: 336383 - DNA, 26 bp, Artificial Sequence
  Description of Artificial Sequence: Synthetic oligonucleotide
gcaacttgaccgtggagggagagacc

SEQ ID NO: 336384 - DNA, 26 bp, Artificial Sequence
  Description of Artificial Sequence: Synthetic oligonucleotide
caacttgaccgtggagggagagaccc

SEQ ID NO: 336385 - DNA, 26 bp, Artificial Sequence
  Description of Artificial Sequence: Synthetic oligonucleotide
aacttgaccgtggagggagagacccg

SEQ ID NO: 336386 - DNA, 25 bp, Artificial Sequence
  Description of Artificial Sequence: Synthetic oligonucleotide
acttgaccgtggagggagagacccg

SEQ ID NO: 336387 - DNA, 24 bp, Artificial Sequence
  Description of Artificial Sequence: Synthetic oligonucleotide
cttgaccgtggagggagagacccg

SEQ ID NO: 336388 - DNA, 24 bp, Artificial Sequence
  Description of Artificial Sequence: Synthetic oligonucleotide
ttgaccgtggagggagagacccgg

SEQ ID NO: 336389 - DNA, 23 bp, Artificial Sequence
  Description of Artificial Sequence: Synthetic oligonucleotide
tgaccgtggagggagagacccgg

SEQ ID NO: 336390 - DNA, 22 bp, Artificial Sequence
  Description of Artificial Sequence: Synthetic oligonucleotide
gaccgtggagggagagacccgg

SEQ ID NO: 336391 - DNA, 22 bp, Artificial Sequence
  Description of Artificial Sequence: Synthetic oligonucleotide
accgtggagggagagacccggg

SEQ ID NO: 336392 - DNA, 21 bp, Artificial Sequence
  Description of Artificial Sequence: Synthetic oligonucleotide
ccgtggagggagagacccggg

SEQ ID NO: 336393 - DNA, 21 bp, Artificial Sequence
  Description of Artificial Sequence: Synthetic oligonucleotide
cgtggagggagagacccgggg

SEQ ID NO: 336394 - DNA, 21 bp, Artificial Sequence
  Description of Artificial Sequence: Synthetic oligonucleotide
gtggagggagagacccggggg

SEQ ID NO: 336395 - DNA, 22 bp, Artificial Sequence
  Description of Artificial Sequence: Synthetic oligonucleotide
tggagggagagacccgggggca

SEQ ID NO: 336396 - DNA, 21 bp, Artificial Sequence
  Description of Artificial Sequence: Synthetic oligonucleotide
ggagggagagacccgggggca

SEQ ID NO: 336397 - DNA, 22 bp, Artificial Sequence
  Description of Artificial Sequence: Synthetic oligonucleotide
gagggagagacccgggggcaga

SEQ ID NO: 336398 - DNA, 22 bp, Artificial Sequence
  Description of Artificial Sequence: Synthetic oligonucleotide
agggagagacccgggggcagag

SEQ ID NO: 336399 - DNA, 21 bp, Artificial Sequence
  Description of Artificial Sequence: Synthetic oligonucleotide
gggagagacccgggggcagag

SEQ ID NO: 336400 - DNA, 21 bp, Artificial Sequence
  Description of Artificial Sequence: Synthetic oligonucleotide
ggagagacccgggggcagagc

SEQ ID NO: 336401 - DNA, 21 bp, Artificial Sequence
  Description of Artificial Sequence: Synthetic oligonucleotide
gagagacccgggggcagagcg

SEQ ID NO: 336402 - DNA, 21 bp, Artificial Sequence
  Description of Artificial Sequence: Synthetic oligonucleotide
agagacccgggggcagagcgg

SEQ ID NO: 336403 - DNA, 20 bp, Artificial Sequence
  Description of Artificial Sequence: Synthetic oligonucleotide
gagacccgggggcagagcgg

SEQ ID NO: 336404 - DNA, 21 bp, Artificial Sequence
  Description of Artificial Sequence: Synthetic oligonucleotide
agacccgggggcagagcgggt

SEQ ID NO: 336405 - DNA, 20 bp, Artificial Sequence
  Description of Artificial Sequence: Synthetic oligonucleotide
gacccgggggcagagcgggt

SEQ ID NO: 336406 - DNA, 20 bp, Artificial Sequence
  Description of Artificial Sequence: Synthetic oligonucleotide
acccgggggcagagcgggtc

SEQ ID NO: 336407 - DNA, 20 bp, Artificial Sequence
  Description of Artificial Sequence: Synthetic oligonucleotide
cccgggggcagagcgggtct

SEQ ID NO: 336408 - DNA, 22 bp, Artificial Sequence
  Description of Artificial Sequence: Synthetic oligonucleotide
ccgggggcagagcgggtcctat

SEQ ID NO: 336409 - DNA, 22 bp, Artificial Sequence
  Description of Artificial Sequence: Synthetic oligonucleotide
cgggggcagagcgggtcctatg

SEQ ID NO: 336410 - DNA, 22 bp, Artificial Sequence
  Description of Artificial Sequence: Synthetic oligonucleotide
gggggcagagcgggtcctatgg

SEQ ID NO: 336411 - DNA, 23 bp, Artificial Sequence
  Description of Artificial Sequence: Synthetic oligonucleotide
ggggcagagcgggtcctatggct

SEQ ID NO: 336412 - DNA, 23 bp, Artificial Sequence
  Description of Artificial Sequence: Synthetic oligonucleotide
gggcagagcgggtcctatggctc

SEQ ID NO: 336413 - DNA, 24 bp, Artificial Sequence
  Description of Artificial Sequence: Synthetic oligonucleotide
ggcagagcgggtcctatggctcca

SEQ ID NO: 336414 - DNA, 25 bp, Artificial Sequence
  Description of Artificial Sequence: Synthetic oligonucleotide
gcagagcgggtcctatggctccaga

SEQ ID NO: 336415 - DNA, 26 bp, Artificial Sequence
  Description of Artificial Sequence: Synthetic oligonucleotide
cagagcgggtcctatggctccagagt

SEQ ID NO: 336416 - DNA, 26 bp, Artificial Sequence
  Description of Artificial Sequence: Synthetic oligonucleotide
agagcgggtcctatggctccagagtg

SEQ ID NO: 336417 - DNA, 25 bp, Artificial Sequence
  Description of Artificial Sequence: Synthetic oligonucleotide
gagcgggtcctatggctccagagtg

SEQ ID NO: 336418 - DNA, 26 bp, Artificial Sequence
  Description of Artificial Sequence: Synthetic oligonucleotide
agcgggtcctatggctccagagtgga

SEQ ID NO: 336419 - DNA, 25 bp, Artificial Sequence
  Description of Artificial Sequence: Synthetic oligonucleotide
gcgggtcctatggctccagagtgga

SEQ ID NO: 336420 - DNA, 25 bp, Artificial Sequence
  Description of Artificial Sequence: Synthetic oligonucleotide
cgggtcctatggctccagagtggac

SEQ ID NO: 336421 - DNA, 27 bp, Artificial Sequence
  Description of Artificial Sequence: Synthetic oligonucleotide
gggtcctatggctccagagtggacgat

SEQ ID NO: 336422 - DNA, 29 bp, Artificial Sequence
  Description of Artificial Sequence: Synthetic oligonucleotide
ggtcctatggctccagagtggacgattac

SEQ ID NO: 336423 - DNA, 29 bp, Artificial Sequence
  Description of Artificial Sequence: Synthetic oligonucleotide
gtcctatggctccagagtggacgattacg

SEQ ID NO: 336424 - DNA, 30 bp, Artificial Sequence
  Description of Artificial Sequence: Synthetic oligonucleotide
tcctatggctccagagtggacgattacgac

SEQ ID NO: 336425 - DNA, 29 bp, Artificial Sequence
  Description of Artificial Sequence: Synthetic oligonucleotide
cctatggctccagagtggacgattacgac

SEQ ID NO: 336426 - DNA, 29 bp, Artificial Sequence
  Description of Artificial Sequence: Synthetic oligonucleotide
ctatggctccagagtggacgattacgacc

SEQ ID NO: 336427 - DNA, 29 bp, Artificial Sequence
  Description of Artificial Sequence: Synthetic oligonucleotide
tatggctccagagtggacgattacgaccc

SEQ ID NO: 336428 - DNA, 28 bp, Artificial Sequence
  Description of Artificial Sequence: Synthetic oligonucleotide
atggctccagagtggacgattacgaccc

SEQ ID NO: 336429 - DNA, 27 bp, Artificial Sequence
  Description of Artificial Sequence: Synthetic oligonucleotide
tggctccagagtggacgattacgaccc

SEQ ID NO: 336430 - DNA, 26 bp, Artificial Sequence
  Description of Artificial Sequence: Synthetic oligonucleotide
ggctccagagtggacgattacgaccc

SEQ ID NO: 336431 - DNA, 26 bp, Artificial Sequence
  Description of Artificial Sequence: Synthetic oligonucleotide
gctccagagtggacgattacgacccg

SEQ ID NO: 336432 - DNA, 26 bp, Artificial Sequence
  Description of Artificial Sequence: Synthetic oligonucleotide
ctccagagtggacgattacgacccgg

SEQ ID NO: 336433 - DNA, 27 bp, Artificial Sequence
  Description of Artificial Sequence: Synthetic oligonucleotide
tccagagtggacgattacgacccggca

SEQ ID NO: 336434 - DNA, 26 bp, Artificial Sequence
  Description of Artificial Sequence: Synthetic oligonucleotide
ccagagtggacgattacgacccggca

SEQ ID NO: 336435 - DNA, 27 bp, Artificial Sequence
  Description of Artificial Sequence: Synthetic oligonucleotide
cagagtggacgattacgacccggcaga

SEQ ID NO: 336436 - DNA, 28 bp, Artificial Sequence
  Description of Artificial Sequence: Synthetic oligonucleotide
agagtggacgattacgacccggcagatg

SEQ ID NO: 336437 - DNA, 27 bp, Artificial Sequence
  Description of Artificial Sequence: Synthetic oligonucleotide
gagtggacgattacgacccggcagatg

SEQ ID NO: 336438 - DNA, 28 bp, Artificial Sequence
  Description of Artificial Sequence: Synthetic oligonucleotide
agtggacgattacgacccggcagatgtc

SEQ ID NO: 336439 - DNA, 27 bp, Artificial Sequence
  Description of Artificial Sequence: Synthetic oligonucleotide
gtggacgattacgacccggcagatgtc

SEQ ID NO: 336440 - DNA, 27 bp, Artificial Sequence
  Description of Artificial Sequence: Synthetic oligonucleotide
tggacgattacgacccggcagatgtcg

SEQ ID NO: 336441 - DNA, 27 bp, Artificial Sequence
  Description of Artificial Sequence: Synthetic oligonucleotide
ggacgattacgacccggcagatgtcgt

SEQ ID NO: 336442 - DNA, 27 bp, Artificial Sequence
  Description of Artificial Sequence: Synthetic oligonucleotide
gacgattacgacccggcagatgtcgtg

SEQ ID NO: 336443 - DNA, 27 bp, Artificial Sequence
  Description of Artificial Sequence: Synthetic oligonucleotide
acgattacgacccggcagatgtcgtgc

SEQ ID NO: 336444 - DNA, 27 bp, Artificial Sequence
  Description of Artificial Sequence: Synthetic oligonucleotide
cgattacgacccggcagatgtcgtgca

SEQ ID NO: 336445 - DNA, 27 bp, Artificial Sequence
  Description of Artificial Sequence: Synthetic oligonucleotide
gattacgacccggcagatgtcgtgcag

SEQ ID NO: 336446 - DNA, 27 bp, Artificial Sequence
  Description of Artificial Sequence: Synthetic oligonucleotide
attacgacccggcagatgtcgtgcagc

SEQ ID NO: 336447 - DNA, 27 bp, Artificial Sequence
  Description of Artificial Sequence: Synthetic oligonucleotide
ttacgacccggcagatgtcgtgcagct

SEQ ID NO: 336448 - DNA, 26 bp, Artificial Sequence
  Description of Artificial Sequence: Synthetic oligonucleotide
tacgacccggcagatgtcgtgcagct

SEQ ID NO: 336449 - DNA, 25 bp, Artificial Sequence
  Description of Artificial Sequence: Synthetic oligonucleotide
acgacccggcagatgtcgtgcagct

SEQ ID NO: 336450 - DNA, 24 bp, Artificial Sequence
  Description of Artificial Sequence: Synthetic oligonucleotide
cgacccggcagatgtcgtgcagct

SEQ ID NO: 336451 - DNA, 25 bp, Artificial Sequence
  Description of Artificial Sequence: Synthetic oligonucleotide
gacccggcagatgtcgtgcagctgt

SEQ ID NO: 336452 - DNA, 25 bp, Artificial Sequence
  Description of Artificial Sequence: Synthetic oligonucleotide
acccggcagatgtcgtgcagctgtc

SEQ ID NO: 336453 - DNA, 24 bp, Artificial Sequence
  Description of Artificial Sequence: Synthetic oligonucleotide
cccggcagatgtcgtgcagctgtc

SEQ ID NO: 336454 - DNA, 26 bp, Artificial Sequence
  Description of Artificial Sequence: Synthetic oligonucleotide
ccggcagatgtcgtgcagctgtccaa

SEQ ID NO: 336455 - DNA, 27 bp, Artificial Sequence
  Description of Artificial Sequence: Synthetic oligonucleotide
cggcagatgtcgtgcagctgtccaaga

SEQ ID NO: 336456 - DNA, 27 bp, Artificial Sequence
  Description of Artificial Sequence: Synthetic oligonucleotide
ggcagatgtcgtgcagctgtccaagac

SEQ ID NO: 336457 - DNA, 27 bp, Artificial Sequence
  Description of Artificial Sequence: Synthetic oligonucleotide
gcagatgtcgtgcagctgtccaagacg

SEQ ID NO: 336458 - DNA, 27 bp, Artificial Sequence
  Description of Artificial Sequence: Synthetic oligonucleotide
cagatgtcgtgcagctgtccaagacgg

SEQ ID NO: 336459 - DNA, 28 bp, Artificial Sequence
  Description of Artificial Sequence: Synthetic oligonucleotide
agatgtcgtgcagctgtccaagacggtg

SEQ ID NO: 336460 - DNA, 27 bp, Artificial Sequence
  Description of Artificial Sequence: Synthetic oligonucleotide
gatgtcgtgcagctgtccaagacggtg

SEQ ID NO: 336461 - DNA, 27 bp, Artificial Sequence
  Description of Artificial Sequence: Synthetic oligonucleotide
atgtcgtgcagctgtccaagacggtgg

SEQ ID NO: 336462 - DNA, 27 bp, Artificial Sequence
  Description of Artificial Sequence: Synthetic oligonucleotide
tgtcgtgcagctgtccaagacggtgga

SEQ ID NO: 336463 - DNA, 26 bp, Artificial Sequence
  Description of Artificial Sequence: Synthetic oligonucleotide
gtcgtgcagctgtccaagacggtgga

SEQ ID NO: 336464 - DNA, 26 bp, Artificial Sequence
  Description of Artificial Sequence: Synthetic oligonucleotide
tcgtgcagctgtccaagacggtggag

SEQ ID NO: 336465 - DNA, 25 bp, Artificial Sequence
  Description of Artificial Sequence: Synthetic oligonucleotide
cgtgcagctgtccaagacggtggag

SEQ ID NO: 336466 - DNA, 26 bp, Artificial Sequence
  Description of Artificial Sequence: Synthetic oligonucleotide
gtgcagctgtccaagacggtggagct

SEQ ID NO: 336467 - DNA, 26 bp, Artificial Sequence
  Description of Artificial Sequence: Synthetic oligonucleotide
tgcagctgtccaagacggtggagctg

SEQ ID NO: 336468 - DNA, 25 bp, Artificial Sequence
  Description of Artificial Sequence: Synthetic oligonucleotide
gcagctgtccaagacggtggagctg

SEQ ID NO: 336469 - DNA, 25 bp, Artificial Sequence
  Description of Artificial Sequence: Synthetic oligonucleotide
cagctgtccaagacggtggagctgc

SEQ ID NO: 336470 - DNA, 25 bp, Artificial Sequence
  Description of Artificial Sequence: Synthetic oligonucleotide
agctgtccaagacggtggagctgcc

SEQ ID NO: 336471 - DNA, 24 bp, Artificial Sequence
  Description of Artificial Sequence: Synthetic oligonucleotide
gctgtccaagacggtggagctgcc

SEQ ID NO: 336472 - DNA, 24 bp, Artificial Sequence
  Description of Artificial Sequence: Synthetic oligonucleotide
ctgtccaagacggtggagctgccc

SEQ ID NO: 336473 - DNA, 25 bp, Artificial Sequence
  Description of Artificial Sequence: Synthetic oligonucleotide
tgtccaagacggtggagctgcccgt

SEQ ID NO: 336474 - DNA, 24 bp, Artificial Sequence
  Description of Artificial Sequence: Synthetic oligonucleotide
gtccaagacggtggagctgcccgt

SEQ ID NO: 336475 - DNA, 24 bp, Artificial Sequence
  Description of Artificial Sequence: Synthetic oligonucleotide
tccaagacggtggagctgcccgtg

SEQ ID NO: 336476 - DNA, 23 bp, Artificial Sequence
  Description of Artificial Sequence: Synthetic oligonucleotide
ccaagacggtggagctgcccgtg

SEQ ID NO: 336477 - DNA, 23 bp, Artificial Sequence
  Description of Artificial Sequence: Synthetic oligonucleotide
caagacggtggagctgcccgtgg

SEQ ID NO: 336478 - DNA, 23 bp, Artificial Sequence
  Description of Artificial Sequence: Synthetic oligonucleotide
aagacggtggagctgcccgtggc

SEQ ID NO: 336479 - DNA, 22 bp, Artificial Sequence
  Description of Artificial Sequence: Synthetic oligonucleotide
agacggtggagctgcccgtggc

SEQ ID NO: 336480 - DNA, 21 bp, Artificial Sequence
  Description of Artificial Sequence: Synthetic oligonucleotide
gacggtggagctgcccgtggc

SEQ ID NO: 336481 - DNA, 24 bp, Artificial Sequence
  Description of Artificial Sequence: Synthetic oligonucleotide
acggtggagctgcccgtggcctaa

SEQ ID NO: 336482 - DNA, 23 bp, Artificial Sequence
  Description of Artificial Sequence: Synthetic oligonucleotide
cggtggagctgcccgtggcctaa

SEQ ID NO: 336483 - DNA, 24 bp, Artificial Sequence
  Description of Artificial Sequence: Synthetic oligonucleotide
ggtggagctgcccgtggcctaact

SEQ ID NO: 336484 - DNA, 24 bp, Artificial Sequence
  Description of Artificial Sequence: Synthetic oligonucleotide
gtggagctgcccgtggcctaactg

SEQ ID NO: 336485 - DNA, 25 bp, Artificial Sequence
  Description of Artificial Sequence: Synthetic oligonucleotide
tggagctgcccgtggcctaactgga

SEQ ID NO: 336486 - DNA, 24 bp, Artificial Sequence
  Description of Artificial Sequence: Synthetic oligonucleotide
ggagctgcccgtggcctaactgga

SEQ ID NO: 336487 - DNA, 24 bp, Artificial Sequence
  Description of Artificial Sequence: Synthetic oligonucleotide
gagctgcccgtggcctaactggac

SEQ ID NO: 336488 - DNA, 24 bp, Artificial Sequence
  Description of Artificial Sequence: Synthetic oligonucleotide
agctgcccgtggcctaactggacc

SEQ ID NO: 336489 - DNA, 23 bp, Artificial Sequence
  Description of Artificial Sequence: Synthetic oligonucleotide
gctgcccgtggcctaactggacc

SEQ ID NO: 336490 - DNA, 23 bp, Artificial Sequence
  Description of Artificial Sequence: Synthetic oligonucleotide
ctgcccgtggcctaactggaccc

SEQ ID NO: 336491 - DNA, 23 bp, Artificial Sequence
  Description of Artificial Sequence: Synthetic oligonucleotide
tgcccgtggcctaactggacccc

SEQ ID NO: 336492 - DNA, 22 bp, Artificial Sequence
  Description of Artificial Sequence: Synthetic oligonucleotide
gcccgtggcctaactggacccc

SEQ ID NO: 336493 - DNA, 23 bp, Artificial Sequence
  Description of Artificial Sequence: Synthetic oligonucleotide
cccgtggcctaactggaccccgt

SEQ ID NO: 336494 - DNA, 23 bp, Artificial Sequence
  Description of Artificial Sequence: Synthetic oligonucleotide
ccgtggcctaactggaccccgtg

SEQ ID NO: 336495 - DNA, 24 bp, Artificial Sequence
  Description of Artificial Sequence: Synthetic oligonucleotide
cgtggcctaactggaccccgtgga

SEQ ID NO: 336496 - DNA, 24 bp, Artificial Sequence
  Description of Artificial Sequence: Synthetic oligonucleotide
gtggcctaactggaccccgtggag

SEQ ID NO: 336497 - DNA, 25 bp, Artificial Sequence
  Description of Artificial Sequence: Synthetic oligonucleotide
tggcctaactggaccccgtggagct

SEQ ID NO: 336498 - DNA, 24 bp, Artificial Sequence
  Description of Artificial Sequence: Synthetic oligonucleotide
ggcctaactggaccccgtggagct

SEQ ID NO: 336499 - DNA, 25 bp, Artificial Sequence
  Description of Artificial Sequence: Synthetic oligonucleotide
gcctaactggaccccgtggagctca

SEQ ID NO: 336500 - DNA, 25 bp, Artificial Sequence
  Description of Artificial Sequence: Synthetic oligonucleotide
cctaactggaccccgtggagctcac

SEQ ID NO: 336501 - DNA, 25 bp, Artificial Sequence
  Description of Artificial Sequence: Synthetic oligonucleotide
ctaactggaccccgtggagctcacc

SEQ ID NO: 336502 - DNA, 26 bp, Artificial Sequence
  Description of Artificial Sequence: Synthetic oligonucleotide
taactggaccccgtggagctcaccga

SEQ ID NO: 336503 - DNA, 25 bp, Artificial Sequence
  Description of Artificial Sequence: Synthetic oligonucleotide
aactggaccccgtggagctcaccga

SEQ ID NO: 336504 - DNA, 24 bp, Artificial Sequence
  Description of Artificial Sequence: Synthetic oligonucleotide
actggaccccgtggagctcaccga

SEQ ID NO: 336505 - DNA, 23 bp, Artificial Sequence
  Description of Artificial Sequence: Synthetic oligonucleotide
ctggaccccgtggagctcaccga

SEQ ID NO: 336506 - DNA, 23 bp, Artificial Sequence
  Description of Artificial Sequence: Synthetic oligonucleotide
tggaccccgtggagctcaccgag

SEQ ID NO: 336507 - DNA, 22 bp, Artificial Sequence
  Description of Artificial Sequence: Synthetic oligonucleotide
ggaccccgtggagctcaccgag

SEQ ID NO: 336508 - DNA, 22 bp, Artificial Sequence
  Description of Artificial Sequence: Synthetic oligonucleotide
gaccccgtggagctcaccgagg

SEQ ID NO: 336509 - DNA, 22 bp, Artificial Sequence
  Description of Artificial Sequence: Synthetic oligonucleotide
accccgtggagctcaccgaggg

SEQ ID NO: 336510 - DNA, 21 bp, Artificial Sequence
  Description of Artificial Sequence: Synthetic oligonucleotide
ccccgtggagctcaccgaggg

SEQ ID NO: 336511 - DNA, 23 bp, Artificial Sequence
  Description of Artificial Sequence: Synthetic oligonucleotide
cccgtggagctcaccgaggggaa

SEQ ID NO: 336512 - DNA, 23 bp, Artificial Sequence
  Description of Artificial Sequence: Synthetic oligonucleotide
ccgtggagctcaccgaggggaac

SEQ ID NO: 336513 - DNA, 24 bp, Artificial Sequence
  Description of Artificial Sequence: Synthetic oligonucleotide
cgtggagctcaccgaggggaacgt

SEQ ID NO: 336514 - DNA, 24 bp, Artificial Sequence
  Description of Artificial Sequence: Synthetic oligonucleotide
gtggagctcaccgaggggaacgtg

SEQ ID NO: 336515 - DNA, 27 bp, Artificial Sequence
  Description of Artificial Sequence: Synthetic oligonucleotide
tggagctcaccgaggggaacgtgcttt

SEQ ID NO: 336516 - DNA, 26 bp, Artificial Sequence
  Description of Artificial Sequence: Synthetic oligonucleotide
ggagctcaccgaggggaacgtgcttt

SEQ ID NO: 336517 - DNA, 26 bp, Artificial Sequence
  Description of Artificial Sequence: Synthetic oligonucleotide
gagctcaccgaggggaacgtgctttc

SEQ ID NO: 336518 - DNA, 27 bp, Artificial Sequence
  Description of Artificial Sequence: Synthetic oligonucleotide
agctcaccgaggggaacgtgctttcca

SEQ ID NO: 336519 - DNA, 27 bp, Artificial Sequence
  Description of Artificial Sequence: Synthetic oligonucleotide
gctcaccgaggggaacgtgctttccat

SEQ ID NO: 336520 - DNA, 28 bp, Artificial Sequence
  Description of Artificial Sequence: Synthetic oligonucleotide
ctcaccgaggggaacgtgctttccatac

SEQ ID NO: 336521 - DNA, 28 bp, Artificial Sequence
  Description of Artificial Sequence: Synthetic oligonucleotide
tcaccgaggggaacgtgctttccatacc

SEQ ID NO: 336522 - DNA, 27 bp, Artificial Sequence
  Description of Artificial Sequence: Synthetic oligonucleotide
caccgaggggaacgtgctttccatacc

SEQ ID NO: 336523 - DNA, 28 bp, Artificial Sequence
  Description of Artificial Sequence: Synthetic oligonucleotide
accgaggggaacgtgctttccatacctc

SEQ ID NO: 336524 - DNA, 27 bp, Artificial Sequence
  Description of Artificial Sequence: Synthetic oligonucleotide
ccgaggggaacgtgctttccatacctc

SEQ ID NO: 336525 - DNA, 31 bp, Artificial Sequence
  Description of Artificial Sequence: Synthetic oligonucleotide
cgaggggaacgtgctttccatacctctaatc

SEQ ID NO: 336526 - DNA, 32 bp, Artificial Sequence
  Description of Artificial Sequence: Synthetic oligonucleotide
gaggggaacgtgctttccatacctctaatcag

SEQ ID NO: 336527 - DNA, 32 bp, Artificial Sequence
  Description of Artificial Sequence: Synthetic oligonucleotide
aggggaacgtgctttccatacctctaatcagc

SEQ ID NO: 336528 - DNA, 31 bp, Artificial Sequence
  Description of Artificial Sequence: Synthetic oligonucleotide
ggggaacgtgctttccatacctctaatcagc

SEQ ID NO: 336529 - DNA, 32 bp, Artificial Sequence
  Description of Artificial Sequence: Synthetic oligonucleotide
gggaacgtgctttccatacctctaatcagcag

SEQ ID NO: 336530 - DNA, 33 bp, Artificial Sequence
  Description of Artificial Sequence: Synthetic oligonucleotide
ggaacgtgctttccatacctctaatcagcagtg

SEQ ID NO: 336531 - DNA, 33 bp, Artificial Sequence
  Description of Artificial Sequence: Synthetic oligonucleotide
gaacgtgctttccatacctctaatcagcagtgc

SEQ ID NO: 336532 - DNA, 34 bp, Artificial Sequence
  Description of Artificial Sequence: Synthetic oligonucleotide
aacgtgctttccatacctctaatcagcagtgctg

SEQ ID NO: 336533 - DNA, 33 bp, Artificial Sequence
  Description of Artificial Sequence: Synthetic oligonucleotide
acgtgctttccatacctctaatcagcagtgctg

SEQ ID NO: 336534 - DNA, 32 bp, Artificial Sequence
  Description of Artificial Sequence: Synthetic oligonucleotide
cgtgctttccatacctctaatcagcagtgctg

SEQ ID NO: 336535 - DNA, 33 bp, Artificial Sequence
  Description of Artificial Sequence: Synthetic oligonucleotide
gtgctttccatacctctaatcagcagtgctgtc

SEQ ID NO: 336536 - DNA, 33 bp, Artificial Sequence
  Description of Artificial Sequence: Synthetic oligonucleotide
tgctttccatacctctaatcagcagtgctgtcg

SEQ ID NO: 336537 - DNA, 32 bp, Artificial Sequence
  Description of Artificial Sequence: Synthetic oligonucleotide
gctttccatacctctaatcagcagtgctgtcg

SEQ ID NO: 336538 - DNA, 33 bp, Artificial Sequence
  Description of Artificial Sequence: Synthetic oligonucleotide
ctttccatacctctaatcagcagtgctgtcgtg

SEQ ID NO: 336539 - DNA, 35 bp, Artificial Sequence
  Description of Artificial Sequence: Synthetic oligonucleotide
tttccatacctctaatcagcagtgctgtcgtgaac

SEQ ID NO: 336540 - DNA, 34 bp, Artificial Sequence
  Description of Artificial Sequence: Synthetic oligonucleotide
ttccatacctctaatcagcagtgctgtcgtgaac

SEQ ID NO: 336541 - DNA, 33 bp, Artificial Sequence
  Description of Artificial Sequence: Synthetic oligonucleotide
tccatacctctaatcagcagtgctgtcgtgaac

SEQ ID NO: 336542 - DNA, 32 bp, Artificial Sequence
  Description of Artificial Sequence: Synthetic oligonucleotide
ccatacctctaatcagcagtgctgtcgtgaac

SEQ ID NO: 336543 - DNA, 33 bp, Artificial Sequence
  Description of Artificial Sequence: Synthetic oligonucleotide
catacctctaatcagcagtgctgtcgtgaacag

SEQ ID NO: 336544 - DNA, 33 bp, Artificial Sequence
  Description of Artificial Sequence: Synthetic oligonucleotide
atacctctaatcagcagtgctgtcgtgaacagc

SEQ ID NO: 336545 - DNA, 32 bp, Artificial Sequence
  Description of Artificial Sequence: Synthetic oligonucleotide
tacctctaatcagcagtgctgtcgtgaacagc

SEQ ID NO: 336546 - DNA, 31 bp, Artificial Sequence
  Description of Artificial Sequence: Synthetic oligonucleotide
acctctaatcagcagtgctgtcgtgaacagc

SEQ ID NO: 336547 - DNA, 30 bp, Artificial Sequence
  Description of Artificial Sequence: Synthetic oligonucleotide
cctctaatcagcagtgctgtcgtgaacagc

SEQ ID NO: 336548 - DNA, 31 bp, Artificial Sequence
  Description of Artificial Sequence: Synthetic oligonucleotide
ctctaatcagcagtgctgtcgtgaacagctc

SEQ ID NO: 336549 - DNA, 31 bp, Artificial Sequence
  Description of Artificial Sequence: Synthetic oligonucleotide
tctaatcagcagtgctgtcgtgaacagctcc

SEQ ID NO: 336550 - DNA, 30 bp, Artificial Sequence
  Description of Artificial Sequence: Synthetic oligonucleotide
ctaatcagcagtgctgtcgtgaacagctcc

SEQ ID NO: 336551 - DNA, 30 bp, Artificial Sequence
  Description of Artificial Sequence: Synthetic oligonucleotide
taatcagcagtgctgtcgtgaacagctccg

SEQ ID NO: 336552 - DNA, 29 bp, Artificial Sequence
  Description of Artificial Sequence: Synthetic oligonucleotide
aatcagcagtgctgtcgtgaacagctccg

SEQ ID NO: 336553 - DNA, 28 bp, Artificial Sequence
  Description of Artificial Sequence: Synthetic oligonucleotide
atcagcagtgctgtcgtgaacagctccg

SEQ ID NO: 336554 - DNA, 27 bp, Artificial Sequence
  Description of Artificial Sequence: Synthetic oligonucleotide
tcagcagtgctgtcgtgaacagctccg

SEQ ID NO: 336555 - DNA, 27 bp, Artificial Sequence
  Description of Artificial Sequence: Synthetic oligonucleotide
cagcagtgctgtcgtgaacagctccgt

SEQ ID NO: 336556 - DNA, 27 bp, Artificial Sequence
  Description of Artificial Sequence: Synthetic oligonucleotide
agcagtgctgtcgtgaacagctccgtg

SEQ ID NO: 336557 - DNA, 26 bp, Artificial Sequence
  Description of Artificial Sequence: Synthetic oligonucleotide
gcagtgctgtcgtgaacagctccgtg

SEQ ID NO: 336558 - DNA, 27 bp, Artificial Sequence
  Description of Artificial Sequence: Synthetic oligonucleotide
cagtgctgtcgtgaacagctccgtgct

SEQ ID NO: 336559 - DNA, 27 bp, Artificial Sequence
  Description of Artificial Sequence: Synthetic oligonucleotide
agtgctgtcgtgaacagctccgtgctc

SEQ ID NO: 336560 - DNA, 26 bp, Artificial Sequence
  Description of Artificial Sequence: Synthetic oligonucleotide
gtgctgtcgtgaacagctccgtgctc

SEQ ID NO: 336561 - DNA, 26 bp, Artificial Sequence
  Description of Artificial Sequence: Synthetic oligonucleotide
tgctgtcgtgaacagctccgtgctcg

SEQ ID NO: 336562 - DNA, 25 bp, Artificial Sequence
  Description of Artificial Sequence: Synthetic oligonucleotide
gctgtcgtgaacagctccgtgctcg

SEQ ID NO: 336563 - DNA, 25 bp, Artificial Sequence
  Description of Artificial Sequence: Synthetic oligonucleotide
ctgtcgtgaacagctccgtgctcgg

SEQ ID NO: 336564 - DNA, 25 bp, Artificial Sequence
  Description of Artificial Sequence: Synthetic oligonucleotide
tgtcgtgaacagctccgtgctcggc

SEQ ID NO: 336565 - DNA, 24 bp, Artificial Sequence
  Description of Artificial Sequence: Synthetic oligonucleotide
gtcgtgaacagctccgtgctcggc

SEQ ID NO: 336566 - DNA, 25 bp, Artificial Sequence
  Description of Artificial Sequence: Synthetic oligonucleotide
tcgtgaacagctccgtgctcggcct

SEQ ID NO: 336567 - DNA, 24 bp, Artificial Sequence
  Description of Artificial Sequence: Synthetic oligonucleotide
cgtgaacagctccgtgctcggcct

SEQ ID NO: 336568 - DNA, 24 bp, Artificial Sequence
  Description of Artificial Sequence: Synthetic oligonucleotide
gtgaacagctccgtgctcggcctg

SEQ ID NO: 336569 - DNA, 24 bp, Artificial Sequence
  Description of Artificial Sequence: Synthetic oligonucleotide
tgaacagctccgtgctcggcctgc

SEQ ID NO: 336570 - DNA, 23 bp, Artificial Sequence
  Description of Artificial Sequence: Synthetic oligonucleotide
gaacagctccgtgctcggcctgc

SEQ ID NO: 336571 - DNA, 23 bp, Artificial Sequence
  Description of Artificial Sequence: Synthetic oligonucleotide
aacagctccgtgctcggcctgcc

SEQ ID NO: 336572 - DNA, 22 bp, Artificial Sequence
  Description of Artificial Sequence: Synthetic oligonucleotide
acagctccgtgctcggcctgcc

SEQ ID NO: 336573 - DNA, 21 bp, Artificial Sequence
  Description of Artificial Sequence: Synthetic oligonucleotide
cagctccgtgctcggcctgcc

SEQ ID NO: 336574 - DNA, 22 bp, Artificial Sequence
  Description of Artificial Sequence: Synthetic oligonucleotide
agctccgtgctcggcctgccga

SEQ ID NO: 336575 - DNA, 21 bp, Artificial Sequence
  Description of Artificial Sequence: Synthetic oligonucleotide
gctccgtgctcggcctgccga

SEQ ID NO: 336576 - DNA, 21 bp, Artificial Sequence
  Description of Artificial Sequence: Synthetic oligonucleotide
ctccgtgctcggcctgccgac

SEQ ID NO: 336577 - DNA, 21 bp, Artificial Sequence
  Description of Artificial Sequence: Synthetic oligonucleotide
tccgtgctcggcctgccgacc

SEQ ID NO: 336578 - DNA, 20 bp, Artificial Sequence
  Description of Artificial Sequence: Synthetic oligonucleotide
ccgtgctcggcctgccgacc

SEQ ID NO: 336579 - DNA, 20 bp, Artificial Sequence
  Description of Artificial Sequence: Synthetic oligonucleotide
cgtgctcggcctgccgaccc

SEQ ID NO: 336580 - DNA, 21 bp, Artificial Sequence
  Description of Artificial Sequence: Synthetic oligonucleotide
gtgctcggcctgccgacccct

SEQ ID NO: 336581 - DNA, 21 bp, Artificial Sequence
  Description of Artificial Sequence: Synthetic oligonucleotide
tgctcggcctgccgacccctg

SEQ ID NO: 336582 - DNA, 20 bp, Artificial Sequence
  Description of Artificial Sequence: Synthetic oligonucleotide
gctcggcctgccgacccctg

SEQ ID NO: 336583 - DNA, 20 bp, Artificial Sequence
  Description of Artificial Sequence: Synthetic oligonucleotide
ctcggcctgccgacccctgc

SEQ ID NO: 336584 - DNA, 20 bp, Artificial Sequence
  Description of Artificial Sequence: Synthetic oligonucleotide
tcggcctgccgacccctgcc

SEQ ID NO: 336585 - DNA, 20 bp, Artificial Sequence
  Description of Artificial Sequence: Synthetic oligonucleotide
cggcctgccgacccctgcct

SEQ ID NO: 336586 - DNA, 21 bp, Artificial Sequence
  Description of Artificial Sequence: Synthetic oligonucleotide
ggcctgccgacccctgccgta

SEQ ID NO: 336587 - DNA, 21 bp, Artificial Sequence
  Description of Artificial Sequence: Synthetic oligonucleotide
gcctgccgacccctgccgtac

SEQ ID NO: 336588 - DNA, 21 bp, Artificial Sequence
  Description of Artificial Sequence: Synthetic oligonucleotide
cctgccgacccctgccgtacg

SEQ ID NO: 336589 - DNA, 22 bp, Artificial Sequence
  Description of Artificial Sequence: Synthetic oligonucleotide
ctgccgacccctgccgtacgct

SEQ ID NO: 336590 - DNA, 22 bp, Artificial Sequence
  Description of Artificial Sequence: Synthetic oligonucleotide
tgccgacccctgccgtacgctg

SEQ ID NO: 336591 - DNA, 21 bp, Artificial Sequence
  Description of Artificial Sequence: Synthetic oligonucleotide
gccgacccctgccgtacgctg

SEQ ID NO: 336592 - DNA, 22 bp, Artificial Sequence
  Description of Artificial Sequence: Synthetic oligonucleotide
ccgacccctgccgtacgctgga

SEQ ID NO: 336593 - DNA, 22 bp, Artificial Sequence
  Description of Artificial Sequence: Synthetic oligonucleotide
cgacccctgccgtacgctggag

SEQ ID NO: 336594 - DNA, 24 bp, Artificial Sequence
  Description of Artificial Sequence: Synthetic oligonucleotide
gacccctgccgtacgctggagcaa

SEQ ID NO: 336595 - DNA, 24 bp, Artificial Sequence
  Description of Artificial Sequence: Synthetic oligonucleotide
acccctgccgtacgctggagcaag

SEQ ID NO: 336596 - DNA, 23 bp, Artificial Sequence
  Description of Artificial Sequence: Synthetic oligonucleotide
cccctgccgtacgctggagcaag

SEQ ID NO: 336597 - DNA, 24 bp, Artificial Sequence
  Description of Artificial Sequence: Synthetic oligonucleotide
ccctgccgtacgctggagcaagga

SEQ ID NO: 336598 - DNA, 25 bp, Artificial Sequence
  Description of Artificial Sequence: Synthetic oligonucleotide
cctgccgtacgctggagcaaggact

SEQ ID NO: 336599 - DNA, 25 bp, Artificial Sequence
  Description of Artificial Sequence: Synthetic oligonucleotide
ctgccgtacgctggagcaaggactc

SEQ ID NO: 336600 - DNA, 26 bp, Artificial Sequence
  Description of Artificial Sequence: Synthetic oligonucleotide
tgccgtacgctggagcaaggactcga

SEQ ID NO: 336601 - DNA, 25 bp, Artificial Sequence
  Description of Artificial Sequence: Synthetic oligonucleotide
gccgtacgctggagcaaggactcga

SEQ ID NO: 336602 - DNA, 26 bp, Artificial Sequence
  Description of Artificial Sequence: Synthetic oligonucleotide
ccgtacgctggagcaaggactcgact

SEQ ID NO: 336603 - DNA, 26 bp, Artificial Sequence
  Description of Artificial Sequence: Synthetic oligonucleotide
cgtacgctggagcaaggactcgactc

SEQ ID NO: 336604 - DNA, 26 bp, Artificial Sequence
  Description of Artificial Sequence: Synthetic oligonucleotide
gtacgctggagcaaggactcgactcc

SEQ ID NO: 336605 - DNA, 26 bp, Artificial Sequence
  Description of Artificial Sequence: Synthetic oligonucleotide
tacgctggagcaaggactcgactccc

SEQ ID NO: 336606 - DNA, 25 bp, Artificial Sequence
  Description of Artificial Sequence: Synthetic oligonucleotide
acgctggagcaaggactcgactccc

SEQ ID NO: 336607 - DNA, 24 bp, Artificial Sequence
  Description of Artificial Sequence: Synthetic oligonucleotide
cgctggagcaaggactcgactccc

SEQ ID NO: 336608 - DNA, 25 bp, Artificial Sequence
  Description of Artificial Sequence: Synthetic oligonucleotide
gctggagcaaggactcgactcccct

SEQ ID NO: 336609 - DNA, 25 bp, Artificial Sequence
  Description of Artificial Sequence: Synthetic oligonucleotide
ctggagcaaggactcgactcccctg

SEQ ID NO: 336610 - DNA, 25 bp, Artificial Sequence
  Description of Artificial Sequence: Synthetic oligonucleotide
tggagcaaggactcgactcccctgc

SEQ ID NO: 336611 - DNA, 24 bp, Artificial Sequence
  Description of Artificial Sequence: Synthetic oligonucleotide
ggagcaaggactcgactcccctgc

SEQ ID NO: 336612 - DNA, 24 bp, Artificial Sequence
  Description of Artificial Sequence: Synthetic oligonucleotide
gagcaaggactcgactcccctgcg

SEQ ID NO: 336613 - DNA, 24 bp, Artificial Sequence
  Description of Artificial Sequence: Synthetic oligonucleotide
agcaaggactcgactcccctgcgc

SEQ ID NO: 336614 - DNA, 23 bp, Artificial Sequence
  Description of Artificial Sequence: Synthetic oligonucleotide
gcaaggactcgactcccctgcgc

SEQ ID NO: 336615 - DNA, 25 bp, Artificial Sequence
  Description of Artificial Sequence: Synthetic oligonucleotide
caaggactcgactcccctgcgcgat

SEQ ID NO: 336616 - DNA, 25 bp, Artificial Sequence
  Description of Artificial Sequence: Synthetic oligonucleotide
aaggactcgactcccctgcgcgatg

SEQ ID NO: 336617 - DNA, 24 bp, Artificial Sequence
  Description of Artificial Sequence: Synthetic oligonucleotide
aggactcgactcccctgcgcgatg

SEQ ID NO: 336618 - DNA, 23 bp, Artificial Sequence
  Description of Artificial Sequence: Synthetic oligonucleotide
ggactcgactcccctgcgcgatg

SEQ ID NO: 336619 - DNA, 23 bp, Artificial Sequence
  Description of Artificial Sequence: Synthetic oligonucleotide
gactcgactcccctgcgcgatgg

SEQ ID NO: 336620 - DNA, 23 bp, Artificial Sequence
  Description of Artificial Sequence: Synthetic oligonucleotide
actcgactcccctgcgcgatggc

SEQ ID NO: 336621 - DNA, 22 bp, Artificial Sequence
  Description of Artificial Sequence: Synthetic oligonucleotide
ctcgactcccctgcgcgatggc

SEQ ID NO: 336622 - DNA, 22 bp, Artificial Sequence
  Description of Artificial Sequence: Synthetic oligonucleotide
tcgactcccctgcgcgatggcc

SEQ ID NO: 336623 - DNA, 21 bp, Artificial Sequence
  Description of Artificial Sequence: Synthetic oligonucleotide
cgactcccctgcgcgatggcc

SEQ ID NO: 336624 - DNA, 21 bp, Artificial Sequence
  Description of Artificial Sequence: Synthetic oligonucleotide
gactcccctgcgcgatggccg

SEQ ID NO: 336625 - DNA, 23 bp, Artificial Sequence
  Description of Artificial Sequence: Synthetic oligonucleotide
actcccctgcgcgatggccgcat

SEQ ID NO: 336626 - DNA, 22 bp, Artificial Sequence
  Description of Artificial Sequence: Synthetic oligonucleotide
ctcccctgcgcgatggccgcat

SEQ ID NO: 336627 - DNA, 22 bp, Artificial Sequence
  Description of Artificial Sequence: Synthetic oligonucleotide
tcccctgcgcgatggccgcatg

SEQ ID NO: 336628 - DNA, 21 bp, Artificial Sequence
  Description of Artificial Sequence: Synthetic oligonucleotide
cccctgcgcgatggccgcatg

SEQ ID NO: 336629 - DNA, 22 bp, Artificial Sequence
  Description of Artificial Sequence: Synthetic oligonucleotide
ccctgcgcgatggccgcatgct

SEQ ID NO: 336630 - DNA, 23 bp, Artificial Sequence
  Description of Artificial Sequence: Synthetic oligonucleotide
cctgcgcgatggccgcatgctgt

SEQ ID NO: 336631 - DNA, 23 bp, Artificial Sequence
  Description of Artificial Sequence: Synthetic oligonucleotide
ctgcgcgatggccgcatgctgtc

SEQ ID NO: 336632 - DNA, 23 bp, Artificial Sequence
  Description of Artificial Sequence: Synthetic oligonucleotide
tgcgcgatggccgcatgctgtcc

SEQ ID NO: 336633 - DNA, 22 bp, Artificial Sequence
  Description of Artificial Sequence: Synthetic oligonucleotide
gcgcgatggccgcatgctgtcc

SEQ ID NO: 336634 - DNA, 23 bp, Artificial Sequence
  Description of Artificial Sequence: Synthetic oligonucleotide
cgcgatggccgcatgctgtccct

SEQ ID NO: 336635 - DNA, 24 bp, Artificial Sequence
  Description of Artificial Sequence: Synthetic oligonucleotide
gcgatggccgcatgctgtccctca

SEQ ID NO: 336636 - DNA, 26 bp, Artificial Sequence
  Description of Artificial Sequence: Synthetic oligonucleotide
cgatggccgcatgctgtccctcagtt

SEQ ID NO: 336637 - DNA, 27 bp, Artificial Sequence
  Description of Artificial Sequence: Synthetic oligonucleotide
gatggccgcatgctgtccctcagttct

SEQ ID NO: 336638 - DNA, 29 bp, Artificial Sequence
  Description of Artificial Sequence: Synthetic oligonucleotide
atggccgcatgctgtccctcagttctttc

SEQ ID NO: 336639 - DNA, 28 bp, Artificial Sequence
  Description of Artificial Sequence: Synthetic oligonucleotide
tggccgcatgctgtccctcagttctttc

SEQ ID NO: 336640 - DNA, 27 bp, Artificial Sequence
  Description of Artificial Sequence: Synthetic oligonucleotide
ggccgcatgctgtccctcagttctttc

SEQ ID NO: 336641 - DNA, 28 bp, Artificial Sequence
  Description of Artificial Sequence: Synthetic oligonucleotide
gccgcatgctgtccctcagttctttcac

SEQ ID NO: 336642 - DNA, 28 bp, Artificial Sequence
  Description of Artificial Sequence: Synthetic oligonucleotide
ccgcatgctgtccctcagttctttcacc

SEQ ID NO: 336643 - DNA, 30 bp, Artificial Sequence
  Description of Artificial Sequence: Synthetic oligonucleotide
cgcatgctgtccctcagttctttcaccttc

SEQ ID NO: 336644 - DNA, 30 bp, Artificial Sequence
  Description of Artificial Sequence: Synthetic oligonucleotide
gcatgctgtccctcagttctttcaccttcg

SEQ ID NO: 336645 - DNA, 33 bp, Artificial Sequence
  Description of Artificial Sequence: Synthetic oligonucleotide
catgctgtccctcagttctttcaccttcgtttc

SEQ ID NO: 336646 - DNA, 33 bp, Artificial Sequence
  Description of Artificial Sequence: Synthetic oligonucleotide
atgctgtccctcagttctttcaccttcgtttcc

SEQ ID NO: 336647 - DNA, 32 bp, Artificial Sequence
  Description of Artificial Sequence: Synthetic oligonucleotide
tgctgtccctcagttctttcaccttcgtttcc

SEQ ID NO: 336648 - DNA, 31 bp, Artificial Sequence
  Description of Artificial Sequence: Synthetic oligonucleotide
gctgtccctcagttctttcaccttcgtttcc

SEQ ID NO: 336649 - DNA, 34 bp, Artificial Sequence
  Description of Artificial Sequence: Synthetic oligonucleotide
ctgtccctcagttctttcaccttcgtttccaatg

SEQ ID NO: 336650 - DNA, 34 bp, Artificial Sequence
  Description of Artificial Sequence: Synthetic oligonucleotide
tgtccctcagttctttcaccttcgtttccaatgg

SEQ ID NO: 336651 - DNA, 33 bp, Artificial Sequence
  Description of Artificial Sequence: Synthetic oligonucleotide
gtccctcagttctttcaccttcgtttccaatgg

SEQ ID NO: 336652 - DNA, 33 bp, Artificial Sequence
  Description of Artificial Sequence: Synthetic oligonucleotide
tccctcagttctttcaccttcgtttccaatggg

SEQ ID NO: 336653 - DNA, 32 bp, Artificial Sequence
  Description of Artificial Sequence: Synthetic oligonucleotide
ccctcagttctttcaccttcgtttccaatggg

SEQ ID NO: 336654 - DNA, 33 bp, Artificial Sequence
  Description of Artificial Sequence: Synthetic oligonucleotide
cctcagttctttcaccttcgtttccaatgggac

SEQ ID NO: 336655 - DNA, 33 bp, Artificial Sequence
  Description of Artificial Sequence: Synthetic oligonucleotide
ctcagttctttcaccttcgtttccaatgggacc

SEQ ID NO: 336656 - DNA, 35 bp, Artificial Sequence
  Description of Artificial Sequence: Synthetic oligonucleotide
tcagttctttcaccttcgtttccaatgggacctac

SEQ ID NO: 336657 - DNA, 34 bp, Artificial Sequence
  Description of Artificial Sequence: Synthetic oligonucleotide
cagttctttcaccttcgtttccaatgggacctac

SEQ ID NO: 336658 - DNA, 34 bp, Artificial Sequence
  Description of Artificial Sequence: Synthetic oligonucleotide
agttctttcaccttcgtttccaatgggacctacg

SEQ ID NO: 336659 - DNA, 33 bp, Artificial Sequence
  Description of Artificial Sequence: Synthetic oligonucleotide
gttctttcaccttcgtttccaatgggacctacg

SEQ ID NO: 336660 - DNA, 36 bp, Artificial Sequence
  Description of Artificial Sequence: Synthetic oligonucleotide
ttctttcaccttcgtttccaatgggacctacgtaag

SEQ ID NO: 336661 - DNA, 35 bp, Artificial Sequence
  Description of Artificial Sequence: Synthetic oligonucleotide
tctttcaccttcgtttccaatgggacctacgtaag

SEQ ID NO: 336662 - DNA, 34 bp, Artificial Sequence
  Description of Artificial Sequence: Synthetic oligonucleotide
ctttcaccttcgtttccaatgggacctacgtaag

SEQ ID NO: 336663 - DNA, 35 bp, Artificial Sequence
  Description of Artificial Sequence: Synthetic oligonucleotide
tttcaccttcgtttccaatgggacctacgtaagtg

SEQ ID NO: 336664 - DNA, 34 bp, Artificial Sequence
  Description of Artificial Sequence: Synthetic oligonucleotide
ttcaccttcgtttccaatgggacctacgtaagtg

SEQ ID NO: 336665 - DNA, 33 bp, Artificial Sequence
  Description of Artificial Sequence: Synthetic oligonucleotide
tcaccttcgtttccaatgggacctacgtaagtg

SEQ ID NO: 336666 - DNA, 32 bp, Artificial Sequence
  Description of Artificial Sequence: Synthetic oligonucleotide
caccttcgtttccaatgggacctacgtaagtg

SEQ ID NO: 336667 - DNA, 33 bp, Artificial Sequence
  Description of Artificial Sequence: Synthetic oligonucleotide
accttcgtttccaatgggacctacgtaagtgag

SEQ ID NO: 336668 - DNA, 32 bp, Artificial Sequence
  Description of Artificial Sequence: Synthetic oligonucleotide
ccttcgtttccaatgggacctacgtaagtgag

SEQ ID NO: 336669 - DNA, 32 bp, Artificial Sequence
  Description of Artificial Sequence: Synthetic oligonucleotide
cttcgtttccaatgggacctacgtaagtgagg

SEQ ID NO: 336670 - DNA, 32 bp, Artificial Sequence
  Description of Artificial Sequence: Synthetic oligonucleotide
ttcgtttccaatgggacctacgtaagtgaggc

SEQ ID NO: 336671 - DNA, 31 bp, Artificial Sequence
  Description of Artificial Sequence: Synthetic oligonucleotide
tcgtttccaatgggacctacgtaagtgaggc

SEQ ID NO: 336672 - DNA, 30 bp, Artificial Sequence
  Description of Artificial Sequence: Synthetic oligonucleotide
cgtttccaatgggacctacgtaagtgaggc

SEQ ID NO: 336673 - DNA, 30 bp, Artificial Sequence
  Description of Artificial Sequence: Synthetic oligonucleotide
gtttccaatgggacctacgtaagtgaggcc

SEQ ID NO: 336674 - DNA, 31 bp, Artificial Sequence
  Description of Artificial Sequence: Synthetic oligonucleotide
tttccaatgggacctacgtaagtgaggcctg

SEQ ID NO: 336675 - DNA, 30 bp, Artificial Sequence
  Description of Artificial Sequence: Synthetic oligonucleotide
ttccaatgggacctacgtaagtgaggcctg

SEQ ID NO: 336676 - DNA, 29 bp, Artificial Sequence
  Description of Artificial Sequence: Synthetic oligonucleotide
tccaatgggacctacgtaagtgaggcctg

SEQ ID NO: 336677 - DNA, 28 bp, Artificial Sequence
  Description of Artificial Sequence: Synthetic oligonucleotide
ccaatgggacctacgtaagtgaggcctg

SEQ ID NO: 336678 - DNA, 28 bp, Artificial Sequence
  Description of Artificial Sequence: Synthetic oligonucleotide
caatgggacctacgtaagtgaggcctgc

SEQ ID NO: 336679 - DNA, 28 bp, Artificial Sequence
  Description of Artificial Sequence: Synthetic oligonucleotide
aatgggacctacgtaagtgaggcctgcc

SEQ ID NO: 336680 - DNA, 27 bp, Artificial Sequence
  Description of Artificial Sequence: Synthetic oligonucleotide
atgggacctacgtaagtgaggcctgcc

SEQ ID NO: 336681 - DNA, 27 bp, Artificial Sequence
  Description of Artificial Sequence: Synthetic oligonucleotide
tgggacctacgtaagtgaggcctgcct

SEQ ID NO: 336682 - DNA, 26 bp, Artificial Sequence
  Description of Artificial Sequence: Synthetic oligonucleotide
gggacctacgtaagtgaggcctgcct

SEQ ID NO: 336683 - DNA, 26 bp, Artificial Sequence
  Description of Artificial Sequence: Synthetic oligonucleotide
ggacctacgtaagtgaggcctgcctg

SEQ ID NO: 336684 - DNA, 26 bp, Artificial Sequence
  Description of Artificial Sequence: Synthetic oligonucleotide
gacctacgtaagtgaggcctgcctgc

SEQ ID NO: 336685 - DNA, 26 bp, Artificial Sequence
  Description of Artificial Sequence: Synthetic oligonucleotide
acctacgtaagtgaggcctgcctgcc

SEQ ID NO: 336686 - DNA, 25 bp, Artificial Sequence
  Description of Artificial Sequence: Synthetic oligonucleotide
cctacgtaagtgaggcctgcctgcc

SEQ ID NO: 336687 - DNA, 26 bp, Artificial Sequence
  Description of Artificial Sequence: Synthetic oligonucleotide
ctacgtaagtgaggcctgcctgccca

SEQ ID NO: 336688 - DNA, 27 bp, Artificial Sequence
  Description of Artificial Sequence: Synthetic oligonucleotide
tacgtaagtgaggcctgcctgcccact

SEQ ID NO: 336689 - DNA, 26 bp, Artificial Sequence
  Description of Artificial Sequence: Synthetic oligonucleotide
acgtaagtgaggcctgcctgcccact

SEQ ID NO: 336690 - DNA, 25 bp, Artificial Sequence
  Description of Artificial Sequence: Synthetic oligonucleotide
cgtaagtgaggcctgcctgcccact

SEQ ID NO: 336691 - DNA, 26 bp, Artificial Sequence
  Description of Artificial Sequence: Synthetic oligonucleotide
gtaagtgaggcctgcctgcccactgt

SEQ ID NO: 336692 - DNA, 26 bp, Artificial Sequence
  Description of Artificial Sequence: Synthetic oligonucleotide
taagtgaggcctgcctgcccactgtc

SEQ ID NO: 336693 - DNA, 25 bp, Artificial Sequence
  Description of Artificial Sequence: Synthetic oligonucleotide
aagtgaggcctgcctgcccactgtc

SEQ ID NO: 336694 - DNA, 24 bp, Artificial Sequence
  Description of Artificial Sequence: Synthetic oligonucleotide
agtgaggcctgcctgcccactgtc

SEQ ID NO: 336695 - DNA, 23 bp, Artificial Sequence
  Description of Artificial Sequence: Synthetic oligonucleotide
gtgaggcctgcctgcccactgtc

SEQ ID NO: 336696 - DNA, 23 bp, Artificial Sequence
  Description of Artificial Sequence: Synthetic oligonucleotide
tgaggcctgcctgcccactgtcc

SEQ ID NO: 336697 - DNA, 22 bp, Artificial Sequence
  Description of Artificial Sequence: Synthetic oligonucleotide
gaggcctgcctgcccactgtcc

SEQ ID NO: 336698 - DNA, 22 bp, Artificial Sequence
  Description of Artificial Sequence: Synthetic oligonucleotide
aggcctgcctgcccactgtccc

SEQ ID NO: 336699 - DNA, 21 bp, Artificial Sequence
  Description of Artificial Sequence: Synthetic oligonucleotide
ggcctgcctgcccactgtccc

SEQ ID NO: 336700 - DNA, 21 bp, Artificial Sequence
  Description of Artificial Sequence: Synthetic oligonucleotide
gcctgcctgcccactgtcccg

SEQ ID NO: 336701 - DNA, 22 bp, Artificial Sequence
  Description of Artificial Sequence: Synthetic oligonucleotide
cctgcctgcccactgtcccggt

SEQ ID NO: 336702 - DNA, 22 bp, Artificial Sequence
  Description of Artificial Sequence: Synthetic oligonucleotide
ctgcctgcccactgtcccggtc

SEQ ID NO: 336703 - DNA, 23 bp, Artificial Sequence
  Description of Artificial Sequence: Synthetic oligonucleotide
tgcctgcccactgtcccggtcgt

SEQ ID NO: 336704 - DNA, 22 bp, Artificial Sequence
  Description of Artificial Sequence: Synthetic oligonucleotide
gcctgcccactgtcccggtcgt

SEQ ID NO: 336705 - DNA, 23 bp, Artificial Sequence
  Description of Artificial Sequence: Synthetic oligonucleotide
cctgcccactgtcccggtcgtca

SEQ ID NO: 336706 - DNA, 23 bp, Artificial Sequence
  Description of Artificial Sequence: Synthetic oligonucleotide
ctgcccactgtcccggtcgtcag

SEQ ID NO: 336707 - DNA, 23 bp, Artificial Sequence
  Description of Artificial Sequence: Synthetic oligonucleotide
tgcccactgtcccggtcgtcagc

SEQ ID NO: 336708 - DNA, 22 bp, Artificial Sequence
  Description of Artificial Sequence: Synthetic oligonucleotide
gcccactgtcccggtcgtcagc

SEQ ID NO: 336709 - DNA, 22 bp, Artificial Sequence
  Description of Artificial Sequence: Synthetic oligonucleotide
cccactgtcccggtcgtcagcc

SEQ ID NO: 336710 - DNA, 22 bp, Artificial Sequence
  Description of Artificial Sequence: Synthetic oligonucleotide
ccactgtcccggtcgtcagccg

SEQ ID NO: 336711 - DNA, 23 bp, Artificial Sequence
  Description of Artificial Sequence: Synthetic oligonucleotide
cactgtcccggtcgtcagccgca

SEQ ID NO: 336712 - DNA, 23 bp, Artificial Sequence
  Description of Artificial Sequence: Synthetic oligonucleotide
actgtcccggtcgtcagccgcag

SEQ ID NO: 336713 - DNA, 22 bp, Artificial Sequence
  Description of Artificial Sequence: Synthetic oligonucleotide
ctgtcccggtcgtcagccgcag

SEQ ID NO: 336714 - DNA, 22 bp, Artificial Sequence
  Description of Artificial Sequence: Synthetic oligonucleotide
tgtcccggtcgtcagccgcagc

SEQ ID NO: 336715 - DNA, 21 bp, Artificial Sequence
  Description of Artificial Sequence: Synthetic oligonucleotide
gtcccggtcgtcagccgcagc

SEQ ID NO: 336716 - DNA, 22 bp, Artificial Sequence
  Description of Artificial Sequence: Synthetic oligonucleotide
tcccggtcgtcagccgcagcca

SEQ ID NO: 336717 - DNA, 21 bp, Artificial Sequence
  Description of Artificial Sequence: Synthetic oligonucleotide
cccggtcgtcagccgcagcca

SEQ ID NO: 336718 - DNA, 23 bp, Artificial Sequence
  Description of Artificial Sequence: Synthetic oligonucleotide
ccggtcgtcagccgcagccagaa

SEQ ID NO: 336719 - DNA, 25 bp, Artificial Sequence
  Description of Artificial Sequence: Synthetic oligonucleotide
cggtcgtcagccgcagccagaactt

SEQ ID NO: 336720 - DNA, 26 bp, Artificial Sequence
  Description of Artificial Sequence: Synthetic oligonucleotide
ggtcgtcagccgcagccagaacttga

SEQ ID NO: 336721 - DNA, 26 bp, Artificial Sequence
  Description of Artificial Sequence: Synthetic oligonucleotide
gtcgtcagccgcagccagaacttgac

SEQ ID NO: 336722 - DNA, 26 bp, Artificial Sequence
  Description of Artificial Sequence: Synthetic oligonucleotide
tcgtcagccgcagccagaacttgacg

SEQ ID NO: 336723 - DNA, 25 bp, Artificial Sequence
  Description of Artificial Sequence: Synthetic oligonucleotide
cgtcagccgcagccagaacttgacg

SEQ ID NO: 336724 - DNA, 26 bp, Artificial Sequence
  Description of Artificial Sequence: Synthetic oligonucleotide
gtcagccgcagccagaacttgacgct

SEQ ID NO: 336725 - DNA, 26 bp, Artificial Sequence
  Description of Artificial Sequence: Synthetic oligonucleotide
tcagccgcagccagaacttgacgctg

SEQ ID NO: 336726 - DNA, 25 bp, Artificial Sequence
  Description of Artificial Sequence: Synthetic oligonucleotide
cagccgcagccagaacttgacgctg

SEQ ID NO: 336727 - DNA, 26 bp, Artificial Sequence
  Description of Artificial Sequence: Synthetic oligonucleotide
agccgcagccagaacttgacgctgct

SEQ ID NO: 336728 - DNA, 25 bp, Artificial Sequence
  Description of Artificial Sequence: Synthetic oligonucleotide
gccgcagccagaacttgacgctgct

SEQ ID NO: 336729 - DNA, 25 bp, Artificial Sequence
  Description of Artificial Sequence: Synthetic oligonucleotide
ccgcagccagaacttgacgctgctg

SEQ ID NO: 336730 - DNA, 26 bp, Artificial Sequence
  Description of Artificial Sequence: Synthetic oligonucleotide
cgcagccagaacttgacgctgctgct

SEQ ID NO: 336731 - DNA, 26 bp, Artificial Sequence
  Description of Artificial Sequence: Synthetic oligonucleotide
gcagccagaacttgacgctgctgctc

SEQ ID NO: 336732 - DNA, 27 bp, Artificial Sequence
  Description of Artificial Sequence: Synthetic oligonucleotide
cagccagaacttgacgctgctgctcca

SEQ ID NO: 336733 - DNA, 28 bp, Artificial Sequence
  Description of Artificial Sequence: Synthetic oligonucleotide
agccagaacttgacgctgctgctccaag

SEQ ID NO: 336734 - DNA, 27 bp, Artificial Sequence
  Description of Artificial Sequence: Synthetic oligonucleotide
gccagaacttgacgctgctgctccaag

SEQ ID NO: 336735 - DNA, 27 bp, Artificial Sequence
  Description of Artificial Sequence: Synthetic oligonucleotide
ccagaacttgacgctgctgctccaagg

SEQ ID NO: 336736 - DNA, 27 bp, Artificial Sequence
  Description of Artificial Sequence: Synthetic oligonucleotide
cagaacttgacgctgctgctccaaggc

SEQ ID NO: 336737 - DNA, 28 bp, Artificial Sequence
  Description of Artificial Sequence: Synthetic oligonucleotide
agaacttgacgctgctgctccaaggctg

SEQ ID NO: 336738 - DNA, 27 bp, Artificial Sequence
  Description of Artificial Sequence: Synthetic oligonucleotide
gaacttgacgctgctgctccaaggctg

SEQ ID NO: 336739 - DNA, 27 bp, Artificial Sequence
  Description of Artificial Sequence: Synthetic oligonucleotide
aacttgacgctgctgctccaaggctgg

SEQ ID NO: 336740 - DNA, 26 bp, Artificial Sequence
  Description of Artificial Sequence: Synthetic oligonucleotide
acttgacgctgctgctccaaggctgg

SEQ ID NO: 336741 - DNA, 25 bp, Artificial Sequence
  Description of Artificial Sequence: Synthetic oligonucleotide
cttgacgctgctgctccaaggctgg

SEQ ID NO: 336742 - DNA, 25 bp, Artificial Sequence
  Description of Artificial Sequence: Synthetic oligonucleotide
ttgacgctgctgctccaaggctggc

SEQ ID NO: 336743 - DNA, 24 bp, Artificial Sequence
  Description of Artificial Sequence: Synthetic oligonucleotide
tgacgctgctgctccaaggctggc

SEQ ID NO: 336744 - DNA, 23 bp, Artificial Sequence
  Description of Artificial Sequence: Synthetic oligonucleotide
gacgctgctgctccaaggctggc

SEQ ID NO: 336745 - DNA, 24 bp, Artificial Sequence
  Description of Artificial Sequence: Synthetic oligonucleotide
acgctgctgctccaaggctggcca

SEQ ID NO: 336746 - DNA, 23 bp, Artificial Sequence
  Description of Artificial Sequence: Synthetic oligonucleotide
cgctgctgctccaaggctggcca

SEQ ID NO: 336747 - DNA, 24 bp, Artificial Sequence
  Description of Artificial Sequence: Synthetic oligonucleotide
gctgctgctccaaggctggccaga

SEQ ID NO: 336748 - DNA, 24 bp, Artificial Sequence
  Description of Artificial Sequence: Synthetic oligonucleotide
ctgctgctccaaggctggccagag

SEQ ID NO: 336749 - DNA, 27 bp, Artificial Sequence
  Description of Artificial Sequence: Synthetic oligonucleotide
tgctgctccaaggctggccagagctta

SEQ ID NO: 336750 - DNA, 27 bp, Artificial Sequence
  Description of Artificial Sequence: Synthetic oligonucleotide
gctgctccaaggctggccagagcttaa

SEQ ID NO: 336751 - DNA, 27 bp, Artificial Sequence
  Description of Artificial Sequence: Synthetic oligonucleotide
ctgctccaaggctggccagagcttaag

SEQ ID NO: 336752 - DNA, 28 bp, Artificial Sequence
  Description of Artificial Sequence: Synthetic oligonucleotide
tgctccaaggctggccagagcttaagac

SEQ ID NO: 336753 - DNA, 27 bp, Artificial Sequence
  Description of Artificial Sequence: Synthetic oligonucleotide
gctccaaggctggccagagcttaagac

SEQ ID NO: 336754 - DNA, 28 bp, Artificial Sequence
  Description of Artificial Sequence: Synthetic oligonucleotide
ctccaaggctggccagagcttaagacag

SEQ ID NO: 336755 - DNA, 28 bp, Artificial Sequence
  Description of Artificial Sequence: Synthetic oligonucleotide
tccaaggctggccagagcttaagacagc

SEQ ID NO: 336756 - DNA, 27 bp, Artificial Sequence
  Description of Artificial Sequence: Synthetic oligonucleotide
ccaaggctggccagagcttaagacagc

SEQ ID NO: 336757 - DNA, 27 bp, Artificial Sequence
  Description of Artificial Sequence: Synthetic oligonucleotide
caaggctggccagagcttaagacagcg

SEQ ID NO: 336758 - DNA, 27 bp, Artificial Sequence
  Description of Artificial Sequence: Synthetic oligonucleotide
aaggctggccagagcttaagacagcgc

SEQ ID NO: 336759 - DNA, 27 bp, Artificial Sequence
  Description of Artificial Sequence: Synthetic oligonucleotide
aggctggccagagcttaagacagcgca

SEQ ID NO: 336760 - DNA, 27 bp, Artificial Sequence
  Description of Artificial Sequence: Synthetic oligonucleotide
ggctggccagagcttaagacagcgcaa

SEQ ID NO: 336761 - DNA, 30 bp, Artificial Sequence
  Description of Artificial Sequence: Synthetic oligonucleotide
gctggccagagcttaagacagcgcaaatag

SEQ ID NO: 336762 - DNA, 31 bp, Artificial Sequence
  Description of Artificial Sequence: Synthetic oligonucleotide
ctggccagagcttaagacagcgcaaatagag

SEQ ID NO: 336763 - DNA, 31 bp, Artificial Sequence
  Description of Artificial Sequence: Synthetic oligonucleotide
tggccagagcttaagacagcgcaaatagagc

SEQ ID NO: 336764 - DNA, 30 bp, Artificial Sequence
  Description of Artificial Sequence: Synthetic oligonucleotide
ggccagagcttaagacagcgcaaatagagc

SEQ ID NO: 336765 - DNA, 30 bp, Artificial Sequence
  Description of Artificial Sequence: Synthetic oligonucleotide
gccagagcttaagacagcgcaaatagagcg

SEQ ID NO: 336766 - DNA, 30 bp, Artificial Sequence
  Description of Artificial Sequence: Synthetic oligonucleotide
ccagagcttaagacagcgcaaatagagcgc

SEQ ID NO: 336767 - DNA, 32 bp, Artificial Sequence
  Description of Artificial Sequence: Synthetic oligonucleotide
cagagcttaagacagcgcaaatagagcgcaag

SEQ ID NO: 336768 - DNA, 32 bp, Artificial Sequence
  Description of Artificial Sequence: Synthetic oligonucleotide
agagcttaagacagcgcaaatagagcgcaagg

SEQ ID NO: 336769 - DNA, 31 bp, Artificial Sequence
  Description of Artificial Sequence: Synthetic oligonucleotide
gagcttaagacagcgcaaatagagcgcaagg

SEQ ID NO: 336770 - DNA, 31 bp, Artificial Sequence
  Description of Artificial Sequence: Synthetic oligonucleotide
agcttaagacagcgcaaatagagcgcaaggc

SEQ ID NO: 336771 - DNA, 30 bp, Artificial Sequence
  Description of Artificial Sequence: Synthetic oligonucleotide
gcttaagacagcgcaaatagagcgcaaggc

SEQ ID NO: 336772 - DNA, 31 bp, Artificial Sequence
  Description of Artificial Sequence: Synthetic oligonucleotide
cttaagacagcgcaaatagagcgcaaggcag

SEQ ID NO: 336773 - DNA, 33 bp, Artificial Sequence
  Description of Artificial Sequence: Synthetic oligonucleotide
ttaagacagcgcaaatagagcgcaaggcagaag

SEQ ID NO: 336774 - DNA, 32 bp, Artificial Sequence
  Description of Artificial Sequence: Synthetic oligonucleotide
taagacagcgcaaatagagcgcaaggcagaag

SEQ ID NO: 336775 - DNA, 31 bp, Artificial Sequence
  Description of Artificial Sequence: Synthetic oligonucleotide
aagacagcgcaaatagagcgcaaggcagaag

SEQ ID NO: 336776 - DNA, 30 bp, Artificial Sequence
  Description of Artificial Sequence: Synthetic oligonucleotide
agacagcgcaaatagagcgcaaggcagaag

SEQ ID NO: 336777 - DNA, 29 bp, Artificial Sequence
  Description of Artificial Sequence: Synthetic oligonucleotide
gacagcgcaaatagagcgcaaggcagaag

SEQ ID NO: 336778 - DNA, 29 bp, Artificial Sequence
  Description of Artificial Sequence: Synthetic oligonucleotide
acagcgcaaatagagcgcaaggcagaagg

SEQ ID NO: 336779 - DNA, 28 bp, Artificial Sequence
  Description of Artificial Sequence: Synthetic oligonucleotide
cagcgcaaatagagcgcaaggcagaagg

SEQ ID NO: 336780 - DNA, 28 bp, Artificial Sequence
  Description of Artificial Sequence: Synthetic oligonucleotide
agcgcaaatagagcgcaaggcagaaggc

SEQ ID NO: 336781 - DNA, 27 bp, Artificial Sequence
  Description of Artificial Sequence: Synthetic oligonucleotide
gcgcaaatagagcgcaaggcagaaggc

SEQ ID NO: 336782 - DNA, 28 bp, Artificial Sequence
  Description of Artificial Sequence: Synthetic oligonucleotide
cgcaaatagagcgcaaggcagaaggcag

SEQ ID NO: 336783 - DNA, 28 bp, Artificial Sequence
  Description of Artificial Sequence: Synthetic oligonucleotide
gcaaatagagcgcaaggcagaaggcagc

SEQ ID NO: 336784 - DNA, 29 bp, Artificial Sequence
  Description of Artificial Sequence: Synthetic oligonucleotide
caaatagagcgcaaggcagaaggcagctg

SEQ ID NO: 336785 - DNA, 29 bp, Artificial Sequence
  Description of Artificial Sequence: Synthetic oligonucleotide
aaatagagcgcaaggcagaaggcagctgg

SEQ ID NO: 336786 - DNA, 28 bp, Artificial Sequence
  Description of Artificial Sequence: Synthetic oligonucleotide
aatagagcgcaaggcagaaggcagctgg

SEQ ID NO: 336787 - DNA, 27 bp, Artificial Sequence
  Description of Artificial Sequence: Synthetic oligonucleotide
atagagcgcaaggcagaaggcagctgg

SEQ ID NO: 336788 - DNA, 27 bp, Artificial Sequence
  Description of Artificial Sequence: Synthetic oligonucleotide
tagagcgcaaggcagaaggcagctggt

SEQ ID NO: 336789 - DNA, 26 bp, Artificial Sequence
  Description of Artificial Sequence: Synthetic oligonucleotide
agagcgcaaggcagaaggcagctggt

SEQ ID NO: 336790 - DNA, 25 bp, Artificial Sequence
  Description of Artificial Sequence: Synthetic oligonucleotide
gagcgcaaggcagaaggcagctggt

SEQ ID NO: 336791 - DNA, 25 bp, Artificial Sequence
  Description of Artificial Sequence: Synthetic oligonucleotide
agcgcaaggcagaaggcagctggtg

SEQ ID NO: 336792 - DNA, 24 bp, Artificial Sequence
  Description of Artificial Sequence: Synthetic oligonucleotide
gcgcaaggcagaaggcagctggtg

SEQ ID NO: 336793 - DNA, 24 bp, Artificial Sequence
  Description of Artificial Sequence: Synthetic oligonucleotide
cgcaaggcagaaggcagctggtgg

SEQ ID NO: 336794 - DNA, 26 bp, Artificial Sequence
  Description of Artificial Sequence: Synthetic oligonucleotide
gcaaggcagaaggcagctggtgggaa

SEQ ID NO: 336795 - DNA, 26 bp, Artificial Sequence
  Description of Artificial Sequence: Synthetic oligonucleotide
caaggcagaaggcagctggtgggaag

SEQ ID NO: 336796 - DNA, 27 bp, Artificial Sequence
  Description of Artificial Sequence: Synthetic oligonucleotide
aaggcagaaggcagctggtgggaagga

SEQ ID NO: 336797 - DNA, 26 bp, Artificial Sequence
  Description of Artificial Sequence: Synthetic oligonucleotide
aggcagaaggcagctggtgggaagga

SEQ ID NO: 336798 - DNA, 25 bp, Artificial Sequence
  Description of Artificial Sequence: Synthetic oligonucleotide
ggcagaaggcagctggtgggaagga

SEQ ID NO: 336799 - DNA, 26 bp, Artificial Sequence
  Description of Artificial Sequence: Synthetic oligonucleotide
gcagaaggcagctggtgggaaggagt

SEQ ID NO: 336800 - DNA, 26 bp, Artificial Sequence
  Description of Artificial Sequence: Synthetic oligonucleotide
cagaaggcagctggtgggaaggagtc

SEQ ID NO: 336801 - DNA, 27 bp, Artificial Sequence
  Description of Artificial Sequence: Synthetic oligonucleotide
agaaggcagctggtgggaaggagtcga

SEQ ID NO: 336802 - DNA, 27 bp, Artificial Sequence
  Description of Artificial Sequence: Synthetic oligonucleotide
gaaggcagctggtgggaaggagtcgaa

SEQ ID NO: 336803 - DNA, 27 bp, Artificial Sequence
  Description of Artificial Sequence: Synthetic oligonucleotide
aaggcagctggtgggaaggagtcgaag

SEQ ID NO: 336804 - DNA, 27 bp, Artificial Sequence
  Description of Artificial Sequence: Synthetic oligonucleotide
aggcagctggtgggaaggagtcgaagt

SEQ ID NO: 336805 - DNA, 26 bp, Artificial Sequence
  Description of Artificial Sequence: Synthetic oligonucleotide
ggcagctggtgggaaggagtcgaagt

SEQ ID NO: 336806 - DNA, 27 bp, Artificial Sequence
  Description of Artificial Sequence: Synthetic oligonucleotide
gcagctggtgggaaggagtcgaagtca

SEQ ID NO: 336807 - DNA, 27 bp, Artificial Sequence
  Description of Artificial Sequence: Synthetic oligonucleotide
cagctggtgggaaggagtcgaagtcac

SEQ ID NO: 336808 - DNA, 28 bp, Artificial Sequence
  Description of Artificial Sequence: Synthetic oligonucleotide
agctggtgggaaggagtcgaagtcactc

SEQ ID NO: 336809 - DNA, 27 bp, Artificial Sequence
  Description of Artificial Sequence: Synthetic oligonucleotide
gctggtgggaaggagtcgaagtcactc

SEQ ID NO: 336810 - DNA, 28 bp, Artificial Sequence
  Description of Artificial Sequence: Synthetic oligonucleotide
ctggtgggaaggagtcgaagtcactctc

SEQ ID NO: 336811 - DNA, 30 bp, Artificial Sequence
  Description of Artificial Sequence: Synthetic oligonucleotide
tggtgggaaggagtcgaagtcactctcatc

SEQ ID NO: 336812 - DNA, 29 bp, Artificial Sequence
  Description of Artificial Sequence: Synthetic oligonucleotide
ggtgggaaggagtcgaagtcactctcatc

SEQ ID NO: 336813 - DNA, 30 bp, Artificial Sequence
  Description of Artificial Sequence: Synthetic oligonucleotide
gtgggaaggagtcgaagtcactctcatctg

SEQ ID NO: 336814 - DNA, 30 bp, Artificial Sequence
  Description of Artificial Sequence: Synthetic oligonucleotide
tgggaaggagtcgaagtcactctcatctgc

SEQ ID NO: 336815 - DNA, 29 bp, Artificial Sequence
  Description of Artificial Sequence: Synthetic oligonucleotide
gggaaggagtcgaagtcactctcatctgc

SEQ ID NO: 336816 - DNA, 30 bp, Artificial Sequence
  Description of Artificial Sequence: Synthetic oligonucleotide
ggaaggagtcgaagtcactctcatctgcac

SEQ ID NO: 336817 - DNA, 31 bp, Artificial Sequence
  Description of Artificial Sequence: Synthetic oligonucleotide
gaaggagtcgaagtcactctcatctgcactg

SEQ ID NO: 336818 - DNA, 31 bp, Artificial Sequence
  Description of Artificial Sequence: Synthetic oligonucleotide
aaggagtcgaagtcactctcatctgcactgc

SEQ ID NO: 336819 - DNA, 30 bp, Artificial Sequence
  Description of Artificial Sequence: Synthetic oligonucleotide
aggagtcgaagtcactctcatctgcactgc

SEQ ID NO: 336820 - DNA, 29 bp, Artificial Sequence
  Description of Artificial Sequence: Synthetic oligonucleotide
ggagtcgaagtcactctcatctgcactgc

SEQ ID NO: 336821 - DNA, 29 bp, Artificial Sequence
  Description of Artificial Sequence: Synthetic oligonucleotide
gagtcgaagtcactctcatctgcactgcc

SEQ ID NO: 336822 - DNA, 29 bp, Artificial Sequence
  Description of Artificial Sequence: Synthetic oligonucleotide
agtcgaagtcactctcatctgcactgccc

SEQ ID NO: 336823 - DNA, 28 bp, Artificial Sequence
  Description of Artificial Sequence: Synthetic oligonucleotide
gtcgaagtcactctcatctgcactgccc

SEQ ID NO: 336824 - DNA, 28 bp, Artificial Sequence
  Description of Artificial Sequence: Synthetic oligonucleotide
tcgaagtcactctcatctgcactgcccg

SEQ ID NO: 336825 - DNA, 27 bp, Artificial Sequence
  Description of Artificial Sequence: Synthetic oligonucleotide
cgaagtcactctcatctgcactgcccg

SEQ ID NO: 336826 - DNA, 27 bp, Artificial Sequence
  Description of Artificial Sequence: Synthetic oligonucleotide
gaagtcactctcatctgcactgcccgc

SEQ ID NO: 336827 - DNA, 27 bp, Artificial Sequence
  Description of Artificial Sequence: Synthetic oligonucleotide
aagtcactctcatctgcactgcccgcg

SEQ ID NO: 336828 - DNA, 26 bp, Artificial Sequence
  Description of Artificial Sequence: Synthetic oligonucleotide
agtcactctcatctgcactgcccgcg

SEQ ID NO: 336829 - DNA, 25 bp, Artificial Sequence
  Description of Artificial Sequence: Synthetic oligonucleotide
gtcactctcatctgcactgcccgcg

SEQ ID NO: 336830 - DNA, 25 bp, Artificial Sequence
  Description of Artificial Sequence: Synthetic oligonucleotide
tcactctcatctgcactgcccgcgc

SEQ ID NO: 336831 - DNA, 24 bp, Artificial Sequence
  Description of Artificial Sequence: Synthetic oligonucleotide
cactctcatctgcactgcccgcgc

SEQ ID NO: 336832 - DNA, 24 bp, Artificial Sequence
  Description of Artificial Sequence: Synthetic oligonucleotide
actctcatctgcactgcccgcgcc

SEQ ID NO: 336833 - DNA, 23 bp, Artificial Sequence
  Description of Artificial Sequence: Synthetic oligonucleotide
ctctcatctgcactgcccgcgcc

SEQ ID NO: 336834 - DNA, 25 bp, Artificial Sequence
  Description of Artificial Sequence: Synthetic oligonucleotide
tctcatctgcactgcccgcgcccat

SEQ ID NO: 336835 - DNA, 24 bp, Artificial Sequence
  Description of Artificial Sequence: Synthetic oligonucleotide
ctcatctgcactgcccgcgcccat

SEQ ID NO: 336836 - DNA, 24 bp, Artificial Sequence
  Description of Artificial Sequence: Synthetic oligonucleotide
tcatctgcactgcccgcgcccatc

SEQ ID NO: 336837 - DNA, 23 bp, Artificial Sequence
  Description of Artificial Sequence: Synthetic oligonucleotide
catctgcactgcccgcgcccatc

SEQ ID NO: 336838 - DNA, 24 bp, Artificial Sequence
  Description of Artificial Sequence: Synthetic oligonucleotide
atctgcactgcccgcgcccatcca

SEQ ID NO: 336839 - DNA, 23 bp, Artificial Sequence
  Description of Artificial Sequence: Synthetic oligonucleotide
tctgcactgcccgcgcccatcca

SEQ ID NO: 336840 - DNA, 22 bp, Artificial Sequence
  Description of Artificial Sequence: Synthetic oligonucleotide
ctgcactgcccgcgcccatcca

SEQ ID NO: 336841 - DNA, 23 bp, Artificial Sequence
  Description of Artificial Sequence: Synthetic oligonucleotide
tgcactgcccgcgcccatccaga

SEQ ID NO: 336842 - DNA, 22 bp, Artificial Sequence
  Description of Artificial Sequence: Synthetic oligonucleotide
gcactgcccgcgcccatccaga

SEQ ID NO: 336843 - DNA, 22 bp, Artificial Sequence
  Description of Artificial Sequence: Synthetic oligonucleotide
cactgcccgcgcccatccagag

SEQ ID NO: 336844 - DNA, 22 bp, Artificial Sequence
  Description of Artificial Sequence: Synthetic oligonucleotide
actgcccgcgcccatccagagc

SEQ ID NO: 336845 - DNA, 21 bp, Artificial Sequence
  Description of Artificial Sequence: Synthetic oligonucleotide
ctgcccgcgcccatccagagc

SEQ ID NO: 336846 - DNA, 21 bp, Artificial Sequence
  Description of Artificial Sequence: Synthetic oligonucleotide
tgcccgcgcccatccagagcc

SEQ ID NO: 336847 - DNA, 20 bp, Artificial Sequence
  Description of Artificial Sequence: Synthetic oligonucleotide
gcccgcgcccatccagagcc

SEQ ID NO: 336848 - DNA, 23 bp, Artificial Sequence
  Description of Artificial Sequence: Synthetic oligonucleotide
cccgcgcccatccagagcccaaa

SEQ ID NO: 336849 - DNA, 24 bp, Artificial Sequence
  Description of Artificial Sequence: Synthetic oligonucleotide
ccgcgcccatccagagcccaaact

SEQ ID NO: 336850 - DNA, 25 bp, Artificial Sequence
  Description of Artificial Sequence: Synthetic oligonucleotide
cgcgcccatccagagcccaaactct

SEQ ID NO: 336851 - DNA, 25 bp, Artificial Sequence
  Description of Artificial Sequence: Synthetic oligonucleotide
gcgcccatccagagcccaaactctg

SEQ ID NO: 336852 - DNA, 26 bp, Artificial Sequence
  Description of Artificial Sequence: Synthetic oligonucleotide
cgcccatccagagcccaaactctgct

SEQ ID NO: 336853 - DNA, 26 bp, Artificial Sequence
  Description of Artificial Sequence: Synthetic oligonucleotide
gcccatccagagcccaaactctgctg

SEQ ID NO: 336854 - DNA, 27 bp, Artificial Sequence
  Description of Artificial Sequence: Synthetic oligonucleotide
cccatccagagcccaaactctgctgga

SEQ ID NO: 336855 - DNA, 27 bp, Artificial Sequence
  Description of Artificial Sequence: Synthetic oligonucleotide
ccatccagagcccaaactctgctggag

SEQ ID NO: 336856 - DNA, 27 bp, Artificial Sequence
  Description of Artificial Sequence: Synthetic oligonucleotide
catccagagcccaaactctgctggagc

SEQ ID NO: 336857 - DNA, 27 bp, Artificial Sequence
  Description of Artificial Sequence: Synthetic oligonucleotide
atccagagcccaaactctgctggagcc

SEQ ID NO: 336858 - DNA, 27 bp, Artificial Sequence
  Description of Artificial Sequence: Synthetic oligonucleotide
tccagagcccaaactctgctggagcct

SEQ ID NO: 336859 - DNA, 27 bp, Artificial Sequence
  Description of Artificial Sequence: Synthetic oligonucleotide
ccagagcccaaactctgctggagccta

SEQ ID NO: 336860 - DNA, 29 bp, Artificial Sequence
  Description of Artificial Sequence: Synthetic oligonucleotide
cagagcccaaactctgctggagcctattg

SEQ ID NO: 336861 - DNA, 29 bp, Artificial Sequence
  Description of Artificial Sequence: Synthetic oligonucleotide
agagcccaaactctgctggagcctattgg

SEQ ID NO: 336862 - DNA, 28 bp, Artificial Sequence
  Description of Artificial Sequence: Synthetic oligonucleotide
gagcccaaactctgctggagcctattgg

SEQ ID NO: 336863 - DNA, 28 bp, Artificial Sequence
  Description of Artificial Sequence: Synthetic oligonucleotide
agcccaaactctgctggagcctattggg

SEQ ID NO: 336864 - DNA, 27 bp, Artificial Sequence
  Description of Artificial Sequence: Synthetic oligonucleotide
gcccaaactctgctggagcctattggg

SEQ ID NO: 336865 - DNA, 27 bp, Artificial Sequence
  Description of Artificial Sequence: Synthetic oligonucleotide
cccaaactctgctggagcctattgggg

SEQ ID NO: 336866 - DNA, 27 bp, Artificial Sequence
  Description of Artificial Sequence: Synthetic oligonucleotide
ccaaactctgctggagcctattggggg

SEQ ID NO: 336867 - DNA, 27 bp, Artificial Sequence
  Description of Artificial Sequence: Synthetic oligonucleotide
caaactctgctggagcctattgggggg

SEQ ID NO: 336868 - DNA, 27 bp, Artificial Sequence
  Description of Artificial Sequence: Synthetic oligonucleotide
aaactctgctggagcctattggggggg

SEQ ID NO: 336869 - DNA, 27 bp, Artificial Sequence
  Description of Artificial Sequence: Synthetic oligonucleotide
aactctgctggagcctattggggggga

SEQ ID NO: 336870 - DNA, 26 bp, Artificial Sequence
  Description of Artificial Sequence: Synthetic oligonucleotide
actctgctggagcctattggggggga

SEQ ID NO: 336871 - DNA, 25 bp, Artificial Sequence
  Description of Artificial Sequence: Synthetic oligonucleotide
ctctgctggagcctattggggggga

SEQ ID NO: 336872 - DNA, 25 bp, Artificial Sequence
  Description of Artificial Sequence: Synthetic oligonucleotide
tctgctggagcctattgggggggag

SEQ ID NO: 336873 - DNA, 24 bp, Artificial Sequence
  Description of Artificial Sequence: Synthetic oligonucleotide
ctgctggagcctattgggggggag

SEQ ID NO: 336874 - DNA, 24 bp, Artificial Sequence
  Description of Artificial Sequence: Synthetic oligonucleotide
tgctggagcctattgggggggagc

SEQ ID NO: 336875 - DNA, 23 bp, Artificial Sequence
  Description of Artificial Sequence: Synthetic oligonucleotide
gctggagcctattgggggggagc

SEQ ID NO: 336876 - DNA, 23 bp, Artificial Sequence
  Description of Artificial Sequence: Synthetic oligonucleotide
ctggagcctattgggggggagcc

SEQ ID NO: 336877 - DNA, 23 bp, Artificial Sequence
  Description of Artificial Sequence: Synthetic oligonucleotide
tggagcctattgggggggagccc

SEQ ID NO: 336878 - DNA, 22 bp, Artificial Sequence
  Description of Artificial Sequence: Synthetic oligonucleotide
ggagcctattgggggggagccc

SEQ ID NO: 336879 - DNA, 22 bp, Artificial Sequence
  Description of Artificial Sequence: Synthetic oligonucleotide
gagcctattgggggggagcccc

SEQ ID NO: 336880 - DNA, 22 bp, Artificial Sequence
  Description of Artificial Sequence: Synthetic oligonucleotide
agcctattgggggggagccccg

SEQ ID NO: 336881 - DNA, 21 bp, Artificial Sequence
  Description of Artificial Sequence: Synthetic oligonucleotide
gcctattgggggggagccccg

SEQ ID NO: 336882 - DNA, 22 bp, Artificial Sequence
  Description of Artificial Sequence: Synthetic oligonucleotide
cctattgggggggagccccgca

SEQ ID NO: 336883 - DNA, 23 bp, Artificial Sequence
  Description of Artificial Sequence: Synthetic oligonucleotide
ctattgggggggagccccgcaca

SEQ ID NO: 336884 - DNA, 23 bp, Artificial Sequence
  Description of Artificial Sequence: Synthetic oligonucleotide
tattgggggggagccccgcacag

SEQ ID NO: 336885 - DNA, 22 bp, Artificial Sequence
  Description of Artificial Sequence: Synthetic oligonucleotide
attgggggggagccccgcacag

SEQ ID NO: 336886 - DNA, 21 bp, Artificial Sequence
  Description of Artificial Sequence: Synthetic oligonucleotide
ttgggggggagccccgcacag

SEQ ID NO: 336887 - DNA, 20 bp, Artificial Sequence
  Description of Artificial Sequence: Synthetic oligonucleotide
tgggggggagccccgcacag

SEQ ID NO: 336888 - DNA, 20 bp, Artificial Sequence
  Description of Artificial Sequence: Synthetic oligonucleotide
gggggggagccccgcacagt

SEQ ID NO: 336889 - DNA, 20 bp, Artificial Sequence
  Description of Artificial Sequence: Synthetic oligonucleotide
ggggggagccccgcacagct

SEQ ID NO: 336890 - DNA, 22 bp, Artificial Sequence
  Description of Artificial Sequence: Synthetic oligonucleotide
gggggagccccgcacagccaat

SEQ ID NO: 336891 - DNA, 22 bp, Artificial Sequence
  Description of Artificial Sequence: Synthetic oligonucleotide
ggggagccccgcacagccaatc

SEQ ID NO: 336892 - DNA, 22 bp, Artificial Sequence
  Description of Artificial Sequence: Synthetic oligonucleotide
gggagccccgcacagccaatcc

SEQ ID NO: 336893 - DNA, 22 bp, Artificial Sequence
  Description of Artificial Sequence: Synthetic oligonucleotide
ggagccccgcacagccaatccg

SEQ ID NO: 336894 - DNA, 22 bp, Artificial Sequence
  Description of Artificial Sequence: Synthetic oligonucleotide
gagccccgcacagccaatccgc

SEQ ID NO: 336895 - DNA, 22 bp, Artificial Sequence
  Description of Artificial Sequence: Synthetic oligonucleotide
agccccgcacagccaatccgcg

SEQ ID NO: 336896 - DNA, 21 bp, Artificial Sequence
  Description of Artificial Sequence: Synthetic oligonucleotide
gccccgcacagccaatccgcg

SEQ ID NO: 336897 - DNA, 22 bp, Artificial Sequence
  Description of Artificial Sequence: Synthetic oligonucleotide
ccccgcacagccaatccgcgga

SEQ ID NO: 336898 - DNA, 22 bp, Artificial Sequence
  Description of Artificial Sequence: Synthetic oligonucleotide
cccgcacagccaatccgcggac

SEQ ID NO: 336899 - DNA, 22 bp, Artificial Sequence
  Description of Artificial Sequence: Synthetic oligonucleotide
ccgcacagccaatccgcggacg

SEQ ID NO: 336900 - DNA, 22 bp, Artificial Sequence
  Description of Artificial Sequence: Synthetic oligonucleotide
cgcacagccaatccgcggacgg

SEQ ID NO: 336901 - DNA, 23 bp, Artificial Sequence
  Description of Artificial Sequence: Synthetic oligonucleotide
gcacagccaatccgcggacggca

SEQ ID NO: 336902 - DNA, 23 bp, Artificial Sequence
  Description of Artificial Sequence: Synthetic oligonucleotide
cacagccaatccgcggacggcac

SEQ ID NO: 336903 - DNA, 23 bp, Artificial Sequence
  Description of Artificial Sequence: Synthetic oligonucleotide
acagccaatccgcggacggcacg

SEQ ID NO: 336904 - DNA, 22 bp, Artificial Sequence
  Description of Artificial Sequence: Synthetic oligonucleotide
cagccaatccgcggacggcacg

SEQ ID NO: 336905 - DNA, 24 bp, Artificial Sequence
  Description of Artificial Sequence: Synthetic oligonucleotide
agccaatccgcggacggcacggtt

SEQ ID NO: 336906 - DNA, 23 bp, Artificial Sequence
  Description of Artificial Sequence: Synthetic oligonucleotide
gccaatccgcggacggcacggtt

SEQ ID NO: 336907 - DNA, 23 bp, Artificial Sequence
  Description of Artificial Sequence: Synthetic oligonucleotide
ccaatccgcggacggcacggttg

SEQ ID NO: 336908 - DNA, 23 bp, Artificial Sequence
  Description of Artificial Sequence: Synthetic oligonucleotide
caatccgcggacggcacggttgg

SEQ ID NO: 336909 - DNA, 24 bp, Artificial Sequence
  Description of Artificial Sequence: Synthetic oligonucleotide
aatccgcggacggcacggttgggt

SEQ ID NO: 336910 - DNA, 23 bp, Artificial Sequence
  Description of Artificial Sequence: Synthetic oligonucleotide
atccgcggacggcacggttgggt

SEQ ID NO: 336911 - DNA, 22 bp, Artificial Sequence
  Description of Artificial Sequence: Synthetic oligonucleotide
tccgcggacggcacggttgggt

SEQ ID NO: 336912 - DNA, 21 bp, Artificial Sequence
  Description of Artificial Sequence: Synthetic oligonucleotide
ccgcggacggcacggttgggt

SEQ ID NO: 336913 - DNA, 22 bp, Artificial Sequence
  Description of Artificial Sequence: Synthetic oligonucleotide
cgcggacggcacggttgggtgt

SEQ ID NO: 336914 - DNA, 22 bp, Artificial Sequence
  Description of Artificial Sequence: Synthetic oligonucleotide
gcggacggcacggttgggtgtg

SEQ ID NO: 336915 - DNA, 23 bp, Artificial Sequence
  Description of Artificial Sequence: Synthetic oligonucleotide
cggacggcacggttgggtgtgca

SEQ ID NO: 336916 - DNA, 23 bp, Artificial Sequence
  Description of Artificial Sequence: Synthetic oligonucleotide
ggacggcacggttgggtgtgcag

SEQ ID NO: 336917 - DNA, 24 bp, Artificial Sequence
  Description of Artificial Sequence: Synthetic oligonucleotide
gacggcacggttgggtgtgcagct

SEQ ID NO: 336918 - DNA, 25 bp, Artificial Sequence
  Description of Artificial Sequence: Synthetic oligonucleotide
acggcacggttgggtgtgcagctct

SEQ ID NO: 336919 - DNA, 24 bp, Artificial Sequence
  Description of Artificial Sequence: Synthetic oligonucleotide
cggcacggttgggtgtgcagctct

SEQ ID NO: 336920 - DNA, 25 bp, Artificial Sequence
  Description of Artificial Sequence: Synthetic oligonucleotide
ggcacggttgggtgtgcagctctca

SEQ ID NO: 336921 - DNA, 26 bp, Artificial Sequence
  Description of Artificial Sequence: Synthetic oligonucleotide
gcacggttgggtgtgcagctctcaga

SEQ ID NO: 336922 - DNA, 26 bp, Artificial Sequence
  Description of Artificial Sequence: Synthetic oligonucleotide
cacggttgggtgtgcagctctcagac

SEQ ID NO: 336923 - DNA, 26 bp, Artificial Sequence
  Description of Artificial Sequence: Synthetic oligonucleotide
acggttgggtgtgcagctctcagacc

SEQ ID NO: 336924 - DNA, 25 bp, Artificial Sequence
  Description of Artificial Sequence: Synthetic oligonucleotide
cggttgggtgtgcagctctcagacc

SEQ ID NO: 336925 - DNA, 26 bp, Artificial Sequence
  Description of Artificial Sequence: Synthetic oligonucleotide
ggttgggtgtgcagctctcagaccct

SEQ ID NO: 336926 - DNA, 27 bp, Artificial Sequence
  Description of Artificial Sequence: Synthetic oligonucleotide
gttgggtgtgcagctctcagaccctga

SEQ ID NO: 336927 - DNA, 29 bp, Artificial Sequence
  Description of Artificial Sequence: Synthetic oligonucleotide
ttgggtgtgcagctctcagaccctgaatg

SEQ ID NO: 336928 - DNA, 28 bp, Artificial Sequence
  Description of Artificial Sequence: Synthetic oligonucleotide
tgggtgtgcagctctcagaccctgaatg

SEQ ID NO: 336929 - DNA, 27 bp, Artificial Sequence
  Description of Artificial Sequence: Synthetic oligonucleotide
gggtgtgcagctctcagaccctgaatg

SEQ ID NO: 336930 - DNA, 28 bp, Artificial Sequence
  Description of Artificial Sequence: Synthetic oligonucleotide
ggtgtgcagctctcagaccctgaatgtg

SEQ ID NO: 336931 - DNA, 29 bp, Artificial Sequence
  Description of Artificial Sequence: Synthetic oligonucleotide
gtgtgcagctctcagaccctgaatgtgac

SEQ ID NO: 336932 - DNA, 29 bp, Artificial Sequence
  Description of Artificial Sequence: Synthetic oligonucleotide
tgtgcagctctcagaccctgaatgtgacc

SEQ ID NO: 336933 - DNA, 28 bp, Artificial Sequence
  Description of Artificial Sequence: Synthetic oligonucleotide
gtgcagctctcagaccctgaatgtgacc

SEQ ID NO: 336934 - DNA, 29 bp, Artificial Sequence
  Description of Artificial Sequence: Synthetic oligonucleotide
tgcagctctcagaccctgaatgtgaccag

SEQ ID NO: 336935 - DNA, 28 bp, Artificial Sequence
  Description of Artificial Sequence: Synthetic oligonucleotide
gcagctctcagaccctgaatgtgaccag

SEQ ID NO: 336936 - DNA, 28 bp, Artificial Sequence
  Description of Artificial Sequence: Synthetic oligonucleotide
cagctctcagaccctgaatgtgaccagc

SEQ ID NO: 336937 - DNA, 28 bp, Artificial Sequence
  Description of Artificial Sequence: Synthetic oligonucleotide
agctctcagaccctgaatgtgaccagcc

SEQ ID NO: 336938 - DNA, 27 bp, Artificial Sequence
  Description of Artificial Sequence: Synthetic oligonucleotide
gctctcagaccctgaatgtgaccagcc

SEQ ID NO: 336939 - DNA, 27 bp, Artificial Sequence
  Description of Artificial Sequence: Synthetic oligonucleotide
ctctcagaccctgaatgtgaccagccc

SEQ ID NO: 336940 - DNA, 27 bp, Artificial Sequence
  Description of Artificial Sequence: Synthetic oligonucleotide
tctcagaccctgaatgtgaccagcccc

SEQ ID NO: 336941 - DNA, 26 bp, Artificial Sequence
  Description of Artificial Sequence: Synthetic oligonucleotide
ctcagaccctgaatgtgaccagcccc

SEQ ID NO: 336942 - DNA, 27 bp, Artificial Sequence
  Description of Artificial Sequence: Synthetic oligonucleotide
tcagaccctgaatgtgaccagccccct

SEQ ID NO: 336943 - DNA, 26 bp, Artificial Sequence
  Description of Artificial Sequence: Synthetic oligonucleotide
cagaccctgaatgtgaccagccccct

SEQ ID NO: 336944 - DNA, 27 bp, Artificial Sequence
  Description of Artificial Sequence: Synthetic oligonucleotide
agaccctgaatgtgaccagccccctga

SEQ ID NO: 336945 - DNA, 26 bp, Artificial Sequence
  Description of Artificial Sequence: Synthetic oligonucleotide
gaccctgaatgtgaccagccccctga

SEQ ID NO: 336946 - DNA, 26 bp, Artificial Sequence
  Description of Artificial Sequence: Synthetic oligonucleotide
accctgaatgtgaccagccccctgag

SEQ ID NO: 336947 - DNA, 25 bp, Artificial Sequence
  Description of Artificial Sequence: Synthetic oligonucleotide
ccctgaatgtgaccagccccctgag

SEQ ID NO: 336948 - DNA, 25 bp, Artificial Sequence
  Description of Artificial Sequence: Synthetic oligonucleotide
cctgaatgtgaccagccccctgagc

SEQ ID NO: 336949 - DNA, 25 bp, Artificial Sequence
  Description of Artificial Sequence: Synthetic oligonucleotide
ctgaatgtgaccagccccctgagcc

SEQ ID NO: 336950 - DNA, 25 bp, Artificial Sequence
  Description of Artificial Sequence: Synthetic oligonucleotide
tgaatgtgaccagccccctgagccc

SEQ ID NO: 336951 - DNA, 24 bp, Artificial Sequence
  Description of Artificial Sequence: Synthetic oligonucleotide
gaatgtgaccagccccctgagccc

SEQ ID NO: 336952 - DNA, 24 bp, Artificial Sequence
  Description of Artificial Sequence: Synthetic oligonucleotide
aatgtgaccagccccctgagcccc

SEQ ID NO: 336953 - DNA, 23 bp, Artificial Sequence
  Description of Artificial Sequence: Synthetic oligonucleotide
atgtgaccagccccctgagcccc

SEQ ID NO: 336954 - DNA, 22 bp, Artificial Sequence
  Description of Artificial Sequence: Synthetic oligonucleotide
tgtgaccagccccctgagcccc

SEQ ID NO: 336955 - DNA, 21 bp, Artificial Sequence
  Description of Artificial Sequence: Synthetic oligonucleotide
gtgaccagccccctgagcccc

SEQ ID NO: 336956 - DNA, 23 bp, Artificial Sequence
  Description of Artificial Sequence: Synthetic oligonucleotide
tgaccagccccctgagccccgat

SEQ ID NO: 336957 - DNA, 22 bp, Artificial Sequence
  Description of Artificial Sequence: Synthetic oligonucleotide
gaccagccccctgagccccgat

SEQ ID NO: 336958 - DNA, 22 bp, Artificial Sequence
  Description of Artificial Sequence: Synthetic oligonucleotide
accagccccctgagccccgatg

SEQ ID NO: 336959 - DNA, 21 bp, Artificial Sequence
  Description of Artificial Sequence: Synthetic oligonucleotide
ccagccccctgagccccgatg

SEQ ID NO: 336960 - DNA, 21 bp, Artificial Sequence
  Description of Artificial Sequence: Synthetic oligonucleotide
cagccccctgagccccgatgg

SEQ ID NO: 336961 - DNA, 23 bp, Artificial Sequence
  Description of Artificial Sequence: Synthetic oligonucleotide
agccccctgagccccgatggcat

SEQ ID NO: 336962 - DNA, 22 bp, Artificial Sequence
  Description of Artificial Sequence: Synthetic oligonucleotide
gccccctgagccccgatggcat

SEQ ID NO: 336963 - DNA, 23 bp, Artificial Sequence
  Description of Artificial Sequence: Synthetic oligonucleotide
ccccctgagccccgatggcatgt

SEQ ID NO: 336964 - DNA, 23 bp, Artificial Sequence
  Description of Artificial Sequence: Synthetic oligonucleotide
cccctgagccccgatggcatgtc

SEQ ID NO: 336965 - DNA, 24 bp, Artificial Sequence
  Description of Artificial Sequence: Synthetic oligonucleotide
ccctgagccccgatggcatgtcct

SEQ ID NO: 336966 - DNA, 25 bp, Artificial Sequence
  Description of Artificial Sequence: Synthetic oligonucleotide
cctgagccccgatggcatgtcctgt

SEQ ID NO: 336967 - DNA, 27 bp, Artificial Sequence
  Description of Artificial Sequence: Synthetic oligonucleotide
ctgagccccgatggcatgtcctgtgaa

SEQ ID NO: 336968 - DNA, 27 bp, Artificial Sequence
  Description of Artificial Sequence: Synthetic oligonucleotide
tgagccccgatggcatgtcctgtgaac

SEQ ID NO: 336969 - DNA, 26 bp, Artificial Sequence
  Description of Artificial Sequence: Synthetic oligonucleotide
gagccccgatggcatgtcctgtgaac

SEQ ID NO: 336970 - DNA, 26 bp, Artificial Sequence
  Description of Artificial Sequence: Synthetic oligonucleotide
agccccgatggcatgtcctgtgaacc

SEQ ID NO: 336971 - DNA, 25 bp, Artificial Sequence
  Description of Artificial Sequence: Synthetic oligonucleotide
gccccgatggcatgtcctgtgaacc

SEQ ID NO: 336972 - DNA, 26 bp, Artificial Sequence
  Description of Artificial Sequence: Synthetic oligonucleotide
ccccgatggcatgtcctgtgaaccct

SEQ ID NO: 336973 - DNA, 26 bp, Artificial Sequence
  Description of Artificial Sequence: Synthetic oligonucleotide
cccgatggcatgtcctgtgaaccctc

SEQ ID NO: 336974 - DNA, 27 bp, Artificial Sequence
  Description of Artificial Sequence: Synthetic oligonucleotide
ccgatggcatgtcctgtgaaccctcca

SEQ ID NO: 336975 - DNA, 28 bp, Artificial Sequence
  Description of Artificial Sequence: Synthetic oligonucleotide
cgatggcatgtcctgtgaaccctccaac

SEQ ID NO: 336976 - DNA, 28 bp, Artificial Sequence
  Description of Artificial Sequence: Synthetic oligonucleotide
gatggcatgtcctgtgaaccctccaacc

SEQ ID NO: 336977 - DNA, 28 bp, Artificial Sequence
  Description of Artificial Sequence: Synthetic oligonucleotide
atggcatgtcctgtgaaccctccaaccg

SEQ ID NO: 336978 - DNA, 27 bp, Artificial Sequence
  Description of Artificial Sequence: Synthetic oligonucleotide
tggcatgtcctgtgaaccctccaaccg

SEQ ID NO: 336979 - DNA, 26 bp, Artificial Sequence
  Description of Artificial Sequence: Synthetic oligonucleotide
ggcatgtcctgtgaaccctccaaccg

SEQ ID NO: 336980 - DNA, 26 bp, Artificial Sequence
  Description of Artificial Sequence: Synthetic oligonucleotide
gcatgtcctgtgaaccctccaaccgc

SEQ ID NO: 336981 - DNA, 27 bp, Artificial Sequence
  Description of Artificial Sequence: Synthetic oligonucleotide
catgtcctgtgaaccctccaaccgcca

SEQ ID NO: 336982 - DNA, 27 bp, Artificial Sequence
  Description of Artificial Sequence: Synthetic oligonucleotide
atgtcctgtgaaccctccaaccgccac

SEQ ID NO: 336983 - DNA, 26 bp, Artificial Sequence
  Description of Artificial Sequence: Synthetic oligonucleotide
tgtcctgtgaaccctccaaccgccac

SEQ ID NO: 336984 - DNA, 25 bp, Artificial Sequence
  Description of Artificial Sequence: Synthetic oligonucleotide
gtcctgtgaaccctccaaccgccac

SEQ ID NO: 336985 - DNA, 25 bp, Artificial Sequence
  Description of Artificial Sequence: Synthetic oligonucleotide
tcctgtgaaccctccaaccgccacg

SEQ ID NO: 336986 - DNA, 24 bp, Artificial Sequence
  Description of Artificial Sequence: Synthetic oligonucleotide
cctgtgaaccctccaaccgccacg

SEQ ID NO: 336987 - DNA, 24 bp, Artificial Sequence
  Description of Artificial Sequence: Synthetic oligonucleotide
ctgtgaaccctccaaccgccacgg

SEQ ID NO: 336988 - DNA, 26 bp, Artificial Sequence
  Description of Artificial Sequence: Synthetic oligonucleotide
tgtgaaccctccaaccgccacgggaa

SEQ ID NO: 336989 - DNA, 25 bp, Artificial Sequence
  Description of Artificial Sequence: Synthetic oligonucleotide
gtgaaccctccaaccgccacgggaa

SEQ ID NO: 336990 - DNA, 27 bp, Artificial Sequence
  Description of Artificial Sequence: Synthetic oligonucleotide
tgaaccctccaaccgccacgggaagaa

SEQ ID NO: 336991 - DNA, 26 bp, Artificial Sequence
  Description of Artificial Sequence: Synthetic oligonucleotide
gaaccctccaaccgccacgggaagaa

SEQ ID NO: 336992 - DNA, 26 bp, Artificial Sequence
  Description of Artificial Sequence: Synthetic oligonucleotide
aaccctccaaccgccacgggaagaag

SEQ ID NO: 336993 - DNA, 25 bp, Artificial Sequence
  Description of Artificial Sequence: Synthetic oligonucleotide
accctccaaccgccacgggaagaag

SEQ ID NO: 336994 - DNA, 24 bp, Artificial Sequence
  Description of Artificial Sequence: Synthetic oligonucleotide
ccctccaaccgccacgggaagaag

SEQ ID NO: 336995 - DNA, 24 bp, Artificial Sequence
  Description of Artificial Sequence: Synthetic oligonucleotide
cctccaaccgccacgggaagaagc

SEQ ID NO: 336996 - DNA, 24 bp, Artificial Sequence
  Description of Artificial Sequence: Synthetic oligonucleotide
ctccaaccgccacgggaagaagcg

SEQ ID NO: 336997 - DNA, 24 bp, Artificial Sequence
  Description of Artificial Sequence: Synthetic oligonucleotide
tccaaccgccacgggaagaagcgc

SEQ ID NO: 336998 - DNA, 23 bp, Artificial Sequence
  Description of Artificial Sequence: Synthetic oligonucleotide
ccaaccgccacgggaagaagcgc

SEQ ID NO: 336999 - DNA, 25 bp, Artificial Sequence
  Description of Artificial Sequence: Synthetic oligonucleotide
caaccgccacgggaagaagcgccat

SEQ ID NO: 337000 - DNA, 26 bp, Artificial Sequence
  Description of Artificial Sequence: Synthetic oligonucleotide
aaccgccacgggaagaagcgccatct

SEQ ID NO: 337001 - DNA, 25 bp, Artificial Sequence
  Description of Artificial Sequence: Synthetic oligonucleotide
accgccacgggaagaagcgccatct

SEQ ID NO: 337002 - DNA, 24 bp, Artificial Sequence
  Description of Artificial Sequence: Synthetic oligonucleotide
ccgccacgggaagaagcgccatct

SEQ ID NO: 337003 - DNA, 26 bp, Artificial Sequence
  Description of Artificial Sequence: Synthetic oligonucleotide
cgccacgggaagaagcgccatctctt

SEQ ID NO: 337004 - DNA, 26 bp, Artificial Sequence
  Description of Artificial Sequence: Synthetic oligonucleotide
gccacgggaagaagcgccatctcttc

SEQ ID NO: 337005 - DNA, 27 bp, Artificial Sequence
  Description of Artificial Sequence: Synthetic oligonucleotide
ccacgggaagaagcgccatctcttcca

SEQ ID NO: 337006 - DNA, 27 bp, Artificial Sequence
  Description of Artificial Sequence: Synthetic oligonucleotide
cacgggaagaagcgccatctcttccac

SEQ ID NO: 337007 - DNA, 29 bp, Artificial Sequence
  Description of Artificial Sequence: Synthetic oligonucleotide
acgggaagaagcgccatctcttccactac

SEQ ID NO: 337008 - DNA, 28 bp, Artificial Sequence
  Description of Artificial Sequence: Synthetic oligonucleotide
cgggaagaagcgccatctcttccactac

SEQ ID NO: 337009 - DNA, 28 bp, Artificial Sequence
  Description of Artificial Sequence: Synthetic oligonucleotide
gggaagaagcgccatctcttccactacg

SEQ ID NO: 337010 - DNA, 28 bp, Artificial Sequence
  Description of Artificial Sequence: Synthetic oligonucleotide
ggaagaagcgccatctcttccactacgg

SEQ ID NO: 337011 - DNA, 28 bp, Artificial Sequence
  Description of Artificial Sequence: Synthetic oligonucleotide
gaagaagcgccatctcttccactacggc

SEQ ID NO: 337012 - DNA, 29 bp, Artificial Sequence
  Description of Artificial Sequence: Synthetic oligonucleotide
aagaagcgccatctcttccactacggcac

SEQ ID NO: 337013 - DNA, 28 bp, Artificial Sequence
  Description of Artificial Sequence: Synthetic oligonucleotide
agaagcgccatctcttccactacggcac

SEQ ID NO: 337014 - DNA, 27 bp, Artificial Sequence
  Description of Artificial Sequence: Synthetic oligonucleotide
gaagcgccatctcttccactacggcac

SEQ ID NO: 337015 - DNA, 27 bp, Artificial Sequence
  Description of Artificial Sequence: Synthetic oligonucleotide
aagcgccatctcttccactacggcacc

SEQ ID NO: 337016 - DNA, 26 bp, Artificial Sequence
  Description of Artificial Sequence: Synthetic oligonucleotide
agcgccatctcttccactacggcacc

SEQ ID NO: 337017 - DNA, 25 bp, Artificial Sequence
  Description of Artificial Sequence: Synthetic oligonucleotide
gcgccatctcttccactacggcacc

SEQ ID NO: 337018 - DNA, 26 bp, Artificial Sequence
  Description of Artificial Sequence: Synthetic oligonucleotide
cgccatctcttccactacggcaccgt

SEQ ID NO: 337019 - DNA, 27 bp, Artificial Sequence
  Description of Artificial Sequence: Synthetic oligonucleotide
gccatctcttccactacggcaccgtca

SEQ ID NO: 337020 - DNA, 27 bp, Artificial Sequence
  Description of Artificial Sequence: Synthetic oligonucleotide
ccatctcttccactacggcaccgtcag

SEQ ID NO: 337021 - DNA, 27 bp, Artificial Sequence
  Description of Artificial Sequence: Synthetic oligonucleotide
catctcttccactacggcaccgtcagc

SEQ ID NO: 337022 - DNA, 27 bp, Artificial Sequence
  Description of Artificial Sequence: Synthetic oligonucleotide
atctcttccactacggcaccgtcagcc

SEQ ID NO: 337023 - DNA, 26 bp, Artificial Sequence
  Description of Artificial Sequence: Synthetic oligonucleotide
tctcttccactacggcaccgtcagcc

SEQ ID NO: 337024 - DNA, 25 bp, Artificial Sequence
  Description of Artificial Sequence: Synthetic oligonucleotide
ctcttccactacggcaccgtcagcc

SEQ ID NO: 337025 - DNA, 25 bp, Artificial Sequence
  Description of Artificial Sequence: Synthetic oligonucleotide
tcttccactacggcaccgtcagccc

SEQ ID NO: 337026 - DNA, 24 bp, Artificial Sequence
  Description of Artificial Sequence: Synthetic oligonucleotide
cttccactacggcaccgtcagccc

SEQ ID NO: 337027 - DNA, 24 bp, Artificial Sequence
  Description of Artificial Sequence: Synthetic oligonucleotide
ttccactacggcaccgtcagcccc

SEQ ID NO: 337028 - DNA, 23 bp, Artificial Sequence
  Description of Artificial Sequence: Synthetic oligonucleotide
tccactacggcaccgtcagcccc

SEQ ID NO: 337029 - DNA, 22 bp, Artificial Sequence
  Description of Artificial Sequence: Synthetic oligonucleotide
ccactacggcaccgtcagcccc

SEQ ID NO: 337030 - DNA, 23 bp, Artificial Sequence
  Description of Artificial Sequence: Synthetic oligonucleotide
cactacggcaccgtcagccccca

SEQ ID NO: 337031 - DNA, 24 bp, Artificial Sequence
  Description of Artificial Sequence: Synthetic oligonucleotide
actacggcaccgtcagcccccagt

SEQ ID NO: 337032 - DNA, 23 bp, Artificial Sequence
  Description of Artificial Sequence: Synthetic oligonucleotide
ctacggcaccgtcagcccccagt

SEQ ID NO: 337033 - DNA, 23 bp, Artificial Sequence
  Description of Artificial Sequence: Synthetic oligonucleotide
tacggcaccgtcagcccccagtc

SEQ ID NO: 337034 - DNA, 22 bp, Artificial Sequence
  Description of Artificial Sequence: Synthetic oligonucleotide
acggcaccgtcagcccccagtc

SEQ ID NO: 337035 - DNA, 21 bp, Artificial Sequence
  Description of Artificial Sequence: Synthetic oligonucleotide
cggcaccgtcagcccccagtc

SEQ ID NO: 337036 - DNA, 22 bp, Artificial Sequence
  Description of Artificial Sequence: Synthetic oligonucleotide
ggcaccgtcagcccccagtcct

SEQ ID NO: 337037 - DNA, 22 bp, Artificial Sequence
  Description of Artificial Sequence: Synthetic oligonucleotide
gcaccgtcagcccccagtcctc

SEQ ID NO: 337038 - DNA, 22 bp, Artificial Sequence
  Description of Artificial Sequence: Synthetic oligonucleotide
caccgtcagcccccagtcctcc

SEQ ID NO: 337039 - DNA, 23 bp, Artificial Sequence
  Description of Artificial Sequence: Synthetic oligonucleotide
accgtcagcccccagtcctccca

SEQ ID NO: 337040 - DNA, 22 bp, Artificial Sequence
  Description of Artificial Sequence: Synthetic oligonucleotide
ccgtcagcccccagtcctccca

SEQ ID NO: 337041 - DNA, 22 bp, Artificial Sequence
  Description of Artificial Sequence: Synthetic oligonucleotide
cgtcagcccccagtcctcccag

SEQ ID NO: 337042 - DNA, 22 bp, Artificial Sequence
  Description of Artificial Sequence: Synthetic oligonucleotide
gtcagcccccagtcctcccagg

SEQ ID NO: 337043 - DNA, 23 bp, Artificial Sequence
  Description of Artificial Sequence: Synthetic oligonucleotide
tcagcccccagtcctcccagggt

SEQ ID NO: 337044 - DNA, 22 bp, Artificial Sequence
  Description of Artificial Sequence: Synthetic oligonucleotide
cagcccccagtcctcccagggt

SEQ ID NO: 337045 - DNA, 22 bp, Artificial Sequence
  Description of Artificial Sequence: Synthetic oligonucleotide
agcccccagtcctcccagggtg

SEQ ID NO: 337046 - DNA, 21 bp, Artificial Sequence
  Description of Artificial Sequence: Synthetic oligonucleotide
gcccccagtcctcccagggtg

SEQ ID NO: 337047 - DNA, 22 bp, Artificial Sequence
  Description of Artificial Sequence: Synthetic oligonucleotide
cccccagtcctcccagggtgga

SEQ ID NO: 337048 - DNA, 23 bp, Artificial Sequence
  Description of Artificial Sequence: Synthetic oligonucleotide
ccccagtcctcccagggtggagt

SEQ ID NO: 337049 - DNA, 23 bp, Artificial Sequence
  Description of Artificial Sequence: Synthetic oligonucleotide
cccagtcctcccagggtggagtg

SEQ ID NO: 337050 - DNA, 23 bp, Artificial Sequence
  Description of Artificial Sequence: Synthetic oligonucleotide
ccagtcctcccagggtggagtgg

SEQ ID NO: 337051 - DNA, 23 bp, Artificial Sequence
  Description of Artificial Sequence: Synthetic oligonucleotide
cagtcctcccagggtggagtggc

SEQ ID NO: 337052 - DNA, 23 bp, Artificial Sequence
  Description of Artificial Sequence: Synthetic oligonucleotide
agtcctcccagggtggagtggcg

SEQ ID NO: 337053 - DNA, 22 bp, Artificial Sequence
  Description of Artificial Sequence: Synthetic oligonucleotide
gtcctcccagggtggagtggcg

SEQ ID NO: 337054 - DNA, 23 bp, Artificial Sequence
  Description of Artificial Sequence: Synthetic oligonucleotide
tcctcccagggtggagtggcggt

SEQ ID NO: 337055 - DNA, 22 bp, Artificial Sequence
  Description of Artificial Sequence: Synthetic oligonucleotide
cctcccagggtggagtggcggt

SEQ ID NO: 337056 - DNA, 24 bp, Artificial Sequence
  Description of Artificial Sequence: Synthetic oligonucleotide
ctcccagggtggagtggcggtcat

SEQ ID NO: 337057 - DNA, 24 bp, Artificial Sequence
  Description of Artificial Sequence: Synthetic oligonucleotide
tcccagggtggagtggcggtcatg

SEQ ID NO: 337058 - DNA, 23 bp, Artificial Sequence
  Description of Artificial Sequence: Synthetic oligonucleotide
cccagggtggagtggcggtcatg

SEQ ID NO: 337059 - DNA, 23 bp, Artificial Sequence
  Description of Artificial Sequence: Synthetic oligonucleotide
ccagggtggagtggcggtcatgg

SEQ ID NO: 337060 - DNA, 23 bp, Artificial Sequence
  Description of Artificial Sequence: Synthetic oligonucleotide
cagggtggagtggcggtcatggc

SEQ ID NO: 337061 - DNA, 23 bp, Artificial Sequence
  Description of Artificial Sequence: Synthetic oligonucleotide
agggtggagtggcggtcatggcc

SEQ ID NO: 337062 - DNA, 22 bp, Artificial Sequence
  Description of Artificial Sequence: Synthetic oligonucleotide
gggtggagtggcggtcatggcc

SEQ ID NO: 337063 - DNA, 23 bp, Artificial Sequence
  Description of Artificial Sequence: Synthetic oligonucleotide
ggtggagtggcggtcatggccct

SEQ ID NO: 337064 - DNA, 23 bp, Artificial Sequence
  Description of Artificial Sequence: Synthetic oligonucleotide
gtggagtggcggtcatggccctg

SEQ ID NO: 337065 - DNA, 23 bp, Artificial Sequence
  Description of Artificial Sequence: Synthetic oligonucleotide
tggagtggcggtcatggccctgg

SEQ ID NO: 337066 - DNA, 22 bp, Artificial Sequence
  Description of Artificial Sequence: Synthetic oligonucleotide
ggagtggcggtcatggccctgg

SEQ ID NO: 337067 - DNA, 22 bp, Artificial Sequence
  Description of Artificial Sequence: Synthetic oligonucleotide
gagtggcggtcatggccctggc

SEQ ID NO: 337068 - DNA, 22 bp, Artificial Sequence
  Description of Artificial Sequence: Synthetic oligonucleotide
agtggcggtcatggccctggcc

SEQ ID NO: 337069 - DNA, 21 bp, Artificial Sequence
  Description of Artificial Sequence: Synthetic oligonucleotide
gtggcggtcatggccctggcc

SEQ ID NO: 337070 - DNA, 22 bp, Artificial Sequence
  Description of Artificial Sequence: Synthetic oligonucleotide
tggcggtcatggccctggccgt

SEQ ID NO: 337071 - DNA, 21 bp, Artificial Sequence
  Description of Artificial Sequence: Synthetic oligonucleotide
ggcggtcatggccctggccgt

SEQ ID NO: 337072 - DNA, 22 bp, Artificial Sequence
  Description of Artificial Sequence: Synthetic oligonucleotide
gcggtcatggccctggccgtca

SEQ ID NO: 337073 - DNA, 22 bp, Artificial Sequence
  Description of Artificial Sequence: Synthetic oligonucleotide
cggtcatggccctggccgtcac

SEQ ID NO: 337074 - DNA, 22 bp, Artificial Sequence
  Description of Artificial Sequence: Synthetic oligonucleotide
ggtcatggccctggccgtcacc

SEQ ID NO: 337075 - DNA, 23 bp, Artificial Sequence
  Description of Artificial Sequence: Synthetic oligonucleotide
gtcatggccctggccgtcaccgt

SEQ ID NO: 337076 - DNA, 23 bp, Artificial Sequence
  Description of Artificial Sequence: Synthetic oligonucleotide
tcatggccctggccgtcaccgtg

SEQ ID NO: 337077 - DNA, 22 bp, Artificial Sequence
  Description of Artificial Sequence: Synthetic oligonucleotide
catggccctggccgtcaccgtg

SEQ ID NO: 337078 - DNA, 22 bp, Artificial Sequence
  Description of Artificial Sequence: Synthetic oligonucleotide
atggccctggccgtcaccgtgg

SEQ ID NO: 337079 - DNA, 21 bp, Artificial Sequence
  Description of Artificial Sequence: Synthetic oligonucleotide
tggccctggccgtcaccgtgg

SEQ ID NO: 337080 - DNA, 20 bp, Artificial Sequence
  Description of Artificial Sequence: Synthetic oligonucleotide
ggccctggccgtcaccgtgg

SEQ ID NO: 337081 - DNA, 20 bp, Artificial Sequence
  Description of Artificial Sequence: Synthetic oligonucleotide
gccctggccgtcaccgtggg

SEQ ID NO: 337082 - DNA, 20 bp, Artificial Sequence
  Description of Artificial Sequence: Synthetic oligonucleotide
ccctggccgtcaccgtgggc

SEQ ID NO: 337083 - DNA, 21 bp, Artificial Sequence
  Description of Artificial Sequence: Synthetic oligonucleotide
cctggccgtcaccgtgggcct

SEQ ID NO: 337084 - DNA, 21 bp, Artificial Sequence
  Description of Artificial Sequence: Synthetic oligonucleotide
ctggccgtcaccgtgggcctg

SEQ ID NO: 337085 - DNA, 22 bp, Artificial Sequence
  Description of Artificial Sequence: Synthetic oligonucleotide
tggccgtcaccgtgggcctgct

SEQ ID NO: 337086 - DNA, 21 bp, Artificial Sequence
  Description of Artificial Sequence: Synthetic oligonucleotide
ggccgtcaccgtgggcctgct

SEQ ID NO: 337087 - DNA, 21 bp, Artificial Sequence
  Description of Artificial Sequence: Synthetic oligonucleotide
gccgtcaccgtgggcctgctg

SEQ ID NO: 337088 - DNA, 22 bp, Artificial Sequence
  Description of Artificial Sequence: Synthetic oligonucleotide
ccgtcaccgtgggcctgctgct

SEQ ID NO: 337089 - DNA, 22 bp, Artificial Sequence
  Description of Artificial Sequence: Synthetic oligonucleotide
cgtcaccgtgggcctgctgctc

SEQ ID NO: 337090 - DNA, 23 bp, Artificial Sequence
  Description of Artificial Sequence: Synthetic oligonucleotide
gtcaccgtgggcctgctgctcct

SEQ ID NO: 337091 - DNA, 23 bp, Artificial Sequence
  Description of Artificial Sequence: Synthetic oligonucleotide
tcaccgtgggcctgctgctcctc

SEQ ID NO: 337092 - DNA, 22 bp, Artificial Sequence
  Description of Artificial Sequence: Synthetic oligonucleotide
caccgtgggcctgctgctcctc

SEQ ID NO: 337093 - DNA, 23 bp, Artificial Sequence
  Description of Artificial Sequence: Synthetic oligonucleotide
accgtgggcctgctgctcctcct

SEQ ID NO: 337094 - DNA, 22 bp, Artificial Sequence
  Description of Artificial Sequence: Synthetic oligonucleotide
ccgtgggcctgctgctcctcct

SEQ ID NO: 337095 - DNA, 22 bp, Artificial Sequence
  Description of Artificial Sequence: Synthetic oligonucleotide
cgtgggcctgctgctcctcctc

SEQ ID NO: 337096 - DNA, 24 bp, Artificial Sequence
  Description of Artificial Sequence: Synthetic oligonucleotide
gtgggcctgctgctcctcctcgtt

SEQ ID NO: 337097 - DNA, 24 bp, Artificial Sequence
  Description of Artificial Sequence: Synthetic oligonucleotide
tgggcctgctgctcctcctcgttg

SEQ ID NO: 337098 - DNA, 23 bp, Artificial Sequence
  Description of Artificial Sequence: Synthetic oligonucleotide
gggcctgctgctcctcctcgttg

SEQ ID NO: 337099 - DNA, 24 bp, Artificial Sequence
  Description of Artificial Sequence: Synthetic oligonucleotide
ggcctgctgctcctcctcgttgct

SEQ ID NO: 337100 - DNA, 25 bp, Artificial Sequence
  Description of Artificial Sequence: Synthetic oligonucleotide
gcctgctgctcctcctcgttgctga

SEQ ID NO: 337101 - DNA, 27 bp, Artificial Sequence
  Description of Artificial Sequence: Synthetic oligonucleotide
cctgctgctcctcctcgttgctgactt

SEQ ID NO: 337102 - DNA, 27 bp, Artificial Sequence
  Description of Artificial Sequence: Synthetic oligonucleotide
ctgctgctcctcctcgttgctgacttc

SEQ ID NO: 337103 - DNA, 29 bp, Artificial Sequence
  Description of Artificial Sequence: Synthetic oligonucleotide
tgctgctcctcctcgttgctgacttctac

SEQ ID NO: 337104 - DNA, 28 bp, Artificial Sequence
  Description of Artificial Sequence: Synthetic oligonucleotide
gctgctcctcctcgttgctgacttctac

SEQ ID NO: 337105 - DNA, 29 bp, Artificial Sequence
  Description of Artificial Sequence: Synthetic oligonucleotide
ctgctcctcctcgttgctgacttctactg

SEQ ID NO: 337106 - DNA, 29 bp, Artificial Sequence
  Description of Artificial Sequence: Synthetic oligonucleotide
tgctcctcctcgttgctgacttctactgg

SEQ ID NO: 337107 - DNA, 28 bp, Artificial Sequence
  Description of Artificial Sequence: Synthetic oligonucleotide
gctcctcctcgttgctgacttctactgg

SEQ ID NO: 337108 - DNA, 28 bp, Artificial Sequence
  Description of Artificial Sequence: Synthetic oligonucleotide
ctcctcctcgttgctgacttctactggg

SEQ ID NO: 337109 - DNA, 29 bp, Artificial Sequence
  Description of Artificial Sequence: Synthetic oligonucleotide
tcctcctcgttgctgacttctactgggtg

SEQ ID NO: 337110 - DNA, 28 bp, Artificial Sequence
  Description of Artificial Sequence: Synthetic oligonucleotide
cctcctcgttgctgacttctactgggtg

SEQ ID NO: 337111 - DNA, 29 bp, Artificial Sequence
  Description of Artificial Sequence: Synthetic oligonucleotide
ctcctcgttgctgacttctactgggtgag

SEQ ID NO: 337112 - DNA, 30 bp, Artificial Sequence
  Description of Artificial Sequence: Synthetic oligonucleotide
tcctcgttgctgacttctactgggtgagac

SEQ ID NO: 337113 - DNA, 29 bp, Artificial Sequence
  Description of Artificial Sequence: Synthetic oligonucleotide
cctcgttgctgacttctactgggtgagac

SEQ ID NO: 337114 - DNA, 29 bp, Artificial Sequence
  Description of Artificial Sequence: Synthetic oligonucleotide
ctcgttgctgacttctactgggtgagacg

SEQ ID NO: 337115 - DNA, 29 bp, Artificial Sequence
  Description of Artificial Sequence: Synthetic oligonucleotide
tcgttgctgacttctactgggtgagacgc

SEQ ID NO: 337116 - DNA, 28 bp, Artificial Sequence
  Description of Artificial Sequence: Synthetic oligonucleotide
cgttgctgacttctactgggtgagacgc

SEQ ID NO: 337117 - DNA, 31 bp, Artificial Sequence
  Description of Artificial Sequence: Synthetic oligonucleotide
gttgctgacttctactgggtgagacgctaag

SEQ ID NO: 337118 - DNA, 31 bp, Artificial Sequence
  Description of Artificial Sequence: Synthetic oligonucleotide
ttgctgacttctactgggtgagacgctaagg

SEQ ID NO: 337119 - DNA, 30 bp, Artificial Sequence
  Description of Artificial Sequence: Synthetic oligonucleotide
tgctgacttctactgggtgagacgctaagg

SEQ ID NO: 337120 - DNA, 29 bp, Artificial Sequence
  Description of Artificial Sequence: Synthetic oligonucleotide
gctgacttctactgggtgagacgctaagg

SEQ ID NO: 337121 - DNA, 29 bp, Artificial Sequence
  Description of Artificial Sequence: Synthetic oligonucleotide
ctgacttctactgggtgagacgctaaggg

SEQ ID NO: 337122 - DNA, 29 bp, Artificial Sequence
  Description of Artificial Sequence: Synthetic oligonucleotide
tgacttctactgggtgagacgctaagggg

SEQ ID NO: 337123 - DNA, 28 bp, Artificial Sequence
  Description of Artificial Sequence: Synthetic oligonucleotide
gacttctactgggtgagacgctaagggg

SEQ ID NO: 337124 - DNA, 28 bp, Artificial Sequence
  Description of Artificial Sequence: Synthetic oligonucleotide
acttctactgggtgagacgctaaggggg

SEQ ID NO: 337125 - DNA, 27 bp, Artificial Sequence
  Description of Artificial Sequence: Synthetic oligonucleotide
cttctactgggtgagacgctaaggggg

SEQ ID NO: 337126 - DNA, 27 bp, Artificial Sequence
  Description of Artificial Sequence: Synthetic oligonucleotide
ttctactgggtgagacgctaagggggc

SEQ ID NO: 337127 - DNA, 26 bp, Artificial Sequence
  Description of Artificial Sequence: Synthetic oligonucleotide
tctactgggtgagacgctaagggggc

SEQ ID NO: 337128 - DNA, 25 bp, Artificial Sequence
  Description of Artificial Sequence: Synthetic oligonucleotide
ctactgggtgagacgctaagggggc

SEQ ID NO: 337129 - DNA, 25 bp, Artificial Sequence
  Description of Artificial Sequence: Synthetic oligonucleotide
tactgggtgagacgctaagggggcc

SEQ ID NO: 337130 - DNA, 24 bp, Artificial Sequence
  Description of Artificial Sequence: Synthetic oligonucleotide
actgggtgagacgctaagggggcc

SEQ ID NO: 337131 - DNA, 23 bp, Artificial Sequence
  Description of Artificial Sequence: Synthetic oligonucleotide
ctgggtgagacgctaagggggcc

SEQ ID NO: 337132 - DNA, 23 bp, Artificial Sequence
  Description of Artificial Sequence: Synthetic oligonucleotide
tgggtgagacgctaagggggccg

SEQ ID NO: 337133 - DNA, 22 bp, Artificial Sequence
  Description of Artificial Sequence: Synthetic oligonucleotide
gggtgagacgctaagggggccg

SEQ ID NO: 337134 - DNA, 23 bp, Artificial Sequence
  Description of Artificial Sequence: Synthetic oligonucleotide
ggtgagacgctaagggggccgct

SEQ ID NO: 337135 - DNA, 23 bp, Artificial Sequence
  Description of Artificial Sequence: Synthetic oligonucleotide
gtgagacgctaagggggccgctg

SEQ ID NO: 337136 - DNA, 24 bp, Artificial Sequence
  Description of Artificial Sequence: Synthetic oligonucleotide
tgagacgctaagggggccgctgct

SEQ ID NO: 337137 - DNA, 23 bp, Artificial Sequence
  Description of Artificial Sequence: Synthetic oligonucleotide
gagacgctaagggggccgctgct

SEQ ID NO: 337138 - DNA, 23 bp, Artificial Sequence
  Description of Artificial Sequence: Synthetic oligonucleotide
agacgctaagggggccgctgctg

SEQ ID NO: 337139 - DNA, 22 bp, Artificial Sequence
  Description of Artificial Sequence: Synthetic oligonucleotide
gacgctaagggggccgctgctg

SEQ ID NO: 337140 - DNA, 22 bp, Artificial Sequence
  Description of Artificial Sequence: Synthetic oligonucleotide
acgctaagggggccgctgctgc

SEQ ID NO: 337141 - DNA, 21 bp, Artificial Sequence
  Description of Artificial Sequence: Synthetic oligonucleotide
cgctaagggggccgctgctgc

SEQ ID NO: 337142 - DNA, 21 bp, Artificial Sequence
  Description of Artificial Sequence: Synthetic oligonucleotide
gctaagggggccgctgctgcc

SEQ ID NO: 337143 - DNA, 21 bp, Artificial Sequence
  Description of Artificial Sequence: Synthetic oligonucleotide
ctaagggggccgctgctgccg

SEQ ID NO: 337144 - DNA, 21 bp, Artificial Sequence
  Description of Artificial Sequence: Synthetic oligonucleotide
taagggggccgctgctgccgg

SEQ ID NO: 337145 - DNA, 20 bp, Artificial Sequence
  Description of Artificial Sequence: Synthetic oligonucleotide
aagggggccgctgctgccgg

SEQ ID NO: 337146 - DNA, 20 bp, Artificial Sequence
  Description of Artificial Sequence: Synthetic oligonucleotide
agggggccgctgctgccggt

SEQ ID NO: 337147 - DNA, 20 bp, Artificial Sequence
  Description of Artificial Sequence: Synthetic oligonucleotide
gggggccgctgctgccggtt

SEQ ID NO: 337148 - DNA, 20 bp, Artificial Sequence
  Description of Artificial Sequence: Synthetic oligonucleotide
ggggccgctgctgccggcat

SEQ ID NO: 337149 - DNA, 20 bp, Artificial Sequence
  Description of Artificial Sequence: Synthetic oligonucleotide
gggccgctgctgccggcagt

SEQ ID NO: 337150 - DNA, 20 bp, Artificial Sequence
  Description of Artificial Sequence: Synthetic oligonucleotide
ggccgctgctgccggcagct

SEQ ID NO: 337151 - DNA, 20 bp, Artificial Sequence
  Description of Artificial Sequence: Synthetic oligonucleotide
gccgctgctgccggcagcgt

SEQ ID NO: 337152 - DNA, 20 bp, Artificial Sequence
  Description of Artificial Sequence: Synthetic oligonucleotide
ccgctgctgccggcagcggt

SEQ ID NO: 337153 - DNA, 20 bp, Artificial Sequence
  Description of Artificial Sequence: Synthetic oligonucleotide
cgctgctgccggcagcggct

SEQ ID NO: 337154 - DNA, 20 bp, Artificial Sequence
  Description of Artificial Sequence: Synthetic oligonucleotide
gctgctgccggcagcggcgt

SEQ ID NO: 337155 - DNA, 20 bp, Artificial Sequence
  Description of Artificial Sequence: Synthetic oligonucleotide
ctgctgccggcagcggcggt

SEQ ID NO: 337156 - DNA, 20 bp, Artificial Sequence
  Description of Artificial Sequence: Synthetic oligonucleotide
tgctgccggcagcggcggca

SEQ ID NO: 337157 - DNA, 20 bp, Artificial Sequence
  Description of Artificial Sequence: Synthetic oligonucleotide
gctgccggcagcggcggcat

SEQ ID NO: 337158 - DNA, 21 bp, Artificial Sequence
  Description of Artificial Sequence: Synthetic oligonucleotide
ctgccggcagcggcggcagaa

SEQ ID NO: 337159 - DNA, 21 bp, Artificial Sequence
  Description of Artificial Sequence: Synthetic oligonucleotide
tgccggcagcggcggcagaag

SEQ ID NO: 337160 - DNA, 20 bp, Artificial Sequence
  Description of Artificial Sequence: Synthetic oligonucleotide
gccggcagcggcggcagaag

SEQ ID NO: 337161 - DNA, 20 bp, Artificial Sequence
  Description of Artificial Sequence: Synthetic oligonucleotide
ccggcagcggcggcagaagg

SEQ ID NO: 337162 - DNA, 20 bp, Artificial Sequence
  Description of Artificial Sequence: Synthetic oligonucleotide
cggcagcggcggcagaaggg

SEQ ID NO: 337163 - DNA, 20 bp, Artificial Sequence
  Description of Artificial Sequence: Synthetic oligonucleotide
ggcagcggcggcagaagggg

SEQ ID NO: 337164 - DNA, 20 bp, Artificial Sequence
  Description of Artificial Sequence: Synthetic oligonucleotide
gcagcggcggcagaaggggg

SEQ ID NO: 337165 - DNA, 21 bp, Artificial Sequence
  Description of Artificial Sequence: Synthetic oligonucleotide
cagcggcggcagaaggggggt

SEQ ID NO: 337166 - DNA, 21 bp, Artificial Sequence
  Description of Artificial Sequence: Synthetic oligonucleotide
agcggcggcagaaggggggtc

SEQ ID NO: 337167 - DNA, 20 bp, Artificial Sequence
  Description of Artificial Sequence: Synthetic oligonucleotide
gcggcggcagaaggggggtc

SEQ ID NO: 337168 - DNA, 20 bp, Artificial Sequence
  Description of Artificial Sequence: Synthetic oligonucleotide
cggcggcagaaggggggtcc

SEQ ID NO: 337169 - DNA, 20 bp, Artificial Sequence
  Description of Artificial Sequence: Synthetic oligonucleotide
ggcggcagaaggggggtccg

SEQ ID NO: 337170 - DNA, 20 bp, Artificial Sequence
  Description of Artificial Sequence: Synthetic oligonucleotide
gcggcagaaggggggtccgc

SEQ ID NO: 337171 - DNA, 20 bp, Artificial Sequence
  Description of Artificial Sequence: Synthetic oligonucleotide
cggcagaaggggggtccgcc

SEQ ID NO: 337172 - DNA, 20 bp, Artificial Sequence
  Description of Artificial Sequence: Synthetic oligonucleotide
ggcagaaggggggtccgccg

SEQ ID NO: 337173 - DNA, 20 bp, Artificial Sequence
  Description of Artificial Sequence: Synthetic oligonucleotide
gcagaaggggggtccgccgc

SEQ ID NO: 337174 - DNA, 21 bp, Artificial Sequence
  Description of Artificial Sequence: Synthetic oligonucleotide
cagaaggggggtccgccgcct

SEQ ID NO: 337175 - DNA, 21 bp, Artificial Sequence
  Description of Artificial Sequence: Synthetic oligonucleotide
agaaggggggtccgccgcctg

SEQ ID NO: 337176 - DNA, 20 bp, Artificial Sequence
  Description of Artificial Sequence: Synthetic oligonucleotide
gaaggggggtccgccgcctg

SEQ ID NO: 337177 - DNA, 20 bp, Artificial Sequence
  Description of Artificial Sequence: Synthetic oligonucleotide
aaggggggtccgccgcctgg

SEQ ID NO: 337178 - DNA, 20 bp, Artificial Sequence
  Description of Artificial Sequence: Synthetic oligonucleotide
aggggggtccgccgcctggt

SEQ ID NO: 337179 - DNA, 20 bp, Artificial Sequence
  Description of Artificial Sequence: Synthetic oligonucleotide
ggggggtccgccgcctggtt

SEQ ID NO: 337180 - DNA, 20 bp, Artificial Sequence
  Description of Artificial Sequence: Synthetic oligonucleotide
gggggtccgccgcctgggtt

SEQ ID NO: 337181 - DNA, 20 bp, Artificial Sequence
  Description of Artificial Sequence: Synthetic oligonucleotide
ggggtccgccgcctggggat

SEQ ID NO: 337182 - DNA, 20 bp, Artificial Sequence
  Description of Artificial Sequence: Synthetic oligonucleotide
gggtccgccgcctggggagt

SEQ ID NO: 337183 - DNA, 20 bp, Artificial Sequence
  Description of Artificial Sequence: Synthetic oligonucleotide
ggtccgccgcctggggagct

SEQ ID NO: 337184 - DNA, 20 bp, Artificial Sequence
  Description of Artificial Sequence: Synthetic oligonucleotide
gtccgccgcctggggagcca

SEQ ID NO: 337185 - DNA, 20 bp, Artificial Sequence
  Description of Artificial Sequence: Synthetic oligonucleotide
tccgccgcctggggagccac

SEQ ID NO: 337186 - DNA, 20 bp, Artificial Sequence
  Description of Artificial Sequence: Synthetic oligonucleotide
ccgccgcctggggagccact

SEQ ID NO: 337187 - DNA, 20 bp, Artificial Sequence
  Description of Artificial Sequence: Synthetic oligonucleotide
cgccgcctggggagccacgt

SEQ ID NO: 337188 - DNA, 20 bp, Artificial Sequence
  Description of Artificial Sequence: Synthetic oligonucleotide
gccgcctggggagccacggt

SEQ ID NO: 337189 - DNA, 20 bp, Artificial Sequence
  Description of Artificial Sequence: Synthetic oligonucleotide
ccgcctggggagccacggct

SEQ ID NO: 337190 - DNA, 21 bp, Artificial Sequence
  Description of Artificial Sequence: Synthetic oligonucleotide
cgcctggggagccacggctga

SEQ ID NO: 337191 - DNA, 21 bp, Artificial Sequence
  Description of Artificial Sequence: Synthetic oligonucleotide
gcctggggagccacggctgag

SEQ ID NO: 337192 - DNA, 21 bp, Artificial Sequence
  Description of Artificial Sequence: Synthetic oligonucleotide
cctggggagccacggctgagc

SEQ ID NO: 337193 - DNA, 22 bp, Artificial Sequence
  Description of Artificial Sequence: Synthetic oligonucleotide
ctggggagccacggctgagcct

SEQ ID NO: 337194 - DNA, 23 bp, Artificial Sequence
  Description of Artificial Sequence: Synthetic oligonucleotide
tggggagccacggctgagcctct

SEQ ID NO: 337195 - DNA, 22 bp, Artificial Sequence
  Description of Artificial Sequence: Synthetic oligonucleotide
ggggagccacggctgagcctct

SEQ ID NO: 337196 - DNA, 22 bp, Artificial Sequence
  Description of Artificial Sequence: Synthetic oligonucleotide
gggagccacggctgagcctctc

SEQ ID NO: 337197 - DNA, 22 bp, Artificial Sequence
  Description of Artificial Sequence: Synthetic oligonucleotide
ggagccacggctgagcctctcg

SEQ ID NO: 337198 - DNA, 22 bp, Artificial Sequence
  Description of Artificial Sequence: Synthetic oligonucleotide
gagccacggctgagcctctcgg

SEQ ID NO: 337199 - DNA, 22 bp, Artificial Sequence
  Description of Artificial Sequence: Synthetic oligonucleotide
agccacggctgagcctctcggg

SEQ ID NO: 337200 - DNA, 21 bp, Artificial Sequence
  Description of Artificial Sequence: Synthetic oligonucleotide
gccacggctgagcctctcggg

SEQ ID NO: 337201 - DNA, 22 bp, Artificial Sequence
  Description of Artificial Sequence: Synthetic oligonucleotide
ccacggctgagcctctcggggt

SEQ ID NO: 337202 - DNA, 22 bp, Artificial Sequence
  Description of Artificial Sequence: Synthetic oligonucleotide
cacggctgagcctctcggggtc

SEQ ID NO: 337203 - DNA, 22 bp, Artificial Sequence
  Description of Artificial Sequence: Synthetic oligonucleotide
acggctgagcctctcggggtcc

SEQ ID NO: 337204 - DNA, 21 bp, Artificial Sequence
  Description of Artificial Sequence: Synthetic oligonucleotide
cggctgagcctctcggggtcc

SEQ ID NO: 337205 - DNA, 22 bp, Artificial Sequence
  Description of Artificial Sequence: Synthetic oligonucleotide
ggctgagcctctcggggtccga

SEQ ID NO: 337206 - DNA, 22 bp, Artificial Sequence
  Description of Artificial Sequence: Synthetic oligonucleotide
gctgagcctctcggggtccgag

SEQ ID NO: 337207 - DNA, 24 bp, Artificial Sequence
  Description of Artificial Sequence: Synthetic oligonucleotide
ctgagcctctcggggtccgagcaa

SEQ ID NO: 337208 - DNA, 24 bp, Artificial Sequence
  Description of Artificial Sequence: Synthetic oligonucleotide
tgagcctctcggggtccgagcaac

SEQ ID NO: 337209 - DNA, 23 bp, Artificial Sequence
  Description of Artificial Sequence: Synthetic oligonucleotide
gagcctctcggggtccgagcaac

SEQ ID NO: 337210 - DNA, 24 bp, Artificial Sequence
  Description of Artificial Sequence: Synthetic oligonucleotide
agcctctcggggtccgagcaacca

SEQ ID NO: 337211 - DNA, 23 bp, Artificial Sequence
  Description of Artificial Sequence: Synthetic oligonucleotide
gcctctcggggtccgagcaacca

SEQ ID NO: 337212 - DNA, 24 bp, Artificial Sequence
  Description of Artificial Sequence: Synthetic oligonucleotide
cctctcggggtccgagcaaccaca

SEQ ID NO: 337213 - DNA, 24 bp, Artificial Sequence
  Description of Artificial Sequence: Synthetic oligonucleotide
ctctcggggtccgagcaaccacag

SEQ ID NO: 337214 - DNA, 25 bp, Artificial Sequence
  Description of Artificial Sequence: Synthetic oligonucleotide
tctcggggtccgagcaaccacagca

SEQ ID NO: 337215 - DNA, 24 bp, Artificial Sequence
  Description of Artificial Sequence: Synthetic oligonucleotide
ctcggggtccgagcaaccacagca

SEQ ID NO: 337216 - DNA, 25 bp, Artificial Sequence
  Description of Artificial Sequence: Synthetic oligonucleotide
tcggggtccgagcaaccacagcaga
